US010982187B2

(12) United States Patent
Funk et al.

(10) Patent No.: US 10,982,187 B2
(45) Date of Patent: Apr. 20, 2021

(54) ***BOS TAURUS* VARIETY 'HO840003150607238' AND METHODS OF USE THEREOF**

(71) Applicant: ABS Global, inc., DeForest, WI (US)

(72) Inventors: Devan Charles Funk, DeForest, WI (US); Katrina Dattilo, Waunakee, WI (US)

(73) Assignee: Genus PLC, Basingstoke (GB)

( * ) Notice: Subject to any disclaimer, the term of this patent is extended or adjusted under 35 U.S.C. 154(b) by 0 days.

(21) Appl. No.: 16/365,306

(22) Filed: Mar. 26, 2019

(65) Prior Publication Data

US 2020/0305399 A1 Oct. 1, 2020

(51) Int. Cl.
| | |
|---|---|
| *C12N 5/0735* | (2010.01) |
| *A01K 67/027* | (2006.01) |
| *C12N 5/076* | (2010.01) |
| *C12N 5/075* | (2010.01) |
| *C12N 15/877* | (2010.01) |

(52) U.S. Cl.
CPC .......... *C12N 5/0611* (2013.01); *A01K 67/027* (2013.01); *C12N 5/061* (2013.01); *C12N 5/0609* (2013.01); *C12N 15/8771* (2013.01); *A01K 2227/101* (2013.01)

(58) Field of Classification Search
CPC .... C12N 5/061; C12N 5/0611; C12N 5/0609; C12N 5/06; A01K 67/027; A01K 2227/101
See application file for complete search history.

(56) References Cited

U.S. PATENT DOCUMENTS

| | | | |
|---|---|---|---|
| 6,011,197 | A | 1/2000 | Strelchenko et al. |
| 9,868,962 | B2 | 1/2018 | May et al. |
| 2003/0157475 | A1 | 8/2003 | Schenk |

FOREIGN PATENT DOCUMENTS

| | | |
|---|---|---|
| WO | WO 2015/148761 | 10/2015 |
| WO | WO 2017/132239 | 8/2017 |

OTHER PUBLICATIONS

Printout from plant variety | InforMEA. https://www.informea.org/en/terms/plant-variety. Printed Jan. 8, 2020. pp. 3 of (Year: 2020).*
Hinch et al. Science 363, 1300 (2019) pp. 1-10 (Year: 2019).*
Bovine HapMap Consortium data set (Bovine HapMap Consortium, "Genome-wide survey of SNP variation uncovers the genetic structure of cattle breeds," Science 324(5926):528-32 (2009).
Burkard et al., "Precision engineering for PRRSV resistance in pigs: Macrophages from genome edited pigs lacking CD 163 SRCR5 domain are fully resistant to both PRRSV genotypes while maintaining biological function," PLOS Pathogens 13(2) (2017).
Cole et al., "Haplotype tests for recessive disorders that affect fertility and other traits," USDA AIP Research Report Genomic3 (Sep. 2013) updated Dec. 1, 2018, downloaded (see comment below) at aipl(dot)arsusda(dot)gov/reference/recessive_haplotypes_ARR-G3.html.
Gay et al., "Development of a Lifetime Merit-based selection index for US dairy grazing systems," J. Dairy Sci. 97:4568-4578 (2014).
Gholap et al., "Genetic Diseases in Cattle: A Review," Research Journal of Animal, Veterinary and Fishery Sciences 2(2):24-33 (2014).
Gordon et al., "Genetic transformation of mouse embryos by microinjection of purified DNA," Proc. Natl. Acad. Sci. USA 77:7380-7384 (1980).
Hammer et al., "Production of transgenic rabbits, sheep and pigs by microinjection," Nature 315: 680-683 (1985).
Illumina's Technical Note "'TOP/BOT' Strand and 'A/B' Allele", available on the internet at www(dot)illumina(dot)com/documents/products/technotes/technote_topbot.pdf (downloaded Oct. 23, 2018).
Jolly et al., "Genetic Diseases of Cattle," Chapter 21 759-777 (2010).
MacNeil et al., "Genetic relationships between feral cattle from Chirikof Island, Alaska and other breeds," Animal Genetics 38:193-197 (2007).
McClure et al., "SNP Data Quality Control in a National Beef and Dairy Cattle System and Highly Accurate SNP Based Parentage Verification and Identification," Frontiers in Genetics 9(84):1-14 (2018).
Niemann, "Transgenic pigs expressing plant genes," Proc Natl Acad Sci U S A 101:7211-7212 (2004).
Park, et al., "Role of stem cells in large animal genetic engineering in the TALENs-CRISPR era," Reprod Fertil Dev 26:65-73 (2014).
Park et al., "Genome sequencing of the extinct Eurasian wild aurochs, Bos primigenius, illuminates the phylogeography and evolution of cattle," Genome Biology 16:234 (2015).
Park et al., "Generation of germline ablated male pigs by CRISPR/Cas9 editing of the NANOS2 gene," Scientific Reports (2017).
Ross et al., "Bovine Somatic Cell Nuclear Transfer," Methods Mol Biol. 636. 155-77 (2010).
Schefers et al., "Genomic selection in dairy cattle: Integration of DNA testing into breeding programs," Animal Frontiers 2(1):1-9 (2012).
The Holstein Association USA (HAU) downloaded from www(dot)holsteinusa(dot)com/genetic_evaluations/ss_tpi_formula.htmlMar. 28, 2019.

(Continued)

Primary Examiner — Marcia S Noble
(74) Attorney, Agent, or Firm — Elizabeth A. Epstein; Michael Stimson

(57) ABSTRACT

The disclosure relates to Bovine germplasm of Bos taurus variety HO840M003150607238. Included in the present disclosure are cells comprising the genome of Bovine variety HO840M003150607238 characterized by the presence of homozygous loci and spermatozoa obtained from said cells. Also provided by the present disclosure are tissue cultures of cells, animals obtained from said cells, and parts thereof, including F1 spermatozoa. The disclosure further provides for methods of breeding, selecting, and using the germplasm to improve existing commercial cattle herds generated from in vitro fertilization methods and progeny cattle obtained from in vitro fertilization and implantation and artificial insemination methods.

22 Claims, No Drawings

Specification includes a Sequence Listing.

(56) References Cited

OTHER PUBLICATIONS

VanRaden et al., "Genetic Evaluation of Length of Productive Life Including Predicted Longevity of Live Cows," *Journal of Dairy Science* 76:2758-2764 (1993).
VanRaden et al., "Productive Life Evaluations: Calculation, Accuracy, and Economic Value," *Journal of Dairy Science* 78:631-638 (1995).
VanRaden et al., "Methods used to compute multi-trait productive life," USDA AIPL Research Report PLC (Nov. 2003) (2003).
VanRaden et al., "Net merit as a measure of lifetime profit: 2018 revision," USDA AIP Research Report NM$7 (May 2018) (2018).
Weigel et al., "Use of Linear Type and Production Data to Supplement Early Predicted Transmitting Abilities for Productive Life," *Journal of Dairy Science* 81:2040-2044 (1998).
Worley, Bovine Genome Sequencing and Analysis Consortium. "The genome sequence of taurine cattle: a window to ruminant biology and evolution," *Science* 324(5926):522-8 (2009).
Whitworth et al., "Use of the CRISPR/Cas9 System to Produce Genetically Engineered Pigs from In Vitro-Derived Oocytes and Embryos," *Biology of Reproduction* 91(3):78 (2014).
Allen A.R., et al., 2010, Compilation of a panel of informative single nucleotide polymorphisms for bovine identification in the Northern Irish cattle population. BMC Genetics 2010, 11:5.

\* cited by examiner

BOS TAURUS VARIETY 'HO840003150607238' AND METHODS OF USE THEREOF

INCORPORATION OF SEQUENCE LISTING

The Sequence Listing is hereby incorporated by reference in its entirety, including the file named P34675_ST25.txt, which is 47,645,133 bytes in size and was created on Mar. 26, 2019, which is likewise herein incorporated by reference in its entirety.

FIELD OF THE INVENTION

The present disclosure relates to the field of Bos taurus breeding. In particular, the present disclosure related to Bos taurus variety HO840003150607238 having high multi-trait selection indices and high trait transmissibility.

BACKGROUND OF THE INVENTION

There are numerous steps in the development of any new, desirable Bos taurus germplasm. Bos taurus breeding begins with the analysis and definition of problems and weaknesses of the current germplasm, the establishment of program goals, and the definition of specific breeding objectives. The next step is selection of germplasm that possess the traits to meet the program goals. A goal is to combine in a single variety an improved combination of desirable traits from the parental germplasm. See Schefers et al., "Genomic selection in dairy cattle: Integration of DNA testing into breeding programs" Animal Frontiers 2(1):1-9 (2012).

During breeding, cattle breeders have a variety of sources when making breeding decisions. In addition to genomic data, a number of agencies and organizations collect and release analysis of population data and indexes. Every three months, the Animal Improvement Programs Laboratory (AIPL) of the United States Department of Agriculture releases the newest USDA-DHIA (Dairy Herd Improvement Association) genetic evaluations for dairy bulls and cows. The AIPL calculates genetic evaluations for type for various breeds, and many breed associations provide their own indexes or other strategies for evaluating certain breed-relevant traits. U.S. dairy genetic evaluations are computed every four months by the Council on Dairy Cattle Breeding (CDCB) and Holstein Association USA (HAU). Both CDCB and HAU traits provide the breeder within important comparative data to evaluate the complex genetic and phenotypic traits to develop improved and desirable Bos taurus germplasm. For Holstein and Jersey sires, for example, evaluations are genomically enhanced and represent a blending of genomic data, pedigree information, and results from progeny. These genetic evaluations provide the breeder important information for the selection of desirable germplasm and the development of new and valuable inseminates.

There is a continuous need to develop improved Bos taurus germplasm for use in improving production herds as well as for the continued improvement of elite animals. The present germplasm is the result of crosses between superior elite females ranked by performance as among the top 1% of the population of domesticated dams and elite bulls that are among the top 5% of the domestic population.

SUMMARY OF THE INVENTION

The present disclosure comprises, in one form thereof, a plurality of Bos taurus cells each cell comprising a genome having at least 90% of the nucleic acid sequences selected from the group consisting of SEQ ID NOs:1 to 29048.

The present disclosure provides for, and includes, a plurality of Bos taurus gamete cells comprising at least 90% of the loci comprising the nucleic acid sequences selected from the group consisting of SEQ ID NOs: 1 to 29048.

In an aspect, the present disclosure includes, and provides for, an F1 Bos taurus animal, or part thereof, said F1 Bos taurus animal comprising a genome comprising at least 90% of the loci comprising the nucleic acid sequences selected from the group consisting of SEQ ID NOs: 1 to 29048.

In another aspect, the present disclosure provides for, and includes, an F1 Bos taurus animal, or part thereof, comprising a genome comprising at least 90% of the loci comprising the nucleic acid sequences selected from the group consisting of SEQ ID NOs: 1 to 29048.

In a further aspect, the present disclosure provides for, and includes a Bos taurus animal, or part thereof, comprising one or more cells having at least 25% of the loci comprising nucleic acid sequences selected from the group consisting of SEQ ID NOs:1 to 29048.

An even further aspect of the present disclosure is a plurality of Bos taurus cells, each comprising a diploid or haploid genome each diploid genome comprising homozygous loci comprising at least 90% of the nucleic acid sequences selected from the group consisting of SEQ ID NOs: 1 to 29048; and each haploid genome comprising at least 90% of the loci comprising the nucleic acid sequences selected from the group consisting of SEQ ID NOs: 1 to 29048.

DETAILED DESCRIPTION

A goal of a Bos taurus breeding program is to combine in a single Bos taurus variety an improved combination of desirable traits from the parental germplasm that provides for desirable progeny when used in artificial insemination and in vitro fertilization programs. Improved Bos taurus inseminate varieties are useful for various artificial breeding techniques, including artificial insemination ("AI") and embryo transfer ("ET"). Improved Bos taurus germplasm, varieties, and inseminates prepared therefrom, are desirable.

The present disclosure provides for, and includes, an improved elite SM germplasm obtained from a multigenerational breeding program. The germplasm is unique and readily distinguishable from germplasm present in non-selected cattle. Indeed, in the absence of continued selection, the germplasm reverts to heterogeneity and diversity. As provided herein, the germplasm of the present disclosure is identifiable using standard methods and the germplasm can be readily identified in progeny generations. Indeed, as few as 800 SNP markers are sufficient to identify parentage with greater than 99% accuracy. See McClure et al., "SNP Data Quality Control in a National Beef and Dairy Cattle System and Highly Accurate SNP Based Parentage Verification and Identification," Frontiers in Genetics 9(84):1-14 (2018). As provided here, the tens of thousands of sequences provide for tracking and selecting animals through multiple generations. Breeding with the germplasm provided herein, combined with the selection of suitable mates will maintain the desirable germplasm in subsequent generations. Moreover, genetic testing allows for the removal of progeny having germplasm that lacks that set of desired loci for the improvement of cattle herds.

The present disclosure provides for, and includes, cells, animals, and progeny of Bos taurus variety HO840003150607238 ("Animal") comprising an improved germplasm characterized by SEQ ID NOs:1 to 41648 and homozygous loci comprising the nucleic acid sequences selected from the group consisting of SEQ ID NOs:1 to 29048, and listed in Table 1. Animal differs from the reference genome at 11832 homozygous loci, or about 28% of the total loci.

TABLE 1

Genotype of *Bos taurus* animal HO840003150607238 ("Animal")

| Homozygous | SEQ ID Range SEQ ID NOs: 1 to 29048 | | No. of Alternate Alleles |
|---|---|---|---|
| | Reference Allele | Alternate Allele | |
| Chromosome 1 | 1-1110 | 17188-17963 | 775 |
| Chr. 2 | 1111-01954 | 17964-18580 | 616 |
| Chr. 3 | 1955-2883 | 18581-19199 | 618 |
| Chr. 4 | 2884-3684 | 19200-19689 | 489 |
| Chr. 5 | 3685-4439 | 19690-20169 | 479 |
| Chr. 6 | 4440-5272 | 20170-20823 | 653 |
| Chr. 7 | 5273-5962 | 20824-21347 | 523 |
| Chr. 8 | 5963-6797 | 21348-21843 | 495 |
| Chr. 9 | 6798-7455 | 21844-22309 | 465 |
| Chr. 10 | 7456-8125 | 22310-22775 | 465 |
| Chr. 11 | 8126-8809 | 22776-23290 | 514 |
| Chr. 12 | 8810-9358 | 23291-23663 | 372 |
| Chr. 13 | 9359-9951 | 23664-24058 | 394 |
| Chr. 14 | 9952-10592 | 24059-24647 | 588 |
| Chr. 15 | 10593-11148 | 24648-24987 | 339 |
| Chr. 16 | 11149-11703 | 24988-25348 | 360 |
| Chr. 17 | 11704-12314 | 25349-25729 | 380 |
| Chr. 18 | 12315-12797 | 25730-26027 | 297 |
| Chr. 19 | 12798-13309 | 26028-26360 | 332 |
| Chr. 20 | 13310-13823 | 26361-26736 | 375 |
| Chr. 21 | 13824-14279 | 26737-27082 | 345 |
| Chr. 22 | 14280-14702 | 27083-27360 | 277 |
| Chr. 23 | 14703-15016 | 27361-27615 | 254 |
| Chr. 24 | 15017-15414 | 27616-27882 | 266 |
| Chr. 25 | 15415-15770 | 27883-28107 | 224 |
| Chr. 26 | 15771-16151 | 28108-28362 | 254 |
| Chr. 27 | 16152-16444 | 28363-28574 | 211 |
| Chr. 28 | 16445-16812 | 28575-28812 | 237 |
| Chr. 29 | 16813-17187 | 28813-29048 | 235 |
| | | No. Alternate alleles | 11832 |

| Heterozygous | SEQ ID Range |
|---|---|
| Chromosome 1 | 29049-29832 |
| Chr. 2 | 29833-30576 |
| Chr. 3 | 30577-31069 |
| Chr. 4 | 31070-31789 |
| Chr. 5 | 31790-32326 |
| Chr. 6 | 32327-32899 |
| Chr. 7 | 32900-33505 |
| Chr. 8 | 33506-34086 |
| Chr. 9 | 34087-34609 |
| Chr. 10 | 34610-35231 |
| Chr. 11 | 35232-35844 |
| Chr. 12 | 35845-36305 |
| Chr. 13 | 36306-36749 |
| Chr. 14 | 36750-36970 |
| Chr. 15 | 36971-37461 |
| Chr. 16 | 37462-37865 |
| Chr. 17 | 37866-38181 |
| Chr. 18 | 38182-38494 |
| Chr. 19 | 38495-38763 |
| Chr. 20 | 38764-39143 |
| Chr. 21 | 39144-39454 |
| Chr. 22 | 39455-39787 |
| Chr. 23 | 39788-40099 |
| Chr. 24 | 40100-40457 |
| Chr. 25 | 40458-40689 |
| Chr. 26 | 40690-40949 |
| Chr. 27 | 40950-41236 |
| Chr. 28 | 41237-41401 |
| Chr. 29 | 41402-41648 |

The present disclosure provides for, and includes, a diploid Bos taurus cell or a plurality of diploid Bos taurus cells comprising improved germplasm characterized by a genome having homozygous loci comprising 90% to 100% of the nucleic acid sequences selected from the group consisting of SEQ ID NOs:1 to 29048.

Animal is the progeny of a cross between Sire HO840003135669665 ("Sire") and Dam HO840003128557405 ("Dam"). The genotype of Sire is represented by the SEQ ID NOs: 41649 to 82185 and homozygous loci comprising the nucleic acid sequences selected from the group consisting of SEQ ID NOs: 41649 to 68810 and listed in Table 2 ("Sire Genotype"). Sire differs from the reference genome at 10935 homozygous loci, or about 27% of the total loci.

TABLE 2

Genotype of Sire HO840003135669665 (Sire Genotype)

| Homozygous | SEQ ID Range SEQ ID NOs: 41649-68810 | | No. of Alternate Alleles |
|---|---|---|---|
| | Reference Allele | Alternate Allele | |
| Chromosome 1 | 41649-42719 | 57847-58601 | 754 |
| Chr. 2 | 42720-43499 | 58602-59159 | 557 |
| Chr. 3 | 43500-44453 | 59160-59783 | 623 |
| Chr. 4 | 44454-45260 | 59784-60266 | 482 |
| Chr. 5 | 45261-45934 | 60267-60700 | 433 |
| Chr. 6 | 459345-46671 | 60701-61265 | 564 |
| Chr. 7 | 46672-47422 | 61266-61885 | 619 |
| Chr. 8 | 47423-48224 | 61886-62406 | 520 |
| Chr. 9 | 48225-48890 | 62407-62852 | 445 |
| Chr. 10 | 48891-49556 | 62853-63309 | 456 |
| Chr. 11 | 49557-50233 | 63310-63817 | 507 |
| Chr. 12 | 50234-50737 | 63818-64185 | 367 |
| Chr. 13 | 50738-51301 | 64186-64534 | 348 |
| Chr. 14 | 51302-51833 | 64535-65004 | 469 |
| Chr. 15 | 51834-52378 | 65005-65353 | 348 |
| Chr. 16 | 52379-52865 | 65354-65668 | 314 |
| Chr. 17 | 52866-53404 | 65669-65967 | 298 |
| Chr. 18 | 53405-53798 | 65968-66197 | 229 |
| Chr. 19 | 53799-54206 | 66198-66464 | 266 |
| Chr. 20 | 54207-54696 | 66465-66813 | 348 |
| Chr. 21 | 54697-55109 | 66814-67072 | 258 |
| Chr. 22 | 55110-55539 | 67073-67329 | 256 |
| Chr. 23 | 55540-55826 | 67330-67565 | 235 |
| Chr. 24 | 55827-56213 | 67566-67821 | 255 |
| Chr. 25 | 56214-56566 | 67822-68028 | 206 |
| Chr. 26 | 56567-56940 | 68029-68274 | 245 |
| Chr. 27 | 56941-57230 | 68275-68477 | 202 |
| Chr. 28 | 57231-57518 | 68478-68648 | 170 |
| Chr. 29 | 57519-57846 | 68649-68810 | 161 |
| | | No. Alternate alleles | 10935 |

| | SEQ ID Range |
|---|---|
| Heterozygous | 68811-82185 |
| Chromosome 1 | 68811-69568 |
| Chr. 2 | 69569-70363 |
| Chr. 3 | 70364-70760 |
| Chr. 4 | 70761-71423 |
| Chr. 5 | 71424-72041 |
| Chr. 6 | 72042-72719 |
| Chr. 7 | 72720-73111 |
| Chr. 8 | 73112-73656 |
| Chr. 9 | 73657-74158 |
| Chr. 10 | 74159-74759 |
| Chr. 11 | 74760-75333 |
| Chr. 12 | 75334-75787 |
| Chr. 13 | 75788-76276 |
| Chr. 14 | 76277-76695 |
| Chr. 15 | 76696-77157 |
| Chr. 16 | 77158-77633 |
| Chr. 17 | 77634-78084 |
| Chr. 18 | 78085-78534 |

TABLE 2-continued

Genotype of Sire HO840003135669665 (Sire Genotype)

| | |
|---|---|
| Chr. 19 | 78535-78953 |
| Chr. 20 | 78954-79354 |
| Chr. 21 | 79355-79764 |
| Chr. 22 | 79765-80082 |
| Chr. 23 | 80083-80419 |
| Chr. 24 | 80420-80769 |
| Chr. 25 | 80770-81008 |
| Chr. 26 | 81009-81269 |
| Chr. 27 | 81270-81548 |
| Chr. 28 | 81549-81839 |
| Chr. 29 | 81840-82185 |

The genotype of Dam is represented by the SEQ ID NOs: 82186-122589 and homozygous loci comprising the nucleic acid sequences selected from the group consisting of SEQ ID NOs: 82186 to 98686 and listed in Table 3 ("Dam Genotype"). Dam differs from the reference genome at 11237 homozygous loci, or about 28% of the total loci.

TABLE 3

Genotype of Dam HO840003128557405 ("Dam Genotype")

| | SEQ ID Range SEQ ID NOs: 82186-98686 | | No. of Alternate |
|---|---|---|---|
| Homozygous | Reference Allele | Alternate Allele | Alleles |
| Chromosome 1 | 82186-83192 | 98687-99371 | 754 |
| Chr. 2 | 83193-84062 | 99372-99977 | 557 |
| Chr. 3 | 84063-84881 | 99978-100492 | 623 |
| Chr. 4 | 84882-85725 | 100493-101051 | 482 |
| Chr. 5 | 85726-86405 | 101052-101490 | 433 |
| Chr. 6 | 86406-87219 | 101491-102080 | 564 |
| Chr. 7 | 87220-87869 | 102081-102587 | 619 |
| Chr. 8 | 87870-88653 | 102588-103065 | 520 |
| Chr. 9 | 88654-89284 | 103066-103516 | 445 |
| Chr. 10 | 89285-89899 | 103517-103940 | 456 |
| Chr. 11 | 89900-90666 | 103941-104564 | 507 |
| Chr. 12 | 90667-91210 | 104565-104932 | 367 |
| Chr. 13 | 91211-91734 | 104933-105256 | 348 |
| Chr. 14 | 91735-92282 | 105257-105760 | 469 |
| Chr. 15 | 92283-92836 | 105761-106060 | 348 |
| Chr. 16 | 92837-93376 | 106061-106423 | 314 |
| Chr. 17 | 93377-93940 | 106424-106775 | 298 |
| Chr. 18 | 93941-94380 | 106776-107030 | 229 |
| Chr. 19 | 94381-94873 | 107031-107351 | 266 |
| Chr. 20 | 94874-95367 | 107352-107726 | 348 |
| Chr. 21 | 95368-95770 | 107727-108041 | 258 |
| Chr. 22 | 95771-96219 | 108042-108305 | 256 |
| Chr. 23 | 96220-96562 | 108306-108588 | 235 |
| Chr. 24 | 96563-96993 | 108589-108894 | 255 |
| Chr. 25 | 96994-97303 | 108895-109070 | 206 |
| Chr. 26 | 97304-97640 | 109071-109263 | 245 |
| Chr. 27 | 97641-97962 | 109264-109489 | 202 |
| Chr. 28 | 97963-98283 | 109490-109703 | 170 |
| Chr. 29 | 98284-98686 | 109704-109952 | 161 |
| | | No. Alternate alleles | 11237 |

| | SEQ ID Range |
|---|---|
| Heterozygous Chromosome 1 | 109953-122589 109953-110857 |
| Chr. 2 | 110858-111511 |
| Chr. 3 | 111512-112144 |
| Chr. 4 | 112145-112680 |
| Chr. 5 | 112681-113278 |
| Chr. 6 | 113279-113859 |
| Chr. 7 | 113860-114455 |
| Chr. 8 | 114456-115061 |
| Chr. 9 | 115062-115588 |
| Chr. 10 | 115589-116273 |
| Chr. 11 | 116274-116642 |
| Chr. 12 | 116643-117065 |

TABLE 3-continued

Genotype of Dam HO840003128557405 ("Dam Genotype")

| | |
|---|---|
| Chr. 13 | 117066-117610 |
| Chr. 14 | 117611-117973 |
| Chr. 15 | 117974-118467 |
| Chr. 16 | 118468-118832 |
| Chr. 17 | 118833-119198 |
| Chr. 18 | 119199-119559 |
| Chr. 19 | 119560-119828 |
| Chr. 20 | 119829-120190 |
| Chr. 21 | 120191-120554 |
| Chr. 22 | 120555-120841 |
| Chr. 23 | 120842-121068 |
| Chr. 24 | 121069-121323 |
| Chr. 25 | 121324-121625 |
| Chr. 26 | 121626-121970 |
| Chr. 27 | 121971-122194 |
| Chr. 28 | 122195-122406 |
| Chr. 29 | 122407-122589 |

Notably, and as expected for a select cross between Sire and Dam, the number of homozygous alleles in Animal increases compared to both parents. As show in Table 4, Animal retains 70 to 80% of the homozygous alleles found in Sire and Dam and more than 15% of the heterozygous alleles in Sire and Dam are fixed as homozygous in Animal. These results demonstrate that improvements by selective are breeding are reflected in the germplasm and that such improvements do not require, but may be informed by, a priori knowledge of the genotype of the germplasm.

TABLE 4

Select cross increases homozygosity

| Alleles | Sire | Dam | Admiral | Homozygous Matches from parent | | Just Parent type | |
|---|---|---|---|---|---|---|---|
| | | | | S % | D % | S % | D % |
| Homo ref | 12944 | 13040 | 17187 | 32% | 32% | 80% | 79% |
| Homo alt | 8663 | 8313 | 11832 | 21% | 21% | 79% | 74% |
| Homo-homo | 21607 | 21353 | 29048 | 54% | 53% | 80% | 77% |
| Het to homo | 6724 | 6340 | | 17% | 16% | 50% | 50% |

It is to be understood that the disclosure is not necessarily limited in its application to the details set forth in the following description or exemplified by the Examples. The disclosure is capable of other aspects or of being practiced or carried out in various ways.

As used herein the term "about" refers to ±10%.

As used herein, the singular forms "a," "an," and "the" include plural references unless the context clearly dictates otherwise. For example, the term "a compound" or "at least one compound" may include a plurality of compounds, including mixtures thereof Throughout this application, various embodiments of this disclosure may be presented in a range format. It should be understood that the description in range format is merely for convenience and brevity and should not be construed as an inflexible limitation on the scope of the disclosure. Accordingly, the description of a range should be considered to have specifically disclosed all the possible subranges as well as individual numerical values within that range. For example, description of a range such as "from 1 to 6" should be considered to have specifically disclosed subranges such as "from 1 to 3," "from 1 to 4," "from 1 to 5," "from 2 to 4," "from 2 to 6," "from 3 to 6," etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals there between.

For the purposes of this invention the term "semen" means seminal fluid which may contain sperm (also referred to as "spermatozoa") secreted by the gonads of a male animal which can be collected from the male animal by a variety of methods such as use of an artificial vagina, manual manipulation of the penis, electrical manipulation of the anus, or the like.

As used herein, "locus", or plural "loci", refers to a physical site or location of a specific gene or marker on a chromosome. Loci of the present disclosure include, and are identifiable by, a SEQ ID NO, each SEQ ID NO providing the identity of the polymorphism at a single nucleotide polymorphic site and the adjacent 100 base pairs.

Loci may also characterized as either 'A' loci, 'B' loci, or heterozygous 'A/B' loci. The identification of loci as either 'A' or 'B' loci is determined according to the top (TOP) and bottom (BOT) designations based on the polymorphism itself, or the contextual surrounding sequence as developed by Illumina. Methods for determining the designation of a polymorphic site as 'A' or 'B' are known in the art, for example as provided by Illumina's Technical Note entitled "'TOP/BOT' Strand and 'A/B' Allele", available on the internet at www(dot)illumina(dot)com/documents/products/technotes/technote_topbot.pdf. The NCBI's dbSNP database has adopted the TOP/BOT nomenclature in 2005 and the designation is well known to those of skill in the art. As shown in the Examples, through sequence comparison extensive information about each loci is available to a person of ordinary skill in the art, including, but not limited to, dbSNP identifier, sources, chromosomal location, genes, transcripts, linkage to genes or quantitative trait loci (QTL), and interactions.

As used herein, "germplasm" means an intact genome present in cells or nuclei and comprising chromosomes. In diploid cells, the germplasm is characterized by the presence of sequences representing the sequences at polymorphic sites (e.g., SNPs) that are homozygous or heterozygous. As used herein, the germplasm of the present disclosure is characterized by the homozygous loci. In haploid cells (e.g., ova or sperm), the each of the sequences at each homozygous loci in the parent are present in each cell. In contrast, heterozygous loci are present in haploid germplasm according to random assortment. Accordingly, the genotype at heterozygous loci in haploid cells varies from haploid cell to haploid cell, while the sequences of the homozygous loci from the parent are present in each haploid cell and are therefore faithfully transmitted to progeny.

During breeding, to maintain and improve the germplasm, selections of a second parent may be an elite second parent having superior traits. As demonstrated in the examples, such select crosses result in progeny that retain significant numbers of homozygous loci present in each elite parent and further result in additional loci becoming homozygous. Thus, select crosses result in some or all of the homozygous loci of the Bos taurus cells of the present disclosure being retained in progeny generations. Generally, locus homozygosity is maintained when the second parent is an elite parent with high trait values as described below. Similarly, the improved germplasm of the present disclosure can be maintained by selecting superior breeding partners in the F1 and later progeny generations. By suitable selection of the second parent, the germplasm can be maintained at the homozygous loci. Even further, careful selection of elite breeding partners results increased numbers of homozygous loci as the preferred allele at the heterozygous loci are homozygosed in elite progeny. Notably, knowledge of the underlying biology is helpful, but not required.

As used herein, "gamete" refers to a haploid germ cell and includes either a sperm or an ovum and may be used interchangeably. Generally, the identity as a sperm or an ovum can be determined by the context as bulls produced sperm and dams produce ova. For the purposes of this invention the term "sperm" means the haploid cell that is the gamete of a male animal which may join an egg (also referred to as "ovum") to produce a zygote and broadly encompasses infertile sperm, sperm having a comparably lesser or a comparably greater fertility between a first amount of sperm obtained from a first animal and a second amount of sperm obtained from a second animal and which may be obtained in the form of a raw ejaculated semen, frozen semen, as sperm separated from the semen and contained in an extender or diluent, or as sex-selected sperm.

As used herein, the term "inseminate" is intended to broadly encompass an amount of sperm whether contained in semen together with a cryoprotectant. Inseminates may optionally include one or more "extenders" and diluents which can be utilized to fertilize the eggs of a female animal whether in vitro or in vivo. As used herein, inseminates can further include sex-selected sperm compositions.

As used herein, the term "sex-selected sperm" means sperm which have been separated, regardless as to the method of separation, into subpopulations containing X-chromosome bearing sperm and Y-chromosome bearing sperm having a purity in the range of about 70 percent ("%") and about 100%.

Predicted Transmitting Abilities (PTAs) can be computed for various traits, for example in the broad categories of production (milk and milk components), health/fitness, and type. Dairy cattle are evaluated for the traits of milk, fat, and protein yield, length of productive life, and somatic cell score (an indicator of mastitis). Evaluation procedures combine information from relatives of an evaluated animal, and from the animal itself in the case of cows. Additionally, numerous type or conformation traits are evaluated routinely.

An important aspect of Bos taurus breeding programs are genetic values for yield, management traits, and type that are reported as PTAs. These important traits include higher milk, protein and fat yield PTAs shown as added pounds of milk, fat, and protein expected per lactation for average daughters of individual sires. PTAs are also expressed as percentage traits that are represented as percentage point differences where plus values indicate higher concentration of fat and protein in milk. Bos taurus animals and cells obtained therefrom are also selected to provide increased numbers of daughters and herds contributing to production, improved reliability, improved productive life, improved somatic cell score (SCS). Desirable Bos taurus varieties provide higher daughter pregnancy rates (DPR) that are a genetic measure of the percentage of non-pregnant cows that become pregnant during each 21-day period (heat cycle). Another important and desirable PTA selected by breeders is the productive life (PL) that is the additional months of life in the milking string. Also included among the desirable PTAs are calving related traits such as the service sire calving ease and the service sire stillbirth.

Traits are typically combined into an index based on their relative economic weights. For example, the Net Merit index (NM$) computed by USDA AWL estimates lifetime profit based on incomes and expenses relevant for today's dairy producers and is expressed as a dollar value. Traits included in NM$ are: protein (lb.), fat (lb.), productive life, somatic cell score, udder composite, feet/legs composite, body size composite and daughter pregnancy rate. Calving ability also is included in NM$ calculations for Holsteins and Brown Swiss. The traits incorporated into calving ability for Holsteins are daughter stillbirth, service sire stillbirth, daughter calving ease, and service sire calving ease. Only the two calving ease traits are available for inclusion in calving ability values of Brown Swiss. Net merit scores are a relative score calculated based on a comparison with a baseline average animal in 2010. A new baseline animal based on the average animal in 2015 is expected to begin use in 2020 and will reflect improvements to dairy herds generally. Under the new NM$, it is anticipated that NM$ scores in 2020 will be reduced by about 150 to 200 points compared to earlier NM$ scores. As used herein, NM$ scores are calculated using the 2010 baseline and persons of ordinary skill in the art will be to calculate or convert NM$ values based on the 2010 baseline population and 2015 baseline population.

Holstein Association USA calculates the Total Performance Index (TPI). It includes the traits of protein, fat, type, udder composite, feet and leg composite, daughter pregnancy rate, productive life, somatic cell score, daughter calving ease, daughter stillbirth and dairy form. Like Net merit scores, TPI is calculated based on a comparison with a baseline average animal in 2010, however, the Holstein Association USA has not announced plans to update the baseline animal. Accordingly, as used herein, TPI scores are calculated using a 2010 baseline animal. However, should a new baseline year be adopted, persons of ordinary skill in the art will be able to calculate or convert TPI values based on the 2010 baseline population any future baseline animal.

The Jersey Performance Index (JPI), which is used by the American Jersey Cattle Association, is comprised of the following traits: protein, fat, functional trait index, productive life, somatic cell score, and daughter pregnancy rate. Functional trait index is based on the bull/cow PTAs for all type traits.

Using a selection index can be an effective way to consider several traits when choosing breeding stock. Conventional animal husbandry strategies often rely on selection indexes, particularly for choosing service sires.

Breeding stock sires and sire lines are typically chosen based upon their size and fertility. Prior successes in mating as well as siring females are both traits that are often utilized in selecting sires and/or sire lines.

Also, knowing where service sires rank relative to other active bulls is typically considered to be helpful in determining if the sires meet a particular herd's genetic goals. Selection indexes can be particularly useful in monitoring such ranking. To maximize genetic improvement using a selection index, it is usually recommended that the service sires for a given herd average at or above the 80th percentile.

In germplasm improvement programs, "Dams of Males" (DM) or more commonly, "bull mothers" represent a group of elite females that are selected based on EBV or GEBV and that usually rank among the top 1% of the population. These cows are typically mated to elite bulls from the "Sires of Males" (SM) group for the purpose of producing bull calves.

"Sires of males" (SM) or "sires of sons" are elite males that are also selected by EBV or GEBV to be sires of the next generation of young bulls and represent <5% of the males. It is the SM semen that is marketed to dairy farmers and it is primarily through the distribution of SM semen that commercial herds are improved.

Sires of females (SF) or "active AI sires" represent a larger group of males that have been selected based on EBV or GEBV and whose semen is used to breed the general population and produce replacement females for commercial farms.

"Dams of Females" (DF) or "commercial cows" represent the large population of females that are primarily used to produce milk rather than breeding stock and are routinely mated to bulls from the "Sires of Females" (SF) group to initiate lactation, resulting in the next generation of replacement heifers.

Germplasm development programs are directed to the continued improvement of the elite (DM and SM) individuals that in turn improve the germplasm of the larger DF and SF populations. Distinct DM and SM lines have been developed to serve different markets and the resulting germplasms are distinct. That is, different DM and SM lines have distinctive sets of alleles as a result of multigenerational selections.

Ranchers and dairy farmers increase the value of a cow's calves by utilizing frozen semen from the most valuable SM bulls in the industry to breed their cows. Frozen semen can be shipped commercially around the world, the best bulls can be mated to thousands of cows instead of the usual 20 to 40 under natural pasture mating conditions. Once thawed, the semen can be used as an inseminate.

As used herein, daughter pregnancy rate (DPR) is a genetic measure of the percentage of non-pregnant course that become pregnant during each 21-day period (heat cycle). DPR is similar, but not exactly the same, as pregnancy rates computed for herd management purposes. Daughters or sires which have larger PTA DPR are more likely to conceive during a given heat cycle and each 1% increase in PTA DPR is associated with a genetic decrease of 4 days open.

As used herein, Cow Livability (LIV) represents the additional percentage of cows that avoid dying on the farm, permitting producers to recoup disposal income. The trait similar to PL which includes cows culled from the herd for any reason. LIV values range from about −5 to +5, where 5% more of a bull's daughters will remain alive compared to the breed average.

As used herein, heifer conception rate (HCR) is the percentage of inseminated heifers that become pregnant at each service; shown as a deviation in percentage.

As used herein, cow conception rate (CCR) is the percentage of inseminated cows that become pregnant at each service; shown as a deviation in percentage.

As used herein, estimated future inbreeding (EFI) is the estimate of future progeny inbreeding, assuming that an animal is mated randomly within their given breed.

As used herein, kappa casein (K-casein) identify sires with homozygous BB genotype for Kappa Casein for preferred cheese production.

As used herein, predicted transmitting ability protein (PTAP) is a yield trait for protein measured in pounds that is the predicted difference of the protein yield of the offspring from the average. PTAP is shown as added pound of protein expected per lactation for average daughters of individual sires. Higher numbers are preferred.

As used herein, predicted transmitting ability fat (PTAF) is a yield trait for fat measured in pounds that is the predicted difference of the fat yield of the offspring from the average. PTAF is shown as added[or added?] pound of fat expected per lactation for average daughters of individual sires. Higher numbers are preferred.

As used herein, predicted transmitting ability milk (MILK or PTA MILK) is a yield trait for milk measured in pounds that is the predicted difference of the milk yield of the offspring from the average. MILK is shown as added pounds of milk expected per lactation for average daughters of individual sires. Higher numbers are preferred.

As used herein, feed efficiency value (FE) recognizes cattle with the ability to produce large volumes of milk without having to consume a great deal of feed, based on the following formula: Feed Efficiency=(Dollar value of milk produced)−(Feed costs for extra milk)−(Extra maintenance costs).

As used herein, predicted transmitting ability type (PTAT or TYPE) is represented as differences in points from a base population. Daughter final scores are collected by breed classifiers. Raw scores then are adjusted for cow age and used to derive Type PTAs (PTAT). These PTAT are represented as differences in points from the base population. TYPE values are normalized to enable comparisons across different base populations through time.

As used herein, STA dairy form (DF or DFM), formerly known as "dairy character", refers to sharpness, angularity, flatness of bone, openness of rib and length of neck that provides an indication of 'milkiness' and reflects the ability of a dairy cow to produce milk from the feed over flesh and fat.

Dairy cattle are evaluated and described using a criteria generally known as linear descriptive traits that are well known in the art. These linear descriptive traits include Stature (STA), Strength (STR), Body Depth (BDE), Rump Angle (RPA), Thurl Position, Rump Width, Fore Udder Height (FTA), Fore Udder Attachment (FUA), Rear Udder Height (RUH), Rear Udder Width (RUW), Udder Cleft (UCL), Udder Depth (UDP), Front Teat Placement (FTP), Rear Teat Placement (RTP), Teat Length (TLG), Udder Tilt (?), Rear Legs (Side View) (RLS), Rear Legs, (Rear View) (RLR), Feet Leg Score (FLS), Foot Angle, and Body Condition. These linear trait criteria are well known to those skilled in the art. See for example, The Diary Cow Today: U.S. Trends, Breeding, and Progress Since 1980, S. L. Spahr and G. W. Opperman, Chapter 9, Type and classification and trait appraisal, hereby incorporated by reference in its entirety.

Linear descriptive traits are often combined into composite indexes to simplify the process of describing the transmitting pattern for type traits. Composite indexes include the feet & legs composite (FLC), the udder composite index (UDC), the body form (BF) composite index, body size composite (BSC) index, and the dairy capacity (DC) composite index. The FLC composite is a combination of rear legs, side view and foot angle linear traits. The UDC incorporates the udder attachment, rear udder height, rear udder width, udder depth, udder cleft, front teat placement, and rear teat placement linear traits. The UDC is designed so that the association between UDC and herd life is maximized. Larger values are associated with longer herd life. The BF index combines the linear traits of stature, body depth, rump angle, and rump width. The DC composite combines the linear traits of dairy form and strength. The BSC is another composite index calculated from four linear traits: stature, strength, body depth and rump width. Every 1.0 STA increase in the BSC correlates with a 24 pound predicted increase in mature body weight.

As used herein, "Productive Life" (PL) is a measure of how long dairy cows survive in a herd after they calve for the first time. It is based on calving dates, culling or death dates, and days in milk (based on dry dates) in each lactation for cows on DHI test. The PTA for Productive Life (PL) is expressed as additional months of life in the milking string. Bulls with larger PTA PL are expected to sire daughters that have longer productive lives. Data used to compute PTA PL include actual longevity, stage of lactation, and culling data supplemented with data from traits that are correlated with PL. By assigning the largest PL credits for months in peak production and by giving later lactations slightly more credit than first lactation, PL reflects the economic impact of cow longevity. The heritability of PL is low at 0.085 and the trait is expressed late in the life of dairy cow. Accordingly, PL is a difficult trait to improve through selection because of low heritability and expression of the trait late in life. Methods for calculating PL are known in the art. See VanRaden et al., "Genetic Evaluation of Length of Productive Life Including Predicted Longevity of Live Cows," *Journal of Dairy Science* 76:2758-2764 (1993), VanRaden et al., Productive Life Evaluations: Calculation, Accuracy, and Economic Value *Journal of Dairy Science* 78:631-638 (1995), Weigel et al., "Use of Linear Type and Production Data to Supplement Early Predicted Transmitting Abilities for Productive Life," *Journal of Dairy Science* 81:2040-2044(1998), see also VanRaden et al., "Methods used to compute multi-trait productive life," USDA AIPL Research Report PLC (11-03) available at aipl(dot)arsusda(dot)gov/reference/multi-pl.htm. Each of the foregoing references are hereby incorporated by reference in their entireties. The present disclosure provides for, and includes, progeny cattle having an increased PL relative to a dam parent.

As used herein, "Somatic Cell Score" (SCS) is calculated from the Somatic Cell Count (SCC). When milk is produced, a small number of cells, are also transferred to the milk (along with the proteins, fat, water, and minerals that make up milk). Although all milk contains some of these cells, milk quality is affected if they are present in very high numbers. Milk processors limit the amount they will allow in milk they buy from farmers. Also, knowing the SCS for an individual cow can help the farmer tell if the cow is healthy because irritation in the udder can cause higher SCS. Health management has the biggest effect on SCS, but just like some people inherit a higher chance of getting ear infections, cows can inherit traits which cause higher SCS. Next to traits like milk or protein production, SCS has a low heritability. Somatic Cell Score PTA is calculated using somatic cell score data from the first five lactations as an indicator of mastitis resistance. Bulls with lowest PTA SCS are expected to sire daughters with lowest SCS, lowest somatic cell counts (SCC), and the fewest cases of mastitis. The present disclosure provides for, and includes, reduced SCS in progeny compared to a dam parent.

As used herein, "Fertility Index" (FI) combines several reproductive components into one overall index: ability to conceive as a maiden heifer, ability to conceive as a lactating cow, and a cow's overall ability to start cycling again, show heat, conceive, and maintain a pregnancy. The Fertility Index is derived from the formula: Fertility Index=18% Heifer Conception Rate (HCR)+18% Cow Conception Rate (CCR)+64% Daughter Pregnancy Rate (DPR). The present disclosure provides for, and includes, an increased FI in progeny compared to a dam parent. Also included are methods to improve FI in an offspring comprising crossing an Animal of the present disclosure with dams of a herd in need of improvement.

As used herein, "Sire Calving Ease" (SCE) measures the tendency of calves from a particular sire to be born more or less easily and is express as a percent of difficult births in first calf heifers on a scale of 1 to 5 (1 is classified as "no problem"). The percent difficult birth among Holstein is about 8%. Generally, bulls having an SEC of 8% or less are considered "calving ease" bulls. Lower numbers are preferred. The present disclosure provides for, and includes, reduced SCE of progeny cattle. Also included are methods to improve SCE in a progeny comprising crossing an Animal of the present disclosure with dams of a herd in need of improvement.

As used herein, "Daughter Calving Ease" (DCE), like SCE, is a measurement of the tendency of calve from a particular animal to be born more or less easily. Lower numbers are preferred. The present disclosure provides for, and includes, reduced DCE of progeny cattle. Also included are methods to improve DCE in a progeny comprising crossing an Animal of the present disclosure with dams of a herd in need of improvement.

As used herein, "Service Sire Stillbirth" (SSB) expresses the proportion of stillborn calves expected from sires. The genetic base for Stillbirth is 8%. The present disclosure provides for, and includes, reduced SSB of progeny cattle relative to the genetic base. In an aspect, the progeny cattle have an SSB below 5%. Also included are methods to improve SSB in a progeny comprising crossing an Animal of the present disclosure with dams of a herd in need of improvement.

As used herein, "Daughter Stillbirth" (DSB) is the tendency of calves from a sire to be stillborn and applies to the Holstein breed only. As discussed below, DSB can be related to certain haplotypes. The present disclosure provides for, and includes, reduced DSB of progeny cattle relative to the genetic base. In an aspect, the progeny cattle have a DSB below 5%. Also included are methods to improve DSB in a progeny comprising crossing an Animal of the present disclosure with dams of a herd in need of improvement.

As used herein, TPI® is a multi-trait selection index published by the Holstein Association USA (HAU) and is calculated using methods known in the art (Available on the internet at www(dot)holsteinusa(dot)com/genetic_evaluations/ss_tpi_formula.html. TPI® incorporates production, management, Type, and important linear and composite traits. TPI® focuses on dairies paid for protein plus fat and requiring more emphasis on Type.

Breeders have developed merit measures for the evaluation of value of improved Bos taurus germplasm over the lifetime of offspring. Various merit measures account for the additional net profit that an offspring of an animal will provide over its lifetime. Income and expenses for a typical dairy operation have been estimated, so that a measure of overall net profit can be calculated. Three different values (Net, Fluid and Cheese) of lifetime profitability are available. The primary difference between the formulas is the emphasis that is placed on the components. When breeding, producers select the index that is closest to the milk payment in their area. Net merit is based upon the future anticipated average milk price for all of the U.S. Fluid Merit would be for producers who do not receive any payment for protein. In the Fluid Merit formula a negative value is placed on protein because additional feed is required to produce additional protein. Without a direct payment for the additional protein, this results in a negative value. Cheese Merit may be appropriate for farmers selling their milk directly to a cheese plant.

As used herein, lifetime net merit (NM$) is a multi-trait selection index published by CDCB. Methods to calculate NM$ are known in the art. See VanRaden et al., "Net merit as a measure of lifetime profit: 2018 revision," USDA AIP Research Report NM$7 (5-18) (2018) available at aipl(dot)arsusda(dot)gov/reference/nmcalc-2018.htm, hereby incorporated by reference in its entirety. The NM$ incorporates production, management and important composite traits and is designed for dairies paid for protein plus fat and requiring more emphasis on management traits. The present disclosure provides for, and includes, increased NM$ of progeny cattle relative to parents. In an aspect, the NM$ of progeny cattle is increased by at least 10% over the parent generation. Also included are methods to improve NM$ in a herd comprising crossing an Animal of the present disclosure with dams of a herd in need of improvement.

Trait parameters have been correlated with the underlying genetics and the heritabilities determined. The genetic and phenotypic correlations among the twelve PTA traits are also provided by VanRaden et al., 2018.

As used herein, grazing merit (GM$) is an index that incorporates economic values appropriate for grazing production in the U.S. The GM$ index is based upon appropriate costs and revenues to allow for selection of cows and bulls for more optimal genetic progress. GM$ is geared toward herds on pasture systems, with those breeders often demanding higher fertility, compared to conventional systems, due to seasonal calving requirements. Methods to calculate GM$ are known in the art. See Gay et al., "Development of a Lifetime Merit-based selection index for US dairy grazing systems," J. Dairy Sci. 97:4568-4578 (2014), hereby incorporated by reference in its entirety. The present disclosure provides for, and includes, increased GM$ of progeny cattle relative to parents. In an aspect, the GM$ of progeny cattle is increased by at least 10% over the parent generation. Also included are methods to improve GM$ in a herd comprising crossing an Animal of the present disclosure with dams of a herd in need of improvement.

As used herein cheese merit (CM$) is an index that incorporates economic values appropriate for the production of cheese. The present disclosure provides for, and includes, increased CM$ of progeny cattle relative to parents. In an aspect, the CM$ of progeny cattle is increased by at least 10% over the parent generation. Also included are methods to improve CM$ in a herd comprising crossing an Animal of the present disclosure with dams of a herd in need of improvement.

As used herein, fluid merit (FM$) is an index that incorporates economic values for dairy production wherein the producers do not receive any payment for protein. Methods for calculating FM$ are known in the art. The present disclosure provides for, and includes, increased FM$ of progeny cattle relative to parents. In an aspect, the FM$ of progeny cattle is increased by at least 10% over the parent generation. Also included are methods to improve FM$ in a herd comprising crossing an Animal of the present disclosure with dams of a herd in need of improvement.

As used herein, a haplotype is a combination of alleles (DNA sequences) at different locations on a chromosome that are transmitted together as a group (linked). Haplotype tests are available that provide for the identification of recessive disorders that affect fertility and other traits. See Cole et al., "Haplotype tests for recessive disorders that affect fertility and other traits," USDA AIP Research Report Genomic3 (09-13) updated Dec. 1, 2018, available at aipl (dot)arsusda(dot)gov/reference/recessive_haplotypes_ARR-G3.html, hereby incorporated by reference in its entirety. As shown in Table 5, certain haplotypes are undesirable in a Bos taurus germplasm as provided in the present specification. When the recessive haplotype is homozygous, fertility and other critical traits are significantly affected. The germplasm of the present disclosure can be used to improve herds and reduce the presence of these undesirable haplotypes.

TABLE 5

Haplotypes impacting fertility

| Breed | Haplotype | OMIA* 9913 ID | Functional/ gene name | Frequency (%) | Chromosome |
|---|---|---|---|---|---|
| Holstein | HBR | 001199 | Black/red coat color/ MC1R(MSHR) | 0.8 | 18 |
| | HDR | 001529 | Dominant red coat color | 0.04 | 3 |
| | HH0 | 000151 | Brachyspina/FANCI | 2.76 | 21 |
| | HH1 | 000001 | APAF1 | 1.92 | 5 |
| | HH2 | 001823 | — | 1.66 | 1 |
| | HH3 | 001824 | SMC2 | 2.95 | 8 |
| | HH4 | 001826 | GART | 0.37 | 1 |
| | HH5 | 001941 | — | 2.22 | 9 |
| | HHB | 000595 | BLAD/ITGB2 | 0.25 | 1 |
| | HHC | 001340 | CVM/SLC35A3 | 1.37 | 3 |
| | HHD | 000262 | DUMPS/UMPS | 0.01 | 1 |
| | HHM | 000963 | Mulefoot/LRP4 | 0.07 | 15 |
| | HHP | 000483 | Polledness/POLLED | 0.71 | 1 |
| | HHR | 001199 | Red coat color/ MC1R(MSHR) | 5.42 | 18 |
| Jersey | JH1 | 001697 | CWC15 | 12.10 | 15 |
| | JH2 | 001942 | — | 1.3 | 26 |
| | JHP | 000483> | Polledness/POLLED | 2.2 | 1 |

In aspects according to the present disclosure, the Bos taurus germplasm is free of certain haplotypes that negatively impact fertility. Five haplotypes impacting fertility of Holstein breeds, referred to as HH1, HH2, HH3, HH4 and HH5, are believed to cause embryonic or fetal death when present in homozygous form, i.e., the offspring inherits the haplotype from both the sire and dam. In a herd, this would appear as if a cow did not conceive, resulting in greater days open and lower conception rates. Researchers have found that these haplotypes never occur in homozygous form amongst any living animal (that had their genome tested; the group researchers studied). That scenario is highly unlikely based on population probabilities, unless affected animals did not survive to birth.

Cattle suffer from a number of genetic diseases that are monogenic disorders inherited in a Mendelian fashion. A number of these genetic diseases are presented below together with their genetic codes. Various genetic diseases are known in the art. See for example, Garrick and Ruvinsky, "The Genetics of Cattle," $2^{nd}$ Edition, CAB International, Oxfordshire UK 2015; see also Parkinson et al., "Diseases of Cattle in Australasia," ISBN 9780958363447 Jolly et al., "Genetic Diseases of Cattle," Chapter 21; and vetbook(dot) org/wiki/cow/index.php/Genetic_diseases_of_cows, hereby incorporated by reference in their entireties. The germplasm of the present disclosure can be used to reduce the presence of these recessive genes in herds and bovine populations.

TABLE 6

Genetic Codes of Recessive Genes

| Genetic Code | Phenotype | Genetic Code | Phenotype |
|---|---|---|---|
| BD | Bulldog* | ACAN | Dwarfism |
| BL | Bovine Leukocyte Adhesion Deficiency (BLAD)* | PO | Observed Polled** |
| TL | Tested free of BLAD | PC | Tested Heterozygous Polled** |
| BY | Brachyspina* | PP | Tested Homozygous Polled** |
| TY | Tested free of Brachyspina | TP | Tested free of the Polled Condition (horned) |
| CV | Complex Vertebral Malformation (CVM)* | PT | Pink Tooth (Porphyria)* |
| TV | Tested free of CVM | RC | Carrier for red hair color* |
| DP | Deficiency of Uridine Monophosphate Synthase (DUMPS)* | B/R | Black/Red hair color* |
| TD | Tested free of DUMPS | TR | Tested free to red hair color |
| MF | Mulefoot* | DR1 | Tested Heterozygous for Dominant Red* |
| TM | Tested free of Mulefoot | DR2 | Tested Homozygous for Dominant Red** |

*Recessive gene carrier
**Dominant gene carrier

The present disclosure provides for and includes Bos taurus germplasm that is free of carriers of recessive genes selected from the group consisting of Bulldog (BD), Bovine Leukocyte Adhesion Deficiency (BL), brachyspina (BY), Complex Vertebral Malformation (CV), Deficiency of Uridine Monophosphate Synthase (DP), and Mulefoot (MF). Brachyspina syndrome is a congenital inherited lethal defect in Holstein cattle that causes embryonic death, stillbirth and other deformities. (e.g., TY). Also included and provided for are methods to improve a herd by reducing the carriers of recessive genes comprising crossing an Animal of the present disclosure with dams of a herd having carriers of deleterious recessive genes.

As used herein, the term "HO840M003150607238 Genotype" or "Animal Genotype" provides for, and includes, diploid Bos taurus cell or a plurality of diploid Bos taurus cells comprising improved germplasm characterized by a genome having homozygous loci comprising 90% to 100% nucleic acid sequences selected from the group selected from SEQ ID NOs:1 to 2904829048. The present disclosure provides for, and includes, a diploid Bos taurus cell or a plurality of diploid Bos taurus cells comprising improved germplasm characterized by a genome having homozygous loci comprising 90% to 100% of the nucleic acid sequences selected from the group selected from SEQ ID NOs:1 to 2904829048. In an aspect, the diploid Bos taurus cell or a plurality of diploid Bos taurus cells comprise a genome having homozygous loci comprising at least 90% of the nucleic acid sequences selected from the group consisting of SEQ ID NOs: 1 to 2904829048. In an aspect, the genome of said Bos taurus cell or cells further comprise heterozygous loci comprising at least 90% of the nucleic acid sequences selected from the group consisting of SEQ ID NO: 29049 to 41648. In an aspect, the plurality of cells comprise a frozen vial, a cell culture, a tissue, a zygote, an embryo, a calf, or a mature adult. In some aspects, the Bos taurus cells are non-reproductive cells. In an aspect, the number of cells in a plurality of cells of the present disclosure is two or more, 100 or more, 1000 or more, $10^4$ or more, $10^5$ or more, or $10^6$ or more. In an aspect, the cells are in a container and comprise between $10^4$ and $10^7$ cells. In an aspect, the number of cells is between $10^5$ and $10^7$ cells.

In other aspects, the present disclosure provides for and includes, a diploid Bos taurus cell or a plurality of diploid Bos taurus cells comprising improved germplasm characterized by a genome comprising homozygous loci comprising at least 95% of the nucleic acid sequences selected from the group consisting of SEQ ID NOs: 1 to 29048. In an aspect, the diploid Bos taurus cell or plurality of diploid Bos taurus cells further comprise heterozygous loci comprising at least 95% of the nucleic acid sequences selected from the group consisting of SEQ ID NO: 17200 to 29806. In another aspect, the diploid Bos taurus cell or plurality of diploid Bos taurus cells comprise a genome comprising homozygous loci comprising at least 97% of the nucleic acid sequences selected from the group consisting of SEQ ID NOs:1 to 29048. In an aspect, the diploid Bos taurus cell or plurality of diploid Bos taurus cells further comprise heterozygous loci comprising at least 97% of the nucleic acid sequences selected from the group consisting of SEQ ID NO:17200 to 29806. In another aspect, the diploid Bos taurus cell or plurality of diploid Bos taurus cells comprise a genome comprising homozygous loci comprising at least 98% of the nucleic acid sequences selected from the group consisting of SEQ ID NOs:1 to 29048. In an aspect, the diploid Bos taurus cell or plurality of diploid Bos taurus cells further comprise heterozygous loci comprising at least 98% of the nucleic acid sequences selected from the group consisting of SEQ ID NO:17200 to 29806. In another aspect, the diploid Bos taurus cell or plurality of diploid Bos taurus cells comprise a genome comprising homozygous loci comprising at least 99% of the nucleic acid sequences selected from the group consisting of SEQ ID NOs:1 to 29048. In an aspect, the diploid Bos taurus cell or plurality of diploid Bos taurus cells comprise heterozygous loci comprising at least 99% of the nucleic acid sequences selected from the group consisting of SEQ ID NO:17200 to 29806. In another aspect, the diploid Bos taurus cell or plurality of diploid Bos taurus cells comprise a genome comprising homozygous loci comprising at least 99.5% of the nucleic acid sequences selected from the group consisting of SEQ ID NOs:1 to 29048. In an aspect, the diploid Bos taurus cell or plurality of diploid Bos taurus cells further comprise heterozygous loci comprising at least 99.5% of the nucleic acid sequences selected from the group consisting of SEQ ID NO:17200 to 29806. In an aspect, the diploid Bos taurus cell or plurality of diploid Bos taurus cells comprise a genome comprising homozygous loci comprising the nucleic acid sequences selected from the group consisting of SEQ ID NOs:1 to 29048. In an aspect, the diploid Bos taurus cell or plurality of diploid Bos taurus cells further comprise heterozygous loci comprising the nucleic acid sequences selected from the group consisting of SEQ ID NO:17200 to 29806. In an aspect, the diploid Bos taurus cells comprise Bos taurus variety HO840M003150607238, wherein a sample of cells of said variety has been deposited under ATCC Accession No. PTA-125702. As provided herein, the plurality of cells may comprise a frozen vial, a cell culture, a tissue, a zygote, an embryo, a calf, or a mature adult. In some aspects, the Bos taurus cells are non-reproductive cells. In an aspect, the number of cells in a plurality of cells of the present disclosure is two or more, 100 or more, 1000 or more, $10^4$ or more, $10^5$ or more, or $10^6$ or more. In an aspect, the cells are in a container and comprise between $10^4$ and $10^7$ cells. In an aspect, the number of cells is between $10^5$ and $10^7$ cells.

The present disclosure provides for, and includes, a diploid Bos taurus cell or a plurality of diploid Bos taurus cells comprising improved germplasm characterized by a genome comprising an Animal Genotype but that do not with favorable haplotypes for the traits comprise alleles selected from the group consisting of HHB, HHC, HHD, HEIM, HHR, HHP, HBR, and HDR.

The present disclosure provides for, and includes, tissue cultures comprising diploid Bos taurus cells comprising improved germplasm characterized by a genome comprising an Animal Genotype. In an aspect, the culture of Bos taurus cells comprise a genome comprising homozygous loci comprising the nucleic acid sequences selected from the group consisting of SEQ ID NOs:1 to 29048. As provided above, tissue cultures may comprise cells having 95% of the recited homozygous loci, 97% of the recited homozygous loci, 98% of the recited homozygous loci, 99% of the recited homozygous loci, 99.5% of the recited homozygous loci, and 100% of the recited homozygous loci, In an aspect, the diploid Bos taurus cells culture comprises Bos taurus variety HO840M003150607238, wherein a sample of cells of said variety has been deposited under ATCC Accession No. PTA-125702. As provided herein, the cell culture may be prepared from frozen cells or obtained as a primary culture from an embryo, a calf, or a mature adult. In certain aspects, the Bos taurus cells are non-reproductive cells.

Also included, and provided for, are Bos taurus cells that are haploid. As used herein, the term "HO840M003150607238 Haploid Genotype" or "Animal Haploid Genotype" provides for, and includes, a haploid Bos taurus cell or a plurality of haploid Bos taurus cells comprising improved germplasm characterized by a genome having loci comprising 90% to 100% of the nucleic acid sequences selected from the group selected from SEQ ID NOs:1 to 29048. As described below, haploid cells can be readily produced by somatic cell nuclear transfer of Bos taurus variety HO840M003150607238, from cells deposited under ATCC Accession No. PTA-125702. Mature animals prepared from variety HO840M003150607238 can be used to obtain haploid gametes through methods known in the art and discussed in detail below. As used herein, the term "gametes," "sperm," "spermatozoa," "spermatocyte," "spermatid," and "inseminate" are used interchangeable for haploid cells obtained from male animals and the terms will be understood by a person of ordinary skill in the art. Also as used herein, the term "gametes," "ova," "ovum," and "oocyte" are used interchangeable for haploid cells obtained from female animals. Haploid Bos taurus cells of the present disclosure comprise a haploid genome comprising a single copy of loci comprising at least 90% of the nucleic acid sequences selected from the group consisting of SEQ ID NOs:1 to 29048. Haploid cells of the present disclosure include a haploid genome comprising a single copy of loci comprising at least 95% of the nucleic acid sequences selected from the group consisting of SEQ ID NOs:1 to 29048. Haploid cells of the present disclosure also include a haploid genome comprising a single copy of loci comprising at least 97% of the nucleic acid sequences selected from the group consisting of SEQ ID NOs:1 to 29048. Haploid cells of the present disclosure may also comprise a haploid genome comprising a single copy of loci comprising at least 98% of the nucleic acid sequences selected from the group consisting of SEQ ID NOs:1 to 29048. Haploid cells of the present disclosure include a haploid genome comprising a single copy of loci comprising at least 99% of the nucleic acid sequences selected from the group consisting of SEQ ID NOs:1 to 29048. In some aspects, haploid cells of the present disclosure comprise a haploid genome comprising a single copy of loci comprising at least 99.5% of the nucleic acid sequences selected from the group consisting of SEQ ID NOs:1 to 29048. Haploid cells of the present disclosure also include cells comprising a haploid genome comprising a single copy of loci comprising the nucleic acid sequences selected from the group consisting of SEQ ID NOs:1 to 29048. In an aspect, the number of haploid cells in a plurality of cells of the present disclosure is 1000 or more, $10^4$ or more, $10^5$ or more, or $10^6$ or more. In an aspect, the cells are in a container and comprise between $10^4$ and $10^7$ cells. In an aspect, the number of cells in a container is between $10^5$ and $10^7$ cells.

As provided herein, the plurality of haploid cells may be cells in fresh semen. Methods for the collection of sperm from mature bulls are well known in the art.

Bos taurus germplasms are often provided as frozen (cryopreserved) semen samples. Long-term semen storage system is advantageous by allowing movement of artificial insemination (AI) doses throughout the world without compromising semen viability. Long-term storage also enables specific health checks to be carried out on both the semen and individual males thus minimizing the risk of the spread of disease through AI. Cryopreservation techniques for semen are well known to those skilled in the art.

As provided herein, useful cryoprotectants are not limited to those acting by a particular mechanism. In an aspect, the cryoprotectant acts, at least in part, by reducing intracellular dehydration. Not to be limited by theory, freezing is accompanied by an increase in solute concentration in the medium surrounding sperm that draws water out of the cells leading to increases in intracellular electrolyte concentration. Cryoprotectants of the present disclosure include, but are not limited to glycerol (GLY), 1,1,1-tris(hydroxymethyl)ethane [2-hydroxymethyl-2-methyl-propane-1,3-diol] (THE), 1,1,1-tris(hydroxymethyl)propane [2-ethyl-2-hydroxymethyl-propane-1,3-diol] (THP), ethylene glycol (EG), propane-1,2-diol (PD2), propane-1,3-diol (PD3) and dimethyl sulphoxide (DMSO), sucrose, trehalose, dextrose, raffinose, lactose, melibiose, melezitose, mannotriose, stachyose, dextran, hydroxy-ethyl starch, maltitol, lactitol, polyethyleneglycol, propylene glycol, polyvinvyl pyrrolidone, polyethylene oxide, and combinations thereof.

The present disclosure provides for, and includes, containers of Bos taurus inseminates comprising a plurality of sperm cells. Inseminates are prepared by combining fresh semen samples with a cryoprotectant and freezing the samples. Upon thawing, the sperm retain high levels of motility and fertility. In addition to the cryoprotectant, inseminates often include one or more additional components. In an aspect, the inseminate comprises $10^4$ or more, $10^5$ or more, or $10^6$ or more cells. In an aspect, the inseminate is provided in a container and comprise between $10^4$ and $10^7$ cells. In an aspect, the number of cells in the container is between $10^5$ and $10^7$ cells.

In general, about 5 ml to about 15 ml of semen is collected from a bull and optionally mixed with a suitable extender and cryoprotectant. For example, in an aspect, about 10 ml of semen is collected and mixed with about 240 ml of Triladyl™ solution, which is an off the shelf product that is available from Minitube of America in Verona, Wis. The Triladyl™ contains an extender and a cryoprotectant, such as glycerol. The mixture of semen, extender and cryoprotectant is then placed in plastic straws and frozen. In the industry the contents of the frozen straw is generally referred to as frozen semen, although it also contains an extender and a cryoprotectant. A goal is to cryopreserve about 20 million motile sperm in a ½ ml semen straw.

As used herein, an inseminate refers to a composition of Bos taurus sperm having an Animal Haploid Genotype and a cryoprotectant. Also provided are inseminates further comprising a component selected from the group consisting of an extender, an antibiotic, a buffer, an energy source, an antioxidant, and a protein source. Inseminates according to the present disclosure may be frozen or thawed.

The present specification provides for, and includes, inseminates comprising a sperm having a genome comprising an Animal Haploid Genotype. In an aspect, the inseminate comprises Bos taurus sperm comprising at least 90% of each of the recited loci. In an aspect, the inseminate comprises at least 95% of each of the loci. In an aspect, the inseminate comprises at least 97% of each of the loci. In an aspect, the inseminate comprises at least 98% of each of the loci. In an aspect, the inseminate comprises at least 99% of each of the loci. In an aspect, the inseminate comprises at least 99.5% of each of the loci. In an aspect, the inseminate comprises sperm cells from Bos taurus variety HO840M003150607238, wherein a sample of cells of said variety has been deposited under ATCC Accession No. PTA-125702. As provided herein, the inseminate may be fresh, frozen, or frozen and thawed and may further comprise component selected from the group consisting of an extender, an antibiotic, a buffer, an energy source, an antioxidant, and a protein source.

The present disclosure further provides for, and includes, Bos taurus inseminates comprising a sperm having a genome an Animal Haploid Genotype and further comprising one or more extenders. The term "extender" refers to any medium that extends to preserve sperm viability. The term "extension" refers to the dilution of sperm and cryoprotectant (e.g., an inseminate) with extender. An extender suitable for use in the selected sperm sample includes a physiologically acceptable carrier. The physiologically acceptable carrier is typically aqueous, and, in certain aspects, includes deionized water. Suitable extenders commonly comprise one or more of the following additional components: a component that maintains osmolality and buffers pH, an organic substance that prevents cold shock and preserves fertility of sperm, a detergent that acts synergistically with certain organic substances to enhance preservation of sperm, an energy source that can be readily utilized by sperm, an antioxidant, which protects sperm from cold shock. a substance that facilitates sperm capacitation, and one or more antibiotics. In aspects according to the present disclosure, the extender may be a commercial extender, such as BoviPRO® CryoGuard, BIOXcell, Cryobos®, Andromed®, Andromed® CSS, Triladyl®, Biladyl®, Steridyl®, and Biociphos. See for example U.S. Patent Publication No. 2003/0157475 published Aug. 21, 2003.

The present disclosure further provides for, and includes, Bos taurus inseminates comprising a sperm having a genome comprising an Animal Haploid Genotype and further comprising extenders that are a source of protein. Suitable protein sources include, but are not limited to egg yolk, milk, BSA and derivatives and combinations thereof. Inseminates comprising a protein source may further include one or more additional components selected from the group consisting of osmolytes, a buffer, and organic substances that prevent cold shock, detergents, energy sources, antioxidants, and one or more antibiotics.

The present disclosure further provides for, and includes, Bos taurus inseminates comprising a sperm having a genome comprising an Animal Haploid Genotype wherein the osmolality of the inseminate is controlled. The term "osmolality," as used herein, is a measure of the osmotic pressure of dissolved solute particles in an aqueous solution (e.g., an extender). The solute particles include both ions and non-ionized molecules. Osmolality is expressed as the concentration of osmotically active particles (i.e., osmoles) dissolved in 1 kg of water.

Substances helpful in maintaining osmolality and pH within these ranges are well known in the art and can be added to the extender as a solid or already in solution. A buffer containing a salt, a carbohydrate, or a combination thereof can be employed for this purpose. In aspects according to the present disclosure, the osmolality is between about 250 milliosmoles (mOsM) to about 350 mOsM. In certain aspects, the pH of the Bos taurus inseminate is between 6.9 and 7.5. Specific examples of osmolytes and buffers include sodium citrate, Tris[hydroxymethyl]aminomethane, and TES (N-Tris [Hydroxymethyl]methyl-2-aminoethanesulfonic acid), and monosodium glutamate buffers; milk; HEPES-buffered medium; and any combination thereof. The component employed to help maintain osmolality and provide buffering capacity in a particular application can vary depending on the other components of the extender and, in some cases, on the species from which the sperm are derived. The selection of such a component for use in the present invention is, however, within the level of skill in the art. Inseminates comprising an osmolyte may further include one or more additional components selected from the group consisting of a protein source, a buffer, and organic substances that prevent cold shock, detergents, energy sources, antioxidants, and one or more antibiotics.

The present disclosure further provides for, and includes, Bos taurus inseminates comprising a sperm having a genome comprising an Animal Haploid Genotype comprising extenders that comprise an antibiotic, since substantial bacterial growth can threaten sperm viability and increase the risk of infection of the host in artificial insemination or in vitro fertilization procedures. Any of a variety of antibiotics useful in the cryopreservation of cells can also be employed in the extender. The selection of a suitable antibiotic depends on the species from which the sperm was obtained, the procedures involved in obtaining and handling the sperm sample, and the specific microorganism(s) to be targeted. Exemplary antibiotics include tylosin, gentamicin, lincomycin, spectinomycin, linco-spectin (a combination of lincomycin and spectinomycin), penicillin, streptomycin, and ticarcillin, which can be used alone or in combination. However, one skilled in the art can readily determine other antibiotics suitable for use in the extender. Inseminates comprising an osmolyte may further include one or more additional components selected from the group consisting of a protein source, a buffer, and organic substances that prevent cold shock, detergents, energy sources, antioxidants, and osmolytes.

The present disclosure provides for, and includes Bos taurus inseminates comprising a sperm having a genome comprising an Animal Haploid Genotype and further comprising organic stress reducing agents. Organic stress reducing agents (OSR) provide improved motility, viability, fertility, and integrity of sperm cells in the Bos taurus inseminates of the present disclosure. Suitable OSRs include, but are not limited to catalase, superoxide dismutase (SOD), a SOD mimic, glutathione, glutathione reductase, glutathione peroxidase, pyruvate, mercaptoethanol, butylated hydroxytoluene (BHT), lipoic acid, flavins, quinines, vitamin K (and related vitamers), vitamin B12 (and related vitamers), vitamin E (and related vitamers), tocopherols, tocotrienols, α-tocopheryl, alpha ketoglutarate (AKG), malondialdehyde (MDA), asymmetric dimethylarginine (ADMA) and biologically active derivatives thereof. Bos taurus inseminates and compositions according to the present disclosure can include one or more OSRs. Inseminates comprising a one or more OSRs may further include one or more additional components selected from the group consisting of a protein source, a buffer, and organic substances that prevent cold shock, detergents, energy sources, antioxidants, and osmolytes.

The present specification provides for, and includes, inseminates wherein the sperm have undergone one or more selections to prepare selected sperm inseminate. In certain aspects, selected sperm inseminates may be selected based on sex-type. In some aspects, the sperm are sex selected prior to preparing the selected sperm inseminate. In other aspects, the inseminate is prepared and then subjected to a sex-type selection processes. In aspects according to the present disclosure, the sex-type selection is performed prior to freezing the inseminate. In other aspects, the sex-type selection process is performed after thawing of a frozen inseminate.

Sex-type selection may be performed based on slight differences in the physical characteristics of sperm cells. Selection may also be performed based on nucleic acid sequence. A variety of methods are available for selecting cells including flow-cytometric methods. Importantly, the selection and subsequent processing of sperm creates challenges to maintain fertility and successful insemination when used in breeding. Methods of sex-type selection are known in the art.

The present disclosure provides for, and includes, sex selected inseminates comprising sperm having a genome comprising an Animal Haploid Genotype.

In an aspect, the sex selected inseminate comprises Bos taurus sperm comprising at least 90% of each of the recited loci. In an aspect, the sex selected inseminate comprises at least 95% of each of the recited loci. In another aspect, the sex selected inseminate comprises at least 97% of each of the recited loci. Other aspects provide sex selected inseminates comprising at least 98% of each of the recited loci. In an aspect, the sex selected inseminate comprises at least 99% of each of the recited loci. In a further aspect, the sex selected inseminate comprises at least 99.5% of each of the recited loci. In an aspect, the sex selected inseminate comprises sperm cells from Bos taurus variety HO840M003 150607238, wherein a sample of cells of said variety has been deposited under ATCC Accession No. PTA-125702. As provided herein, the sex selected inseminate may be fresh, frozen, or frozen and thawed and may further comprise one or more components selected from the group consisting of an extender, an antibiotic, a buffer, an energy source, an antioxidant, and a protein source. As provided herein, the sex selected inseminate may be skewed toward X-chromosome bearing or Y-chromosome bearing populations of spermatozoa. In an aspect, the sex selected inseminate comprises $10^4$ or more, $10^5$ or more, or $10^6$ or more cells. In an aspect, the sex selected inseminate is provided in a container and comprises between $10^4$ and $10^7$ cells. In an aspect, the number of sex selected cells in the container is between $10^5$ and $10^7$ cells.

The present disclosure provides for, and includes, a container of a Bos taurus inseminate comprising a plurality of sperm cells having attributes of Bos taurus semen variety HO840003150607238 wherein a sample of cells of said variety has been deposited under ATCC Accession No. PTA-125702.

The disclosure provides for, and includes, the distinguishing attributes of the inseminates of the present disclosure in Table 7. The unexpected and desirable combination of attributes is particularly valuable for dairy herd improvement and breeding purposes.

TABLE 7

Composite scores, linear trait scores and genomic results for HO840003150607238

| | Sex id17 | M HO840003150607238 |
|---|---|---|
| | Birth Date | 2018 Jun. 03 |
| TPI | TPI | 2905 |
| Net Merit Score | NM$ | 1131 |
| productive life | PL | 8.4 |
| somatic cell score | SCS | 2.57 |
| Daughter Pregnancy Rate | DPR | 1.2 |
| Cow Livability | LIV | 4.5 |
| PTA MILK | Milk | 1351 |
| PTAF | Fat | 127 |
| PTAP | Pro | 57 |
| Heifer Conception Rate | HCR | 2.5 |
| cow conception rate | CCR | 3.7 |
| STA dairy form | STA | −0.50 |
| Strength | STR | −0.72 |
| Body Depth | BDE | −0.87 |
| Dairy Form | DFM | 0.77 |
| Rump Angle | RPA | −0.61 |
| | TRW | −0.38 |
| | RLS | −1.15 |
| | RLR | 1.35 |
| Fore Udder Height | FTA | 0.43 |
| PTA Type | PTAT | 1.21 |
| Fore Udder Attachment | FUA | 1.42 |
| Rear Udder Height | RUH | 1.74 |
| Rear Udder Width | RUW | 1.60 |
| Udder Cleft | UCL | 0.84 |
| Udder Depth | UDP | 1.03 |
| Front Teat Placement | FTP | 0.95 |
| Teat Length | TLG | −2.20 |
| Feet Leg Score | FLS | 1.33 |
| Rear Teat Placement | RTP | 0.79 |
| Sire Calving Ease | SCE | 6.6 |
| Service Sire Stillbirth | SSB | 7.1 |
| Daughter Stillbirth | DSB | 3.9 |
| Daughter Calving Ease | DCE | 3.1 |
| Udder Composite Index | UDC | 1.42 |
| Feet & Legs Composite | FLC | 1.49 |
| TPI Formula | TPI | 2905 |
| Brachyspina/FANCI | HH0 | T |
| APAF1 | HH1 | T |
| — | HH2 | T |
| SMC2 | HH3 | T |
| GART | HH4 | T |
| — | HH5 | T |
| BLAD/ITGB2 | HHB | T |
| CVM/SLC35A3 | HHC | T |
| DUMPS/UMPS | HCD | 0 |
| Mulefoot/LRP4 | HHM | T |
| red color/MC1R | HRR | T |
| Polledness/POLLED | HHP | T |
| | HBR | T |
| | HDR | T |
| | naab_code | 29HO19060 |
| | Dam Name | ABS 7405 ACAPELLA-ET |
| | Sire | TORQUE |
| | MGS | YODER |
| | Milk Fever | −0.5 |
| | DAb | 0.2 |
| | Ketosis | 1.1 |
| | Mastitis | 2.0 |
| | Metritis | 3.0 |
| | Retained Placenta | 0.2 |

The present disclosure provides for, and includes, F1 progeny animals, and parts thereof comprising a diploid or haploid genome wherein the diploid genome comprises loci comprising 90% to 100% of the nucleic acid sequences selected from the group consisting of SEQ ID NOs:1 to 29048, and said F1 haploid genome having loci that comprise at least 25% of the nucleic acid sequences selected from the group consisting of SEQ ID NOs:1 to 29048. F1 progeny animals are obtained by crossing a first parent animal prepared by somatic cell nuclear transfer or breeding of the Bos taurus cells of the present application with a second parent.

F1 progeny animals obtained from crosses of Bos taurus animals having the Animal Genotype of the present application with elite DM animals (or SM animals for female germplasm) are likely to retain many loci in their homozygous state. Moreover, as nearly all elite DM (and SM) animals are genotyped, a breeder can predict prior to the cross whether progeny will share the desired loci and estimate the expected number of homozygous loci. In most aspects, these valuable F1 progeny are subsequently screened and the most desirable elite F1 progeny identified and selected for maintaining the DM (or SM herd) and for further improvement. Thus breeding strategies and decisions, informed by genomic data, can be made to continuously improve the germplasm and further, to lock in trait combinations by fixing homozygous alleles. Analysis and selection are necessary to not only make further improvements in breeding stock, but to maintain existing breeding stock quality. The animals of the present disclosure and those bred and selected from them do not occur naturally. Rather, under natural conditions, populations revert towards homogeneity. See Park et al., "Genome sequencing of the extinct Eurasian wild aurochs, Bos primigenius, illuminates the phylogeography and evolution of cattle," *Genome Biology* 16:234 (2015) Feral cattle (i.e., cattle not selected in breeding programs) are genetically distinct. See MacNeil et al., "Genetic relationships between feral cattle from Chirikof Island, Alaska and other breeds," *Animal Genetics* 38:193-197 (2007).

Thus, the present disclosure provides for, and includes, methods of breeding and selection to retain the homozygous alleles of Animal Genotype and generate new homozygous alleles from among the heterozygous loci selected from the group consisting of SEQ ID NO:29049 to 41648. In select crosses with elite second parents (e.g., a DM or SM second parent), selection of preferred traits comprising homozygous loci comprising at least 40% of the nucleic acid sequences selected from the group consisting of SEQ ID NOs:1 to 29067. Further, for an F1 progeny of Animal, the probability of any individual heterozygous locus becoming homozygous is either 50% when crossed with a second parent that is homozygous at a locus. When the second parent is heterozygous at a locus, there is a 25% probability of generating homozygosity at a locus. Thus, over time, the total number of homozygous loci will increase in select crosses.

Also provided for, and included in, the present disclosure, are F1 progeny animals that have desirable EBV or GEBV scores. Such animals are important Sires of females (SF) that are useful for breeding commercial herds and populations. Like breeding F1 progeny for the production of DM and SM animals, the second parent is a select parent, however it is not an elite parent. Select parents for the production of F1 progeny animals that are either SF or DF animals have positive EBV scores for one or more PTA traits selected from the group consisting of productive life (PL), somatic cell score (SCS), Daughter Pregnancy Rate (DPR), PTA MILK (Milk), PTAF (Fat), PTAP (Pro), and STA dairy form (STA).

As used herein, the term "HO840M003150607238 F1 Diploid Genotype" or "Animal F1 Diploid Genotype" provides for, and includes, a diploid F1 Bos taurus cells or a plurality of diploid Bos taurus cells comprising improved germplasm characterized by a genome having loci comprising 90% to 100% of the nucleic acids selected from the group selected from SEQ ID NOs:1 to 29048. In an aspect, an Animal F1 Diploid Genotype comprises at least 90% of the loci nucleic acid sequences selected from the group consisting of SEQ ID NOs:1 to 29048. In another aspect, an Animal F1 Diploid Genotype comprises at least 95% of the loci nucleic acid sequences selected from the group consisting of SEQ ID NOs:1 to 29048. In other aspects, an Animal F1 Diploid Genotype comprises at least 97% of the loci nucleic acid sequences selected from the group consisting of SEQ ID NOs:1 to 29048. In a further aspect, an Animal F1 Diploid Genotype comprising at least 97% of the loci nucleic acid sequences selected from the group consisting of SEQ ID NOs:1 to 29048. In yet a further aspect, an Animal F1 Diploid Genotype comprises at least 98% of the loci nucleic acid sequences selected from the group consisting of SEQ ID NOs:1 to 29048. In another aspect, an Animal F1 Diploid Genotype comprising at least 99% of the loci nucleic acid sequences selected from the group consisting of SEQ ID NOs:1 to 29048. In yet another aspect, an Animal F1 Diploid Genotype comprising at least 99.5% of the loci nucleic acid sequences selected from the group consisting of SEQ ID NOs:1 to 29048. In certain aspects, an F1 progeny animal of the present disclosure comprises an Animal F1 Diploid Genotype that comprises the nucleic acid sequences selected from the group consisting of SEQ ID NOs:1 to 29048. In an aspect, the F1 progeny animal, or part thereof, is an F1 progeny animal of Bos taurus variety HO840M003150607238, wherein a sample of cells of said variety has been deposited under ATCC Accession No. PTA-125702. As provided herein, the present specification provides for parts of F1 progeny animals including cells, cell cultures, and tissues. Also provided are frozen samples of parts of F1 progeny animals. Cells of F1 progeny animals include somatic cells and haploid germ cells (e.g., sperm and ova depending on the sex). In certain aspects, the Bos taurus cells of an F1 progeny animal are non-reproductive cells.

The present disclosure further provides for, and includes, F1 progeny animals, or parts thereof, further comprise a Net Merit index (NM$) of at least 1000 or a Total Performance Index (TPI) of at least 2000. In an aspect, the F1 progeny animals, or parts thereof, comprise a Net Merit index (NM$) of at least 800. In a further aspect, the F1 progeny animals, or parts thereof, comprise a Net Merit index (NM$) of at least 900.

The present disclosure further provides for, and includes, F1 progeny animals, or parts thereof, comprising a diploid genome comprising between homozygous loci at between 40% and 80% of the nucleic acid sequences selected from the group consisting of SEQ ID NOs:1 to 29048. In another aspect, the F1 progeny comprise homozygous loci at least 50% of the nucleic acid sequences selected from the group consisting of SEQ ID NOs:1 to 29048. In yet another aspect, the F1 progeny comprise homozygous loci at least 60% of the nucleic acid sequences selected from the group consisting of SEQ ID NOs:1 to 29048. In some crosses, the F1 progeny comprise homozygous loci at least 70% of the nucleic acid sequences selected from the group consisting of SEQ ID NOs:1 to 29048. In an aspect, F1 progeny can comprise homozygous loci at least 80% of the nucleic acid sequences selected from the group consisting of SEQ ID NOs:1 to 29048. In certain aspect, F1 progeny comprise between 60 and 80% of the nucleic acid sequences selected from the group consisting of SEQ ID NOs:1 to 29048 that are homozygous. In certain aspects, an animal having an Animal Genotype is crossed to a DM or SM animal, wherein said an F1 Animal comprises a genome having at least 90% of the loci comprising the nucleic acid sequences selected from the group consisting of SEQ ID NOs: 1 to 29048, and at least 45% of said loci are homozygous. In certain aspects, an animal having an Animal Genotype is crossed to a DM or SM animal, wherein said an F1 Animal comprises a genome having at least 95% of the loci comprising the nucleic acid sequences selected from the group consisting of SEQ ID NOs: 1 to 29048, and at least 55% of said loci are homozygous. In other aspects, an animal having an Animal Genotype is crossed to a DM or SM animal, wherein said an F1 Animal comprises a genome having at least 95% of the loci comprising the nucleic acid sequences selected from the group consisting of SEQ ID NOs: 1 to 29048, and at least 65% of said loci are homozygous. In certain aspects, the second parent is selected that comprises Net Merit index (NM$) of at least 1000, a Total Performance Index (TPI) of at least 2000 in any given progeny generation. In aspects of the present disclosure, the F1 progeny animals comprise a Net Merit index (NM$) of at least 1000 or a Total Performance Index (TPI) of at least 2000.

The present disclosure further provides for, and includes, methods to prepare improved F1 progeny animals comprising selecting a second parent having a Net Merit index (NM$) of at least 1000 or a Total Performance Index (TPI) of at least 2000. In an aspect, the second parent comprises a Net Merit index (NM$) of at least 800. In a further aspect, the second parent comprises a Net Merit index (NM$) of at least 900.

The present disclosure further provides for, and includes, F1 progeny that are F1 hybrid animals. As used herein, an F1 hybrid animal is an animal comprising an Animal Haploid Genotype and a haploid genome of an animal that is not a Holstein breed. In an aspect, the second parent of the hybrid a Bos indicus breed. In an aspect, the second parent is a member of a breed selected from the group consisting of Angus (ANG), Beef Shorthorn (SHR), Belgian Blue (BBL), Belted Galloway (BGA), Brahman (BRM), British Shorthorn (BSHN), Brown Swiss (BSW), Dutch Belted (DBE), Dutch Friesian(DFR), East Anatolian Red (EAR), English Longhorn (ELO), Finnish Ayrshire(FAY), French Brown Swiss (BRU), Galloway (GAL), Gascon (GAS), Guernsey (GNS), Hereford (HFD), Jersey (JER), Limousin (LMS), Longhorn (LHR), Milking Shorthorn (MSH), Normande (NOR), Norwegian Red (NRC), Red Angus (RGU), Texas Longhorn (TXL), Wagyu (WAG), and combinations of each.

In aspects according to the present disclosure, included are gametes obtained from F1 progeny of a first parent comprising a diploid genome comprising Animal Genotype and a second parent having a Net Merit index (NM$) of at least 1000 or a Total Performance Index (TPI) of at least 2000. In an aspect, the second parent comprises a Net Merit index (NM$) of at least 800. In a further aspect, the second parent comprises a Net Merit index (NM$) of at least 900. Crosses of Animal Genotype animals to improve select DM and SM animals, results in superior F1 animals having a having an Animal F1 Diploid Genotype. Improved F1 progeny having an Animal F1 Genotype that are produced from select DM animals having loci selected from the group selected from SEQ ID NOs:1 to 29048. Accordingly, in additional to the at least 90% of the loci comprising the nucleic acid sequences selected from the group consisting of SEQ ID NOs: 1 to 29048 provided by Animal, a DM animal provides loci comprising nucleic acids selected from the group consisting of SEQ ID NOs: 1 to 29048 provides for the generation of homozygous loci. In an aspect, the number of homozygous loci thus generated is at least 25%.

As used herein, the term "HO840M003150607238 F1 Haploid Genotype" or "Animal F1 Haploid Genotype" provides for, and includes, haploid Bos taurus cells or a plurality of haploid Bos taurus cells comprising improved germplasm characterized by a genome comprising between 25% and 100% of the loci selected from the group selected from SEQ ID NOs:1 to 29048. In aspects, an Animal F1 Haploid Genotype comprises between 25% and 45% of the loci selected from the group selected from SEQ ID NOs:1 to 29048. In aspects, the genome comprises at least 30% of the selected loci. In some aspects, the F1 haploid genotype comprises between 25 and 35% of the group of SEQ ID NOs.

In an aspect, the gametes of an F1 progeny animal of the present disclosure comprises an Animal F1 Haploid Genotype having at least 45% of the loci nucleic acid sequences selected from the group consisting of SEQ ID NOs:1 to 29048. In another aspect, the gamete of an F1 progeny animal of the present disclosure comprises an Animal F1 Haploid Genotype of at least 50% of the loci nucleic acid sequences selected from the group consisting of SEQ ID NOs:1 to 29048. In yet another aspect, the gamete of an F1 progeny animal of the present disclosure comprises an Animal F1 Haploid Genotype of at least 55% of the loci nucleic acid sequences selected from the group consisting of SEQ ID NOs:1 to 29048.

As provided herein, gametes of an F1 progeny animal comprise between 55% and 95% of the loci of an Animal F1 Haploid Genotype comprising nucleic acid sequences selected from the group consisting of SEQ ID NOs:1 to 29048. As will be understood by a persons of skill in the art, the smaller the phylogenetic distance between the first parent and second parent, the greater the probability of obtaining progeny having the desirable high levels of desirable loci. As discussed, given the availability of genomic data from a second parent, the expectation of obtaining F1 progeny have high number of homozygous loci can be determined and accordingly the probability of gametes having desired loci determined. In an aspect, gametes of an F1 progeny animal comprise 60% of the loci of the Animal F1 Haploid Genotype. In another aspect, gametes of an F1 progeny animal comprise 70% of the loci of the Animal F1 Haploid Genotype. In yet another aspect, gametes of an F1 progeny animal comprise 75% of the loci of the Animal F1 Haploid Genotype. Other aspects provide gametes of an F1 progeny animal that comprise 80% of the loci of the Animal F1 Haploid Genotype.

The present disclosure provides for, and includes, methods for improving bovine herds by selective breeding. Generally, selective breeding includes mating through natural service, artificial insemination, in vitro fertilization and embryo transfer. As provided herein, selective breeding comprises providing a bull of variety HO840003150607238, or a frozen inseminate thereof, to a second parent, artificially inseminating or inseminating by natural service, and calving a progeny calf. In an aspect, the selective breeding comprises providing an inseminate comprising a sperm having a genome comprising an Animal Haploid Genotype. In another aspect, the disclosure provides for, and includes, providing an F1 inseminate comprising a sperm having a genome comprising an Animal F1 Haploid Genotype. In certain aspects, the second parent is an animal of a herd in need of improvement. Herds in need of improvement generally comprise DF animals having NM$ scores below 900. In an aspect, a herd in need of improvement is commercial herd.

In aspects according to the present disclosure, methods of improving herds further includes testing a second parent for the haplotypes HHB, HHC, HHD, HHM, HBR, and HDR and selecting a second parent lacking one or more haplotypes HHB, HHC, HHD, HHM, HBR, or HDR.

The present disclosure provides for, and includes, a composition comprising a Bos taurus genome comprising an Animal Genotype as recited above. In an aspect, the Bos taurus genome further comprises heterozygous loci comprising at least 90% of the nucleic acid sequences selected from the group consisting of SEQ ID NO: 29049 to 41648. In an aspect, the composition comprises an isolated nucleus or plurality thereof, a cell or plurality thereof, isolated genomic DNA. In some aspects, the composition comprises a Bos taurus genome from a non-reproductive cell.

In other aspects, the present disclosure provides, for and includes, a composition comprising a Bos taurus genome of Animal Genotype. In another aspect, a composition comprises an Animal Haploid Genotype. In a further aspect, a composition comprises an F1 Diploid Genotype. In yet another aspect, a composition comprises an F1 Haploid Genotype. In an aspect, the composition comprises a Bos taurus genome of Bos taurus variety HO840M003150607238, wherein a sample of cells of said variety has been deposited under ATCC Accession No. PTA-125702.

The present disclosure provides for, and includes, a composition comprising a genome comprising an Animal Genotype or an Animal Haploid Genotype as described above but that do not with favorable haplotypes for the traits comprise alleles selected from the group consisting of HHB, HHC, HHD, HHM, HHR, HHP, HBR, and HDR.

The present disclosure provides for, and includes, containers of Bos taurus inseminate comprising a plurality of sperm cells, wherein said plurality of sperm cells have the attributes of Bos taurus variety HO840M003150607238, wherein a sample of cells of said variety has been deposited under ATCC Accession No. PTA-125702. The present specification provides for, and includes, containers of inseminates comprising a sperm having a genome comprising Animal Haploid Genotype. In an aspect, the containers of inseminate comprises Bos taurus sperm comprising at least 90% of each of the recited loci. In an aspect, the containers of inseminate comprises at least 95% of each of the loci. In an aspect, the containers of inseminate comprises at least 97% of each of the loci. In an aspect, the inseminate comprises at least 98% of each of the loci. In an aspect, the containers of inseminate comprises at least 99% of each of the loci. In an aspect, the inseminate comprises at least 99.5% of each of the loci. In an aspect, the containers of inseminate comprises sperm cells from Bos taurus variety HO840M003150607238, wherein a sample of cells of said variety has been deposited under ATCC Accession No. PTA-125702. As provided herein, the inseminate in the containers may be fresh, frozen, or frozen and thawed and may further comprise a component selected from the group consisting of an extender, an antibiotic, a buffer, an energy source, an antioxidant, and a protein source.

The present disclosure further provides for, and includes, containers of Bos taurus inseminates comprising a sperm having a genome comprising an Animal Haploid Genotype as recited above wherein the inseminate is free of recessive haplotype mutations for bovine leucocyte adhesion deficiency (BLAD; haplotype HHB), complex vertebral malformation (CVM; haplotype HHC), deficiency of uridine monophosphate synthase (DUMPS; haplotype HHD), and mulefoot (syndactyly; haplotype HHM), polledness (haplotype HHP), and red coat color (haplotypes HBR, HDR, and HEIR).

Also included are containers of inseminates comprising a sperm having an Animal Haploid Genotype as recited above wherein the sperm of the inseminate is obtained from a bull having a TPI of greater than 2900. In an aspect, the sperm in a container of inseminate is obtained from a bull having a TPI of greater than 2000. In another aspect, the sperm in a container of inseminate is obtained from a bull having a TPI of greater than 2100. In yet another the sperm in a container of inseminate is obtained from a bull having a TPI of greater than 2200. The specification further provides in an aspect, sperm in a container of inseminate obtained from a bull having a TPI of greater than 2300. In yet another aspect, the source of sperm has a TPI of greater than 2400. Other bulls having a TPI of greater than 2500 are further included. Also included are bulls having a TPI of greater than 2600 as sources of sperm of the containers of inseminates. In an aspect, containers of inseminates comprising a sperm having an Animal Haploid Genotype as recited above wherein the sperm of the inseminate is obtained from a bull having a TPI of greater than 2700. In an aspect the TPI of bulls suitable for the inseminates of the present specification range from 2100 to 2900.

The present disclosure provides for, and includes, processes for storing spermatozoa comprising obtaining a Bos taurus ejaculate spermatozoa, each spermatozoa having an Animal Haploid Genotype as recited above, mixing the Bos taurus ejaculate with a composition that induces sperm immotility and an antibiotic to form a sperm dispersion. In an aspect, the Bos taurus ejaculate is an ejaculate of a bull of Bos taurus variety HO840M003150607238, wherein a sample of cells of said variety has been deposited under ATCC Accession No. PTA-125702. In another aspect, the spermatozoa comprise an Animal F1 Haploid Genotype as recited above. In another aspect, the spermatozoa comprise an Animal F1 Haploid Genotype comprising at least 55% of the recited nucleic acid sequences. In another aspect, the spermatozoa comprise an Animal F1 Haploid Genotype comprising at least 60% of the recited nucleic acid sequences. In yet another aspect, the spermatozoa comprise an Animal F1 Haploid Genotype comprising at least 65% of the recited nucleic acid sequences. In yet another aspect, the spermatozoa comprise an Animal F1 Haploid Genotype comprising at least 70% of the recited nucleic acid sequences. In other aspects, the spermatozoa comprise an Animal F1 Haploid Genotype comprising at least 75% of the nucleic acid sequences. Other aspects provide for spermatozoa comprising an Animal F1 Haploid Genotype comprising at least 80% of the nucleic acid sequences. Further aspects provide for spermatozoa comprising an Animal F1 Haploid Genotype comprising at least 85% of the recited nucleic acid sequences. In addition, the disclosure provides spermatozoa comprising an Animal F1 Haploid Genotype comprising at least 90% of the recited nucleic acid sequences. Other aspects provide for obtaining a Bos taurus ejaculate comprising spermatozoa comprising an Animal F1 Haploid Genotype comprising at least 95% of the recited nucleic acid sequences. Further aspects provide for spermatozoa comprising an Animal F1 Haploid Genotype comprising at least 99% of the nucleic acid sequences selected from the group consisting of SEQ ID NOs:1 to 17199. As provided herein, the sperm dispersions may further comprise one or more components selected from the group consisting of a cryoprotectant, an extender, an antibiotic, a buffer, an energy source, an antioxidant, and a protein source. In aspects of the present disclosure, the number of cells in a sperm dispersion comprise 1000 or more, $10^4$ or more, $10^5$ or more, or $10^6$ or more cells. In an aspect, the cells are in a container and comprise between $10^4$ and $10^7$ cells. In an aspect, the number of cells is between $10^5$ and $10^7$ cells.

The process for storing spermatozoa further includes preparing a straw or sheath having a volume of sperm dispersion and freezing the sperm dispersion containing straw prior to storing. In an aspect, the volume of sperm dispersion is 0.25 milliliters (ml), 0.50 ml, or any volume between 0.1 and 1 ml. As provided by the present specification, the storing comprises maintaining the sperm dispersion at a temperature of −196° C. Also included, and provided for, in the process for storing spermatozoa is sorting said spermatozoa into X-chromosome or Y-chromosome enriched inseminate. In certain aspects, the process may further comprise removing immotile spermatozoa. In aspects of the present disclosure, the number of cells in a straw, sheath or container comprises between $1 \times 10^6$ to $100 \times 10^6$ cells. In an aspect, the cells are in a straw, sheath or container and comprise between $10^4$ and $10^7$ cells. In an aspect, the number of cells in straw, sheath or container is between $10^5$ and $10^7$ cells.

The present disclosure provides for, and includes a combination comprising an elongated container for use in the insemination of a Bos taurus dam and a sperm dispersion comprising a plurality of sperm, each sperm comprising a genome comprising an Animal Haploid Genotype or an Animal F1 Haploid Genotype, wherein said sperm dispersion comprises immotile spermatozoa and a composition that induces sperm immotility, and wherein the sperm dispersion is contained in the elongated container. In an aspect, the concentration of spermatozoa in the sperm dispersion is between about $0.04 \times 10^6$ sperm/ml to about $12 \times 10^7$ sperm/ml. In an aspect, the composition that induces sperm immotility comprises potassium and optionally sodium, the molar ratio of potassium to sodium being greater than 1:1, respectively. In an aspect, the composition that induces sperm immotility comprises potassium and optionally sodium, the molar ratio of potassium to sodium being greater than 1.75 to 1.0. Also provided for in the combination are sperm dispersions comprising a source of carbonate. In an aspect, the source of carbonate comprises $NaHCO_3$, $KHCO_3$, and $C_6H_8O_7$. In an aspect, the sperm dispersions comprise a buffer comprising 0.097 moles/L of $NaHCO_3$, 0.173 moles/L of $KHCO_3$, and 0.090 moles/L $C_6H_8O_7 \cdot H2O$ in water.

The present disclosure provides for, and includes, methods of inseminating a Bos taurus dam comprising thawing a frozen inseminate comprising a plurality of sperm cells, each sperm cell having a genome an Animal Haploid Genotype or an Animal F1 Haploid Genotype and artificially inseminating a dam with said thawed inseminate to produce an F1 bovine calf or an F2 bovine calf respectively. In an aspect, the method includes providing a plurality of sperm cells that comprise an Animal Haploid Genotype or an Animal F1 Haploid Genotype comprising at least 55% of the recited nucleic acid sequences. In another aspect, the method includes providing a plurality of sperm cells that comprise an Animal Haploid Genotype or an Animal F1 Haploid Genotype comprising at least 60% of the recited nucleic acid sequences. In yet another aspect, the method includes providing a plurality of sperm cells that comprise an Animal Haploid Genotype or an Animal F1 Haploid Genotype comprising at least 65% of the recited nucleic acid sequences. In yet another aspect, the method includes providing a plurality of sperm cells that comprise an Animal Haploid Genotype or an Animal F1 Haploid Genotype comprising at least 70% of the recited nucleic acid sequences. In other aspects, the method includes providing a plurality of sperm cells that comprise an Animal Haploid Genotype or an Animal F1 Haploid Genotype comprise at least 75% of the nucleic acid sequences. Other aspects of the method provide for sperm cells comprising an Animal Haploid Genotype or an Animal F1 Haploid Genotype comprising at least 80% of the nucleic acid sequences. Further aspects provide sperm cells comprising an Animal Haploid Genotype or an Animal F1 Haploid Genotype comprising at least 85% of the recited nucleic acid sequences. In addition, the methods provide sperm cells comprising an Animal Haploid Genotype or an Animal F1 Haploid Genotype comprising at least 90% of the nucleic acid sequences. Other aspects provide a frozen inseminate prepared from a Bos taurus ejaculate comprising spermatozoa comprising an Animal Haploid Genotype or an Animal F1 Haploid Genotype comprising at least 95% of the recited nucleic acid sequences. Further aspects provide for sperm cells comprising an Animal Haploid Genotype or an Animal F1 Haploid Genotype comprising at least 99% of the recited nucleic acid sequences. As provided herein, the inseminate suitable for the methods of insemination may further comprise one or more components selected from the group consisting of a cryoprotectant, an extender, an antibiotic, a buffer, an energy source, an antioxidant, and a protein source.

The present disclosure provides for, and includes, methods for preparing transgenic animals. Also provided for, and included, are transgenic animals having an Animal Genotype and an Animal F1 Diploid Genotype as recited above. Also included, and provided for, are haploid cells comprising a transgene comprising an Animal Haploid Genotype and an Animal F1 Haploid genotype as recited above.

As used herein, "transgenic animal, cell or tissue" includes reference to animals which comprises within its genome a gene encoding a heterologous polynucleotide. Generally, the gene is stably integrated within the genome such that the expression of the polynucleotide is passed on to successive generations. The gene may be integrated into the genome alone or as part of a recombinant expression cassette. "Transgenic" is used herein to include any cell, cell line, tissue, or organ, the genotype of which has been altered by the presence of heterologous nucleic acid including those transgenics initially so altered as well as those created by sexual crosses or asexual propagation from the initial transgenic. The term "transgenic" as used herein does not encompass the alteration of the genome (chromosomal or extrachromosomal) by conventional breeding methods or by naturally occurring events such as random cross-fertilization, non-recombinant viral infection, non-recombinant bacterial transformation, non-recombinant transposition, or spontaneous mutation. The transgene can be introduced into the genomes of the present disclosure directly or through breeding with a transgene containing animal. Methods to prepare transgenic animals are known in the art, for example by pronucleus injection as described by Gordon et al., "Genetic transformation of mouse embryos by microinjection of purified DNA. Proc. Natl. Acad. Sci. USA 77:7380-7384 (1980). Pronucleus injection has been shown to be suitable for large domestic animals including pigs and cattle. See Hammer et al., "Production of transgenic rabbits, sheep and pigs by microinjection," Nature 315: 680-683 (1985) and Niemann, "Transgenic pigs expressing plant genes," Proc Natl Acad Sci USA 101:7211-7212 (2004). Other methods of generating transgenic animals are known in the art. See Park, et al., "Role of stem cells in large animal genetic engineering in the TALENs-CRISPR era," Reprod Fertil Dev 26:65-73 (2013).

Also provided, for and included, are gene edited animals having an Animal Genotype. Gene edited animals are non-transgenic animals. The animals of the present disclosure can be gene-edited animals having an Animal Genotype, an Animal F1 Diploid Genotype, an Animal Haploid Genotype and an Animal F1 Haploid genotype as recited above. Suitable methods for gene editing are known in the art. Methods include, but are not limited to, the methods provided in International Patent Publication No. WO 2015/148761 published Oct. 1, 2015, U.S. Pat. No. 9,868,962, published Jan. 16, 2018, and International Patent Publication No. WO 2017/132239 published Mar. 8, 2017, and references cited therein, all of which are incorporated by reference.

The following are non-limiting exemplary embodiments of the present disclosure:

1. The present disclosure provides for a plurality of Bos taurus cells comprising each cell having a genome comprising homozygous loci comprising at least 90% of the nucleic acid sequences selected from the group consisting of SEQ ID NOs:1 to 29048.
2. The plurality of Bos taurus sperm cells according to embodiment 1, further comprising heterozygous loci comprising at least 90% of the nucleic acid sequences selected from the group consisting of SEQ ID NO: 29049 to 41648.
3. The plurality of Bos taurus cells according to embodiment 1 or 2, wherein said cells comprise a frozen vial, a cell culture, a tissue, a zygote, an embryo, a calf, or a mature adult.
4. A plurality of Bos taurus gamete cells comprising at least 90% of the loci comprising the nucleic acid sequences selected from the group consisting of SEQ ID NOs:1 to 29048.
5. The plurality of Bos taurus gamete cells according to embodiment 4, wherein said gamete cells are cryopreserved.
6. The plurality of Bos taurus cells according to embodiment 4 or 5, wherein said cells comprise a cryopreserved bovine inseminate or a cryopreserved oocyte.
7. An F1 Bos taurus animal, or part thereof, said F1 Bos taurus animal comprising a genome comprising at least 90% of the loci comprising the nucleic acid sequences selected from the group consisting of SEQ ID NOs: 1 to 29048.
8. The F1 Bos taurus animal, or part thereof, according to embodiment 7, wherein said genome comprises the haploid genome of a parent Bos taurus animal having a Net Merit Index (NM$) of at least 1000.
9. The F1 Bos taurus animal, or part thereof, according to embodiment 7 or 8, wherein said F1 Bos taurus animal is prepared by artificial conception.
10. The F1 Bos taurus animal, or part thereof, according to any one of embodiments 7 to 9, wherein said artificial conception is in vitro fertilization and implantation, Artificial Insemination (AI), or in vivo insemination and embryo transfer (ET).
11. The F1 Bos taurus animal, or part thereof, according to any one of embodiments 7 and 10, wherein said part thereof is an isolated oocyte or a plurality of sperm.
12. The F1 Bos taurus animal, or part thereof, according to any one of embodiments 7 to 11, wherein said plurality of sperm comprise a genome comprising at least 45% of the loci comprising the nucleic acid sequences selected from the group consisting of SEQ ID NOs: 1 to 29048.

13. A Bos taurus inseminate composition comprising a cryoprotectant and semen of Bos taurus variety HO840M003150607238, wherein a sample of cells of said variety has been deposited under ATCC Accession No. PTA-125702.

14. An F1 Bos taurus inseminate comprising at least half of a haploid genome of Bos taurus variety HO840M003150607238, wherein a sample of cells of said variety has been deposited under ATCC Accession No. PTA-125702.

15. The F1 Bos taurus inseminate according to embodiment 14, wherein said inseminate comprises an F1 Haploid Genotype comprising 25% and 50% of the loci selected from the group selected from SEQ ID NOs:1 to 29048.

16. A Bos taurus animal, or part thereof, comprising one or more cells having at least 25% of the loci comprising nucleic acid sequences selected from the group consisting of SEQ ID NOs:1 to 29048.

17. The Bos taurus animal, or part thereof, according to embodiment 16, wherein said loci are obtainable from Bos taurus variety HO840M003150607238, wherein a sample of cells of said variety has been deposited under ATCC Accession No. PTA-125702.

18. The Bos taurus animal, or part thereof, according to any one of embodiments 16 or 17, prepared by crossing a bull of Bos taurus variety HO840M003150607238, wherein a sample of cells of said variety has been deposited under ATCC Accession No. PTA-125702 with a second parent to obtain an F1 progeny animal and crossing said F1 progeny animal with a second parent, and obtaining a Bos taurus animal comprising at least 25% of the loci comprising nucleic acid sequences selected from the group consisting of SEQ ID NOs: 1 to 29048.

19. The Bos taurus animal, or part thereof, according to any one of embodiments 16 to18, wherein said second parent has a Net Merit score (NM$) of at least 1000 or Total Performance Index (TPI) of at least 2000.

20. A plurality of Bos taurus cells, each comprising a diploid or haploid genome
each diploid genome comprising homozygous loci comprising at least 90% of the nucleic acid sequences selected from the group consisting of SEQ ID NOs: 1 to 29048; and
each haploid genome comprising at least 90% of the loci comprising the nucleic acid sequences selected from the group consisting of SEQ ID NOs: 1 to 29048.

EXAMPLES

Example 1: Genomic Characterization of Bos Taurus Cells

The genotype of HO840003150607238 was determined using the Illumina Infinium HTS BeadChip microarray system using the BovineSNP50 v3 BeadChip microarray kit (BeadChip) according to manufacturer's instructions. The BeadChip contains 53,714 highly informative SNP probes uniformly distributed across the entire genome of major cattle breed types at a median spacing of 37.4 kb. The SNP probes are validated in 18 common beef and dairy breeds. The BeadChip is a collaboration of Illumina, the USDA-ARS, the University of Missouri, and the University of Alberta. More than 22,000 SNP probes target novel SNP loci found in pooled populations of economically important beef and dairy cattle. The BeadChip is well known and extensively used by those of skill in the art. Other suitable genotyping chips and technologies can be used, including but not limited to the GeneSeek® Genomic Profiler™ High-Density array (GGP HD150K) and the Neogen GGP Bovine 50 k chip that contain 139376 and 47843 SNPs respectively (Neogen Genomics, Lincoln Nebr.).

A wide variety of publically available resources are known in the art including the bovine reference genome (Bovine Genome Sequencing and Analysis Consortium. "The genome sequence of taurine cattle: a window to ruminant biology and evolution. Science 324(5926):522-8), Btau (available at ftp(dot)hgsc(dot)bcm.tmc.edu/pub/data/Btaurus/fasta), and the Bovine HapMap Consortium data set (Bovine HapMap Consortium, "Genome-wide survey of SNP variation uncovers the genetic structure of cattle breeds," Science 324(5926):528-32 (2009) available on the internet at bovinehapmap(dot)org). Analysis tools and sequence data are maintained by the Bovine Genome Database (BGD) that is supported by the European Union's Seventh Framework Programme for research, technological development and demonstration (Grant Agreement No. 613689), and the USDA National Institute of Food and Agriculture. BGD is hosted at the University of Missouri.

TABLE 8

BovineSNP50 BeadChip Sources

| Source | BovineSNP50 v1 Probes | BovineSNP50 v2 Probes | BovineSNP50 v3 Probes |
| --- | --- | --- | --- |
| Novel SNPs [a] | 23,840 | 24,181 | 22,299 |
| Bovine HapMap Data Set | 12,298 | 12,342 | 11,607 |
| Btau Assembly SNPs | 9361 | 9404 | 9086 |
| Whole-Genome Shotgun Reads [b] | 5808 | 6038 | 5485 |
| Holstein BAC Sequence | 1409 | 1411 | 1238 |
| Parentage | 116 | 120 | 200 |
| Other | 1169 | 1113 | 3384 |
| Total | 54,001 | 54,609 | 53,218 |

[a] Derived from sequencing common cattle breeds using the Illumina GenomeAnalyzer.
[b] Obtained from six breeds: Norwegian Red, Holstein, Brahman, Angus, Jersey, and Limousin.

Example 2: Breeding and Selection of HO840003150607238

HO840003150607238 is a progeny animal of a breeding program for the improvement of dairy herds and breeding purposes. HO840003150607238 has the predicted characteristics as provided above in Table 7. The definitions and abbreviations are provided above. HO840003150607238 is an individual of the Holstein breed.

HO840003150607238 is a cross between Sire HO840003135669665 ("Sire") born on Sep. 24, 2016, and Dam HO840003128557405 ("Dam") born on Sep. 16, 2015. The composite scores and linear trait results of Sire and Dam are provided below in Table 9. The genotypes of Sire and Dam are provide above in Table 2 and Table 3. Like HO840003150607238, Sire and Dam are SM and DM animals respectively. Sire comprises homozygous loci comprising the nucleic acid sequences selected from the group consisting of SEQ ID NOs: 41674 to 57882 and heterozygous loci comprising the nucleic acid sequences selected from the group consisting of SEQ ID NOs: 57883 to 71267. Dam comprises homozygous loci comprising the nucleic acid sequences selected from the group consisting of SEQ ID NOs: 82237 to 98750 and heterozygous loci comprising the nucleic acid sequences selected from the group consisting of SEQ ID NOs: 98751 to 122665.

Sire is the progeny of paternal grand-Sire HOUSA000070726929 and paternal grand-Dam HOUSA000072292872. Dam is the progeny of maternal grand-Sire HOUSA000072128216 and maternal grand-Dam HOUSA000072852291. Notably, selective breeding has increased the sire NM$ from below about 950 to over 1100 in HO840003150607238. Other desirable traits are similarly improved.

The genomes, composite traits and other characteristics of the parents and grand-parents are determined using the methods of Example 1 and the results presented below in Table 10.

TABLE 9

Genomic Report for Parents of HO840003150607238

| Sex | Male | Female |
|---|---|---|
| id17 | HO840003138277108 | HO840003127335731 |
| Animal Name | TORQUE | ABS 7405 ACAPELLA-ET |
| Birth Date | 2016 Sep. 24 | 2015 Sep. 16 |
| NM$ | 953 | 1041 |
| PL | 7.9 | 7.5 |
| SCS | 2.49 | 2.85 |
| DPR | 2.8 | 2.8 |
| LIV | 4.6 | 3.5 |
| Milk | 1303 | 1083 |
| Fat | 92 | 120 |
| Pro | 49 | 48 |
| HCR | 1.8 | 4.5 |
| CCR | 4.0 | 5.1 |
| STA | 0.18 | -0.75 |
| STR | -0.66 | -0.45 |
| BDE | -1.00 | -0.70 |
| DFM | -0.12 | 0.84 |
| RPA | 0.66 | -0.11 |
| TRW | -0.40 | -0.31 |
| RLS | -0.67 | -1.56 |
| RLR | 0.42 | 1.27 |
| FTA | 0.43 | 0.12 |
| PTAT | 0.67 | 1.11 |
| FUA | 1.17 | 1.33 |
| RUH | 1.36 | 2.17 |
| RUW | 1.25 | 2.00 |
| UCL | 0.45 | 0.13 |
| UDP | 1.59 | 0.47 |
| FTP | 0.33 | 0.01 |
| TLG | -1.16 | -1.75 |
| FLS | 0.75 | 0.85 |
| RTP | 0.07 | -0.09 |
| SCE | 7.2 | 5.8 |
| SSB | 6.5 | 6.4 |
| DSB | 3.0 | 4.1 |
| DCE | 3.0 | 3.6 |
| UDC | 1.14 | 1.41 |
| FLC | 0.69 | 1.13 |
| TPI | 2714 | 2811 |
| HH0 | T | T |
| HH1 | T | T |
| HH2 | T | T |
| HH3 | T | T |
| HH4 | T | T |
| HH5 | T | C |
| HHB | T | T |
| HHC | T | T |
| HCD | 0 | 0 |
| HHP | T | T |
| HHR | T | T |
| naab_code | 029HO18634 | n/a |
| Dam Name | BUSH-BROS FAIRFAX 5290 | COMPASS-TRT AMRC AE J925-ET |
| Sire | SKYFALL | YODER |
| MGS | FAIRFAX | ALTAEMBASSY |

TABLE 9-continued

Genomic Report for Parents of HO840003150607238

| MilkFever | -0.3 | -0.5 |
|---|---|---|
| DAb | 0.1 | 0.5 |
| Ketosis | 1.2 | 1.6 |
| Mastitis | 2.1 | 0.2 |
| Metritis | 2.4 | 2.9 |
| RetainedPlacenta | 0.1 | 0.1 |

TABLE 10

Genomic Report for Grand Parents of HO840003150607238

| Sex | Paternal Grand Sire | Paternal Grand Dam | Maternal Grand Sire | Maternal Grand Dam |
|---|---|---|---|---|
| id17 | HOUSA00 0070726929 | HOUSA00 0072292872 | HOUSA00 0072128216 | HOUSA00 0072852291 |
| Animal Name | UECKER SUPERSIRE JOSUPER-ET | MELARRY SHOTGLASS FRAZZLE | MR MOGUL DELTA 1427-ET | DE-SU SUPERSIRE 3349-ET |
| Birth Date | 2014 Nov. 17 | 2015 Jan. 28 | 2013 Jan. 05 | 2013 Sep. 30 |
| NM$ | 938 | 691 | 904 | 758 |
| PL | 6.2 | 6.7 | 5.2 | 5.3 |
| SCS | 2.61 | 2.55 | 3.04 | 2.72 |
| DPR | 1.4 | 2.7 | 1.8 | 0.8 |
| LIV | 3.2 | 3.5 | 0.6 | 2.8 |
| Milk | 1780 | 1011 | 1171 | 1208 |
| Fat | 107 | 52 | 105 | 89 |
| Pro | 56 | 39 | 51 | 45 |
| HCR | 2.0 | 0.8 | 3.9 | 1.6 |
| CCR | 2.5 | 3.3 | 4.3 | 1.7 |
| STA | 1.35 | -0.13 | 0.50 | 0.43 |
| STR | 0.60 | -0.27 | -0.02 | 0.20 |
| BDE | 0.28 | -0.92 | -0.11 | -0.19 |
| DFM | 0.88 | -0.92 | 1.34 | 0.71 |
| RPA | -0.25 | 1.05 | 1.84 | -0.94 |
| TRW | 0.47 | -0.38 | 0.14 | 0.79 |
| RLS | 0.10 | -1.80 | -2.61 | -0.28 |
| RLR | 1.01 | 1.12 | 2.27 | 0.44 |
| FTA | 1.43 | 0.88 | 0.84 | 0.32 |
| PTAT | 1.79 | 0.22 | 1.86 | 1.13 |
| FUA | 1.62 | 0.99 | 2.19 | 1.31 |
| RUH | 2.43 | 0.80 | 3.32 | 2.08 |
| RUW | 2.24 | 0.74 | 3.05 | 1.91 |
| UCL | 1.32 | -0.40 | 0.60 | 0.89 |
| UDP | 1.55 | 1.27 | 1.25 | 1.18 |
| FTP | 0.73 | -0.37 | 1.68 | -0.56 |
| TLG | -1.55 | 0.12 | -3.06 | 0.64 |
| FLS | 1.39 | 0.84 | 1.54 | 0.40 |
| RTP | 0.59 | -0.45 | 1.41 | -0.07 |
| SCE | 9.2 | 6.3 | 5.9 | 8.6 |
| SSB | 8.0 | 6.3 | 5.9 | 8.4 |
| DSB | 3.5 | 4.4 | 3.7 | 5.9 |
| DCE | 3.6 | 3.4 | 3.4 | 5.9 |
| UDC | 1.55 | 0.77 | 2.06 | 1.37 |
| FLC | 1.16 | 1.03 | 1.69 | 0.36 |
| TPI | 2774 | 2421 | 2730 | 2511 |
| HH0 | T | T | T | T |
| HH1 | T | T | T | T |
| HH2 | T | T | T | T |
| HH3 | T | T | T | T |
| HH4 | T | T | T | T |
| HH5 | T | T | T | C |
| HHB | T | T | T | T |
| HHC | T | T | T | T |
| HCD | 0 | 0 | 0 | 0 |
| HHP | T | T | T | T |
| HHR | T | T | T | T |
| naab_code | 029HO17918 | | 007HO12266 | |
| Dam Name | DE-SU MCCUTC HEN 2352-ET | BUSH-BROS SUPERSIRE 4624-ET | WOODCREST PLANET YAKARA-ET | SEAGULL-BAY MISS AMERICA-ET |

TABLE 10-continued

Genomic Report for Grand Parents of HO840003150607238

| Sire | JOSUPER | FAIRFAX | MOGUL | ALTAEMB ASSY |
|---|---|---|---|---|
| MGS | MCCUTC REN | SUPERSIRE | PLANET | ROBUST |
| MilkFever | −0.3 | −0.2 | −0.4 | −0.5 |
| DAb | 0.4 | 0.6 | 0.5 | 0.1 |
| Ketosis | 1.2 | 1.6 | 1.5 | 0.7 |
| Mastitis | 1.2 | 2.2 | −1.3 | 2.0 |
| Metritis | 1.9 | 2.7 | 2.8 | 1.5 |
| RetainedPlacenta | 0.1 | 0.0 | 0.1 | 0.0 |

Example 3: Culture of Bos Taurus Cells

Adult Bos taurus fibroblast cultures are established from ear punch or tail clip from HO840003150607238 at an age of less than one year according to standard methods.

Briefly, an ear punch or tail clip is treated with collagenase and digested. The collagenase treated cells are they collected by centrifugation and washed with buffered saline. The washed cells are treated with trypsin and triturated and a suspension of cells plated on standard culture dishes and cultured under standard conditions to prepare a primary culture. The cells are cultured and either fed or split 1:4 to 1:6 and the culture expanded. Cells are harvested when the culture reaches at least 10 million. At confluence, cells are collected by trypsin/EDTA treatment and centrifugation. Cells are resuspended and counted and then collected and resuspended a concentration of $1\times10^6$-$10^7$/mL. Cells are diluted with freezing medium (90% FBS+10% DMSO). Tubes are transferred to −80° C. overnight before being placed in liquid nitrogen for long term storage. A representative sample of culture prepared using these methods was deposited to the American Tissue Type Collection (ATCC) under Accession No. PTA-125702 on Feb. 21, 2019. The address for the ATCC is 10801 University Boulevard, Manassas, Va. 20110-2209.

Example 4: Somatic Cell Nuclear Transfer (SCNT) of Animal Cells

Somatic cell nuclear transfer (SCNT) is performed according the method of Ross and Cibelli, "Bovine Somatic Cell Nuclear Transfer," *Methods Mol Biol.* 636. 155-77 (2010). See also U.S. Pat. No. 6,011,197 issued Jan. 4, 2000, to Strelchenko et al.

Briefly, five to seven days before performing SCNT, a culture of fibroblasts as described in Example 3 are plated in four well dishes at a density of 100,000 cells per well and cultured. The cells are synchronized in the G0 stage by contact inhibition. Oocytes are harvested from either slaughterhouse-derived ovaries or from live animals by ultrasound-guided oocyte aspiration. The oocytes are matured in vitro and enucleated. The cultured fibroblasts are injected in to enucleated oocytes and oocyte-cell fusion is induced using a square DC pulse generator. Fused oocytes are activated using ionomycin and cultured under standard conditions. At 48 h after activation, noncleaved embryos removed from culture and at 72 h after activation, the culture medium is supplemented with serum and cultured for seven days before being recovered and implanted in synchronized recipients. Calves are born normally to the surrogate mother and are genetically identical offspring to Animal. In addition to providing a source of inseminate for herd improvement, new cultures of cells as described in Example 1 can be prepared. The high availability of bovine oocytes and the relatively higher efficiency levels usually obtained in cattle provide for the use of SCNT for both commercial and research purposes.

Example 5: Breeding of Animal Progeny

Mature bulls prepared by the methods of the present specification are used for breeding purposes using conventional artificial insemination methods. Alternatively, bulls prepared by SCNT can be used for natural service.

Frozen inseminate obtained as provided below in Example 7 is provided for artificial insemination for the improvement of existing herds. Breeding for the improvement of existing herds does not generally require consideration of the recipient heifer or cow. In an aspect, a Dam is selected from a herd in need of improvement and artificially inseminated with Animal inseminate. In an aspect, a herd in need of improvement has an average NM$ index of less than 700. In an aspect, a herd in need of improvement has an average NM$ index of between 700 and 1000. After gestation, calves are born and evaluated for production, composite traits, and predicted transmitting abilities. In some cases, genomic testing is performed. The resulting calves have improved NM$ and other desirable traits as compared to the parent dam and as compared to other calves born in the herd.

The frozen inseminate obtained as provided below in Example 7 is also used for the generation of elite bulls and heifers. Frozen inseminate obtained as provided below in Example 7 is provided for artificial insemination to an elite DM animal having an NM$ index of at least 900. After gestation, the calf is genotyped and identified for predicted characteristics, composite traits, and predicted transmitting abilities. A calf having improved traits is selected and used for further breeding and for the improvement of existing herds.

Example 6: Characterization of LOCI

The sequence listing provides the results of the genotyping. Each sequence represents the sequence of a single SNP and the adjacent 100 base pairs (bp) of sequence on either side of the SNP. The sequences are listed first by homozygous alleles then heterozygous alleles and sorted by chromosome. Thus, SEQ ID NO:1 is the genotype of Animal at a first allele. Genomic sequences matching SEQ ID NO:1 are identified by BLAST search of the Bovine Genome Database (available online at bovinegenome(dot)org/bgd-_blast/) using any of the five available nucleotide datasets, but most conveniently using the Bos taurus UMD3.1 chromosome assembly with an e-value cuttoff of $10\times10^{-10}$. Blast identifies sequence GK000007.2, chromosome 7 having significant alignment (e.g., e-value of $1.42\times10^{-98}$ and total score of 363.76). Notably, as all the sequences in the sequence listing comprise sequences of 201 bp, the e-value and score for each sequence searched will be the same and dependent on the size of the sequence database. The sequence match identifies base number 41741927 as the start of the matching sequence and base 41742127 as the last matching base in a region of 100% identity without gaps. From the BLAST results, the matching sequence can be viewed in the genome browser, JBrowse, which allows for an extensive set of details to displayed, including polymorphisms from the Bovine HapMap SNP50 and the dbSNP databases. Analysis identifies the allelic locus at base position 101 (the SNP) corresponding to HapMap allelic locus ARS-BFGL-NGS-69727 and dbSNP allelic locus rs109034414. Analysis shows that SEQ ID NO:1 comprises the 'G' allele at this site. Thus, Animal is homozygous 'G' at the rs109034414/ARS-BFGL-NGS-69727 SNP locus ("the rs109034414 locus").

The BGD provides extensive information about the rs109034414 locus through "BovineMine," an integrated data warehouse for the BGD. From BovineMine, using either SNP identifier, though more conveniently the dbSNP identifier, information about the variation including aliases and importantly, identification of "Overlapping Features" such as linked genes and traits.

TABLE 11

Overlapping features of SEQ ID NO: 1

| Overlapping Features DB identifier | Feature | Abbreviation | Peak Centimorgan | Inheritance Model |
|---|---|---|---|---|
| 106490 | QTL: Calving ease (maternal) | CALEASE | 50.24 | Mendelian |
| 119779 | QTL: Heifer pregnancy | HPG | 50.19 | Mendelian |
| 31181 | QTL: Cold tolerance | COLDT | 61.47 | Mendelian |

As shown in Table 11, SEQ ID NO:1 is linked to three desirable QTL's, Calving ease, Heifer pregnancy and cold tolerance. Linkage of the sequences of Animal to desirable traits is not surprising given the multigenerational selection program that has led to the production of the elite germplasm. As a homozygous loci, it is more likely to transmit the desirable traits on to the progeny for improvements to existing herds. When bred with elite heifers, Animal's homozygous genes are likely to remain homozygous.

Example 7: Progeny Generation Using in vitro Fertilization and Embryo Transfer

Semen from mature Animal bulls is collected by electroejaculation or by other methods known in the art: The collected semen is frozen in straws per methods known in the art. Progeny are generated by thawing a straw of frozen semen and the thawed semen used for artificial insemination. In short, about 5 ml to about 15 ml of semen is collected from a bull after being electroejaculated and mixed with a suitable extender and cryoprotectant. About 10 ml of semen is collected and mixed with about 240 ml of Triladyl™ solution (Minitube of America in Verona, Wis). The mixture of semen, extender and cryoprotectant is then placed in plastic straws. Straws containing about 20 million motile sperm in a volume of about ½ ml are obtained and frozen until needed. Prior to use, frozen straws are thawed.

The collected semen of the present specification may be frozen according to standard methods in the art as discussed above.

Example 8: Generation of Multiple Embryos by Superovulation and In Vitro Fertilization The Animal inseminate collected as provided in Example 7 is used for in vitro fertilization of oocytes collected from a heifer or cow to create multiple embryos. The heifer or cow is treated with follicle stimulating hormone to induce multiple ovulations. Following superovulation, the donor heifer or cow is bred using artificial insemination of the Animal inseminate. About seven days after insemination, embryos are non-surgically collected by 'flushing' from the donor's uterus and transferred into synchronous recipients that serve as surrogate mothers. Embryos may be frozen for implantation at a later date.

Embryos are also generated using IVF collection of unfertilized oocytes from the ovaries of a donor cow or heifer. Oocytes are fertilized in vitro and transferred seven days after fertilization following incubation under controlled conditions. IVF collection and fertilization allows for the generation of multiple embryos obtained from open cows, pregnant cows, virgin heifers and females having difficulty in conventional breeding. IVF collection also provides for collection of oocytes from donors shortly after death.

Embryos are transferred to a surrogate and gestated until birth.

SEQUENCE LISTING (122589 sequences)

SEQ ID NO: 1 - DNA, 201 bp, Bos taurus
tcccagacatttccccatttctgtattcactgaaccctatcttctgttctgaaaaccatgcacacctgttctctgggtacatctcactgaggcccagttcctccagtctctgggaggctctgtgtccatgcctacaaaacccacacagttattccagttcaggccgcctctccccgcatcccttgtctaagagaaaagcca

SEQ ID NO: 2 - DNA, 201 bp, Bos taurus
tattcttatcaccttgaatgacaaatgagcaaagcaagaaacagagttcaagtgcttcacttcaggttgagtgaacggatggttacctgtgagcctgtgcctcacattttatcaatactttctatcactcttgctaccaagagaaggagaacactgaacaatcacggcattcattaaagacaactcccctgaccgatttct

SEQ ID NO: 3 - DNA, 201 bp, Bos taurus
ataacctactaatttccctgtgtctttctatgtgggtgaattgttttctgcctctttgttctcctaaacatgaaaggagagacacaactgctgtatgtatgctgtgtgtctcaatgacctctggtttttcctcgcatttccccccagtttaggtatttcatcgatgggagcttttcttcttcctgtttctctttccttcaa

SEQ ID NO: 4 - DNA, 201 bp, Bos taurus
cctgagaattcccagaatccataggggcctcaaacacttccatgagaagaggatgggaagacattgtaattggaagagataattgggccaatggctggagcgtgactgttttgcaaaattgagtgtttcagctggtcctagtcatcggacaatggaagggccagcatttggatattcaatcacctcctgaagctgaggatt

SEQ ID NO: 5 - DNA, 201 bp, Bos taurus
gttgtccaaaagatacaaatgtgtgctaagtttgagaaccactgctcttgactgactgactagagcagtactttagactcacctgggagcttgcaaaaaaatactgcctggcctcacctgtctcccattagttcagttcagttcagtcactcagtcgtgtccgactctttgcgaccccatgaatcacagcaccccaggcct

SEQ ID NO: 6 - DNA, 201 bp, Bos taurus
ttgaagttagaagttaaggtaggtttttaattgtgtacagtacatttcctgaggttgtttggcacttaaaatggactggaaagtgagagcagattatgtaaaactgcctatagtagaacctttatgtttattttcaaaatagactattactgaatccattcacaatttgacttctttttccagatgtaattattacatgtt

SEQ ID NO: 7 - DNA, 201 bp, Bos taurus
cttcttcttctctgtctctatgtagagttcagacgctgctttgattttctgcacccaggcagtccttggaaagaaagagacagaactcaggcgtcaggtcggtaccaattcagtttccaggactctgctttgttcttttgatttttacaacaaaggctcagcatagagagtctggttttatgtcacatggacctaaggatg

SEQ ID NO: 8 - DNA, 201 bp, Bos taurus
ggtgtgtgcacggggccccagggaggaaacatcttcattccctttaacggacgtttctcgggagtcatgggcggcatgaggaataatgcaagccatcagccccgctggccgccgttttgaaacactactgccaagggccgggaggtggtgctctgtggtgtcgggtagttggtggcaagttctctgagtggagccctgatg

SEQ ID NO: 9 - DNA, 201 bp, Bos taurus
aggttaccactaagggttcattcattcattccttctctgcacagcttcttagtcccgggtgcagtgatgggcactaaggaatgtggatgaaagcctctagggcaacaagaaactctcagtctggtgagtgatcctgtactattatcccactcattgcattgttgaatttgttattttttaaatctatctttttcctaacca

SEQ ID NO: 10 - DNA, 201 bp, Bos taurus
aggtgagcaccgggagacgcgctacgtgtcttgggaaaccggcctttgggcggaagctcgggagacgccccgcgggaccgtccagccctggggcgcagggtggtttccgttgcaccccaaccttcttaacacctctcgggctcaggcctagctggcttagctgaggccgctgaggggagggagatacttgatttgcctatt

SEQ ID NO: 11 - DNA, 201 bp, Bos taurus
ctctgtccacaagtctgttctctgtgtctgcgtctgtgtccctgccctgccattttttaagcactacattttttatttcttaatgaaagtataggtagtaccaattcttatgatggaagataatctcaaaaatataagcaagttgtacatagactgaacatgcactgttagagtagatgggctttagagtcagactttcaa

SEQ ID NO: 12 - DNA, 201 bp, Bos taurus
ttctcattcatggcccaagtggctctgacagaaacgcaggactttgtgctgatcatcacacaacataccactgtcttttttaataacctctacaaaatttgaaaggggaggtggtggcattagccctgtggaacagatcttgcttgattaactcagtaacactggcccagtatctgtccagcagaacccattgtgaactag

SEQ ID NO: 13 - DNA, 201 bp, Bos taurus
cttgcttgttcacatgcctacccttgaagctgagaggtcatagcactagtgtggatggaagatttacaggagaagggagagaacactggcaggcactaacatatccactttatctacagtgctgtagcttttagttgaagttggcagtgtccgccttcagaaagtttctatgagtgagtaatgataagtaaaacaaactta

SEQ ID NO: 14 - DNA, 201 bp, Bos taurus
tttctaattcttttctcactgattgtcttcaattcctctccttcactctcacatcgtcttcagcgggaatgacttggcctcctctttcacctgccatcacgtaacattcggatgaagcccatgttcttatgtgatgtttccagagacctaaaaacgcacagacccgaatggcactttggtgtttctaaacggtggcacggc

SEQ ID NO: 15 - DNA, 201 bp, Bos taurus
accatccacgaggtcgcaaagagtcagacacaacataacaactgaacaaaaacagttccgtgacttccattttctctccttcactccttctcatcaacaataaaacattcccaggtctctcccatcttcaaaaagtatgtatcctttacttccccagaagtagtttttctttcctgtcatttacagccaagtttagctacc

SEQ ID NO: 16 - DNA, 201 bp, Bos taurus
cactggaaggaactctggcttctgaggctggaagacttggcagacttggctgtggaccagtgagaaatacaatgggggtgctggagaggggccagtggagcgagggtgaaggaggctccaggcgcccacaagcagattagggtcctcagatcatgaaattctccagtctgacccggattgtagagagttcattaaccatgg

SEQ ID NO: 17 - DNA, 201 bp, Bos taurus
taaaatttttgcagtggcagacgatgggaccccaaagcctcaatgggtgtgtggtaccacccaccacctctgtaagcacagacaggctgcgaagtccccccgacttccctggagacagtgccttcttgaagaaggctagctaagtgtaaaaagtcatctttgctgaaacgtgctgttgaaactggctggagcttgacgtgt

SEQ ID NO: 18 - DNA, 201 bp, Bos taurus
tttaaaaatgagaaaagagcctaaaagcctttgcaaggaatgtccaggatgagtctggggggaatgaggtttgggctgaggggttagggagtgtgcgtacttactcagagatggtatgtctgcagctggggaagcgtctgagattgaggtcaaaggcaaagcaaaaaagcaaaaaaaaaggcaacatcaccaattttgttt

SEQ ID NO: 19 - DNA, 201 bp, Bos taurus
caaggtccatggatggaacataaatgcattcataaggagatgttggcgtggtgacactggattctgttctgacccttttcaacaaatgggtatttggccccctccacttcagtatttgtcttcatggtaaaaatctagctctgagaaatgatgctaaatccacaagatcttgtctatgggacttgtcagggggacaaagat

SEQ ID NO: 20 - DNA, 201 bp, Bos taurus
cctgttccttcccctacaaaatgcccacagtggtgttcttaggatattctgaagccagaacgctatgtttagattcaagttggaaaggccatgtggtcctctctccctctgtgtatctctggagcccatcattgtcccttcccccattttcccttctaacccactgcccctgggtctggctggccaagcctggccctaacc

SEQ ID NO: 21 - DNA, 201 bp, Bos taurus
aagctccaacctgctgtagggactcaaaggggaaagacagaaataagttgacctgaccagagcccaaacacaaaggcaggaggcctctgtggacatatcacggactgaatcctcccccagaggcatgaaatctcagagtcgtgcttacagggagggcagaaggacatgcagtcaagggcccatgaagacaacactggaggg

SEQ ID NO: 22 - DNA, 201 bp, Bos taurus
ttttctatctttcattccctttgtcagctctacttgactttattctttctgcaggcctttcccatggggctgtgaacatggcccctgcaagccccacattcataaccttgcagttaaagtcaacgataaggggtagctgttaagagtgctatagaaaattcccaaagaagactctcattggccgtgctgagtcacatgtcc

SEQ ID NO: 23 - DNA, 201 bp, Bos taurus
aagttacttgttccccagggcccacttccctttccctcccctctccagatggattttataaacaagataaaatcagaacttaaaaagctaaacagactccacgtggcctctttcactggctagatcagcccaggactgtttttccagacgttttcccagcctgtttgtaggagaggccagaggtaaggagtgtcaagaggg

SEQ ID NO: 24 - DNA, 201 bp, Bos taurus
ggaaggagagggtgcaggagttctcactctgctccactcggaggtggaaatgcaaagggaattcatattctttctagagaagacccccaggaggaatacacgcctgggccctctgcagagttcatgctttgtttagaattccaggaaccactgctggggttagacgaaagtccagaacactggagaatccccaaggaccct

SEQ ID NO: 25 - DNA, 201 bp, Bos taurus
agggactgaacccgggtttccagcattgcaggcagattctttaccattctttaccattctttaccatctgagccacccatttcttaagggctcaggaaagtgagtaagtatttgtctctggctacttccatgtcccataacaactggcttcctttccagtcctcttcccataagggaaatccactcttcctaagaggtccc

SEQ ID NO: 26 - DNA, 201 bp, Bos taurus
cacccaccaacccaaggaatccctcccagccctcccgcctccagccccgcggacggctgctgccccttcccacgagggcctcagtccgcgtctgctgaccggttcccagcgccacctgcacacaaggctgccttcctctctgcataaatcacgtgttaaatatcagggctggccccagcgcccatgctccttggaaagaga

SEQ ID NO: 27 - DNA, 201 bp, Bos taurus
ctggaactttactgattaataataatacctggcctgtatatcttccttgagagtttcctaaacacttcctcatagactgtccctgtcacactttgcttctattaatcacactgggaaatagaaggcctgggcaatggtggctgtaaagacaggaattacacctgtcggaacttatacctgcagaggcaacagatgatgtca

SEQ ID NO: 28 - DNA, 201 bp, Bos taurus
ccggccaaccccggctgctcccagtctgggagctagcaagcaagggagcctgtgctgttttcactcctcactgctgcagcagcagccccaatacgccttgccaaaatttcttgtctggcctctagtcagtttctattgactggggaagaccaagaactctgctcagtaacaaagcctccagaaaacctccaaaagatagga

SEQ ID NO: 29 - DNA, 201 bp, Bos taurus
gctctactcagtgtgggtgggccttgtccaatcagccaaaggcctaaatgtaccaacaagcagatgctgtcgccataaagggagaatgcctcctgcttgaatttaccaccgagctgggacactggcctcttctgcctttgaccttgggctggagctataccctcagctgtctttggtcttcagcttgccacttgcagagct

SEQ ID NO: 30 - DNA, 201 bp, Bos taurus
ctttgctggtcaagcagcatcaatctgtgtgatgaggactgaaggctttgatggaaacaggaagtgtggtaacaaagattcctcccagacagggagggcatgaggccgcagaatcacgcctggaagaaaaatcaagggttgacagatcttcgtggttttaattttggaaggaacagtggaggtaattacagttgcctgcat

SEQ ID NO: 31 - DNA, 201 bp, Bos taurus
atatttgcgtctctgttttggtatccttcctgatctaagcattttgggaggatatttttcttactttcttttatggctgagttggtgtgttccaaacttgtttcttttggcttgaggccttgtgtggaatggacaccgaatttccagtgggaccgctggcagggactttcggcctctcaagtgtgcagcttttgaattgga

SEQ ID NO: 32 - DNA, 201 bp, Bos taurus
agcacatttgcttctggctcagtccttatcggccagtgaccttgggaaagtcacttcatcactggctccttgtctgtccagggtgagtgacaccagcctctgacggggccagtaggagaaccaagtgggattccatacatagaagccttctgcagagtctataaaatgaacggaagtcttattttggtctcaacattacgt

SEQ ID NO: 33 - DNA, 201 bp, Bos taurus
gcctggcaggccacagaccatggggtcacaaagagtcaggcaggactgagcagctaacagcagagcacgtagattcaagaaggggtgtggttgtttggtcggtgtgttcagggcagctcaggcctgctgggacatcccagtctagaaccttccagaaccgaagcccacgtggtcacccgaggagccccctggcacacgcca

SEQ ID NO: 34 - DNA, 201 bp, Bos taurus
cttatttttttttttttttggcttggaatccaactttaaaattctaaagctaaataagccatacctctttctgaactagactagatcagtgtgaaacctatagaagatatttttctgaggcctgtttcatatatttatagaaaatgtataggataaaaagtatcccagctgagctatattaaattcctaatagggaagaac

SEQ ID NO: 35 - DNA, 201 bp, Bos taurus
caaacggacgaagtctgaaatcgtaaatgattctcgtttttatacttttgggattccatcgaaaatgcttttgtttgagttaactgtgctgtaggcagaacgctgtggtctgaggaaatgcagtctgattgagaggaaaggaaatagaagacctctagatccaatcattttattaaaaggcaagctgaactgttcctttaa

SEQ ID NO: 36 - DNA, 201 bp, Bos taurus
cctgttttacacatgatcatgaaacaggcccagggagtttcagtgagcagcctctggtcagacgatgagtcagtgggaaagtcgggggaaaaaacttgtggaacttttgacgtgcaccttgaatgtgctgccttaagaagggtgagcaattaatagatgagcaagataaatggagatccatttgaagaacagatttgcaat

SEQ ID NO: 37 - DNA, 201 bp, Bos taurus
atactgacttcatcaaactcaaaaagatattcatgtatctctattcagttagttttctttagcagatctttccgtatagaagtctgagatgtgtgaggaactacagattagaactttagaagaagatttactttctttattttcccttcaactttggggagtataattgacgcctaacactgtgcaagtttaaggtgtgta

SEQ ID NO: 38 - DNA, 201 bp, Bos taurus
ttattaaactttacatgtaaacaaagatttctacatggaactgggcagaagaaatatcacctaaagggaacaacaataattctgttctgtaacactccttacattgctgggataacaagggaaagtagaagactgattacagtattttgagagaaagtcttgctatatcaaggatttaaaatccaacacttttctaatact

SEQ ID NO: 39 - DNA, 201 bp, Bos taurus
aaaatgactctgtagcatgatgctttgtaaaatggtctgtagatgccatgtaaatgcttcataacccataacttcagaacaggcaaatgtcatgagcctgtgatttcagtctaagaggtggcatgagagtgcctgtcccattacaaagaccatgggaagatgctgcggagtaatgagattattttgttttagttgatctct

SEQ ID NO: 40 - DNA, 201 bp, Bos taurus
aggagtgtgatgtttatgaaatatttaaaaaatcagtgaaactaactggaaccaagagcaaataagactgagtcttagcaatataatcttttttaacataaaggaaggttggaggaggttaaatgaacatataatttgcggcaggcaatgtaggtgtctcctttctttcaagtcctcagttggattagaggagcccaaaca

SEQ ID NO: 41 - DNA, 201 bp, Bos taurus
agatatggtcacattcagaggaacttgaacataggttagatttactatcttcacggagtgaaccaagaaaaaccagaagactggccaactgcatcaaatacctgttcctgtctcagtcatttcatcactacattcatttttggcaatattcaaggcatcaggattttaagaagctgtgttagaaatattgtataattttta

SEQ ID NO: 42 - DNA, 201 bp, Bos taurus
tccttcttctctggagcagaggaaggactccggcttttggttctgtgacagggagatagagaatgactgcgctttctctgtcccctgacagggaaagatcgtcttcgaggggaaggagaactggatttgcatcttcttgggctttgagacggctccctgttttctcttctgctttatttttcttctttatccctcttatcc

SEQ ID NO: 43 - DNA, 201 bp, Bos taurus
ctctgcacaggctttgacttcctggcatttgcagagctgcagtttcctgcctatatgtgaagatttttttccacttctcttttcttctgcagggtgtatacatctctctctttttctcctctttctgttctcaccctaccatttttccttcctccttttaatgtatttaacctagattttctctcttttctgttttccaaa

SEQ ID NO: 44 - DNA, 201 bp, Bos taurus
caatgtcaagtgtgccgtgagtttagaacaagggcccagactgggtagtgcattggctagagaagtaatcatgtatggtctttaagataagagcttaaaacattggccagcatagaaattagatttcaaagaaacagatggaaaaaacaagggaaaataatcttttaagacttgattttaagcaaagatttcttaaataca

SEQ ID NO: 45 - DNA, 201 bp, Bos taurus
cccaatgagatgttctaatcagattcttacatagggtggggttgggaaagggtagagagagaggagagaaatgaatcaaatttttattctcagacacagacgctgtaatacactctaagggcagtctgtgtctttgtattctgtaaatcaccagaatgggaactttagctatacaaacacaaaaccagtttctaatacttt

SEQ ID NO: 46 - DNA, 201 bp, Bos taurus
ttcatatttatttcttcctccattttatcagtgaccctgatttgcaaaagtcaggtcataatctctcttgacaaatgtgatggaatgtagacagatcaatcttctttatgacttgaataaacttttgaaacattctgttttttaaatgtccctgtcattgcaagggccaaattgatagcaaatgacacaatcatctccgtg

SEQ ID NO: 47 - DNA, 201 bp, Bos taurus
taaaaggagataggcttgaagattgactatagaggtagaaaatatgcagaatatgagtgggaaaatagagataagaatgatgaagacattatattaaatatgagagaggatatagaagtagatttaagatcttgaacttaaaagatgctatatgaaatactgctcctagaggaaaatggtgtaaaggttagggtaattttt

SEQ ID NO: 48 - DNA, 201 bp, Bos taurus
tatttaactctcagcggctgctttacaacctgtgcaatccttattattttcagaactgtaatgatggttttgtgtttttattgtgatagaaaagcaatcagattgcttttccctccccaccccaaactgtcagacaaaatgacatgaggtaagaccttggagctatgatgggaaagttaagcccacaagttcactaattta

SEQ ID NO: 49 - DNA, 201 bp, Bos taurus
taagtgacaaagttcagatttcaagccttatcttattccacaatccacggtattaatcgtggcactctcttgcatgtaataaaggaagatgaacacaaatgcttgagtatcctttggtacaagtgctaaagtcagagttatatgaaatgctaagtgtatgttcactgcatctggaagagtgtggcaagaattcttttgaag

SEQ ID NO: 50 - DNA, 201 bp, Bos taurus
taacttgcatctaaaagaaatgaagacagttgcaaaatggctgctcttaatatcctgtttcttttgaataaaataactctttaatgagctactattttccctaaaatgtctctggatggaatattggggccaccaattcttctactagtttaaagtttccaaaaaaaaaaaaaagaaagaaaatcagcactagctcagaaa

SEQ ID NO: 51 - DNA, 201 bp, Bos taurus
gagtcggggctactctccagttgcagtgtgggagctcctcattgccgtggctcctcatgtcgcagtgtgcaggccccagaggatgcaggccacagtatttgtggtacacctgctgagttgtcccccaacatgtggaatcgtcccagaccagggattgaacccatgtcccccacattggcaggcagattcttaaccactgga

SEQ ID NO: 52 - DNA, 201 bp, Bos taurus
aatcaggcataatatttccgggcaggtattcttgttgattatgttggtttgtgtgtggaaagtgaaggataagacctatggatcaaactgttattctaatgtctaatttacatacgagtgaaattacaaggcaaatgcagagaaagaaagggcagtttctttgcttagagttgcttatgtaagcttagaaaatatgctgtt

SEQ ID NO: 53 - DNA, 201 bp, Bos taurus
gctttggggaggagagaggaagttggctgatgctgaaagagtctgcttctgtttgaggtctggcaccttttaataacttcttcctgtttctatcatattccgctttcttggtacttccccaggcttgtatatatctcacttcactataggtttttggtatttgcaatcttctctgaagaaaaggttggggcttctccaatg

SEQ ID NO: 54 - DNA, 201 bp, Bos taurus
acaaagatcagtgggcagcttatcgagctttcttggcttgatggattcattccttaagataaagatcctgttcttgtccttctacctttgctctcaccaacgaccatatgcttttatttgggttctagaagtccagaaagactttgtacaaatccctgacttccttcccacattgacctcctattataaatacagcataaa

SEQ ID NO: 55 - DNA, 201 bp, Bos taurus
gctttaataaaacagttaaaatatttacaaattcaaaatagatgtttcataactgaaaaaaaagttcacctgagaattcattataacattgccatttttttattttttttctccaagttgttaatgtggctgagtgtccacatgcaacctgtatcgtctactgtgtcaaatatatttgattccttattttaaattagttaa

SEQ ID NO: 56 - DNA, 201 bp, Bos taurus
ttactacctgtatgtgtctagcagacatctcacattgaacatgtccacaaaccttggttcctcgacctccagctaggatatacatcaaaatattaacaatagttacatttaggtaatttttccttgtttctgccttcaaattcttaactataaacacatattactttagaatcagaaaaatgttcaaacagacaacaaact

SEQ ID NO: 57 - DNA, 201 bp, Bos taurus
gataaaaactgtgaatcataccagttcctgctttgaacacagtccacaggcactgtgagcagatgggctttttggcctccaaaccattctttgctgtctaccacaggtgagtagtagataccctcttaaattagcccaactgctaagccaagaactagccagttataaacacgatagacaacttatgacagcattctgtat

SEQ ID NO: 58 - DNA, 201 bp, Bos taurus
ttctttcagaaaagatggagtcatcaaaaagatggaaatccaaggtactaatgccttattaaggatcagtaaaaataagatactacacacatattgctaaatttcccaagtgtgagatataactagtaaagtgtcttttttcgttaaacctgaaattaaggttagagtaagatgcgaatataataaaggacacagacggta

SEQ ID NO: 59 - DNA, 201 bp, Bos taurus
acttgacacggaagaagcagcaacccactatagtctgctggtgtcatattttaccagtgtcagtaaaatacagaaatcttgtcacttttaattcaatgatataataatcttaaatttttcttctacatacatttagaacaacagtcttataatctgtgattcagccatcagatatgtagtgccaatattaataaaccctga

SEQ ID NO: 60 - DNA, 201 bp, Bos taurus
gcatggttacccgtgtggacagtggggctcagcgaggctcagtaaggcgaccacagtcacagggtcagaaagactgactgggcttccccgtctgggtctcgcagcttaggactggactccgcttccccagaaggctttcctccccaggctgcagcaactccctgtatctgagcattacttccaattcatctcctccgcctc

SEQ ID NO: 61 - DNA, 201 bp, Bos taurus
attcattagaagttggaggatgagtgaagatagactgatatcatagaatattaagaagagaagttttatgggaaaccctccctgaactaatttcccagggtagccctgtaggtgaatgtagtcaaagggcagaggagcgtggcatatcggacagggaatgtggcaggagagtgtgtcctgtctccagcactcccaagggga

SEQ ID NO: 62 - DNA, 201 bp, Bos taurus
catgttaatctaactttcaatgtttcagtatctttctctatcaaatatgtttgaactgctgttgctattcaaatcttcattatctcatgggtctgtatcctgtaatagctccattcatttatttattcacttatttaaaattttgtgttgggcaattactattctaccagcaaatatggtaggtggttcagtggttacagt

SEQ ID NO: 63 - DNA, 201 bp, Bos taurus
ggtgggcctcattccatcagttgaaagcctgattagaatgacagaatcaaccagcggatggcttttgggcttgaactgcaacactggttcttcttagctctccagtctgctggcccatcctgaagaatttggacttgccagtttctataatcttgtgaactaattccttaaaataaatctctttatacttatatacacatc

SEQ ID NO: 64 - DNA, 201 bp, Bos taurus
tctaataaggccaccctttgagggctttcattcttctagaagtgattgggttgttcaacataggtcaaatctctgatatgctttaccatctgagccaccagagaagttcctaaaaatcttagggccagataaattttggaattcagaaattttacaactttttgtaattttgataggtgttatggtataaatacctttaac

SEQ ID NO: 65 - DNA, 201 bp, Bos taurus
ttgtctattctgatcctgggctaggtcatgaaagtccaaactaaggttcacgattatgctggagatgttagcaatgcatgtgattttcaacttcctgtggattttttttcagagcagtatgcagcatgcagggtttaaacatctaagcgggaagttcggcaggatggtagacaaagtagatgatcctgcggactccacaaa

SEQ ID NO: 66 - DNA, 201 bp, Bos taurus
caattgtgtacaaaatgagggatatacctcaggcctaaattctgtactttcaacaatacggacatctctccgtaagtgtagaataggtgcttgatgaaagtgggaaaaagaaagactttgggaagctgtgaccatcattaaatctctctcccagatctcaccatttgggggcaagctggagaaaatggcattttttcatta

SEQ ID NO: 67 - DNA, 201 bp, Bos taurus
tttaggtatctaattactgttttcatttgcatttctttaataaaatgatgtgaaacattttttaatatgcttagcttttatctggtgatgtgtctgttaaagtcattgcttcaattcaaaattttgaagttgtttaaaaaaaatcattatgcccaaggtcatctaagttttctcctgtgttatattctatgagaattttat

SEQ ID NO: 68 - DNA, 201 bp, Bos taurus
gaatcctctagaaagaagagggtattagccaagaatacaaggccacacacagaaaataacttccttcacaaatgtcaattggcacttgagaaaagaaagtatggactgaagtgttcaggcctctactaaaaaaggaactcagacccaagctgtaagattgaggtcaaggacaaattaaaaaaaaaaaaaaaaaaatccatt

SEQ ID NO: 69 - DNA, 201 bp, Bos taurus
tcaacttttgatgcctctaaggcctaaaatcaggtcagcatattctcttttggcagaatttcattctgaggcttaattctgtcttgtagtattcattttattcatgaacccttgggccaccggcattcatttgtcatatcctagcaagaaggccatttccatgagcaggcattggacttaactgggtctcagagaatttgt

SEQ ID NO: 70 - DNA, 201 bp, Bos taurus
taatcagaaccgaaaaaactatcagctttggctggccgagatcaatgtaaagctgctactatcatctgagaaacctttgcttttgggctatgtatattacgatatcataaatcaatcattaatcaaagctacttgggaaaaatacctaattaaataagtaatttatgtcattttatagtgcttagtagctcagctgtgtct

SEQ ID NO: 71 - DNA, 201 bp, Bos taurus
atattggtgctttaggtatttcttaaatgcaaatgggtatatcctcaatatataccatttactcgcagaactagtgaacattcacaacttactgaataacggaaagaaatgaaagagtgacgcaagctaacatttgcatgaaaccaggaagttgctaagttcacttctttcttttctcttctagtcatctcttatatggct

SEQ ID NO: 72 - DNA, 201 bp, Bos taurus
tccaatgtttataggactgaaatctgaattcaatgcatgaggtattcaccaggaggaacctatagaaacgaattttggtggccatgagaatgcactttgcggaactctagctaaagacagtgcaattgacataggacccttgaggctgctctctgaaacccattgccatgcttgagtcgacaccatgctttcctaggttgt

SEQ ID NO: 73 - DNA, 201 bp, Bos taurus
atctgggtggtggtacccaagggcctggggtgcttaagattggcagtgcccaaaacaaaacatcacgtgctgcccctagagatagtgagagattttcataagcgttagtctgaggtctagagtggcctgtctcaagaaagtgcttccagatgttgagaatctggcttaatgacttctccgtagtcatctcttttgaaattg

SEQ ID NO: 74 - DNA, 201 bp, Bos taurus
ttaagatgcagagaaagcactttataaagaaatcctatgtcagcctgccttataatatctgtgcattgtgatgatttcagttggcctatctgtttagctttgtttaaaacatgtggtgtcaaagacataatcacttatttaaaatttggattatatcccaaaacacctgccttataatatctgtgcattgtgatgatttca

SEQ ID NO: 75 - DNA, 201 bp, Bos taurus
gcttctgacacgatattcacccccacccagccacctcctagggaggctctgacttttctaaaagaacaaaactgggccctgcagaagactggagatggggagtttctaacgttttgattttgtgggaggtatttttgttgctatagaagtaagcagaacatccccccggcccccttcaataataaatctggccatcacccc

SEQ ID NO: 76 - DNA, 201 bp, Bos taurus
taaaatcatttggtcaaaaatctaaaaaaggaggaaacgaatgtacaaacaagttaaaagttagttagaaacaggatgtgagggcacagttcttcaactttcaaggtcaatgtgcagaagctacgtttaagctctgattaaactgtatttaaacttcccactttacatttgtccaggtaaaaaagcaaagtttgatttatt

SEQ ID NO: 77 - DNA, 201 bp, Bos taurus
tgaacctgggtctcctgcattgcggcggattctttaccaactgaactaccagggaagcccaatcataaggaagtgaaatctgccaatgagcatgaacgaggttggcagcagagttttattcagaacctccagtcaagaattgagcccagctgactccttgatttcagccttgtgatagataccctgggtagacaacccagc

SEQ ID NO: 78 - DNA, 201 bp, Bos taurus
ctgttacagggagtttaagcattcaagaagcttgtaaatggaggggaaacacagagaaccagccagtctcagaatgcaccatggtagaatcagagactaacagaatgagaataagagctttaaacaaagcatcaggcagtataggatacaggtaacaagtaaatagtactgctgcaataattcccacaaagttaagaaaaa

SEQ ID NO: 79 - DNA, 201 bp, Bos taurus
tcctcttcactttctgccataagggtggtgtcatctgcatatatgaggttattgatatagaatcagttagcccatggcaaaaccataaacaactttacagctcagatgaagagactgtaaaatgatctggtctttaccaaaattttcagaatttttctactctagaatcacaagctcatcaaatttcattcttttataaat

SEQ ID NO: 80 - DNA, 201 bp, Bos taurus
ttactgagctagtaaattaaaatgcatcttctatttacagtgttaaattgtcagtcaaattgagttttcaataagaaagacatatgagtttttacacatacacttaatcttttccatttggaagcctctagggatctaattttagttttttgaggtatctttttagagtttagatacaaatataaaatatattttaccctg

SEQ ID NO: 81 - DNA, 201 bp, Bos taurus
caaaaattcacattaaagattctatattcaataaaactttaaaagttaaatagtcctgacaatgattcgaataactattagaaacaaaggattggctaaggattatgctagaattagctcaatgctcatagctttagttcaaaaggggagtaggaatcagaggccataaaaagatctcatggaacaggaaaacatgaagct

SEQ ID NO: 82 - DNA, 201 bp, Bos taurus
catggggtctcaaagagtcggacacaactgagcgactgaactgaactgaactgatattactctgagatgggtgcccttgcaatagtgatgaattaccagactggtcatggccaggcatcctgatctccacgggcaaaacaatcacaatgtgtcttcaaggacatcactgattttcaggaatgaatgtcacctgcagcctca

SEQ ID NO: 83 - DNA, 201 bp, Bos taurus
ctgcctgccaatgcaggagacaggggttcaatccctgagtggggaagatcccctggaaaaggaaatggcaacccactccagtactcttgcctgggaaattccatggatagaagagactggtgtcaatccctgggtcgcaaagggatctgtccatccctacagtctgcaggattgcaaagagtcggtctttgcggcggactg

SEQ ID NO: 84 - DNA, 201 bp, Bos taurus
ggagagctaagaagagatttattggcaagaaggaatccacttgctaaactgttctcacagcaggtgaaaggaattttgtggccagagggagtttgaggaactggtccactaagcacccagcatgctacctatccatcttagataataagcaaaatcaaaaacagaaaaaaaattgtcacccagagatatttgaaatttcag

SEQ ID NO: 85 - DNA, 201 bp, Bos taurus
tgtttgaaaaaataaataaagtagaaaatgcaaaaggtagaaatgatataaaatgtatgcatggcacatggaaggcctcatgatttgtttactgaatacattgatcttacataggatactcttgtcctaagaagttgccctaagaagtttcctactctctagacccagagctctgctcttttcttttttccaagttttggc

SEQ ID NO: 86 - DNA, 201 bp, Bos taurus
ttcacatcagagatttcaagaggaataagactggccctaaagctgtggacccagaaaagttcattcagtgtgatagatgtcaggaatatgttgagatgaataggtactttttctgggccttaaattttcaaaattttatcctaactaccactctaaaattactgagtttcttagttaaaaaacaaaacaaaacaaaaacaa

SEQ ID NO: 87 - DNA, 201 bp, Bos taurus
ctgatcttaaatagctattctcaaggtacaatccctaaaccacaggatcactgccatcatacagtccttcagatatctctgatgtcgcagtgtttgagaactactgtaaaggttagggaaagagctcgtgtttgttgcctgattttcttgttttcctttatatcttgtacagtggttgggaaaccaaggtctaaatgtgaa

SEQ ID NO: 88 - DNA, 201 bp, Bos taurus
tttcatgatttgtttatctaaaagactgaaacagtgcaaagttctcttcttacatacacaaagcttataataatgacctgcaggactggccatcctaaattaccacagagctccactctactttagtggcttgattaaaaagatgaatggttgcaggttcaattcaggaaagtcaaggaaaggaacatataatgacctctt

SEQ ID NO: 89 - DNA, 201 bp, Bos taurus
ctgtgtgtgtttgggagtctctggtggaggcctgggtctacagtgtcctgccatggggtcaggggcactgatacagcagttctggaaggcctggcatgctgggattaagtccttttgaaggagatcagcattactactattacccctcccataggggaacacagccccacccatcagcataaaattggattaaagacttac

SEQ ID NO: 90 - DNA, 201 bp, Bos taurus
aaggaatagctgggaaagaagaaatatcacagaataatatttttatttttaggatcaaaagacattgtgattcagtggctcttaaatatctttaggtttccggcttgatttcatgatctagtagacagctcagctggtaaagaatccgcctgcaatgcaggagaccccggtttgattcccaggtcaggaaggtccgctgga

SEQ ID NO: 91 - DNA, 201 bp, Bos taurus
agaaagaaataactgtataaaacagaaaacttcaggcatgcgaggagaaattgtacaatccttagaaactgagaggagagttagaacgaaaagtgaatcagagaacaggttgaatacccattgtcaataaccaacaaggacattattctggtctccagcaaaggaaaaggtaagaataggtctccagtccatcatttagtt

SEQ ID NO: 92 - DNA, 201 bp, Bos taurus
ctctacctttacaaaattgagggtcacctataattttcccccagttttgacattctctggtccctgtgtaaaacagtcattccctccttgctgatactcttgtctgcattggtatctggggccctgtgctaccttgaatcccctcatccttctcctgtttctctttctccaactctatttcactttagtggattatttttg

SEQ ID NO: 93 - DNA, 201 bp, Bos taurus
caagtctcaggcagagggttttgatggtaactcaagaatgtcacagtcattcacaggtaggcaggctcaggttatctctctgtgaactaaacaaaggcacgttagcttaagggtcaagaggagggtgagagagggcaagggtcagagaggtttaagggtcagaggagggcaaggttccctgaccattatgtttgtttataa

SEQ ID NO: 94 - DNA, 201 bp, Bos taurus
tacaccacacttagactgcagacttaattttaatatgccatgtcccacctctatacaatcatataatgttaatacatatcttaccaaaattcagttgtagggcttgatttttcaaaatgaaaaaggagagtaatgtgtgcctatctactgaggttttgaataggaaacactatttttgggaggaaaggggtgacccatgta

SEQ ID NO: 95 - DNA, 201 bp, Bos taurus
tttgtttgtttgtttgttttggttctacttgctatatagttgctttgtcagtttccacgagataatttatgggattaaaagacaattccatcataatcatttaattacacacagaatctaaccattgttttattcttattttatttttgtaaaacaaaaatttaatatattgatttagttgggaattgtttattgctgtga

SEQ ID NO: 96 - DNA, 201 bp, Bos taurus
atgtgatcattccatttggcctcctttaagaagtccccagatggagcagtcagttgtgttttcaagaaccatgactgactgggtaacatacattatggtacttgctctctttattagctctttctaaaacggagcaggacctgtagtccttgcccctcccatgtcttccacctgccttttatctgtggaaaaactttagcc

SEQ ID NO: 97 - DNA, 201 bp, Bos taurus
agtcagactcaaactgctatttgcaagtaaacctgtttcaatctaattaatgtgattgttttcatgaaattattgattctgtacaaagaactgaataattcatgaaatatttctgtggtataatttaacattatgtaggagagaatttttaaaagtttattagcctacgcatctgccattttatcctctggtttatatttt

SEQ ID NO: 98 - DNA, 201 bp, Bos taurus
aaacaacaggtaatggatttttaatagtttttttttttcagctgttccttctgtaggaaattgagttaagagcgtcaatgttggcaattactcttgtactccacagcatttgtttggaactactacttaataaatttactgcagcgtttatattcttttagactattccttccaagccccttgcatagattcctgaacaaa

SEQ ID NO: 99 - DNA, 201 bp, Bos taurus
aaaagaagaaggcagaaagcaaattctagaatattctaatatctaaatatttgagaagaaaagagctggcaaagagaaactgaggaagagtagagagtgacatgagaggaaaatcacaaatccatggatagtctggggaatcaagtgaagaaaggcactcaaagatgatttattaagtttccaaatataatccttgttgtt

SEQ ID NO: 100 - DNA, 201 bp, Bos taurus
gcattgccacactgaatggttgggtttgttcctatcaaataaaaagatgcaaaactgaaaaattagcagcctgaaccatagccaacacagtattctgaatgcttgtgtagtagtaatactcgtaatagagacttcaacacaaaagtctcggtcttttagaaagcttaaacttgttatcacaaaccactattttcattcaga

SEQ ID NO: 101 - DNA, 201 bp, Bos taurus
gctgtattattttaaataactgtaatagtgccttctgtttttagagttctgtaaagttcatggtagactttgagatactaaaggggaaaataaacaattttaataactctttgcactattttaaccttgttgcaacatttgcattatcttctgtaaaatgaagcatataatcttgctttgattccccatttcaccatgatt

SEQ ID NO: 102 - DNA, 201 bp, Bos taurus
ttattgtggtctaaaaattaaacacaaaactatgtaaacaagagaaagaaaactgctagagtccttcttagaactgaacaatttctggcttgaaaaccttagtttacaggaaaggaaatgttgcatatttatgaaacaagattggaaatcaagtacataatttcttagctttttactaacctaaaataaaatatatgacat

SEQ ID NO: 103 - DNA, 201 bp, Bos taurus
ctgagccaccagggaagcccacatcctggcatcctgacatcctgacaagagccgcatcagactttcaggccttccagcaggagcaaactttggctccacgttacaggtctggtaactgaagcttggaaatgttccatcactagctcaaggtcaaatgactaataacgggcagggcctgaatctgttgttgttggctgtgct

SEQ ID NO: 104 - DNA, 201 bp, Bos taurus
tataacatttttctcattttgcttcatgttgttctggaggtagttgcaagacagacaagcaactttttcttcatccctagttgtgattttagtgaagtgaaagtcactcagtcatgtccgactctttgtgaccccatggactatacagtccatgaaattctctaggccagaatactggagtgggtagcctttcccttctct

SEQ ID NO: 105 - DNA, 201 bp, Bos taurus
agtggtcagccagagacttgggctgagtttacacgtagacattaaaacagtctttccctggctctctcccctctgattcccactttctgctaactctgattgctctgtttttcttgccctgtttccttagtcggtaagctagtgggctttctagccatgttggaatcctccctgcaccactgccacggttactgacactgc

SEQ ID NO: 106 - DNA, 201 bp, Bos taurus
tgcaatcttggaatcttgctcatttctttaaaaaaaaaaacctattctgatcatattaaagatcagaagtgggcaaactatggctcacgggccaaatctagctggctgtctacatttttgtaaatcaagatttactggaacacaactgtactcattaaattatgtactaccagtggctgcttttacactgtaacgctagag

SEQ ID NO: 107 - DNA, 201 bp, Bos taurus
atagctgagaagcagagagggggtaagtggatggaaaactactgagaggaaacatcaggaagagagattctagctagatggacctgacaggatctttcctaaagacaggccatggtagggacttttctggtggtccagtggttgggaatccactttccagtgcagaggagaagggttcaatccctggctggggaattagaa

SEQ ID NO: 108 - DNA, 201 bp, Bos taurus
ccagaaagttgtctgagatggaattgaagagctaaggcactagtggggattttttaaaaacacctgtatatgctactttgccaagttagagctccattgtgtcaataaatgtgggaatttaacagtaagtcatatacacacagggcttccctggtggctcagagggtaaagaatccacctgcaatatagaagaactgggtt

SEQ ID NO: 109 - DNA, 201 bp, Bos taurus
cacacgaaaaatagagatataagtatgggtagggaaaaatattacttaacagatgatgtatcaactacacagaaaacccccaaagaatcaataaactataaaaccaagtgacaaattaagtaagaggtcagacgaaggaacagctttcaaaattcagtaacatttttctaaactagaaataaccagctgagaaaatataaa

SEQ ID NO: 110 - DNA, 201 bp, Bos taurus
tttaataccattaggacttttttgaggtccaagtgaaacaaaagcagtgatcaaataaaaatataagggagcatcacaactccagaaattctagaaacttgaaaggtaagagagaaggtaggctatagtgaagttgcagtttgaagatgtgaaaagtaagcatcactgtgaaataaagtggcaatctgtcctgctggcagt

SEQ ID NO: 111 - DNA, 201 bp, Bos taurus
tatgactttcattagagatcttatttattgtcatatgacatactctctaggcatgcagcataaaaaagaggggaaacacctgacatccattttcactttaatttgacttgacacatttcaggaaactgaatatttgaaaaacgtttctgtattgattaagatataagtaatagaatactttattaaaatagcttaaataat

SEQ ID NO: 112 - DNA, 201 bp, Bos taurus
ggggagcctggtgggctgccgtctatgggggcacacagagtcagacacgactgaagggacttagcagcagcagcagcaggtcatctaatatgactgcatacgtcttcttaccttcctgtggttagtgaaatgttttgttgccaaaactattatcttgaaacagtgctagttcataagcttgacacataaactagagatatt

SEQ ID NO: 113 - DNA, 201 bp, Bos taurus
ccaaagagatatcaggtttcaattaaccagttagttttcttaggttgcagggcattgatgttaaggaaattatttgcttcaccatactacttgattgacaaagaaaaacagacttttctttcatttctcacaagtataattgcaaaagttatggaaaattttcttattcaagaagagaatggaattgaattgtgggtaata

SEQ ID NO: 114 - DNA, 201 bp, Bos taurus
gacctcctttattgtaaccactagttttttaaaataaacttgatggactgttttactagtgactttcaatttttgatggttcattgaacatttggggattaaaaacacatattcatacaatgtgaagacaaaatattgctacatgaaagtcattagtctatatactatctttctaatactgatcttgtaatataaatccta

SEQ ID NO: 115 - DNA, 201 bp, Bos taurus
tacttgtacctgagcagccactggatggtccagggactgcttcaaggactcatacagaaaagagctcttgatgcttctctgtgggccagctatggttcttatccttctgcatagatgggttcctagtaagtcctgtggtgtcggaatacgatttacaactaaggggactctctagggagcactgtgagaggcaaggagtga

SEQ ID NO: 116 - DNA, 201 bp, Bos taurus
ttgattcttatattgaaatataactaatttagggatattgtatctgttcttctctttttgtctaatctcataggcacttaaaaatcttaataatattaccgattatttctgggctatagattattcatctatcttcttcttgagtaagaaacctcattttatgtcacttttcatatgtagaaaatgtatctgttgaattat

SEQ ID NO: 117 - DNA, 201 bp, Bos taurus
caatagataaaaatttcaaaatacctgcatccttgttaggaaatcacttaccacatcagactagttactaaattctttgtttatagaactaaaacacttccttaagaaattctcataaacaagccttccatccctagcagggattatcctgattgtttccaatgctcatttggaaatatttctttttctcccctgtcaatt

SEQ ID NO: 118 - DNA, 201 bp, Bos taurus
tatggccacaccaatattactcaaactgcataacagtcatatgaggcaagtgtcatccagaaatgggaaactgagatgtcaagattttgaacagatgtaagtggccaaatctgaaattgaactcaatcttgaatgacttcaaagaataccatcaaccatcctccttatatattatatatgggagaattttctattaactac

SEQ ID NO: 119 - DNA, 201 bp, Bos taurus
gcctcattcaaacagcatgaagttctccaagaaagtgagtccttctttgtccaggcagagtgcagtttctgttcttatcaaatgtaccttcagtgccaccatctgggggactcttgagatgttcaagtataacagcatcattgatgctgcatatgaggctaactctggttgggcatttgactctcaccgaattttccaagg

SEQ ID NO: 120 - DNA, 201 bp, Bos taurus
cagcttatggacattcttctggttggttggtggtgagataattgggagtgagcatcatccatcttctggttccaaccactttagggtccatgttcttgccatcaacagctttcatcatggggggtctgcattttgtagaaacaacttaggaatgtgtatcaggcctttatcactatcttttaagaactgtctttagtgttc

SEQ ID NO: 121 - DNA, 201 bp, Bos taurus
tgtgaagttatatattttatgattcttatatgtattcaataattgtcatttgtcagcatttgtacaaaccatcttgtacagttttaagaaaaatatatgtacctaaagaaatagtttataaagaccttcataaaacttgcatgtaagttagttttaattaatattttcatttaaatttgctatgcattttagctttcatac

SEQ ID NO: 122 - DNA, 201 bp, Bos taurus
aaaaaaaaagctacatagagaaaaatcacagaatagtcaaataacacttctttactatatcctggcaaccatcttacttaaagctcttttaaatacagtggttttaagaatatatagatgaaaattacagaaacaattgaaagcttttcatctcatatattttaattttattacttgaaatagttggaaactagttagact

SEQ ID NO: 123 - DNA, 201 bp, Bos taurus
tttaaaaattaatgatattaggaaagtgattaaaaatccaaacctaaataaagcaggtgacttagctccagttacgttataagcgtatttgcggggtggagatgggtaatgtggagaaggcaatggcaacccaacccactccagtactcttgcctggaaaatgccatggatggaggagcctggtaggctgcagtccatggg

SEQ ID NO: 124 - DNA, 201 bp, Bos taurus
aattccatgatattattgtaagggacaataagcaacttcttttgaatttgaacaattcattagtaaatagtctaaaagacaactcagtgagccaatataactaaaaatttgggaatggtaggtatgacgaatcttttcctaaatctttgacaattcttaagaacaacaaaaattctgttttggattaaaaaaaaaaaccac

SEQ ID NO: 125 - DNA, 201 bp, Bos taurus
gactcctatgaaaatagtatttgggtactctctagtgtgttgcttagtcttaaattctgttattgcaaatcatttaattaaatgctctatcacttgcattatgtttgagtatcattaaaggggaaaatttagcctggaaaaaagttatactaagtcataaatgtccatctttgaaaataatcacgacttactgttcaatct

SEQ ID NO: 126 - DNA, 201 bp, Bos taurus
attttcagtgtgaattctgtttcattgtttctatgcatttgagttcaaattccacatagtagacatataaatactgaggttgatgaaggcctattaactacgttgaagctactatactctttttttatttttcttagtttttgctaattatctcacaaggattgcttagaaattaaattaaggcccttagtcactaggtgg

SEQ ID NO: 127 - DNA, 201 bp, Bos taurus
caccaagagagctgaggcctaactggttcagatagagtttcagtttgaactccgatgctccctgtgtttggagcaggaggagctcgcgggtcctcacacagattgaggctgactctgatgcagcctgggtcagtggcagcccctagagatggcagctgtagccccaggtggtaaatatatgacagcagcttgatctatcga

SEQ ID NO: 128 - DNA, 201 bp, Bos taurus
gtaagattatatctttatacagataaataattctgcatatttcccatgtttatattgatggcagttcaattgatggcaattaaactgatagcagttgccaatttagttgcaccccaaatgacaactgcctttgtattcactgcctggttgaattttaagtgtactcatgtacctatggcatagggaaattattattagttg

SEQ ID NO: 129 - DNA, 201 bp, Bos taurus
tcagtagcaccacctgttgatagctaaccttgctatgaacggagtgctattacaaagactgtggtaatgaacacgtttaaccctcacagtgattctatacaatccccattttacatcttaaaaaaagaaactgagaccctgtgcttaagaatccattttctgcgttgtagtgtgtgatctgaaacaaattgcgaaatgatt

SEQ ID NO: 130 - DNA, 201 bp, Bos taurus
atcaaacattagacccttttgtgtttagtagtttacatgattaaatagttaatgatctttgagtcttagcttgcatttgatatatttaggctgcattgctcaatatattttaaatatttgtaggtcaaagtgtggtctcttttacaaccaatgcaaatcataattttaagttaaatatatatttaaccttcatgagagcta

SEQ ID NO: 131 - DNA, 201 bp, Bos taurus
tgatcctgcttttctgctctcaacaaaaagtcatctttacacaacagcagccaagcaagtccgggaagatggaaacactggatggcagcttcacatacacttagtgtgtgtgctctgtgagagcctgggctttgaaatgagactcctagattggaatccttgcattgtgtgttctcgtgcttttcattagtgaggatagct

SEQ ID NO: 132 - DNA, 201 bp, Bos taurus
aattaagtgacataaaagtatagttctactaattaatgaagctcattctggagaacagattttatatcagtgggctcaggacctcctaatagtgattctcatttcagagaattcatctgttatgtcaaaattatttctggagtcctgtttgggggagggggtgggggacaggcttcttctacgatatgacaaaggtcagaa

SEQ ID NO: 133 - DNA, 201 bp, Bos taurus
atactggagtgggtagcctatcccttctccagtggatcttcccaacccaggaactgaaccggggtctcctgcattgcaggtggattctttaccaactgagcaatcagggaagccctatgacaagtgccaattggtagttgacacacaagaaccagacccaaatggccctgtcctttttctaaaaagacactgagctgtttt

SEQ ID NO: 134 - DNA, 201 bp, Bos taurus
attatgaaaagaactagaaaaaaggaagctatggataagaaagtcatggatctaagaaatgaacatatcagtaagggaactagccctggaggaacaacaccatcttcttccatgtgagacaaactccagggaacggaaaccagtagcaatctatagtcactgtgttccagttactccccaggtgataatcataatcaaatg

SEQ ID NO: 135 - DNA, 201 bp, Bos taurus
catagaatcttaaccactggaccaccagagaatttccattagacctttagtaatgtagtagcaaaatgtgagggaagggaaagtgttctagagtcctatgattaggcctctgtccttcagtcagcttgtgattcttcttttcccctctctttggtggaacaggatggctcaagtgggctgaagttgtgtatttccctttcc

SEQ ID NO: 136 - DNA, 201 bp, Bos taurus
aattgaagaatggaatttggtggtccaccagcaatatagccttacaaataaattttaaaaggtgctctatgtacattttagtcaattaattaatcacaaagttttacctttgtttctcattaatttcaatctctttctcttggtcatacacacatacacacacacacacacataagtgtgcatgcctataatttatggttc

SEQ ID NO: 137 - DNA, 201 bp, Bos taurus
actgaaagaaaggtgtggccttgagagttttgacccaaccccaagggtctcactagcaacctatttcttatctaagcagaaaattagacatagtttcacgcgggtggccccactgtctaagagtaattggggcaatggttttattaacacctgaagatttaaaaataattaatggatgaaatcttactgtattgacttctc

SEQ ID NO: 138 - DNA, 201 bp, Bos taurus
aagaaaatgcagattttaagttagccagtgttgtcacatggacttgagccacttgcccattatttccagccattagcaaacatactcatttatacaacttcaccacttacatattatgtgtgctgtactgtagagatgtttgagaagcatcaatatatggcacctgtttggtaccaagggacttgaaattctgcttgggca

SEQ ID NO: 139 - DNA, 201 bp, Bos taurus
acaaataaaatgcaatcactcatgccttccattgactttttagaaaatcatgaacattaatgtgacaagaggcaaaacaattctatctggcttcatctcacagttttctagtctatatgaagtagaatatgagaaacaaatcactatcttttgtaatctgtccacttttccagcttaatgtataatattagctatgaattt

SEQ ID NO: 140 - DNA, 201 bp, Bos taurus
catggtggtgaatctatagatgtagaactgcatatacagaagcttattgtgggaactgagaatcctaggactctggaattcaagcgggccatggaaccaacgctgaaggacacacagtgaccactgtatatttaatttgtgctgtgtgtgcttagtcactcagtcgtgtctgactctttgctaccccatggactgtggccc

SEQ ID NO: 141 - DNA, 201 bp, Bos taurus
agcatgtcaaacaaaaattcagtaggcagcaatggagtatttttcagaggtagagacacagcatggaaaatggtggtatactttaaagaggcagggagggcgagccagggccattagtgctattctgttctgctatttcttgtttttaaccattttcagctgtttactatacaaagtaaatttactgcacaaaaagtacaa

SEQ ID NO: 142 - DNA, 201 bp, Bos taurus
ctcacagccagaggacagacacctctaactatctagcatgtcaagtttctttttaggccatctggtctcccatccctccccttctcactccccctagaagacttcattccttcattctctctccccgagcacattcctttctcattctccaagtggctctgtgtccacaggaaggcgtttccttctcccttgcttctcttt

SEQ ID NO: 143 - DNA, 201 bp, Bos taurus
tatgtcatctactaacaaacctaaaattcaataaagattagtccctttgattattctttcaagatatcttacaatcataataaagctgtaacttatctagtattcaaacaactgaaaactttttagcataaaaagtcattttctctacacatttgacccatgaaactgataatcataaaaatgatgttatgatattaatac

SEQ ID NO: 144 - DNA, 201 bp, Bos taurus
cccaccaaaaaaaagataccccatgtccaagggcaaaggagaagccacaacaagacaggagcaggcatgcaataacttttaaaatcaaaccccataaccaccagagatgtttggagcatacaaacaaaaccttgtgtgcatcaggacccagagaaaggagcattgacctccacaagagactgagccagaccagcctttgag

SEQ ID NO: 145 - DNA, 201 bp, Bos taurus
attattataaattattagtgccaatcaaagacatgatttccatctcctgattaaatctatacaaaaggtcttcaaacacacagttcagctgccaccaagtgacatatcaatcaagaaagacaatacaagtgagtgatagggctgcaggcaaaacacaatggtttgtggatggcctttcccctctcattcaaagccctgtta

SEQ ID NO: 146 - DNA, 201 bp, Bos taurus
aggaaatagaggcttctgtcattatgctcacaagatgtctcaatcttccagcagacatattttactcctcctttctacatccaaatctcaggaggggcccagtgcagccaagcttcaagataatttggaaaatgaacttcttgctttttacttcttttttattttaaaaatatctatcttcctcttttatgtttaaaatat

SEQ ID NO: 147 - DNA, 201 bp, Bos taurus
gattatcaacaaaccatatcagctgagagattgatgtgcaagcagttcagtttatttttttaactataatatcacttcatgttaggttaggcagaaaactagcagaaattcatcaaagttgagcatgctagctgagagcaattgctctgaaagcacgagagctgtactgaaaactggcgacagtgccaatccaaaatctca

SEQ ID NO: 148 - DNA, 201 bp, Bos taurus
agtagcccgtgaggagggaaaaatataatctctagtgatttgataaaaaaaaaaataacaagctccatagaaaagcggaaatgctcattggctgtatcaacacaaatctattgacaaaaactatttcaccccatcatcaaccttgctttttcactatttatatactaatctcatttgaacagggaaaatggaacagggtgg

SEQ ID NO: 149 - DNA, 201 bp, Bos taurus
ataatatttgttaaaaatacattcttaagaagaatataccaaaacaattatgtacattcttgtgattacactattttatgcccctcaattttctttaccttcaccttgatcctccactctagcaacagagagtagaaaagacacaatcataaacattctcacaaatatttacataaacacaataaaatctggttaactaaa

SEQ ID NO: 150 - DNA, 201 bp, Bos taurus
tatagaaatatggtcagggataccaaatgttcagctgaataattcaagcattgaaggcataagagcatggtctatagaaatggagaggaacttctccatcagatcttaattgtctgtataaattttttgatcagttcagtatttcagtgacttgtcagggcagtaccttatgcattcaagtctgtaagagatattgctacc

SEQ ID NO: 151 - DNA, 201 bp, Bos taurus
gaaggaagacgtgtgaggacacacagggagaaggccacgtgaagacagagcattgtagtgatatgttacaaaaagttggacaagacttagtgactaaaacgataatctccaagccaaatggccaccagacactaggacagaggcatggttacaacagttctaggaaactagaaatcaaatacagattttcattattctaag

SEQ ID NO: 152 - DNA, 201 bp, Bos taurus
aacacctctcttttactttctattttgtgggtggcactcttggggcctcggtgccatcattcccctcacccattcccacatgtgtttcggccattgggctatggggctgggtacaggggtggatgtggcaggcaaggtggaggcaccataactggagttaaggggatggagggccactaccacagaatgacattgcccgtt

SEQ ID NO: 153 - DNA, 201 bp, Bos taurus
atgcatagggcctaggactgtcatcacattcttcatagccaagacattattcttcattccttactccaaaaggatccaggagctttatcctctggagatactaaaccaggaggcctatggactaaggggcagcaggtgtggattgtgaggtgtctcactgagactgatgggacaaggggaagtctgcatgaggaagagtga

SEQ ID NO: 154 - DNA, 201 bp, Bos taurus
tgagcctcaccaagttactgaaagtccccttgcatttagattggaggaggcgagatgaaattatcatgcccttacactttagaaaagcatattgagagcagcagtcacactgtaggcagtcctagtaattcctgcctgtgacataaggttctaccatttctcgctgtcactgtctcctgtgattcaggggaggaatttgac

SEQ ID NO: 155 - DNA, 201 bp, Bos taurus
aaggatccagcctggaaattccaaagtcatctttttttgactctcctaaaaactctacttatgcttaaaaaatataataactttctgtgaaagaaaagtatatgatttcctcatccaaataccaccctttttgaactaggtcttatttatttagccctacatttttttgtattttcagtaaaccagagctaatattgatgt

SEQ ID NO: 156 - DNA, 201 bp, Bos taurus
caaaatgtgacagtgtgctaaaagagaaagtttgtaaattcacattggtaaaaaacaaacttatgctgatatttcatacctcagcaatgaaagtgagctaccttaattttacataaaatttaaccagttaatggatgaaaacacctctctgtaatataaaatgcttcattttacagtttttttccctcaaaaaactctggg

SEQ ID NO: 157 - DNA, 201 bp, Bos taurus
tcttataaaaagaaggaagatcattgttcaccagatcatcacaaagtaaaccagtcacaagtttctggacgtgcttcaatcttcaatacaaactgaaagctgaggatcatcatgaaatcctgtagtactgaatagtaaatcaaaagctagaataaaccctggcaaggaagacagcaataagaatggagacagagaaatgga

SEQ ID NO: 158 - DNA, 201 bp, Bos taurus
attatttttaccttgcatcttaagagttcagtgccaccatgtgactacttttattctaaaaccctgccattccattgtcataatgagtccagcttcatgattgcatttccaattccatcaaccttgaactacaagagacagctacctttgaattccttatcacttaggtaaaggagatcctctggaccaatatagacttct

SEQ ID NO: 159 - DNA, 201 bp, Bos taurus
cttcttgggaaaatttaggagttatttggagtggacattccagtcatacccagataagggagctgagtcatagcccaactgacttgtgtgtgtagctcctgtcctgtttggccagatgggatggtaggaatgcctggagattacatagcacagcaagctccaacagagagatgagaaggaagaactaaccatccacaaaat

SEQ ID NO: 160 - DNA, 201 bp, Bos taurus
attacattccacataagaatttcttgtattttcttggacaaaggaacatataatatttgaatggatgtgtgcaaactaacaataccatggactgtatatcgtcacagcaaaatatcatttgatgatattctaaataataacaaaaagggggtataaatggaactgggcttattatgccttcatttattaataagatttaaa

SEQ ID NO: 161 - DNA, 201 bp, Bos taurus
ttcgaaaattcacaatgcatttgaaacaacattgtcactagtgagtcaaactgtttctataactgaatattaggactggaacaagcaacttcttttatttacatgatcaaggaagaaaacactggattttcatacgagcaattacatgtttcagattaaaaaagaaatgtcatgttgctcaacctaaattcaaggaggtca

SEQ ID NO: 162 - DNA, 201 bp, Bos taurus
agtgtgagttgtatggagaagatagagaaagaagaaaaacatttctttttttttttttagctctctaattgagctaggcaatagctcacactcttaaaactgtgagatgttgtgttacctgccatatagatcttgtgataatcatctgtattgttgtccaactatttctgttggcagtatcactttgggttctcttcacag

SEQ ID NO: 163 - DNA, 201 bp, Bos taurus
tatttttagtatcagccacaatgtggcttttgtcatataattcttagagaattcaaagtattgtgtcctccaaaaattcctcagaatgcaatatgctttttaataaaataaaattttcccagtgcttaaatctataagataaaacatagaaagataatattatcttatcatatcactgtcatgttgctaagtcacttcagt

SEQ ID NO: 164 - DNA, 201 bp, Bos taurus
tgcatttgaattctctacatccttcttaaaatttactgtcaaaaatgtggcataatgactcaaataaatgtaatggtattttaagaaggcaggcctatcagctttctaactctggatatacatgtcaagatagatttaaaaaataccatatttaatggttcagttcagttcagtcgctcagttgtgtctgattctttgtgg

SEQ ID NO: 165 - DNA, 201 bp, Bos taurus
agaatgataagtgaactcctaccagactgtgtcaatattatcaaataaatggggaattaatttgacaaaattgcaggtgtcaggtcaagagctcaatgaagtcagaaaaggtttaaataaaatcaatttgtgtgtgtgtgtggcggggggtggggggtggggaggagttggtgctgaggaaactgtagagtagatttccat

SEQ ID NO: 166 - DNA, 201 bp, Bos taurus
ttattcatttaattacacatattgttgggaaactgttatttgggcaaagcaagtaaaaaaaggcttttgacaagagaatggagacaactagggagaagacaactaaaagaagcctggaaagttaggttgggataagcttatgtatggcattatttctcatgattttccttttttcctaagaacgaaaaatcataagttgta

SEQ ID NO: 167 - DNA, 201 bp, Bos taurus
gcaggaccttaagagagtaggctgggccctgctcagaccacatatttctcatttccaaagtcagaagatctacccaaacacacaagaacagaaaaggctccttggaggccaagtggggagcaatgtcaagggatgttctacccagatgcttctttagtagaatccatcttggccaagagatgcatgtgcacatatgagatc

SEQ ID NO: 168 - DNA, 201 bp, Bos taurus
tctccatcatactgcatatagtcattaatgatggagcatttcgagccaatgatattaaaagccaagaacaccaagcttcatttaaaagaaaccatgagcacctatgctagattcttcaagtaaaatcaaaacaaattcaaatatagtcagggtattaaaataatggacatttctaaaagtaagcacattaattttttttaa

SEQ ID NO: 169 - DNA, 201 bp, Bos taurus
tattctttaatatgagaaaaattagaattttattccatctccttagatttatttcctggattttttttttttaatttggagtaacatttggattgcagaagtagggacaccaattaagacttctacagccttacttctcaacatgtggtcctgtctcattagcactaacaaacttacaggtttctcagaaatgaagaactc

SEQ ID NO: 170 - DNA, 201 bp, Bos taurus
gccctttttattaatgccgtttaccaatctagcgtggtctgcctttttcctttgttctttccctgccctcctgcacaggggccagtttagattttacccagggaagctcctaaggagggttcaaagctatacatatatgaatatgtatatgtacatgtgcatgtttacaaacacaaatcttgatagatcatggccttctcc

SEQ ID NO: 171 - DNA, 201 bp, Bos taurus
acatttatttctgtcccattatttatcttttcaaggcttttctcttgctctttcagttgaaagtagtacctctgtctttttgttttacataactttcttcgtctctgtcaatttaagtgaagtcagttatctattcttgtcttaaagtagtgtccttatgttgtagctttccaatacagattttgtgtatccagtgccatg

SEQ ID NO: 172 - DNA, 201 bp, Bos taurus
taaatatataccagttaattcctcttccaaccctcttgtgagttgattttgggattagactgccaaaagatctgattacctataaattaggtaaaagaacatgttaagactaatctagtacttcttcatgaaggtacagtagaaataacttctattgttataagaaataaaagcagaattttaaagaagatcattatacaa

SEQ ID NO: 173 - DNA, 201 bp, Bos taurus
gtttctaccgtaatagagccaaaattgtcaatttttcaaatagtaacttgttttctatgccctaaggtttgaaagaaaatagtctcataatggaaagtagtaagctggctttctgaatccataaatagcttgatttttatcagggtatggtttgctacctgtctagaggtgtttagaaggtttcctaacaataggatatga

SEQ ID NO: 174 - DNA, 201 bp, Bos taurus
taattaccccaaaatcccatgtcaggttctccatgcctttgggctgggttttacaataatcttttatttttcaatcttgacctgttttgatccattctatttaataccatcaatgaatattcccaaatcatgaattttgcacagccaattatctactttgaaagaaagacaaaaagaataaaacttttctgcctatcttcc

SEQ ID NO: 175 - DNA, 201 bp, Bos taurus
ggtatgtaatgaatgtttcattttaattacttactgttttgtttccatatctgcccagaagtgagagctacaacctcatttgggagctcccatgtatcccgagttttcctgccataatatatgaattcttgattctaaaagctgaattactgagatgaaatggctttgagttgaatcatttcactctggaaagtagttgtg

SEQ ID NO: 176 - DNA, 201 bp, Bos taurus
caattcatgtagctatgtagaggtttactttgtaacagatgttcatggtagtttaagaagctgctatgcttgattacatatccacaatatgtatgtggatgtactacctacacttaggttatttggcaacaattttgaacttgaacaatttctattgaaaattcagttaattttaaaaaatccacccatgtaattatatcg

SEQ ID NO: 177 - DNA, 201 bp, Bos taurus
ttcctaatagagttattttggtccctttacagttttttggaaatatttaaaaagtaataaattaagagaaagtatattaaaaccaattttcatggcatatcttattattttctgttttttctgcatttcctttgaaggcatttagtagtgattacattcatatttcttaaaaatatttttaaaatgtgtgatatagtcaca

SEQ ID NO: 178 - DNA, 201 bp, Bos taurus
tataaaatattttaaaatgtgctgcaatttaagttgttttttgttttgttttttaaaaatatatcaatcttctaaaacctattgaatacaacaaaatagatgcattatttctcccttttttagtatcagattgaagatttccccagggatttcaattttaaacagttatgtcccacccaatccatttttttttttttgtct

SEQ ID NO: 179 - DNA, 201 bp, Bos taurus
tttttctttaaaaatacattttttttaaatttaccaaatcaattattatcaaattttctacaatcagaaaagtatgaccaatatcaaaaaatttagagacgagttactgttttggtcccagcctatcaatagtgatacttttggctatgactgcttgagacgcttggctcagctcctgttgcttttaggagcacctgcagg

SEQ ID NO: 180 - DNA, 201 bp, Bos taurus
cttgatttgtggcctaaaatatatgatctgtcctagagaatgtcccatgcatgcttgaaaactgtgtattctgttgcttttagatgaatgttctgtatgtctgttaagtctgtctggccaaacatgtcctagaaagtcaatgtttctttatggctttctgtatggatgatttatccattgacgaaggtttggtattaaagt

SEQ ID NO: 181 - DNA, 201 bp, Bos taurus
gttgaatatcacattaaggtctgcattagttattcaggtgctaggatcttttttttaacacagaaatgccctggagcattaaatctttttttatattcatcttagtaactagaaaaagaactttgtagtggttgcttgaaaatgaaaactgctgggaactgagggagaggagatgtatgcagttctttgtcctgagtctca

SEQ ID NO: 182 - DNA, 201 bp, Bos taurus
aatgaccttggtaacatttgtcttacttgaaatgtcagaagtatttggcatagctcattactcttcttctagtaatgttattatctcttttgtcatgacaatacatatttaaggtgtttcctttactatattgtctgctgcctcttagtctcttttgctccttaaccttctctgttctctaaaatattggtgagtcactgg

SEQ ID NO: 183 - DNA, 201 bp, Bos taurus
atcatgagataccacatagaaaggattctttactctttttgaagtgagagatggcattttggaggaagtgatctgaaagaacacctaatcagaaggaaaagagagtgcagaatttgggcagtctgtgaagagatcgttggaaggataaaaggtgggagacttgaaaatgttccacaggagagaagagcattttcaaaacat

SEQ ID NO: 184 - DNA, 201 bp, Bos taurus
taataatatatgaaattgagtagtcattgaatgaactataatgactatcacaaatacttttggaaccaataacaaaggacaataagatgtttgaggcatagtggaatggctttcaaagagggctctgggcagttttagtaagatttatttttatactaatactgatgttacatgactacagtataataggctttataaatt

SEQ ID NO: 185 - DNA, 201 bp, Bos taurus
attagtaccaaaatatctaaataccataatatctaaaatggcaactgttttgcttcagatatactgttttccaaaaggattgtactgtacatagtactgtcatggaacatgaagaaacaagaaattaggaattttgttatgtattaagactgctgaataactgatgagattcttgactaaagattaataataataaaataa

SEQ ID NO: 186 - DNA, 201 bp, Bos taurus
caacaacattctgtagtggaattaatgattcagctctatgtcccttacatggcctgaccatgctcccgatcatgtagctttccccagtcttcctgttacctgagcagtagttcaaagctaggagcagtcataagcaacaattgtaagtatttaacctccttttgtagacagagagagtctaccaaagccctagttcttcac

SEQ ID NO: 187 - DNA, 201 bp, Bos taurus
tacaacaatatttccatctctgcttcctatgatataaacatccacattttacttaattgatggattcttatggaaaactgctttctattgaaactagaagctttatactttttgtcttctcattttcctgttgaaatcttgacagtcataacatatttagaatgaatagtctatttgtttcctacacgtagaaatggttca

SEQ ID NO: 188 - DNA, 201 bp, Bos taurus
tcaataagtttggccaaactgccagtggtgtgtgggtttggatttttctctctccaggaaattataacaattcagaccagactagaagacacagggtcatatctcatcatttatggcccatggcctgggaatggggactaggtggtcaagctcaactgtgtaatagtggaaaggagaaaggagatagtgtgaatggagaaa

SEQ ID NO: 189 - DNA, 201 bp, Bos taurus
aatattactgactccagtactcaagaacttttctatacctggcatttgttaggctatatgtcagatatttgacaaacatttccagacttcatctatatatctagcatccctctagatctttaaggatggcaaaatcagctctgactattgtgaaagcaagatcatacaaaagcttacatagaatagctgaaaatagcctgt

SEQ ID NO: 190 - DNA, 201 bp, Bos taurus
actcgcgggccggattgggccgagccggctgcccgggtgcggtccctgaccatggcgtccctcttcaagaagaaaaccgtggatggtgagttccgtgcctagctgaaaaggcctagctctgcgtttcccaggcttatttgggggacttccggccttgactcttgttgctgtccctgggggcggggctggatcaagtggccc

SEQ ID NO: 191 - DNA, 201 bp, Bos taurus
tctcagttctaaaaggttacctgacatttgcttttctgaagtagaagtcagtgtagcttagtataaataggatcttttttttccaccttcctgggagcagtggaaacaaagataatgcaaagccaaaggaaagaaccagggacttgcaaataatttaaatagaaataagcaaatttcaaaaaagtgtgagttttccatcat

SEQ ID NO: 192 - DNA, 201 bp, Bos taurus
cagatcaatgtgagtatttggtgcaagcaatgaactgaaagtgtagaatgtgaacaattattttgtgattaaatcagtttaactagaacatttggtgtgcgtaagtgaacagggaaacaagctggtaaagatatgggggctagcatgagacattttgagtgggagactgagaaatgtgcgtttattccaacagaagaatat

SEQ ID NO: 193 - DNA, 201 bp, Bos taurus
gtcctgatcttccaaattacctaaatatgatgaacttaagaaacccagagatgagctcactagatcttatttgtccttaaaatgaagcctacagagaggagaacaatgagccactggttgtgtatcatactccactgtgacactacaacactctcatctttcacctgtaaggtgcaaaccttgcaactgcctctcttgata

SEQ ID NO: 194 - DNA, 201 bp, Bos taurus
cccactgatttatacaatctttaatgaagacttcaagaaagcattccaaaaacttgtgcgatgtcgatgttagttcaaagaagtttattatgaaaaggttgggattctattgaggagaagtaactaaatgaaggttaaataaagcatttaaatttttagaaggaattaaagcttctaagatgatattaatatgtattttaa

SEQ ID NO: 195 - DNA, 201 bp, Bos taurus
attcttttataatttgcttatacagtcttcagagatcctgtgaattattcctatctgaattgttcagtttcagtgttttgtaaagtagcaacagactgaaaatggaaaatgttaactctaaataaatcagaaaccactcacagatttcttaaagccaaaaaagtaaacaagaataatctaattggtgctgccaagccaata

SEQ ID NO: 196 - DNA, 201 bp, Bos taurus
atatgactcccagtggtaaattcttataatgttccctaaaatgtatgattcctatcatgttttagaggtgactactgattgagctggcaggagataattccttagggggaaaacttgaatttttttttttttaatgttaaggttgactttatcccattaaaagtgatggtatattaagttaaaatatcttttaaaaaatga

SEQ ID NO: 197 - DNA, 201 bp, Bos taurus
ctccaacaccacagttcaaaagcatcaattcttcagtgctcagctttctttatagtccagctctcacatccatagtgtagagaagattattattaataaaattcctgaccagaattaaggaggaaggggaccactgacttctttagtagccatcctagaaaattgtagaaaatgggcatttgttgtcaaaaaatctaaagg

SEQ ID NO: 198 - DNA, 201 bp, Bos taurus
aacaagggagaaggaaagatccccaccttcgccttagagcctccagaggaattgctgttctgtcagcactttgattttaggccctggcttccagaactacgggagaatacattttcttgttctaagccaaccagtttgtgatggtttgtcatggcagctcaaggaaacgaatacatgggccatgtgatttctgtcataact

SEQ ID NO: 199 - DNA, 201 bp, Bos taurus
aatgggttgccatgtccttcttcaggggatcttccacactcagggatcaaactcatatatcctgtgttggcaggcggattcttgactgctgagccaccagaaagccctattattcatgcaggcagaagcaaaatgaagaagttctttgggttaggagtgactgtctctcaccagcaagagtttgcttttggatttgtggca

SEQ ID NO: 200 - DNA, 201 bp, Bos taurus
acaaggccataacagagagtgggctgatgcttcacatatatccctttatgtgtacgagtgatattacatcattacagaagcctctaggaattctgttgaagcagctgttgatggaaggttaatagaaccagtgataaagaacagtgattttctttcctcccaaactgtgtcatactttaaagcatttcagtcataatcttt

SEQ ID NO: 201 - DNA, 201 bp, Bos taurus
atacagtccaggttatttctaaataaaatatatatttttttatttttgtcatcttttatatgccagtaacatgaaactatgctctagacacccctatatgagctggaagagccacagacatattaataaatggttttaataaaccctggtattgttaaaaacatcagaaagaaaccttgtctttagacaatctaccaattg

SEQ ID NO: 202 - DNA, 201 bp, Bos taurus
atgtaaaaatagttcttactgtaaatatgaagtttgcacgtactaatggtggtaagataaatctgtagacagaagattcatttttagtcagttttgttgcgaatgcacttgtatgtctaacacatgctgtatacagcggtcctctgtatccatgggttccatatttgtattcaacacatcatggattttagaagggacttg

SEQ ID NO: 203 - DNA, 201 bp, Bos taurus
atgtggtaccaacatgctgccttgcttagtgattttatttatactccttatttcccttcagagactccgggggtagtggagggcaggtgtttttgcattactactagtcctttatgtatctattagctgttaggtaatacatatttgtgattgagactaatcttttttattttctctgtattgccaggaacctaccattga

SEQ ID NO: 204 - DNA, 201 bp, Bos taurus
gatttttctgcttcactacctcttttgtaggtgcccaaaataactgctgattgtgccaagttgtatctttatcacctgtcaaagagctcagtgctctgtcgtgtggtgcctaaggtaaatatgcatttattctcgcctttacttttcttattgagctctattcataaagcttcacttcttttcattggcctttgtcatctg

SEQ ID NO: 205 - DNA, 201 bp, Bos taurus
aagttgtggctgccaccacagtcactttttctcccggcttgtcccttttatctgccttcccaaagtaggtgggtggcactgccgggcctttgcacccaccgctgtgggttgatggcagctgcagactctgcccctgttggatacatgcagctctggtcaaattagccattataaaactcagaaatgcagcaaacttaggct

SEQ ID NO: 206 - DNA, 201 bp, Bos taurus
acccccttaaaccactgactggcctactgattaaacatgagttagcttctcctaggaaagatgtcatgttttcccaataccacctccaccctgtagcacatggcctttgactatttatttaacaaagctattctgctggggaaaaaaaatgccaaacacttagaaaaatgcatttaaatgcttgattatcttgatgatttt

SEQ ID NO: 207 - DNA, 201 bp, Bos taurus
taaaaatatgtgctttgattaaaaataaacaggcatgaaaaaaaaaatctttcttccccagaatatttcccaagttgtaacaataatgctttttaaaaaccaagcaggaaaacatattgccttcccctttatatatttgtaatttttgtgtacacaacatatagatattctcatcacttattaatttctgttaatattgtt

SEQ ID NO: 208 - DNA, 201 bp, Bos taurus
ccacaactacagggttgtttcgtttcaagtcacggactctggataccaaccaaactggcagatgaaaaataactcagccggggccatttcacccaccagtgatctctgtgtgtgagataattcctccctgaggtttctttctctcctccactgtgtttttaaaggcctaaggcagggcagcaggctggtgccactgtctaa

SEQ ID NO: 209 - DNA, 201 bp, Bos taurus
gtagtggactcagggaagtggcaactgggccttcagcctatcatgctacctgcagcaagttctcctgaaggaaatctaagttgcatatctcacaaagtcacccaaaccctactctaaggatagagcttacgctaaggtatgaaattcctctgtgactcctatcggtgcaggagtatatgtgtgttttcaaccagccatcag

SEQ ID NO: 210 - DNA, 201 bp, Bos taurus
gccattctcaacatcaataatgcaattggccctggaactgctaatgcacatgcagtgcagtgaagttttgcaaaggagaccagagccttgaagatgaggaacacaatggatggccattggatgttgacaataaccagttgcaagccatcactgaagctgttcctcttacaactaaatgagaagcttccaaagaactcaatg

SEQ ID NO: 211 - DNA, 201 bp, Bos taurus
gcagtttttatttttatcacttggtttaatttttatcagtctaaggtggtgtctgccaggtttctccattataaggttatattttcatgtgtaattaatatgtatcttgtgaggagacattttgtaactatggaaatatcctgtttcttatcatatttttgtctactagttttagcatccatctgtgactcttgcctgata

SEQ ID NO: 212 - DNA, 201 bp, Bos taurus
ggcaaagaatccaagtgttgtaattctttagaatacatttaatatgaatttttgcaattataacttaatggccatggggagaaaaaaaatctcttaaaaagatctatttatactaactatggcctttttgtttccagatgaagaagtttggatcaaaactcgtttgggagtggtatattatcagtggcaagttttggttct

SEQ ID NO: 213 - DNA, 201 bp, Bos taurus
attgtttcatcttttgcatgttttaaaaaaacttaattttacctttgtatttggaagatttttttttctttaagtatttgaaagaatttgcttaagtgtcttctcacattcattgtttctgatgagcattgtgctgtcatctttttttatagataatgtgtcacttttctctggctacttttaagacttttcttcatcatt

SEQ ID NO: 214 - DNA, 201 bp, Bos taurus
aaaaacatgagtatctctcacacagatcatcacagaccatcaaattgggttttccaagtttccatttgccactagggacatacattgtaataaatatcatcggaaaacttaaaaagtgtttaccaatttgttaatcatgactgatctcaaatagcagcccctatatccctgcagaaatcctagtatcactaatcttcttag

SEQ ID NO: 215 - DNA, 201 bp, Bos taurus
gtggtgttaatatttcccaaataggctctttgacagtgcagttaaggtagactggcttaatgtactgcattgaaagtagttttttttttttttggaaaaattgtaaccctgccatatccaaaatgtttttctcagtgactctctactctcccctttgtatcttcatttgctttccagtcctttttattttcagttacacta

SEQ ID NO: 216 - DNA, 201 bp, Bos taurus
tagtgagttggttcaaggccagccaccttattaagtgtgtgaagagttacagaaaaccctgtttttgcttttacccccatattcatctgtactatggggacagtaatagtttctacctcatagggccattgtgaatacagatagtatgtttcttcaaatgtaataaaatcgataaacattgaccctcgataaacgtttgtg

SEQ ID NO: 217 - DNA, 201 bp, Bos taurus
atacttgagtgggtggcctttcccttctacaggggttcttcccaacatagtaaagggtctactaaataataataataacctgagttctgaatcattcagtaggccgcatgtcctctaacccatgaggctcatctgcccatggaattttccaggcaaaaaatggtggagtgggttgccatttccttctccagaaaatcttcc

SEQ ID NO: 218 - DNA, 201 bp, Bos taurus
gaagttatatccatcccacaggcaaaatacaagtatcctgtctcaatgtttccaaaagcctctatccattacaatatcaactaaaagtcccaaagctcatctaaatctcaatagctcaaaaggtccaaatttcatcttatagattacctaaatcaaatacaggtgaccaaatataaagaccgaaaagcagagacattactt

SEQ ID NO: 219 - DNA, 201 bp, Bos taurus
gctggacagctggtgtttttcaagtggaataaaattgaagctttgttttccctagatactccaaggacaaagctaatggtaggagctgagctctgctggagtagagataagagggccactcccaaggtcaaggaaacctctctgactatgtatgcataggaaggctcactggagatccaaatggtcgggggcaacaccctg

SEQ ID NO: 220 - DNA, 201 bp, Bos taurus
agcagttttgctcaatatgatatcacattcatgaggagggaactcatcatagagtctgtttcagttgaaccctccactttcctttgcaagatgcaaatatattcttcagttcttatacctgggagctcttaactgtgtaaacacactactgcctccccatccacttactttcacatactttcatatgtcctcttacaaatt

SEQ ID NO: 221 - DNA, 201 bp, Bos taurus
ttctctcatagttttggaggccagaagtctgaaatcaaggcattgtcaatgtcaagctccctctaaagtttctaggaaagagtctttctttgcatctcccgaacttgtggtgttggccattaatccttggcatcccttggcttgtagttgtgtcactccattagctcaaatggtaaagaatctgactgcaatgcaggagac

SEQ ID NO: 222 - DNA, 201 bp, Bos taurus
tctattacattggatagcatgatgagcattataatattcagtaattgcattgagtaatatgaacattctatgtgcatggtcttttaatattttaaaacatgtctatataattccaaagaatttacataataaaaatatgaaaataacataatttataaatttgacacctcaactgaaaggaaacctactccataaaaaaat

SEQ ID NO: 223 - DNA, 201 bp, Bos taurus
catcatacaacaaattctcagtatctattttacatatggtaaaatgtatttttcaagctcctctcaatccatcacaacctctccttccccagctgttctctgtgtctgtgcctctattactgccctacaagtaggtttgtcagtactatttttctagattccatatatatgaattaatatatgatatttttatttcccttt

SEQ ID NO: 224 - DNA, 201 bp, Bos taurus
aaattatatcttgttaaaacttcagtaatgcagagaatgaattaattgaaataaaaagattcctggaaggttaggaaaacatgcagcccttgcagtttcaattttgtcaatgaaagaagttatatgctataaacatataatctatacttttgttcaaacaagggagcttttacatatcatgtttttaatgaattaaaaatg

SEQ ID NO: 225 - DNA, 201 bp, Bos taurus
cccattaggtcgagttattttcatttcataaatgagattgaaatacagaaagtttaaggtcatagtttgttatcttttacataaattcttaatgatatctgatttctaacataaagttatttcagagagattgctgttatatcaaattaaaatgggatttgtttcattgagtttgtgctaaatatattttattatgattct

SEQ ID NO: 226 - DNA, 201 bp, Bos taurus
gcccttcttaattcaaatgttactaaaatcttacaatctggttagtatcttactttggaaaccacagtctaaattaaacatctttggtagtaactaactttcattgtcaataaggcacttctagttaaagagacatctttttggtcatatgtaatttccagtggaaagaaagaaagtactgaatattactgaagttaattg

SEQ ID NO: 227 - DNA, 201 bp, Bos taurus
gcactgacagtatttctgagccctcatactatgagctgcatttttcatatagatggaaaatattgataaagatttttttggtacaatgttatcaaaagaaattcagagcaaaaagaattgtaaagacagagctccctgatgttggtcagcttacttggaggtatctcaagccctcatgttcatcttaagaaagatgttaac

SEQ ID NO: 228 - DNA, 201 bp, Bos taurus
ttttttttgtaattgggaagagagattgggatcaactccaaacataacaactgggaatttatagcaaaggaacaaggaggccaggatggggggtgtgcaagtcagtggatggaaaattactaagaggaaacataaggggtcgggggaacctggctaaatggacctaacagaattcttgctgaaggagggccaggtggtcag

SEQ ID NO: 229 - DNA, 201 bp, Bos taurus
aactgccccggggaagacagaaagtgtttaaacgggacaagacttcataacatcgtagatctgagtgtggaagccaagtctggaagggaagtgtgggagacggtttttgatttctaagagcagagcaggaatcaggactctagcgaccactcctccccactcccccacagtgcttttgtttttggtcattaaacctgaggc

SEQ ID NO: 230 - DNA, 201 bp, Bos taurus
gcgggcaaacttggactgatttttctcatctggaaggacccccatcttcacacccccatgtactcattcctgggcagcttggcctttgcagatgcttgctcatcatcttctgtgattcccaaaatgcttgtcaacatcttagacaagagtcaaatgatgtctctctttgagtgcatggcccaatactatttttttggttcc

SEQ ID NO: 231 - DNA, 201 bp, Bos taurus
ataaaaagaaaaaatgagaaaggagttaaataaatgaaagtcagaacaaattataagaggatgtttttagcccagtgggtgtccataaataatgagaagatgggagctgcctctcattgtccatgataccttgaaagacactgtctagttttcttgtgtattatacagtaatctgaaaagcttcactaattcagaaagcta

SEQ ID NO: 232 - DNA, 201 bp, Bos taurus
gtaaagaacaaagttacccaaccagcctctagatactctgtgatcactcacactggcctcctttgtctactttgtctccactttgcctctctctttgcacgcatgctccatttgctatttttctttgtttctgtattgtttctgtaatgatccaactctctgagaagctaggcgtgcaaatgaaggaagtctctgaggatc

SEQ ID NO: 233 - DNA, 201 bp, Bos taurus
actgaaattccgtacacctacttactgatgtactgaggaccttatcctacaagctatctgcctctgtcttttgcaaaactttccttttatcatgttggtactcaaaagtcctaaacatagttgccaggttatacttcatagacagaactatgattaaatcatatcccttttcaataacttttacaggattgacattgctga

SEQ ID NO: 234 - DNA, 201 bp, Bos taurus
gtctagatactttgtcatctgatgaatagctcctgggcacactcaaccttgtacttttttatctgataaattctagctcatattctggcctcttggtcacattatgtcccaaagtaaaaagctcttagggtagttttttttttttttttaatagtttataattctttgctgcagtcaacaaggccttgctcaaaaaccata

SEQ ID NO: 235 - DNA, 201 bp, Bos taurus
aatggcctatgattgctatgtggccatctgcaaaacactgcagcaccacactatgatatcaaagaaactctacattcagatgaccacaggggcctacatatctggaaacattcatactatgattcatgtagggtttctctttaggttaactatctgtcagtcagtcactcagtcatgtccaactctttgagaccccatgga

SEQ ID NO: 236 - DNA, 201 bp, Bos taurus
caaaggaggaagctggagctatatttggcatgtttgcaataaatctggagatgattataataaatctttaataaattaatacaataaattattataataagtccataacaagtagactaaaagagttgcttgaggttatcacagttagggacgacaggacaaattggtttatccatctctggataaagattagctgaagag

SEQ ID NO: 237 - DNA, 201 bp, Bos taurus
ttacacgtggatgaaatggtaattttttctgaaggatagactgctagattgtaaaagtggctataatacatcgtagcttcttccaccaggagatgtctatttttccaccctttgaatctagacagatattatgactcatttcaccattcatgtacaacaaaattgataccacaccaatataaggcacctttcatttcataa

SEQ ID NO: 238 - DNA, 201 bp, Bos taurus
tcctaagagttgttttgaaacgtctgctgtagggttgccagtgtcttagcatggtaaactgagaacattactttagatcagaagtttgatgggccatgtatagcacaggaacagacagagagaccaaaggaatcaggactcctcccctgggtaacagttactccataagaggagaccactgagctgagtgacctgaaggct

SEQ ID NO: 239 - DNA, 201 bp, Bos taurus
ctagtctactatggatatacttgatcagagctgggatttattatagtaaaagtccacgcagtgctgaaagtccagattatgctcgaatgaatgtaactcacgtgaccttgctcccaaatgccctgggggctcaaaagcgctcctaggaggaaaacatgaattcaaaacagaaggctttataaggagagttacgaagacaac

SEQ ID NO: 240 - DNA, 201 bp, Bos taurus
cgaatagctgtgaatataagctttctggaattcagagacctacacctttatagatgtgagatatctagagaaatgtgacagtgtaattttatggatttcctatttttctctaaggaagttataggaaaggaggagagactgatagtatctagaaggatttctccatattagtgcatcaataatgatgagcatggggttttt

SEQ ID NO: 241 - DNA, 201 bp, Bos taurus
aaaattcaagtccacctgtacaatgcagggactccattgtgctgtcatctcacagggagagtttagtggagatacatgagtccccagaggggcccccattaaaacacatggctctcttacaagtaaacagtctgaatcatctatatcattttaatgaaactgtgaggaccaataatgcatagcctatcccaatgccatttc

SEQ ID NO: 242 - DNA, 201 bp, Bos taurus
attgagtctctagagttcttctcaaaatgtttcttctcccaccaatttgactctgtaatctttgaacactttcactgtggttaccatgacagatattacagccttgtggacccactgctcatctaactggaaggtcacttgaggctggtttctatttcacctcttgtcctctttcgcttttcctcttgctggtcacagaat

SEQ ID NO: 243 - DNA, 201 bp, Bos taurus
ataactgctgagtttgctgatttttgaatctactccaagccttactcctcgagcatctgctgatggttggggtatctgaacgacgaaccagaaagattcacaattaatcttagttctagaaccaaaataggggctctatattttaaagtaatgaggaaaaaaaccctagacctttaaaggatttttaaatcttcatttata

SEQ ID NO: 244 - DNA, 201 bp, Bos taurus
ccaggtatgctgaagtccatcgggttgcaaagagtcagacaggacttagcaactgaacaataagaaaactaatcactctatatttctgggccagctcttatcttctgaaatgtcatacattctgcctatggagtaggtatgttttttgttgtttttttttttaattggccataccacgtgacatgtggaatcttagttccc

SEQ ID NO: 245 - DNA, 201 bp, Bos taurus
ccctactgactcagaatcttttctaggctggggccagaaatctgcattttcaaccagcaccccaagggatacttatgtacattaaggtcctgggccagaagtacagataatcacaatagctggttgagtagggagaacaagagtgggaagcaaatacccttccttggtggtgtctagctcgatactgtgagccccagttgc

SEQ ID NO: 246 - DNA, 201 bp, Bos taurus
cctaaaatttctcagatgaggcaaaataaatttaaacaataggctgcatcctcaaaacaatagtcatgggttatatttttgattgaagacctgcactcaaattttaatagaatttaccacaatattaaaaaatattagtgggatgctttattcaatttagtactaacctttttatagtgtgtgaaaattttaaaaagagaa

SEQ ID NO: 247 - DNA, 201 bp, Bos taurus
tattaataaaaaataagaaatccagtttttttctcctacccctttggattaccttgatcacttcagggagatcattactctggcctataggaataatggagggttgttaatatagagtagatacatttaaaacacttaaatattatgtaccactttgtttatataaatgttctcacatgaaggacaaggccttcagtttct

SEQ ID NO: 248 - DNA, 201 bp, Bos taurus
ccttcagctctctacctaagtgtcagcttttctgtgggcctcctcccttaccctgtggcttaggacatttaccgtaatctgaaaataacttatgtatttacggatttttttgtttatcatctggccctgttgctaagttatgaacttcttgagatatttattggcatctactgttagaagagagtcacagctggccttcga

SEQ ID NO: 249 - DNA, 201 bp, Bos taurus
cccagccaagttatgaaatcctcgaagatcctgatgacctttcacccaactgaccatctgaattttcctgtactgtgagagaccctgatgaaaacagcatgtttggggtggccagctccctgcagggtgctgcgataagtcgtctgcatgcgctctctcactcacacctcagagtaatcccatgcaattgtactattttta

SEQ ID NO: 250 - DNA, 201 bp, Bos taurus
ttttttggacaggacagcttattaaagtacttgatggtgactgtaaattaatgagagtatttcatagcaagacaaatgatgtcctgagttctctttaagaattcatttcttactatgttttcctcccttaggggaaaatgagttttatgatatagcagagtctttttcacatgtatgttgcccatttgggactatgctttt

SEQ ID NO: 251 - DNA, 201 bp, Bos taurus
tgcccaggccagaactggcacgagacaagcaaggtctagaacttgggcactaggtgcctttcttgtcacaagtaagtgcccctaggttggcagtgtcaacgtaggagtggccttgttggttagcagtgttgacccaaagattcttggtgaaaaacctaagaactatgggggaaacacagccttcaaaagagattttttaaa

SEQ ID NO: 252 - DNA, 201 bp, Bos taurus
attccagctaaatggttggggtagagaattagggaaggggcgggtggggagaggcaggaagtgaaggatgtggatggcctgggaggtgtgtgctgcttctccagagtggatttctagtacctgtggcactaaatatagaagatcatgggtctggttgattcagaaaggtaatgtgccaagagggccttgatcttgacagca

SEQ ID NO: 253 - DNA, 201 bp, Bos taurus
gataggacattttgaaaaaggtgaaactacaggacaaaaagcagaccagctgttgtagggccgagtaggaaggggaaggacaacattctgagaagtggcacgacgcgcctgtgttttgtctgtgatggtggtcgcacacccccgtgcatttgtcaacacccatagacttgcatactttaaaagagtagattttaatgtaca

SEQ ID NO: 254 - DNA, 201 bp, Bos taurus
gtgtttaggaaagaaggccactggggctggaacagtcacaggaaagaccaggaggtgggcagaagccagatgatgcagggcctgagggccatgagtttgacttttttttttttttttcagaaaaagaccagtctcttggtgggtgacacaggttgggcatggaccccaagacagttgcccacctaaagggaggccccccga

SEQ ID NO: 255 - DNA, 201 bp, Bos taurus
cattgcccatgtgaccagtaaaaagtgttctttggttatgttagtgctcatcagcctgagtgcccgcaggcggtttgaggatctgggccagtcagtaggtgtcttccaagtaggttttctgaacacaatcctccaactccatctctgcttttcttctaatcttaaaatctggcttgtgctggccaaatctggattagttca

SEQ ID NO: 256 - DNA, 201 bp, Bos taurus
atatgcagctgtttaagaaaaaaaaagaaatttagaaaatacagaaactaaaacccacccataaatgtgtagggaacaccaattactgcagcaactggccaccacacacgggaacacacaagtgtgtttttcttctacaaaaactttcagcctccccctcttcccaccggcctctgctctgctcaccaagaagactacgct

SEQ ID NO: 257 - DNA, 201 bp, Bos taurus
tggtgcttagtaaataatttgtacactatttcgtgtgcagttggtagggatattaatgatttttgtcttaaaagtcagtaccaggtagtttaaactagtggtccagtgttcaacagcattctttcttctgtatgtgagtttttaatttattggtctgtgatctacagttttcaactaagtatatgctctcttcaaatttct

SEQ ID NO: 258 - DNA, 201 bp, Bos taurus
tctctgtcaacctccatgtattgatgtgagaggaaaacatgagaagcagttctgacaccctggttgaaatggctgggccccttaaactgagaattgactacatggtttgagtttccttattgtcatttccaaacagtgagcacagaggagctagaaagtctctttttcttccagggccttcagggacctgggctctgatca

SEQ ID NO: 259 - DNA, 201 bp, Bos taurus
aacccttgcacgcctcgtcagcttccgggccctcagaagccctgccccgcgtctgggactgtgcctccctttctcgtcatccactctggggccaaccatgctgctccggctcccctgactgtgaggggaggctgttcacagtgtggtgtgagaagagcttgccggtgtggcctggagcgtccgcctgtgtgagcgcaaggc

SEQ ID NO: 260 - DNA, 201 bp, Bos taurus
tagctttctccttcaattaggtcaggttgttcctcctcatttacaactgaacacagacttcttaattttcagaatactgtgacagagaatgagagttccattttggacttgaaggaagtgtgtttaaaataagagaaatactttgttgagatagtgtttaatccccagggcattttcacaaggagtttgaagcaaattaag

SEQ ID NO: 261 - DNA, 201 bp, Bos taurus
tttctttgatcttgcatttctgtagggggacacacatttcagatctgggttgctctctaatactgaagtgttgctaagagtatcttgcaccccctccctaaatactatggaatttgaagtacaaagtaataaaaataatacagtgatgtgaaaagaagaattgctgtctttatagactagtggagttccatgctctttgcc

SEQ ID NO: 262 - DNA, 201 bp, Bos taurus
gaagtagtcggaataaagagggcattgagtaagaatacagttggaattcaatgccagccaaaaagaggaataaaagagccaaaggatacttcttgttattaaaaagcctcattagatcatttgcttcaaagtaaagttcagttttgcacagtaagttggttcatgtggtgctcatgttcctccctctatactgatgaagga

SEQ ID NO: 263 - DNA, 201 bp, Bos taurus
ctctcctcgttcttccatcagtcagttagtgacatttacttggcgcccactgggttcagaaggccaaatacaggaactcaaacaaaggcccacaattactctcacaggagctcaggacgctgagagtacttttcagtttaccccttggctttttctgcaggagcacatctggccttctgaatagagttaatactgggttac

SEQ ID NO: 264 - DNA, 201 bp, Bos taurus
taatcccttcatttacattacagtgagttttatctcattctgtaaaagtttccagacctacaccataacattcagcatcaagttcagaactacagtatcactttttattcaaatatttatcaaatgccaatattttttgtaccatctaatttggacacagttttactgaatactaaaggtactgtattgatacaaggatcc

SEQ ID NO: 265 - DNA, 201 bp, Bos taurus
cataagtaagtatatcaagttttcttttttagaaactaaagaaaatcttgaaagacttctgtattttatttaactttgccactgattagttctgtcataggtcattatgaaatcagggcaagaactcttatgataggcagccaaggatgtcaactgactaaaaggtaaggtactgcttttattttagaagataattttaat

SEQ ID NO: 266 - DNA, 201 bp, Bos taurus
aaatacaaaccagaagttacctttggatgattaggggtagaaaggcaattaagattggatcaacaattattcactcagatcacaactatttattgtagtgttagaaagcggaaaataaaatagagtttcacggtaaatgaaagttaaaagatctagtattatgtactaactgacatccccaagctttttaaccacaatttt

SEQ ID NO: 267 - DNA, 201 bp, Bos taurus
actgcatgcaggctttctctacttgcagagagtggggggccactctctagctgcagtacatgggcttttcattgtggtggatcctcttgtggagcttgggttttaggtgagtggccttcagtagctgctgcacatgagcttagtgattgtggcgcatgggcttcgctgccctgagccatgcgggatcttcctggaccaagg

SEQ ID NO: 268 - DNA, 201 bp, Bos taurus
cagcagacgagcaggaaagctttgtagtggaaaaaaagggaaggctgctggcatgtcctgattggaccatatcggcatgaggaagctgtctacaagctaattaaaagggagccatcctgtgtcactggttaggggtgcctatgtggctttctctggtgggtcctaagttggaagcaggtataaaaattacggaagctataa

SEQ ID NO: 269 - DNA, 201 bp, Bos taurus
gattgtgtttattttgtatttttgtattgtatatgaattcttttttaatgtgacagttaaacacatcttttaaagcatagacacacatagaaaaaacatacggtataatgatttccttgaagactacaatgttagatttggaggcagcttcagactgattggtggtaactacttgctgagctctttaaataagtaataact

SEQ ID NO: 270 - DNA, 201 bp, Bos taurus
ccccttaatgatatcgataagttaatgaaaaatggcatagctggcactcaaaaaaaaatcaggcagtcctatgcaaagaactaattctaatactgtagttcggtgtttcactaaggaattccctgaagtatcaaagaccaaaccttccagctctatttgttaatcaaatcagtcacatttaatatcctttctatattttta

SEQ ID NO: 271 - DNA, 201 bp, Bos taurus
tgtgacccaggtagatggccactgctcttaggtcacagagacgggttggggagaggttcaccgctgcctgaaggcccaggccaaagccagtgggtggccaaggaaggggttctggagtcctgcaggacagagccccaagcctattccctgagtcccccagtttatccactggcctaaggcgagggagagggctgggatctg

SEQ ID NO: 272 - DNA, 201 bp, Bos taurus
tacagagggtagggagagcatctattttggaattacataagtctgggttcatgtcatggttttactacttaatccctttttggccttgagcaaattacttgagctcttagaatcttggtatccttatttataaaatggggaaaataacatcgcctccatggccagttgagagcatttgaaaagagctgcacattttctact

SEQ ID NO: 273 - DNA, 201 bp, Bos taurus
tatatattttagacattaatctcttaccagatatatggttttctcccattccacaagttgctttttcactctgttgattgtttcctttgctgtgcagaagctttttagtttgatgtttcccttgtctatttttacttttgttacctgggcttttagtgtcataccgatgaaatcactgcatttgttacccatgattttaat

SEQ ID NO: 274 - DNA, 201 bp, Bos taurus
ttctccactggctctttctagccttgtcagtctccgtttgatatccctccagtttgtccctttgcttgtatcccaggttctaattgctttgggcagatttctcaaatgcaatgtgttcctttatttgtcgtgcattttcatcttgttctttctgctttactttgttttttttcttaatctacatgtcatcctcctaatgac

SEQ ID NO: 275 - DNA, 201 bp, Bos taurus
ctgttaaggtataatcaatccctttatatccattttgttgagagttttaattataaataaatgttggattttgtcaaaagctttttctgcatgtatcaagataataatatggggcccactcttggtaaaaacttctgctattgcgctcttaaaattctccataattttatctttgaaactgtattttgtaagtgaggtctc

SEQ ID NO: 276 - DNA, 201 bp, Bos taurus
ctttactaagctgctgttagtggcctgtttcaagtaacatgtgtttcttaaccatttttggtaaacatatatgtgtccagtttagcctgtaataataattctcaattcttccacaatgaggccctcctctctgattttaaaaaataattttcttcctcacaatgcccatattataaaatacatctattaaacaaattgcat

SEQ ID NO: 277 - DNA, 201 bp, Bos taurus
caagcctgtggtgggggcagcactggcactagaaaggttgattgaccagatggccagggaatccctggtattaaaagataaaaactataaaagatgtggatctgtactacatatctgttagtcactcagtcatgttcgactctgcaatcccatgggctgtagcccagtaaactcctctgtccatagagttctccatgcaaa

SEQ ID NO: 278 - DNA, 201 bp, Bos taurus
acccagggtcttaggtaacatacaaagcagtaacaattggtgatataccagaaagaatactgaacaagaagttgagagactgacattcactttgacaaatcgtaatttctctaaaattccattcgatcccttatttttgtgctttattaatttcctgttggaaatgcaatcagcatttcttctacttcatgtgtcaaacta

SEQ ID NO: 279 - DNA, 201 bp, Bos taurus
ggcaaattgagtttcaggcaaattgaaaggtatctaaattctttcagatcaccttggtaccgattagtgtcctggtgtgttaatttgccaaatggacacccagggaaaagaaataattaagtcaataaagaaagtaagtaaacgcttacttatacataagaacatcctatactggtatgagctctttgatttgttgtatgg

SEQ ID NO: 280 - DNA, 201 bp, Bos taurus
cttgctgcactcctcagagtcataacacactggctgcctcaaatagaaacccatgctctagtttggctccatggaaccaaatcattgcaacaggcagggacagccacttccctgaaagaagggaggatggaagctacaaaacaagagaaatgatttgggagacagcactaattggcacaattcaaatatctacccacctag

SEQ ID NO: 281 - DNA, 201 bp, Bos taurus
agctgtttcctgtattttgttggtacaaacgaagactggatcttaccgtaaagataatttcccagcccaaagaagggtatagcattgcaaagataaaaatctcttatgaaaatctttatcagtctaagttgtctaaaaattctgaaattgttgaaatgcagagcaagaaattagttaaatgccatgttgaattgcagctgt

SEQ ID NO: 282 - DNA, 201 bp, Bos taurus
tttttcatcatgtggaggcagcgagttgtgttaaattctgcttctttgggaagatggagagtctgctgaacattatctccctaggaagataatttaaatacttaaaataacaggccatttgttgaccttgcagcataatagcatgtaacactccttgctggctgcaacagcttgggtttttacccttcaaccatttcacat

SEQ ID NO: 283 - DNA, 201 bp, Bos taurus
aaggcggagaaaagcaaccagagctttggttatgtcataattatgatatgaaataaaattccttttcctctgggaagttttccctggtaatcaagaggaagttatgtcttccacttctgactttccagtgtatctcctaaagtacttagaaccttgtatggtagtgatttatggatactctccagggtcttatgatactgc

SEQ ID NO: 284 - DNA, 201 bp, Bos taurus
tcaggatagttccaataaaatgaactaccaagatatattagtgtaactctttgccagcagggaagcaccctggatcatttcctttgtttcaagcaattctgttcttatctcaatagactcttctcaagggatgagtggggagcagttcaaaaatagcttatgagttcttctagatcttggagggcatttttctatacaaat

SEQ ID NO: 285 - DNA, 201 bp, Bos taurus
ttttattcaggttgttaatgaattaaatgctagttcacctaactgtgggtcaggattcataactaaaattctcagttgtgtaatagcaaagttgagtgtgattttctccaagtcctcaaggggaaaaaaaaaaattggcttaaaaacatgaaccatattttgttaaaagttcaggctcaaagctcttatcagagtctcctt

SEQ ID NO: 286 - DNA, 201 bp, Bos taurus
tttcattgatgtataattgataaaattgttagatatgtgaagtatgcatcttggtgattttgatagaagggaataatgtgaaaagattcctcctatctacctactcatatatttatcttttgggggagagctgatgagtaatttttcttagcaagtttcagttgtgctatacagagttatcaactatactccccatgtcgg

SEQ ID NO: 287 - DNA, 201 bp, Bos taurus
aacactgaagtggacttaaatccccactgagggccaacagtctgaccatttaccagcagatttattagagctgtggagacagtttagcctggcaaattctgggcttgctataagtaccacatgtttcttggaagttttcgtgaattgatactgtgactgaacctcttagccataatttcagtgtccagtctcctcttcaca

SEQ ID NO: 288 - DNA, 201 bp, Bos taurus
ctcccatgagtgggtagatgagaggagcattgaaccaggtactatgtatcaagatcttttagttcaaattccagtctttcttttgataaacttttcaaccgagggcaaattcacattttcatgtttaaattttcatctaggtaatgccagagatttggtgttctctgaaatcttatatttcctgagctacctttcaaaggt

SEQ ID NO: 289 - DNA, 201 bp, Bos taurus
agtaaggcaattgccaagtaccactaaactagtaaatgatttaaccagaatcagaagctgtgcagtacgacagcaatgtccatgtttttatatgcaacattatttttgccttgccagaaagtctgtagaataaaaagagtaaggggaaagaaagtactaatacaagttttctgctattgtggcttcatctactaataaaat

SEQ ID NO: 290 - DNA, 201 bp, Bos taurus
cagctggcacaatccaccagaagccccaggatgtggccccacccatcagtgggccatcactagccctggatccaggcctcagccatcaggcaaagggcaccagccctggacacaatcacctgtgagcctgcactagcttcaggatctggccccatctaccagaggtgcaatggcaccccactccagtacttttgcctagaa

SEQ ID NO: 291 - DNA, 201 bp, Bos taurus
acaagatctgttaagcattctcagttctagaagaagcagcctaagaataaggttgtgaaaaataccttctgtgatctagagtttgttaagaaaattggctgcagaaagatcttaactttctacattcttattttagagagaaaatagggaagttaagaaatttaccaaggtcatatcatttgggaatgcaaagcaaaatta

SEQ ID NO: 292 - DNA, 201 bp, Bos taurus
agtatgtatttctaagccattcctaaaataccacacaagaattgaaatcaatactgtccaattataggtcttaggcatggtcatagttaaatcactgtatatataaaatggtgttgctaacaataatcctcttcacagataacagtaacatttctatttgtgtcaacacctattttctgtgactgacacagagtatttttg

SEQ ID NO: 293 - DNA, 201 bp, Bos taurus
gctatgattgttaactctcttctgatcatgtggctaaaaattaatgatttatgaaatactggccttgcttcttcgtttcattattaattaataatgaggatcaaaaaggcaaaaaataaaaaaaattctttgatgtgccaactttagtgctttacagatatctgcataacaaaagtctgttatatgtgaactgtatctact

SEQ ID NO: 294 - DNA, 201 bp, Bos taurus
aactgcctgccttggccaggcatgataataactgctggcatgagttgtgtcacaacaggagaggcttgataagaaatatggggctgtcaacaaaactagccgggagaattcaggagggccaaaaagaaggaggaaacgctggtccataatttgccttgccaatctcctagaaaccttcaagaatctctctcgtctgtgaga

SEQ ID NO: 295 - DNA, 201 bp, Bos taurus
tgttcttaggatatagtggtgacttccaagtttcttatatgctgacccttgtttactatacagtacggctttttgagcatggccaatacatctgtgtctctgccatcctctatccagtccatggctgatgatgttaatctcataacttactaaagtgcatatcatctgtagccagagcggccctttgcaggccttctgttt

SEQ ID NO: 296 - DNA, 201 bp, Bos taurus
atttgactgagttactgaacagcaacaacaatgtgtggtcaaattatagtaagaaatcatataagctagttccagaatggtttgagcgtatttactttcataccttcattgataaaacatgtgaaagatcagaaccaagaggacctataatttatggagggctcacatataaaaataaattgatcacaggttaaaaaatgg

SEQ ID NO: 297 - DNA, 201 bp, Bos taurus
aattttgtcgatctgtaatgattcatttatgtttaagtcatccaaagttttaagcaaatatatcaaagtaattttagtagcagtaaagtattttggatagatatgtttgtcctgtgtttcaaacagtatactaatccctacaaaaaggttccatgatataatacattcagctgattttcaaagagcagtttatgaaactac

SEQ ID NO: 298 - DNA, 201 bp, Bos taurus
cattttgagtaaatataaactcataatcactgtctaatctaacaataatgtgtaacctaaggttaaaagtaataattaaaggtagagctacaataagtgacaataatgtagtgtgaaacgaaaataattagattatttatgagaataagaattaataatgagaatgattagaaataaagttgtctagtgcctttctatttc

SEQ ID NO: 299 - DNA, 201 bp, Bos taurus
agaataagcaagtacagagagaatgccatgtgaagatgaaggcagaggtaatggtgatgcaggtataagtcaaggtatgccaaagattgccagcaaacctcagaagctagtgaagaggcatgggacacattctctctcagctctcagaatgaatcaacctgtattaacaggtttttaggctccagaaatgtgacatagtac

SEQ ID NO: 300 - DNA, 201 bp, Bos taurus
taagataatattgcattcctcaatagtttatcttaatgctactatattaaaactaatattgaggcatacgtaatgtctttaataatgataggaaatatgcatagcatatatatatgtatgtgtgtatttatgcaatgtaacagcttagaaaaaatatagatagtcatcatgactttgaaaaaagttttaatttaaaatgac

SEQ ID NO: 301 - DNA, 201 bp, Bos taurus
gtcccagctccacataagtgagccccatactcaaaccagagcttatattagctgttttgtcccattcacatccattggcaacttcccttttgtagcaccccacacttttcctagataaagcctttctacaccttgagagtttgagtctgtcctttctctttcaaactaaacctgcagcttctacttggaaatccaagagaa

SEQ ID NO: 302 - DNA, 201 bp, Bos taurus
caaactgaagttgtgggctgtgcatgagcagacatgtgtggaaccacatcctcaaggccaggggtaagagcctcaccttcaagcagctggccctggactcccccaagggcttcagcatcatcctgctctctggtcctcacaaaagcagggaggtatacaggcatttccttaaggcccggggagcagcatggccacaccaaa

SEQ ID NO: 303 - DNA, 201 bp, Bos taurus
aacacaagttctaaatattagatatgacttttcttgcaggctcaccattttttaagtccagaatcagataattgattttgttttcatgtttacatatactttttaactgtggtaactaaaggttcttaacagtgtagttgctacggtggccaaagttcacagatcagcctctatggcaatgcatcgaatcaggtttctgct

SEQ ID NO: 304 - DNA, 201 bp, Bos taurus
tatttttgaattgaatcaatgaagaaaagaaagttttatggtatcctttaaggaagaaattcaaataaagtgtgcttcccactgaagcacagaaaaccatgaggatgttctcttttttttttctttaaacaacatcaaatcattctcactaggaaagggggacttctaaaaggtcacggaatgcattgaagataagcagtg

SEQ ID NO: 305 - DNA, 201 bp, Bos taurus
ccaaatacttttaaattaatgaatgaaaaagtgaaactgcatattttgaatagaaataaaatgtttgacccctttgaaaattatagaatgcccagagaatatcttttttaaggtgatctaccttggtcacacaaacctgcccattagcagaaaggctgtccacagccatattaagcccatagacattcctaaacacactac

SEQ ID NO: 306 - DNA, 201 bp, Bos taurus
cattgtttggcttgggaggggtggattcagtcagtaacatcacacccattactcccttctcccaggccagcccctgagtccatcatcttctgtgtatatatcttgagggctgtggatgagagtgctgctcctagaatgagtcctgcagaggtttgctaggtgggttttagaatatggaggcatttagttaatacctgttgc

SEQ ID NO: 307 - DNA, 201 bp, Bos taurus
ctacttaccagatatctctagagagacacagttaaatatggaaataactcttgtggtggtcccaaagctagttacttatatttgcatagttcccgccttttctaactataaaatactgcagcagatttttatgtctacttatgtttcacttgccacatcttactatctcctattcatatttttcctcatcttgattgttta

SEQ ID NO: 308 - DNA, 201 bp, Bos taurus
atatatgctaaattgaggcaaaaaaatatacaatttccaataacacctctaaattctcacaggagaaactacatacataatattgggcataagtaggctccccaaaatttcttttatttaagggaaacaactaatgactgcagataaacaaggcaagaacaaagttacacagaaaacctattactgtcatttcctactgat

SEQ ID NO: 309 - DNA, 201 bp, Bos taurus
agaagagaatgaggtattactcaatgaaaacagaaaacaattgttttctcttttaaaggataatgagttcaagatgaaactgtcttagtcttcctttctttaattttaaatatcgtcccctagaaagccaacaagaagagaaaaaatttacgtctactgttctggatataacaatttctccggcctaaaaagacctaagag

SEQ ID NO: 310 - DNA, 201 bp, Bos taurus
tacttccacctccagaggagagaggaagcaaggagagagagtgagaatctgagtccaagtttgaagtgtctgaggaaaattacggccatgctgagaaactgaaagaaggctgaggtggctagagctcagagatgaaggaggaagggctggaatcactgacagatctgctcctgggcctgtctacttattcaccttaattgt

SEQ ID NO: 311 - DNA, 201 bp, Bos taurus
aagggagtaattagaaaatgggataaagcagaatattcacatcctaaaacaactgataaagtaaataggagcgagttaactaggtaaaaagggccaagaacggctttgtggaggaagacaggagggtggagggtatgagacttgaatccatctggctgggtgaagtggaggggaggcctgtctagccatggggttctcctg

SEQ ID NO: 312 - DNA, 201 bp, Bos taurus
tttttttacatttaaagaaatgccaatgactgccaagggccccattcccagttatttggtttggttatttagggacggggcctggtaatcagtatttttagtgctcttggatgattgtgatatgtagtctagcttgagaatcaccaatgtgatagttacagtggttataaactgtaaaatgaatcaaatattccagtatgg

SEQ ID NO: 313 - DNA, 201 bp, Bos taurus
tacagtttttcattgatattatgtgcagccttctatactaaggcccagaatttgacctatcatgaggcaaatatacaataaactcagtgactagcacttcgtatttgtaagctatggcctgagcagaaatttgttgatctctgcattttctactttttctattggacctgtgctgtattctcctatgttctgattctgtga

SEQ ID NO: 314 - DNA, 201 bp, Bos taurus
ccctcccactgccttgttaagcatgacccattattctagacggatgttttgtctcaggaactttccatcatttggacaagctttctctggacaaacaaaatttctagtctacaactacctatcctgtcctgctttcaccttttatctttcaaagggatttgcctcaatacatttcttgcatgtcttattccatatcggtgt

SEQ ID NO: 315 - DNA, 201 bp, Bos taurus
agagcaggtatgtgttgcatcccaaacaccactagcttgctttcttcctggtgtcaaggacaaatttaatttgtagaccctgccctcttcacactaagctgacagggataaaagagccaatttcaaatggattttcagctttcaaaaacgaaagcatataaaatatactctagaatttttgacttcagaatattatttcaa

SEQ ID NO: 316 - DNA, 201 bp, Bos taurus
gactgtcaaagaaaataaattgcctggggtcataaggaaataggagaaacggagtgtgcattgtaaattctgcccatagtgctttcaagaggccagtatggctggtaaaaatccagataactcatggctgatgaccatgggctacagagagctgaacaagatagtgcacccatccatgtggctgtgcccaacaatgccacc

SEQ ID NO: 317 - DNA, 201 bp, Bos taurus
atggaattttgactttgtaactgaaaggattccagttcagccagacaagaggattaatcttattcttattatttttaaaaagctctccttaataggtcaacagaattttcactgtcactaaattattagggatttttgttctttcccatctctgcttcatgttatgtggcagcttagatgagaggggaatttggggagaat

SEQ ID NO: 318 - DNA, 201 bp, Bos taurus
gggtgggccttacctaatcaggtgaacccctctaaaagaaggtttagaaataagagagagaagtcagaggttcaaagcaacagagacagacattttcctgctggccttgatgcagcaaattgcaattttgtagagatatccatgtggaagttaataaacaggtacattctaagaactgagagcagccccagtcaatagccg

SEQ ID NO: 319 - DNA, 201 bp, Bos taurus
gatttttgtgtagctttatttttttcatcttatatttttatatattcttattgggaggcagatagctaggtgtctgcaatcgccttcagtcctcagtcacgttttataacgtttgtaaaggtatatggggcttcccaagtactttatctgtgtggctatttatccactgagccacttgggtaaagaaacccctgcaaagca

SEQ ID NO: 320 - DNA, 201 bp, Bos taurus
atctcaaaaaacctcaactatgtaaataaaatccacttcaaccccaaaaccattcttgcaaacaagccaaaatcaaagcaaggataggagacaaatgatacctacctccttccattgtattcaaagcattttcctacattatcaaatattattactatgagatttgaatcttcttttatattaacagaactcctggaaatt

SEQ ID NO: 321 - DNA, 201 bp, Bos taurus
agtataagcaaaaggtcaaacagggaaggtgccagctccctcactgaaccacttttccccaaggatcagccccatgtcagggcctgggggataagaccaggtggagaatcatctcactgccaaccgagtccaagataaaaggctcttcaggtttttatgtacctgagggccaggaagaagagggagagggaagggttagaa

SEQ ID NO: 322 - DNA, 201 bp, Bos taurus
ccagggaactagatctcatatgcctcaactaagagtttgcatgccacaactgagacccagagtagcatgccacaactgagacccagagtagccaaataaacaattttttttttaagagtgtgtccaaaagtcagtttctccatgaggctttccctgaccacctacttaaaatagaaaatttcccccagcatttcctatact

SEQ ID NO: 323 - DNA, 201 bp, Bos taurus
acaagaaaaaaaaaaggaggggtggatagaaatgttcctttgggaaaaaaagaaataaaggcaagacacaaaatcagatttcaatatgccatataggaaggtggcataggatctttaaaagggtataagcttacagtttaggtctacttcatagatttctgaagattatataaaatagtataagaaaaacagaataaattg

SEQ ID NO: 324 - DNA, 201 bp, Bos taurus
ctcaggggcccctggaggcgcccaggaccccagaccccggggctgccgagacgaacgaaccggcggtaggtcccccttttcaccccacatgttcaattaaactggattcccagagacaacaggacgcccttcctgcaagcggcgggggtatcacagggcatctgccgccccctgttggtgaccaggggcaaaataacccga

SEQ ID NO: 325 - DNA, 201 bp, Bos taurus
tctagtattctaaactggccacttgagttccttttccaaagtctgtgtacctggtaatcttcacctccaaaggctttgcaaaatatttcttgagcaactttaggccatctgtctgctgttttctttactaaatctcatcagataattagtgataaggacatgggttgaaacttgtaaaggtctgataaatagcactgtttt

SEQ ID NO: 326 - DNA, 201 bp, Bos taurus
gctgagctggggggtcccatccctcactcagctctgaaggtgccactgccactaaaagggttaggagagtttcattactgctttacacatggcctcctccggaccaaggagcagggttggggtgggctctttgctactgggtggtagtcaaagtcctgatgtgtcttcactgggcctcttctgaaaccacccaagtgggga

SEQ ID NO: 327 - DNA, 201 bp, Bos taurus
tgccatgatagtttctcagggaattctgagctgtggcagttcaggcctggcttcgtgttcatcctgtgggaggcagtttcatgggtgggaaatgggccttcggaaaggagcaggttcttaatgagctagtgggactgaagtccttgggagttgggaatccaaggccctgtttgggtggaagggagggctgagaggaagcac

SEQ ID NO: 328 - DNA, 201 bp, Bos taurus
ggctttgatgcagggcaggcatttaaagtggatagtctggtagcaatgaacagcatcagtaagagagtcggacctgagttccaggaatcaagaaaggctgagagaacaagtgtaaagcagagtgtagtttaagatttcaggtacttcctgcccctcagtgttactgtttccagaaggcggtcagtcactgacaagggagcc

SEQ ID NO: 329 - DNA, 201 bp, Bos taurus
agatttggagcaggggagtgcagtggtgagagcagcctttgaagagattcgcttgctggctgtgggggtggcagactgcaagggatccagttggttgtgataactgagtctgtatcagagggaaaggaagggagtcagcaaccactccagccctgaacttgagtgtgtaggagaagggcttccagaagtttgccctgattg

SEQ ID NO: 330 - DNA, 201 bp, Bos taurus
aaaaccaagatcacacaccttgtcaggacagcagatggccgggtgtcaccagcaggaggcactttgggtaagaaaaggaagtgcttagacagaaaggaccagagcaagcaaggggccaccatggcctcagtggccagaaagtgactctaagccaactgtgagtcctccccgaaaagtaggtctgctctgtgggttctctct

SEQ ID NO: 331 - DNA, 201 bp, Bos taurus
ataagcagggtctattcaggtggtggtattctgactgaggatcaatttgtgccccgtgagtctgggaggaatggggaacccgggccctggcctgaaggaccaaccacccccaacaggcaaggggatagaagcaacaatgcagacgtgattgaaattacatggctcaatgatgattctcttggcttttgcatgtaaaggctg

SEQ ID NO: 332 - DNA, 201 bp, Bos taurus
ctatagggaccttcacaagtccacccatttcatgagttggaattttaaatgagtttgcaacagtgggttttgacactgaaatgaaacagattgaaaaccatggccccagattgttggggcctgtacaagtccccccgctaatataaggggccctaagagcacttgtctctgctcatcccgttggaagttttaatttttcag

SEQ ID NO: 333 - DNA, 201 bp, Bos taurus
aatgagggttgggacatgtgctgggggtgggggacagagaggggtggtacctcagatctgatcagtgtttagacactgactcatcctaaagaaactcctaaggcattaataaatacaaaccagcatagctgtttgctaattttcatgagaaattagagtatatatctttcacacagaccagagattgacagctttgaggtg

SEQ ID NO: 334 - DNA, 201 bp, Bos taurus
gagaacagaatatgaaataacaaacaagtccatagtagttaaatgaacaaaatctgaaattgccaaaggattttttgtcccaatgactttaacatcaaaagacactcacaattcattctgaggtttctagtaacccaccacactcttatagtaaagattttaatcaacaggataagggcaatttctactggacacaaaata

SEQ ID NO: 335 - DNA, 201 bp, Bos taurus
ccccaacccgccaccgcccatttcccacctcagcgtgctctatcagctggtttgtgctggagaaggcaccaattcctggatttagttttcttccagacacatagacaaaaccaacgttgtatgaatattttgatcagtaactggggatcctgggcagctgctccctgctgtggtcagtaactaagtatacattgtatagta

SEQ ID NO: 336 - DNA, 201 bp, Bos taurus
cagaggagtgaaccatatggaaggaaaagatgatggatcattcctaggaacctgaggtcacaggtcaggggtgagctaactatgggctctgggccaaattcggccatgtcatttgatctcttattatggctgctttcaagctaaggttgcagacttgagtagctgcaactgagactctatggtccacaaagccaaaaatat

SEQ ID NO: 337 - DNA, 201 bp, Bos taurus
cctgggcctctctgtcagcctaatatgctttcgaaaatgctttggtttctactgtaccactgagtattggcatttctggcattataattcaagaaaagataaagtaaacaattcaagataaagttcagcataatgtatacgcctatgagagtgaacagagtcaatttatcccaccaagaaatatgtaaggcagcaacagaa

SEQ ID NO: 338 - DNA, 201 bp, Bos taurus
ttaacccagtgatcagagaaggcctccataaggtgacatttgcgtaaagagagttacaggagagagtcataagtaattacgggaagaaattgctaaaaagaaaaaaagcaaatgaaaaggccttgaggtggggtgcttgcctggaattttgagtggctaaggttggtaaaagaaagagtagtccatgaggtccaagaagca

SEQ ID NO: 339 - DNA, 201 bp, Bos taurus
cacaggggccagagggaaactggagaaagccaggggatgggttggactcccctggaaggatggggcagacctggcagaacacacagatgttgcctttgagttcctgcagttggttatgtaaccgccggcactccatctcaagcccatggagatgttcttcccactcagccagtgagccctcccagactgcagccttctggc

SEQ ID NO: 340 - DNA, 201 bp, Bos taurus
tgggtgggaattcaaaggtgacaatctctcgctttctataccaatacaaaaagacagcggtgggagcgaggagttgccctttgttttcgaagctgagaccgctacagtctcggccaccaagtgaacgaaggctacagggaagtccgtctcgtccgccatccccggagccccttacttacctctaagtgccgcaaaagctga

SEQ ID NO: 341 - DNA, 201 bp, Bos taurus
aagcgtcttttaatttcatggctgcagtcaccatctgcagtgattttgtttagtgcacagataatctaggttctaatcccagctctgccagttcctggttctgtgaccttcagcatattatataaccaatctgtgtctcaggttccttatctataagatgggaatgctatagtgcctgtctggttaaattattgtgagaaa

SEQ ID NO: 342 - DNA, 201 bp, Bos taurus
atatattttcaagttgtttttctgagaattatactcttgcccaaatgtttggattgctcatggcggtgctttcatttgaactctctcccagcttcctcctcatgtcctgcagagtagtaagcagccacgtttgactaagcaaactgctacgttcaacatgagcctctactgccctccagtgttcactacaagtgatccgtg

SEQ ID NO: 343 - DNA, 201 bp, Bos taurus
tggaaaataatattttctggaggccaagggtcaggagacatcagctcatgggaggggttgacagtacagttatgatcacaactatattagtagacttacaatcttaggagaggagaaaactctcctttctaggaatcaatcctgagacgattatcctgatgattactatggagactgtaggttgactgggaagaaaagtgt

SEQ ID NO: 344 - DNA, 201 bp, Bos taurus
tgggtggaggtgttgctgcttaatgggtcacaatgttggcagttactcagtgagaaagaacagaactctaaggaatttataaaaatgatgacaaagcccacaggcttgcagtctaaggatttcctggttggttgtaagttcctccaggtgggatctgaagctcattataaatccattaattgtttaaaaataaattctttt

SEQ ID NO: 345 - DNA, 201 bp, Bos taurus
ccaaacccattagcagtccaatcagtgtaaaactgactcctttaccagttactatggtaagattttgttctcaggtagtaactctttgagaatctcaaatcacttcacaaaaccaaatgctattaccagcttattttcaataggctgaatgccaccaaaggcttagtacagtggttataaggaatatagtattctctcctc

SEQ ID NO: 346 - DNA, 201 bp, Bos taurus
cctctctcctatttatttctactctcctgaaatactcttgctactttgcatcatttactgattcatttatttacttatctaacaaacactatgaccatctctctctggcctagtcaaggcagaaatacaaagaggactgagacgtagtcccttctccatagagcgttacattcaggaaaagtgataaatatccactgtatt

SEQ ID NO: 347 - DNA, 201 bp, Bos taurus
cctgttcttattttgtaggtaaaaaaaaaaagtgcacagaactgtggtgacatatctcactttaaattttgtaaccagtaatctctcacatgggcctttggctttgccaaggtcaactatatttctctaatcctttccttccatcactcttctagagaggcatttagtactctcccctttcacaaacctcacatagctcct

SEQ ID NO: 348 - DNA, 201 bp, Bos taurus
gcgttcaagaaaatgcattgaggatgcctgaatgtcaaggttggtacaagacagtggcttaacctctttcagtcagtgctagtttttcttaagtgggcagaggagccctcaaaagaccaggaaccccattattgagaagtcctatgagctgctggggcttccctggtggctcagtgataaacaattcacctcccagtgcag

SEQ ID NO: 349 - DNA, 201 bp, Bos taurus
gactcaggatagccatcaaatagccaaattctagccactgtgccttatgatagctacagtagttaaaacaggtattattccctgagaaattcacccacaccaatgttatcaatttgtttccctgtttgttaagcaagaaagacaatatctgatgattcatctgcatgtcactatttcttcagctgaggatgtgaagtttat

SEQ ID NO: 350 - DNA, 201 bp, Bos taurus
ccagctgatgtttcagggtctgagatttttcccaatcagtttgctgactttagcatattagaccggccttagctaaaattttaaggccctgtagctctgcaactttagctattagaacttgtttgctgttcagctgtgtccattcatctaacagcaggagatgtgggcctctgtaaattactaaatgctttttggctctca

SEQ ID NO: 351 - DNA, 201 bp, Bos taurus
tcatcttcatcctcccagctaccattgtgctcaggatttcatttcttctcccctgaagcactgtatagcctcctttttgctctccttatctttattcagtttcccctttctaaaccatcctccacacaaggcttactatagaaggctgtgctgtccacctccaggagacataggcctgaatggtgttccctggagtccttt

SEQ ID NO: 352 - DNA, 201 bp, Bos taurus
atgtagatcacaaattgttagaggttgggtagtgggcaactttgggacagataaaagaagtagtggactgtaagggcaaaaggaggccattagatgctagcattttgtttattttatttttttttattttcaggtggcaccacacagcttgtgggattttaattccccaaccagggattgaacccaggcctgggccactgc

SEQ ID NO: 353 - DNA, 201 bp, Bos taurus
aggggtcagactctcaagacaattgggactgacagtgcctggggtccccacatgagctcctgtcctaattacacctgaggaaaccagcatattaataactatggagggccaatcagtcgatttcttttggacactggggcaaatttctctgtgctcactgaagcccttggtctgctttcctcccaatccactcctataatg

SEQ ID NO: 354 - DNA, 201 bp, Bos taurus
cttctaacaagtgtgaggtgatattgataaaaataaaatattcacagctattgcaagcagtgctacaatgaatacaggggtgcatatatctttttgaatacgcataaagtataaaccaactaaatatatgttggtttgttaatggcccttctgagtctcttgagtttattcaaactggtcagtgtctataccagatggctg

SEQ ID NO: 355 - DNA, 201 bp, Bos taurus
acatacttgctagtactcaaacttgccaaatactcttcacagtcactgccctgttgttctctgtgcttcctcttcagagctatgcatggcttcttccatgcattcaacaggttttgatgtaaaagtgttgtctctgtaaattcttactctgccctttttaaaaacaaacaagaatcttgcttcttgtggaccctaatctct

SEQ ID NO: 356 - DNA, 201 bp, Bos taurus
ccccaaactagatcgtggtggtggcagacatccttaattacaggcaatggaaagtgaaggtcactgctggtttgaatccagcataggtcagtgcagcaaaaaaagccattaacagctgattgtgattttgtgctttgaacagaatgaattgctgcctcaacccaatttcttagtaaacaggcatcctgcatccaagctaac

SEQ ID NO: 357 - DNA, 201 bp, Bos taurus
tgttttgaagaggccagtagactgagatggggactgttttgggggcagcccttgacaaatgatgactgagaacccaaccagatgtttcagcagacgcctatgtggccagatgacagcaagcacaagatgcctcagcctgatgtctggggactgtatgaagcctctaataaactggatgcttttcctagagaactcaaaata

SEQ ID NO: 358 - DNA, 201 bp, Bos taurus
tactactattgttttaaaatgtctggatgtttgtggatgattaaaaatggcagaaaagttttgacacatttcccatcagacagtagaatctgttcccctctactagaagttgtgctgccctgtgattgctttgaccagtggagtatgactccagatctcgactttttagatatctagtagtttccagtcaggctctaggaa

SEQ ID NO: 359 - DNA, 201 bp, Bos taurus
tcatatatataaaatgtggagaatccttgaagacaaataaaagtacatactcatccttagaaagacctagcaaaagatgtaatgccttcacccataatccgtagcaaagtctgttctaaaaataaaaatttgaagatatactgaagtgtataataagatgcaaagaataagttagtcttcaaaagataaacatttgttttt

SEQ ID NO: 360 - DNA, 201 bp, Bos taurus
ttgtggatatagatgattttactacttttgtatcttttaacctttctactaggttaataagtggttggtctacgttttctgtatactttcctttaccagtgaaaatttttcttcaaaattttcgtatttctatttgtggccttttcttttctgctgagaagattccctttaacatttcttgtagagctgatttagtggtgc

SEQ ID NO: 361 - DNA, 201 bp, Bos taurus
tagcattaggatacttagctgagcattgattataattacttctctagaatctgctttgtttctagctttcctcttaggttaagttttatcctgaattcatcgtgatacagaaattactattttgtaaaacaggggtaaatacaattagcattcacatatcaaatttgtggaatcatataactctctgccagagacctggac

SEQ ID NO: 362 - DNA, 201 bp, Bos taurus
ctctgggagtactgaaaaatgagagaacataataactgagctgaaattttaggaatgagttatagttaataggcaactgtgaacatgggaaaaacgtaacgtaggaggaaggcataagatgtgcaaaggactaatggcaagagagagcatgacttacaggaggaaatgtgaaaaggctgatttcctgaagagcaggaagga

SEQ ID NO: 363 - DNA, 201 bp, Bos taurus
ttttccatttttactctttgagcacaaggtttataggtaatatttctttggattctccttaatatcaggcatagtgtcatccccatgaaggttaattaacgtgtgttggatgattcacatttgatggtaaatgacatcaatctcagtttgcaacttctggattaaaactggcaaatatttacatggctttatgctcaagaa

SEQ ID NO: 364 - DNA, 201 bp, Bos taurus
aaagtcaagtaaaaagtaattcattttgttgaaagaaacattctttatggtatatggtagggcatttataatctattgtatggaatattgatttcactgctagagataccctgcaataagacttagcaaaactggatgactgattataaatggtgcacaaagatgagggaggattcaaaaaaaaatgtctagttaggaatg

SEQ ID NO: 365 - DNA, 201 bp, Bos taurus
actcccggagtccacccaaacccatgtccatcgagttggtgatgccatccaaccatctcatcctctgtcatccccttctcctcctgccctcaatctttccagcatcagggccatttcaaatgagtaagctctttgcaacaggtggccaaagtattggagtttcagcttcaacatcagtccttccaatgaacaccaggactg

SEQ ID NO: 366 - DNA, 201 bp, Bos taurus
ggagcctggcagggtacagtccatgggattgcaagagtcagacatgacttagcgactaaaccaccagtattcctcgccttgttggcctgataattggcacggcagtacacatggaatttgggttaggctgttcttcacactgtatatctggtcatgtgcttcagtgtttccactccacttactgaataaagttccaagtcc

SEQ ID NO: 367 - DNA, 201 bp, Bos taurus
attattttctgaagaattcagacatttttgtcctaagactttttcaaactggatgttgtagatttcattcccatggcaacatttagcacatttctccagcttcttgatttcccataaactgataattagttttagagacttcagcagattcaggttcaatttttagaaagaatagtatctaaggctatatttatttaaata

SEQ ID NO: 368 - DNA, 201 bp, Bos taurus
tctgaagagacaacaagacttaaagttctgaagctgacagaaatgttaatagaattggtttgttgcaatccattaatgttcaggaacaagggcccagagtctactctctgccccaaacatacctggctctgtagctctgaagcctcaccttcagaaagaagacatacagatggccaaaaggtacatgaaaattgcttaacc

SEQ ID NO: 369 - DNA, 201 bp, Bos taurus
atttgctcagctttttcaaaaatgtttctgataagtttccttctaacagattgctaagggaagaagtcactagaggatagagggcagaatactgccaagcgttgctgtgaaaagctgtagaagcaatcttagtgaacagctgtgcttgagagtgaagttaataattagacacccaggagtctagcattggttctggcactg

SEQ ID NO: 370 - DNA, 201 bp, Bos taurus
ctgacccagggatctaccttgcatctcctgcatctcctccattggcaggcaggctctttaccatgagccatcagggaaggctggactgacttaggccccatccaaaattatatatttaaatcctaacccctagaatctcagattgtgattgtaatgggagaaaaggtctttaaagaagaaacataagttaaatgcggtcat

SEQ ID NO: 371 - DNA, 201 bp, Bos taurus
tagtgtttttgacctcctcgtttatttatcctcaagtcaattctctgaggcaggcactagtattttcttcaatttatagatgagaaacctgagtcttaaaaaaattaaatacttggtcccaaggccagaagctgatcagtaatagtagcctggagattcagacccaagctgtgaggctccagaacctgatgtgcttgtgtg

SEQ ID NO: 372 - DNA, 201 bp, Bos taurus
gactttatagacccccagaggctggccaggcccccagaagcttaagaaatttcaagacccactccttttcttaaagtgctgcttgacttgctggcaataattggtgtatttgcaggccagcatgtagttcagttagggtccaggcagggtcagaatccagtcagaggcctgctcttccacttctgaaccctgaacaagact

SEQ ID NO: 373 - DNA, 201 bp, Bos taurus
accattctccccacaccttcatgtgttcatggcctgtaagctctttaaaccccatccttgtggatatttatggaagcttcattacacaagcaaaattgactaaatcactggcccctggcaacaggcaactgactcaacctccagcccttcttcactcctgggaagccaggaggatggaactgaaaggtttcaatcctctaa

SEQ ID NO: 374 - DNA, 201 bp, Bos taurus
tttttcttgtttctagccttagaggaaatgctttctgtgtttcactgttgagtatgatgttagctataggcttgttgtatatggcctaatttattatgtcgaggtatgcagagacattactttgctaacaaaggttcgtctagtcaaggctatggtttttcctgtcgtcatgtatggatgtgagagcaggactgtgaagaa

SEQ ID NO: 375 - DNA, 201 bp, Bos taurus
tctctcaccactacgaaatatattctcataaaattatcaactttaaagataagaaaataagacattgaccactgaaagctagttatctgttatgggaaaacacaaaatttatttcagatgtttccaaaccaactttaaaatctaagtgctataaaatcctcaagggaagaaattgtgatccaaactagtgcacaattgcac

SEQ ID NO: 376 - DNA, 201 bp, Bos taurus
taaatattttatttagcccagaaactgagaacggcatttcagagatgcatagacatgggtttctatctcaactcaatcacactgtggccatgtgatcttaggcaaactaatatatctaaatatatagaatataggactaacaatatgtactacaaagggttattgagaaggccaaataagaaaatatgtgaagagcatcta

SEQ ID NO: 377 - DNA, 201 bp, Bos taurus
accgtggaccatggttcacacaacagatacttatttttcacagttctgggggcaggcacagggagtttctggtgagaaacacttccggccttgcagacaattgcccccactgaatgctcaggttgtggggagggggaagcaaggaagaggatctctcttctatccttgtaaggccactgatctcttaggacttaacccatg

SEQ ID NO: 378 - DNA, 201 bp, Bos taurus
ttccagggcctagctcaaagcctggtttatagtaggcacttaatgaagattagcaccttcatagtaacaaacaactctcaaatctcagtggcttaagacaatcttggattggcaaaggccctcttccccattatcctcactgagggagaaggctaaggaagcctttacagacttggacacaagaggggtatggaaatggtg

SEQ ID NO: 379 - DNA, 201 bp, Bos taurus
attggtagatttggaggaacaaataaaagcaattggaatgattacagtttaggacttggaggagggggtctgtggaatgaaattcaggcctctgaggagggggtcctgcctagctggtgttcatgtctatgatttcggaagttcattaacttgggacccaggcctttgaggggagggtgccagacagctgagctggtatct

SEQ ID NO: 380 - DNA, 201 bp, Bos taurus
aaagccctgcagaccagggccagggcagaggaaaactctggaagttaagcacaggatactaatactggtgctcagagggaccagctccgtcagagacaaacctcaaaaggtgctctggggccaaaggaattgatgttgaaagaagagcagagctagcaaggataatttactttcacttatacttcacttttaccttcactt

SEQ ID NO: 381 - DNA, 201 bp, Bos taurus
ggatatatgcatctcaacatatgctttagtggttataacctaagcatgaaagaaaaactagatcttataagtatgtagtgtagaaaggcctgatttatgttcatttggggtgaaactcaaaatatttaagaaatgacactctgtggtcatccagatacctagaccaaccaattagagaggcatgccaaccacaaaaaactg

SEQ ID NO: 382 - DNA, 201 bp, Bos taurus
ccatttgacaatactggaagccaaaggttgactcccagttaagcaccaaatatgtggctttgcagtattagtctctaggccttcagttttgtcaccgacaggattaatgcagcctgaccctgaggagcagctgtgaggattccttgttaatgagcagaaagcaattacaagtatttttcaattatagtgctctaggccctc

SEQ ID NO: 383 - DNA, 201 bp, Bos taurus
attcagtgagagacaaataggttaagaagtggatttatttagagaaatacacattccatagacagaatgagattcctctcaaaaggctagagcggccttaaggcgtaggggtcatcttggaaagtgagagaagccaagggagaaacacattccacagaaggcatctcagaaggcaagaggccctgaaatttggagtgattg

SEQ ID NO: 384 - DNA, 201 bp, Bos taurus
tatcaccaggccagagctcaactgttcatgtccctgagcaccaccgtttggagtttcatagttatgcatggcttacatattagcagggaaaatactggtcgttaaggggcccaggaaagacaaaaagcaagtgatgctatggagggtttgtttttccctattccaaatttgtttagtcaaattagactgaagagtttaacg

SEQ ID NO: 385 - DNA, 201 bp, Bos taurus
gttatcaggaggccttgatttaaatgttagtgacccttgttatggaggcaacaaggtccagtagaataacactaatctagaaatatggagacttgaattccagtcttgggcctatcgtcatttacataaactaatttcggcaagtatttggcctctctagatgtcagcttgtacaactataaaatagaccccactgtatct

SEQ ID NO: 386 - DNA, 201 bp, Bos taurus
tcatggggaaggtttagaaagattaattcacctgggtcaggaaagaatggaggtatattaccaggcaaccacagtagtacaagggtaaggtaaagcaattactttgataataacaaagatgtcaggagtgatttcagaatgatggtgtataggatttgatacctaactggaaatgagacaagggagagagaaaaatgggag

SEQ ID NO: 387 - DNA, 201 bp, Bos taurus
ccttcagtcactgaggttttgcactgagctgcttctccaaagacccagcagtaaacctcgttgagagcagcgctatttgtgcctccaggcatcttccacacggccccaaagacatgttcttaaccatttaagaatggcctttcaattgatcagccaacagattattgagcaccatgcctggggcccttaagatgcttaaaa

SEQ ID NO: 388 - DNA, 201 bp, Bos taurus
gcacagtttatagtcaggtttcctactggaccagtttggtcacccactgaatttcgagaaacgtcaaggattaccgctcactgtgtacactgaatctcttgcttttctgattgatttcaaaataaagattgctatacctggtggataatgctgctctaccaggtgccctgttccccttggggaatcctgggaacctgtgat

SEQ ID NO: 389 - DNA, 201 bp, Bos taurus
ttttctcgctacctgttgtgatagcccatgcctcttctactctttgccaaaataatacacttttgtgccctgtttcccaagagtcctgttttttttctttctactattggacatctcaccagtccctattacttctacccaatgctctctgtttttcattatttatctctgctactacaagggctttccttgtggctcagc

SEQ ID NO: 390 - DNA, 201 bp, Bos taurus
ggatgtttatggctacacatatttctgtaaatgttaaagaaaaaagtctggaaggacagtggatagctttcagagctgaagtcagaaataagaaggaaatttttggtttttactttatcccttttcctcaaaggcagacattttaggatagtgggtgatttttctttcctttttgtgatttttctgtttttccaaatttcc

SEQ ID NO: 391 - DNA, 201 bp, Bos taurus
taactgagctcagatccactagcttcctcagggtcaccaaggggctgctccttgtacatatttcatgttaatgccacgggctggccaaagaatgcttatggtaaagtataatcaacagcccagtgctgtttctttctattcagcaaaacactcatttggctgtaacgggatttctgggctaaggccattctatgtaatctt

SEQ ID NO: 392 - DNA, 201 bp, Bos taurus
acagagctgtcagcagaaaggaacatccttgaagctctccttggagttaaagaaataatgaaatcagtgttgcatttaaagatgcttcttatccccagtataactggcttgtgggattgtattggaatgcattctgtggcttccccacagtgcagccattggagatggaaaggaccagctctgagtaaaaaggtgtcttgc

SEQ ID NO: 393 - DNA, 201 bp, Bos taurus
aaagttacaaaaacataaacacgcactctctcacaaactcacatgtgcacgtccttaaattaatgcaaagaagagatatattcttttgttctagtggagtgcaaattatgaagactaataaatgaataagcaaagcgccgggcaaccaaatcaatgtctgctcaattctggtcaaggaggtgaagtgaggtttccctttga

SEQ ID NO: 394 - DNA, 201 bp, Bos taurus
tagacattcactttgtgtttaatgaaattccacgaagattttaagacagatagtcttggattcaagttctgtctgttatttcctaggcattcttggaaaaaattattcaaacatgctaaatatccatttcatttttataacattatagacttaaaaagagtagtttaaaaggttaaatcatatagccattaaaaatatttt

SEQ ID NO: 395 - DNA, 201 bp, Bos taurus
acagggttgatttcataacgggttacaaactgacattttttgaactgatgctgatatcagacttttggttaacctatcagttaagaagtatactttgtacatgacacttttcttgcttgagcaattgactccaaatatcttacttttattttgcttttctcactttcctttctacttctatttaactatatcttctttatt

SEQ ID NO: 396 - DNA, 201 bp, Bos taurus
acaataatcagaggagtagggtgggagtgctggggaggaacggccctgcaggtttcactctgctgctctgcccctcaccatggagtccatactctgctccgtgagtaaataaagacagtgaaaaatacaaatgtgctcaatgggtcctcctggctgtcttgttctcagtaatgggatacatagggaccctgtcctgcattt

SEQ ID NO: 397 - DNA, 201 bp, Bos taurus
ctgttcaagaggtggattttttgttgtttctttctttttctttgtctgtttttttgtccagggtaagcagaacacttttacagagcaggaataagataggaatacattctaattccactgtcaaattatattctttcatctgtctcatttacagcataaatgatctaaaaaaggtttatgtataaccttaaggtaagagtt

SEQ ID NO: 398 - DNA, 201 bp, Bos taurus
agacctgctaagttatttctgtaaggggaagaaggggaaaatggagacgttttccatccatatggaggatatctgtaaagaccagaaatgagagtgaggtatgtgctgaaagtatgaaaagaagttcagtatgattggagcatgggcttcccttgtggctcagctggtaaagaattcgcctgcaatgtgggagacctaggt

SEQ ID NO: 399 - DNA, 201 bp, Bos taurus
agaaattacaggatggcaaagtctccttcaataatgaaagtagataaatctagaggaggagaataagtaatttgtaggcaataggttcttaagaaaggagggggaaattaaaaaaaaaaaatctccagctaagtcagatgattagtttctttatgtaaaataaaagatggtagaaaaactgaacatcaagaataaaagcta

SEQ ID NO: 400 - DNA, 201 bp, Bos taurus
tgaaaaaaagaaattctcttgaatcccataaccttaaaaatatcttgtataacaaaaaggtataatgtgtagattctcactaggtagaagtctgaatgccgagcatatcatattacagaataaagatgggtattttctgggatgctatctagtttttataaattccactgctgtcctcacctaaaatgactatggaaatgg

SEQ ID NO: 401 - DNA, 201 bp, Bos taurus
agattctttaccactgtgccacctgggccttagcccaaatggaaaaatcaaagtatagccataggaacgtatggctcctatgctatagcctctgaaaacataggcccttcttaaggagacagtacatacttcagagttccaaggagtgaccagtggcactttgaacagtggccagtaaatggtgaagagtgaatagtaaaa

SEQ ID NO: 402 - DNA, 201 bp, Bos taurus
atgaaaaccaagaacttcttgaagttcaacctaggtttagaaaaggcagaggaaacagagatcaaattgccaaacagagatcaaattcactggcatattcgatcatagagaaaggaaaggaatttctgaaaaacatctacctctgtttcatcaactacactaaagcctttgactatgtggataacaaactgtggaaagctc

SEQ ID NO: 403 - DNA, 201 bp, Bos taurus
tgtttaatacttaaggaaaagaggtctttatttggctagaaaatgttctattcttagcaattcaaaatttacaccagtgacttgaatgaaggaatatatcgtgtaccatatagcacacatgagttctagataaaatatatctcactaaaacaattttatgtagctcttgttttgccactcacactgttcactgaatccagg

SEQ ID NO: 404 - DNA, 201 bp, Bos taurus
accttgtggttccttatggttgtaagactgagacacttactcttgttggctcttaggcagagtacactttgagatcttagaggccacccacaattacttatcacacaatctctttcataagtgcttaaaatctctgtaacttcaaaaaggacctactttcctttaagagttcacctaattgggtcaggcccacccataatc

SEQ ID NO: 405 - DNA, 201 bp, Bos taurus
tagttaatagctctatgatttaaccccccccccccttttcttttttaactccaatgaccattgtctattatgatgtctccaagggcctaagttttggactggttaaactgagattagaaaaaatatttagtgtttttatatcaagagcaatgtgctctaataagcacctgaaattattgtgggccagtatgacagagaaga

SEQ ID NO: 406 - DNA, 201 bp, Bos taurus
cccatgtttcttaatgtccagcccaggactccttcaccatattataggccttttccattgcttttgaaaaaaaaaagtctctctttttttttatgttctaaaataaaatgcctgtttacaatttaaaacaaaaaattggggggagcaataagactggaacatgaatacaaaaagtatgtgaagtgcaccttaaaaacaact

SEQ ID NO: 407 - DNA, 201 bp, Bos taurus
gcttgatataagcattttcagtaaaatcaaggaagcgatttccaaacggaagtgtggcttcagtttatgaccctcattgtggtctaagcccagtgggataggggtcccagtccccgggcccagaacctgtaccggtccacaggcagttaggaacccaggccacatagcaggaagtaagtggtggcaagcgaggaagcttca

SEQ ID NO: 408 - DNA, 201 bp, Bos taurus
accccctccccccaattagggccgatctggttgaggatggtagagggaaacggtgatggcaggagagatccagagcccctcttctgcttctgttccttccatctaaatggaccttctctggcctctgaagtatagtttgaaaaatacaaatttaaggaatttctctggtattaactttctacacatggacagcaaaatggt

SEQ ID NO: 409 - DNA, 201 bp, Bos taurus
tggctttccacgtccccactctcccctctcctgaaccctgtctctcctcaccctcttcttaactccactctgaagtttcccttcctgtcctgctcacgtccgtgagtctgtcctctcccacccactggccctctttctctctgtgtggcaaacatttaaaaaaaaaaaaaaagcaggaacgatcccaagtcaaacagtgtg

SEQ ID NO: 410 - DNA, 201 bp, Bos taurus
gggaccggatgccgggttggctgccgtctacggcgttgcacagagtcggacacaactgaagcgatgcagcagcagcagcaaggcctgagatggagctgaatataagcatcaggcatcccctgcatatgccccactgtcagaatctgataaaatacaacaggattagggtccaaaagagggccatgagagtgaaacaaaact

SEQ ID NO: 411 - DNA, 201 bp, Bos taurus
gtaatttctgcttatttcttattatccctttaagggaggaaaagaaaaactttcagaaactctctttgctgagatgaagacaattattgtaaataccacagtcccttcggtgacagaaaagacacagatagagggccttcaagtgattcttcagtgtctggtctaccccttcctttacatatttttcattatcattggctt

SEQ ID NO: 412 - DNA, 201 bp, Bos taurus
ccataagatactctttttccactgaatcaaaaatcttgacctatttaatggtcagtaagagaagccacatctcccacatcttaagggtcttcactgtagatggaagagatagatacctgaagccttaaggtctcacaggtcagaatttatctggcatccttttcgctagcagctgcagccatttgatgctgaggggggcta

SEQ ID NO: 413 - DNA, 201 bp, Bos taurus
tgtgaactctggccccgaagggagggtaattaacataaagtcaccagaaataccttgggaagacagctgtgtttccagtcattgtcatttgacagagaaagaatgaaatatgggtttgaggccttgtttttactttacagatgaatgaagcacatcctaaatgtagaatattaaggcttaaggtccgcaccaatcatccag

SEQ ID NO: 414 - DNA, 201 bp, Bos taurus
ctttgcagacaggtagggtcaaaagtgtgcgtcttggccaatgaattatgagtggaagtgaagttatgagctagtgacctaccgtgtccccgcctctccccgcatcacagtgatcttggaggccacgtttacagccatagggtggcagagctacacgatgaagaatgatacacatgggactgtaatattagggtgtggagt

SEQ ID NO: 415 - DNA, 201 bp, Bos taurus
ccctgtggggtcgagctaattacaggtacatttcctctgcaaggcagtcacactctgttctattgaaggcacaattaattattgaacaaagctagctggagatttttgctcgtatggccatgggttacaggtagctttgctgtcacacagggagcagagcctcttctttgagtgtctttatgaaaggctttggattatagc

SEQ ID NO: 416 - DNA, 201 bp, Bos taurus
gttagtcctttattttgatgccttctgctttataactttaaccctacaaatgaaacccttaatgaagcaacaaaattatctcattttccactagaaagaaagacacttggtctggaaattcatctggttcattctcagcattacagcgtgccattagcaaatgctctaagcagaggcaataaagtatcagaaatatcccaa

SEQ ID NO: 417 - DNA, 201 bp, Bos taurus
caatctggtcttatggtctttgcttttcaccctcctcctcctgaaacaatctgaacacttggagttttgtcaaattgagttttaacgacttcatagtgccgtgaaaagatgttgcatttcagtaagggtttcagatcatcaagttttaaaactttcttaaacaattgcctcttgacagcagtggcttcttcccattttctg

SEQ ID NO: 418 - DNA, 201 bp, Bos taurus
gagatggagggtcatgggggctcagccctgtaaccctaaggcctggaaacttttaaagctatttgtgtccaggctgaaagctcagaggtattttgatacaaatttttaaatggcctaaattattgtcgaaaaagccatggcatacacacccctttaaatcaatgtagaacctcagtttccctctctacttactgtcctgtg

SEQ ID NO: 419 - DNA, 201 bp, Bos taurus
agtctagttattgcccatgatctttgccagcaagacctgaggcccttacagtgtctgccttgcaccatctggcactatactgataacattctaatcagggatccttggaggatgcagcgtgtgagaccctaatgctgctggtgatgcacctgaaatatacaagttgggctattgtctcatctaaaactcaagggccagcca

SEQ ID NO: 420 - DNA, 201 bp, Bos taurus
ctccataagcacctcagggcaggagaagggagtggatgcgggcccctacatcagatgcaaaatgatgcgtatgaaacagacacagacttgaagatatagataacaaaccaggggttaccagtagggagacggaccaggggacagacaagacaaggggatggatttaagaggtacagattcctatgtataaaataagacaca

SEQ ID NO: 421 - DNA, 201 bp, Bos taurus
gaacaattaaattttgtgtactgtggttttagtgcctttcttaacaccggtctccaataccacactcttcagtcaaaatttaatctcctcatccttgcctccagaacccacatcaagccttgcttttaatgacccatctctaggaactttctccttctaagtgaaagaatggaagaaagaaaatggaggatctgaaccaat

SEQ ID NO: 422 - DNA, 201 bp, Bos taurus
gcccaaatgactcagaatttctggaagtaggacctcagcatctgtgtttgcttatttgtgttaggctcacaagatgagtctgatgcacagtcagggttgggagtgactgcattttcaaatatatatttagattcattaacctggaggaacaggtgacatgggatatacagagggataaagttaacaaatcagctggatgat

SEQ ID NO: 423 - DNA, 201 bp, Bos taurus
actggaccaccagaattacaaacctcccttgtctcttgttgccatttcagatcattcagggccacagactcactgagagaggacgttttttccctttgccgtttcactttctccgtgccaaacatctactgtggcttccaatgaatcaagttctccttcctctcctcccctggaagctcatgctcccagtaaaatgtcaca

SEQ ID NO: 424 - DNA, 201 bp, Bos taurus
cattataaaatacctcttctgattttaaaaagagagagcaaactaaagatgtatcccaaatgcaatatctgttggagtgtagaatcactaagaaggtaaataaccatatgatgaaagaaaaatcagtaacatttatttatatatattttcttaaagcctcttatagtaattgctagttaactgtaagttttaaaccaacaa

SEQ ID NO: 425 - DNA, 201 bp, Bos taurus
gaatctgaccacatcttgtgaactttaggacaacatacacattcgtcaaagccaccactgactctcatatgcatgattccaacagcctcctaccatgttgctctgctttcactacttttcccctatttattctccccagagtagagaacagctggaattattttttgacatcctaaattaagatcgtgtccctcctctgct

SEQ ID NO: 426 - DNA, 201 bp, Bos taurus
gtctcctagtagcctattctctgaatcctgctaatacttggccagactgaaaacccatcctccactgatagtgcttgttcacagatcagtagagggttctatatattggttcacattctgaatggcctgcagcggcttatccagagacagcatcagaaatagagctgtcaatcacagaggaaccttctagagtagaagatg

SEQ ID NO: 427 - DNA, 201 bp, Bos taurus
ttggtaagataggtctccatctatcatcacacaacgtgtgtgcatgcttctttgtctctatctctatctctctgttctcctcctcctcccacctctccctctctcacacacataaacacacacacacttcagaccatctttgcaatcagaactctgtagacataaatcagcataatatcattaagaataaggctcagttac

SEQ ID NO: 428 - DNA, 201 bp, Bos taurus
agatgacctactgacaaatgagctataaaaatcataatggcatacctggaaagggatttagggattattcctggtttgctgaaggcccagagaatgttccatgatacactcatacatttgcatttggaaaataacatgattatgaccgaggtccttgcacacttcagataattctaaccttcatcaaatgtccgcaattgg

SEQ ID NO: 429 - DNA, 201 bp, Bos taurus
gagataatctgaccctgcccacctgtgaatggctgcaggaaagaagagattaacatatctcttccatagggtgtccattcccagagatgtctttcaaaaccgatggctctttttactttacttcctcactgcctctccctctctattctgcctttttactttatttcctcacctcctcctacctctgctctataaaagaac

SEQ ID NO: 430 - DNA, 201 bp, Bos taurus
attttattatttattacaatctgcacgattaaagagttaaaagaaaaaaataatccaaattaatctctttattctgattttttggggaggggattggaaagggcagtccaccattggccaatatgatgtttttattttactatttgtaaattaaactgactcaatctatctgcatttactatgatgatacgtaaatgaaat

SEQ ID NO: 431 - DNA, 201 bp, Bos taurus
tcggtgattatcctgcatgggggactttctatgattgcaacccactgaaatactcctcagttcaggctgaatggctttcaaagacaatttatacactgaagtcaggtggcacctacatccttggtaacctaaggaagtttaatagaagtctgaatgggaagctacaaactggagctgtctgggtaagctgatttacaccgg

SEQ ID NO: 432 - DNA, 201 bp, Bos taurus
gatatctctgtaacacaaagaactgatcacatttaacagcagatcattctgttagaaagttctgtatactgaggcagggtgatcggcctcataactaccacccactgtcccagtttggcagcctcggttcagaaccaaatatcaaatgtcccactgggcagctcttcaattagatgaaggcagccatcaggccttcatgct

SEQ ID NO: 433 - DNA, 201 bp, Bos taurus
ttggacagggcctaattacagctctgtaaatgcaagctaattggtgactaaaagtttaagacaaaagattgacttccactcttgtaattgaagaatttgaagtgttaggccatgtgtcttatgtatatattgtttctattaggataacggctaaaatttaataacaaatatgttagcaaaataatctcaatattgatatat

SEQ ID NO: 434 - DNA, 201 bp, Bos taurus
actttcttcagttcttttaaaggcaggtggccagggaaccatgggaaagagttagaccattcaaactgaaaacagaggtgaaagagagagaacacactgcgtactgggcaatatggccagtctcccaagtctcaagtggctcttccttacaccaagaagcctagcaataattctttctactgccaccacatgcaaccaaaa

SEQ ID NO: 435 - DNA, 201 bp, Bos taurus
atcagtcagaattttagattgggttttaattttaggtaactgagcagttatagcactgctagagttattcaatacactttaagggccaacccatattcctagtaagcaatgcactgctatctgcctaacaaggatggagcgcagggaataatgcataagtattggtgaatgatcttggtggccacaaacaaatgacaagag

SEQ ID NO: 436 - DNA, 201 bp, Bos taurus
gctgtggcaccaaataaacaacaaaaggaaaggaacagcagccgagattatatcagtgcccctggttaccgtggcggggatggcccactccaaagtcttaggaataaaggagagtgacattcaaaaaatctgtaaccaaacagaataattcctgcaagttttttgaggacacgctgggaaatgttgaggaaggccaggata

SEQ ID NO: 437 - DNA, 201 bp, Bos taurus
tggcacaggcagtacattgctagccaaggagaggatggatcaatggaaaacatctaaatcaggtcagttcagcccactggcagcaaggcaagccagtccatgcagagccaaaggcagaatcagtctatccagaggaacacgagatgggcaatatccacagcatgggtttaacagaagcccaccaactggcaaaggcagcac

SEQ ID NO: 438 - DNA, 201 bp, Bos taurus
aaaagagcaggaatgggaaacctttgtaagatttgccaaaaattatcatgaaaacacacagccaaaagattaataaatctaattacagtggccacacacagaggtctccttgtgactccatggcaaaagggattcaaaaatgagaatgcatacaaattcactttataacatgcacagtggtttcaactattacaatggcca

SEQ ID NO: 439 - DNA, 201 bp, Bos taurus
tgtcttgttttatccacaacagcttgtgctcagctgagaaaaaccgaacagaagagaatgccacactagcccaaaacaaaagcaagatatgccctacaccggtaagtaaacattgtcacaaatgatggagcgaggttaaactggctgttctgacactattattctgagcctcagctctctctccagttagtaaaccagaga

SEQ ID NO: 440 - DNA, 201 bp, Bos taurus
gaatgtgaactgtaacaactgcgagtgctggtagcttttcactgtccatggcctccccatctctgtagcctagagatagatcaattgaaacagctagaccatggtcgagatttcttcatagggcctcctgtctatggaaggatttgttctgtgttcatgaacttgatatatggctgtggaatccaaggcacacattcatca

SEQ ID NO: 441 - DNA, 201 bp, Bos taurus
ttaaagaaggtgaaagtgaatgatcatgttcatatcaaaaggacaaattctatagttattcaaggttgacagttctgctggttcatctaaaataaaagtatgtattttctgtttgccttgcaatcaagaaccatgtttgtaccaaaacccactgaatcacacatgttaaatgggtgaattgtgagatatgtgaaataggta

SEQ ID NO: 442 - DNA, 201 bp, Bos taurus
agaccattgccaggtgtgcctctccagcatggcagcttgtttcatcaaagggcacatggagaagtccaaggggagagagtccagcaagatggaaatcacaactttcataatttaatcatgaaaggagcatcctggcacttttttcagattctgtcctttagaagcaaatcacaaggtccgacccacaccaaagaataggct

SEQ ID NO: 443 - DNA, 201 bp, Bos taurus
tcttttgtgagtctgttatggaaaacttaaatgtctttaaggcactgttaacagaagtctcattgtcttagataaggctgctgctgaggacattcaggaacgtgacctaaatgttattgaacactggaagaagggagatccttcttatatagtggtagaaagttcaacatggacaccatccatcatgttgaaagtaggaaa

SEQ ID NO: 444 - DNA, 201 bp, Bos taurus
tgcccacacatgacttcctgcactcaggatcagcactgcacacaaggctcagatagaaaaccaactgggacataaagtaggaaataagtggcccaaagcttctgttgggtaggtcgtgagagagatcgaagaggtgagactgagatggcaagtaccacgttgtggagggccctgaacaccacatgcagaagtggaacatgc

SEQ ID NO: 445 - DNA, 201 bp, Bos taurus
aaactttaagaacttttttcaaaaaaagcagcttgtagtttaaaggtggcaatgcttctctactgaaaactgaaaaaccaatagaaaatagcagagtcctaaccccacagtaggccttcaacaaacttttatgaaatctaatcaagtgtcaggccccagcccaagttactatgctatgaaatattcccagaggggctttct

SEQ ID NO: 446 - DNA, 201 bp, Bos taurus
agtgttggttcaaaatagttttgccttttcaagagtacaagtgtttgtttgttaataacaaagagtcaccactctcttgtggcagcaaacccatcaaacagcttcattcacatcactaccaatgatagcagacctgaggacaacctggcaaaagtacatgcagatgactaatcatgctcttcttattggacaggctatgtg

SEQ ID NO: 447 - DNA, 201 bp, Bos taurus
cagcacagaagaatcctttgtgatctggcagaagaaggtatggagaactctggactgaagaaaggatcacaggaaactggagattattaggaagctagtgcaacagtccaggggaaaatggccaatacttaaaatcagcactagtaatggcgaaagggcagaaaagagtccagaaagctctcaagaggtacagaactgaca

SEQ ID NO: 448 - DNA, 201 bp, Bos taurus
taatggcactagactgcttaaggtaagaaaataacatgcttaaattcctaaattctgggctcaaggcatgaaactcagatgctttctaagagtgtactaagataacctctaagatttagggttgaaaaagattcatttcagaaataaggtctgtaacctcaataatctcatttcttcctgtgtcatttatatagttatgat

SEQ ID NO: 449 - DNA, 201 bp, Bos taurus
cctgaggtacattacattgcctggaggatcagccagatctctcacaaggtctatagtttgtagagttcagatcctgtcaataccaaattccactgataacatcaacagtaacaaaacttcctgggaattttctattcattaaagactttcttgggggatatttccattttaggatgatttttcatcataccaggaaagaag

SEQ ID NO: 450 - DNA, 201 bp, Bos taurus
atcttattataatagtaatcaagtgttaatatattaggatataaatcacaaaatatgcataaagttttaagagaaaacatgagcctccttagacattttttagctcaaggctgatgattttgtggaatggcctacacttcccatctcatgcattcactctgctttttagggaccctggaatcccttgctgggctccaggta

SEQ ID NO: 451 - DNA, 201 bp, Bos taurus
ttatcccattattccaaactctgggacacgaaactcctttactcctttcaaggacaaatcagttaagagacctcacctttgatgatggttagacgctcttttacccaagacagacaaacagccacaaagagaggggagtctggagggcagaggcctcgtccacccccccagactcacctggtggatgacgtagatgccata

SEQ ID NO: 452 - DNA, 201 bp, Bos taurus
cccaggcacgctgagctggtaaggggcctgtgggggacctgaagcttctctcctgtgcctctggaatatgctcatccaaagatgattgagtaggagcaccgggcatgttgaggaaggctggaatggacagggaggagagtgcagagggagatcatggggcgtcgggggcctgacaacaactgtgtatggggaaaacaattt

SEQ ID NO: 453 - DNA, 201 bp, Bos taurus
ttcatcttttcttcctccaatgtaagaaaccacagagcagacagcagatctgtcattcttagcaattctgctcccaggtggcgtcttgagcttggccccgcgagctcccattcccttcctagctaggtgctcccactcagagcggtgtcttctcccacccgcctgggtccccgaatcggagacctcagcgtcccctggagg

SEQ ID NO: 454 - DNA, 201 bp, Bos taurus
tcattctgttgagtagaaagtcactcatatgaaactagtacaactcattaccacagttctgcagttattctacacttgatctctgtcgctgtattttaacgtagaaaaccctttagggtttgtaaagaatacttggggattattttctgaaaggtctaaggaagcagtagtgtgccatgcaacaatgtaggagctttcttt

SEQ ID NO: 455 - DNA, 201 bp, Bos taurus
ctcaactgggaataccagaattgtttctgggtctaattaagcagtatttcccctttgtcttcccttgtttgattttggcaccgaatccccgtttgaggccgtgttagcctcaaacagcactccccctggtagccttttagctgcgttggtctccaactataacctgctactaaggcctgccctccctgaaactctgtctct

SEQ ID NO: 456 - DNA, 201 bp, Bos taurus
gtagtggtttcaaccactcatgttaaggctttccactaaggactggcacagtgtttatttgtatatgtatcagggctctagcttcaccttaaactagttacgagtcacaggaagcctatttatacaagggactgaggaatcttctgggaagattaatcgtcagaggagtcaggcccagggagcttgacttcgtaaggctat

SEQ ID NO: 457 - DNA, 201 bp, Bos taurus
cctgagtttgttttgtgtgtgtgaaatcagcatattttaagcatatgttaaccaaatattaaggtcaattaaactttaaatactgagtatcaccaccactcagtgctggtcctttaatttatttcaaagattttagcccccaaactgtgttccctaggtgcctgctgggtcttaaaggcagaaagatgccagccgccattt

SEQ ID NO: 458 - DNA, 201 bp, Bos taurus
gtgtttcttagtttagagctgtgcctaaagtaaaaattgcccttacagactccagaagccaggcggtcctgccacctttcttccgtcttttgatcacacaagagatccagaggagaaggaatccagaagatccctgcggaaacctgagagcagtttctctacttttatgaccactgagtggctctcagtttctgctcctcc

SEQ ID NO: 459 - DNA, 201 bp, Bos taurus
ggcctccaccttctcctccttggatcacttggtctaggggaagccagctgccacaacatgagacacttgtatagtgctacagagaggttcacacaatgacgggctgggccttctgcaaatgccagtacagattcactccccacaggaatgagccatcctggaagtaaagcttccaaccccaggcaacaatccttcagatgc

SEQ ID NO: 460 - DNA, 201 bp, Bos taurus
actttgtttcaaaacaaaaaaaggattttcagtgtagaaagtactcttataaatagtctcataatctaatgagctctgtagtagtaaccagttctgctttcagcctaggtggatagccaaatgttacatgagcctttatcattaggaaacttaagcctctcagacgcctctgtgccttgtcacagtctgcatgtcctttcc

SEQ ID NO: 461 - DNA, 201 bp, Bos taurus
aggcatagtaggctgaacccttgacagtctcatcctcaatttgctcacaggaacagctcccatgctgggagggccaacttgtgaagactagggggtgccactgctattgcccctcttttggtgccttctcatacagtgggggtgtaactctgggaaaagtgagtcctcatccagttctagggtaggagtgcaggagttctg

SEQ ID NO: 462 - DNA, 201 bp, Bos taurus
agactcactggaaatcacaaactattaaaagaggccacattaaaactactatactaactccaagtaatgactctgttattactattatcaatctgcttctaagaaaaggccgacaggaaaaggtactactggctgcccagattacgaaattaactgtaactagagacaaagttctaaaaatctttaaaaacattctggtgc

SEQ ID NO: 463 - DNA, 201 bp, Bos taurus
aaatatgagtatctttccaaaaagctttttaacaaaacaattaagattaaattgtgaaatttattaaatgtttttttaatccactgtttttgatccttgctacaatgagattataaatctaactcatctgggtatgttccaagtgactttatcataattttatctgttgtagttcagcaaatgtgatcgtttatctctaat

SEQ ID NO: 464 - DNA, 201 bp, Bos taurus
tactgaagtgggttgccatttccttctccacaacagtccccatatctttccacaaaaatctgccctatccttttacacataatttctggctattgaaaaattagtcctacaattattgtcctttaaaaagttgttttgcagttggtagaacttctgcttctgttcatgaagcattaactgctattggaattgccttcctgc

SEQ ID NO: 465 - DNA, 201 bp, Bos taurus
aaaaacaagtccagtgccttgtcttgggctctcaaagaaggctcctgcacaggaggcctcctggggctttcatggaaggggtttcagaaaggagccaggatataaatatttgtccggagtaagtttgggaggggaatctggtgatttttcattttcataggagttgtggttacactttgcactattctatgaaattaaaga

SEQ ID NO: 466 - DNA, 201 bp, Bos taurus
atattatgtgcccggaaatgactactttcaaatttcaaatgggacaaggctgtttaccttaatcactgtctttattattttacagattctgtcacattctctgagcgctggccctgtcagacaaggatctacactgccaccttcatatggaagccctcccactttcccagctgctcagcaccatctctggaattgcctctc

SEQ ID NO: 467 - DNA, 201 bp, Bos taurus
gcaaggtctatctcctctttctgtctcagaggttcatgaaataccctagtagtcttccaataaatttttattattattattattttgcttaagatatcttaagtggttctggcccttgtgaataaatggactcccatcaagccccctggcgggtctgtggtaacaggtgctctggggcatgcatgagctgtctcctctgag

SEQ ID NO: 468 - DNA, 201 bp, Bos taurus
ttactctttccagtatatcctatagtaggccccacaatagcctctctgaggcagaaactaataagtattcactgaatcacaataacaacaataatatctatatctgcccgtgttcactagaggccaaaagcagtttgagtgctttcaacgcacggtctcattttgtgttgttttagtcagagtcgtgtccagttcttttga

SEQ ID NO: 469 - DNA, 201 bp, Bos taurus
gaataatattcatagtttatggactgtagttaagggacattttaggagttgacttttccttcaaaaataaaaataaaaactgaagagggtataaatcccttttcctgcccttgtgcaggtcttagagttcaccttgcctattttcaaacagaaaacagtaatagggtgcagagctggaacctaaggagtgaagggtttagt

SEQ ID NO: 470 - DNA, 201 bp, Bos taurus
atcaatttccttatttatagtttgtgaaaatattaaattctgtaagtcttattttcataattaagcacagccatgcattatattggtcccattagacttcaggcaacaaaataagaacacagtaatgaatgaaggataccacaaaataaaacttttctccttttttccttcaattcagttatgaacacttctgcagtgcat

SEQ ID NO: 471 - DNA, 201 bp, Bos taurus
ttcattaaacaattaccatgaattatttttgacagatgccccagggaaaaggctatatatactgaatggggtctgggccagatcaaataaagacctgtgagttggggcttccaaggagatatcaaacaagtaatacaatgataattctctcatataggagtattccaaatcaattttgaattttttaccattggccattag

SEQ ID NO: 472 - DNA, 201 bp, Bos taurus
gtaagggaaaactgaagataaagtgtcatcaatgataatggagaatttaggaaggtacaacattttgaaggtgatactttctggcctgttaagtcttaccatcattaaaataggtatctctggaagtagctgaagatttaggactaaaaagaagacagggctaatgtttgcatcttccttcctcttggcctgattgtttct

SEQ ID NO: 473 - DNA, 201 bp, Bos taurus
ggcctgaaacgaggagttagccatttaacaaaatggagaacaagtatccccattaaaggagtgagtatgtgcagagaacctgaggtgacgaggagcttgggttattagaagacctggaaggaggccactgtggctaaagtatatttcatgagctaaggctggatggtaggcaagggctagatcaggcaggatgttgcaggc

SEQ ID NO: 474 - DNA, 201 bp, Bos taurus
atagagtagccttgtttgatgttgtttttctgtgaaattgttcatgttcaacaggagagcaccatggcctgcctaactgttagtacagggcaagctccagtagacagctgttagaggctgctattttttttatcttttggcaatttattacttttaaagtagcttttggtaagcaggcctggttcaatatttagacaagag

SEQ ID NO: 475 - DNA, 201 bp, Bos taurus
gcctggcaggctacagtccatggggtcgtagagtcggacacgacagagactaaaccaccaagcttcatgaaggggaaacattaaaggcattgttcctgctcacaaaggagtttagaacttacttgggaagaccaaagggcaataatcattcttcagtaattttgaataagtgctaaactgtggtgttggcttagaatttaa

SEQ ID NO: 476 - DNA, 201 bp, Bos taurus
tatatgagattgtacatggagattgtatataaatgaagtagcaaacttgtagacaatgaaccagttttgactcatgggtatgttttgtttgcccatcaaaatatttaagtatattctgaattattagtttccagtatttaagaactagtagaatagagatgaaaaattgaatttccagcttttcatgaaaacaattcctaa

SEQ ID NO: 477 - DNA, 201 bp, Bos taurus
aaggagataaaattttacagcctcttatatgcctatagagagttgaagccaaaggtagtatgatctaggtcagaaaaattacatgtttcttaagtgttatcgctataataattctgtgttaaaatatttttcctttggaatatagaatgatatatcaactttcttcctcctctacttgtttttaattgttatttcattagg

SEQ ID NO: 478 - DNA, 201 bp, Bos taurus
tacacttgaaattggtttatatccggaataactaaatccctagaaacagaaagtagactgatggtcaccagtggctagggaagagtagaatgggcagtgactgcttaatgtgttagtgctgtttttagtggtgatgaaaatgttctggagctatatagttgtggctgttgcacaatattgtgagtgtactaactaccactg

SEQ ID NO: 479 - DNA, 201 bp, Bos taurus
tactgtttagcagtttcttataacaggatatagctgaacatctgatgggagatgcatagggcaaggaatgtagggaggtacatgaagctacctcttccatgccttctccaggagtgtcactctccccacactgctacctgctccttaacccggaagctcttcaaaccaccaccaccccacctttgggtttttaatatggtt

SEQ ID NO: 480 - DNA, 201 bp, Bos taurus
gaggtggacacaactgagtacataggtcttcagtctctcaggccccccttgcgtctcaaaaggctggctgaagagttaatgattagtaaacgtgaagacatagaaacaaagaataactgttggcctaggaaactgctaacaatttagagtataaataagctacaaagcagagtcactgaactctcagttccttgaaaggta

SEQ ID NO: 481 - DNA, 201 bp, Bos taurus
ctaataaatatcagacagtatagaaaaaggatcttcttgcatgctctttcatttgtctgtttttaacccaaatatttggcccagtgttactctgatttccatagaaatattgtaaaaactagggagtttcccccaaatatagctcagtactatacaatcagccctgtgactcttgctggagaggcctttccagacccatag

SEQ ID NO: 482 - DNA, 201 bp, Bos taurus
cagttttaatcttttgttgttggccaaatcttttcctcttcttttcccctaatttgtgcttctgcctcaggcaacatcatgcactaaagaaatgtctttactcccaggtggaaggtggctggcctctcacaactgctgaagccagtagaagttgaactgcttaatgtagacccttcctggcccctgtttcccaacctaact

SEQ ID NO: 483 - DNA, 201 bp, Bos taurus
tcacagaacaaaggattagagcagatcagtgtgtccaccagttctctctcctctttgggtagtgagagcaggcaggggacatgtgcaaaaggagaaaatagccaatcggtaaggattggggctggggaataggcacaaacggaattcaaacctggctgtcattctcaggcttggatttaaatattttgtcttctctatagt

SEQ ID NO: 484 - DNA, 201 bp, Bos taurus
cttccctgcttggaatgagatgtgttcagtctcttttgtgtggctgtccccttttcatcattcaggtaaccagtgatcagagaggcctaccctgaccactcggacactactttctccttcccccagacacatgtgcagtagcctgttctattttcatcctagtatttatcactctctgaaattttcttatgtatatacatg

SEQ ID NO: 485 - DNA, 201 bp, Bos taurus
tgcagtggcttctctcaggatctttattctccacctggacactgtcaccttcccgtaacacagctgtgtgatgaggttctgttttttgttgcatattatccgtacagtatacacatttccagatatggtacaaagggagcttgtccatcctttaggaataggctgggaatgctttgctcctttgtccaatttgaagtccaa

SEQ ID NO: 486 - DNA, 201 bp, Bos taurus
ctttacatataataataaaccttcaagagtttgttaatgataataatatccatcaggataataatgaatttgggaaggccttccatatcaggagtttgggcttattagataggtcttggaaacaacattttaatttggcagcagattagaaggaggagaagcaaacagggattgaaaaactagttggtggccattttgaaa

SEQ ID NO: 487 - DNA, 201 bp, Bos taurus
taaacgtctctttcaccagagtagcccttggggtagtgagtccactgccaagaggacatttcttttacttgccttaactctcccagagatttgaagaaaggagctttggggaagggtccctgaagaattttatactaccagttatcttccttaaactggactttccaaatgcaatttaagtagtctggtagaatgaaaatt

SEQ ID NO: 488 - DNA, 201 bp, Bos taurus
gaggataactcagcagctctggttgcaaagcaaatgaaccaggcagtaaggagtgagggatccccatcccccacaagcctgggacaaaaaccagagcagccaacttccaccagggcagcaatgagagcactaaaggggtcaccacacagacagcaggtgactgaggcgcccaggtgctgtgtctctatgcacatgtggcca

SEQ ID NO: 489 - DNA, 201 bp, Bos taurus
ttaggtctctatgtaaaagaagccccaagtttatctttaagtgacctttatgtactgaaaagcctgttaaggaaaacaggctgtaaccagcaattttttttaaaaaatgccaacttataaatgtatagcctataaaagtacagggttacctacactgcattgtaccaaatcttcctggactgggagtgcctggattccttg

SEQ ID NO: 490 - DNA, 201 bp, Bos taurus
agtctgttctacacaaagcattagaatatcctatcattgatcaaataaactttttcctgtcctagtcttaccaattttctagcctagtctttatttttgagggccatgcttatcaaacagtcatcctaggcctgtttaaagatctctgttacagataatactgttggcttttaatgggctttctccatagaggaacatttg

SEQ ID NO: 491 - DNA, 201 bp, Bos taurus
aatttatttaagcccttgtttttcaggtctcaggtatcattaaccaagcaccattcctattccacacaattggatttctcatgcctacaacccacatgcccaagacaatcaggaatttctctttctaatatgtttaggtggtctggatttctccactggcagtgtgtagtggaggccatgccaccttcctgaggcttgcag

SEQ ID NO: 492 - DNA, 201 bp, Bos taurus
ctcccctgcatccagctccaagtccagtcttgatggttcacactacctgaggctttgagcaacttggggctgggagtctgaagttgagagagcccctaccaacctaggacaggtaattcagagtgtctacataccttgtttcagaaatctgggagctagaagtgattgaatcccaaagtgccctgaaaaaccgctcttaat

SEQ ID NO: 493 - DNA, 201 bp, Bos taurus
agaaccatgtcattctctctgagaaccatggtaaagccacagtgatcctggatgggtcagaaagaatgtgtgtggccaagaaaacctatgccactgtccctagaaggggatctgaatcttgagaagagaatcctgggttgtaaccaagaagaggcccaagcccggcacttagaggacctgcgcagggccagacctctggac

SEQ ID NO: 494 - DNA, 201 bp, Bos taurus
aaagtggaattaccacgtggagaagcagaaatgcttttaagatacttgattaattgtgccaaatagcttttcaaaagaattgtactggcttaagtctttgccagcactatatgacagtcaggtgtcatattttaagagattcactaacagtgtttttcaattttttttaaaacctgtgatacaaaaatcaagattggtgtt

SEQ ID NO: 495 - DNA, 201 bp, Bos taurus
tttaccaggtttcccccacatcctggttcgtgggtcgcagtgttcccacctttcctgctgccctgcacttcttccctgggcctctccattggctgctcatggcttacggcagccaaatgcagaaggatgaggaggatggtccagccttcctagttctccagatgactctcagaagcccaggagagaagggccaaatgctgc

SEQ ID NO: 496 - DNA, 201 bp, Bos taurus
atgagttagcagaacaaacacaaagcacttagaacagagtcgggcatagaggaggcacaacacacaggctctgcccttgagggcacagtctgcagcttattcatcttggtttcccagcgccaaatacatggtagacatctgttaaataactcagtcccacaaacatctaacaccagtacctggggtcacacagagtcggac

SEQ ID NO: 497 - DNA, 201 bp, Bos taurus
tggccattttgggcactaaaaagaagagatacaacatactgaaaaacaccaaatatgctaaaattcatgaggtcacaatgataagaagcaaagaccttcactgtccctttgacatggcctgatctatgctgtttggaggaaggggtgaatgtgtgtgtgtgtgtgtgtgtgtgtgtgtgtgtgtgtgtatgtatctgagtg

SEQ ID NO: 498 - DNA, 201 bp, Bos taurus
aggcaagtttggccttggagtacagaatgaagcatggcaaaggctaatagagttttgccaagagaacacactaatcatagcaaacacccttttgcaacaacacaagactgtactatatggccaacatcactagatggccaacaccgaaatcagattgattatattgtttgtagccaaagatggagaagtgctatacagtca

SEQ ID NO: 499 - DNA, 201 bp, Bos taurus
gccgaatgctgcgcttcatagtcccgggcgcgcaaccagaacctctcttcgacccaccgcacggcgccttgggtttgcgcaatagacccctcccggccccagctcgtcacactcggctgcagggtgagagaagtccacagaacgccggcgaacgctgcgggactggggcggggcggggccgagaggggcggggcggaggag

SEQ ID NO: 500 - DNA, 201 bp, Bos taurus
caatccaccttgataatttcatagtagggcccagaaaaaatgaagctgatataggctgagcaggatcacattatggctttcgtgaatctcaggtaaatttgcttctgtgggccctcttccaccattaaaaaaaaaaaaaaaaaaaagtatgtttacaactctgttggtatatgacagatacagtaatatattaaaatattt

SEQ ID NO: 501 - DNA, 201 bp, Bos taurus
tcctagctgtccttagcagttgttttcattattaagtgaatgtgatggcacagaggctgagggactctcctgaagggggaccacgcagggcctttgacataaagtgaaggggtgctggagaggcatcacagtggtgtgcaggagcctgggtggaatcagaaggctagagtctgggccttggctctttttctttcattcatt

SEQ ID NO: 502 - DNA, 201 bp, Bos taurus
acatgggcccaggccttgaggcagggctgaacctctctccatccctgccttgcagcctaatagtgctggcaggctgccttgggacctagcacccactatacaggctgcatgagaagtctgagggccaactgggtcctgggcacctgactccctcagcaatgacagctgagcagggtttggggacatggccttgaaggagca

SEQ ID NO: 503 - DNA, 201 bp, Bos taurus
attgctcaagagctgattggaaagacagaatcccagacttaggaatctgaacctcattttatcttcaagtaaattatgtgcactttaaagtttgagaagcggtattcttggccacagctgtaccttttcaaggccttattacagaaggggaaaactgatggagaaccttgtctggactcaaggtttcaccctatagcttgt

SEQ ID NO: 504 - DNA, 201 bp, Bos taurus
atgtcacctgagaccaaggacagtcccagcagctgtgttgcctggtcagctcatcacaggctaacaccaccaccactgtgactcacttcccttctctcctgctgtctgctctctgctttcacttctgctctgcaaaaagctacccagaaccctgtctctatggtccacgttcccagaaaatccacccagcatgttgcccct

SEQ ID NO: 505 - DNA, 201 bp, Bos taurus
gtcaaggttgatccaaagccaggcctgggtagcctgctcctatctaatcagggtctcatgaagccctcccagacaacccagggaggtctgtggctgccacggtattctggggaccttactcaaagtttcctggactggtcatctctgactcccccagaactggaggataattggagatcacagccagtgaacaaagtggac

SEQ ID NO: 506 - DNA, 201 bp, Bos taurus
gtctttgcagctgaaatgagagagcaacaacttttctctaaaagttttgagctctcccttccacatgctgggcagttcgtgctcctgtggccatctccagctgggatcatttgagactctgttaatgtatctgagagcacatgcctggtctcagagtggagagatgctgagaggagttgtcaaaaagagcagttcttagag

SEQ ID NO: 507 - DNA, 201 bp, Bos taurus
tgaacagccataagctttaaatgctatacattttctcaagttttgtaaattaggccagctgaacttctttctgctccacacttatttctcccaccattagttgtaacaacacatcttggtgcagttcacactgcacttatattgaaatatgttttctcaggtactttttaaaaaaagctttgaaatttaatttacatacca

SEQ ID NO: 508 - DNA, 201 bp, Bos taurus
actgaatcacatagtcttaactgaatttcaaccactccctaagacataacctgaaatctccattttttaaaatgggatagtagcaagttacaggtaagcacagttgcatttatggctctaaagttccagaggggggctggtgaggccatggaagagaatgagacagaaaacagaaaacatgagcttaagagaagatgataa

SEQ ID NO: 509 - DNA, 201 bp, Bos taurus
gtcattctcaaatatataattccataatgcttttttgtggtgtaccaattttgagaccagaattcaacaaggcagttagaaaaaacctgttatgatggttgaaccatttatgaattcattgcctttactgccccacttctgttactggaacatgtctcttaccagttggcttaatattaggctttgtcagcagagggagct

SEQ ID NO: 510 - DNA, 201 bp, Bos taurus
ggcacatgttactacacgaatgaaccttaatgacatcatgttaagcgaaataagccaatcacaaaaagacaaagacacgaggtacctggggtgatcagtacgtggagacagacagtaggaaagtgctgcaggtgtgggtgtggagagctgttattcaacgggtagggtttccgctttgtaggatgaagagagtcctggagt

SEQ ID NO: 511 - DNA, 201 bp, Bos taurus
agaatcacaagggggacactcaacaggccccacaagagaaacacatagaaaacagtcatgtttcttaactactttgcaattccagctactaggaaatccaggaggccccactatagtctttaactaaacctcactccttttccaggcaataatttcagttgggtttctactgcaagcagctatggaacagagaagccttga

SEQ ID NO: 512 - DNA, 201 bp, Bos taurus
ggggcccaccttctcaaaatctctaaggtaagaaagcccgagtagcctcggttaacacgattgggagaccatacaaataccttaccttctcgactcatccagcaggtagtccgagggccactgcctcccgccctcctgcccgccctcgcgttctcccatcctcctcgccaccctcccccccaccacctcccacccccgcct

SEQ ID NO: 513 - DNA, 201 bp, Bos taurus
gctatatgtatacatatatctattcttttttagatgcttttcccatataggttattacagaatattgagtagagttccttgtgctctacagtaggcccttattggttatctgctgtatgtagtagtatgcatatgttagtccccacctcctagtttatccctccccctctacttttccccttcagtaaccataaatttgtt

SEQ ID NO: 514 - DNA, 201 bp, Bos taurus
aagtacttcatgaactttcataagtctaataatttaaacaggtaaatataaggaatctcagattccaacactttattaatagagacaaaatgtcataactctccacttaaaataaaacattgattaaacattttaaattggaatcatgaagctaatctgtcagattctctattttgtcaaattctcttaatcaaagtgtaa

SEQ ID NO: 515 - DNA, 201 bp, Bos taurus
atgtgaggagtatgccctaggtctgcctccctcagctgtgtgatcctacattacttgcttaaatcccctaagcctcatgtttctcacctataaaatgggggtagtaatacctgcctgcctacctcagaagagatgtctgtagtatataaaaatcagtaattgttaccatgaaacacaatagcattaaacaatattacttgt

SEQ ID NO: 516 - DNA, 201 bp, Bos taurus
tcaagagcacacagaggctctctgctgggactcacctcagagatgtggtggccccttgcctttgttcccttgggaaataaaaacttgtgctaaggaagcatggtagtagtcattctggaagggcctaaatttatcttccaactggtcttggagaaaacaaacacaatcattctcaccctcctttaaaggtccctttactga

SEQ ID NO: 517 - DNA, 201 bp, Bos taurus
actgctgttagctcacagagaaaagaattggggagaggttcaccactgcctcaaggcctgggccgaaatgtcaccaagaaaggaaaagttaggccccgtgggaataccttggtttccatgcaaccttatgtgcagacacgggcagatccctgcaggggtaggcatctacagtggccagatgagagacctgtagttaatgca

SEQ ID NO: 518 - DNA, 201 bp, Bos taurus
gatgctctaggttgtcacggccgagtgcttcagccaagagagatggaaatgtccgaggaggacagacacaggtggcgatagtaatgtggcttctgcagggcggccttgcaggtaaccacccatgtttgggtttccaaggtggcaccagtactagagatcctgcctgccaatgcagaagacccaagacatgcaggtttgatc

SEQ ID NO: 519 - DNA, 201 bp, Bos taurus
cggcctcctgggcttcagaaaagagcctccaccctcgggagtacctgagacagtggtgagcagccaggaagtttgccaacagggaggcccagagactgttcttgttcatccaaaatcagtgggaagcatagagtaagggctgtctgctttattgggaaggcaaggtgctggttggccaggaggcaggatggtctcgtcatc

SEQ ID NO: 520 - DNA, 201 bp, Bos taurus
cacacacactcatgtaggaacttcaacaagggttggccagagtcgtttatctctgctccagagtatctgagaccttatctgaaaagacgtgaagatggggatgggaggtgttactcagcagttggaagtatccagagtcatcttcaccaatatgtctagtgatggatgctggccatcagtgagcccttcagctgggtggtt

SEQ ID NO: 521 - DNA, 201 bp, Bos taurus
tgccttctctttttcctttttaagtagttaacttcatttttcccaggctatcaaagtaatatgtaaccttaacataattttttttaattttagaaaaatacgttttatgctaattactcaaagtatcactcctcagagacagtcactattcacattttagcctatttctcttcagtcttttttcttagcatttcccccttt

SEQ ID NO: 522 - DNA, 201 bp, Bos taurus
ctgatccttcatttcctcagatgtaaaattagattattaacatctaccctagttacctcctagagtagaagcatccacacaagtaagtcatgcttcttggtgcagtcataaaatttttcccagctctctcggtcctctgcccacagttcctgggtggccaggagacagcctggactggcatattccatgggtccaaagaga

SEQ ID NO: 523 - DNA, 201 bp, Bos taurus
gaaggaattccagtgtttgatggagacaggtgtgaggctggatcatgccctttaagatcccttctccctcacatggcctgtgattactctaccttgccccaggttgacctgggcaaatatgggtgtaacccactgcccagactctggcctccggagacactggccatggccttgttgagctgctttgaacaaaaaggaaga

SEQ ID NO: 524 - DNA, 201 bp, Bos taurus
gggcctgatggattcccctggggtcctaaagatgccaaacctgtaaccttggatggattttggctccaacaaggatctgtccgtggtaagagttcagggtcgttttgtaatcttcagaggcctggcctagactctctcctgctgtcctgtgacgctggtgacattccaggaatgctcaggccacgtgaggggaggaacctc

SEQ ID NO: 525 - DNA, 201 bp, Bos taurus
ctacagacagaaggccagggaagagatgaggaaggtcagtacagatcctgcaccttctagcagagcctctggaagtaaaggtctgagcctcaaattggacctcgaaaagggcctgggggcgaccccggggatccaggcagccgcaagcttggaccagtttccctaccgcctcagccgcacatctggccagagcccagctgg

SEQ ID NO: 526 - DNA, 201 bp, Bos taurus
ttctttctgacacatatgaagtgtcagtgagaaggtactgccttgagcaagtaaccataggacgggctggcctgtaggtcaactggaactaggactcaaaaccctcagagttgctcctgtaaccttggaggttactcctccatccctccattgcagccagagctccaggaccccagccccatccaggccccaagaccaaaa

SEQ ID NO: 527 - DNA, 201 bp, Bos taurus
gattatagtccatggggtcacaaagagtcggacacgactgatgaactgatgaacacacacacacacacacacagatggtatttatatactttccttttagatatcagccttggggaacaaaccttctaacacttgggggttggaaacttctggtctcttccaaagagttcctcacttgtcctgccttgtagtactcgacag

SEQ ID NO: 528 - DNA, 201 bp, Bos taurus
gtggccaaagtactggagtttcagctttagcatcattccttccaaagaaacccccaaaaggttaactttcccaggtcaataactagtcagtggtcacagtggacttggtccaggcctccaggtcatcaagctgatggccctctggtaggagcacagggaggtgagcaggagagatgtgatctctagtgtctgggtctcaca

SEQ ID NO: 529 - DNA, 201 bp, Bos taurus
gaccgttaaactttgggcgggtcactgccctgtctgagctgctgtttcctaaactgccatctgggtcagtgttttagattggaggctctcaaagttggccaagggctgatcccgctcctggagatttccttttaatgaatctggaggcagcctggattctaacatgtagccagtgttgagagccatgcttgcagatcttaa

SEQ ID NO: 530 - DNA, 201 bp, Bos taurus
gttctgctgattaaatctcctagttgcctgctaatcctgtctcaaagagggtcagtcccagagtttgaacaaacaaaactcataggccacaggggtggtttagatcatttttaaaatgaagcttgggatccagactggaattcttggatctgtcatttgaaaaattccctaaactcctaagagttggccaaacatctcttg

SEQ ID NO: 531 - DNA, 201 bp, Bos taurus
tgtataaaatgctatgggaatagtccccaaatcaaagtcagtggactcgagggcagtgaaggccaccaagcctgggacatataaagcattaggaaaatactagagtgtaatagagtaaataatatactagagtaaataaatgatagagtaaatagagtaaatattatataatagactgaagagacaacatttaaaaaatct

SEQ ID NO: 532 - DNA, 201 bp, Bos taurus
aaacataatttccattagaatgtttactccaagaaggagaggctccttttttgtccagttttgtaactgccatatgcttgccttttaaactagtttctggaataataatagatgctcaataaatatttgttgaacaagcaattggctttaatgaccacttgtgtcctaataattccctatttggcacctctctgccaaaaa

SEQ ID NO: 533 - DNA, 201 bp, Bos taurus
tggcaggtgggttgtttactactgagccacctgggaagccctgaagtagaaaaagccttgacttattctaagatgagttagaagggcaatgtgtcaagagtaagatgagggaaaacggtaggaaaggatattgcttttatattgtaggctgtggcaagtattttggaatttattttgagggttatgcaaagtcatagaagg

SEQ ID NO: 534 - DNA, 201 bp, Bos taurus
aatgtcatcttaacccactccctcagcagtctgagcttctgtgtatgcatatataaatcaggtatataataatactaatgatagttattagctgatggccatgaggattgaatgggagtcatgctcttcataatagttttcattttttaaaaataaagcctgtcatgatctttaattaaaaaattaaatcttataccagag

SEQ ID NO: 535 - DNA, 201 bp, Bos taurus
cgttgatgaaatagtaaatttcaggagtaaacaaaaataattacgatcttaaggcagaagctactaaaatctgttattttatatccagttagtatggcctgttattgtataaagggaagatatgtgcaaaatactagagttatctctgcacagtaaataactcatattaggggaaaatgaaattcttcatattgttgtgca

SEQ ID NO: 536 - DNA, 201 bp, Bos taurus
ggcagggtacagtggccactcccatacagatgtgagccagggcccgggggctgtgtctgggttgcagagtcaggggtgtcaagggcagtgatagccttagtcgcagggtaacggtggggctggggccccaggcctcctgcagctcctcctgcccagacacaatgacttcacttggaggcacatcaacccagttagaaactc

SEQ ID NO: 537 - DNA, 201 bp, Bos taurus
tattttagtgggctagcccattgtcatgaggaaatgtaaaataatagatctgatctagtcttcagtagtcttttctgagcatgtgacatttgtagtatcagtaggagtcaaaccattgtgttgttaaaagtgagagaaagaatacttcaagaagaagaaaaagcaaatccaaaggtcctgaagtaggttggagcaaaacct

SEQ ID NO: 538 - DNA, 201 bp, Bos taurus
aggatgcccctccctcacctgtgttttaatactttgctgaaacccttcatggagtttgggtctttgaggcacatgaggcctctgctctccttgcttggtctttcaatgtaccttgctctgctccaaactctgatgtttcagcattgtttggcctcactgtgtggtgacagttggaattaataagaaagaaagaacctaact

SEQ ID NO: 539 - DNA, 201 bp, Bos taurus
aatgagttaaacgccagagttgagcaatggaaaaatctcgcatttatagatggaaagtgtttgttgaaacccttgagaaagaatatactagaattaaccattcatatcttggttagaaaccaaaagacctaagagtaatataaacgcatacataagaaagtgagtttcaagttcgtttcaggtcactaacatgtacaggga

SEQ ID NO: 540 - DNA, 201 bp, Bos taurus
ttttttaacatctaaaccacgagggaagccctgaaagcaagcacaactatatccaaataactaaaataagttatgtttaacagagtaaagaaagctgagacggcaatatctcatctaatggtgaataccaataaagagatagaaatcataaaaaaaagaatcaaatgaaaactgttgaaatttccagagtattttcaaata

SEQ ID NO: 541 - DNA, 201 bp, Bos taurus
gaaccagtccctccagatagggtcaaggaaagttaaacaaagtgctactatttttagccaaatatgactattaaaaaacagagtaggtaaagtctgtgccgattaaaggaaaatactgaaggaaagcttctatttaatacatttagttctttagttctgtattttgtgttgtaagagacataaagaaattgcaaataaagc

SEQ ID NO: 542 - DNA, 201 bp, Bos taurus
cggcgccgtcaccgcgggtcctgatgctcgggccagtgggatgcgcagcgaaccctcattcgcgcggattttgaagccgcgttgcacacccggagcgcggcgggcccgccgtgaacccgccgtgaatacactgcccggaaccccgagccgttgatcctgggtctggggagcaggtcgccgagagtgccagtgactttggct

SEQ ID NO: 543 - DNA, 201 bp, Bos taurus
gaacaaaaatggcttttgaatttttttatactagagttctgaacttttaatttttatattttattttctttttcttactattctagggcctaaaagaacataagacaggtatttataaggatgaggaagcaagattaaaataaacttaataaatgtcatctttcccttctagtccatttacatatcatgaatttatttgct

SEQ ID NO: 544 - DNA, 201 bp, Bos taurus
ttaaaaatgtggtccctcttagacacccagaaacacctcctagttcttaagctttatttttgtgttacttattgttcaatgagaataattaagaagttaataatatcagagacattttagtatgtgttcataaaattatatttggtataaatattcagtcagtttctaatttatcaattggctggtatattaatgatatga

SEQ ID NO: 545 - DNA, 201 bp, Bos taurus
tggaggctgcttcctaacagcatttaagattttctaattctttccactccttttgctacttttctggctcaaatcagcagtgtattttgactaatctgctatgatagcctccctcctggtcctcatgttctgatcaggttttattctgtagagcagacaggacagttttcaaaaaatgggacttctgtttatagacatact

SEQ ID NO: 546 - DNA, 201 bp, Bos taurus
aaggagagagctcaggtctggcatggggattggcataagagaaagcaacctttcagaaatcatactccatctaaggaccaaattcagacatgggattctccgtggctatctgagtggacagatgactgaatatacgtgaggccccccaaacacaagctaaatatcagacaaagaaatggaaaagcctgagtggactgagac

SEQ ID NO: 547 - DNA, 201 bp, Bos taurus
accttcacccacataggctggccccagcctacctctcgagctgctgcctcctatccgcgaccacagcttcaggcagaatagcagagccctgtcttcaggcaagcaaagcaggctggcctctgtgttcttagctccgctgctccactgcctctccggaaagtctgctctcttccccactgaaccatctgcctggtcatttgc

SEQ ID NO: 548 - DNA, 201 bp, Bos taurus
aaatagtgagaaaactgaagtaagaaatcaagcttatttctccttctataggaattcaaggctgggtgtcttctgtgtcatcattcaggaacctctgcttctatcttgtacctctcccagtctctgtggtctcaaagtcctctcacttcagccagcatagaggaaaaaagagggaatgtggaattatgcaatgcctttttg

SEQ ID NO: 549 - DNA, 201 bp, Bos taurus
catttgtctgctttgttgtatgttgtgcatccagtgggactcagacaaattgcttcagctttctaaactgttttgtttcttccattcaattatcctttatcccttttccttcctgcacctcactcttattcccaagttcccatttaatccacaatgagaggacacaattgtgctgttactcagcttcaggctgagaaagaa

SEQ ID NO: 550 - DNA, 201 bp, Bos taurus
tgtccagaaccaggacagctctggcagccaggccataggttccttcttctacttccaaacctggatgcagtgcaaacccatggggtatggaacctggcttccccaaggatgaagtacaagagggtgtctctgtaatgagaagtttgagtgacaggtggttgtaaggaactgattaattcctctcccctcctccttccagag

SEQ ID NO: 551 - DNA, 201 bp, Bos taurus
attctgacccttggtcaggtatattttgggtttctcttggcagggtcaagggaggcagagtggaggaagctgatatctaattgcttacaaaagtaggcctgagacataaaagtagcagaaaccacaggcaccatgaagtgaaaagcttttattttcaggttggtcaaggtgaaaagaaagtgttgattttggatttctgtc

SEQ ID NO: 552 - DNA, 201 bp, Bos taurus
aatcttggtagatcattctactcttggggctgaaaactgaatttagaagctacagttctgtgtagttgtgtgtgtcatttaataagacttctgtttgggtttattaggtcaatgtttagcaaaggaaggtgaatgatgtttccacttgcccattaagtgaattagtttattgaaaaaagtagcaagcacatagtgggtaag

SEQ ID NO: 553 - DNA, 201 bp, Bos taurus
cattgaaagttctcttgcattttccaaatatccttcacctatatctgtatcttaacctaaatatctactgtgtttatatctaatacatgtttcgaaaagattgaaaataacaacggttaccctatgactgtgatttttcaattagaataaaaattcttacttgatagatgagaattctaatttttccaaaacaggaaaaat

SEQ ID NO: 554 - DNA, 201 bp, Bos taurus
attgtaaatgtactttctcactcagtgctaccaaaaagagcaaaatgaaccctataattaaggctacttcttttagattttaagtatatgaagattgaaagaaatcctgcaagctcacataaaacttcttcatttccatgttcttatttgaatcttgtaactaaagcccagaggagacaattctcttcttttaacaagtta

SEQ ID NO: 555 - DNA, 201 bp, Bos taurus
ttatagtatttgactgagaaaggccctccagaggaaaagagatcagacttgctctgtgtcaactcagaaagcaataggcttaagaaggcagaatccaatatgagagatatattttcagcgtatgattcaccgaacaaacaaacaggctccagggagtcatgaaacacttatcaccttggctgtatgagcattaatacagga

SEQ ID NO: 556 - DNA, 201 bp, Bos taurus
tctctcacagagaagacagaatctataaaagaagcagacaactaataagggcattacaaagctgcattggccaagtgcacacctgttcctacagctttgcgctggacacacccgaatttcttctccaacaacaaggacaagcagaggggaaagaccgtgagggtgcactcaaagcaatcctctccaccctcagcagaaagc

SEQ ID NO: 557 - DNA, 201 bp, Bos taurus
aactgtgggattctgtcatccgaataccttctacactagtaattctaacaaagtcagcaactccccaaagagtcttcaaaaatagattgtctgtgtagacaagaaagctagacgtccaaggagagaaggaaaaataccttctttaagtaaaagaaatcatatagccaaagagaattcaagtataacgcgatttcacattaa

SEQ ID NO: 558 - DNA, 201 bp, Bos taurus
gacatgactgagcatatatgcacaacacatttttaaggcctacataatgtaacgctgtataaatgaatacgtcatgtttttcaaaaagccaatttcttttcgttggctatttgattttttcaaattactttggttgtgaaaaacatggtaagcatttttgtaaatgaatctgtgcacataacaattattacttccttacag

SEQ ID NO: 559 - DNA, 201 bp, Bos taurus
caaaagatggcaagggtaactcatgatccatacctcatggaggtgcctgtggattagtcacacccaggctacaataagcattcagctccctagagttgggcgcaaccattaagtatttataaaaaacacctgagtattacaaaaggcgctgctttccaattctcaggtggaaggaccctccttccatgcagtggggagaat

SEQ ID NO: 560 - DNA, 201 bp, Bos taurus
acaactgcccatcagatttccactcctacccattccccctcacaaactctgctgtagctacagtggcctccttgctgttcctgggacacccaagcaacctctcaccataagatcctttctggtgatgtctcctttgagagcactcttccccacatagtaacagggtacactccttccttcagacctcaactcagaactcac

SEQ ID NO: 561 - DNA, 201 bp, Bos taurus
cacacaggagagaaaccttaccatgtgcgtgagccccttgtggccactggctggcctgggaggggcggggaggtggggttggggccacagggctgttcgcgtcaatctcaggcatgcagtgggaggaccactgaactcgcatggtcctaagaccagatttcactctgattttcaaagacagccagcttgaggttggcctga

SEQ ID NO: 562 - DNA, 201 bp, Bos taurus
gtggcctgctgtccatagggtcgcatagagttggacacgactgaaatgacttagcatccatgcatgctagggtaatcagtaaggaattaatgtctcctgagtctgagaggccctttgcctcagttgcttgggtaaatttgagagtcctgagaggtttcattgctgcttatttttctatttgagaacccacatgactgagtt

SEQ ID NO: 563 - DNA, 201 bp, Bos taurus
tggggaaagtgaaccaggccaggaagaattactgcctgcaaacacagctgagcttgtggctatctgggagcctgccaataaggaacctcctccaggaaactggagcaaagtgcccccagggccagagaacaatgaaactgcttacctgcctgcctcatttacatgaaggaggcccctactctccatctctctctggccagc

SEQ ID NO: 564 - DNA, 201 bp, Bos taurus
gttttcaataaactttactttgaatgaataactgccttttcagcccaagagccaactccaacccagaaattgtcttggtgaatgggaggaataatccattcatcactgagtaagacagaataatattactcacacaccatatcttccaccttcctgatcctacccatcctcaagggacagctcaaagcccatctgctccag

SEQ ID NO: 565 - DNA, 201 bp, Bos taurus
cacttagaacaatacatggcatcataagcacgggtaagtgatggctattatcaacctatgagtgcatcataaattattcagccattttactgcagttggacattaggtcattttcaattttcccactattataaatagttctgcaacaaaccatttacagcatgcatgacaggaagaaaagtggattgaaagtccattgtg

SEQ ID NO: 566 - DNA, 201 bp, Bos taurus
gatgcactatgtttattagggaccaacacctatataaggaagaggggagaagcaggatcaggcgcagggagcagatgaactgtgactcaggcctaatgggaagctctggactcaggacatctgttggtgtctcaggtcgcacacagaggtccggagctttgtaccaccgctttactccatccctggacataggcttccctg

SEQ ID NO: 567 - DNA, 201 bp, Bos taurus
ctggggaaagattttgcatgctaattttgaggactgaggtgagggaacatttctggggtggtgtgaggcagagccagattaagattattaaaggccttgggttccaaatgattttgaagctccaacctgtatgtgattcaaattcaatatatcagaaaataaatactaactaggagagattgggcttctcaggtggtacaa

SEQ ID NO: 568 - DNA, 201 bp, Bos taurus
gatcactagagaaatgcaatcaaaagcacaaggagatggcacttcacagccattagaatagccatgatttaaaaaaacagcaacagcacagaaaagaacacgtgctggcaaggcttgggagaaactgaaacccttgtacattgccacttacggtgactcttcaaaaagtaaactcagtgagaattccctggcagtcctaaa

SEQ ID NO: 569 - DNA, 201 bp, Bos taurus
ccagaaacaatgtgagtgaacgaaatactattcaggtatacatacacatataatagaacaaataaacaaggagtggcaacagagacgaaactcaggatacgacgtagtcaccttggaagggaggtgggggatgggatagggaagtagcatgtaggtagatacaagtcatggtttattgttttattaagttctggggctgag

SEQ ID NO: 570 - DNA, 201 bp, Bos taurus
tgatccagagctgtgatttgacgtgtaagtaggagtgcctattttaattagccctcttgattttattggatgttaaaattagtgttgttctttggacagccgtgtctgtattgtagtggaaagtactcggactcaggaattagtacagaccatgccacttactgtgtgacactgaaggtgtcatctgatctatcgcttggc

SEQ ID NO: 571 - DNA, 201 bp, Bos taurus
tcacatggtacaggcttcaggcctcacaaaaatctaaatctccctcttcccccagatctcaaaacagataggttttaaaagcatgcccaatcccctggagcggcctttccctgacctgggtaccctggtcccgactttgccccactgcatttaggcacttctcctgcaggaagtgagcgagggtcatgtcttgcccattgc

SEQ ID NO: 572 - DNA, 201 bp, Bos taurus
ttactgtgtctatctctccagggctccacactcaggcagctgtcagctcatctctgataaagtgctaccctgcccagagttgtttgccttttacaagaaactcttagagcagaataatctccatataccccaaattagtcactaatggcagaatacttggtcagggagctgtttggggtttctcagaactgtctacggtga

SEQ ID NO: 573 - DNA, 201 bp, Bos taurus
gaattcttttaaattagacccaatttaggagtcttgatgttttgatttcagtggttcctccctccagtgcaagtatatcaggtacacttagtaaaccagagtcttttctctccactgccctttcacatcagcatcagcatgtgagcatcattgtgagctgagctgtcctgtctctgaactgcatggtgcttagtgtacact

SEQ ID NO: 574 - DNA, 201 bp, Bos taurus
gtctccacataaaggcaccagtctgcttaggtcctaaggcaatgatcaaggctgtgctcctcgtggggccactgtcatcatgcctggctgtctgtgcaccggctcttgggtcatgattgatggagaatcttccctggcacatttatcaaagggaggccgttcctccattgacagtcacggtcccaagggcagaagctccta

SEQ ID NO: 575 - DNA, 201 bp, Bos taurus
ggttttgaggtggaagaagaaaaaagcatattctggccccaggaggagaccagcatttgaaaaagcacgtgggtttctctagagaccattagcagaggagtcaagcacaggaataggtctggccactatggccagcccaaaccagaggggcccagaaataagtaggtttcagtccagcacgttggactccatgtacctgac

SEQ ID NO: 576 - DNA, 201 bp, Bos taurus
ttgttgttctgtgtcttcacaacacacccctgtgccgtgagtagtattgacccaattctacagaaggggaattcaaggtacagaaagatttagtgcctcctcgaaagccgcatggcatggcgtgatgtggcagcacttccatgtttggcaatttcttatcaaagtaaacatgcctctactctgtgatccagcaatttcaat

SEQ ID NO: 577 - DNA, 201 bp, Bos taurus
cttttgtaagtaaagatttgataggcagaaaaacttattaataagctgtcagatataatgctcaggcctaactgaaacatctagttgggttttatatatagataatagttaatttggggctttgttcatgatttatataacaactcatatcttttgaaggcaaaagagcgtgccaatggaatggagcttgatggacgtagg

SEQ ID NO: 578 - DNA, 201 bp, Bos taurus
atctatgaatgagaatctttgaccaaacctgtgttctgttgcctagacgtgcaaaggcagagaccacctgtaccatctcctgtcccattcaaaagggtgcattttgctgttgcatcaggattttacaaagtgtgctcaatgcctaaggcaaactgcttgcattctctatgggaaggaaaattattgttcttggtcaagtga

SEQ ID NO: 579 - DNA, 201 bp, Bos taurus
cctcttttggagcatgtgtagcagctcagggtttggaatctgcctgatccaaatgggacaagttcctgagtaataacaggccatgaaacagcaactccatggctgacgttatgccctcgtaggactgtcatctccctgagcctctttgcccttctctgaaagtctgacccagagatagtaaatttgactatcatggtggga

SEQ ID NO: 580 - DNA, 201 bp, Bos taurus
catgagtctcttttactacaactttgccagcaatgactgttgccaattattttttggtgctaaaatagtgttttataagtgtgcattattttaattgccagtgagaatgttttttccacatttaatacatcttctttgtatgaattatcaaatttaccccttgcccatttatttacttgggtttgcagttctcataaactt

SEQ ID NO: 581 - DNA, 201 bp, Bos taurus
atcctcatctagttagtaaaaaggaaaaaaaaaacaacaaaacttttgacgatattatttgtatatatctactcttaagatttttctcccacataggccactacagcataatgaatagagttcccaaacagtaaactctcaaatgcaaagtcaagaggtcttttggcttctaaggtacaatttcattttcatgtgtaaagg

SEQ ID NO: 582 - DNA, 201 bp, Bos taurus
agtatgtcttcaatacaaacatactgtgctccttgtagcactgactctgttcacttgtgattttttaaggagattgataaatagtatggtaaagaactgaatgtacctttttatattccttcagcaacaccaatatttgtttctacttatgtacttacctgtttcttctttcctgttttccttcaagccaagaataattaa

SEQ ID NO: 583 - DNA, 201 bp, Bos taurus
ctctggacatggcctggagcagtcccacttgctgctccacaggtgcgtgtcctttaacatccaggtacaagccccctgtgaagtctggaatcctatatcgcggcatggcgaaggccctgcatcctcacaactttactcaactggtgtaacctgccaggctgctcctctcagtgggattttccaggcaagaatactggagtg

SEQ ID NO: 584 - DNA, 201 bp, Bos taurus
ggggagcagctctcaacagctgtgagataaatggagcttctggagggtacggagtgctggaagacatgggatactaacttctaaggtgaaaaggccttgataaacacctgggtgtccactgagaccaaaagaaaaaagccatgtattaggatcagggatattctagatctggccaaacaaaggttaaaagcaagcctcaaa

SEQ ID NO: 585 - DNA, 201 bp, Bos taurus
ggctaacagaagctaaaagaactttgagaaagggaaacagaacattatcattatttggctgtttgaaaagagaagtagaaaaattaagagggctgattacgagaacagcaacagagaccaggagagtgatactgaaggaatgaacgaggggattggagggggccaagaggaggactcacatataagagataaccaagaggt

SEQ ID NO: 586 - DNA, 201 bp, Bos taurus
cactcctgctccgagaaaggggagggagcggggagaatgaacggcagggggccttgccaaggcccgaggcgacggcaaggcccgagtcctgtctgcccttcgcctcccatttccagccgtgacacttggatggagggaaaccgtgtaccctcccaggggaccctcagacctgacccctactccatatgcattgaggagcgg

SEQ ID NO: 587 - DNA, 201 bp, Bos taurus
gatgctcggtgggtgcggggcagcaccttctgcccaccatccagaaaaggaagaagtagtgtgacctctgaagtttccagcttcggaaacacaagggaagaaggagacatgtagaggataagaccaaacgttgcgggtgtgtctgtgggacctcctaggggtaggacgccctccccccagctcttggcaggtgtgaaggcc

SEQ ID NO: 588 - DNA, 201 bp, Bos taurus
ttggcatcttcaatccatctctcccttccaccccaaccttgtatttaagctccagcgggtcctaccataaaacacccacttctccctcctgcccagccccctctcccatcttcttttaccaccgacactcctccttctgacctgctgccatcaatccggggacccttgtttagtttccttccccgaggcctgtcactttga

SEQ ID NO: 589 - DNA, 201 bp, Bos taurus
gcccaaggtcacagaatcaggtctggtgacttgagggtctgtaacgtcacccaaacccagtgttccagaacttagtacagttgtgaaggccatcgagggaggtcagttagaacactttagagatgtcaaggactataggaatgtaacattcaagaaacagaggcccagaaaggtaaactgtcttgctcaaagtcacagcaa

SEQ ID NO: 590 - DNA, 201 bp, Bos taurus
gtggctggcacagcagagcatgaagctggagtgggcagccacagccttggcccttgctgtgatagtgctggaaacggtggccctcattgagaacaggaacgccctggagttccgagtgcacaccatgctgatgctgccttccttcctgctggccctggtgctcaccatcaaggtctgggcccctgaccagcccccattctg

SEQ ID NO: 591 - DNA, 201 bp, Bos taurus
ttcatgggcccacaggagccacacagatggattgaagagatacttcagtatttctttattgtccagtgagagcactgaagactctctgtaatatacaggagccatctcttcacattgtttatggccaaggttgtcattcttagctaacttcataaatctcacagggaggaaagggtagcaaggctaccgtttactcagagt

SEQ ID NO: 592 - DNA, 201 bp, Bos taurus
tttgttccttttccattctatggttatcaccagttcttttttgagtgaggcattatgcatggatgagtaaaatagattccatgatcaaaaccatttgaaatacactgttctaaattctttgaggagattgttaatgctcaccctcacaatccttaaacattgtacaatagtagcaaagtaaccaacatgggactctccctc

SEQ ID NO: 593 - DNA, 201 bp, Bos taurus
ggtgcgggccacagtggaggtcctctgcgcagtcctgctccctggcctgtcccgtgcaagtgctgcctggaggtgtcgccccatccctggtgaaacccactgagaaacctctgcaagccctgggagactgagcagttttaatcctcttccatgagttaaaaaaggggagcaaaacatgcgtgccttcttcctgaaataagg

SEQ ID NO: 594 - DNA, 201 bp, Bos taurus
tcaatgtcatatttgcttcataaatggcattttgaagttctctttcagtttttaggctcagaaactattcttgtgggattaggactttatagccattgacgatttgaattcccctgtgaaattcccctgtgaatttgggccttgataactgtctctgtttcctctatggacttgagtttgtttaaactttatatttttaat

SEQ ID NO: 595 - DNA, 201 bp, Bos taurus
cacccatctgtgcctctgaggcagcagggacaagcccagtacctccatctctttcttctctgtgaagccgaggcaggtgggggcagtatcacttcccagcgtcgtggccagcctgtaacatctgttactctgacttcaattgcagcggatgaatgcatcagtgacagaaacaggagagaaatccctgtggccgtgggcctg

SEQ ID NO: 596 - DNA, 201 bp, Bos taurus
aaatcagtccacctacttatgaataaataattgtctagctcttttatgacattctgtccaatgttacaaaaaaaatttatttccagtagcaggaaataactgcccagtagtagtgaagagctagttctctgtctcttgttctaaagaaacaattgagtttctgagaacatttcctaattgaaataattgtctcagctattg

SEQ ID NO: 597 - DNA, 201 bp, Bos taurus
accacccacctcttacacacacacacacacacacacacacacatatattccatggcagttttattaagtttgtcttcattattgataaatattttcttctgcctttctacaatgttcagttagaagatcgaccacaagccaaatattaaaaaaaaaaaaaacaacagctatgaacataaaagttttctgagaaagaaagaa

SEQ ID NO: 598 - DNA, 201 bp, Bos taurus
aaaaagaactaaacaaaactattaaacaatttggggagaaaattcttatctagaggatacatttaaaaacaattatttatgaattttataatttgttaagcatttaacacctgtgatatccctaatagaaaaagagaaactaccaacaaggatctactgtataacatatggaattttgcacagtgttatgtggcagcctgg

SEQ ID NO: 599 - DNA, 201 bp, Bos taurus
tgccttcagggagcttgggcctcaaagccctaagacacaaagcaaaagacacaagctgtgagcacaattcctggtgtccagatggtcactgttaatgatagaggctccagagacccaaaggccacagactgaagagttccactccaggccgttccttcatctcttccaattccagggcccttcgctgctttgtctccatcc

SEQ ID NO: 600 - DNA, 201 bp, Bos taurus
aggacaccatgaatgaagtaagagttctacaatgcactgggagagtaccagatgtctgtttttatgtcaagtgctggaggagaggattccaggaagagagttttgtggaaggagaggccagaataagactgtcctggggccagagcagtaggtaggtgtgaagagagccctggtgcttcctcttcccttcctccatgctac

SEQ ID NO: 601 - DNA, 201 bp, Bos taurus
cttatataattttcctattaaaaatttctagcctggacttactcataaagaaataggcagacccaactgagagatattctggaaaacaactggcagatattttccaaaagcatctatggcacgaaagaaaaagaaagatcaaggaactactacaaattaaaggagacaacagaagcataacaactaaagggcaatgcataa

SEQ ID NO: 602 - DNA, 201 bp, Bos taurus
ctggaagtattcttttctgtgtgttgtattaccgttttgacaggaaaaccctagaaaaggatgctttgctggcacactaccctcttaaggaaaagcccacgggcctagccctggcctttgtgagcaagggagtcctttaaaatgcacataaaattccaaatttatggacatttctaagtgctccatattgctatggatgga

SEQ ID NO: 603 - DNA, 201 bp, Bos taurus
gtatatatatatatatgtttttacattcttcagataaatatacatatatatgcaaacataaacatttctgttatgtttggccatattaatatattattaagtaatgatcttttgtaagtttgtccacgttgcatcgtctctgtatctttcaagttaacctaccttactgttccaacagatgttttacctatttgcttatgg

SEQ ID NO: 604 - DNA, 201 bp, Bos taurus
gggggcaggtctacgcactaggagcaattaggtccctgtcccaagctccagctggatgtgctcccttgctctcactcaggttagggcctgcagaaggcctggttttatagggaagcctttacagaaggagggagttggttttctgagggctttctgcagaccactagaaaatggcctggctgcagactgttcacactgctt

SEQ ID NO: 605 - DNA, 201 bp, Bos taurus
tttttccagtacaggcaagattctcttagaaaggaaagtgtacagttgtttatttccactgatattagaataataggaagtggctttcacactgcagcacagaagatttaaattaggatgattgaaaaaaaaacttataagtaatgtgaactgtaaaacattgcaaatgattactaattaatactatgcaacatttgtaga

SEQ ID NO: 606 - DNA, 201 bp, Bos taurus
ccctcccaccctatactttaaccatgtgagagtatttatgcatccccacttatctttttaggcctgactcaaatgaagcctcttaggtaatgcttttaattatttctcttgggtagatttcatcatctttttgctcccatggtacattgtccacaccacagttattacgttgcatattctagttattttgtatctccatga

SEQ ID NO: 607 - DNA, 201 bp, Bos taurus
gcagttttggtatcgcgaaattgagcgagattacggaagccgggaggattggggcaacattttccggagtttagggccggttgtggcgctgaggtagtgaagtgtgtaacaagttttcgttttaaaatttctgtggtgttattacattgaaatggcccaagctctgatctgtggtaaataataattcatccttgtgtttag

SEQ ID NO: 608 - DNA, 201 bp, Bos taurus
tttcaattcatttaacaaacatttactaagtgtatacagtgttctagaatgtaccatgtgctgggacacaacggtaaacaaaacagtttttgtcctaaatgctcattgtgtaggatttacataacagcctcagaaagtccagatactttcagcaattgaaggagaaaattatttctgaaaatatacatgtctctatagtat

SEQ ID NO: 609 - DNA, 201 bp, Bos taurus
ggaactcaaaagtaacaaaataccccactgaaacctcaaagttaaaaacaccaccaaaaattaaactgctacttttggacatatcatttatataagagacaagggaaagaaagccagcttttgctcctttatatatgtcttcagacatcactttaaaaataaaaaagggattttaaaaacagagaaaagaaaatccatata

SEQ ID NO: 610 - DNA, 201 bp, Bos taurus
tttttttcctatcggccaactcatgtctttaacaactttgaacagaacattacaagaagaaaaatataagactggttaagctaaggtttgggaaggctacgaatgcctgctaacagtgctacctctatttcctgtcatcccagagaaggaggagtcacatgggcacagtaaaacctccttgtgatgaaccccactacgaca

SEQ ID NO: 611 - DNA, 201 bp, Bos taurus
acgtactatgctgccttgggttgctttgcagcaactcttgggcttcccacttatataggtcagtgccaacaccatgttatgggactgttacacagcccaaggaactgaacagagtcaaagctttatgctcttcaattgcttcactagaacaattgaaaccattttggaatcagaagaatttcatccatgtgataataatga

SEQ ID NO: 612 - DNA, 201 bp, Bos taurus
gaatgaaatgagcgaggaaaaatctggaggcaaggctaatgccataattcagggaaaaaatgctgaatccctgaaccaagggcagtggcagaaaagatgtgggaagaaaactggcttgacagacttgaaggagacagaactgataggactggcaaatggatggtgactcaaggacactctcagacttcaggctttgacagc

SEQ ID NO: 613 - DNA, 201 bp, Bos taurus
tgaaagagacagacttcaagaacaaaattctgcttgtcagtgggaagagacagttagggactttggaatggacatgtacacactgttatactttaaatggataaccaacaaggatccactgtatatggaactctattcaatgctgtggtcagcctggataggagaagggtttgggggagaatggatacatgtatatgttgg

SEQ ID NO: 614 - DNA, 201 bp, Bos taurus
gtgactccacccagtcctgtatttctctaaagcccaggcccattgtgtggtactgcactgctcccccacagtggaaaagaggctattatacgagcttagcggattcctatccgtgtcctgagacgtcttagttagaaagattaaacaaacaaatgaagaaaaccccttgagctgcccattggtcagattttcattctaaac

SEQ ID NO: 615 - DNA, 201 bp, Bos taurus
attgactccaaagagtcaacctgagcaggaggtagcgtgggggctttcagttgcagcgagtgaggacgctctaatatgccagctcctatagtctgtaggtccaccctttatatcatctctcttttcatcctaaagcattgtctttgagaaatccaggttaaagtaacatggactttgggcttggtcatgtattcttatcag

SEQ ID NO: 616 - DNA, 201 bp, Bos taurus
gcctctgtctcctatgtaccaatacaaagcaaacaacttcctagtctccttctcctccagccgttagtagaacctggctgcttgatgacagcacacagatccactcccctggagtggccccaaagcgctgagcacactcccagtgggcctccagagttaaccacattaaccactacagtcagacagcattaaacccacgta

SEQ ID NO: 617 - DNA, 201 bp, Bos taurus
acagtttgattaagtcaggtatgagactgaaacaagatagagttaagtctaatttttctctattctacacaaactgttaatgttgctacaccttgctaagtgtgtagggattccaggtggttttcctgtcattaagcagtcatggctcactagcatgcttcctcttctaaggtggaattagaaacatatactaatatcttt

SEQ ID NO: 618 - DNA, 201 bp, Bos taurus
ctatcattttaatatttattttttgattcagtgtgagatccagataatttttctatagctattcaattgacccaatgttatttattgataacaaaagcacacaaattgtaacctctactatttgagtcacctttgtaataaatcaagttttcacatatgtgtggacatttttactcttctcataacagaggctaggaattc

SEQ ID NO: 619 - DNA, 201 bp, Bos taurus
ctccttataaggaggccaattctttttatatcagaacacgtttatggtgctttgcaattgatacaactcttctgcccacttcatctcacttactttatcaaagcaatgctttatggtgtggccataggtactgtattcactagggatatgtcccaagatttgtgggaatctcatacttgagaatctcgaataacatcacat

SEQ ID NO: 620 - DNA, 201 bp, Bos taurus
tttttaggtggtcacaactgaatcatatatgagttctgttcaaggaatacatacagtgataatacatcagtctcagtagataagtgcaggtggaaacttgcgagggccatgaaaggggcagaactaagacgccatggaaagaaattatttgcagcagtggtccaagaaaacttcaggaaggggttgaatttaagttaatat

SEQ ID NO: 621 - DNA, 201 bp, Bos taurus
acgtacaatagaaatgtgagagatcttaacttagccatacgcacaaagaaactgggagggcaccaagattcatggctaaggacatgggatggccacatgggagaataaactcatggtaattatttatcactctatttcttttaaatgaaaatagcattctaaactatatgactttggaagaaaaataaatttttgattaat

SEQ ID NO: 622 - DNA, 201 bp, Bos taurus
agtgagaggggggatttggaacaacggccggccctagtgctacaacaacagccccatccccggagctcgatgtgtcaaggacaccatgctccccccactcgctacagagggcccatttaaccagctgcaatagcaaaagcagggcttcagaggctcagttgtaaagaatccacctgacaatgcagaagaggcagattcaat

SEQ ID NO: 623 - DNA, 201 bp, Bos taurus
attccactgaagataaacgttcaagtcaaagatggaaccattcctgggaaccatatagccatatatatatttagcatttttcacacaaagtataacttctgaacattctaagtaatacatggtctacaatccttagtgctctccagcaaactgccaatcaaacgccttggcaacagccaacagaatggtctttcctgtccc

SEQ ID NO: 624 - DNA, 201 bp, Bos taurus
gcattcctgtttccttgggcaaaaactcctctaaagtgctctttaaattgatgtcactcattacccaagactgtggggggcctccgctcttatcactggacaccaggtacgatacagcagcccccacacatacacggaacttcttgctggtccctgacacagggccgccttccacaggctgtagctttgcaaatgctgatc

SEQ ID NO: 625 - DNA, 201 bp, Bos taurus
caatagggattaaagtgaaaaggagggaaacatggaaatcatctttcccataccctgaatctcactgaagcagagaagtgagacatatgacaaggtctcagttgcttcatctgtgaaatagagggtgtttgcacacagagatgccgagtcccaccaacagaatgacagtcaccagcagtgtgctcctgtactgtcccaagc

SEQ ID NO: 626 - DNA, 201 bp, Bos taurus
tgaagataagttaattcacttgttcaaggccacagaaggatcaaatgatgcactagtattcagacctttgtttgagccctagtccgttttatgtgtagatgactttagctgggcctaagttttgtcagttgtatctgtaggtatcctttgaaaaactactgtttttaatgaagtttataattctataattggggttgctac

SEQ ID NO: 627 - DNA, 201 bp, Bos taurus
tgtgtttgggtaatacagtatttcagagcaaagtgtggttgtttaataagtggccatagttctaattttttacctttgaaacaaaaattttacttccaggatccttaatttcacatatggtttgcattagactaacatttgtcttcgttcttcatgaaattgattttgtgaatgagtgaatcacatgtcagtgatgttatt

SEQ ID NO: 628 - DNA, 201 bp, Bos taurus
tggaaccccagcccctggcccaccggggaagtcccaggagttgcctttcaagtgaggaagagtgatggctaagctcagaagccaggaaataaggtgggcttaagaaataatggccaatatagaactctgggtgttactgatacatcaatcaaaccagaataaaaaagatcagaaatctgtcttttattgaagcaaacttta

SEQ ID NO: 629 - DNA, 201 bp, Bos taurus
actagaagcaaggagaacctacagcaataatccaggtgagaaaggagcctcacttggcagtggcagtgagagagagaagactcgggtcaaattctgtgtgggtctggaaggtagagaaagactggatacaggagtgagtgtgtgagaaagggaggagtcaggggtgactccaaagattttggcttgagcaaccaaagagat

SEQ ID NO: 630 - DNA, 201 bp, Bos taurus
atattggtgttctaaaataatagcatgccatttagtattcacgctgacggaatttgttgttaaggatcacacacagggatgtcaagataaggcagaattcagaacagtgcctgtcctgtgctggtcaggagccctgttacaggtatcaccttcttgcattcccacaggctgaactctgagaaccacaggacagccaggctc

SEQ ID NO: 631 - DNA, 201 bp, Bos taurus
tagtcagggggcaagtgaaaaggagagtcaaataatggtcgctcaagtgtttgccgtttcgatctctgatatgtgttcaaaatctcaaaggaaatctgagtaaatttcctgttcatcggaaagcaattattctaagggcagagacaaatgcttggttagtatgtggaggtgccctaagcacgaacggtgttctaagtgcct

SEQ ID NO: 632 - DNA, 201 bp, Bos taurus
aaggggtcagagtgaattcaagtaggccagttagaaggctattaatatagaattaaatattttgcttccattttaactagagaccattggatctttaaatcaagtaattacttcccaaactgaacttgtgttgcaaacctctgcccttgtcatctcccaaatatttgtccttctttattgactgggtatagcaacagctcc

SEQ ID NO: 633 - DNA, 201 bp, Bos taurus
aggctttagcatagtcagtgaagcagaagtagatgtttctatggaactctgttggttgtgtccctagccacagcctatttggttagagcttagcattttttatcatatatgaacaagaatacttgaatcgtgtttgtttgtatatttttttagtgacccgagagatggtcaaatactggaaacccagtagttgaaccttgg

SEQ ID NO: 634 - DNA, 201 bp, Bos taurus
tttttataaaagatacacacattatgaaactcaattggcaggcttataggtaatatttatgctcactgcagtgtaaaccaagcaacttgtttagggtaaagttaaattatactttattttagttaatttatcatatgtatgtgaggacatatgtatgtgaagctatgtaggacaaaaataagtaccagaattttatggata

SEQ ID NO: 635 - DNA, 201 bp, Bos taurus
aaactaaacatttgctctaaattacattgttgttacatttctaaagtgcctctttgaaagattatctgtgcctatttaaaatttgtctcaatcttattttctgtgcttaacacttataaacagtgaaaaatttctatgagcagttttttaaaaagagacactaaaaactttaaggacatttttgttttaactaagttactt

SEQ ID NO: 636 - DNA, 201 bp, Bos taurus
gtataatatccataaagtatattatgtgtactttagtgtttgggaaaagaagcaaaaataaatgtgatttacagattagactatctagtatatgtctgacctaaccgtgtccattcagcttgtgaacaaattgattcacatgttcaagttttccccacaataaaatgggaataattttaatagtgattttgtaagaaagag

SEQ ID NO: 637 - DNA, 201 bp, Bos taurus
gctcctgggcaggatagaatccgtcagtgagaccagtgggccacctccttaaaagaatatctcaagttcatcatttagccctggccaacatacttttccaatttgacctccccttccttatttttctcctttatatccattacagtctagtgaaactacccatttttgtggcccacaaacccatcctgtgtatccacatct

SEQ ID NO: 638 - DNA, 201 bp, Bos taurus
agagaggagacataaacagaagacagagaaagcaggtgaatgattagcagatgatttaatggggaaagaaatcacaataaattatgtgtaaagagggtacaagccaagagagtcgattcaccaaggagaaacccaaatgcaggacatgaaggacccaggatggcacaggttaagagtgagcctgagttggaaaatgggaat

SEQ ID NO: 639 - DNA, 201 bp, Bos taurus
ctgataatgagattccaggtagcaagactcctgcatgagtttgtaaatctggagcattcttcagtctcaaagtagagaagattaagaaatacaagacaaagatgccatgagagcacagactaagtgatgcatcaagactggagttttattagaagaaatagacataatattaacttgggagaaatgcaaacatattgatga

SEQ ID NO: 640 - DNA, 201 bp, Bos taurus
atacttgcaggaaaaagaaaatgactaatcacctactaaaaatggcaacagatgccataagcaaaatttcattcaacctgttaactttggttccactgtaagaatcatttaattaaaagtcttagtttttaaatatgattttttaaaaatagcatctgcttctagaatatgaggaaatgaattttatgctcaatattttga

SEQ ID NO: 641 - DNA, 201 bp, Bos taurus
ttgtactttaatatgccctaccgatggttgaggcagcaaacgtttcagtgctgctccagaaaaatttagcacaagctaaagttcatcatcagattgtttccttatattagaaaaataccataaaaatgttgaattttggcttacctttttaacaagatatggacatttaaggataaaataaagcatttattttaaaacaac

SEQ ID NO: 642 - DNA, 201 bp, Bos taurus
cacatgctaaatattgttctgatgaaagatccatttattatactggacatgctttcataaacatcctactttcttttttcacatgaaatcaaaggttacatggtaataattatgcatcagaatagatgctttcaaaataggcctctttctacttatttgtcaagtggtaaatttttcttttattatgtgtatttaatatgg

SEQ ID NO: 643 - DNA, 201 bp, Bos taurus
aaccttgagtattaaaccttctctagcattttcttgatcttcactaaccatatcaaggtagcatagtcttatctgcaaattactaaaaataatcagctctaagaagtgaccttggatgaagcagtattaaattggcgaggaaatttttttgaggcatcactgttattaactcacaattttttcatttcactctgccactga

SEQ ID NO: 644 - DNA, 201 bp, Bos taurus
gccctcgcccccgagcggtggccccggcgcctccgccgcgagcgtcagccgcttggcaaggagcgagctgggctgagtcataataaaagacacgtttgcccagcgaggtgggaagggggcctcgagtagcggtgttaaatggcgacaggctcaaagagaaagctttttttttgtttctttttaatgggctgaactggaaaa

SEQ ID NO: 645 - DNA, 201 bp, Bos taurus
tgcagatgtagaaaatggacttgtggacacagtgggggagagagagagtgggatgaagggagaaagtagcctcagcgtatttacaccatcaggcatgagacgcatagctggtgagaagttgctgtagagcacatggagcccagtgtggcactctctgatgacctagagggatgggaaggggcatggcttgggaggcttggg

SEQ ID NO: 646 - DNA, 201 bp, Bos taurus
tattgtgcaggagctgatcacaaaccctataactagcctccctacttggcctttaaaagtgctttcctgaaacccattgaggaatttgggttttttgagcataagctgccctggactccttttctggcagcttatactgaatggtgtactttccttcacaatctggtgtcagtagattggcctttctgtgagtaggcaaga

SEQ ID NO: 647 - DNA, 201 bp, Bos taurus
gctaagtatatggcttcatgtacatggaagtattgaggtgataaccaaacaagatgggccatgttgctttcctatttctccctgtttctcttatatactgtgtaaaaactattcatttttactttactagtcccttataatctattcattcttcagggcttctgcaaactgaccttctcgttcactactttccaatatggt

SEQ ID NO: 648 - DNA, 201 bp, Bos taurus
acaatctacctcttttaattgctactttcttttgaatgaacttcctcttggctcaatgatctaaataaagttttagtagaagaacattaggatgtgtataaaaaaggaagaatgggcagtcatatcaagaaagtatggagaatacatgtatacatcttatatcaaagtgtattttgcctcactggaaaacctcctaattga

SEQ ID NO: 649 - DNA, 201 bp, Bos taurus
gccttttgtgtagcttaaaatctttacagatatgtgtgcttttcatctaaccagattttgcacatctattatagcacaccctcaatcaaaagatgtttctgcattgcctaccaagtaaaggctaaatcaatataaaattatattcctcaaaaaatgcttttaattcttgtgggaagaagattacatacatagataaagata

SEQ ID NO: 650 - DNA, 201 bp, Bos taurus
ttaatcatcttttgcctcctctttggttaaaaaaaaaaaagaaaatagtatttttttcagaggctttctctgccttgatgaggttaataatttatttgaacacactataatggcataaatagctttttttgtaccttcattttgataaaaagaaagaaaaggagggcatattcgtttccatgatcaattttgctgaaaatt

SEQ ID NO: 651 - DNA, 201 bp, Bos taurus
tattggcatgtggggttcacatggaggggaagttatatggaggagaagtgcccactgaaaacactttcagattcccaggattacctgggtagtttattggtgcagagatgtctgtgagagaattcacagtgaaaagtgaagatttcacatcccaagaagcatgttcagagtaccagtttcctggaacttcagcatgttcaa

SEQ ID NO: 652 - DNA, 201 bp, Bos taurus
ataaaataatatgaaacaaaatgtctacatttacaaaaacaagtcaacaatcacctagaaaattcagtaaaacagtctattgctagtttgtttaaaggcattattgcatggtggaaatactgagtatgactatattctcaatagcaatcacaggattcaaatatattatctcttattaggggataataatgactataagaa

SEQ ID NO: 653 - DNA, 201 bp, Bos taurus
gggagtaacatagaaagggattaggaacattctgaccacggcaaagaacatcttcaatgatttactcaaatagccagaattcagttactatttcctgtttaagaggttaatcattttcccttagtgcattaatcatctttcttcagtgtttagtcatggacctacaaggatgacaaacactttctaaactattgtaaattg

SEQ ID NO: 654 - DNA, 201 bp, Bos taurus
tctaatggtctctgatgcaacacagcagatgttcacagtgtaccaggtacaaagaagcacagttgctttgatgccattattaccatttggtgactctgtgatcagcaaatggtttgtcaatttaaagtctggtatcccccactcatatggaagtgtagtgcccacattatgttttaagaatttaacgacttctggaataaa

SEQ ID NO: 655 - DNA, 201 bp, Bos taurus
tggatttaaaacatagttttagaacttattgtcaaataagttagtaccctctcttcaggcaagttccttacctgaaaattaggagtaaaatatttaataagatatcatcaataaaagacaatatcgagtgcaatactatatgaacttagcacaatgccaaacacacagtcaacactcaatatctgctggctattataatta

SEQ ID NO: 656 - DNA, 201 bp, Bos taurus
gtggacactgtgtctggcctaacccaagctttcccctgtcgctttgcaaaccagggttagtggaaaggaagaatggaatattaaagcagcagattagattgcaggtaaaaccaccttggccagggggactacagcactatctcaggctttaatacatgtgaatgactagccaggaggaccttctgcctcatatgccagact

SEQ ID NO: 657 - DNA, 201 bp, Bos taurus
gtttaacaatttgaaaaaagcccaattagtacaaaagaattctcataggaggctctcaagtcagtgtctattcctggaactttccccacttcagggaacctaggagcaggatagcaaacccacccaatcattccacttcattcccatcccccatgtcacaccccgccccatacaccctcccctcacctctctctctctccc

SEQ ID NO: 658 - DNA, 201 bp, Bos taurus
gatccgaacaaggaagccacatataattgaggaaaaggactgtaggcttaagaagtaaagttggactggatagtgacagactagtatcaggcattcttacgtatgtctagccaggagggggatttttttttttttttttaagtgatgctttctcctcacaactgaataacaaaaagacattctgcttcttgacaagtcgaa

SEQ ID NO: 659 - DNA, 201 bp, Bos taurus
gaaaggaaaaaacagccaataaatgaagaggactaaagggaactgtcagtcggattccacaatgtccttctggtaaaggtgaaacctgagccacctggccagagtatccaggcactgctaggtgaggctaccaaggtgctgtgaacgggagctgaagatcagaaactgaggtgggccaatccaatcaaaggcacataatga

SEQ ID NO: 660 - DNA, 201 bp, Bos taurus
ttgtgatttctgtttctcctgcctgtaaccttttccctagataattataaatcttgttactttatttcattctggtctctgcttaagtgtcatctccccagagaggccttttttggccaccctatgtaaggagagtgtcccctcaccccatgctctccacttgtttactctgctttggttttcttcttagcacttagcatt

SEQ ID NO: 661 - DNA, 201 bp, Bos taurus
taatttcagtcagatggggtcaagctgatgttgaagaatatcaaaggaatgtcataaaaacccactggttccagtttggaaacagtttatggtaaattgacgctataaattctgggagagcattgaatgtgctctttttgttttaaaaagtaaataactgaagcagtgtaggctcaccaatgactactttgcattcatatt

SEQ ID NO: 662 - DNA, 201 bp, Bos taurus
ttaccccttctaagttggtaaactcacctaaaagttgaggacctactttttttaaaaggaaaaaaggagtgtattataatgatttttctatactatttgtgttcttagtcactcagtcatgtccgactctttgcaatcccatggactgtagcccaccgggctcctctgtccatggggattccccaggcaagaattctggag

SEQ ID NO: 663 - DNA, 201 bp, Bos taurus
ccacaggaatgattttgtataattactttttagttaatagaacataatcatccttcccataaacataatttttattgagtacctcgtgtagatttaccataatttacttcaatcatttctctattattagacatttttggttattttaacttaatacagtatagcaattaacataatgttttgttttaaacatgtgagatt

SEQ ID NO: 664 - DNA, 201 bp, Bos taurus
gtttattgtgagggtactttgtgggcataggtggattggaccatcagccctatggccaagccctgtgggaccccaggaatagttgctcaatcaggcctcaaagggagaggagggataagggtttgtgagttgtcagtcccagctgaggtgttctgcagttggagggcctcagctctttgaatctgttatttatccttcaat

SEQ ID NO: 665 - DNA, 201 bp, Bos taurus
gaggagcctggcgggctacagttcatgaggccacaaagaatcaggcatgactgagcacacacacacagattgagccaggtatcactgtggttgactgggatttaggccctgagagaaccactggaggcagtataaacatgccttggatatcccaccctaggcacaggggccctggggtcttcattcaccgactcctgttag

SEQ ID NO: 666 - DNA, 201 bp, Bos taurus
ttcacttcaattacattatctgcctggttcctgaataggtttgagttccgacctcatttcttaagcactgcgcctaagaaagaaagaatgcatagggccagtgttcaggtgctcagtgtgacatagagaaaagcaggcatgaatgttaaccacttcactgagaatgtcttttgtcactcccaatatccaccatcagcttgg

SEQ ID NO: 667 - DNA, 201 bp, Bos taurus
gactcagaaaatcattctgttctccaaagagaacctataatttatacgactgtgattatcccactggtcagggcctaggtaacattcagcattccattccatggcactctgacaacactggagacaggagctgtgctcagtttttttaaatacatgtgtttaaagcagatagtgactcaaaaatgaaacagggtaaaaaaa

SEQ ID NO: 668 - DNA, 201 bp, Bos taurus
accagggtaagaaggatcataggggaatcaacagaccttaatgaaaagtttaaccttttatttgaatgaggcaaaggctttataaggttttatagatttcactggaaaattagggcacttaataactatttagggagaaagaactatgagttatactataaaagaataaggctgtttcatcaaagaactaattaaatttac

SEQ ID NO: 669 - DNA, 201 bp, Bos taurus
gatgggtttgccaactcagaagttctccaaacccctttgcttggggttttcatggagattccattacacaggcaggactgattaaatcactggccatgggcgactgaattcaattctccagcacctcttcccttctgggggtggggaagaaggggctgagaattccaaccctgtaatcacgtgcttggttcctccaacaac

SEQ ID NO: 670 - DNA, 201 bp, Bos taurus
cagagttcctcatttgttccttcattactgtcttgataaaggataactatcaaaacacaacctagacgctaggtctcactgccaccagctgggcctgttactggtacctatccacctttctacctccactggtgcctgctccaacgcatcacacacttgctaactagacacttccttcctggccaaataccacttatttct

SEQ ID NO: 671 - DNA, 201 bp, Bos taurus
ggactctcttactaccaaagtgttttgatattggtttaaattgtaaaccttcagacttgtcaatagctctgaaatatgtttagaaattatgaaacattaataagtaaggctggtgttggaagtaatggtggtttatgaaactgtggctatcttttcaatgtgtctgaacagaaaatcaacttcaatatcttcaaaaataat

SEQ ID NO: 672 - DNA, 201 bp, Bos taurus
tggccactggctcttaccgtgttcccaaggtactcagagcttggcagagccctattcccaagcgctgggtacatcgtccgttcactgccgtccccccacgacccctccaatcatctcgaaaccaggccgggtgggatttgggggtggagctggggaggccctagagaggagggaggtagtgctcaccagagcgccctcccc

SEQ ID NO: 673 - DNA, 201 bp, Bos taurus
ttccttttgatttgtaagttctgcgtagatagggcctcagaaaagcaaataaaaataagaacttcgggatgagctaacagataggttgccatgactttcataaagtgtttgagggccataatgcttaactgtgatattggcaggtagcacagctttgctggagtttgcacgtgggagctgtgacttgggctaatcctagtg

SEQ ID NO: 674 - DNA, 201 bp, Bos taurus
ttttagagaaaggaaatgctggacttacattctgtcattatgtgcttccacccttaaatcttcaatctggcactattcaattgcctacttcattcccatgcattaaacttcaggggtaatgacatccatctctgggataatagaatcatgcatttggtaatgattcagtatttggcctccaggcaggtgaagacacaaacc

SEQ ID NO: 675 - DNA, 201 bp, Bos taurus
aatgttaataacatgcaaatggtttatcatcaatataataataggcactattcactgctaatcctgccagaatccctgatggtaaggacaatatacttgacgtttaacttgaaatatcatctgccttcagtaatctggtgccttgttttggttgaaaagtttcagattgcctggccctttaaggcaaatctctggtattca

SEQ ID NO: 676 - DNA, 201 bp, Bos taurus
ttcagtataactttaatggcatgtggaaatgactcaagtgtaactgagatgaaaaaatcttgaaagcaccttttattctctatatttccatctactcaaaatcttatgtatatttgatacaaattcagacaaatccggagaaggcaatggcaccccaatccagtactcttgcctggaaaatcccatggatggaggagcctg

SEQ ID NO: 677 - DNA, 201 bp, Bos taurus
atttcttatatatcattccaaagagtttacatgaaaacctatgtgtatacacataaacacatgcattgtagaaatcttttgtgcaaagtgtacctatattgtctgctttatttttgtggtaatattttgtggatctttccctatgtctatgtatctatctatccacctgtttatgtttacatgggtatataaatagctact

SEQ ID NO: 678 - DNA, 201 bp, Bos taurus
tttactcccaaagctcatattaaaaatagaggactttggatatgaaatttgccaatatagaagcatggatccttacaacctttgttctaccaaagaatcaatggttactgtatctaatcttagcaattcatagatggagaagttgaggcccagtatggtgaagtcatgtcttctttgattccttagtattcctggctttgc

SEQ ID NO: 679 - DNA, 201 bp, Bos taurus
acatctttacatatgcatgtagctgttgtaaatgtagtatatgcatatttttaatcaaatgatataagaaaatctgctatgttttaatattctcaaaattgacaaaggatagcaaaagatgaggcatgtgtatagagcttgggaatatagcaatcacccactcagatcactgaaaaagtacctatgggagcacagtggtag

SEQ ID NO: 680 - DNA, 201 bp, Bos taurus
catccccattttagttctactaatttagtgtctaatgttatttaaactaataaatgagtgatattttctttactgttctctcatgtacttaaaactcattgatttcctctccacatttttccattaagtccaaaaaatttttaaattgtcaagaaagtagttgccaggccatttcacttttttttttttaaaaaaaaaagg

SEQ ID NO: 681 - DNA, 201 bp, Bos taurus
ggttttcaatatcaataaatatatgcagtatttttaatgatttgcacaatagtctctttgtgtggctataccttatttaaacaattctccttctgagacagtttaagtttttattttcccaattctttttcctattacaccctatccttgtatttgcttgaatgtttctatagactcaattcctttcagccaaattgctag

SEQ ID NO: 682 - DNA, 201 bp, Bos taurus
tcgtggcatttcagaggtgactggaagtggatgtttgtgatattcttacttccttcacatcgttgtcagtaaatacataagagcatcagccccatttcactgtgacgtgatgaaaggtactccctaatgaaaggctcacaatcagaaaaaataaaatgtgtgtctttaaagccctctgataaattcaaaagccatgagctg

SEQ ID NO: 683 - DNA, 201 bp, Bos taurus
aagctgtctggattcaggctgataaggctgaatttgtctagggatggattctcttgaaattcgtacttgatgctcaagaggctgtaccaagaattatcagtggtaagaaggcactctaatttagcttataaagcagttattgctctggttgaatggacattgattagaaattggaagaatgtgctccagtaggtcaggttt

SEQ ID NO: 684 - DNA, 201 bp, Bos taurus
gcctcccacattattttggttgacagtacaaactggaatctaaataaatgacccctgttattaggagtattacacaagttgtctctcagtatctgtgggggattggtttcaattcccctacagatgccaaaatctgtggatgtcaagtgccttatataaaatggcatagtttcatttttattaatggctgagaatttgcag

SEQ ID NO: 685 - DNA, 201 bp, Bos taurus
caatatgttcagaagatgatggaatgggtttcaatgagggaaaaaaaaaattgattcagatagctcaagtgcgtacagaagacccagatggactgacaatctaatacctgccagccctgacatgcagcagagacaaggaaggcttctgccttatacatcagctgctttccagtgcagggtaaaggcaggctgtggagatga

SEQ ID NO: 686 - DNA, 201 bp, Bos taurus
tacccccaaaaggagggtctggaaatttacttggctacttccagtggaagagagggaataaactaagataggtgggaggcatccaaaaggaaatggccaaagtatggagaagaccagtcaggaacagaggaggaggggaagggagactgggtgagacagagattcagttattcaccaaaccatggtcttaccagaaacatg

SEQ ID NO: 687 - DNA, 201 bp, Bos taurus
gtacaaaggaaacgcacaagtgaagaagtgaagtgggaaacagaagtagccagtagaaaactcagagcagagtcagttctggaaacaaggcagcatcttgggaaggaattttagcagaggaggccagattgcagtgggttaaatgatcaatgataaaatcattgatatgcatcaaagaactgttcttgagaaattaaaggt

SEQ ID NO: 688 - DNA, 201 bp, Bos taurus
atcacaagtgcccggaggatggaggcaggctccataggattggatcccagggtaataagagtgatagtcaccgtggtgaacttggctcccccacacttctcatctctctctggcacattgtccttggtccaaaattaggggcttaaacagtcccttacctttggatggttctttctcagactcctctgcaacttggggtat

SEQ ID NO: 689 - DNA, 201 bp, Bos taurus
ccacttggcttcctttagagcacgatcttgactacattgcctgttcacctttctttgaaagtgatgcacatgcttgctgaagttgtccatgatacgtcccgttagtgcactcatttagcataataaaggtatacttaagccccattacctggcatgtttatgttcctgtgagccactgcccagactgtggggactttggcc

SEQ ID NO: 690 - DNA, 201 bp, Bos taurus
ggacttggtagatgccaccagcttcattggagccatcactaaattcccctaaaaaaggacagaaaggagaaaaaaggcctccatcaaggcttgaataaaacgtttatatttgttataactttcttccaaagttatgtatagaatataaaaaattcaggcatctgagaagaagacaatttattttaaagtaggccctgaaat

SEQ ID NO: 691 - DNA, 201 bp, Bos taurus
agtagtcttccacataattttatataaaattgtgatcatacctgagagtgtgcacatttttaggcaatgttttagtgggatattcttacagtagttagatggctctgcttatttttttgctagacaacttagcaatcccagaaactgattcttttagagccagttattggacttactatgtacagaacagatgattgcact

SEQ ID NO: 692 - DNA, 201 bp, Bos taurus
atgaaagtgtttcctttaggtaatgtgatcttgttttctacttgcttttcagctatttagttacagtgggctgtgatgttatcttcattgcattcattctgcttggggttgttgtccttattggattcaaggattaacatcagatttggactttttggccattattttttcaagcattttttttgtctccccacatctgga

SEQ ID NO: 693 - DNA, 201 bp, Bos taurus
tagattttcttttttttaactttagcatgaagaattaattgaggcaatggctggagagaattgaaagtgtatgaagaaaatattcattaatattctgcaaggtagtatcattactttatttcttaaaccattatggaaatactgtcaatctgatattcttgaaaactaaacccaaataaataatgctaaaaaaacccaagg

SEQ ID NO: 694 - DNA, 201 bp, Bos taurus
ttcctgggaatgtgccattgttgatgggaggagagtggggcacaggccagctgcttcatctccttcctcctcatcaccctcctaaacttggggattatcgctcaagtcagtggcttgacttggccagaaaaaaaaaaaaaagtcctcattgttttactttcagctttcctgttgggatttttttttttttttttttcctca

SEQ ID NO: 695 - DNA, 201 bp, Bos taurus
atgatatgttgcgagatggagagatgatcatttttattggttatttcatccaacagtgtaccttgcctttgtagactgctttagataaatgagccttgatggtgatagcttaggtaagatttcttatgttaaaaatgtctttattttaattgtggtaaaagcagttctattacaaataatgtgtagaaaaccatagcatgt

SEQ ID NO: 696 - DNA, 201 bp, Bos taurus
ggtcaggtactttgtctccccaggacttaagtcaacagctatttctcaagtggagtgtatgtttttattgcacagagaatgactgtgctccaaaaccacatggaccatcctctgtgaaaatgattctcctgttggggtttgccacaagatcaatacggtatctggagctttcactgacgctgtgcatatttcctcttttgt

SEQ ID NO: 697 - DNA, 201 bp, Bos taurus
gtaattcttttaaaaatttgctcattttacatttaaaaaatattgcaaaatgtaaatctctttatcttcaataattatatactctgacagaagaagttccctgggtctcatgtctgacagaagaagtaccctgtttttgttttttcccccctgcagcccgtatcctgaactagccctggtggccaagacattagaagctat

SEQ ID NO: 698 - DNA, 201 bp, Bos taurus
caggggatactcttcattgtgatgctgggactttccattgtggtggcttcttttgttgcagaacatggggtctaggtacgagctttagtagttatggcacacaggctcagaagttgtggttcccgggctccaaaagacagtctcactagttatggtgcacaggtctagttactcctcagcatgtggagtcttcccggacca

SEQ ID NO: 699 - DNA, 201 bp, Bos taurus
cacatccatcgagtcagtgatgccatccagccatctcatcctctgttatccccttctcctcctgcccccaatccctcccagcatcattatacccaaataagtcttcctgctttctttatgtaaagcttcttttagaatgaacaacttgatcagtatacttgaatacagtagtctaacaaagactatcatctcaggttttgc

SEQ ID NO: 700 - DNA, 201 bp, Bos taurus
ggacagatcagtgttacagctccatgttacagttcagttttatttagaaaataaaagaaaaatacatccttgaggagtgagggcatgccaactcaaaagatgctaagagaagagagccctgtcccattggttcctcttttatatgtcttttcctccccctaggcctgccatatgtaaactgggctagccaggagtgctgtt

SEQ ID NO: 701 - DNA, 201 bp, Bos taurus
gatacatataattttgaagggagaaataaagtttatagactctgtatttattttgtgtttgtatctgtctggttctaatcaagaaacaataaaatgtttggttacttgaaacaagttattttaaagtgagagacacagagaaagaagcagaatagttaacgtaggcttaattatcataaaaagcttcatgggaacagtagg

SEQ ID NO: 702 - DNA, 201 bp, Bos taurus
ggcccactcacagaacaaagggctaagcagagctagccagctgcagaccagcccatcacccgcctcctgtgacaggcaggcgagggtagccagagctggaaggggttagtcgcggccccagagaagcatcatgtaccaaactgcaagcaggcttcattgctaaccaagacttcttgggattttggacagtcaacatccgcc

SEQ ID NO: 703 - DNA, 201 bp, Bos taurus
cctcctccagagactaatggtaaagactgggatataaacagattagttacagtataaatgatgcttactctgacagaggtgtacatttagtgcttcaaataatccacctctgtgtgagtcaaagaagcctcacagtagataatggcacttaagatgacactcaaaggcagtctgccaggtagagagggggactgaatctaa

SEQ ID NO: 704 - DNA, 201 bp, Bos taurus
actaagctctgcaactgatgggcaatcttcattgccatgtgacattcaggctctcattagtgatttcaggccagcagaggagacagtaaaatttgatacaagctgtcaaggtgaagttttaagagttatgattctgaatttattgttaagagtcatataagactaatacatgacaaacagatttagaaatgtctttacaca

SEQ ID NO: 705 - DNA, 201 bp, Bos taurus
gataagagaaagattggagctaacctataccatgctttctgtttcaacttgtaagtttttaaatctgtattcatgatagtttaatagtctgtaaacatatatcacatcataaatttgtgttggaatgcacagggtaaatactttacttgaaaatacgttatttgaatttaatgcacgtctttcaatttcagggagtagaaa

SEQ ID NO: 706 - DNA, 201 bp, Bos taurus
ccttcactgtgctacttactgtgtcatcaaatcaaaagtggctttaaaggtattaaataattggcttattttaacattcaaaaacaaaagttagtgagccgtcaacaattggtctaagattttattgacactttggatgtgatgaatttgattattaaatatcagacccattcttctattcaagctgagagcaaaaataaa

SEQ ID NO: 707 - DNA, 201 bp, Bos taurus
tttacagccgacagaattacatgaagctcattgttgctgcagatgataatcagatggcacaaggatctctgttttgggatgatggagagactattggtaaatcttccatttaggagtgttgggggagtgtgtaatttcctcagttctgtctcaccacagcaaaaatttgaagcaatggacagaccagtgttacagcctggt

SEQ ID NO: 708 - DNA, 201 bp, Bos taurus
taaagtgagtacctaagtcaacacaattctacctgcatacagtgacctctgcagcctgattgctgagtagaagttaaataacttcctccagcttaagttaaatatctttgagataccgaagttaaatgtgcagctaatttcaggaggttgagtggtagattaggaatatttaaatgaggaagtcttctagaaataaaagac

SEQ ID NO: 709 - DNA, 201 bp, Bos taurus
tgaaaaatattaagaaagagaactggagagaaaaaggaagaaagactaaaattggggcagcagggactaaaggaaccagggaagcagtcaatactatgaccgttttatcaaatgattacacactttgacacttattggagaaacttacctattttaaaacacaatgtgtatagagaaccaactctgccaggcactaaacta

SEQ ID NO: 710 - DNA, 201 bp, Bos taurus
ataaattcttcagtcatatttccaaaaattaatcactctggttaaggttctatccattcttacagccctcattctcaatgcaaagagaaaaaaatgccttctacttcaagtaaaaacaaagcctatcaagtaagaatgattcagcattctaattacctcttaaacacaattttatataaatcaatctttgttttaatcatt

SEQ ID NO: 711 - DNA, 201 bp, Bos taurus
actatgtaaagaaggtgcatggattttatgtactttgaactttacaaactgaaattatcaaatacttataatttatgagaatgaattactcccttaaaagacattctccatgtgttaagtttgaaagcttatactcatcctttaagtactaaggcaaatacttttttttttcctaaaaaccattcccaaaatttctatggc

SEQ ID NO: 712 - DNA, 201 bp, Bos taurus
ctacttgacctttagtaaactggaatcctactgttattacaaaaaggcagagagattatttcaaatattatgtcttcctcctgtatgtctagtcttcagaggatatccaataaactcttcaaagattttagtgctttcaaaactactatttttctcaagctttggtgaatgggacgtctcctggaataatattagtgattc

SEQ ID NO: 713 - DNA, 201 bp, Bos taurus
tccttaatgaaaaatcaaattataattgtgtctagagaaataagagatttgagcagaaatttcaaacagatgctcttgggagaaacacattgaaaataaggtgaaagtgtaacccacttggactatctgaggagcaatatacagcccagttctaaatgcacttatgtatataaaagtgtatttatttggtgacaggttgtg

SEQ ID NO: 714 - DNA, 201 bp, Bos taurus
ctagtgttaaatctccactgggcctggcctctctccctcttttccctttctccagtaaaggatccattttagactctgctcttagacagctgacatgggagtgaaggcattacatccaagttagggccatcttctctgggaatttgtcctaaatcattatagacaatgactcatacagggcataaagacttttaatccaga

SEQ ID NO: 715 - DNA, 201 bp, Bos taurus
gagggccatacaagggcataagtagaaagccagaatctgcaagccaaagaaaaaggcttcaggagaaacaaaacctgagtgaagtcagcaatacagcagaataggaaggcccggattccttcatcagcagagaaactgacttaaaaacggtgtaaacaagcctttatgagtattccagaaactagttaagaagtctcagtg

SEQ ID NO: 716 - DNA, 201 bp, Bos taurus
atgcccatcatgccttgcaaaccattgtatagtaatgttccaaaattcctcttatcatagttcattaatattcctcagtcactacaaattatgaaatataacattcatttctacatatgaattctccagcagggtcatggctattgtttaattgtctccaattagtagggatgaaaatacttactatacaagaattatagc

SEQ ID NO: 717 - DNA, 201 bp, Bos taurus
atctcaaactctagatgagaaccacagtatggccaacaattatctggatcacagcattgtgtgagcctcagcataaaatccagtaatgctggacccagactattggcctgcagagctgaagcactcagttatcttgtttcaagtcattaagtttgttacacactaacaaattatatacagtatataacagtaagttacata

SEQ ID NO: 718 - DNA, 201 bp, Bos taurus
tacctaagaatattcaaataaatcttaaaatattttaccacatttaagtgtattccagaaacctaatttctttgatatgtattgtctaagataaactaatgtttatattattgactatttattgaaaagataattgaataatcaaagtaaaaatgatacaaaatattattcaaactgtaaagtagagtaacactgatttgt

SEQ ID NO: 719 - DNA, 201 bp, Bos taurus
gaaaaaaataggcttcaagcaaaaaaaaaaaaaaaaggcagaaagagcatacgtatgtactcctcttatatccctaagtctacctcacctacatacatgaatctaataagaaatacagccttaataagaaatgatggggggggggggaagagatttaaaaagatttatttagcatagtgcttagaaaacaagaatccagaa

SEQ ID NO: 720 - DNA, 201 bp, Bos taurus
ctctgctttttctgcttcagactagaaagtggtctgtggcctcacaaaggaaaattatttcagcctcccatactttaagacttctgaagtacatgcgtgtatctacttccatagtttcctgcctacaggtaaatatatgacattaaagagtggctttctatttttatccaagtgatctgtttgagtgtttaaaggtttcct

SEQ ID NO: 721 - DNA, 201 bp, Bos taurus
aggctttaatcaccctgtggttctaactcttggggcaggcattacggaaggaatgtactctccttacaggaaatgctttgtgctctcttcagtggtgactgtagttatttgactgttagaaagcttatctgagaggccttcattctggggtccctgggcccaacctacccattaggcaattccaacaaggaacaaaagacc

SEQ ID NO: 722 - DNA, 201 bp, Bos taurus
attcaatcactgaccttcttaaatgcattgaccttcttaaaatcctccttctaaaaataagaattaaaataaatgtgaatagacacagtaaagcttaataaaggatattgcgaagcactgccccaggatgtcacttcaaaggtaagcatttcctctgagcaatcaaaataataaatgcagggtccaaaagatataatcgac

SEQ ID NO: 723 - DNA, 201 bp, Bos taurus
caccactgggcctgacccaaacgtgctcaaaatctgcagcaagaccagcttcagtagcccagtgagcagccgccggagctgacgccggtacagtgcagattacgcgatagaagggttcgaaatcccgcgagtcgcgagacgagactcacagctgcgggtgggggcggaggaaggggaaggcgctggggaacgttgggcgga

SEQ ID NO: 724 - DNA, 201 bp, Bos taurus
gggttgccatttccttctccaggggatcttcccaacccagggatcgaacctgggtatcacacattgtaggcagacgcttttactgtctgagccaccagggaagttcatgacactgtataaatctaagatttatagcataatgatttgactaacagaaatcatgaaatgattatcacaataagtttagtgaatatccatcat

SEQ ID NO: 725 - DNA, 201 bp, Bos taurus
ctttgtccgatttacagtttttgaagaaacctctgggatagtttcaagtaatttctgagctaattctttgcattcattgtgatcctctggactatgtgatgtaaagtccattaaagggcttttctttcctgctttctctcttcattcccttgctttgttttcagaatgtaacagctgtattagttgatacagatcggaaaa

SEQ ID NO: 726 - DNA, 201 bp, Bos taurus
acttatcatgtccagtttgacttgagcaacaatggcagtaacgatttgctttcattggagtaaaccactgagagctcgggttgctctgttgctgcagctccgtgttaattacctggactaatgtgtcttgctaattacagcttgctgaatctgtcataattactgctattaataatatctgttggggaattccctggcagt

SEQ ID NO: 727 - DNA, 201 bp, Bos taurus
aaagcatcaattcttgagcagtcagccttctttatggaccaactctcatatctgtacatgatgactggaagaaaccatagctttgactatatggaccacttgactaaatggtaaagctattgttttcctaaagacctggcacctccacttgcagtgtcgtgaaactggtccatgatttggatggtttgtatgaccggcctg

SEQ ID NO: 728 - DNA, 201 bp, Bos taurus
agcaagggccacccaggaagctggaatcacagtggatccacccagaaaagcaggaaccatgcatcagaagcagctgctgctccaggagccaccaaggcatgggagaggagacggcatggcctggcttctcactttcttttgcatcctgtctctttcaggtatctcccactgcctaaacctagctggaagccatttgcaaag

SEQ ID NO: 729 - DNA, 201 bp, Bos taurus
accaggcttccccgtccctgggattctccaggcaagaacactggagtgggttgccatttccttctccagagatgtgtagttactggccccaaatctcacagcccatcactttagtttccgaaagcatcactcattctgctctaccaaaatgtagtccctcaaagatttctggagtgcttttccctccactaataagtgctt

SEQ ID NO: 730 - DNA, 201 bp, Bos taurus
tttatctgattttctctaaaatgaagtccattattctatcttactgttctctcaacatagagaaaaggcacagagacacttttactctttatgttaaacaatttatttaagtcccaagatattcatcccagttaaatagagacgccaaccataggacaacatcattcaaatcctgccaccagataatccaacaagctctag

SEQ ID NO: 731 - DNA, 201 bp, Bos taurus
caaactgactgatgcttatttaaatttctcaagctcagaggcatcacaatctaaccatggatattcattaccatgatctaacccccacacattaaagttcaagtacaaaattcacaggctactctcagcaagctctataccaaaccttgtaggtctttggattgctgacggctgaatattttgtttctagaagaagttaac

SEQ ID NO: 732 - DNA, 201 bp, Bos taurus
gactgtcttgatttaattaaatgcccccactaataaaaggaatctaagcagactcgggcatgcccaaagcactgctctcacatttgagcaggtgttgacaaccttgagtataccctgaactctggattttatttctgcttgagttaaagactcagaagcctattttctctacaagtttctgagtcttggggccctaaagaa

SEQ ID NO: 733 - DNA, 201 bp, Bos taurus
aaataccatacaattagtttccagagcttcactcactatctctgtcagttttaggaactgcctgtcactatatccctccagtaccagtggatgaggctatgtgcagcataaaaccatgaaagagccagaatttgctagaataatcctggtcttaaatgttccagggctaaagctcacagctgactattagcaaactatgaa

SEQ ID NO: 734 - DNA, 201 bp, Bos taurus
caaacgatcttccccactcattcagcacgagctctgtcccaaagtaccacaaccgtgccacccacagttgagttgtttcagcttccccagggccccagacgagagtgtgcatggctgtggatcaggtcccaggtctgttatcatgctggagagacttcacaccaattaagagaactgatggcccctagagcagagggaggg

SEQ ID NO: 735 - DNA, 201 bp, Bos taurus
agaatcacaggtatagagaacaaaccaatggttaccagtgaggaaagggaatgggggaggagcaatatcaaggtggggaaataagaggtacaaactattatgtataaaataaactataaataaatattgcaaaacacagggaatacagccaaaaattacagttttataataactataaatgaagtaaactttttaaaatta

SEQ ID NO: 736 - DNA, 201 bp, Bos taurus
caatacctgctttcatttggagggaaaaaattataaactgtctgtcagtcttcatcgccacctagtggttcattggccaaataacaccaaactatctagttgatttgaaacacaggaaaagtaattcaaactactaactcctgtaatccaccatctaattaaatgtaccttggggccccattttgaaaacttattgaaaga

SEQ ID NO: 737 - DNA, 201 bp, Bos taurus
cagtgcaaggggcctgggtttgctccctggccagaggactgatcccatgtgctgcaactaaaagttgcaagccacaacaaagaccaaagatcctgagtgctggaactaagacccggccgtcacagcgacagtgtagtgacttcacaacctaagtgtaagagtgagcgaggaggaaggcagaatagaaaatcgactgtgtat

SEQ ID NO: 738 - DNA, 201 bp, Bos taurus
ctgaaaaaaaaaaaggggtggggaagggagaagcaaatcgcaaacagtcagaaaataattcttattatcctaaagaatggctcttcacagccttcagaatctaatttcttccttcctggcaaggtccctggttgtctttcatttcggaaacttcctttcaaaatatacatacccagtggtctagggctgggaaaaggcgca

SEQ ID NO: 739 - DNA, 201 bp, Bos taurus
gtggtaaatcatgattgtgactagttagttcaactgcataagagctgttgtgtccaaatgcttgtttgtgcagcagtgctggttaaaaatcagaagcacttgggaaacttgaagaaaatatataggctctcggtttgacttcctcaaaattcagaaaaaatataaagtgcttggagttgaaatattttaaaaattgctctc

SEQ ID NO: 740 - DNA, 201 bp, Bos taurus
atactaattgaatcattctaaacttgatacatgaatatataagatacaagtgaattaaatttagagctggagaatgtgaaactggaaatagagctgaatgcatgaaataaacagaaaaggtgaaaccttcaataattgatccagattggtccgagttctgccacattcccttcctttccactttgtctatattagttttgc

SEQ ID NO: 741 - DNA, 201 bp, Bos taurus
gtcttgggtgcagtctcatactcattttgccctgggcctgaaaattatgtagtcagccctgcttgtagatgctcaacaaaatacgcttattggaccgcaaggtgagaggccagatatggcagagtgaaggtcaaagaaggcagtatctgcaaaactaggctttttatcaaaggttgcaagcctagaaagacagctgggagc

SEQ ID NO: 742 - DNA, 201 bp, Bos taurus
tgaagacacagttaaaactattggataagttcatataaagaatattaatgaattcaatataggattaatggtgagttcttttttcttcaagaatacctagtaacctgataattcaaggcctctcagcactttcttgtcttcatctgccaagatgtgcaggttgttgaaagtggatgtgtgcttatcttgatgtgaatgtgt

SEQ ID NO: 743 - DNA, 201 bp, Bos taurus
gtactggctgtcttggggcagtgggaccagacagcaaccccatgccaggaagaagagtgtgggcgctatcagatggcccatgctgctgctctcccatgggctcagttataagctgcaatttaggagtagaatgctgagaaaagcaggttaccatagggccagagtgggaaggcagaaaaagacatccgaagatagccaggt

SEQ ID NO: 744 - DNA, 201 bp, Bos taurus
ttgaccaatccctggatgaaaagtgctttgagtttgaggcccatcccccattccttttctttcaccatttggcctaaagtctccccaagaatcattaaaaggggcaaaacatctgctcctccttcactggacttccagtgatggacccagaggagggtggctgaaagaatcccaaggtcatttatctttctctattcactg

SEQ ID NO: 745 - DNA, 201 bp, Bos taurus
aaggaaggaatattgagagcaggaaacctgatcaagaatgttcagaacaaaaggccagaggggagagcctgatctggtttcctgagcctctgggcctcccggggctccaggctcatgtcacagatgcctctgatcacaagagcaaggatgtaggaagggagggaaggagagattttaatgggccccgagaagccaggattc

SEQ ID NO: 746 - DNA, 201 bp, Bos taurus
gaaggaagtggaaagtgacaattgcaggaaggacagggcatgattgcaaaagcaaaattcttgaggaggcaagacaatatgagtttctgtgatgccgtgcacagtggagaagttgtcccctatgggcacagagactgttggaatgatgtaaccagtgggaagatagagccagatagaactagacgtaggaagataaggcag

SEQ ID NO: 747 - DNA, 201 bp, Bos taurus
aaaagattggaaggacacttcctccagtccctctgccagcgacctacagcttcaccattcacctcacgatacccccgggtgatggcccagttctcaggcattctgcaccccaccaccgtcggggaaaccgccccgctcccgactcatgactccgtctgggctcggatctcggccgggggtccgagggacgcctcctgccgg

SEQ ID NO: 748 - DNA, 201 bp, Bos taurus
ctcctggactcaggggctgcacgcagcctctgtgggcctccgtgatctgtccggaatcgtggtgggtggcatcccaggaaagtcattgtagcacgttgtaaaagtaggctagctcattcccaggcctcaggtctgcggattgtgagttactggttctgggatggcggcctcaaatctgtttttgaaccaacacccgggtta

SEQ ID NO: 749 - DNA, 201 bp, Bos taurus
ggtggacactgaagacacagtacccatgtgctttgacttatcactgagccctgtcctggagctccaaacctgctctagggtccagaagaaggttgtagccgctgtgacttctccagaaaaagaagtgaggcctctttgcagccctgtctgtcctcagcgtagagcttgaaatgccctcttataaaagatattcggtttctt

SEQ ID NO: 750 - DNA, 201 bp, Bos taurus
taatcaagacccggcagactcggaaaaactcttctctcttacctatctaaaaaaacttagatagggggcctggcccagaaaaagagttagtaccagagatatttttttacctggaagacttacctgcatgacaggacaaacatttgcttttcttatcttcctttgaattactctcctccctcttgaagcccaagcccctat

SEQ ID NO: 751 - DNA, 201 bp, Bos taurus
ccaatcccacagagggaagctaagggaccaaggaaaagataaatattattttacagttaagtttcctaccaaacttggttgtgaaaatttagaaaaaaaacaactaatcataaaatccagggtgaaactagtcttcccagaggaagtcacaaatcatagggaccactgtgttgtgtgtttttttttttttaaacctaagga

SEQ ID NO: 752 - DNA, 201 bp, Bos taurus
ttgtgataacaatgtactagtaaaaggttttattggcaaccattccatctgaaccaatctaccttttcattgtcttcttctaggcacttgtgcatgagtgctcagtcactaaatcatgtccaactctgtgactccatggattgtagcctgccaggcttctctgtccatggaattttccaggtaagaatactggagtaggtt

SEQ ID NO: 753 - DNA, 201 bp, Bos taurus
atatatctttctaaaacaacaatctcatcaaatcaccagtgcctcctgagtcaagcccaagcacatgataacacaacaccttccatgatctggccactgatctcctccaaacctcattacacactctttcatctctccacagcatttttcccaacaatacagcctgcgtatggcaacccactccagtactcttgcctggaa

SEQ ID NO: 754 - DNA, 201 bp, Bos taurus
gaaaatatttaaaaagtaccttaacaaaagtatccccaatgatttttcttttctcctcaggacttgtagtcatatttaacgttttgctaattctctttcgtggagttctgtcttcatctgatattggtagagttgttgttccattgtagaaagaatgagcagcatttatcactggggaacaggagagaagcatattttaaa

SEQ ID NO: 755 - DNA, 201 bp, Bos taurus
aaaaacaaagcttccaaaatttaagacatttggctagattttttgatgttcttttgagcttaaaaatttttataatcaaattaggtttactatcccatcttgttctttactgctttgaggacctctagcctttccttttacaatttctgatgtcctaatatttgcattgatgtaagttctctgttgaacatctagaaggtt

SEQ ID NO: 756 - DNA, 201 bp, Bos taurus
aaaggaaactctaagaaggccagcccacgccatgctccatgtgctctcctgccctgaggtcctcattcatgtgctcctttctctgtttaggggtgtgtacatgtcccctccacccagtggcccttgctgggcttaacagacctgagaaaactattactctctcaggcaatcatttgtttgactaaaacagtcaagctggag

SEQ ID NO: 757 - DNA, 201 bp, Bos taurus
taaataggtccaatatacaagattttgattttgaaatcctatactagttgaatttcaagctcctctcaggaacacacagaagaagacaaataaagggctcgtgatttttgaatatttcagtcactcctcactggattatgttagcactttttctgcatatggtaagctacattctgccatgcttgcagtcattcatgtttt

SEQ ID NO: 758 - DNA, 201 bp, Bos taurus
aaaatggactcctcaccagaacccctgcagtttgactatggttggaatgatgtagaccagcagttggtaacttgttctgcagaaaaagaaaaggggcaaatagtaaatattttcagctttacagaccatatggtctctgctgtaactattcagatctgctattatagcatgaaagcgaccagagacaacacagaaatgaat

SEQ ID NO: 759 - DNA, 201 bp, Bos taurus
aagggaccagggtttcatgccatatccattaacagtggtggccaggctcacaaaagttccctattcagcccctatagcttcttctgggtcctgaataaagtcaaaaggttaatttggggggcctctggcatctgtcactgcaggtctggggcttcagagtaggagaagggtgattatacgctcataatttattaaaagcag

SEQ ID NO: 760 - DNA, 201 bp, Bos taurus
ccattcttcctctggaagcaccaggagacaacccattcccttctctttcacctcctagtagctgccagaattttgtgacttgtggccatattactccaaactctaccttcatggtcacacttccttctccttttctgtaatctcagatttgacacatgatctctctttgcctctcttctaaggacacttatgattggattt

SEQ ID NO: 761 - DNA, 201 bp, Bos taurus
tagacatagatgatggaggggagtcaattccgtacatcattagaacatatccaatagaaaaaataactcagaagttctagtatcccaatacaaatatacatgatgatcagagatatagaagcctgtagccaacattcaactgaaaggagtatttagtatgatagctcctctaacagtgatagaaggagggcattttcagat

SEQ ID NO: 762 - DNA, 201 bp, Bos taurus
aatctagactgcaggtgaacacttgacaagtttgtgggactatgcctagtagttgagatatagaagtgaatgggaatagtgatgggacaggcctgaaatccgtagaccattgcttctcaaacctgaatcacctggtatcttgtaaaaatgtagaactcgcgcgggctcagatacagcttttctcacaggctcccagatgac

SEQ ID NO: 763 - DNA, 201 bp, Bos taurus
aaataaccataatttaaattgcaaaaaaaaaaaaaaaaaagcgtactggtttctaagcgtacacaggataaaattcaaaatcctctccaaggccctataggacttggcaactgagcacaagcacaccaacaggaagtgcttacctctgtagcctagactcccccaacccctgcacttgttccttcactagttttaggccgt

SEQ ID NO: 764 - DNA, 201 bp, Bos taurus
agacagattggttggcaaacttcccaaggtcatatagagtccaagaccggatctgataccatgtggagcccattctcactaaccaggaagctgtggaagagagaaacaggtgtagggatcctcagtagagttccctgatgaggtgggctttaccttgatgtggaaggatctggaaggttttctgagtcatgcttcattttc

SEQ ID NO: 765 - DNA, 201 bp, Bos taurus
ctgatgtttactcttttaggttttactctgtcttttattgcaactccttagccctagtctgtacagtttggtctttcttaaagggcaaatggagtaataataataagaggaagactgttcagaaacaccctgataattggccaacttccagtctatatgcttgtcagagcataaatatactgcacgaccaatagcttaaat

SEQ ID NO: 766 - DNA, 201 bp, Bos taurus
ttgtatttcctcatggtttgactatttatgtgttttcagccaatgaaagctactctacgcatggtactttacactcttggccaatgagttttcttcatcacactcccctcatcatcagaaatgagtgaattctgcaatacgtagtttccaactcttggtctttatttctattatatattttggcccctagtggcttacagg

SEQ ID NO: 767 - DNA, 201 bp, Bos taurus
aatcatcaccctgtacatctaaatttacatatattataagttagtaatatctcaaaaaagctaaaggagataagagagacttcgttggttgggaccgatcactaagcgctcaaatgtgttaagcaggtaataaatgtggtagtgggtctctctcacatctagtgtactctgccttacatgcaggttgtggttaggatacca

SEQ ID NO: 768 - DNA, 201 bp, Bos taurus
ctttccatggttatatttactgtcctgctaagtatgaagcttatggacttctgtactctgtctcttcctctaagttactggttattaaattgatttatatctgattagtaagatcatatccttaccataagtcttccaataaattctagactattttggactgcatggaagtgtccaggagtataaaaaaaaggtaaatga

SEQ ID NO: 769 - DNA, 201 bp, Bos taurus
atcagccctctcccccagtcttgaaggagtggacttattgaaatagtatcttgtggggctcagaagttagttctcaactggccaccagagtcagcactcagggggtgcccactatgtgggttatatgtcagggtatagtagggctatagtaactcctgctatagtagggctacagctgctatagggtacttagtggaaggg

SEQ ID NO: 770 - DNA, 201 bp, Bos taurus
gcaaatgtgtacatttctaaatatgtaccagttctaaattattatggaggaagaagagtcattttgtgttccttgtctagtagaattgggctacccatgcataaaaactctgattttgtacatgttcccagaaaatcagaccagtttcctctctcattaatcccttcccaccaacaccagcctccctcaaggtcccatacc

SEQ ID NO: 771 - DNA, 201 bp, Bos taurus
ctattttaacacacagcttaatgtagacctcaggtattctataacctactggtcaaataagacagttatcttaagaacttatttatcaaagagttttccccttccttatttaatggattctgatgagactatttctcacgtatgctaatgttgcccaggaagtgatttaattgacaaagccccaaatgacagcctggcttg

SEQ ID NO: 772 - DNA, 201 bp, Bos taurus
gattttctgcttctcatttccaaagctaccaataacttatcacccaatcattaattttttttttcctttttcacattgattctttctttttactgaggtgtgccatgcccaagttgtggtcttccatttctttatcttccaccttgcacagctcagttaattccactttttattgtttagttgctcagtcatatcccactc

SEQ ID NO: 773 - DNA, 201 bp, Bos taurus
tattgccatttattttaaagacagggagtatgcataatataatatctttcaaaagggaccagcataaaagctgtggctttgtaagtagtcaaaatgcctgataccattcagaattaataacgaacaacgcaagaaagaaattctgtttcagggagtgagtgactcaagagtcaaatgtttaaccaaggtgtagttttgatt

SEQ ID NO: 774 - DNA, 201 bp, Bos taurus
agaatcccaattcaccaccaagtctgggtcctctgtacagttctctcatgactttctataacacccaccttctccagcaaggcctgatgactggtccccagatcctggtcctacatacatagtttctgtttttctatctcaaggtattatgtcaaagtcatgcagtaaccagaaggaaaacccacttctgagtgggttttt

SEQ ID NO: 775 - DNA, 201 bp, Bos taurus
tctttgctctgtgctttagcagaagaaattttcacgaaacctctgtcatttgtgctgctatcacacacatctcccacattgggttccgctgctccctctcagagcagatacattaccctcctactgcccaaaggcagaaaatgacatggaatcaaatcaaactcagggaaataagaaacctgaagttttaataatataact

SEQ ID NO: 776 - DNA, 201 bp, Bos taurus
ttttccaagtcagtgaagctgttaacattactgcttcttcaagatgtgggaaacagtagtcaaatcatggactgggcagtcgaaatctcaattgtctaactttgactacagtttgatgatgctgtttttggtgccagctacaatttgtaagcgcttactcattccccacaatgaaatccctttcaatggactttctccttt

SEQ ID NO: 777 - DNA, 201 bp, Bos taurus
agtggattgtcgtttcttcctcaaagttcaggtaattaatttcaaactttggtgggcatatcacacatgcagatgaatatacttccttccacccttctttccttcttaccttcctctctttctttacttccttcctttaaaaaacctcagtccataaaacaccacattcttatcaatcacatgtatgcatgcctgctgttt

SEQ ID NO: 778 - DNA, 201 bp, Bos taurus
caattaataatttctattacttatcagaaaaagagaaatagttataatgaaggtataatatatgatagaattatccaggaatataagacagagatttatcaatactgcctaacttcatggcacagatgagatttgagttggacccaaatgaatgatcggagaaggcaatggtaccccactccagtactcttgcctggaaaa

SEQ ID NO: 779 - DNA, 201 bp, Bos taurus
tgatagatgcctacataatcttgcatgatcatagccagtgggctactctttaacacacacataaaacaaatgcttttgaatgaggaacaataaatgaaggaataaagttgaaaatcctaaaagaggttggcattctgagtgcttaaagcacacacacacacttcaaaacagatcaaacagggaaatgttaatgacattgta

SEQ ID NO: 780 - DNA, 201 bp, Bos taurus
agaagttcaagttatctcttgagtagggcatcaaattttaatggtgaaggcaagagggtagggatggggaggaccataaagatttttttattttaatctcctaactagttctgacacagtcccttctctcatgttaagaatagctactttatactgacttgcctctgtggaaacactcttatttaaataggtctaacttag

SEQ ID NO: 781 - DNA, 201 bp, Bos taurus
ctgaagctcagattaagggttagcttctgtaaaaaactttgtccaaccaatgacatcctctttgtgtaccctctgcaaaatatttcaacagcacaagctgtcaattcttgcttgtattgtttgcatgcttgtctcatccatgattacacccattcaactttatgtacctgacacctaacacaacgttgaaaacaaaaggtc

SEQ ID NO: 782 - DNA, 201 bp, Bos taurus
tatgagtaggctttgagacaataacctcacagaaaaggtcagattatggtcaacactgatggggaggtagagactcccaagacagggaaagaggagaagacgggagatcattcaagagcaggaatcagtatgaagaaaggcacggggttaaaggaaaggcatgcccctgtgaggcaacagttagcataaagaattcctgat

SEQ ID NO: 783 - DNA, 201 bp, Bos taurus
cgaggctgtgatcctcaaggcccctcaggaatcaggctgacagagcagtcaccatgctggggttgccggatgtggtagatggttacagcaatggtccaggtgtgatcacacctcctaccaccaccactgcgtcctcatggctgtgtagttccctcccatgtttgatcatcaaactaggaggaaagactcctgaagcgtccc

SEQ ID NO: 784 - DNA, 201 bp, Bos taurus
tttggcttccacgatttgacactgagaatgttttgtctcagaatgtctgaataagatgtcatcagaattacagtcacattaattaattttcaccttgaacaaactagtacatgttttccagggtaaaagccataatactaatctaaatccttgatcaattttctatagggcaaatatttccatttttgttttatactccca

SEQ ID NO: 785 - DNA, 201 bp, Bos taurus
accattgctaacatcattgtcagaggctgccttcgttttgagagcttcacggatggtgtcacctgcaatttacatctggccagatgaagacagatagggtcgatgagacctaaatcattagatcagtggtctgtaaccctgctgtgctttagaatcacccagggagtcctgaaaactaccgatgccaaggccccatccctg

SEQ ID NO: 786 - DNA, 201 bp, Bos taurus
tgactgaacaacatgagcttcatgtaagggttattgttcttttatggccaagcatcctggaccccctttacaggagaccttagttttcctttgagaaatatccaggggtgagaataatttggttctggtgatccgattaaaaactgactaatttaggacttccctggtggcacagtgaataagaatccacctgccacagca

SEQ ID NO: 787 - DNA, 201 bp, Bos taurus
tttgctgctttgcagaaagaaacaaaaacccatagagttccttcaacaacatatatttactttacaaatatcaaacctaagtaccacacctgtgctctgaaggctttcttcgtgtgcaatgactttctgtttcaatattgaatcatagagtaaacattttgaagacattgtaaagggcgatagagctggacatatccaata

SEQ ID NO: 788 - DNA, 201 bp, Bos taurus
taatgtttctagttggctgataattttcatagcaaccatggtatttggcatgtcctaaacacctttcattagaggccttcagatctctttgaagcagttcattatactctgaaacagttcagagaataagagagaataatccacaagttttgctgatattctatagctgtgtagagggcatcacgtagcaaatactgaaaa

SEQ ID NO: 789 - DNA, 201 bp, Bos taurus
tggcctggagatgactggcaaaccctgatagggtcgtgcaagcagagggcccagggcaaggccctgggggaagcttttagcagggtggccaagttgctgtgttggggcagggggatgtgactgaggtatgcctcagtgattacaaggaggctgggaggtcatgactgactctaaagacttcatttgctgggggcaaattcg

SEQ ID NO: 790 - DNA, 201 bp, Bos taurus
aaatttcactttgcctggcagggccttcctctgtcacagctgaaagagaactaagacaggctttctctcaagagtgagacagaatgagccatgtggggtagtattggttttttcctgcactaatcattctattggtttttaaacacttgctttttaaaggaaatataatccttatgtttaataaaaaattttaattgaaag

SEQ ID NO: 791 - DNA, 201 bp, Bos taurus
gcagtggctgtcttccacaggccaaggttgactgtaggagatgctccattagacttgggctccatgctcatcctcaagtactgaaggccagctggaggcatctaatcatcagaggcaagctgggagtagttgtcatagtgagacacaggcagaagcacaatctgggggctttgacctgcaggggcctctggtggtgacaga

SEQ ID NO: 792 - DNA, 201 bp, Bos taurus
cacaatgcaaaagtgtcagacacaactgagcgtgcacgcacacacacaccccccagcagctctgggtttttttggtaccattttcttgccagaaaacagggtatgtttgttcacctaataagcccatcagaatgcctttagtcctgttttgtaacaacactagatggagctccttctttttgttgcccttgactctggcag

SEQ ID NO: 793 - DNA, 201 bp, Bos taurus
gaattcacaacaaagtgaagacagagtttacctctaacataacatgcagccaaaggaactgtaggtacacgatggagaaccaattacaagagacacgttctatcatgaagggtggagtgggagatgcttgtcaaaagggtttgaacattaagctaatgatgggatgaaaattgctgccaaaatagatttccccatttccgc

SEQ ID NO: 794 - DNA, 201 bp, Bos taurus
gccatataccaggaaggggaggctgagcaggtggaaaaggcaatgggttcaggaatggatgtgtgagggttaggaatatggaaagttgttccattgatggcgaatttgaatttgaggtttcagagggtgactggggctgagaagcctcttgtccagatttcctcaggtgagttctagtcttttgagatacaatttccttca

SEQ ID NO: 795 - DNA, 201 bp, Bos taurus
ggaactcttttttgtctcctttaaaccacagaactgctaattcaaatgaaatgacatttccggaagaatagaaattcctggtttaagtgaggcccttttgcgttcagatggatttgtgataaataagagaaagagactcttgttcccaaaccggctactcactgctgccccaagctgtagattaatggaactggcccagga

SEQ ID NO: 796 - DNA, 201 bp, Bos taurus
aaattaagtcatgtcctgtatagaacatagtccttgcagacaggccacctgaattggatctttgcttctctactttttagtagtaactttggtaagttacgtaacctcccagggcctcagatttctcacctgtaaagtgggagtaatgtgcacacctggtacagtggtgaggcatcatgaagtcatagtgcttggcacaaa

SEQ ID NO: 797 - DNA, 201 bp, Bos taurus
ttcagctaatcccactgggagccctcggagtagaatggcccttcaaagttgtctttatcgaagcaagggtatattcctcctcctcagtcatcagaagtgggttgccctcaggcagggcctttcctgagctgaggcagcttcgttaggctgggagcaatgcccacagacatcctcagctgggaatggctgatgcgcccagca

SEQ ID NO: 798 - DNA, 201 bp, Bos taurus
ttacaaagcaaaaaaaaaaaaaagtttcactgaaagtcttgggaaattctagttcaaggaaacccccaagtacagcatccagagattcacaataatattgagatcttgatctcatattctccaaaatttgtctgtgtaacccagatctagtcctatagttctctccatgttgcttcagatatttgagctctggtggtagta

SEQ ID NO: 799 - DNA, 201 bp, Bos taurus
ggaggccagaggccagggcagagtaaacaggggcagaatgtgaggagatgggatccaggcagggcagggagccaggtgcaggaggagggaggaggacctcagaggccgtggttacaatgttgtatttcattctgaaatcccatgtgagggtttaggttgaagagtgatgatctgatgaatagtttttaaaggactggtctg

SEQ ID NO: 800 - DNA, 201 bp, Bos taurus
tacgtctcaggatcaacctgacagcttggcctctgctcaagaagcctgaatcatcatcttggttgcacacgaatgagtcagagcctaaaggacagcgccccggccctcactgggagacaagcgctgttaactgggctgtattagctgctgaattagaaatacacagggaacagtgtgaaatgagcacgttgcaaaaacagc

SEQ ID NO: 801 - DNA, 201 bp, Bos taurus
cttaagcatttcttcccaatgagatccaagctgaacaatgacacgagctgatgttcagtggtggagatgcccgtgtatcctcgcctaacagctgtcacggtaggtccacactgctcctgaaagctagataattaactgccgtttgctttgaagtccagggaaagctgcttcctactgcggtgcatttacaacttctacaat

SEQ ID NO: 802 - DNA, 201 bp, Bos taurus
tgtttttatgcagtttaacaatgttgatgcgatagagctactcttgaataacaaggtccaattacaatggatgttgggaatgttcagtgaaataggtccctggtgagtctcaggtcttttaaaaactgtgcattatataatctataagaactgcttgcacaaaatcaagtacctggttggcatatattttgctacataaaa

SEQ ID NO: 803 - DNA, 201 bp, Bos taurus
gtatgtgctcttgcacatactacatttctggaaataatgctgaagtcagtagtttacaagtctgagaatccaggcttgtagtaatatatgctgactggcctggaagtagtttataaaataatatttgttttattgaaatcaaatttggttgtcagcgttttatcatttttatctaattagtttttaataacttaacttatc

SEQ ID NO: 804 - DNA, 201 bp, Bos taurus
tgttcaacagtggaaggtttgccaaagaggatggtgacagaagagcaagagtgagatgagctccaacagcagccctccttggttccacctgacttgacacgctcagtcgcctctctaagtaaatatttccaatatttacacaacatctgttaaaagaggaaccagattgttagcctacatgatttagtctagatctgctta

SEQ ID NO: 805 - DNA, 201 bp, Bos taurus
ttatataacactgaatattaaatttaacatatattgttgatggcctcatatacctattgctgtgagttgaattgtgtctccccaaaagatatgttgatcctaaacccagtacttgtaaatgtggccttatttagaaatagggtatttctattaatagatataatcaagtgacaaaaacggtccactggagaagggaatggc

SEQ ID NO: 806 - DNA, 201 bp, Bos taurus
gtggtgaatcatttgtcttattgtttatgcttttttttttttactgaaaaatattaagaagcaatgaaatatccgattttttttttgtccacagttttgcattctccgtgtcattgtttatttgactgtacattatttcaccatttctagaatgattcagtattagtttttgccaaatgatggaggactaaaatgcatccc

SEQ ID NO: 807 - DNA, 201 bp, Bos taurus
taaaccattatcagagtgtttcataaatctagtagcatattcacttttgattaatatttccaaaagacacctctttcagtatgtggttattttgatagattaaagaaaaaagacagtcttgtgtttcatgtgtcctaagccttgcatgcatgtatgctgtcgtttcagccgtgtctgcttctttgtgaccctatggactgt

SEQ ID NO: 808 - DNA, 201 bp, Bos taurus
cattaacacaggaaaaattgcatgactctgagaaaataatcattatagcttcattaacacatggagtattttacacatgctatagtatgaggttctttccggccaagaaagatataatttatgagccaaggatctggagaagcaaaaaatctgagcaatccatccttgaatgtgaaaaagaatagacagatgcatttagaa

SEQ ID NO: 809 - DNA, 201 bp, Bos taurus
gtacaattacttctatcatatcattattgtgttatctggaagaagagtattatatgtaaaaactggtagtagttaaaagtgtgacatagcaatctactttgcagtgttacgttgggtaatactttctagttcatgcagtcttttcacttaggtacactggaattatctttataactattggcctttcattcattgaatcat

SEQ ID NO: 810 - DNA, 201 bp, Bos taurus
gcagctgcctgatgcttattcaatgcctctctccacagctacaggatttcccagttaataactttaattgtgatcatttctatgtcatatgaatatgggatttttaaaaatgcatgtaattctatcatattattaattcattatttgtattctaagaatatggcctgatactgactctctaatcttacacttaaataaaaa

SEQ ID NO: 811 - DNA, 201 bp, Bos taurus
taatgtgactccaacgtggaagcagctcacaaaatcatcaagttcaagtccattattttattagagtcagactcagacaagctacttgcaaaacatcccatgatttgtgaggtgacagaaaacttctttattagagttccctcctctatctcctatcaactcccagaaatatttgacaggggtttgagagccctctgacac

SEQ ID NO: 812 - DNA, 201 bp, Bos taurus
tacaatgcagtgtaacatattctatgaattgtgctttaaaggagatgagagaaacagtaagagggaaagagaaattgattctgacccagccacaaggtgacaagtttctgagtgtttaagacagtcatgttatcctcataaatatagcacctggtttaaatcaggtggtaaataagtgcatatgtatactgcgactaccat

SEQ ID NO: 813 - DNA, 201 bp, Bos taurus
gaataaccactgctactggagatgactggaccaggatctagccctggaaaggaaagggctagactgcttccaatgttggtctagggctcaatctcaggtctagggctgttttgtaccctaggggagatttgagttcaaggcaggaaaacctggcacagccaacacatgtagaatcccaatctatgggaagatcagtcagga

SEQ ID NO: 814 - DNA, 201 bp, Bos taurus
ccatacactttgttcaaaaaagatatagtggagccactcagagtcttttctgtttcctgtaaggggaatttggatcctgcctcacggtagtcataaaaatcttatctgcaaggtgaagttttctctagaggctgtactgctttcaccagggagaacaaatattgaacccacctcgcctgcttttcaaaaaaaagaaaaaac

SEQ ID NO: 815 - DNA, 201 bp, Bos taurus
ctaatttgtccttttgcattgtaacaacgttttcaaggccctttctatttttccaaaccacatttttataaagaacataaatcgccccccgaaaacaaaaggggcgcgtccgggccaactggcgccatcacgcttcagtgtttcgcggttctagaaagtttgttgcgtctagaagctaccctcactgcaaacgatgcgctg

SEQ ID NO: 816 - DNA, 201 bp, Bos taurus
aaaataacatttcttaaggcaacatatttcagcattaagtgcttgacaactgcgcatttgactggacctaaaactaaacctatcagtttaaacattttacggtacaaaacaaaaatatccccatttaagcaacactttcttaaaataatggaagataaatggtttagtcacaaaagctctctaaagagatgcatttatttt

SEQ ID NO: 817 - DNA, 201 bp, Bos taurus
tatagttctgtaagtaaaaatgtatgcccttttgcatactgacagtgaaaattaatcagaatctatctttcccaaaataattttgagtaacatgattaatttctcacagataacttctgagcacagtgttatgagttcattagaaacatttgttacaataatggcaccaaatgttgaaggagtggaaactaaagtaacata

SEQ ID NO: 818 - DNA, 201 bp, Bos taurus
tcgccaacgattcccaggcctctcctggagttgttccagggatagagccttgagagagtaaggtgttgtggaaaccatctaatggtacacatgactaaaccagttaaggcctctataaaaaaacttttaagatcctgggcaaagatctacttgtcttgaagcccccaaagacaaacctcctaagtaagttcttctgtttat

SEQ ID NO: 819 - DNA, 201 bp, Bos taurus
actggcactgatattttcttttctaacaaaacacaagtattcagtgaggtaaactgctatggtataataggaagcagcttattcttccctccacagtcttcctaccctctctcagatctcccttcccttgtttcttcacagcaactcaagcacattactaagatttccaataactttcagatgttaaaagtgtcttaattt

SEQ ID NO: 820 - DNA, 201 bp, Bos taurus
aacttcccttaaaattaacatttctttgtgagagtacctcgtggcttaataacaacatgagaaaagaaattccctgtcactgaaatcaagtgagaattcatatcattgtcacatttcataccatggaagctccatgaggaaagagattctgtcctgttcattcactgatacattttgtgccagatgcagtaggtactcagt

SEQ ID NO: 821 - DNA, 201 bp, Bos taurus
ctttatgatttttcattactatctgtgccttctcaggccacttaactatttttagaagtagacagtgtggctgataaagtagtaaatccaactaattcaatctctccaaattatattaaccaggccactgacttgttgagcaaaatctccatgggcattgagaaatatgagctggctagtcaaggttacagttattttttt

SEQ ID NO: 822 - DNA, 201 bp, Bos taurus
ggtcactatatgaaatctagtaactatacaaaaatattgctgtattattggctatattctttatgctgtatacctcatctatttctttattttatacctgaaagtttatacttctcaattccctttatccaattcaccagcctcatgctgcttaccctctgccaaccagcagcttgttctctgtatctaaaagtctttttc

SEQ ID NO: 823 - DNA, 201 bp, Bos taurus
aggaggagaagtttccacacagtaagaaactctctcaggggcatgtcttgggggttttggaatctcagagggcaacataactgggaagaagaagaagaaggaaaaaaaaaaaaagaaacagagaatatgcacctaaccgcaactgccagcagagaagtagcccagatgctcacgtccgccaccagcaagtgggctgggcag

SEQ ID NO: 824 - DNA, 201 bp, Bos taurus
atctatattcatcagtgatacctgtaattttgtgtgtgtgtgtgcgatatctttggtatcagggtgattgtggccttttagagtggtttcaaaagtgttcatttctctgcagtttttttgaattaatttcagaattagttaaattttctctaaatgtttggtataattcacctgtgaagccatctggtcttgaagtttgtt

SEQ ID NO: 825 - DNA, 201 bp, Bos taurus
tcggaagtggaatggtatgttatcagcaatgagcgatgctgaccactttgaaattcacttcccattagacctggatgtgaccatgaaagccatgatttttagagcttgcttcctcattgtaagtctgtcacttttgagttatcttgaaagtgttattctttctgatgaggaataatagtacagagtgctgggaagggaata

SEQ ID NO: 826 - DNA, 201 bp, Bos taurus
ttcctttctgaaatgtagtcatgcaaattaaacttccatggcaagttccagcatcacatgtgaattgcacacatagatttcagtccagtgaatgtacaaataactgagtgcattataaatactatgagaatctgtgactttaaaatcttgctattagtgttagaacaagaactatattaattaaacaatcttttgtttttc

SEQ ID NO: 827 - DNA, 201 bp, Bos taurus
aagaagagtctgtttcattaaaataattaaccttcatattattataaaatagttgatgtattcatgtctctcaaatataagcgtgagatttttccacaggatatataatcctgaaaagcccagtctttcttctccatagcaagtccctgaatgcctctgtcacaccagtggcgacagcactatggcgggttacagtttatg

SEQ ID NO: 828 - DNA, 201 bp, Bos taurus
atccttctcagtctatgttgcttcccagcaacgtaggacattttccttcccctcccagccacactctttagagactgttgctcttcccaccacccaggaacggctcctgccaaagtgttgtgatatccttgttaaggagtagacacgaaggagctctcacttatctttcatccaaagataacatttgctgatgttcatccc

SEQ ID NO: 829 - DNA, 201 bp, Bos taurus
gggagactcacccatctgcatgaaggacttcctgtaaaaaatggaacaagatacattgctgtgtcatttatagatccctaagttattttcttttcattgaatgaattttcttttggaatggatgactggcatgaacatgcctttgaagttgtccttgagaagatgcgaggagtatttaaataacttccacagaacaacttc

SEQ ID NO: 830 - DNA, 201 bp, Bos taurus
ctgaatttgcttttatcagaatctccagtttttgaaggagatggctaatgacaaaaaccacatcagctcccaagtggaaaatagtgctcagggcttccaggggtcaccacgtctcttccagtattataaaatggagccctccccaactctctcttgtattaaaatagttaacagctgtataaaataaaagcagacacaata

SEQ ID NO: 831 - DNA, 201 bp, Bos taurus
ctgctttgtgaaaatcctaccaggaacagggacacacctgagggttccacagtcactctgaaaaaagaaggtaatcaaacagcatatattataggctatcggtggcagggtggatagaagaattgcactgcatttgacataaagcacatatccaattgatacaccaaatcagtgggtttcaggaaaagaaaacacaaagct

SEQ ID NO: 832 - DNA, 201 bp, Bos taurus
tgttataacctctagaaagtttgagcactcatcttagatctagaagagatggagagaaaaaacctccatgtcagggcacagtagaacccttgtaccctgacatttacaaaatgtgtgtctgcaatttataccaggggtccttagggctggattaaatattcagattcccaagatacttgtctgcagtctactgtgcacaga

SEQ ID NO: 833 - DNA, 201 bp, Bos taurus
agagatgctgttgttgcacatgttgtaagaaacatggaagatgaaggccagaatatctacagggattggatattatacagtatttccctcccagttttctgttgtccctccagaagactctaaaggcaacattgtggacccaggaggggctcaggaaaagagcatgaaacagggggcaggacacaacttttgaaagaatga

SEQ ID NO: 834 - DNA, 201 bp, Bos taurus
gacattaacaaaataccattgactgggtggcttaaacaatagaaatttattttctcatagccttagaggacagaagttcaagatcacgttggccctgaatgactatgtggaactaagctcccacatctacccaataaagatgaaaagaaatgtttacatgaagcgccactgaggccctaggttatataatatgcataaaac

SEQ ID NO: 835 - DNA, 201 bp, Bos taurus
tcttatcagatatgcataaggtatgataaattttctaaacagcaaaatgataagtattggtcttttgttgaggactgccattgtatgctccaaggatgtacgtatgctaagttgcttcagttgtgtctgactctgcgaccccagggactgtagcctgctgggctcctctgtcaatgggattctacaagcatgaatacagga

SEQ ID NO: 836 - DNA, 201 bp, Bos taurus
atatatagtagttgtcagatttaaatccaaaaaaaatgaaatttgttttttagtaactaaaaatttcatactcacaaatggagaatttcctcagagtttccatttattcttgtgattgtccattgtatctctgtcctttgcatcatttatatttgctaaaatagaattttgtctttacaaatgccaccctctcttaagtca

SEQ ID NO: 837 - DNA, 201 bp, Bos taurus
ttactgaattcattacaatattgcttctgttttacattttggtgggatctcaactccctcaccagggattgaacctgcaccctctgcttaggaatgcacagtcttaaacgctggacctctagagaagtcctaatccttatttcttgagtttttatcttcatctagctctttgtagtcctttgcctcttcatctcatgatgt

SEQ ID NO: 838 - DNA, 201 bp, Bos taurus
ttagaaataagggggggggggggaacactaacataaatagtataaatagaactaactgaaaaagagaaaaatggaaagaaatgtcatgatattgtggtactgaaaagcacaaaacaagatgtaatgaataattccaaatttgtcagtaaccagaaaagtgatagtcaaccaagctgttagttatgaggcaaagattttaag

SEQ ID NO: 839 - DNA, 201 bp, Bos taurus
ggaaacactgagactttttcttttttttttctttaactgtcattgtctgttataaggtgattgttaatgtgccttgttaatgaagtttaatcagttcttagcaactcaattctataaaatggtccaagtagaaacagctttggggagctggtaaggtaaggaatagtaaaggtcattctaatttcccccattctttgttca

SEQ ID NO: 840 - DNA, 201 bp, Bos taurus
tattaaaggaactcttatgtatttcatctctatggttttacttttcacaataaaaatgggggttggggccagggaacagtatttcagggttggtgacaatagactcataaaggatacaggtttgactcagaaaaacatgaaaatttggaagctactgttaaatttaaaatactggtcaagcactatgctaggtgcataagg

SEQ ID NO: 841 - DNA, 201 bp, Bos taurus
tgcatgcccaaatctgaggcttgtcaaaaaaacaatgaacacaccactcatcacaagctaacaaggtacagattacaagtagaaacataatattgctgacgaaggggcaagaaaggaacaagaacatgtagagatactgtgttaaaggcactgcaaactgaaaatcaaaatctcagaatctagcatttctttggtaaacca

SEQ ID NO: 842 - DNA, 201 bp, Bos taurus
acactttgtgatgaacttcacctttccagctgactttatgtagcaccatgttcattatccagaataatagtcatctttaatatgtcacaaatctgaacagcgatgacatctgttcccaaagttcagcaaaatatattaacaaggcttagactttatgaagaaagaggttgtctaggtgattctgagagatttcttttccat

SEQ ID NO: 843 - DNA, 201 bp, Bos taurus
tagaaaatgatatgtatgtttcacctggtgtaagtggaggtgcttaggttccctgtgagctggggatctcatgctaagtttacctgtggcctgtttatcacacaagaaatttctacagtagattctgagcacattaagaatagggtattcatcttcaagtccacagctcctaaaacagggccctcaataagaacatgtaaa

SEQ ID NO: 844 - DNA, 201 bp, Bos taurus
aaagaatcagacatgactgaatgactttcactttctttttattttcactttccccataaatcagcccacacttgcatctacgtaacctggatgggcctctgccagctcagtcaccctttggggtcttcacagtttcaaaatggcatctaacatgccatccctctatggcatcccctcacatgccatgccttgctttcagga

SEQ ID NO: 845 - DNA, 201 bp, Bos taurus
tttgggagatgttgtttctccactggccttcagtctcagagcaaatgcctggacatgcagggacagcacattgtcatgctgatcaccagagacttgccaactcttggccaaaaaggaggctactaagactggaaaatcaacttggtgggaggcacctggtaggcagcaaactctcttacaccaagcagtgaaaacaagtaa

SEQ ID NO: 846 - DNA, 201 bp, Bos taurus
ttttgcacatggagatgaatctagctattatagtagattttggtggaatacaataatatttcaatctgacaagcaattgactctgctttttccaaattcaatatttcttaaatatagtgccttaacagattaggtttacataagttcaaagtagagttagaaagactttttcacttaaaaaaaaaaaaagattcttcattt

SEQ ID NO: 847 - DNA, 201 bp, Bos taurus
agtctttctttttacttgattattctggctgcagagtccagaaggcaaaactcttctgctaacagggacagcttgatcagaaagagttattagaccatgagataaatatgtgcacttagtgctgggacactttgggggaggataaagtaaagacaggaaaggaatgtctaaaaccgttctggccacaatgagagaagcaag

SEQ ID NO: 848 - DNA, 201 bp, Bos taurus
tattagcaactttctccatcaaacttttgatgagaattaatgactgggagaaaaatgacctttcctgggcaactgtccccttatctttccctaaccattcgaagtggatttttttaaaagcagtgccttccaatataaacttggcaaagggaagaaagagcccaactatcttgcttagtctatgacaaagaatggttttca

SEQ ID NO: 849 - DNA, 201 bp, Bos taurus
cttctggaggacatttatttgaacataattctggtcactgtaggcccccagcccttgcagatattctagactagaggccccatgtgccaactacaagcttctagcaaaatgtttactttcaagacaaataagacagtagaatgaaaagtggccgttgctgtctaaactctaagattttacctaaactgcaactcttctgat

SEQ ID NO: 850 - DNA, 201 bp, Bos taurus
gctttgcccttggccatgatattacttattatttggtgaaggaaactgacaacagtcatctgaaaagttttctggagattgtatgcaatggcctttctcacgatttttctcttgttttctaaaagctagtgttttccttttcattttatccaaaggttttaataaaaataatataatacaaaaaggccacagagtactaag

SEQ ID NO: 851 - DNA, 201 bp, Bos taurus
tgtgctcggcaacaagaaaagccaccaaaatggcccatgcactgcaacaaagacccagcacagccaaagatagatagataaaatcatctgcaaaaagagagagaggccagggcaggtaagagtcctagccactctagacaaggcagttgaccaagggccaattaagtcacaagagacttgcttttaaagaaaagaccaccc

SEQ ID NO: 852 - DNA, 201 bp, Bos taurus
tgcaagtgtcagatttagtccaagggctcctgactctgctcaggagctctgagcggcatcaggagccctgtggttctgctgactccaacagaaagagctacagaatgcttggcttggcctcctccaaatcctcaagaagactgcagaatctctatgtccagcgacactgtgctcacggccccaggccctggctgtagccct

SEQ ID NO: 853 - DNA, 201 bp, Bos taurus
actttgacacccccatctaggcctccatctccccactctgtgtctgggctgaccttctctgttgctttgagcaagagaatgcagcttgtgccactttgagtctaggccttaagaggtcatgcagtttccagcctcctcctctctgaagtcctgtgacccacatggcaagaagaactccaggatgaaagctcacgtggagag

SEQ ID NO: 854 - DNA, 201 bp, Bos taurus
ccaattaccctcacattactaaccttggcagtcttccctcatcctattccctggccactccttctgtgaatactgcacactgctgctcagctctggtaatctgtataactttttttttttttttactttgcatttgggcaaagaatccagcgcctcatcctattttatactatttcccaggctcttttcacatatacccta

SEQ ID NO: 855 - DNA, 201 bp, Bos taurus
cccagagaggcccctgggtctcaggggagtcagccctgcccctgcccccgctaccaccctcctccccagggacctaatgaggccaggccacaggtattactacctcagttttttactttgtattatgctctattggaatctatgagccactgcttaggaagagcagctagaagcctaccctcccaggaactgaatttccag

SEQ ID NO: 856 - DNA, 201 bp, Bos taurus
aaattttaaagtaaaaataaattcacatataaaaaattggattgtgatgatgactgcccaactctaaatatttactaaaaatcattgagatgaatcagttgtatggtttgcaagttttacctcatgtatccttaagaggaatcagttgtatgatttgtaagttttacctcagtgaagtttctttttttcttttcttttttt

SEQ ID NO: 857 - DNA, 201 bp, Bos taurus
aggaaccgagggtttggggacagagggcagacgagggacgcaggctgaagaagcacagtccctgtcaaaccaagcaggcctgtgctgtgtggtgtgagggcgccgccaacagccccttcctgaggctcctgggggctagccttcctggctctgttctgaagtcattcagagcagaaatgcgcgtgcccggccccaagtccg

SEQ ID NO: 858 - DNA, 201 bp, Bos taurus
aaaacttgagaaaaaatatatacacttaagcaactaatttgtttccatcattatgcctgtactatttttatggtaattaatttcagcgggttgtttgtaacaatgacttttgtattagcctacattatcatgtctaaaaacatggattagggacataatgcacagaaaaactgctcgtattggtggcaaacaagtggctgt

SEQ ID NO: 859 - DNA, 201 bp, Bos taurus
aacaaaaaatacaaaagggaaagaggaaaaggacagatcctatgtagttaaatgaagataagatcctatcagcagcaaaagtactattttatctatgagaggtttcatacagattccatgagaaccacaaaatgtaaatctagagtagaagcatgaaacataaaaaagtaggaaactatgaaagacagaaaacctctaaac

SEQ ID NO: 860 - DNA, 201 bp, Bos taurus
tcacagatttctgtgatagtttataaacatctactttgacatatttatcaaagcattaaatggaaaaatggaatattcataattgtcagtcactgtctgtttatcttttttccagacaatgtagaagaagagatggaagatgatgacctatttgaaaccgagtttaggcaatataaaagaacatattacatgacaaagatg

SEQ ID NO: 861 - DNA, 201 bp, Bos taurus
tctagtttcctgactagggatcaaacccaggccccctgcattgcgagcacagagtcttagccactggaccaccaggagtgcccctgaggtttctttcttgactatagaaactcaggccttgcttttaatttcctgtaacagcttaaggaggaggtgtagaacatctgaccctacatagacaatcactccagtaggtggagg

SEQ ID NO: 862 - DNA, 201 bp, Bos taurus
gcggctctcaaattggcctgttctttctagcaaagtcttgttagttccattaaatgccgctccgttgagtatttatttttctaccaatacagacacgactctgtaagcctttggccccggtctgtaatctggggttggttgaagatgccttgtcagctagttttgttgtaaacgttgtcaggggttcaggctttgctgctt

SEQ ID NO: 863 - DNA, 201 bp, Bos taurus
cggagggcctttgggttagcatcagctctctgtcacaccaagtgctgaacagctaaggagcaggagtgggactttgctcatgagggctcagggtgaggctttggcgtcatctctgggccttcctcggcttggaagacccaggctgagacagccaaaactcagaagaaacccattcctccctgggcagaggccctcacgcaa

SEQ ID NO: 864 - DNA, 201 bp, Bos taurus
tccagagctctgtacagaaccacagaaaagacaaaggacactggtccactgcagctactcaaagatcattcattctttgacaagaaaaggtgtgttactaccacagcagtgtggttatactcagttctcaagttaaatgagtggccaatgtgtagttgctaagaggagaggtggccttcagagcctagtttaactacaaaa

SEQ ID NO: 865 - DNA, 201 bp, Bos taurus
cccccacaccctccccctgggctggggcctgccaggcgcaggtgtcagggaacaagatggcgccccacagtgaagggcgcggtgtgagggggtctgggggcggcctgcacttactccgaggcgctggctcctctgaaacccagacgctgccaattccctgggctcaggagttctaaccgccttcttgctctgggttcttca

SEQ ID NO: 866 - DNA, 201 bp, Bos taurus
tcggccctcagtagagactcaggcctcagcagagactccacagtctgctcactcacagcccagaaagcaaagtccacaggaagagtcactgccacatcagtagggggagtaggactgtgacctacttcagaatagctcccacatctcctaatcctcagacatcactgtccatggaagatgctcttgactcaatatggcatc

SEQ ID NO: 867 - DNA, 201 bp, Bos taurus
agggaagggcatgcggccagggctggagtttgtgcagagcactgcccagcaaccagagggtaggaggggctgggaaggcagtccttgaagcactgagcagggcaggagagggcccaggattgggcagagagccaatgggcagtttccctgcccatcctgggtagattgccccacgccctgccccctcacccacctcctttg

SEQ ID NO: 868 - DNA, 201 bp, Bos taurus
gctttggtgacagtttttttccctggatttaaaagcactgtgtggtaccccacaatcacaggttggtgattctcagatgtgcacttggaaatctagtaaactgtttctgtgagccagaagtaccagagttttatctgctgctctatgaatatgctcttcagtgtgtaccgctttaaactgaaaggatcaattccattttct

SEQ ID NO: 869 - DNA, 201 bp, Bos taurus
tccagtccgttacaagaactggtggcaagctgaattgggcccatgattaatgtttcctcaacccttgctctggatcgtagcaggcttcctattaggaaaaaccctcttatgtttgcacggccctgacacgccacttcctatactctgtacctacaaccccaaagtgaaataaaccattgatttgcttttcccaccacttgt

SEQ ID NO: 870 - DNA, 201 bp, Bos taurus
tcccatctgcttgttacagcagtggggacttccagtcttgctcttctctgcttggttgctttcttcctatacagtgcccttgagggtacatattgtgtcccggccatctcaggttattccaagtaccaggcatggagaaggtgcagaaaaaaggagatgtaaaaaaaaactgttgataaacgaatgaacaaatgggcattt

SEQ ID NO: 871 - DNA, 201 bp, Bos taurus
ggaaatctgttcttggatctcagctgcctcattcctctttgggagaagagaattcccagggcgacagttcatcagaacggcaggtaggaaagtgaagaatgcactgcagctgtgtaggcaatgtaggctacatggagaaggtcatttgaccagattatgccaggtaggttacgtgtgtggccactgctaggaccaaagtta

SEQ ID NO: 872 - DNA, 201 bp, Bos taurus
tggcccccagcactgccttttctgtgccattcttcatgaagtgggggaggagatgggatctgtttgtataacttggggtccagagaagaaagcctggaaggaggccccctacaatagagagcaaaggcacaaaagtgcgggatgaacccttcagggtcttcacagggtggaagatgagagctgagtgggcaggaggaatgg

SEQ ID NO: 873 - DNA, 201 bp, Bos taurus
ccccgaatcttgaaagcgttgcgctaaatgaaagaagactccgaagaacatataccctcttcttccatttcatggcattctaggaagagcgaaactgtagtgacaggatgcagactgtggtggcctgaagccaggagctttggggggtgccacagggaacttttggggatgatgaaaatgttctacatcttcactgtggtg

SEQ ID NO: 874 - DNA, 201 bp, Bos taurus
atgcatagttttgtatgcctttaaaaaatttttatatttattgggttagaaatcttattctactattgttttttttttttttttttctgcccttatcactgttcttacatgatatgttcttacatgttgctatgcatgttgggttggatttcccagaaaacactatgagatagaagattagcctgaaagaagtttacttag

SEQ ID NO: 875 - DNA, 201 bp, Bos taurus
tgtggaatgctttctggcctccatggtgtcctgtggttggagctgccagtagggcagccctgcaggtctcagtggctgccagcaaggcaggttctcagagcgctttggcgggaaccaggccctgctgtggccaaggacctattcttggttttggacttttcatataagcttctatggcctcaagaagaacaaaggaaaagg

SEQ ID NO: 876 - DNA, 201 bp, Bos taurus
aatggaaatttcacaaatgggaactggttcccttgccaacctcaaaagtaccagaaaaactccccacaattacagtcccaaaggggcctgttcacacagcgggcttataatgtgtgtataagtggagtttggaaggcttagaaacatgccgaggcaagggctgtattactgactatcaatttcacagcactgtgtcctatt

SEQ ID NO: 877 - DNA, 201 bp, Bos taurus
aatgaggtgagaagtgcttcctcgtcccttagttcctgaagcgtttgtgaaggtctggtgttatcttctttaaatatgtgatgggattcaccagtgaaatcagctgggcctgggctttcttcgtgggaagatatttcattactgctaatgctgctaggtcgcttcagtcgtgtccgactctatgtgacgccatggacggca

SEQ ID NO: 878 - DNA, 201 bp, Bos taurus
aaaagttctcttaattacaacagaattaaatagagcattcttcagccttaaccttgttatttttcaaggtgagttattactaactcaattctaggatggcgttcagtagcctctctttgtagcagctgtctgcagagctatttagaagggatgtatctcaggctagatgcagctggagatggatggagtataactagatga

SEQ ID NO: 879 - DNA, 201 bp, Bos taurus
agcctccatgactgcatgaatcaatgcactcacacacacacacacacacacacacacacacaacccacacccacacaggttctgtttctctggacaaccctgatgaatagacactgagctaaaaaaaaaaaaaagcatgaatacttaaagagtcagtactaagctgtctcctagaaatcatctgatccacatctcttattt

SEQ ID NO: 880 - DNA, 201 bp, Bos taurus
acttcagagaaaagaggagccactgtctaatgggagaagcagggaagcttgcttctgctggagggtttaggtacaggtgtactcagagtattcctgtcacgctggagagatgaatatgcagacgtctgatccaagagtccctgcttaaggcaccaagcaagtctgcactgatactgggcacagggagcgctcccctgaaat

SEQ ID NO: 881 - DNA, 201 bp, Bos taurus
gattcctaaccactggaccacttgggaagtccctgaacttgaatgtatgaacaagggagaactccattctggacgtgaaagggggtcttcttgccttaaatccctaagaaatgcaccccttatgggtagaatagcaggtacagtggcatgtgggtgagagaaagtatttggacccataaggacagggcacttcatggggct

SEQ ID NO: 882 - DNA, 201 bp, Bos taurus
tcaagaaaatgcagtgtaatgtggctattttatacactgtcagtagggttataaaatgatacaagtattttgaaaagcaatctggaatcatcttgcaaatttggatagtcacccacccaaaggccatcaacagcaaaatggacaaataaagtatgtatatgtcaaactgaaatatagatacacacagtaacatcttaaagt

SEQ ID NO: 883 - DNA, 201 bp, Bos taurus
ccaaacagcctgctcaaccaggaacaggagctggtgttttgggatcagggctgaaacagacccagccttggtgaagtgaactttacaaagagcactattccagcctgagaaattcctaaggcaaaaggacacttaccagcaaaaataaattaagtgattttttttttttttaattaagagcttaagcttatcagggaatct

SEQ ID NO: 884 - DNA, 201 bp, Bos taurus
aggtgtgtgggtcagagagaggaaaacccagaacctgatgtggctgaacaaagcgcagataggaggaagaaccagcaggcgttgagattttaggattttagcctctctgatctttctgtttccaaaaaagatgaaaaccaaactgaccaatcagttgccccagccttagatcaatgcctgaacttgatctaacgcctgaac

SEQ ID NO: 885 - DNA, 201 bp, Bos taurus
cttttccatctccctagtttctgactcagttgaagaaataccaggaaccgaagccgctgttaagacatctggagaagacccactgtctcctttcctgcagtggtgggatagccctctggaatctcatctccttctggacttccctgactctttttaggctgagttttacagtgtataccctgctgcttcagcttgcccttt

SEQ ID NO: 886 - DNA, 201 bp, Bos taurus
tggtcatcaaagaagacaggaaagatttctgggaacagggggacctcagttggacatgaaaactgaactgtttgagaggaggctgtgtcagatatctgggatcaccatctggtttatcactagcttctgccttgagttgcttgtgacagtctatattttttaaacaatgaaattcctactgctgctgacccagaagcatgc

SEQ ID NO: 887 - DNA, 201 bp, Bos taurus
tatcatcacctgagttgggtcttaacagattgggatgtgctgtgagtattccagttggaagaaactaaagtagcatatactgggttggccagaaactttaagatgttatggaaaacccaaacaaacttgttagccaacccaaaatcaaagcacttgaaggtgaagcaggaggccatgaggagctcacagagaaaccactga

SEQ ID NO: 888 - DNA, 201 bp, Bos taurus
acttccgagaagagggaacagcactgcaaaggcctggggcgcttggaggattgtaagcggctccctgggctcagttggctgatgcaggatgaggtgggcacatccggacacgtggccagcactcgggtgaggcaagtgaagactaaatagataggatccaaccctgcccttgtacgatttcccttactcccctctaatcct

SEQ ID NO: 889 - DNA, 201 bp, Bos taurus
gctgcgacaggaagagtatctggcgggtgattgcagactatccagtgtcagctcattgttccgggaggaagctgtcaggaccagacctcccgggagtgcccggggcctctggttcttatttttccctttgtaggtgggaagatgctagaggtggcagtggggcagccatcatcctttctcccacccaactggacactccca

SEQ ID NO: 890 - DNA, 201 bp, Bos taurus
cttaatctttcaaatggccacgcaggcatattgtgcctatgtgattcctaccagttgtaggtcagtcaggatgacttctaggccacttactgaagcaagagttaaggcagccctgcctgtttaaggtgagtgtgcccaggattgccctgacaaggaagcttgcttgttatctgagtcatggatgggctggttctgactgca

SEQ ID NO: 891 - DNA, 201 bp, Bos taurus
aagattctgacaagctgagttacacagccaattaaaagaaagaaagagactgatcagaagagaaaatcaggtccctctatgctgggcccccagtaactgcctttatctcaggacaggaccacgttcccttggaaggggagctcacagtgacaattcatagggcccagaacaatgatgagcccaaatgtgaaactactaagg

SEQ ID NO: 892 - DNA, 201 bp, Bos taurus
ccaaacacccagcccagcctgcagatgtagattattgcaatggttcccagcctttctggaaccagagaccagttttgtggaagacagcttttgcatggcctggaagtggtggggatggtttcgggacaattcaagcaggttacatttattgtgcactgcacttctaatctaatgcctccactgatctgacagaaggtacca

SEQ ID NO: 893 - DNA, 201 bp, Bos taurus
ccactcatctcacgggccaggactgatccacatgcttgttcctatttgctgacaaaaagatgagagcactatgtcagctaactgtggtctgcccaggagtagggccagggtctcagcagtatctgagttacctgcatcactgaagaaaattaggattctctgaagaaggaagagagggagagatggctgttagaggggcag

SEQ ID NO: 894 - DNA, 201 bp, Bos taurus
tcatcatctaattcatattcatgtaataagtgttctgcctgttgctgaatattaggagggctagaattaccttgtaatggcaaaatcacggcttcaatatgagcccacaggggccaaaaatctatcgggatattttttccctgtctggtggcacgttcaatattctctttggcccagtgccaaatttctaaatcaaaactg

SEQ ID NO: 895 - DNA, 201 bp, Bos taurus
cgttgctgacccccatcaatacacagaggggtcagctgcccagagggctgcttccctggctgggagcaggagcctcaaggccttctcttctgaatccagcacatcctttctccatggattcctcttcagtgactgcttaaggctctctaagtagggctgtgctataaaactcagagaattgcctggtcattcagtgtttgg

SEQ ID NO: 896 - DNA, 201 bp, Bos taurus
gtggacatgtgactgaagctggccagtcagtaagtttcacctccttgattacaatgattgtattgtggatgggcataaaatacaaaccaggtcagagactcgatttggggcatcttgttgggccaaaggggttgttttcactaggtccatttgcattgagtctgatgaacacttgaagatggtagaaccaattattgaata

SEQ ID NO: 897 - DNA, 201 bp, Bos taurus
tttgaatcaataaccccagttttattctggctgttgaaggcatgcatgccacatgtaataagtttaaagctcacacaattaaaagaaattatttataatctgtgttccctagtaacaaggttgtggtttctctgacctaattctggctctggtgaggaatattgtgtcttaagacaatggtagtcatgaaatctggagtct

SEQ ID NO: 898 - DNA, 201 bp, Bos taurus
ggtgggggctggggattagggagaggcttaggacccccacgtgactggtgcttttgcttccatttgcttctttgtgaagttctgtaatgaatgggccttgaggagaatctctttcccccttgcatttccttttctttgctaatcttgccacaaagaggtcctcagtggagggccaagcactgaggggaaggagctggggag

SEQ ID NO: 899 - DNA, 201 bp, Bos taurus
gagggagcaccagaaaggggagttagcctctcaccatggccagagggtcctcatcccaggatacatagggtgatgaggtcagggaaggctgaccatttttattcagtgaactatcacttccagctctgtgaacccatttctttcaaggaccaaaggctacagtagctaaaatgctattgcattttctgatgcagctaatga

SEQ ID NO: 900 - DNA, 201 bp, Bos taurus
cgaagtcccttcagtgcctgcctcgaaggcggggatcccgaatgcattgcttctcccagcccaagagtaaaaaagtttggaaacggccaccggctgccagagtagcgcaactcctccacttggcagcaaagaggaagctcgtggacttctttcggtctctatccggcctaggcacctgctcccttttccaactcgtaccaa

SEQ ID NO: 901 - DNA, 201 bp, Bos taurus
ccagcccctgtcctggccccacatggttaaaaagggaatgattcagggctctgtagattaggacttcagggatgtgatggaagcaggaagcagaattgtattagtcactaaggccccatgcctctgacaccaactccaagaacactagcagccagaattttccctcccaaccagggatgagaggagaaacaagatgccaaa

SEQ ID NO: 902 - DNA, 201 bp, Bos taurus
agaccagactgagaaatattcttaaacgttttcgacagtgatccaaggcaaattttctcttaaaaagaatgccagtctatcaagaccttttattcagtggttttcaggaccagattggaatacagaattatgaaatctatattcatcttctaatatctggactttttataaacatataataatatagataatagatgccta

SEQ ID NO: 903 - DNA, 201 bp, Bos taurus
ttaccatctgagccaccagggaacatcccctaaacatctgagctaccagggaacattctctaaacaccagggtttagggaagggaggggaaaaaccaattcaggcatttacagagattggggttttatctgcatcacattccaggctgcagagaattccttagcaaaaggaaaaaaaaaaatgccacaattccagggatgt

SEQ ID NO: 904 - DNA, 201 bp, Bos taurus
gtttctcaatcttggagaagtggccttatgtagatgtcctgtggggtacattcttctctggtcaccagtgttatatgctctagggttgccccttgtgtgggcttcatgggcccttctcttgtggtgaggccaacttcactgataggtggggatggattcaacccagccggctaccaggatttgcttggtgtgatggctttt

SEQ ID NO: 905 - DNA, 201 bp, Bos taurus
gaggacgatatgggcaaatggcatgaacctcaatgaagaggactcttaactgtcagctccgccactgggtagctctaaacaaattacctaatccctgtgtgcctgtgcttcttcatgtttcaagcagaaactgcaattctgcctttctggccaaggattgttgtaggaatcaaacatggtggtaagtgaaaaagcagactg

SEQ ID NO: 906 - DNA, 201 bp, Bos taurus
gatttgcatttctaaaaagttcccaggtgattctggtaatggtggtatagggatcacatttggcaaattgctggtttaaaatttttccatgactgacccaaatcggccaccacaatgtcaatgtcacctgccacgctttcagcagacttcctgcaaatatagtatgtctgtgtctctgtgttcagtcctgcctgcacgtaa

SEQ ID NO: 907 - DNA, 201 bp, Bos taurus
aaataataaaactcaaaataaaatagagtattttgtctcattagcctcccatgtttgtcatggaagattatataattttgttacataactggcctattggtaaggtagagttttgccactggaatcaactgtgtgtgtgtgtgtgtgtgctgtcatgtccaattctctgaggccccatggactatagtctgccacgctcct

SEQ ID NO: 908 - DNA, 201 bp, Bos taurus
aaaaaagtttttttattattacatcatttgtggttgaggtataattatcacaaatgataacacacagatgttaagtttaagtccaactgaaattggcctacatcggttccattcagttcagtcactcagttgtgtccaactctttgcaaccccatgaattgcagtacgccaggcctccctatccctcaccaactcctggcg

SEQ ID NO: 909 - DNA, 201 bp, Bos taurus
ctttgaaataagcatcagggtcaccagttgttgctaaaaacacctcttcatcatttttacttcgccacggcctttcctttccctttagtgaagtctcgttattttatgttgcagcatttgtccaaggcttccgtttttcatctctggtgcctgcagccacctctttcccaccttgaactgcagaatccaggggtaaacagc

SEQ ID NO: 910 - DNA, 201 bp, Bos taurus
acccatcagtgggactctctcaagctcttcttttaggagtaaatagcaacagcagaaaaaatacaaaaggaacaggttttgaaggccaagctgaagagcaagaagaaaatgaggtaaggtagctattgtaagcaagctcattaaggtaatgtgtgtataggagcataaaagctgctggagggttttcactccatgcccctc

SEQ ID NO: 911 - DNA, 201 bp, Bos taurus
gaatcttggagaacattaaaaggatgtagaccaattgctatatcaagaactccatccagcccacccacacctgctagggacacctggcccacagatccccataactggtccacaggcaatgttctgtgcacctcacccacacataaccccacccagtagtcaggcctcaaggtgaactaccaataacagatcaagaagcaa

SEQ ID NO: 912 - DNA, 201 bp, Bos taurus
ttacagctgtcatcttttcacagcaaatcagaccattttagagtcctcaagtcttttcaagctctctatacagaaccaagatcacagattactctctacaacaatttctccttctttaatttccccaagagtttgttgttttccccactgacctgtttaactattcttgtgttcctctgtctgggctcctgtaaaccttgt

SEQ ID NO: 913 - DNA, 201 bp, Bos taurus
cattttatggttatttgtgtttgtgtgatgttttataacttcctacactgttttttctgccctcattcactcaataagtgtcattaaatagtctcgaagaacatatctttattggcttctgactaatttattttaaggataaactataagtattatgattcctttagtgtgtgtttacatttttagaatattttaaaactt

SEQ ID NO: 914 - DNA, 201 bp, Bos taurus
ttgcccaattcagaagtatgatattacgagagattaggtattagaagaaaccagaggttgtcctttttttctttactttgtgtatctctttcttatttgacttatgacagatacatattattgaaaagataaaaaggacaaagaatagaacttaaccttagtctttaagtaatagtgtgcaggtttttttttatattgtgt

SEQ ID NO: 915 - DNA, 201 bp, Bos taurus
tctgacgacagtgaggtgagcctcaaggcccctcacctgacatggtggtgtgggtcctggcacccccgagttcctcctgagtaacgtcctcattggtgacagacttcacaacgtcagggccagtgatgaataagtaggaggtgtcctgaaaccagagaattccagaaagttcagtctcagagaaggtggtgacatggtggc

SEQ ID NO: 916 - DNA, 201 bp, Bos taurus
ttattccatagaataagtaatgaataaaatatcttaaaaggggtccatgtaatgtgaagagcaaaagacctagtttttatctacaaaaaagatttgtagcgctgaggaaaggaaaagctttcatgcagaattaacctccaaagtcagaggttatcagagggtctatggaggtcaaacaggcatttctattactaggatata

SEQ ID NO: 917 - DNA, 201 bp, Bos taurus
aaagaatccacctgtcagtgcaggagacatgagacgtgggtttgatccctaggttgggaagttcccctggagtaggaaatggcaaccccttccatggtgtcgcaaagagacggacactactttagtgacttagcaggctatggagtagtctgaacttccatcatttttcataacaagaatgagtaattccaaagaagcaga

SEQ ID NO: 918 - DNA, 201 bp, Bos taurus
gccatgttgagtatcagtgaacgcacagtggcagtactgtaacataccttgcccccctaaataccttgccccggtgtctttgtggggggtgtgcatgtgttcggtttctcagtaatttggggtgaattaagagatgtcagaagagaaggctagaattgatggtcaaagaccctagggatgatctttatgttgcaaatataa

SEQ ID NO: 919 - DNA, 201 bp, Bos taurus
atggggaaggtgacttccactgaataaatgtgtaaaggaaacagagagagacaaagccaagttgaatttcattgccaggtgtcgtgcttgttccacatactatatggaaagcatttcgctaaatctaagatgccactgatactaaggaaaactatacttttagatgctgcttagaacaaaaaaaaaatttctatccataat

SEQ ID NO: 920 - DNA, 201 bp, Bos taurus
aatttctgaaggttgagtttctaggtcaaagaccatggacatttttaagggtttcagtacatactgcagcctgtcctacaggaaggccgtgccctttcacactcccccagtgagcaagccagtgcgcatctcttgtcaacttctattagatttgtagtttctgtctgagaggccttcctgctttgtgcaatcccatcgcac

SEQ ID NO: 921 - DNA, 201 bp, Bos taurus
tgtgatattactgtccttacaagcacactttgctttgagcagtgaggtcatttgtggcctcagctaatggggaacggctttgaaattgatccagacaggagagttgcctttggattattatcaaggagaagaatttttcttcaatttgggttcagaaatgttgcttctcggcagatgccttccccagacatgttgtatatc

SEQ ID NO: 922 - DNA, 201 bp, Bos taurus
accgaaaagttggcctgaaactatgtttgccagggctatatgtgttggtagtgggcttcactgtagggaaaacaagcttggtcctttcactggggacccaactctcagtatttgttggcctggttgctttttcctgtgagacacctgccaacattttgcccaggatgcttcagccaggttacctgcattctgggagctgaa

SEQ ID NO: 923 - DNA, 201 bp, Bos taurus
ctctgtaaagctgaggctggatacttttagatgggttcattgtgaccctaaacaaccaggaagcagtgagaaactgttgggtaggcaaccagtggtgcccgtcacagctggcctctaacaattttaggtctgacctgacctagtttcttttcaaaaaggcattctctgaacttcttatctaagtatcacctctctgccacc

SEQ ID NO: 924 - DNA, 201 bp, Bos taurus
aggatggaatcccagcccagagcactgtgtcagaaacagcacaggtttcagtaagtgtttgcccattacctggcagactgaccaggggaaacatgtgtcacgggccaccaaccccagctgcagcagggcagctggtcaggtccctgctggggtgcgtgtgtatgcatgtgtgttcagaagttgactcttacccactgtaat

SEQ ID NO: 925 - DNA, 201 bp, Bos taurus
tattgctcctattttatgttttggttcttttggccatgaggctgcacccccggctttggaaggtgaaatctttcaaaattcttccatgccgatcctgtcatgagggccctcagttttccttttgaatatcagcttttccggggttcctggaagctctctgttctactgttttctgttttgcaatgactcagaagagggaac

SEQ ID NO: 926 - DNA, 201 bp, Bos taurus
actggcaagcacaaccaccagtccccacaccctggtggccaggcagcccccttttccctttaaggtgtttaacctgatggccatcacttctggccacaacctccatgccatgtctccccgtcagctccagccatcaaggccactggcccctccattcaccatgtcagggtactttctggtttaggttggtttacttgctgc

SEQ ID NO: 927 - DNA, 201 bp, Bos taurus
tagggagggcatgccccttctccctggagaacatggcctctgtcctcacccctctcactatttagggggtcagtcccactcttctgcatcattctcttccgcaccctctgcctggccctctacagtccctgtcacctgcacataggtatcctctggtgctcacagacctgctgtgtctttcttccttctgactctcccacc

SEQ ID NO: 928 - DNA, 201 bp, Bos taurus
gagccccaggccagctctgctgctgagaagtgtgagtccctctccggactacactcacccttttggtgaaatgaatggctaaaatggagtcaatggcccatctattcctctaacacatactcgcccttacagtcatccacctatcttctccctacttggcacgctcctttactaagcaggggcccagcaacacacacaggc

SEQ ID NO: 929 - DNA, 201 bp, Bos taurus
cccaaggttgcctctagaggcttcttttgaccccaggctgggctggcaggctgccggcaacactttcatctttatttttttaacaccaggccttctgtgcaccgctcctccccgttccctgcagcctaccgctcctcctgcagtaggaaggcggagaagagggccccttcccctctgtccttgccccctaaggcatctctg

SEQ ID NO: 930 - DNA, 201 bp, Bos taurus
ggttttggggggcatcagcatggtgtgggccacagaaggacaatgaatgggatgcaggacagggcatccactgttcccggaatgaatttcctgcagctcctgcccctcttctggccaggaactggggattttctgaggctctcacaccgcaggcccctctgtgacatgcagcctgggctgaaagtctgcacacatgcttcc

SEQ ID NO: 931 - DNA, 201 bp, Bos taurus
gagagcctgttcccagagtcccaattaaatcagaaccaatcaatactttctctggttcctgctgttctgctcaggaaataatgagaaaaacaagggccccagccagcaagcgtgggatggcagccctttgaagtctggagaaatcacccctgctatcaagagtgtgcctggcagctgtggcacctgcaactaaactcagcc

SEQ ID NO: 932 - DNA, 201 bp, Bos taurus
attccttatctacattcttttccttttatctcagctccctttcccattccagcgtctatatttcctgatccttcaagctggccagacaccctcaaatccacgtgcacctctcctacgtctgaaaataccccatagccagagaactgagaagaaaagtgtgtctcacccatcctggctggggagctctggccctccacagca

SEQ ID NO: 933 - DNA, 201 bp, Bos taurus
cccctctccccagactgcagaaaggccatggtacagtggcagacacatacctgctctctaaacctgagccctcttcccagatggatgctcactccatttcccaggtcctgtccagctgggaccacgagaggaggggcagtgaggtgtcagctccaggctgggaaggtaagaacgggtggactcctcctccaccagcacagt

SEQ ID NO: 934 - DNA, 201 bp, Bos taurus
atccttctgctgccaaaccagtcctcctccagccaagcttgatcttatctcttctcagtacagaaacctaatggctcctcattgtctgctaaagaaagacggagcactttgggctggcatccagactcctccacaagctccctggaacctgccgtctcagcccagactacaccagcctccctgtgggccgggctgttcaac

SEQ ID NO: 935 - DNA, 201 bp, Bos taurus
agtcagccaggcacccaatgccaagctaactctgggctctatacctccttccttctttcttctcaacctggtcaaagtgaccctggcccatcagatattacctatttttctcttcattgttctttattctttatcccatcaaagcttcctgccttctgcagttttccagttctctgaatggcccacttaaagaagtgctaa

SEQ ID NO: 936 - DNA, 201 bp, Bos taurus
gatagtgaaggacagggaagcctggcctgctgcagtacatggggtctcaaagagtcagacatgacttagagactgaacaacaacaacccaggttaagtaggaggcccatactcttaggtctttttcacatggatgggttataatgtgcatttgttctggaaaacttctctcgggttttgtttcatttttagggcctagatg

SEQ ID NO: 937 - DNA, 201 bp, Bos taurus
gtggatgggacaccagagagcacgtgactggggctggaccgataatcggacttttccctggcagctggggagcgagagcgtctggccttttagggccctaacttggatggctggctttcatgtttatatttaaagttcatttagtgagggcttaacctatgtcgagggccgcagatgacctcagggaccttaatcgttctg

SEQ ID NO: 938 - DNA, 201 bp, Bos taurus
ttcatttatttattggcctgccctcctctctctcactccacttgggttttgtgaggttttacgacatctcttctttaatcaggaccaaatgacctgtgacgttgcgcatgcctttatgtttattggccaacaccaaaaggaggatattatactctgacatccctggtgtcatacatagattgatattcactccaggcacac

SEQ ID NO: 939 - DNA, 201 bp, Bos taurus
gcaaccccactccagtattcttctctgggaaatcccatggatagaggggcctggtgggttatagtccatgggattgcaaaagagttggacatgacttagcgactaaacagcagaagcagtgggccctacattaactttcagaagctccactcatgccacatttaacatgttaaaatgtacccacatcctacaatttaatat

SEQ ID NO: 940 - DNA, 201 bp, Bos taurus
tgatgagcttctgccatgaagtctgactccagtgtggagatcccatgacactgagatctttttctttgttttagggcaagaacacccatcatgtttaaattctagaatcagaatattaaagagtaggaacaatcttgtagaacacttgatgttcttttttaaatgttctttttataggtggataaactgagactcaggaat

SEQ ID NO: 941 - DNA, 201 bp, Bos taurus
aggatactgagacaactaaaaatcgaaacttgaggctaaaacagctgtcagagaagagatccctggtatatggcaaagtggggccctggccagcagcccaagctttagaaatctggtgaccagagctgggagaagggtgagtagaggaggatgcaccactgtgggcaaaattctccaaaggctcacagattcaggccactg

SEQ ID NO: 942 - DNA, 201 bp, Bos taurus
ataaaactggggcctgtaaaccagaaggccatgtaaaaaacagtcaatgtttatacagttcatgaatttgaatccaggtatcagagcagcacagcagaagcatgctgggcccatgaatttgaacttattaatgaaataaaaagaaagggctagttgctcagtcatatttgactcttcactaccccatggtctgtaccccag

SEQ ID NO: 943 - DNA, 201 bp, Bos taurus
acaaacccaggtgggtcccaggccttctggggctccctcctggtggtgtcactcggccattcccactgttagaccaacagctactgtttagggccaaatcctcacgtcttttctgactttgagattcctgatcccgccccagagcgtgcagctcctgggaagttgagtccgtctgcacactctacttcttctgtaagacaa

SEQ ID NO: 944 - DNA, 201 bp, Bos taurus
ccagggatcaaacctgcatctcctgcatttcaagtaggttctttatcattgagccaccagggaagcccatcactgagatgattatatgattattattcttcaatttgttaatgtgctagtgtgatgttggttaatttgtgaatattgaaccaccttgcatccttgtgctaaatccaacttaatcacagtgtatgacttttc

SEQ ID NO: 945 - DNA, 201 bp, Bos taurus
atcagtgctgctcatcttaaacttagactcacctttttttcattgaagtacagttgatttataatattatattagtttcaggtatacagcatagtaattccggctttttttttgcagattcgactccactgtaggttattacaggtaacggctagaatgccctctgcgtgcagtataaagtttgtaatttattttatgcag

SEQ ID NO: 946 - DNA, 201 bp, Bos taurus
accacactgtctccaatattgtgtatcatttaaaaaattcttctatgattgaattagttgttgaattattaattggaagccaaaaagagtaacttgttgcgtttgagggtttattacccttttctgactctttccctgggaaagatgaagcgactgagcaggtatccgcagtgtcatcataacttttgtgttctgtgatgt

SEQ ID NO: 947 - DNA, 201 bp, Bos taurus
cactccctgcccctgctctgtgaagtccaggggccctgattccctgacgggctgcccaggaagctagagagttgaatgcgtcatgtgatgccctgccacaaataagaggagaaggcctcctgccgcatttctggtggagggccagcagtgcccaggcttttgcccagatatcctccagagctccaagccctgggtcatgag

SEQ ID NO: 948 - DNA, 201 bp, Bos taurus
ctcttcataagctatactccaataagagaatatctctcctatttttaaagactttttaaggagtccacagtcatcttggcaggtccacagctttgagtcatggaaccttattaacacagatggtgtttaacagctctcagtgtaggaaggaagggattttccaagagggatccaagaccagttttgagggtttaatacttt

SEQ ID NO: 949 - DNA, 201 bp, Bos taurus
cattaacatttccccaactgcatttggataaatcatgtggattcttcttagggccagcaactggtttccacagaggtgtaaatactgatgatgataaaatgtgaatgggtagggaaggcagaaatggtaacagctctcagaacttgtacatgatggttgaatcaaagaatctcaaactgtcagtgctcagaggaaatttcc

SEQ ID NO: 950 - DNA, 201 bp, Bos taurus
catctggttctgaccttttgttacatatttttgattatagaagtggccctggagggcttggagcactaacaatggataagttaaggaccctcaggggcccgtaaggatgggaagtttaactctccatgtcccaggctcaccaagcaagccacaggcaagcaggaatctttgatctggggccaggcctggaatagatggagt

SEQ ID NO: 951 - DNA, 201 bp, Bos taurus
aaaatatgattgatcaccatgcatttgttatgtcaatccatcatggagttaaatacgtgttacccttgggcactattataaataatgatatggcaaacacagctaggtttaatggtcctttgcattcagctattaaattgatgacacagcatcagtattgatgaacagagattttctctatcaaggataatttgtatccct

SEQ ID NO: 952 - DNA, 201 bp, Bos taurus
gagaattcacttcaaccttcaaggagatgagaggagcaatggaaggcaaacaggtacgtggtgagccccctgtggtatttctcccagattcgcctgtcacgatgcctcgttagcacccagacagagcagctagaggtgaaatattagtgtataattaaatgaggccaggagggagcatggagggatccataacccaggttc

SEQ ID NO: 953 - DNA, 201 bp, Bos taurus
ggccttttcatgaaaaaaggaatccaccttccttttcctgctggagtgagcagtgatggagtagcctgtctccatgacctgtcctcctgcttgtttgcctgtggcccacactgttttccctgctggccatgctacagaattccggaagcatttgttggaaatggagcacatgatgggggaagaatatagatcaagtgttgt

SEQ ID NO: 954 - DNA, 201 bp, Bos taurus
ggctctctatcctgctctgttgatctatatgtctgtttttgtgccagtacttcattgctttgattaccatagctttgtatagagtttaaaatcagggagcatgatacctccagctttgttgttctttctaaaaaccgttttgtctattctgggttttttgtatttccatataaattttaggatttctgttttgggtctgtg

SEQ ID NO: 955 - DNA, 201 bp, Bos taurus
ctaacaaaacagtggtgtgtgggatgggatcaagaagccgatcctcctgttgcagggaagaaagtgcatccaagtccctgggacaggccaccaagtgtaggtttttggctttttgcaggaaagaatttgagagcaagccatagtaaagtgaaagatttattcatggagatgcacacttcataaagtgtgggccatcttaga

SEQ ID NO: 956 - DNA, 201 bp, Bos taurus
ttcaggataccgaagacttgtggttatctcgggaagagtgtgaactaccacatgggctgaggacttgagccagaacttccgaggccctcaaggggcaggacaagctggctgacatgtgggttacagctatgaggctgaaccgtgccttcacagagaagggaaagtcattcctggtgcaggcaacagatgtaacaggcccac

SEQ ID NO: 957 - DNA, 201 bp, Bos taurus
tcagcatgttacaagacaaaacccccaactccacactcttgaaatcttccagcaggctgtaattcagattcttctcctccacctccttcatgaggctccagcctatctgtcctgccctcaaattaggcgaggccttgccatagccctaaactcctgtgattttcacctgtcccttccagactccaccaacactctgcagag

SEQ ID NO: 958 - DNA, 201 bp, Bos taurus
aagtaaaggacaattcagggcaatgcctatgaaaattctgtcttttttacaggaatggacaaactgattctaaaattcatatgggaatgcaaggggctaaagctaaaggaaacaatctcaaaaaagcagcacaggacttccctagtagtccagtggttaagaatctgctgccaatgtaagggactggttccacccctggtc

SEQ ID NO: 959 - DNA, 201 bp, Bos taurus
aagcaccatgcttttgagccaccagaatgctcagggcatgtgtgttgtgccctcccagcctgctctggccctgggaagaggggtggccctcagggcactgagcacaggcataggtccatttatacacatgttccaggaagccagaagctgccctttggcttctctttttgaaactatcaaaagcttcacagaggcctctta

SEQ ID NO: 960 - DNA, 201 bp, Bos taurus
aacaacacactagttaccttcaagttcccatgggaggggcctgggcacagctgggttagaggctatgcccagggtctactactcagggtctcacaaggctgtgtcacagtgtcagatgggccacattcttgtctggattcttgcctggggaagactccacctccaagctcagtctctttgttgacaaagttcatttccttg

SEQ ID NO: 961 - DNA, 201 bp, Bos taurus
caccctggcccttaggacacctcctgcaacatctggtgccgggcggggctcagcctgcaaagcaagttaaagtcaggtcacgatgcgcccactgacggacgggactggaagggccctgccgtggaaaccccaggatgcagcgccacctagaggctcctcggtgacactgtttcccaacttggatagaacagaacaccaggc

SEQ ID NO: 962 - DNA, 201 bp, Bos taurus
caatttgaaaagttttcatcaaaaatacttgatctgtactgagatttcatgaaacttctagttgaaaaactaattcacatactcaagttgtttaaaatacgcttaaaagttctataagtactgaatcatatccattaaaaacttaataattcgattcctcaattgcaccagccacaaccaaagtgctcaatagagatgtgt

SEQ ID NO: 963 - DNA, 201 bp, Bos taurus
tcacccaaatgagcacagcaatctcctaattgtcttcctccttctgtcttcatcctgttactgcccatcctcaacaggccactgatggatctttaaaacctgtcagatgtgtccttctctaaaaatgcttcacaggttcccatctgactcaaaggccaaggcccaagaggcccagaggagctgatctcactggtctttctc

SEQ ID NO: 964 - DNA, 201 bp, Bos taurus
tggccagggaaatccttgtaccaaagattttaaaaccaaattctccattgaccaaactttacaaattgtgcccagtgtttcgttcccgcaaaggatgttgcaatgaataaccacgtacatacacatcatgtgcatactgtataaaacaaatgtccttacaagccccagtacgggctgaaatgactattataaagtccactt

SEQ ID NO: 965 - DNA, 201 bp, Bos taurus
ttcagccactttctctgagctcagaatatcagttcccaaacccttcaccttggtccatgagaaccttatttaaggcttcaggaaactgctgatggcctgagaaacctcactggctcagtcattctaattggtagtgaattccctgggagcaccatttttcaagcttcaaagaacttctaatcagctctctaatttgcatga

SEQ ID NO: 966 - DNA, 201 bp, Bos taurus
ggagagttatgtcaaggatgttctacccacaggccttttcagtaggattcatcttggctaggagatgcgtgcatacacatgggaggttcctgagatatacaaaatatggcctgtgaaccagaacaaatcagaatgactggccaaatggaacccaaaagaaatagcccacaagaataatttaaatgccacgagggtgagact

SEQ ID NO: 967 - DNA, 201 bp, Bos taurus
aatggggccccaaggaacagagactggtacagaaagtatccacgacgctgagactgtgtttctgactttcctcattcctccctggcaggggtaggactagagagtcagaagatggctgcttctgagctccaaggaagcccaggacatgctccactggcttgtactttgcaaattaggtcttgtgctgggggaggtgctacg

SEQ ID NO: 968 - DNA, 201 bp, Bos taurus
cggtgtctacaatgagtggaggcaggagagatttcattttcctcaatgggaaagaattgaaaatttttgcacatgaatatgaaaggaaatattgagtctgaaaaaaagttcatttgagtgttttcctaagatattacagaaaaaccgaaatgaattttttggtcaacccagtatgagtgagggggtgaggcttttgtaaat

SEQ ID NO: 969 - DNA, 201 bp, Bos taurus
ttgcctgatctgagccaactgatgaaatctcaggtacttcaggatgggtcctcagacaacacggcagtatttgatcgagggccaccaccttggacttgaccgagctgtgttaagtgctgttatgcctgaagcaaccttgaatccagcaacggcatcccaggcctcagaatttaggagccacgaggtcagatatttctgctc

SEQ ID NO: 970 - DNA, 201 bp, Bos taurus
gttctggaggcaggatgctttgctggggggagagcagggccagggtgaagcccccgcaaagatgcctgaggtccagtgtctcctgggggctaccagccagtggcagactttcaagggccacaattgagaagtcgcagcagatggctagtgaaaataagagaaatgtttgctcctgtgtggtccccgtgcacttggaaagtt

SEQ ID NO: 971 - DNA, 201 bp, Bos taurus
aattaggatgacagggaggaactccaggcactgcatgatgcagaggcagttgctaaccagccccaggaggaagctgacacctgtagggtttgacggctcttcccaggccattatggagccttctggaactggcatagccatggaaacgtgccatactccctaaagtgtgtctaggagatggctgagagcttgcagggatat

SEQ ID NO: 972 - DNA, 201 bp, Bos taurus
caagagagctgtgtttctgtgaaagcatattgacactaacgtgtgtccttgcagaggaaactcgtttctgggcttgttgaaccaaagaggatattaaagatagcagggcactggctccctactgccctctttttggtagtttctacagggaaggagaaagttctccaagttgtcccagagcaaaacaatgggactagaaag

SEQ ID NO: 973 - DNA, 201 bp, Bos taurus
ggaggtagcacttcactgggccggggaggtggcccctttcaggttcggggcttcaccagttccctgggcaaactcaggccggagcaaaaccaaagtggaccatagatgatgagctttgtctgagatagttctgggtttaatgtcaccaccagtcaggcctttagactctggacaaggggctaagatgagcctcaatttcca

SEQ ID NO: 974 - DNA, 201 bp, Bos taurus
cagaccatggaggccttggctgcaggccattggtggagttaaaaattgtcacttacagacactcaaagccatcagcaggatcactgctttgccacaggccagtgcccaggaagtcactgcagctggcatttggctgcagaggttccctgcgacccactccatccccactggccagtgcttggcctggctgccttgcctggt

SEQ ID NO: 975 - DNA, 201 bp, Bos taurus
agaacttacagcttcactacaggaggtactgaatctccataatcccaggaaaaatggaagcacaatcacaggcccccagaacctaagacagcttttaccagattgctccatttcttctatttcattttgagtttgaatcactggttactgtctcaacttgccctagagctaggaacattaagtaaatttctggcaatagct

SEQ ID NO: 976 - DNA, 201 bp, Bos taurus
ctgctgttcattctgtttccaagtccaacccctatgtggccctgtacggtatgggtctttttcacctgggttgtgattatacctgactaaaataatgctgccgatctcacctgtccaggccaggagtcaatgttgggtcatccccataacggatgattcactccatctccaaaggtgaaaaggagacatcaatataggtgc

SEQ ID NO: 977 - DNA, 201 bp, Bos taurus
tgttttgcaaacattcctttagaggcacattggaaaatggcctcagggtctcaagaaggacacaggaagacctttagggaattagcctgagtccagagggtaaatgagtaagacctggtttggccttgggatgaagacatttgtatggtataatataaggaaatatttaaaaggtgagatgatcagtcagaaatcctacta

SEQ ID NO: 978 - DNA, 201 bp, Bos taurus
acatttttgttcacgcgagatatttcccctccagcaattactgttgggtaacactttttacttgaaataagaataaggctccagcgttttattaaaattcttttcccaagccaacgataagccagaggctttcacccgggctgggttctcagtgtctcagtgggaactgggaagagagaacagggaaagctggagttgggg

SEQ ID NO: 979 - DNA, 201 bp, Bos taurus
caaggacctaccttcttcagctctaggaaattatcttctaatattccttcaaaacctgattcccttgtctttcttaagtttctctcatctgttggccttttgtctttgtttgtctcttgtcacttaggtgcttgtaaatatttctttgtttttaattttaattttttaacacctaaaacatgttgtattggggtatggcca

SEQ ID NO: 980 - DNA, 201 bp, Bos taurus
acatctataatagcagccatttttaggtacctaccatgtgccaaaaatgactatatgaagatgactcagaagcctgtgaaatcttgacttctaacagaacgttttgtgcctaatagtttctatgctttcccccggctttcatcctgggaggagcattgtacctccaacaaggtacctccatcaccttcagtccaagaaaat

SEQ ID NO: 981 - DNA, 201 bp, Bos taurus
tttctttcttagaatagctcctgaaatttccctgaggaaaaagagtcttagaattctatgttaagttcttcgtggtgccccttcagctgctgatctcctcgtgtgtctgggagcatcttgtctgcacgtatttggggggaaaaagctaagactgacgtatcttggtagctagtgcaggttcattctggagccagtttagtg

SEQ ID NO: 982 - DNA, 201 bp, Bos taurus
caggtgggtagaggatgctttcctggcctcaggaccaggttcaaagacagagcacaactcctacaggcctcagggccctggaatcctctgttactttgggctccgcacagagtttgacctacattcctcagtccccaaggctacgggccactgtgagtgacacatccactcagaatcagcagcaaaggaagatcacgtgga

SEQ ID NO: 983 - DNA, 201 bp, Bos taurus
aagaaacgatgttctttgagacgcatccgtatttcaggtaagattctttacgacagccttggactcgatggaaaccagccctgcctaccagaattggccaagatgattaccatatttaaaaattatacaattaacatcagttcagttcagtcactcagtcatgtccagcttttttactctttgtgatcccatggactgcag

SEQ ID NO: 984 - DNA, 201 bp, Bos taurus
agcgggcgtgggctccctcccggcaggtgctgagtcaggctcggccctgagaagtggggacacgcacacgtatgtcacagctagtacaatgcacacagacacagacagtgcccagggcccggggaattgatgacagcttgcaaggaagcagacatacgttcagactttgctcacatcacttgaggaactctgacaaagccc

SEQ ID NO: 985 - DNA, 201 bp, Bos taurus
ttaacttacatgcagagtaacagtctaagtgatgatgctgtaaatgtgataagggtgctcttggctcatggaagtggcctgatcttgctccttcttttctgaatcctcatccctgctccctagcctctcccctgagctggtggaagaggggtgagggcctggattcccttctgagggctttctgtttctctcctgcagcct

SEQ ID NO: 986 - DNA, 201 bp, Bos taurus
ggtcacctcgtgccctccattgacagagatcttcaaagaaatgcaaacctgaacacactaacaatggccaatcccagcgggcggcccctggtttttagttatattatacctcatgcttttctgctttataaacttaccgaaaaatagatcagaactaacaggccttgagtgaagacaacagaaggcgtccctccagggctt

SEQ ID NO: 987 - DNA, 201 bp, Bos taurus
aaaggcatcactcaagcttcttcacctgcctctttgtctccctggctggacagccagaggactggctgctggccgccacctcggtggccctgagcctcacccaccacccctgaaatgggtgcacacgtgtgagctgtcactcagcacattcattcattcattcggggcgctgatgcttctattactcagctaatgaccttt

SEQ ID NO: 988 - DNA, 201 bp, Bos taurus
gtttgcttgagggtgacgaggacgacagcttaaagtataaacttgtgcccgcgttgcccgatggacagacgtactgacggatgggcagcctgggccccagcggggctgtgatgggccacttggaaatgcaaacgcgcagcttcttcctctgtgtttgacagaagacattccgagaattccttcttagcgaaatgcctttta

SEQ ID NO: 989 - DNA, 201 bp, Bos taurus
tgctgtggccacggtggccaagctgagggagggccagcctgccgggtgctcgccatcagcgacccttggtggtccttggggccagtggggcactggcagctcctcccactgtgaagcccttatacaggcaccagggggagtgtgaacttgaaccagagcgcgtggcaggaagcctggctgtgctggaggtgggccagcggg

SEQ ID NO: 990 - DNA, 201 bp, Bos taurus
gacaggaaagagatgcctgcctgctacgtcctgctcagcagatgaaggcttggaaatcccaggactgcagcccagttcctggccctcagtcagttccctccacccctcaggatggtcctttgttgggtgtgccctccaatgaccctgttttgaaagaaccatctgtttctctctgggatcctgatctcagagggctgtgca

SEQ ID NO: 991 - DNA, 201 bp, Bos taurus
tgggacttcctcttcctttttcttctacaaacgtctatgtaccaacatgtcacctaagagacactgacatattccgaggccccagtaggtcctgtttcagactgaccttgatgtgcacataaccaggcaggcgtcggcggcggttgaagggcgtctcctttcagctggccccggcgcactaatcaggcctggtcccctccc

SEQ ID NO: 992 - DNA, 201 bp, Bos taurus
ctccgcacatccttctctcctccgctcttcccatcctgtctcctcctccacctctggcccgcaagcccagagccttcttgtcctccctccctggcctggggtataaacaccctcccctcctgactggtctccaggaatcacagctgcctgagttttctgtgccctgcagattgcaggcccccttgctgccacacagcccct

SEQ ID NO: 993 - DNA, 201 bp, Bos taurus
catggtgaactcatccagctcactgataacactgcacaaatttaacagggaccttaaagggggacagaccacctctctgtgaagggccggagcctaagtatttcagactgtgcaggcaaccccgcaactcagctgctgcagccctgaagctggcgctgagcacccctaatcgagcaggtgtggttgtggcccagtgagatt

SEQ ID NO: 994 - DNA, 201 bp, Bos taurus
acgtaccatcagtgtggctgtcatttttcttcaactctttgaagatgttaaaacacaaaccattcttggtgtgggccttacaaaaagaggcagagagcggatttgtctgagagccacagttttaagttttaacaccccagtgttatggggcagccacaggccatttaattcagtgaagggtgggctaaactagtttgcttc

SEQ ID NO: 995 - DNA, 201 bp, Bos taurus
cagcgaatggtcagagtaccctgctgctgggtgcccttggctggcaactgtcctcgtcttggtgtgtcagcctcactggtctactcactgtttctgggaggtttgcagactgtgccggatgctggcccagccaactctttgtgtgacgaggtggcttcagactctggatgtggaagctctgtggctctgaaggtcacttct

SEQ ID NO: 996 - DNA, 201 bp, Bos taurus
cccccgtccagtcccaggtatttacgtcagggctgcacgcctgttggggcactgcggtgttggcaggggtgaagcgtatccaaggccactagccctgtcaagatcggggtgggtgggggctgtacttggctgtcctgctctgaggagcccccaggtctccaaacatggcctgtgctgggaacacacacggcccctcaggcc

SEQ ID NO: 997 - DNA, 201 bp, Bos taurus
tgtggcctggaccagctgctttcaccagcaccctggggacagttgtgctggccacatctgcacaggcttcctgaggctccacaggcctgagaggagcaggatgagccaagggactgcgcaaggcagccttgggaaagagggtgacattcaagcctggctaagggtgtctagaaagatcagagctgtatggtctcctgtcca

SEQ ID NO: 998 - DNA, 201 bp, Bos taurus
gggcctgcagtccaatgatgggtgtgcttaggagaagtagacacaggtgcccaggaagaagccatgtgatgacagaggcagagatgagctcacaaaccactggaggccaaggaccgctggtcttagccagacactggaaggaacaaggaaggagctgtcagatgggccccagagctgtcagatggaccacaaccctgcctg

SEQ ID NO: 999 - DNA, 201 bp, Bos taurus
ggaagaacagccacctgagagacaggagatggaccaggggtcctgggctgcagtaggggagcagaaatgtggggacccaagggtggctgacctgggccatctctgcaagcctttgggacggaaacactcagcatctcagaaatagagcctgtttgtctgcctctcccaacacctgctgatggggagcgcagattgggggcc

SEQ ID NO: 1000 - DNA, 201 bp, Bos taurus
cacacacaaacatttcacagggacgacaaagtggcttccaaagaacaattaaatgtggtccttccccaccatcaagtgaccgaaaccaacactccctgaggtgcagcaaggcctgagtgaactgtggctgtggcgggtggcggtctcagcaggaccagcctggaccatgctcggccagcgggggacagggactgggtcact

SEQ ID NO: 1001 - DNA, 201 bp, Bos taurus
aaccgtgttactgcatctgcggtggcctcgggtcctcccagtgaaagaccctgagcagcaggatgcaaggaatcccacgtccctgtgtgagcgcgctgcccgggcctaagcatggggtctgtgaggcacgtgatcattggatgctgcactcatggaacgggaggcagaaacatgtgttctatttgtttcaaattctagtga

SEQ ID NO: 1002 - DNA, 201 bp, Bos taurus
tccccccaagcccccactgcttccaggggccccacagtggctccctgccctcaagcagtactcaaggatgcagtcatgccctcctgggaggacctgtgggtggccttcagagtcggtcctcttagcgtcatttctggactcaatggccttttccagacatacactctgggagtgaggtgtcttgctggcttcctggggtca

SEQ ID NO: 1003 - DNA, 201 bp, Bos taurus
ctcaggtggacgcccaggtatgggccccccagcgaggagcccagcttgacctggtgaagggggaccaaactggctgagctggtgacaggcaggcaggattcagggcctgatggggtctgtccctggactgattaccaatgtcctcaggtttacactaggatggggctccctgatgatgagcagtagcttgggtaactgggg

SEQ ID NO: 1004 - DNA, 201 bp, Bos taurus
cgggaggggtgggagacaatgaggaggtggtgcctggcattcagggataaatggaatctgctggacctcgtcctcctgagcctgagccctgtcgctctcacggcccctcccctgcagccttggccacagctgtgtctgtcctgtccctcctccagggtcagctgcttctccttccaaggacccccttgccagcttggcttc

SEQ ID NO: 1005 - DNA, 201 bp, Bos taurus
ctgctcctgtcgctgcagcaacacccccaccccaaggccccccagctcctcctgagtggaggacgtgctttcaccaccagggactcaagtgcccctcccacgtgaccaagggccccggttagagatactggcccaagttattcttaaaaacaaaataaatgagacccaaacactggatgcctggttcaaacactggatgcc

SEQ ID NO: 1006 - DNA, 201 bp, Bos taurus
tagaaccttatttggccctcacaaattctgcaggtcaggggtcagagaatgtatttttttctcccgtttgatgattgagaagttgagagtcggagcccctaaggccacactgcacaagctgcagggaagcccgttttctctctctaggtcccgtcgtggtttcccctggggtcgctgggctcacgtctcacctgctgtcag

SEQ ID NO: 1007 - DNA, 201 bp, Bos taurus
tttcccacagttctagaggctgggagtggaggtcaggtgtgggcagggtggtcccttctgaagcctctgcctctgcttgtccctggccgcctcattccacgtcctcaggtggtctttcctcagagtgtgcagggaaggaggggtttctagttctcctcttacaggggcactaatgctgccatgtctgggccccaccctacg

SEQ ID NO: 1008 - DNA, 201 bp, Bos taurus
ttacagatgaggaaactgaggctgcagccttgcaggagtcactcagatgcccaaggccaggccagtgcctctgcatccagaggcctcaaggttatggcctgttcagacagcacagtcgcagtctcttgggtgacactcaccctggattccttctcagtggggcactgagggcgctggcctagagctccaacagaaccctgg

SEQ ID NO: 1009 - DNA, 201 bp, Bos taurus
aagagcctgagcgcctccactagctggacagctgctgcagaggaggacgaccctgcagagcagactgagaagacggacgggaaaggaggtgacgacacaggggggaggccgagggccgtgaggcaagacctcctagagtctgcctgtgatctcgtcaccacggatgcagttacggacctcgcttttgtaaccactagtttg

SEQ ID NO: 1010 - DNA, 201 bp, Bos taurus
gagggccgacctgaggctggcctgcccatcttccggggaggaggcagtggaacaaagacttgaaggtggcatggtacaagggttcaagtccaactgacccacctggccagctccctatgatctttgagcacccgtggagataaggtgaggcccttggccctcccattcccaccagcgggggtgcagaccatgggggcagcc

SEQ ID NO: 1011 - DNA, 201 bp, Bos taurus
attcttcacgcagcccctgaaggataaggtgtgtgggtggcgtgttgaatgtttttggcttcagagctgcatacttgtagaatttcacttgggatttcccataacggttacaaacctggacccgcaggaggactgaggctctgactcaggccagttggtgccgaccctgtccttccagaagctgggggaaatgatacaacc

SEQ ID NO: 1012 - DNA, 201 bp, Bos taurus
ctgtggccggctgcgtggcggaagtccctccgcacatcatcttggcggcaagcggggcgggagcgtgcggacaccgggcggcggtcacgcgggagcggcagtcacgcggaagcagcggacactcgccggagcagcggacactcgcgggagtggtcgagcggagtcgagcgcccagacctggcgcggcggtcatgtgccatg

SEQ ID NO: 1013 - DNA, 201 bp, Bos taurus
cgtctctagggcgatgtcacccagccagcgtttctgtttgtctgttgccctgtgtgcattcctgtgggatcgtactctaagggccagcactgtccctaaatgcaagagctttccttgaacctaaaagagatgttcgagggaaacaagcatcgggaggagggtgacgtgctcggtgaactttaagctgaacttgagggcctc

SEQ ID NO: 1014 - DNA, 201 bp, Bos taurus
tcaggtctggagctgcctttccacactcggttccggcctgcctgaagtggtctcccgctggcttgtgtgttaatttacattcagaagcatgtccttggaaacacagggaccccagggccaaggcaggtgggtgctagacagaggctggcctgtgagtgctggttgcattgtccacctgtggccccttctcagcttcagcgc

SEQ ID NO: 1015 - DNA, 201 bp, Bos taurus
tcaaactggctcctgtggccttctgagcactttctaactttagacatgacagaatattctgggttcttgtccctttgctacccctgtgttggaatcagccgttttttctcaaggccttgatccccctggcatggcgggaatggccctgctgctgtgccagttgactccacagggctctgaaagcacatgtcttagaaatca

SEQ ID NO: 1016 - DNA, 201 bp, Bos taurus
gtcctgatgaggccgggcaccctgttctttctgccccgtggggaaccagagggtaactgggcctcgagccgggaggccgtcatgaccgcagccgtgacgtattttggctttcaggtcctctttctgttctccgttcctttaactctcttctccacgtttcatggaagtcctcttacgctggcctctcgggcccagcacatc

SEQ ID NO: 1017 - DNA, 201 bp, Bos taurus
tgtgggcgacgggggtgagctcgccagccaaggcatttatgggcagggagttgagaatcccagctcatctcctgtcaaatatggaaacaatagtcaaatcacctggtatcttgcggttttcaaatgtttcaatcagtcatgtaaacaacagcatgggtgtaaatgaagcccatgtgtaatggtcacacacacggaccatcc

SEQ ID NO: 1018 - DNA, 201 bp, Bos taurus
cccagccgaaccccgcgggcctggacacctggctcccaaacccgcaaggggaggcagttctgctgattcggtatgggctagtggggaagggggcccaacaaggagctccaaggactatggcacctgcacgctctgggtgggctggaagacaactgcttccagattcccgctggccttctgagacctgcggcccggacaccc

SEQ ID NO: 1019 - DNA, 201 bp, Bos taurus
ggcagatgataaagagaaaagtaacacatttgttggaaaaaacagagtacctgcggaaagatgcatgagtgtgctctgtgacagggtcttgagagtcgcccttggggaagtttattaacagatacacagcacaacaagtgggacagctcccagagaaacagcgtgtttagttcagacagaagcaaggcagagatgcgcacc

SEQ ID NO: 1020 - DNA, 201 bp, Bos taurus
ttgtttagtaaatgctatgcactaaattgttcttccctcaaattcccctgctgaagctcaaaccccagattcatggtactgggagatggggccttcaggaggtgattaggtttaaaagagtgtgaggtccttatgaagggattagtgccttataggaagagaccagagacccccttctctctttccttgccatgtgaagtc

SEQ ID NO: 1021 - DNA, 201 bp, Bos taurus
tacagctgggtgacttttgacagctgtgcacaactgttagacaggaacttcccatcaccccggaagattccttctgtccaggtatcgtccattccctgctcttcctctggattgcgggaaagcacagagatactttttgtcattttagagtagtttgtattctttattaatgtaatcgtacactatgtactcttttctgtc

SEQ ID NO: 1022 - DNA, 201 bp, Bos taurus
caccttgctcttctcttgaggcctctgccccgcgtgtctgctcctggaagccttcatctggtcactggttctggtccagtctggtctcgctcaggactcatggggtttgattccatctttaccaaacaagcagctagcttagcttctgatcatactgttcatttactgctgcgtgtggctttcaccactaagaaccctgca

SEQ ID NO: 1023 - DNA, 201 bp, Bos taurus
gtcccctgagtgcagcccccaacacacggacccggcctggagctgaggaagtgggtgagtggtgccagaaccagaaggccatgtcctgtcagcacccaggtggatgggggtagggtctgctgggcagcaccatggggccctccctccctgctgttcagcctcaggtcctgctgctcaggggccttgtctcccgaagcttgt

SEQ ID NO: 1024 - DNA, 201 bp, Bos taurus
tacctttttaaaaaaggtcaaatagtaatatcactaaatttttacatcgcaaggtcatggagggagattttaccttcacctgtttcttgcaggctcccttgaggcctaagtgcacaagtaacacctgccaatgtctgttgagaaggcagccgccattctctttgtctgtctgtcagaggcagggcagcccaccgcctgccc

SEQ ID NO: 1025 - DNA, 201 bp, Bos taurus
atggctagggacatgcctctccagctcctgtgtccactcaaacatccctccagcccgagagtgcagcctagaggggccagcgtggcctcaggcccacagaagacactgagccaggtgaggggtctccatgactgcaggctcttcatttgatgggacttcctagagttgaggcctcgaggctcccattctccagcaggagtg

SEQ ID NO: 1026 - DNA, 201 bp, Bos taurus
cagggacggccgggcatctcattggtcaaggaaaactacgccgagcttctggacgatggcttcctgaagaacatcactgcccagatctgcataggtgagtgtggcaggcgggccccgtggctctgctctccgctctccgcttgctgtgacctccggctgtggcagcagatgcccatggccagcagcgtgtctgctccccac

SEQ ID NO: 1027 - DNA, 201 bp, Bos taurus
tctgccctcagagcctctgcctggggagaagagcaacccctcctttcacaagaaggcaaggacccagcctttgcccacagagatgtggccgctccagccccggcaggggtccagcttgggttggggagagtgtgggatggggaggctggagcctgggagacctgcggctgtgtcacctgagcaggtgagagagtgggccgt

SEQ ID NO: 1028 - DNA, 201 bp, Bos taurus
ttgttgtaataaaggtgataagtgagagcccagttatcacgactgtggactcaaaaccatgctgcctggatttggagctccgctactagctgagcacctcagacaaggtacctatcttggtctcagtttcctcatctgtgaaatggaggttatattggcactaatatccaagggctgttgtaaaggttaaaagtctgcagt

SEQ ID NO: 1029 - DNA, 201 bp, Bos taurus
catgctgtttaagcccaggagatcagcatcagggtcacctgcaatccctgtggatgaggctcaaggttgaaggttgcccccgggctgacaggctctatccacctaaatcaggccaggagaaggcaggtggccagctatgtgcccagtgtgggaccctcgtccctgtgcttccccagcaccatctcacagccctggctccta

SEQ ID NO: 1030 - DNA, 201 bp, Bos taurus
gggctgcctgtctctgggcatcttgcaggaggctggagatgcgccggcggacctaaagacacaggagcgctgtcatcactgctcacctgccacccacccacgggcccagcctccctgccggttccctgggctatccactctgggtggccccgagcctctgacctggaactccagatcctcacaggtctctcgtggggatgg

SEQ ID NO: 1031 - DNA, 201 bp, Bos taurus
agtgacaagccatcaagacccatgaaaaccctccaggccttctcctctctgcgggtgggtgtccaacagtcacagatcttcagggcatagcaggtggtggcggggaggggcccacacgcgggcctttatggctcctacaacgacctgaatgatacacaatcatgctgcaatgtttggtcgaaggatcgacctcttaaaaga

SEQ ID NO: 1032 - DNA, 201 bp, Bos taurus
gatcaaatatggaataaataaatatccatgtacatcagtgttaagctaatgagggagggagtgggctcataaccaccatcacaccaacttgttaccatgggggttgataatttaaaagaacacaggtcacacctgctgatgagggaaattcttcacagtaaagcaccagcttattaatatagagggagcaatagatacagt

SEQ ID NO: 1033 - DNA, 201 bp, Bos taurus
actgggcaagtaagttggcttccctacttcactatcacgcccaagaacaagtgaagacagtgctcaaccagaggatggtgtcggccctcgggacatctggtagcatctggtcatttttggttgtcatgactgggggcaggggggtactgctggcatctagaggccagagacactgatgaaggcccggcatcacacagcact

SEQ ID NO: 1034 - DNA, 201 bp, Bos taurus
cagcaattacaggccgcagctaagagcgtgtcacgagtcaagtcagataaagttcagaccagaacccagaagttttgacccggttcttatcaccctgtccgttgtagaattggccacttaatttttctgaatggaccagggattctttgaaatggagcctgacatggtcccaccccacctccaatttatcctattgcttct

SEQ ID NO: 1035 - DNA, 201 bp, Bos taurus
cagcagaaacacacctacctgggaactgacaagttatcgtttctactgcattctatcggctgaagcaagtgagcaggccgcgcaccgttgaaggggtaggagagtaagctgcatatctcaatgggaagagcagcagaatcccattataaaggacatgtccaccaggaggggtgaagagctgtggccatctttaaaatcaat

SEQ ID NO: 1036 - DNA, 201 bp, Bos taurus
ctgtcgggcccgcctggggtggatcactgctgtaccattgactagaattaattaatctcagggttcagaagatcactgaagggctacattcaaccacaccaaacacatggcctcctggtatcctacccctcttcagaaagtagaagtaactcagcaacctggccaggaatttagttcaaaccaggactgggtgatgataat

SEQ ID NO: 1037 - DNA, 201 bp, Bos taurus
taaaacaacagaaatgtattttctcacagctatggaggccagaagtttagcaggttcactgggctaaatccaagggagagataggacctagctcctgccaaagggagagtgagcttctggtggccactggcactccttggcttgtggccacataactccaatctctgcctctgtctttacacaactttcgccttttctgtg

SEQ ID NO: 1038 - DNA, 201 bp, Bos taurus
ggggaccatgtgttacacttcattgtacaaataccatgcgttgccttcaaaaaccagagtaaacgggcttcttctcctgaagccaatttctgccttcatacagctgtgtttggatatgcagatatggtacagaaatttggaaaattaccacgtgaaattattgtttatcttttcttctcaggggaacaaagttttaaagaa

SEQ ID NO: 1039 - DNA, 201 bp, Bos taurus
ggggactcaccttctgcccttgactgctgggctcatctctccctctcccacctcccgcaggctgcctggggttctagagaagagggatccagattcatagccagggccaaactgagcactgagtgcttctggccagccaataatctagccccttataacaatatgaagtgtctgttttacatttttttaatgggaacatgt

SEQ ID NO: 1040 - DNA, 201 bp, Bos taurus
gctgtgtcctggtttggctcaggatgctgcaccaggaaggggtgcagtcaggagtggtcattaggaaccttctggaacatctggccgctcctaggagggaggcaaaggggcgggttctccttctcaagtagtcacaacactggacccaggaacacagtgcttggcttttctgcctgtgatgggcctccacatcccactctg

SEQ ID NO: 1041 - DNA, 201 bp, Bos taurus
tcaaagcaccccacgctgacccccaggacccaacttggctccaggctacaagcttgcctccagggaggtcctgtcctcagaggcctctgttccgtcagccctactgttcttcaccagagtctccaaacctctggtgtcctctcctctgtcctcggaggccatagccctacactatgcttcttgccttgcaaacatctctcc

SEQ ID NO: 1042 - DNA, 201 bp, Bos taurus
tctggtattcttgcctggaaatcccatggacagaggagcctggtgggccacagtccagagggtcataaagagtcgggcacgactaagcatgcacacggccggtccattggtaaggcagagaaagggtgtgggtgtcccatctagtgaggagagcagcagagagacggttaaatcatctgtgtagggcagttcctccaggtc

SEQ ID NO: 1043 - DNA, 201 bp, Bos taurus
acattataatatataatgaaataattatacagttgtcacttgctgctcagtgatagagtttgcatatgagtctgcaggcagttgattcttcatggtctcctgcagtcctcctccccaagccactccccagagctcacatcatggcctgagctccacctcggatcatcaggcattaaattctcacaaggagcctaccacctg

SEQ ID NO: 1044 - DNA, 201 bp, Bos taurus
agatggtgaagggccttctgcatagtagacgctcactgagcatcaggaatggtgaaataaaattcatatttttggcaagacaagaaagtttagacgtaacgttttcttggctcctttgggcctcctccctccccttccgtgtgtcttatgctgcattaaccagacttccttaacttcctgcttaatttcataaagggtcac

SEQ ID NO: 1045 - DNA, 201 bp, Bos taurus
agggcatctgagcagctggcagctagacaattactgtgtcctttgggatgagcctgtgtgggcacacatgtcatttggttggatggttaactgccctgtctgctgggccaaggcagacattcagaaccaaccagaaatgccatctctgccctttggaaaaaacgcctgatacatcagggcatcatcatctcctccctaaaa

SEQ ID NO: 1046 - DNA, 201 bp, Bos taurus
tctcctactgggcccttcctttatttatttagaggactcagcctttcctctgagtaaatattgaacagatcttttcataccacccagttaaacagtggcaaattgttatcttgtctccacctggccctgtgcatggctacggtgcttcctgctttaggccctaacttccttggtggagcaggcggagcccctgctctgtgg

SEQ ID NO: 1047 - DNA, 201 bp, Bos taurus
tctcccaggccccaggaagtcacccctgcccccactatctgacgattccattggaggattaagagggaccggaagttgcgatttagaaagagtaacgaatttgaagctgggaagaatttggacttttctgtgcaatcaatccctggggcttccctggtggctcagacagtaaagaatctgcccacaatgtggaagactggg

SEQ ID NO: 1048 - DNA, 201 bp, Bos taurus
tcttagagcctttggaaaggaaaactggcctgctgatacctggattttagcccaaccagactcatctctgatctccagaaccgtaacaaattgtgtctcactttaggccactttctggtaaattgctacagtagcaatagcaaacgaacagagttacctcgatgtcttcctctagttgacaaaaattacaaaagaactaat

SEQ ID NO: 1049 - DNA, 201 bp, Bos taurus
tgttccaaagaaatgtattccacttgagaatggccagggtaatttttcagcaatggaatcagacatttttgaggggggaaacctaataaatggcctcgctgtcagtggtcagaggaggtcttttggaggatggaaaacagaatccaaaggcaggcattgattccccagaggagaaaggataaagctgagatgaaaatcagg

SEQ ID NO: 1050 - DNA, 201 bp, Bos taurus
aagataggccatgaacctccgggacaggtcctcggggacgggctccccggtggcgatgaccagcagcagacagttgtctggccacgggtccctgagagcgttttctggaggcaggtggtacagagtgtaacagtccgtgtccacacagtcggccagggcagatcggacctgctggagcctgtcctggccatcccgagagtc

SEQ ID NO: 1051 - DNA, 201 bp, Bos taurus
cctgtttaccttgaagaaaccaaacctagccctcagggcaccagaattttaaatgtgccgcatggtcaactttccttaaattgcttagcatatggccagctgagtgcaaatgtggaaaataaagaccctgtagccacggcagtaacggtgtcacaggctctgtgagtgcatgagggtgtttgtgatgcgggagatggtggc

SEQ ID NO: 1052 - DNA, 201 bp, Bos taurus
cccatttaacaagcagttttgcctggtgggccctgtcaagattactgacacctgaattaaagcaacgccagtctacattttctgcagtgactttgacacaaatggccagttggcttgtgtggggaaccagagtctaaagttttcaaaacttacccttgctggtaataacttaccctgagctgtgcagcagcaccctgctgt

SEQ ID NO: 1053 - DNA, 201 bp, Bos taurus
aacgtcaccagcaagaccttgatttagttttaggtaattttttctctcatctttccttttctccatgatactgctgaattactgctcccatgatacgcactccccgccccctacaatgttgggcgattgttcctccgggtcctttatgtgtgacggttcttggatgcagacaacagaaactcaggctcggcaaatataggc

SEQ ID NO: 1054 - DNA, 201 bp, Bos taurus
taatctctggagcctgtgaatatgttacgttgcatggcaagggggaattaaggctgcagatggtattatggctgttaatcagatgactttgaattagagcgattatcctagattatccacgtggtccagtgtaattacaagggcccttgtgactggtggagggagacagaagggggagaacctgagagatggcagcagaag

SEQ ID NO: 1055 - DNA, 201 bp, Bos taurus
ggtccgcacttgtttaccatccacggccacagccgtgtgcacctgctgacctcagaggtctcgccaccaagatgcgggtggtccctgctatggcctggggcggaaaaagccacgcccccctgggtcctcggggacccatctagttgcatttttggattagagctgctcatctgtggccctgcttgcacgtcaggatctcag

SEQ ID NO: 1056 - DNA, 201 bp, Bos taurus
gagtatgcattagcatcaggcctaaaagaaatacccatatttaaatttaaaaaatacttttttttgctaaaaagatgctaaccaccatctgagccttcagcgagttgtaaactttttgcttgtagagggtttgaaatatggtgagacttagcagaattctgacatagaaacaggaagtgagtaaatgctattgaaaaaaat

SEQ ID NO: 1057 - DNA, 201 bp, Bos taurus
accagtggcctctgatcaggggcctgtccttagggttggggggcttggtgcagggtcaggaaaggagaaagttcacctgcttcagcctttaactttcccttggtggcctccagggctctaatctggagaaaaaaggttccaaacactcccagatctgtgagttccaaaaccctgtggatgaaaggacccaggccacccggt

SEQ ID NO: 1058 - DNA, 201 bp, Bos taurus
gcaacattgtagaattagacacgtcttgtgattgaagacaacatggcaacatcattgatttcatgattgtgactggttacttgagtatatttgagcacccatttttctttgaatgggaatcataactcttatagagttacgactgaggacaggaggagaagggggcgacagaggatgagatggatggatggcaccacctac

SEQ ID NO: 1059 - DNA, 201 bp, Bos taurus
accaccaatgacaggtggaggagggaatacggaagcctagcatttggccattttaacccccagcgtccccataaggtcaactgatgctgtctcccgtcattccacacatgcgtttcttctcccttgacaggtgtcaatctccagggtactcattagtaaacatcctatactttaaactccatttcagagtctgccccccgg

SEQ ID NO: 1060 - DNA, 201 bp, Bos taurus
tttctgttgcagtgactcccaaacttcaacatgcttccaaatcacctgtaaggtgtgtgagacctaatggctgagcctcactaccagagtttcctattcagcatgtctgtggtgggacctgaaaatttgtttttctaacaagttccaggtgaggctcctacagccccctgggaccccacttagagcactgctgctctatgc

SEQ ID NO: 1061 - DNA, 201 bp, Bos taurus
tacttctggcagaggaaccacgagccgctagagataagttgccttgttttcagtcctccagttcaattgttttgaaaacatctatgtctagtctccacaatgcgtggacatcaaactggtaaatccctgtggtacagagttaaaaaagaaagtcatctctctctctgcagcctcttatttgtattttagatgacacagtta

SEQ ID NO: 1062 - DNA, 201 bp, Bos taurus
agggggagctccacggagaggctgaagaaggaaggaagcgcctcacaagagggagagaagcttccgtgtaagatggcccaaagaaaaagctcctcacaccgttccccgtggatggaggagcctggcgggctatagtccacggggtcacagagtcagacacggccgaagaaacttagcatgcaaacacaccccgttccccac

SEQ ID NO: 1063 - DNA, 201 bp, Bos taurus
aattggtctgtgatgggacctgggcatctgtatccggcagccaacatagagaactctgggttcataataaagaaaactggaaacaggctaaacactcagagcggcctgagtgagtcctctttgtgtgcgttagtcgctcagtcctgtccgactctttgtgaccccatggggttttgcccaccaggctcctccatccatgtg

SEQ ID NO: 1064 - DNA, 201 bp, Bos taurus
tgaggaaaaattcatttgactatttaatgaatatttaagtctttcttaaatgattgagtcacaaccataactgtttgggccattatccccgacacatcctcatgaagtaggaagtctgcaccacagcactgctctcccgccagggtcctgctgttcccttagaatactgaaagtgaaagtcgctcggccgtgtctgactct

SEQ ID NO: 1065 - DNA, 201 bp, Bos taurus
gaaaagaactttcaggatggatgagatgcctggtgttgagatgcatgttggtaaagaggaaagttgagggatgtccttcccttggaggggggcctcctctcattcagaggctagcaagtcagctcttcctaggcaagctcaggactctgacccacagtgtctggccaagtgggcccaggagggggtcaccttctcagctgg

SEQ ID NO: 1066 - DNA, 201 bp, Bos taurus
gtgtatatatgtatgatggaataatactcaatcataaaaagaatggaatgttgccacttgaaggtacatggatagacttggagaatattaatccttagttaagtaagtctgactcattggaaaagaccctgatgctgggagggattgggggcaggaggagaaggggacaacagaggatgagatggctggatggcatcaccg

SEQ ID NO: 1067 - DNA, 201 bp, Bos taurus
aggcaattttcctttcactgctttgctttctttctttttaatgaggattgtttgcagtaaaagcaggaggcctcacccatggccgcaggttgctgaaagtgaaagtgaacgaaagtggctcagttgtgtctgactctttgcaactccatggactgtggccagccaggctcctctgtccacgggattctccaggccagaaca

SEQ ID NO: 1068 - DNA, 201 bp, Bos taurus
attttgagacattagtctgccatcttctcagtcagctggctttccaaataaagttgttattccttaccgtaacacctcatatctcagatttaccggcctattgtggatcaagagcagagtgagtttggattcagtaacagcttctaaagaatgaggacacttcagctgaggcctggacgtttcactgaccacattcagacc

SEQ ID NO: 1069 - DNA, 201 bp, Bos taurus
cttcagggcctttcaagtaaactttctgcaggggtcagaggagccccacagaagggttatagccccacttcgtcattgcggggagaactacagtggatgcggtgagcacgccaagggtgggaacaacagcagctttgaacatgtcctcttattacggaatctctgcctttgcatccccaactcctggacatggaagggtaa

SEQ ID NO: 1070 - DNA, 201 bp, Bos taurus
gcagggcatccgggaggccgtggtcctccgtgaaggtgatgaccgcagcagcaatgtccagcgcactgagctctagcatggcggtgctgatagaacctgcatccggggtcgggcccgcctggaagaacactgccaccttcctcaggaggcggcccgcacgcacgcgcttgaatacgtgtctagccacaaacctcatggcgt

SEQ ID NO: 1071 - DNA, 201 bp, Bos taurus
atgtacctaacaaatcttactccacttggtacaaaaatttccaagagtaaccttatctttggatttgaatccaaagctatgtggcctctgacaacaactttactttgctaaactgatatttcctctcttagccataaaaagtaactaatgatgctcataactcctggggctgcagaaaggtttacatgaggccctataaac

SEQ ID NO: 1072 - DNA, 201 bp, Bos taurus
ggggctcggtcatcaggggctccggagccctccagagccaggtgtgtgcatcaggacagcaggagaacgaggacctcagccatctggccccttcccaaacattccagcttagctggtggacgcaggagaatccaggatccggaaggattaagcagaaacagattctgaggctcacacacatttctgtggccagaaaactcg

SEQ ID NO: 1073 - DNA, 201 bp, Bos taurus
acaggcttggggtggagatggggccagactgaagaggaacctacataaacttaatttccttccaacaaccaccgtcaagagcgcccactacacacgcctgcagctgccctgcttgagagcccaggccagtatgaaaacacccccccgccgtctctgtatcaagagaactggcttcagcttgagatcaagagacctaaattc

SEQ ID NO: 1074 - DNA, 201 bp, Bos taurus
gatgtttctatttctgtaggtgtggagaggaactccagcttatgtaataaacactcaaggaaaatcttgccgtgttcaaggggcctcactctcctgtcttcgggggaagggagggtctccaactgtgtttaagtgttgtcagcctgttttgggaaaagagaaagtgaccttttccccaaaactcttgaacaatctgggagc

SEQ ID NO: 1075 - DNA, 201 bp, Bos taurus
cctaaaccaatctacagactcaatgcaacccctataaatacaccaatggcctttttcacagaagtgggacaaatcatcttaaaatatgcacggagctgtgaaagaccccaaatagtcaaagcaatcataaggaagaacaacactgagcgtatcatactccctgatttcaaactataccacaaagctctaataatcaaagtt

SEQ ID NO: 1076 - DNA, 201 bp, Bos taurus
catcttgcccacatggccctggggctctctcggcagtgtgcaaggagttctcaaatccttcgtgtgggatggcgaggccagagtttgtctccaactccatcctaagggagggagtcttaagccttgcctgagccttagcaatctgcaaggccactaagacgggttcccctcgcagatgacacaggaagtcacaccgtctta

SEQ ID NO: 1077 - DNA, 201 bp, Bos taurus
cttgagtcaaatggcctggaggtgtgctcactacctgactgcccctcagtcaggcgtgccatcctgggatgagggtcctggtctccagccccggtgtgacagtaacgtgggccatggctttggacagctcccttctgtgctcggggttggttttcccacgtgtaaaatggagtgaaacaggagggaagggggcagagcaca

SEQ ID NO: 1078 - DNA, 201 bp, Bos taurus
aagagaaacatatgtttgcagctgcagaggcctcagaggccttggctgtaaatgaaatgacacatgtaaggcacctttcacacagtctggcctataaatgtgaggttccaggttccctgtgtaaagtgcagggttggtgcgtgccttttcccctacctgccccaggctctctccaccatgtcaggacacctcccacatcag

SEQ ID NO: 1079 - DNA, 201 bp, Bos taurus
cctctcttcctggttaacgtggcccctgggggtgtcagctcttttcgggcaccttataggctgtgagggcagagagcttccaagcttcagaggaggcctccgggcaggaaagcagagaggactgggctcgaccatcacgcagtgcaagatgagtctgagcctgcgtggcaaggtgccctagggctgaaacccaggcacggc

SEQ ID NO: 1080 - DNA, 201 bp, Bos taurus
gggctacgtctgcagacctgttagaatgtctgagatttaaagtgtcgaccatggcaagtgatgccagtgacgtggagcaactggaactctcatgttgcttgtagtgtcagcgggagtgcaagggctacagctgtcctggaaaacacttctgcagtttcatgtgaaaccaacacacacttgacggaatacctagcggtgtga

SEQ ID NO: 1081 - DNA, 201 bp, Bos taurus
tgtggtttgctcgattccaaagcctttgttttttcaagagctgacagaattttgctaccacaaggatgtgccagagctctctctggccggtggtgggtgacggacagcctcagagcctggtctcatagagtgggcgtgctctgaccacaaggctgtgttccccgcctgtgtgttttgggtgcatcccagtggagttgcagt

SEQ ID NO: 1082 - DNA, 201 bp, Bos taurus
gattaattcactcactacttacttcctcagtatcttactgagtaagacattacttactcagttacttactatgtgctgagaacgaggtcctggggaagcacacaggcaccatccttgacctcctggatgcaacactttttggtctcactctagagactctgaagagtccatctgatctccttctcaacctgcctgcgctta

SEQ ID NO: 1083 - DNA, 201 bp, Bos taurus
gaggactagatgagactgtacacaacgtggccgctcggcctggggcacactctaggtgctgagtttctttcgcaaatgagagacctgggccccctccagccggtgacaggctgggcagcaagtcactggctgagctgcccgcgtggggagggggtgctcggggcaggggtggttttctgaggtcctgggcctgccgttcct

SEQ ID NO: 1084 - DNA, 201 bp, Bos taurus
ttatacaaattattcatttaatctttttctgtccttcccaataaataagttctgccaggcaagattccaggctgggtttgttcgccaacaagctggccaagcccgagtgcctggagaaggctcattaacaatcatcgctaaatgaagaattcctccattgacccatacggccaccacccacgtcatgaccacactagaact

SEQ ID NO: 1085 - DNA, 201 bp, Bos taurus
gtctctcccctgggccgcttacaacacggcagccggctgctctcagaagccggaagcacaggagcgggagagaccgagacgcaggccagcgtctttgtacaatgaagtctcagaagtggcatcccctcactttcccgaggagcgggtcgtcactgggttctcctacacccagggcagcaggctccacagaggggtggccac

SEQ ID NO: 1086 - DNA, 201 bp, Bos taurus
ccgagtggagggccctggaacattccagaacattcgctcagatcctttctcagtcactccctgctgccactctccagaggcaaccactgttctgtttttcttttcggccacagattaattttgccacaaatatgtagaatcatacattatgtactttttgtggctggcttcttttcactcagcacagtgctttgggcttca

SEQ ID NO: 1087 - DNA, 201 bp, Bos taurus
tgataggtccaccacgtgtgacctctagtctcgagggcaccttgtggtccaagatagaggcctggttccatccatcatgtctgcactctggccagagacgcgaaggacgagaagacacagagcaacaggtgactgccagccggcttggacggaagcttcagaggcccctgcaggacgtgctgaagccctgtgtgtgcagca

SEQ ID NO: 1088 - DNA, 201 bp, Bos taurus
gccgaccctggaacatgacccccgccctccgttttctccatcatggcttgtgtaacaaccataattacctcgccccttgtacagtcaagttgtcaccgtccgactgtaagctccgtgaggccaggctggggctctgttccggtgctgtgtctccagagcccagtgcagctcctggcacgtggcgggtatttttacctctta

SEQ ID NO: 1089 - DNA, 201 bp, Bos taurus
cccagtatcccccatatgggaagtgtgggtagtccctctgtgcccaagaagttcctggaggacactgaaagctgagcccagagaagcctgtggtcaggaatgtgaggcctggatgggatacatgtttctccatggaaactagtgtggaaagatgatggctgagacgagattcccatattcaccagcatctttaaccccagt

SEQ ID NO: 1090 - DNA, 201 bp, Bos taurus
ctcttaaagttgccacagtacttagagggagaagaagatgagaggggaaagttgtgattgtctgagcttcagcaaaggggccaggactgggctgttagtgacgtgacagagtcagcagctggtgacctagggctggggggagacacttcacagagggcaccggggttgttcaacatcgagaacatccctcctaacctgtgg

SEQ ID NO: 1091 - DNA, 201 bp, Bos taurus
cgccctcggctctggggggcctcgcccggctgagggccagtcaggtgggctgatggtgagggctctgcaccccttcacggacattcatgctccgtctgtctaccaagtacaacccttgaggggcccaggctgcttagaggaggagattctttgggccttgtgctcccaggacgtccacgtgtctacaggggcatgactgga

SEQ ID NO: 1092 - DNA, 201 bp, Bos taurus
aatcaccaccagcaccacctgtgactcaatgacggtcagatgcagggcttaccgtcccacgcaacagcatcaactcttctctcattacgctttaagaagcgctgcagaggagaagcctgaggaagctcctctgccgattttacgattagcctctgtacgcaaaaccacgctccctttctttccccaaacctgctctcagga

SEQ ID NO: 1093 - DNA, 201 bp, Bos taurus
ctccttagacattttcaagagggcctcattattttcactccaggaaaaacaaaacaatccacattctttagccaggtgggcagtctttccctcacgtggtcagcctgctctcactgtgcttgcagaaaccctggtctgccattctctacgtgaagcatccctcccagtgtttcctctgaagggcccccacgtgtactgtca

SEQ ID NO: 1094 - DNA, 201 bp, Bos taurus
cgcacacgcccgaggaagacaagcagacgtgtgcatataaaggagagaccactcacagggtcttccagtcgagtgaccaagggactgttccaggtttttggaaaaggtagggtcagtaaagaatagaaattagttatttaaacccaagagggattcactaaaggtactgtgagaaaaagcaagcacaaggttagtcagttt

SEQ ID NO: 1095 - DNA, 201 bp, Bos taurus
agaacccaggcccaactacaaacaagcaacagtgcaaaacaccgaacaaaaagggccttgtcacgggtgacaagtcaaaacaggactcgagagagggtgaggtcaaggtaaaccacatttttcagaaagatttcacggagtgtgcaggacatgagctccaagttaggaagaaagtacgcaagctttagaagagcatgttta

SEQ ID NO: 1096 - DNA, 201 bp, Bos taurus
ggctgggcattgggagaagctgttgtgcaagtgtggctgcaatcaaggtttcagataatcatacagggaatgtaaccctgggcaagacagttctctggggcggagggcagttcccagggagggatgaaggcctgaatggtcagcatttgatattactagcaactggggggaggggtgactcagaaggagggcacaggtgaa

SEQ ID NO: 1097 - DNA, 201 bp, Bos taurus
gaaacaactgttttgttgatgggtttgttgggcaagacctggctcctacctctagaatatctggtttgtagaacgtggccagttagctgccttagaaaagaacatgaagatagattgagaagctactaggagggaagcaaagggttaagtgtacatgttgtttccatccacgcgcacctgggcccttctcccacggatgtg

SEQ ID NO: 1098 - DNA, 201 bp, Bos taurus
ctgagagacacaaagtgcactgtgtgcagtgagtcaacaacagaggtcaccgcacagctcggggaaatactcagccagtattgtgtaacatgtaaacggtataatctataaaaaattggatcactgtgctgtgcacttggaaatgacacagttgtaagtcaattgtgcttcagtaaaaatagcaatactagcactttgatt

SEQ ID NO: 1099 - DNA, 201 bp, Bos taurus
gacagaaaggccttctatagggggcaccgtttaggtggagagaaggatccagccaagtaaagagatggaaaaataaagcgcattccagcaaaagaaactgggggtgccatggccctgaggtgagagagcacacagctcgtctgagctcttgaaatgggtcagttggattggaggaagggatgctgtggggtgagactaagc

SEQ ID NO: 1100 - DNA, 201 bp, Bos taurus
tattttatgaaatgtagtgtctggtgctggacatacatattatttcagtttttttaatgcagtacttaaacttgcagaaatctgaaatagctcttcccagtgattattttcttgcgttccattcatatgtacaacagtgacaaaaacataatggatatacctagactcactggataaacaactcataaatgcagggttgta

SEQ ID NO: 1101 - DNA, 201 bp, Bos taurus
attatggccctgtggccttttccgtaacatttattttcaagtctgccatgtgtcgggcattcgtaacagccgggctgactgtcactctgcggctccaaagacgtcggccgtgagagcaggtctggattcctgcaaagtgtgatggagttggccgggtttcatgcaacagactcagatgatggtcctttgtccagagcaggc

SEQ ID NO: 1102 - DNA, 201 bp, Bos taurus
ctcttacatcccagtgaaaagttcaaaattaagttactttattcgaaaacattctgataattgtggacccaaaatctgactccatacattctgaaagactgttttgaaaagagtctagcaagcagcagcttgtatgtaacagtatacatcattcttttttgacatgactgttaatatacagttaacatgtctcagaaaagg

SEQ ID NO: 1103 - DNA, 201 bp, Bos taurus
tggatgcagggtgctgatgaagccgggacagggcagactccatcggcatctctgcgtctgtctcttgctcggtctaactacaaaaacctgcagggcatgatggctacagcttcctctacacctttcaagaacctcatgcaaacttttggtcaacttccctctagcaccataagtggacggatattctggggaaatccttcc

SEQ ID NO: 1104 - DNA, 201 bp, Bos taurus
acgtcgccagtcactggggacgcccaccccagggtcacgtaaattccaggggattctcctccagtgctcctgggagcatcctccccaagagggttgtgcacgaggccactggaagtaaatagcaaggagcaggaagaaatcactgagacggctgaaggaactcaagggatctgggtggggcagtcacagcgcctgccccgt

SEQ ID NO: 1105 - DNA, 201 bp, Bos taurus
aggagaatagtgatgtaacggctgctaagaatattcttcaacaaatattaaagtacttctgatagattcaccaaatgtttatagtaacaattacctttcattcacagcaattaaataaaatttaaattattggctttcttagttcacataaacattgactcccaggtacccaggtgagttcctgttaaagacagaagtcac

SEQ ID NO: 1106 - DNA, 201 bp, Bos taurus
acccactccagtatcctggcctggagaatcccatggcgtgtacagttcatggggtcccaaagagcgacttccactttatttccttagggcttctctggcggcttagctgataaagaacctgccggccaatgcaagagatgcacattggatccctgggtggggatgatcctctgcagaaggaaatggcaacctgctccagtg

SEQ ID NO: 1107 - DNA, 201 bp, Bos taurus
caacatgaaggccactcaggaccttgacaagggttctcttttcaccaagtgcggagaatgaaacttgtctagagattgggagagaatgagaggagaaaacgtgagaagtgtgagtacagacacttgttctctataaagaaaaggggaggaaagggtagcgttgagacagtttatcctttagacatttatatgcagatgagt

SEQ ID NO: 1108 - DNA, 201 bp, Bos taurus
atcctccctacaagtacctaggtaatgcgcctcacctgcctaaaattcttcaagcatgctacagactgaaaaataatatgtgtccaagtataactgaatcacctttctgtgtgcctgaaaacatggtaagtcaactacacttcaataagatatatgtattaaaaaaaaaagaatgctacagacaatatttgtgtctccctc

SEQ ID NO: 1109 - DNA, 201 bp, Bos taurus
cgcagttgggactcagtaacgggaaattcgggaaattgtgagcaactaagtaaaaagctccttagagttgccctgctaagggccaaaaggccacatccacaaacatccactcctcactggttgagagatggtcctgggtatccgcagcccctcacctccagggagcgtccgcaggcctgctgagcacgcttacgtggcttc

SEQ ID NO: 1110 - DNA, 201 bp, Bos taurus
catgttttgaaatacagatctccagaatttaggccttggttggagaaaacccttcaacaaaacatgtgaagattatttcttaggtttttgttaacgggtcttataagtcctctgggccaagcctttgctgctcactgtggtcccctttctatagcatttgtgtccgtcacccatctcagtgtaagtattcttggtaacagg

SEQ ID NO: 1111 - DNA, 201 bp, Bos taurus
tgttttctgggcttcaattctggaaaaacaattattcccaacatctagattgcttcagaaatgttgatttggacttatttatgttacttattagtaagcagtggcttctaatgtttatgattgcaaacagaaaatatttccatgagagggagctctgatggtagtgtcataacagagagtgactgtgaaggtgataacagg

SEQ ID NO: 1112 - DNA, 201 bp, Bos taurus
ctcatgaccaggggatagtgcagaaggtcacagatggccacgcagcagtcagtggctcccagcataaggaagaagcacatttgtgtagcacaagtgaaaaaagaaatggttcctgtctgggcccaaaggtcgacgagcatcctgggaagagtgacagatacctaacagatttctaggaaagaaaaactgccaagggaaaaa

SEQ ID NO: 1113 - DNA, 201 bp, Bos taurus
tcaataacagaataaccgaggcagaagaatagataaatgacctggaggacagaacagtgggaatcactgctgcagaacataataaagaaaaaggaatgcagagaaattaagacagcctaagagacatttgggacaacattaaatgcaacaacattcgcattatacaggtcccagaaacagaagagagagagaaaggacctg

SEQ ID NO: 1114 - DNA, 201 bp, Bos taurus
gttatgtggtatttaggagactggggcccaagatctgcaaggcacacacaaatttcaggagaaagtggttccaattcccatgttagttgtgtctgttgctcggccacctgtccctccacccttgcctgcacatggccttaatctggatagaggtgcctctcaaacctgtacatagctactaatgcaactcaagaaggacat

SEQ ID NO: 1115 - DNA, 201 bp, Bos taurus
gatcctggccccctggtcatgggcttaggggttgccttgggagccactatcttccttccccacctactgccaagatttgcagtttggctggcccccactcgtctttccattcaccctccaaggaagccaatcttgctaaatcagtctgtgatgcagaatcaggaggaaaggagcctggcatctcactgggccaagctaacc

SEQ ID NO: 1116 - DNA, 201 bp, Bos taurus
ccctgatgctctgtcccacaggcataaaggtttgtgtgtcctgattcctgtaggcacttctgcaaccactgctactgccatcacagctgtgcagtcagagctacagtcccagtggatgttcaggtcagacccaatcatgtgggaggagggcaaggtcagacccgatcatgtgggaggaaggcagccagcacaagggcacat

SEQ ID NO: 1117 - DNA, 201 bp, Bos taurus
gtagggaatacaacccatatgatggcaagagttcacactgtggaattttcagagcaccttatacaccctcagaaactaaattaaagtgatgatgagataaaagattacagaggttcaaaacaaattcctcaaactctgttttggttgtgtccacaaaacaccaatatttcaattaccagaagagtgaagaccagacacaga

SEQ ID NO: 1118 - DNA, 201 bp, Bos taurus
aggttagttcctcatctcctctctcccaactaacctgaagacttgatcttcttccaggagcaagtttacagttgaagatgagagcgctgaatgacgatggaggtagtcccgggaggcaggcgagctcccagctgctccacggtcctcctgccggcctggccacacccacagacgtcacgacgggcatcccctccgccccca

SEQ ID NO: 1119 - DNA, 201 bp, Bos taurus
tggcagactgaggcaccaactacaccgcagcactgctgtcctgacagagacgccagacacaaggcggcagcagggagccaggggaggggccagggccggggtggggtggggagacacctgcaccctacactgagagaaacctggaaaacccagggtgaagacgacagggaagcggagtgggtgccaactccacccggggaa

SEQ ID NO: 1120 - DNA, 201 bp, Bos taurus
acaccatttaaatggtcaatactagtgattatattttgattactattttaaaaacaaacaatacactgttacagtaattaacttccaaagtttttaaactgagaaaaacttaatgagaccattctctattctttcagaaatgattattttaatctatttttccttgtatttagataataaaggttatcttagtaagaagtt

SEQ ID NO: 1121 - DNA, 201 bp, Bos taurus
atgttaaagctaaaagtaattaaggcacagaaatcccaggcagcacttagtagctttgccacatgcccagcagaaccacagataggccccatggagtagtgcagaggaatccagaactcagaacagacaggcacaagggaagcacagaccatagcataggccgtgtcatccacatcctccaccacctcctcgtctgaacat

SEQ ID NO: 1122 - DNA, 201 bp, Bos taurus
aatatacctctccagtggctgccaaggccaggtaatggtgaccatctgaatgggcagcaatttttacaatgtttctggaggcaagcccctggaccaactggggggcctaaaaaaggtaaaaacaggaggaaaattagtaagcaatccaaggacaagaaaactgcatgacttgcctcactcgtgtgtcttactctagtaagc

SEQ ID NO: 1123 - DNA, 201 bp, Bos taurus
ttggcacaactgcagggtcccaaaagtgggtcccctggccgtttagagtaagtctgtcaacctctgaagcaaatctcattgtaaatattacaaataaaaatacaaaatgctaatataacatcagcaatataatctttcatcaccaggaagcagacaagaagcatcactaaacacaactcaagttttactctcaggagcata

SEQ ID NO: 1124 - DNA, 201 bp, Bos taurus
accagcaaaagcatacgctctatagtagtgttgtacgatagtgaaagccgtgaaagaggagagtctcagtgggtccccttgtactggcatccttgaactgcaggaggattgcccacattctagctgctgctgtagcagtggtcccatgccctcagcatagacccccaacagaaaaggttgtgactgattccttgatttcta

SEQ ID NO: 1125 - DNA, 201 bp, Bos taurus
cttccactgtcatatctcattctttgactctgatacccccgcctccctcttacaaggacccttgtgattattttgggcccacctggacaatccaggattatcttaagatgcttaacttaatcatactcacaaggttctgaggatgaggactgtagatatctttggggggccataatactccccacctgatccactcaacat

SEQ ID NO: 1126 - DNA, 201 bp, Bos taurus
tctgagtatcagaatgtgtctgaaaaagcattgttctcaaatgatgttctctagagacaatccttttttttttttaaggtttcactaatttggaccaagagattacttatgtttaaatgacgactcaatacatggcccatttctattaacattgtattattgtagagttattttaaattttccttcaccaaaatctaaatg

SEQ ID NO: 1127 - DNA, 201 bp, Bos taurus
gttggcagtcttccctcaacacacgtactttgagaagcatgtgtttctcactgggcgtcaggtacattctattctcatagtaatccacacagagattcacaatgtctgctaagagctcttcataaccagatatcacttcaagctgctgctgcagagactgaaacacaaagatctatgtcactgaccactctctgcccctca

SEQ ID NO: 1128 - DNA, 201 bp, Bos taurus
cagtgcgctggtgggccctgggggaactcagggaggaaagcatgcctgccatctaacagccattgcactgcagtcactcagatgctgagccctgaggaaccgcggatgtgaaaacaggatcctggccctagacagctgaggcgcgtatcaaaggaatgacttcagtgagctcagactcttgcatctgctcatgtgtagaaa

SEQ ID NO: 1129 - DNA, 201 bp, Bos taurus
tgttttgggttcaaatctaatggcctatttttaatatacatgtgaataccctcaaacacctttctttaaaaaaccaaaattctgcttctcattaataaagcctttagactatgaaattaggttaatggatcttaccatagggtttcccgaataacctgtgtttcagtaacaaaaactctgtcatctggaacatataacggg

SEQ ID NO: 1130 - DNA, 201 bp, Bos taurus
cctcgcgggatcccacctcctctggagtctgggtgcccgctctcaccatccagaacttctggagtccgtcctgagactcgctacagaacgagaagggagactggacctttggcggccccggcccggccctctgcccgcccacccgctgcagcatgcaaggctcctcacctggtgccgacgcggacctggggctccatgtgg

SEQ ID NO: 1131 - DNA, 201 bp, Bos taurus
tttggcccacgctagtcagaggtgcctacataccacagagtcccccagtaaaaaccttgggcactgaattcctaaggagcttccctgtggacatttcacatgtgtggccacaactcacagctggaggagttaagcgcatcctaagtgactctactgggtgaagacccttggaagctggcaccttgttttctgcagacttca

SEQ ID NO: 1132 - DNA, 201 bp, Bos taurus
aaccatccttctggaagcatcttattatataggatgaagggattcttgagtccatggtgtctgaagccctgcatcataagaaggcctgagtgtctttgctggcacttcagaatttacaaagcaatttttccactggttttctccaaatgcagatcttattaagtccagtcacaggaacatgaaaggtgctgacagcgtaat

SEQ ID NO: 1133 - DNA, 201 bp, Bos taurus
gtcccaagggcctgcttgctggagtgagcaaggtcctagccggggccaagcaggagaccaagtcttcatcctgtgacccctctctggagtgtgtgccagtctctggggaacgagggacacaaggccaccctgaaggctcattttcccctttagggtctgcagccgccatgggatccaacacattcaggaagaacaaagtcc

SEQ ID NO: 1134 - DNA, 201 bp, Bos taurus
aaaatcattataccacggataatgatttgagtacaatgcaattaggaaaagtggatatttctgcaacatatatactttagtataatcactagaattatgactgataatactatatcaggacatagcttcccaggtggtgctagtggtaaagaacctacctgccagtgtaggagatggaagagacacagatttgatccttgg

SEQ ID NO: 1135 - DNA, 201 bp, Bos taurus
tgacagctcttcccatttgactcattagtatcaaatatgcctaaatatatctagcacttgacttttttataaggtgagagaacaaatgcattatgattttccaggagccctctgggaaatcacaaagacagttttaggtggaaaagtcgtcatttaggatttaattttggaaacgtaaaatatcaaaaattgtcacaagat

SEQ ID NO: 1136 - DNA, 201 bp, Bos taurus
ctgcgaagtcacatattcatacagcataaatcaagacttattgcaagaacacactttagttgattctatggacagaacaatggaaatgaaatctaccaatgtttcgtttacatgtagaatatgaaaggcttatttataaacctacaacattctcaaaatctaggaaaaactattctgattcaagaaaccgtaatctctgtg

SEQ ID NO: 1137 - DNA, 201 bp, Bos taurus
atcctgaagcgcctctgtgcttgttaccatgagtggccctgaccctgacgctggctgcacccctcacagatagcaagctgatgggaggatcatcactcatcggaaaatgttcagtcacctggcccagatccaaacaaaagaaacatatctcctaaaccttagaggagggctgtagaacagaatttttcaaaaatacccatg

SEQ ID NO: 1138 - DNA, 201 bp, Bos taurus
gcagtcaccatctgcagtgattttggagcccaaaaaaataaagtctgacactgtttccactgttagcaccaaagacaatgacacacacaaaaaggtgccactacctgctgactttctaaaagacacatgtacttcaaaacactcttggcatcaaattccattacagagacaaaatacaaaaacacaccacttcaaatttct

SEQ ID NO: 1139 - DNA, 201 bp, Bos taurus
caatcacctgagggtaaaactgaactccaatagcaaaaaacaacaataagacaaaaagtaaaaagccaggggagaggccttagccagggaagggcttaggggaaggtggggtttaggtgggggcaaggtctagggtcaggacccatgccactggaaaggccttgggtgagttggagggcaaggcccaggctcagcccctcc

SEQ ID NO: 1140 - DNA, 201 bp, Bos taurus
gcaatgttcatccatgttgagatgttatcaggggagtcctagtggacagtcaggattttcacagtcacccgatagcaacaaggccaacccctacctttttggtttcagggagaaacaaggcacctctaccaccttgagaaggtgtggtacagcagaggccaagtggggtgcctgaactcacaacatttatcaacagagtca

SEQ ID NO: 1141 - DNA, 201 bp, Bos taurus
ttcaaggtcagatctttcccagttcctgagaatatggcctagaggtgagtctgagggaggttcttgagatgtacgtgagctcatccttagaatgggtgtattgaaagttcactggcctagaaggtgtctcaactgtaccagtgaaatcgctgcatgcctcaaggcacagtacggctaatggcacaaatagccaacagttct

SEQ ID NO: 1142 - DNA, 201 bp, Bos taurus
ggtcttgtttcttacactgccaagcctgtttgatgaaggccgttttgtggtcctttttcaaaatggctctgctcttgtcttcctgtcttgttaccacacatccccaccactggctaggcctggttcccagtacctccactgactcagctcagaatatctaggggattcagcattacttctgcaagatttttctcctaggca

SEQ ID NO: 1143 - DNA, 201 bp, Bos taurus
tctaggtccagatcattcaccatgttggggccagctgggtgggggacctcacctggaactgctcctgcacagggtcgggaagaggatagcaggtgcctaaagggccttcatgcagactgataagatgcagtgggtacacagggtggtcattcagctctactggcaaagccaatgacacccttttgatggctggtatattcc

SEQ ID NO: 1144 - DNA, 201 bp, Bos taurus
aaaaaagaaggaaaaactggcatttgtagaaacataggtggacttgaaggacattatactaaattaaataagtcatacagaaaaagacatacagcatgatgtcatttatatatggaatctgaaacatacaacaaactagtgaatgtaacaaaaagaatcagacctacagaaatagagaacaaactaatggttaccagtggg

SEQ ID NO: 1145 - DNA, 201 bp, Bos taurus
attatcatagtgtatcctttcacgcccagtagtgccctggtttgaatgataaattacagttttatcctacttgagaggaaagtggccaccagccaacctgcctttctgctggtagccttgcctcccagatgctggggcttcttctctacatgacaagtgtatccacatctgacctggtttcacaccaggagcaatagcacc

SEQ ID NO: 1146 - DNA, 201 bp, Bos taurus
taccatctctgcagacagcatgggtctgactggagatctcagggcaaccattgggaaatagaagaacagccttctctgtggcctttctttaagcttttaaagaatatttgtttcagttcagttcagttcagttgctcaatcatgtctgactctttgcagcctcatgaattgcagcacgccaggcctccctgtccatcacca

SEQ ID NO: 1147 - DNA, 201 bp, Bos taurus
acattgggagacagacaccggggcctgttggagggtgggctggagaatcttttgcattggcaaaaacatccaggatgtttcatgcttctgtcccttctggaacatccttcccaccctgctatggcctccactgtgggcctggggattgcccgttcatcattccatttcagcaccctcttcagtctcccctgacagccaggt

SEQ ID NO: 1148 - DNA, 201 bp, Bos taurus
agcaacactacagattggtgcaccacatgccccaagccatgagtcagttgttgcacatttatcagaacagcctgcaccatgggcctgtagaggaggagagctcccttgttagtgagaatggggaaggaggactccaggatgcagggagcatctgagcaaaggctgccctgaggtgagaggggccagaccatatggctgcag

SEQ ID NO: 1149 - DNA, 201 bp, Bos taurus
aagctagtttgagaccttggggatgaaataacagcagcagggtgttttacaacctcccacccaaaggatgaaggcaacccagatctatagcctagcaacagagggcagcccagatagtctcattccttaccaaggtcaaataggagtcatgccaacaacataaggtaagtcaactctctagtaagggggatcaggttggac

SEQ ID NO: 1150 - DNA, 201 bp, Bos taurus
cccctaattctttcaagaacagactcatccaatagccaccagtcacaaaccctatctgtattttcagcgatgtgtggccacatgacccctgtgacaccacggagtgtaagcagggtgcacgtgtgcaacttccagagcaatcccttgaaaggaagtcgcttggcctctgttcctcttccccttctctttagggcaggaatg

SEQ ID NO: 1151 - DNA, 201 bp, Bos taurus
ggcacacatcagccaaccatggtgcagccagctcagagggagaaggaggagccctctgcaccagcagagagggagggcagggggagggggcccctgtcaacgtcttccttatcctggtgccaatgacttttcctccagccagcgtgagacttccaagtgacaggcagcagggaacatggcctgtctacccagctacccctt

SEQ ID NO: 1152 - DNA, 201 bp, Bos taurus
tgacttctgcacatgccccagcatcaggaaggagcccctctgagtgctgggctaggttcaagggtgaacattccaaggtcagaacggccacactgcccacgccttgcccagcatcagactcaggctgggagggagcctgccactctctactcccagaccccaggcctatagcccacttgaatcgatacagttctcaggccc

SEQ ID NO: 1153 - DNA, 201 bp, Bos taurus
ggtgcaggtactagtgcgatcacaaaagtctgaggcccagttccgaatgactgggagagaaaccatggttggactggcttgagtcagatgctcacacctgttcccatcagccatggccagagaggcaggggcagagaaaagtggtgtgggctggggaagcttccccaaaagacatccgctccataggcagagaactcaggg

SEQ ID NO: 1154 - DNA, 201 bp, Bos taurus
acctggggctctgtgcatggacctctttgagtccttaaattcatttaggaagttttgactgagtgctcactccatgcagtctccagaagggtgccggtgtggaatcctggcccccagccgtccccggcagggctgcccagctgtgtctgacaggcatccagaagtaggaggccccaggcttcacggcatccagcaccaccg

SEQ ID NO: 1155 - DNA, 201 bp, Bos taurus
gccaacagccagccccacacttccagccatatgagggcaccatgtgcaatggggatcctccagcctgggtagcctgcagatgactgaggccccagctgtccgctgacatcaggtggaaactaccccgttgagccttccccagataactgatgcacagagtctgtgagcatgagatacagttgttttacaccacttacatca

SEQ ID NO: 1156 - DNA, 201 bp, Bos taurus
aatcctcagactgcctcaaatccaaagaagtataatgggcagaatcccataaaacgtgtattccctaatgaacaatatgacaaattcatgcatatatactgaaataaccaaacatgactaaccgaagaaatctttcatagagatgaccagatgcaacggagaaaatattaattatgtcatctttgtcttgtttcacttcct

SEQ ID NO: 1157 - DNA, 201 bp, Bos taurus
agtagcattttgttcttactgtagtagatattctggatacagatttgcctttcctgtatgcaatgcttctgccaaaactgccatccgtgggcttacagaatgccttgtacactgttaccatgttctatacagcattgcttcagatcaagtaattcactttatggcaaagtaagtgtggcaatgggcccatgcttccataag

SEQ ID NO: 1158 - DNA, 201 bp, Bos taurus
tcatacacaaatttcttgttctcattctacctcagtttctgtcttgcctacagcctccttccccctaccccaagctccaccccagatatgagataaatacgctttggggatgaccctgactactagtttaaatttgtcgtttctgttagtgtagctcaaaagtgaatactgcaatgagtagaaattacagtaattattttt

SEQ ID NO: 1159 - DNA, 201 bp, Bos taurus
ttttgagaatgaattcatttagagaaaacggaaaactcaacatttttattacttaatgtatatatctgcattttaaatcatcactgtcaaaatacatacaatatattgtgctttgaattttataaaaacagatttcctgacagtgaattcttgggaaaatgctggaaaaacaatttttaaaaatagcatcaatataaaaat

SEQ ID NO: 1160 - DNA, 201 bp, Bos taurus
tggagatcaaccagcctgggcttcctgtttcagagaagatgtaaagaagggacatgcttgcttgtccccacatgggaccacaccaaaccccacagattcctagaacctagttgcaaaacccactcaggcccacgtggtcccttcactaaaagcagggagagggccctggcccgcccggtctgttgcttgtccaaggccata

SEQ ID NO: 1161 - DNA, 201 bp, Bos taurus
atagctgcacacagagttttggttttcttcaaaataaaaccctgaatggagttcaggttgggacaacgtttaagtccagagttagagagtggagactgagcggaaggcctggctgtggggttaggaggttcaggatgggccccaccccagcctgtgtctgtgtcagattccctcctgtgagaagtgaggacggtgcccagc

SEQ ID NO: 1162 - DNA, 201 bp, Bos taurus
tgtgtggatgtggcctcccctccacggagagctgcccagctaaacagatgattctgagtaagccagctgttggcatttagaggcagtcctttatattgcacgacatttagtatcttggttccaaagcattaaataaaatggtagtaacataccctctccagtcattgctaaccaaagggcctttgcattcacaaacgcccc

SEQ ID NO: 1163 - DNA, 201 bp, Bos taurus
atcaaatggcacctctggccttttgctggctaaacagtgtgcatgtagaacatttttgtgtgtgcacttttgttaacagctttcttagacttgatgaatacaggcccaacgtctgcactatcaaaaggtaatttttaaagatttaaaccaatttgacaactaagtaataaaggagcttgtttttggttagaataagagcat

SEQ ID NO: 1164 - DNA, 201 bp, Bos taurus
caggacagctgtgttattcagcttgatgatggccatggactctttgtcataagcacttccacttccatcttcctttagcccatatatacaagacacatcagttacaacatcaatcatgtcacagcaaagttcatatgactgcatatccacaggagaactgtctgttgcaatgtagattttgctgacaacattgaagagaaa

SEQ ID NO: 1165 - DNA, 201 bp, Bos taurus
ggggagcctggtgggctgccgtctatggggtcgcacagagtcggacacgactgaagtgacttagcagcagtagcagcaggataaatgatgcttagacatgtagttctatcaacttgcaaagcccctcaggtcagtcagtcggttaacaaacagtgccacttaacggcaagagtcagaccaagcagcatctctaacctgtgg

SEQ ID NO: 1166 - DNA, 201 bp, Bos taurus
taaaaatacacgttcaaaggaatagcaacagaaggcctttctggcactttaaaatgaccgtcacttagtggctagagtagggtgggctgcgtcctggaagagcagagatgggcctcctgggtgaagatgagcaggaggcagctgtgcaggtggccttgctctatcgagacgcttgcttactctctgggtacgtcttcataa

SEQ ID NO: 1167 - DNA, 201 bp, Bos taurus
tcaccagccgtttcccagtgtgctccttgaaggataaagcagaaccagagtgatcgtcaggagaatgtactggggtgtttggccagttaccacatgtgtttccaagatcctgtggtcttgtgtaaacctctgagttgggctggagacgccaagtagtgaggctcctctgctccctgacggggctttaccgacacgaggaag

SEQ ID NO: 1168 - DNA, 201 bp, Bos taurus
tttccccctgtaaacttaatattgaaaattttcaagcctgcagaagagctgaaaaaatagtacaatgaacacccatttctacattatttaacatttggccgcagctgctccatctctttctcacatatgcatgtgtgtgtgtgtgtgtgtgaaccatgtgaaagtcagttgtagacaggacactctctacccccatcaatt

SEQ ID NO: 1169 - DNA, 201 bp, Bos taurus
cgatggcccttgctgatgggaacaaggcctgccgttccaggagctggcagagctccgggggtctgggacagctgagaagacagcttgaaacgagctcctctgaccagttccaatcaggccacctcaggatgactcagaatgtcaggccttctaaaattaatctgtgtccacatctaaaatcagcacctcacttagagtcac

SEQ ID NO: 1170 - DNA, 201 bp, Bos taurus
cttagaaaggtgggtggacattagaggccaggtggaggggatgtaggggagaagatatgcagacagcccaggatgtgccctatgaccctaggagagggggcgaggggaaggaggggcccaatggcacaggtataggaaaccagctgctctttgctttcaaagcctgatttagaagagagcatgattcagcaggggcttccc

SEQ ID NO: 1171 - DNA, 201 bp, Bos taurus
gagccaggagcccggctggttcccctgggagcctgttgcttttctctttctctggttttctctccagctcccttctgcattctggattcttcttccacactgtctcctggcctccactcagcttctcgcctggctctgtggcttctggatggttcctgccaccttcccactgtgcctggaatcgaccgaagggtcgtgggc

SEQ ID NO: 1172 - DNA, 201 bp, Bos taurus
tgatgtcctgtgaatgcctttcagtgctgctgctcttctctgctccacgctagatacatgcacacagctcttccttaattccctagagtacagccaaggcaactgaaatactcagcccttcacggacgcgttagggataattcaagcacaacatagaaagtgtcttataattcagctgccactaaaagtgactctctgctc

SEQ ID NO: 1173 - DNA, 201 bp, Bos taurus
aacccaatttccaagtaattatgctcacaatgataatcagacatcattttacttgatgtcttgtttcacgtctcttttacagatattaggccttctgattctgtgtgaatgtcagcaggcagtgttatagttcttaacactgaggaaattgagacttaggggttatggggtgagcccaccattccaccaccagtatgtaac

SEQ ID NO: 1174 - DNA, 201 bp, Bos taurus
atgaagcccttcatttgtatataagcgtttgctgttctaatcaaatgcaacttgagatagactttaattttaacacatttaagtgttaacacattttattgtatactggattattgcacatcataataattagacataaatactaactttgtatttttgtcttctcattttgccatttcttcaacatgcaaaaactaaggt

SEQ ID NO: 1175 - DNA, 201 bp, Bos taurus
aacatcagaggagctttcacaacaaattctttaaacaaattcacagctgtcagccatgatacgagatttaattaggccaccctgagttgtgctgcatacaatctttactgtaatcaggttctttgttgtacccactgtgtggccactgaggaaaggtccttaagaggcacactctcccatgggtaatcacacccggagccc

SEQ ID NO: 1176 - DNA, 201 bp, Bos taurus
catcctgcttgacttgtggtggctgttaaacatttctttgataaattaacaggagaaaaagtgtctcgattcacaacagcatttgttttcttccctcttacaaaattcttgttataaatatcttctttaatcataaaaaaaaaaaaaacttctctcattagctctattttcttaagtcactaacgcaaaccatcttttttc

SEQ ID NO: 1177 - DNA, 201 bp, Bos taurus
atacctagtcatcattaaaaacagttttgccacttatattcagtgtgaattggtttaatcacattactctcttcctaacacttcttgagggtagttaatccggaggaatgacaatttcactgggggtaaaaaaaaataatttgagagaatggggtattttagaggaatggagagcttaccaggaagacaaaagagggtggt

SEQ ID NO: 1178 - DNA, 201 bp, Bos taurus
ccaggcaagagtactggagtggggtgcctttgccttctccccttaaaagcagagaatgtattaatatttgcctctgagagaagaaatgaggcaagatggtataaaaagtctaattaaaaaaaaaaaaaaagccttgcaaacttgctcagttttttaaaaaagctttgtatatacataactcattttaaaaataaaaatcaa

SEQ ID NO: 1179 - DNA, 201 bp, Bos taurus
gttgtcagctcagtgtcaacaaggccttgctgacaataacagaaaggagggacactcacaacgcagtgagcttcctgtcactgaagtgccccccgcagagtgtggccagtctgtcaggagagcaatagagggaatgttaaaatggaccggacgttggtcaatgattttaaagtatccttttgttgtaagaccgtgggccta

SEQ ID NO: 1180 - DNA, 201 bp, Bos taurus
acagtccaactcaggttgtgttttgttttcaaagtgggcgttttgacgaggtatccgggtcagctggcagctctgaggcctggctcaatttgcaatctccttgccctgtccacacgcagaacagacccttccctgcactctgaggggttctctcctctcctggaggcctaagtcatctgctcttcccacagaattagaatc

SEQ ID NO: 1181 - DNA, 201 bp, Bos taurus
tggcccataaactgtgtagaaataaggactgtaatcatcatgtatattttctttttttttttttcattttcatttgcttccctgaggtctatcggtatccaaatctaattatggactaggcctgtgtctggaagcaatgagaagcaatgggtttgactttgaggagattccttatcctctgacaaatcaactatcttgggt

SEQ ID NO: 1182 - DNA, 201 bp, Bos taurus
aggtgcaagacctgaaattataagcagtgttttgatgttgatgagtccaggactttatatgtagaggtgtgatttttcaggcctttggagaagttttaacatatgatgtggcgttcgggggacagtaccaatgtttgtcacagtggcgcatctcagaaaacagatgcttacattcaaggccagcagacaggttcaccctgt

SEQ ID NO: 1183 - DNA, 201 bp, Bos taurus
taattaaataattaagcatgagtattcaattggggatcacagataaaaggactacttctaaacctaaatttggaatgctggaataaaatgacaaaaatgatttatttgtacttcaagtttgttaaaattatctaatgagttttggattgtttttgactaaaaaacgttggatcttaaattaccatgagaaactataatggt

SEQ ID NO: 1184 - DNA, 201 bp, Bos taurus
atgtttataagtaatgtcttacctcagatcctctttcacctctgttacctcggggccccggtggtccaatgggaccagggtgtccacttgctccgtcctttccagggggcccgctaggtccaacaggtccctaagaaatgaacatgatatcacaatgctagaatacttccctgcagtgcaaaaatgttaaaacatggaact

SEQ ID NO: 1185 - DNA, 201 bp, Bos taurus
tgcatacatttttgaaaaggcactttaaaggtttaataaagatgtgaaaattacattttacttttacatctcaaaaagtacataaaactgttaaaagaccgtatttaatcatggtttttcttgcagcattaaaatttgtctgttctacatgacaaagatatttacaggccttagagaagttagcctattaggaaatcctca

SEQ ID NO: 1186 - DNA, 201 bp, Bos taurus
ttaagcatgctgtgttcatttctgttttagggcccataaaatatgacccataattgatctaagggtctgttagcctgagctattcagaagtgtctagataattggcctttgttctacttttgcagaaataaattcagaaaagtacttaggacagggtgtcctggcatgagagtggtaaataagagccttattaatgctgca

SEQ ID NO: 1187 - DNA, 201 bp, Bos taurus
cctaggagggaggtaagagaaaagagcatggaagcaaaaggaatgctcctagagaagaagagagtgaaggagggagcaaggtaggaaagaaaggaggaagacagcaaaggagaaagagaaaaagaaagactaggtacaaagtatgagaaattagtattttgtaaaatgtatcagataaaggtcgggtattaccccctctgc

SEQ ID NO: 1188 - DNA, 201 bp, Bos taurus
tctccattccccctggcatccatctctctcctctttgtcaggatttaaagatactcgaatcttgactttgttaaaacaaaccaaccaaaaagctctttactcagcgcttctttactcctctagaccctcatttctctttctcttctctattgaagctgagctctttgaaggaggtattatatttcttgcctgtttacttca

SEQ ID NO: 1189 - DNA, 201 bp, Bos taurus
ctcctacccagcatcaagccacagtcactttccttgagtggacctctccactggactcctgatgtgtgttcacccctgcctcttacagctaatttctgttcaaagcttctttcacttcttgtcactctttctctcaaaactctctaaattgagtgtttctcaaattttacagtgaccaacgctggagaggtggaaatttcc

SEQ ID NO: 1190 - DNA, 201 bp, Bos taurus
aatgtatcagccactatcaatgccagaatgaattccatggtgcctgtttcttgtcattaacttctgattggaagatttacctctgaacctctgatcaacagggcctgggtcatacaagtctttgatacacaagacgctgaggaagcaagattctagtttctattctgggaaatgactcctaaggaaggattttcccaaaga

SEQ ID NO: 1191 - DNA, 201 bp, Bos taurus
aaaaccatgagaaccatagataacacatgtccagccattcaacatagcccattaaaaagtgattacagagtcataggaaaggatgcacttcgactaaatgcgagctttgtaatgatccaagctactgtcttcctaatctttgcagtggcctactagaacaggagagaagtgatcttttgcatatcacaaacatctattggg

SEQ ID NO: 1192 - DNA, 201 bp, Bos taurus
gccacaacatgaagctgccattggatgagctctcaagttcagaagagaaataaagctacataagctgtatataaaattcatggggccaaccttgtatgcaatcccatttaatttctcattcagttcagttcagtcgctcagtcgtgtccgactctttgtgaccccatgaattgcagcacgccaggcctccctgtccatcat

SEQ ID NO: 1193 - DNA, 201 bp, Bos taurus
ttaagcttggcataaaagcaacagaaacacccaacttcaagaagtcatgagggctttgacaagaggtgctcaatatgaacccaaggtcatgtattctaaacggagaagaggagaccccataaaatatgattttgactgcatttaccaagagtcaaatgagcaatggcattgaggaagtatgatttagagaaatagagttaa

SEQ ID NO: 1194 - DNA, 201 bp, Bos taurus
tatatagtgatgtataccaattatttttcaataaaactggaaaaaatcttaaattgaaatagcatgctatataggaacatattcaatagtgaaagataaacgaccattatttttttaaaaataagattactgaatcaattatttttcttttgtagccctatctccttgacctcatttcatatcatatttacaaagttttca

SEQ ID NO: 1195 - DNA, 201 bp, Bos taurus
agctgaggcttttgtatctaattttacaaatggatattaaatatcttgatcattctttgggccccctataacatactagacataataggtggcaacaaatgtgcccacacttagaataacgtcttgcaaatattgaaagtgtagattctgaactcatatacagcattcttccctctatttcttgctggtctctggccctac

SEQ ID NO: 1196 - DNA, 201 bp, Bos taurus
gttgaattctcttgagtaaatttttgtgtatgatactagattgggtaatacatatttttaacagggccagctagtaagacagtagagtgcagaaaggtacaaggatgtataagaagtgagtcaattagtacacagcttcagtttgggtttgttatttatcttgtcactttgcaatgtaatgcatcttgaaatttaaaaaat

SEQ ID NO: 1197 - DNA, 201 bp, Bos taurus
cagtgtggccactgttgataacttgttgggaaccactgatgtgtgctagatctattgatttaatagaaagtatcatgttgtgcttcccacaagagttcttggttctgtttctttccattcttgaggtcattgattcctgcattcattaatattgtctttattttgtgccctttctctagaagtaaacagattcctatgtta

SEQ ID NO: 1198 - DNA, 201 bp, Bos taurus
tgcatattaggataaagaaatccatctataaaaagaaagctaaaaggtgattttatgaagtgtagataaagcagcactgccatatagtttaacatttttctagcatgtagttgaaggatccctgatgagctgttaaatacctcctaacgccacccctttcctttcctatagttcctacacgttaatttcccttgagaatgt

SEQ ID NO: 1199 - DNA, 201 bp, Bos taurus
aaaaaccaagtggaaaaaagaattcttttcagtctgcaaatgtcaagggtgataatatgtagctgtgttcttaccactgagcttaaaatcttgcaactcaggcttttgtagaaatacgaggaagaaaagaaacttctcattgccacttctaatgaattcagttcagttcagttcagttcagttgctcagtcatgtccgact

SEQ ID NO: 1200 - DNA, 201 bp, Bos taurus
caaatgagagttattaaactgtattagataatcatttaataatagagaaaaagtgttaatgtcagcagttaacatcagccaagtcaaccagcattataactcaattctaacttaggctagatatgaaacagaagagacataaaaggaaaagtcatgtgctatgttgttgtttgggaagtcttgcccttaatttgaactctt

SEQ ID NO: 1201 - DNA, 201 bp, Bos taurus
tgaaaagctgccagacatccaggctagtctcctagagacacgtggcccagccaacagccagcaacagtctccagatgtgagtggggggcctttaaaccatccaggtgcagtgtgactcacggaacacaaaccagggctctgtaataatctagaggagtgggctggtgagggaggtgagagggaagttcaggagagaggggc

SEQ ID NO: 1202 - DNA, 201 bp, Bos taurus
aatgaaaaatgggcctctgagtatggactgggggaaggtgagatttttactttttcttatgttttataaagtatggaacatctacacaagactcagtagtggagtgactatttctggcctgtggaggaacattagggcattgttctaaattatggaattgagaatatttgatttgaatgaaaattatccatgaattataca

SEQ ID NO: 1203 - DNA, 201 bp, Bos taurus
aattttgtacttggcccttcatattcatagttcttccaaatcttcagtttcaaccaatgacagacactgtaatactgaaataatttctattgaagaatatcttcatataagtggccctgtacacttcaaacccatgttgtttaaggatcagctgctcttttagactatattagaacatatcactgcagatggtgattgcag

SEQ ID NO: 1204 - DNA, 201 bp, Bos taurus
acagggccttgtctctcatactaagtatgaatgtgtgacatccaagcatccttctggaacaagaccattgataccaaacgagatgtggtttattctaggatggtgaaagtcatctgtggcccttaggaaagctagattcatggacctcaccattgatactagtagttttgaagaaattgctttagtagttatgaagtgaag

SEQ ID NO: 1205 - DNA, 201 bp, Bos taurus
tatcaccaacttaatggatatgagtttgagcaggctacaggagttggtgatggacggtgaagcctggcatgctgcagaccattgggccacatgcttggacatgaccaagaaactgaaatgaactgagagttaattgaaaatatttagctaaaaaataatattagctgcaactttttcattgtaaatttggagttgctttag

SEQ ID NO: 1206 - DNA, 201 bp, Bos taurus
ccactccttggtcttttgatagtgccttggaactgtcatggcgcctctgggtgtgtcatttagcttgtagattgaagatcaaggtttagttgaattttacctgtctgccatcatggacccattcgatttaatgggtttatgttatgcccttgggctatgtcattctttcaaaggttgtgccctgccctcttctgttctgtt

SEQ ID NO: 1207 - DNA, 201 bp, Bos taurus
ggggaccccagtgtgtggcagggaggctcccagtggggacggtagtgggtcttttaaaaaaaaaaaaagtgcctcttagcagaccttgaacagtatccatcaatgtctctaaacctccatttcttcatcagaaattacaggtaagaatacctacccagtagtattcctatttggagaaggcaatggcaccccactccagta

SEQ ID NO: 1208 - DNA, 201 bp, Bos taurus
aatgagacttactaaatgatcatggctgaaattatgtaataggacatagctctgctacagcctcagaggaggagatttctaaatgttctcccttcaaacataagaggatcttagcacctggaaaccacctctagattcacatttttcgttaagtcatactaattcaggcatgtaagtaggttggcaggaaagaagcttaat

SEQ ID NO: 1209 - DNA, 201 bp, Bos taurus
tcatgttttctctaagatcattaacttaaggcccatgtacccagggcttccggtgctgggtttctcactccatagagtgggaaactctcactacataactatgtgcccaagaaggaggccaccagagaaaggcatagctgagagatagtacagactgtgcaccagtaagtcagggagaactacacagagatgtctttttta

SEQ ID NO: 1210 - DNA, 201 bp, Bos taurus
taggagttggtgatggacagggaagcctggcatgctccagtccatggggtcacaaagagtcagacatgactgagtgactgaactgaactgaactgaggttcttctaggctccatctaggatcctaggttcttattcttcctatttacagagttgtgcctatttggaactagtggttatttttcttaagttgaatggcaaat

SEQ ID NO: 1211 - DNA, 201 bp, Bos taurus
atatcaaatatgaatttctataatgaatacatgtcatctatgtcaatatcaaaaaaagaaaaagaaaaacagaaaactacaggtagtttgtcttatattagaatctttttttgtgggtgggttctctagagacctgtctgatatcccagtatttgtttcagctccttgacagctacttgaacctcagcttcttcatttata

SEQ ID NO: 1212 - DNA, 201 bp, Bos taurus
ctcttctaaaaatgtctcccacagttttatcagtaagattttccaagactgaaaagctgaaggtgccatttccctgactatagcccaccagtgactacccgttacttgttggatatagtctgagctccctatatggcacatacaatttgacatttgttgattttccagctttatttcctgctactctccctcacacctata

SEQ ID NO: 1213 - DNA, 201 bp, Bos taurus
taacagacattttctcaaagtcctaaagactgaacatgcaaaatcaaagtgtaagcaagtttgatttcttccgaggcctctcccctaggcttccagatggctgacttcttgctgtgtcctcagtgacctttttccttgcttgagcataccttggagtctcttcctggtcttacaaggacatcagtcatgttggattagggc

SEQ ID NO: 1214 - DNA, 201 bp, Bos taurus
aaagtatatgaaatttgtctagatggattatagatctaacccagtttgggaatctttttatgcccatctaaaatggacatatctttgcacataaagtacacgtatacaattgttttctaagagcattgagttgtttaggtaataataagagttatgctgtttttataacgttcaatacagtatatttacaagttccttcaa

SEQ ID NO: 1215 - DNA, 201 bp, Bos taurus
ttaatctagcccctataaaaccattatcatgtaagtacaaatagggccctaaggatatgaatatgttttaaaaggtgggagagtggaaggaggaagagaacacaggaaattgaggttttggccatgggtaatgtgaactaatataaaggaagaagaaagagccagcaaccatgtacatggaaaacctctaacacatgccct

SEQ ID NO: 1216 - DNA, 201 bp, Bos taurus
actggaattccagactaccccacccaaaaggccccagcctgcttagtttcttccccagtccccaggcatgggttgttccatttgcatgaaacatccctaaccctgagggaggcccaagaggcagctgtctacaggggctatgatatgcatatgtgagtagatgtggccacctgctactcttgagacctctcatcttataag

SEQ ID NO: 1217 - DNA, 201 bp, Bos taurus
ggccaaacttaaccacccctctccaggcctgactgtattttatcaccatccttcctttttttaactctcagcttctcaactgtgcaaaaactaggaaagcaaaagcccaggccacatggttagataccatcttactccacatagtcactccatatccagaacctctgaaaggaagtatggcattgaaggacagtgcttcag

SEQ ID NO: 1218 - DNA, 201 bp, Bos taurus
ggaaggagagaggataggttggagttggttgggggaaggttctgggtgttattttcaggggttcaggctttctcctcaggcagagataggccctggagctttgaaccagtgcagggctgctgggaactagaagatctgaggatgcagtggaaggggtatgctacaagacacctgtgagtagccagagagagatggctaggg

SEQ ID NO: 1219 - DNA, 201 bp, Bos taurus
gtgaagaaagtctctgggtgagagatgggtaaattttctaagaggcagagaaatatccaagaagaaagtgattgaaacattgctctttcgaattcaacattactaatacctcattgatggatttaagtgctcgtgactaaggcacaatggtaaaagggggaaaaaaagctttctagatgctccagactccttcaggaaaag

SEQ ID NO: 1220 - DNA, 201 bp, Bos taurus
tgctggagccagaggctgccatccactgggctgaccagtaacgctgtcctcttcgagccgtctcactcctttctccccgagcaccaagcaaagtatggcttttcaattttattgtcttttgtattttcccagacacaagaagaagacggcctccaagctttatttgcgtaaatctgtattttccaggagatcaaagagcct

SEQ ID NO: 1221 - DNA, 201 bp, Bos taurus
aggttaagtttcactgaggttgggttaagttggggctcatgggtttatcagattcagacatttagaataagcagctttagaaagaaaaaagattagtcaacacaattttcttttttaaaatgacaagaaaagtatcatttgttggctgtatggaaatccctaactttttaatatcaaagcctgcaagaaaaaaatctctcc

SEQ ID NO: 1222 - DNA, 201 bp, Bos taurus
cgagctttctcatctttcaaaactgaaaactcgatgcccgttaaacagttaaacagttccctctttcctgacctgctatgcagccccgggaaccaccattctactttctacttgtataaatttgactagatacctgatataagtggaatcagatagtatttgtcttcatgtcacacaaattaaataatcttatttttctca

SEQ ID NO: 1223 - DNA, 201 bp, Bos taurus
gtctgggatacccaatcaaatttgtcatactttgggaacttttttttgaaaagtgtaggactttatgtgaaagtggaagtgtcaatctctcagtcatgtctgactctttgcaacaccatggactgtagccctccaggctcctctgtacatgatattttccaggcaagaatactggagtaggttgccattcccttctccaag

SEQ ID NO: 1224 - DNA, 201 bp, Bos taurus
agtaccatttagaacccttatgagttttttgaaattcagaaaaatcacaacaattttgatcatattagaaaatgcttttctccttgggataaacccagcttttgaaaaatattgatactaaggtggtaggcaaaggctgactcatataataacacaattacaagcaaagggaacaaaggtccacaggcaaggaccaggttt

SEQ ID NO: 1225 - DNA, 201 bp, Bos taurus
ttgaaaaagcctttgacctagctcttccagaactaagctgtttcctttgaactgactggtattcaggcttgcaagctgtttgaactgagctgactgtgctgtaagctgcttaaattgtttcaaaattgttctttactgtagaggaaaggcctctagggaatgggatcccaattatctaaatataatgagggctcccccggc

SEQ ID NO: 1226 - DNA, 201 bp, Bos taurus
taaatagaggaaggtgcagacaatggagccaaataatccagaaaaccaagaatcttcccccagacttttgtttggcttcaatcagcaaatgagttatcaacaatgatcattgtaattcaagatgatggaaagaaactgagtgcatgaagacactgttaagccactgaatcaatagaatatcaacccaacttctaaactacc

SEQ ID NO: 1227 - DNA, 201 bp, Bos taurus
agataagagcagggtttgaaatccttatcaattgcagcaattacaattttatttcagattaaaaggaagattaaaacagatgttgccagcattggatttgtaatttccatcattattatgatacactgtaaatcctggaatataagcttggaatcttgaagaaaaaactactatgatcaccagccaacttattccaagttg

SEQ ID NO: 1228 - DNA, 201 bp, Bos taurus
ttccaattaaacagcaaaataggttcaaaaccaaagagtctcccaatccctcatagacaaaagtgcttaacatccatctgtcagagagcccgtgtgtgttcattttaaatgtaaactgaatctaaataatgatttcaaatgttcatcatttcctaacttatgttgatccaaatgcagagactgcttaaattattaataagt

SEQ ID NO: 1229 - DNA, 201 bp, Bos taurus
gttccattggcctttcatgggttacataagatctgagcatcagtaactctgagtagtaacattgattagatcttcttttagggatagccaggcatgaatgccagcccttgtgacttggcctagaatggggaaatcccctaagggaccttaagatactccagtgggggtggaaaaatatatagactcataggtaaggtagat

SEQ ID NO: 1230 - DNA, 201 bp, Bos taurus
gaagaggcatagcttgccctttccttcttccccattacatcatttctgattcttaccctttccaatctttagggatgggagaaggaatggaagggagggcaaatactttggtacttaaggacaactattgatgccttctgcatgggaggtatccagatgcttctcaaagaccatgagtaaggtctccacgtggttcaattc

SEQ ID NO: 1231 - DNA, 201 bp, Bos taurus
aggaatgaataatcatcttcattctacaagccatgaggtgccagacactagtgctaagaatactaaaataaagagactctcaccaggccctaaaggagcttattaagcccttcaaggaaagtaaaaattgagtagtagattccttttcacatgtgtctatttgttttaacttgacttattttgtttctgataatgctgaaa

SEQ ID NO: 1232 - DNA, 201 bp, Bos taurus
aggccattaggcaagaagaaatgatgttgcaagttaagtccaaaggcagtctaattggagaattctttcatgttaggagagagtcagtctctgttctgtttaggccttcagctggttgtatgaggcccactggtgatatgaagggcagtctgctttacattattgattgaaatgttcatcacatctaaaaacatccttgca

SEQ ID NO: 1233 - DNA, 201 bp, Bos taurus
atttaaattaaaaatacttgaggaactttgggaggggtaaaccaattagaatgaaagcttgaaaggtttttgattattttaaaatttcatctcaacttccgttcataggttgtgaattggcttgaagggcctggatcagagcagctgagagcccagtggggaattggagactccatccgggcttcccaagccctacagcag

SEQ ID NO: 1234 - DNA, 201 bp, Bos taurus
atccattgattgttcttcaaaactgccactgatcaaagtccagttcatacagcaagtcccaaacagctcactggtgaaacagttgaatggaagaacccaaggttgtaattaatgggtttctaacaatttgtacagagaagagtttgtctccagggtttagaatttaaaagcactgggaatatatttaacagaaagagttac

SEQ ID NO: 1235 - DNA, 201 bp, Bos taurus
ttatggtgaaaggtctttccagatagctcccacaggaagctttttcccagcttgaatcatctttcatccctgaatcaatcacgttttcatccttgagcctgtcaaccaattcataactaggatgggttagtcctctgtcagtgcctttgctcaccagtgggtgagggggcagggttggtccttcctaaaatcacatattgt

SEQ ID NO: 1236 - DNA, 201 bp, Bos taurus
agcaactcttcaaaactcaagtttcgaaactaaaaatgtaagtttgtctttcacgacattggatattggtgtctggcttccttctgaaatcaaagaagtttaaggtaaatcaggagcttattttctttattgtcatttatgagtttcacaatgcaggtaaatagcatgttgttctcattgccgttttgcccattcccttca

SEQ ID NO: 1237 - DNA, 201 bp, Bos taurus
tgttttgttttttcaaacaaaagtaataaatgctcatggtgaaaatacaaactcttcaggcaggtgtaaaggaaaactggaaagttattcatccttgttagggaacaactagactgaagtcaggaggagaaggagacaacagaggatggcatggttggctggcatcaccaacttaatagacatgagtttgagcaagctcta

SEQ ID NO: 1238 - DNA, 201 bp, Bos taurus
agtctctgaggaaggtgttccagagagccaagctcctgttaccagaagaacaataccaccaccaaaaggtacaagtgagaagacagtcggccttcttatctcctgattgttgttgttcttaacacctgtgaaaatactaatatcttaaaagctctagttgctaccagggaggccacttcaaagtgtgtcccccaaattagc

SEQ ID NO: 1239 - DNA, 201 bp, Bos taurus
tcagaagaactaagctggtgataggaagaattagttgggcatataatatgctacataattttataaaaactacagagatgtgtaaaatgcaaagcatcacgactgaatggcagctccaagtgacttgcaaatcagtggtagcctaatatgaaaaagcctgcaaaagactcactttttcttaatatgcactatagtaatgtc

SEQ ID NO: 1240 - DNA, 201 bp, Bos taurus
actgagccaaatttaaatattaagaagagctcttccaaataaaagatttcattttatcaagctcctatgcgccatactagcagtgaacttaaatgctctacaaagataaaaacttcaagcacacaaggttaaaagcacaactagctggagggtcactagactacacttcgttcctggaataaattatgacttatcttagta

SEQ ID NO: 1241 - DNA, 201 bp, Bos taurus
atggtgtggtgacatttgtgacaaaggatgaacttaggttctttccaggtcagcattttaaggaacttggaacacacagagaaggtgaaagtactcacccatcctttgttcgcccagctcagagaaaaccgatgcacacttagcttaaaacctggagttgagtgcatatttcactgccgctctttcaattggtaaaactta

SEQ ID NO: 1242 - DNA, 201 bp, Bos taurus
tcccaggcctaacaaccccatatgaaggaggaaaagagccatggcaaaaccattagaccgaaagttcttagagcttttgcttgtaggcaggacatgctacttaaactcacaattttttttggccagagcaagtcatatggacaaactgaagtctatgaggcatggaagtataattctctcagtgattacttggacacagta

SEQ ID NO: 1243 - DNA, 201 bp, Bos taurus
ccagagactgagacacagtcatccacttgttagaagcactgcacacaaacagccaattttcctagaattttattattgattcacacaaagtaaaacaaatgtgttttggatagcagagtaatgaggtcatttggaataagcagaacaggtaaaaatctctttaaaacaggcattaattacatagtaagaagcccagtgaat

SEQ ID NO: 1244 - DNA, 201 bp, Bos taurus
gaggcctggcatgctgcggtttatggggtcgcaaagagtcggacacaattaagtgactgaactgaactgaatgctttaaatatgcttctttctgagtacataagtgactacttgactgcgaactaaatatcatgacttttttcattcactgtagtgtagagcctaacacaaggttttctattcaattgaataattatcact

SEQ ID NO: 1245 - DNA, 201 bp, Bos taurus
ttaacaaaaattctttatattccaattttttttttaacctgcaagatttagtaggaaattataccatatcaaaactatggtgctgtggtgtggagacaataaacgactgataaattttcatggttttcttttgtccatttgttaataatttgaatatatgatgttactcctttctttaactgattaataacacttattaat

SEQ ID NO: 1246 - DNA, 201 bp, Bos taurus
ccctagacagaatatatcactctttctttcctctgtgctacatctgtatctacactggctctactcaaaatgtgctggaatgtacacctcccttgctagattgaattttttgaggccaaggactattatctctttacttccagtacctaagacaacatctatcataaagcaactactctataaatgttaagtaaattgata

SEQ ID NO: 1247 - DNA, 201 bp, Bos taurus
tggctaagaactatggacctggaagctgtagatatttacaaaaatggcaaaatcttaccaaaaacaagctaggattccagtggccataatggggaatgttctagttagataagatcattcatttaagaagtacacttgaaagctaggattcccaaattaaataaaatgagatacctgttttaattggtatgcaggggcctc

SEQ ID NO: 1248 - DNA, 201 bp, Bos taurus
agatttccttggcccaacttgaaaaaaatatccctccctgaatccacgccccttgtcattctttgctgtaagcgtctcattcccctatggcttgtcctggtctcgcgtcagggcctgattgttgcagagacagaagaccagtccgtggcaaggccttacgcgtgccctgggacacagaggggcacacgctgccctgtctcc

SEQ ID NO: 1249 - DNA, 201 bp, Bos taurus
gtaagatttaattctacatagttgatgcatataaaaacattctaaggggaccgctaccatcaccaaactgccaaagggagcatggcatataaagaaacccgtaataacttgatcatggtcacaaaactctttgaaaactcctgattgtatattttccaatacttaatgaataaagggtgttaagacaactgaggttaaatg

SEQ ID NO: 1250 - DNA, 201 bp, Bos taurus
tggtagatagaaaacaaaatggcagcaagaggcacttggaagaacatgtgggtttccctttgttatagcaatatagtaatttatagaccttttctttcatttccctaaaaaaatgaatgaacatgtaataataaaacatagagtcaaggaaaaccctgtttcctttggattaatctctgtccttgcctacatgggcaccct

SEQ ID NO: 1251 - DNA, 201 bp, Bos taurus
ctctatagtaaatatgtgtctgatgtccactacatgccaggcgcctagtgatgctccagggatatggagatgaatgcaatagacagagtcccactcagatggagccagtgggctaataattttccaacgatgctggggcttttcttgtttcctcagagggctacagggtccttgcccttctcacagtccagtgtccttgga

SEQ ID NO: 1252 - DNA, 201 bp, Bos taurus
aaaacccaacctgattcacatcccagtgcaacactctcctccggcaaaagagacagaaagaccatccccatttcttgggcttcaccctttccatattttcccacttgctttcctaagcaaggccctccccaaatatccttcctgggcttcatcaacaacctcctgatagacttcctttctcaatagacgtacagtgtaaac

SEQ ID NO: 1253 - DNA, 201 bp, Bos taurus
agtaaatactattaaaataatattttgtttgatcaaagcaatctacactaacaacttttaggcatacaatggaagaatgattagaaaaattattaatgttcttatagatttaaatacatccaaaaataattcttagacctaacatttgctttaatcactttatgtattacaaagcctgcaagctttcattcctgctgctga

SEQ ID NO: 1254 - DNA, 201 bp, Bos taurus
cagttactgaacggccctgtgccaaaagaaaagcttcacggagcgctccttcccgcaattttctcaacccctggcattcggggcacgctcaatgcaattctcctggtttaataatgcctggggccgcgtgttccccataagacccaaaccgccgtccacggggaccgctgcagcgcaccctcggctcagttccgctgggca

SEQ ID NO: 1255 - DNA, 201 bp, Bos taurus
atttaagaatgtagaataaaagtatagcagaacttttcttgtaagaacaacatagaggacctactttaaggaacagaaaattgcaaagtggtataaatatacacttttaaaatgccttgctacttaaaaagtccttccagcattattttcacttttaaatatgttctgccttgaaagaaagattttttaaaaggtggacta

SEQ ID NO: 1256 - DNA, 201 bp, Bos taurus
ttcaacaataaaagcataattgttttagacaagaatggatcagatttttcagcatgcatattatcaggtattgctctgatattatggcctcctatgcagttggtttgatgtgtttgagttttaaaatatatattgtgttaagcaggatctagaaatagcttggtaaatattatttatggagttatctttttaattaactgt

SEQ ID NO: 1257 - DNA, 201 bp, Bos taurus
ctagttcattttataaagccattttggctgttggctagtttcattaaaacagggctcataattataggatgattagctaaaatgtcagtgttactatgatatctttcctgggggaaggacaacagctaagtgctggcagccccagccttgctgctgttgcagtacatgttctactagagcatgccagagtccagctgccct

SEQ ID NO: 1258 - DNA, 201 bp, Bos taurus
atgaagggatgaggagggtgaagaaggagggcattccttcttaagtttttttattgggggtataccctgtcttccaccgaggctaactcagtgcacactttaggtgttgggagttcaaatgtcaagcagccaacaaagaccagagtctatgatataggggtgtgaactgcatgggtttctagagtagagctcagacccaat

SEQ ID NO: 1259 - DNA, 201 bp, Bos taurus
atgggaattcagaacgatttatctcggcctcctcggtgaccatctctttgtcagttccacatgcactctgtttgcttttggtgcttctctcctactacagacaagttacactcaagctctcaaggcctcagcttttacaactgcagattgggaacagctgtccacaggactgtgctgatcaagtgagacaatgtgtaggac

SEQ ID NO: 1260 - DNA, 201 bp, Bos taurus
ttaaaacttttcattataagtcatttaaaaatagcttaagatgagcaaaagatttcacggagcttctgcattgaggcctgcctggagagggtttgtatgggtgtgggaccatgacagttaacaacttaggtattccaaaagggtgaagataatgtagctcacaaggttgaccataaggcatggccatagagctccctgaag

SEQ ID NO: 1261 - DNA, 201 bp, Bos taurus
ctgaacagaccaggtgtggggagagctggcagggagggaaccaacatactttggggtacatgttgaaagtatcaactaaaatactcagtccccagtagaactgaaaggaaccaggccaaactgaaaataaactagatggaaagagagactgaccacactttctgagctttgatttcttgcatctctcatctcctgccctgg

SEQ ID NO: 1262 - DNA, 201 bp, Bos taurus
cttccccaccactcccactccttttggtttccacgggcctctgggtacaggctgggagaaatcctcagaaaggttctcacattctcttagcctaagacctgggggaggaggtggggccctgggcctctgtgaagggtaagcgaagacaatgagaattcgatgctctaaacctacagtgtgccagcatgccatttaaaaacc

SEQ ID NO: 1263 - DNA, 201 bp, Bos taurus
aaccaagctaagtagtaggacttcttgatgaaagtcctagtctggtggcttctcagagctctcaaggcatgaatccgtggggccagggttctgaagtaaacgtagcaaatgcaggctgttctctttgggaaactctgcaaatgtccaaatcagctctgggggaataagggtgaaacccttgacaggccaacatttttgaat

SEQ ID NO: 1264 - DNA, 201 bp, Bos taurus
gaaaaccttgtcaaaaagcaattttatccataaggtaagtccatagcttgggaatgctgagactaaagaatcttccaaaaggttctaggacataacctccgaaacaatatgtctaaatacatacctttttaggataagtatgttaataatgtgacttaaggctttgaaaaccttgaacgtggagaagtgcaacacatatca

SEQ ID NO: 1265 - DNA, 201 bp, Bos taurus
cattatacatttgtccaaacccatggaatgtacaccaggagtgagccctgatgtaaattatggactctagatgataatccagtgtaatgtgacaaatgttttattttggtgcaaaacactggtagtgaaggaggctacagagtgtatggtgatggaggtaatatgagagctcttaattttgctatgaacacgaagctgctc

SEQ ID NO: 1266 - DNA, 201 bp, Bos taurus
tgtaatgtcctattttgataagatgcacaatgttggaaccagctggtagtcttgaataaatggccaattttgtccatcgtacacaaatctgtaacaaataacatagctgggaatgcattaggaacattcataatatataacccatagctttcatttttatgatttagtgatatttcaggatatttgtaaatctgaagattg

SEQ ID NO: 1267 - DNA, 201 bp, Bos taurus
tttcatctttcaagtgaaccagtcatcagcataaatacaaataatttttaaatcctcaaatcctaaaaactctccaaatgtagttcatattctggtcacttgcctttccttcctgatttgacaaacctctagccgtgggcaggaaacacggtccctgtgttagagccgacattccagaactacagtgttcgcacctagcta

SEQ ID NO: 1268 - DNA, 201 bp, Bos taurus
tttgtagacttttaaataatggccattctgacctgtgtgaagtgatacctcattatagctttgatttgcgtctctctaataactagcagtgctgagcatcctttcatgggcctgtggatcatatgtatgtcttcttttaggtctgtttaggtcttctgcccatttttttaaagatttatttatttttttggctgtgatggg

SEQ ID NO: 1269 - DNA, 201 bp, Bos taurus
caccgtgattcagatagatatatatgttcacgttagtgtgtgtagagcgtgggggcggactctgacagtgagcgtgtcctttgccatcccagctggcctcgtcctgggctccgaacatgagactcgtctggtggcaaagctctttgaagactacaacagcgtggtacggcccgtggaagaccaccgccaggccgtggaggt

SEQ ID NO: 1270 - DNA, 201 bp, Bos taurus
agttaaaaagtttgtactcaactgacatctctcctagacgttgagtctcatgaattctcaggcacttagaagtgattgttaactcagattgttgcccacacatgaggtcctaaggcatttttataagcaaagttctcgtaactgggaaaccctggattatttaggacctgaagaacattccagcttggtctaaggttattg

SEQ ID NO: 1271 - DNA, 201 bp, Bos taurus
ccttatgagagttcacatgtaacacctaacttcatcaaatcctttaaccaaattttaagatgagcaagaatgtctctccctttgtagctgcagtagaaaataaacatctttttcatctctttactagattttttttgttgaatgatgaagttctatattttcaaagtcaatctctgaaatatcataagttagcattaaaag

SEQ ID NO: 1272 - DNA, 201 bp, Bos taurus
actcctaaagggtctctcaaaaacaaaataaaaaatactctgctgtatcaaataggaaagcaaataatgatgttatattctgaatttgaatgtgatgaaaaacaaactggccaatttcctaatccacttgctgattcaagctaaaaaatcttttcatttaaaaaaaaacacctattgaataatgtctcaccagtgaataga

SEQ ID NO: 1273 - DNA, 201 bp, Bos taurus
tgtccttcccctcttagcaacattccacaccagagtggtacatgtgttaccattgatgaacctcactgacacatcacccaatgtccataatttactgtagagtacactcttggttctttaccttctatggatttagacaaatgtatgaagacctttgtccacagtatctcatagagttgtttcactaccctgaaaatcctc

SEQ ID NO: 1274 - DNA, 201 bp, Bos taurus
tgaaaactgaagcacctctcccttgctttgctatcttcctccttaatgcagagctggccataactaacactgcaggcctttctgttcaatatttgacattatggattttcttacgtttcctttgtccatagacgcttttctagagctctatcgcctgcagggccacctggaaagtgaagaggaaggagggaccctccatcc

SEQ ID NO: 1275 - DNA, 201 bp, Bos taurus
tgagaaggagttcatagtacaatctttaccagtgattcctagtgtttatgggatcataggccttcttagaaaatggccacacttacggaattggtggaggaagaggagttgtcaaggagactgacatagaaactcagtgtcaagatggtgaaaacagaggcaggccagaggttcagtcagaagaaaagacaaaagattttg

SEQ ID NO: 1276 - DNA, 201 bp, Bos taurus
ggccctggtttacccatagtgggaaattacacatctgataatgtagaacatttctcatacacctcttagctttgacattgaagaattatgagactatactgtaagtgtaaatacgataagtgagtttgctgtgattctctctgcaatgtaagaaaaaaaagtcagtggctgactttgggaaaagtttgagagaagtcctat

SEQ ID NO: 1277 - DNA, 201 bp, Bos taurus
cccattttaaattaagtgtagcattgtctaataaaaaaggcatagatcagttgcagtcaagggaaccaaattttcacttggattctgacactagactgtctacattctactgagcaagtcattagcattattgcttcatggtaaatatggtttttccctctggttgaagagtaattttcttgaaggcggagataatgctca

SEQ ID NO: 1278 - DNA, 201 bp, Bos taurus
aggatgaatacagaaaagctatggttcaaactccactttcctggaagccagggaacagggctcctgctgggtccactccaaaggcaggtaagtggtttacgtaacgtgcttccgaaaaagcttttgtactgaagaagctaattggcatatacaagccaataccaacacatattctgtccattactccccccccccacttca

SEQ ID NO: 1279 - DNA, 201 bp, Bos taurus
tccatgtggttcctatggaaaatgtcctaggtcgctgggatcaatgataattcctggattacttctttcaccaatatcattggccttaggatttctatccggagaaggcaatggcacctcactccagtactcttgcctgcaaaatcccatggacgcagaagcctggtaggctgcagtccatggggccgctaagagttggcc

SEQ ID NO: 1280 - DNA, 201 bp, Bos taurus
gaattcaaggaattaaatagaattcacttctatttccttaattctctcttagtctctttaaatttttcttctttttcggcccccacccacctttcatttgcgtatgagaagcaagaagaatgtgaaattgggagtgtgtctgatagaaattcaaatcttaatttagccatgtacatttgtgtggccctgcagcttccctgg

SEQ ID NO: 1281 - DNA, 201 bp, Bos taurus
ggccacgcagaagcatgtgactgctccaggctgctcgataactgataacactgtgtgctttctctgactgttgagtcaactgtgtgcttagcagaaaggcctagcatggcttcgaggagggcagaggaggaggacaagccggtagcagccttcagcttcaccgctgctccctcaggcaattcggcaacggcccgtatttgc

SEQ ID NO: 1282 - DNA, 201 bp, Bos taurus
cctgaccagggatcaaacccgagcctccctgcatggaaatgtggaatcttaaccaccagactacgaaggaagtccctgaagctgcatcatttttgtggctcagcttacaaagccacatatcaccactttcatcattccccactgaccagggctgtcgcaagccctgtctagacgcaaagaagagtacctacatgccctctc

SEQ ID NO: 1283 - DNA, 201 bp, Bos taurus
agaaaaccttcatgctggccaaaagtttgtgcttttctgatatgctgaatttacccatgatcgaatctaaatgagaaagtcagttctttcttgtctaacttatctcagggaatgaggtgaagcagcccaaggctttcaggaaggtccttcctcatatgaggtcttatcagatgtcttttatactggggctgagagtaggga

SEQ ID NO: 1284 - DNA, 201 bp, Bos taurus
tgtctgggtaagcagttttccagacaaagggaatggccaagctaaggaactgccactggatttcccttccccacattctggaacgtcaccccatgagcacgtcaaaggccaggaggaaccagaggcagggaggccagagcaggccaaccttagggtgatggcaagagagaaacctaatagacccagaggttttgcttcttt

SEQ ID NO: 1285 - DNA, 201 bp, Bos taurus
tcattacctatcaagaggttaagtttgtgactggagcccccaaagcagcaagctgcgccccagtggtgagccccacctcccaaggctttctaaacctgctcacccttctccatctaggggtcttttgtaaccaaaaggacggctgggaattaaatccaggcagatttgaaggccgattaccttcctcactattccgcggag

SEQ ID NO: 1286 - DNA, 201 bp, Bos taurus
atttattggagaattactataatcatcttcattaatttaagtgaaaggaatgaccactatcattttttaacagtgttctgaaagtgctagaaaatgcaaactggaaagagaacaaaataagaggcatatttataaaaaaaggaagtgaataaaaaactaagaaaatcagctgaaaccactctccaaaaacagtagaagaat

SEQ ID NO: 1287 - DNA, 201 bp, Bos taurus
aatattgctttatggaatttttatttcagtgtgtcctggggttgtgatttaaaaacatattttttactactcaagtctgggacaatgaagttggaaagcccccaatggaaaagccaataaacaaagaggtatttacaacacaatgtgataaatattatggtgaaaaggggagttaaggattgtattctggaggagggattc

SEQ ID NO: 1288 - DNA, 201 bp, Bos taurus
ttgtagaacttatttctgacctctccttcacttgattcattttcttacttaaccagcacttactggccaatccatgggccaggcactgtgctaaggttggagatacagaggaccagaaagtggtcacagcccccagctgaagggatcagttaggccgatgaagcacataaactggttacaccagctggttaaatgcttaca

SEQ ID NO: 1289 - DNA, 201 bp, Bos taurus
ttgaggccccaacccaataggactgagatccttataagaagaggaagagacaccagagatctctctctttctctctctactacattcgtacagagaagagactatatgaggacacagtgaggccatcacacaggtgattgtctacaagccaggaagagaggtcttaccagactaccaactctgctggcacccagatcttgc

SEQ ID NO: 1290 - DNA, 201 bp, Bos taurus
gtaaagtgtttatatatatttatatatacatacttttatacatgtgtttatatatatatccaaacacatatgtatgtatgaacaaatgaatgaatgaaaacgaatgagacctgactctgaattctgtcagttatctgaactaagttaagcttcttaagtgctctcagacttggcatcctcacccctagaataaagaataaa

SEQ ID NO: 1291 - DNA, 201 bp, Bos taurus
caatgcaaatattttgccttatattggtattcgtctttagaaatggcttttttccttataccagttacaagatctctgaagccaggcactaaatatttctattctaaatatttctattctcattcattaattcaaaaattatttcttcagcaccttctacaagacttgtgaagagctctacaaatgtgtgtgtgtggttag

SEQ ID NO: 1292 - DNA, 201 bp, Bos taurus
ggtcatctaatcaatattgtttcaagatcttaaatcaaatggttaacaggcaaaatgttagatgagggtccagtagcagctagagctctgataagtggacgtatttctctttaaacacaatcttctaacactactcagacctataaagtggaaaaacagtaaccttccattttgacacattttgaataatgtcaaatctgc

SEQ ID NO: 1293 - DNA, 201 bp, Bos taurus
ccatcgatgtgggtagaattactttatactcaccaggacaggccctgtttctccacttgcatctgggctcagcgccactgacagaggtactgagccaaaatgcctgcacgatccaggccctgccctgcccagccccaagatctgcctagcaacgcatctctctgggcctcagtttcctcactggcatggtggggctgcttc

SEQ ID NO: 1294 - DNA, 201 bp, Bos taurus
cacacaatagaatttaataatgaagactattatttacttctttgttttgcagagagctgaatgaaaacctgacctccctgggccctggtagaatttctccatgaatggttagacggttttgcgtttccagcacgttggcatccacttggtcctggaatggctgtgcatagctgggggccaaatgagttcaaatgactcctc

SEQ ID NO: 1295 - DNA, 201 bp, Bos taurus
taaaaatattgttttaatattataatttaaggaaataagggggaggtcatttgctttagttttctttgaagcacttcagagggaaaatttataataacatggcagctcttgtaaagaaatggcaatatttactaggagataaaagggtaaaaaattttttcttttttcttttaattgtagtgattatattttagtgataat

SEQ ID NO: 1296 - DNA, 201 bp, Bos taurus
tatttttatgcagtatacattttattactttgtactaatacattctcatattacaaaggcaacttaatggaagaatgtttcttttgatagttgaataatccgaaagaacacaaacagaactgcacattaaaaaacgtatttcgataacaaaagacaagttcaacaacaacaacaaaaaaatcttcttttcttacaggtaga

SEQ ID NO: 1297 - DNA, 201 bp, Bos taurus
actctctgagcatatacccagattattgccatggtatttaatctggatgcttaggcagttaaaccttctctgggaatcaaagactgtccagtgatgatgagtaaaagcaattaatccttcacctttggactgctaaagatggctggtccccatgaatcaaggttagcaaagggtaagaactgggaagagcagaaacaatta

SEQ ID NO: 1298 - DNA, 201 bp, Bos taurus
aactgtgggtctcaactgagatgacaaataggtatggaaggaggaaggaggtgagaaaacaagatgcatgggtattcccaaagagccaatggagtagagcggttccaggtgaaaataagacctaaggtgtattcgtgggtagataacttaggtgaattagacctctttggcattagaaagttcaagaatgggttaagtaca

SEQ ID NO: 1299 - DNA, 201 bp, Bos taurus
aaaatgataaacattatgttttatatatattatatattacaattttatcataataatttaaacaatctatctttttgttagaaaacaaccttctcataatgtttagtcagacactgcatatctgagattgtttgattgcttttggtttgcaggctactggctctcagatcgggatgatggtcaatgccttcactaacattg

SEQ ID NO: 1300 - DNA, 201 bp, Bos taurus
aaaagaagtaccactgctttaccttcagtatggaatcagcctcagaaagcattacaaggggaaggaaaaattaggaacactaccttagtttcttggaaactttgaggtccgtttttccaggaggctgtttgcaatttccagagaggcttggatagtcagtcaatgagggccaaatcctcaggtgcaactagacattggcga

SEQ ID NO: 1301 - DNA, 201 bp, Bos taurus
gtctgagggcacggacccccgcagcccaccatcaccagaagagacgatttgcaaccaaagtcctggggaaagaatcgggtgtcttagacaccatgtgtgaggatggggccactaggagaaaccttgtccctaacggaagtgggaatgagcagaactggttgagaatttttccctgtcctggggctactgcatttcctgaac

SEQ ID NO: 1302 - DNA, 201 bp, Bos taurus
gcaatacagaagtggtttgctgaatataagataaagctttcctttagatgaataaagagagcttttaaaaatcaatgaagtgaaaaggccggatgattaacgaaatcggcatgatactgaaaatgaaatcttgaactatctgttgttgtttagttgctaagttgtgtccaactcttttgcaacccatggtctgtggcccgc

SEQ ID NO: 1303 - DNA, 201 bp, Bos taurus
ctgtttgagaataaaggactggtgaataaggaagggaagtgggaaacaatttcccagcctggaaccttgtaaattaggtcaaccaatcccaaatcaaatcgtatccacagtatttagtaatttcatttttacatggcccctttatcataattcacatgaaatcaagataattagcaaagcaccactatctcaatttcttta

SEQ ID NO: 1304 - DNA, 201 bp, Bos taurus
ggacatgaatttgagcaaactccaggagatagtggaggacagagaaacctggcgtgctgcagtccatggggtggcaaagagtaggacacgacttagtgactgaacagcaacaacaaagaaaagacaatctcaggccctcatcttacaggagtccatatggagcaaactgcaacccaattcaatttaggagaaacttgttgg

SEQ ID NO: 1305 - DNA, 201 bp, Bos taurus
agcatcttgtggtatatgggccatcctggattactatattgagtattaatcacaaactttcacttttcctataggctactaaatcacttttatttggatcaagggcctgcaagaaactcaccaagtctctacatatcaatatgaggacatctgctgtgactaacagttgaaggcagctgacccccttgtgtaaactgtaag

SEQ ID NO: 1306 - DNA, 201 bp, Bos taurus
tgttccagggcctagctggaggaagacagcatcctggccaccggcctgtgcgtagctgtgttagacttgttgctgcctgatttcccgttgcattgctctcatggggacgtgctctgctggccctctttgatgtcatctgctgttctccgcaacacttgccagctgtcctgagacccacaggtcacaatgtcctgcccgcca

SEQ ID NO: 1307 - DNA, 201 bp, Bos taurus
ctgagtgaactccgggagttggtgatggacagggaggcctggcatgctgcgattcatggggtcgcaaagagtcgtacatgactgagcgactgaactgaattgaactgaaagagactcaaagaagtaaatatgcattatacttgaatttataatgcacacattcaggctggggaggaataatctctgtggtctccaggtttc

SEQ ID NO: 1308 - DNA, 201 bp, Bos taurus
taaataggaaaagaaaattttcaacacagatgtccgtagaactaaatatcaatgaagaaaatgtttgtaagattagtagagcatctaacaggcatttggacgtgaaaacctgacctttagtgttggcagtgtggttttgtagaccactttagactttttacacggtgggtgtgtgatgctgtctaatctctgactctctta

SEQ ID NO: 1309 - DNA, 201 bp, Bos taurus
cagagcttttgcattgagaggggagtgctagcttgctaccgaccactcagagaaaagatgagggatgggctagataagttttcttctgtagctgagggtatctttctgccagacattgggtttagacagtggaagacagaggcctacaaacaactctgtgatgtgagagggagggaagtaaaaggagccataggaaaagcc

SEQ ID NO: 1310 - DNA, 201 bp, Bos taurus
ttattgtattgaggagctcatgttcacagggaggagattggtgattggggggtgttacttttcctattttaaagctgaaagaacagttggccaaaggttacagttattgatttaactggacagatgttcccagagtataaggtcattgttttcattatttaaaaaaattttaattcgttgcttttaggcaggttagaatgc

SEQ ID NO: 1311 - DNA, 201 bp, Bos taurus
gtaaacctcgttttaagattaaggtaaacaatgttgtttgttttgcgtcgtttttcctatggtacaatattctaatctacttccttagcttttcgtaatattagcataaaataaaatgatcttatttgatttcctgggatagtcagtgtgggctgtattcccaggactaattgccctcttgtaattgtttcctcaagaaga

SEQ ID NO: 1312 - DNA, 201 bp, Bos taurus
tctcagtgattgcctcaatgcttttttgccacagagaaaaagcatggtccagtaacaatgctgcttctttacctgtcttcttacaccttattcaacaaccttaaccatggctagttcagacacctaagaacagaagacaaattggcacaattagcttatcaggtactgtgcatctatgccaagccaatggatgcttgaaga

SEQ ID NO: 1313 - DNA, 201 bp, Bos taurus
gatgtgaacaccaagattttaattaacttgatggacagcacttttgatatgtttcaaagctataattatacgatgttctataaaaggaaataactgccaagtatttaggtctatcactgaagattaattttgaaatcttattttccttcctttttctccatttttctccacttcctctgtaaaagaagatttaacaaatac

SEQ ID NO: 1314 - DNA, 201 bp, Bos taurus
tccataacaccatgtccgtatgtttgggggtcacaggactacagtatattcccacccagctggatttgattgtgcagctgcctatgggtgcagagaggaagattgagtcttgcctcctccgaccaaacaagtgctggcataccccagggaacatgtgtgaaatcctagtctgtcgtacaccaagaggagattatagctgcc

SEQ ID NO: 1315 - DNA, 201 bp, Bos taurus
ccgcttctctctgtacagagtggccacccacagacgccctgggcccaggtggacatgtttgtctcaggcaacacaattttcctccaactcggctgactaggtcagagatctaggcctggccatctctagactggcttgtggcaccagagataacttgcctgagagcctgtgtagtaactaaactaatcaaatcctctccct

SEQ ID NO: 1316 - DNA, 201 bp, Bos taurus
taaagctaagaagaatcttttttaaagatctctttactctctcttcattttcattcttaatattaaagatggattctctctggggtttgaaattccacaaataatatccttagaagattcattgtgtattcaaagataagcagagaaaaatacagctctattgaatagaccccagttcttgtctttgaccatgttatgggc

SEQ ID NO: 1317 - DNA, 201 bp, Bos taurus
ggtatgatcaccccaatttctccatagacaacttcaacatttttctttctcttgcctctatcattctcagagatagaagcatgaagctgcaagtcatgcagtgcatctatacggccaggaatgccaataaatggacaatgatgtaaccatggatgtcatggattttgattcaatcccaatctgtatgtcacttacaaatgt

SEQ ID NO: 1318 - DNA, 201 bp, Bos taurus
aagtaaaactaggtttatgcactttagaaataacagacacatgtcaggtaaaacacacttgtccactgaatagagctaatgacataaaaacaagaaaaaacccacaaaaatcagatagtgataccaactgatattaatctaacctaagacataacagaatacaaagaactatacaaaaaagatcttcatgacccagataac

SEQ ID NO: 1319 - DNA, 201 bp, Bos taurus
attcaattactgttgactgccatttcaacctgtgtcatgtcatttgtatctgagataactataagagtagatccaggttttatgtggcctgaatcttatacaagtttaggatccctattaaaaagaaaaggagataagactaaaagtccaaaattagatttgtatgtaatagactcacagaagtgacaggccttgaagctt

SEQ ID NO: 1320 - DNA, 201 bp, Bos taurus
agtctcatagtagggaaccaatctgctttggcttaacagctgtagcctgcaaaacaaataagaaagggaagaagagacccaagaaactgcagattatttcctttacctggaatatggttcccaaaaacatgaacaaaggtttataaacagtcttcctttcaaacattactgtgtttgcaagatggaaaatctgggaaatgg

SEQ ID NO: 1321 - DNA, 201 bp, Bos taurus
agagaagtcatcttacaatcattctgagaaggccagaaggtggaccacatactcataatccatgcctccttttctccttctttcattactaataaagtgcgctgaatggaaacttggggttctggggagatgactggagtgttaattgacaagtttccttttgtgtgataccatacagcaagtcggctttccctccttctt

SEQ ID NO: 1322 - DNA, 201 bp, Bos taurus
gtagtagcagctattgctcctttgtcacaagaaaacacatatcatgccagagtccagtgggtaatgcactctgaaaaaatcccatccaagactgaaaaaagttcagaacataagaagtctttatgaaaaaattctctctttattttgtatctagattggcaactattctaggagcctcttcatagtaggtggatttatact

SEQ ID NO: 1323 - DNA, 201 bp, Bos taurus
tcattattgtagcgtctgccacgtgcctcccacttgtgcagcttcttaacctttctatacctgggggtgctttgaactctcagatcttccaaagacccacagttgtttgaaatggcccagtctgcattcctgcttgaagttctgtgctgtaacttgccggcttgcctggtctccactttgcctgctcttaactcctgaacc

SEQ ID NO: 1324 - DNA, 201 bp, Bos taurus
cagagtctgcttctgaaagtcctctgaaacctcacgtgtttctccaaccatcctgttgactggaccctgggttaaaccaggcctagagctttgtgtatctgttgatgttttagtgtttttggtatttttaggactcttgacagggaaagcctcaatcttctggtagtcattcctcagttggccagtttcagtctgttgctt

SEQ ID NO: 1325 - DNA, 201 bp, Bos taurus
taaaaaaagaggagacttccttgatggtccagtggttaagactctgcacttccaaagaaggggtacaggtttgattcttgattggggaactaagatcccacaggcccagcaacatgatccccccaaaaacacccagactcgcatcttctcatacagagaaaagtgctaaattcattaacttaggatgtttgcttttacttt

SEQ ID NO: 1326 - DNA, 201 bp, Bos taurus
gaagagggaagtagacacacagagagacaccaagattgtgcacatggagagaaaagaccatttgagaacacagggagacagtggccgtctgaaagccaagaagagatgccccacatgacaccaacctgccaccgctttgatcttggacttctggccaccaaaactgagaaaatagattgtggtttaaactactcagtttgg

SEQ ID NO: 1327 - DNA, 201 bp, Bos taurus
ttggctgatacatatatcctgattaaatcagttgcaatcatcgactaaaatcacataactttagtaccaatataataccttgtataaactactgaaggaataagatatggaaaaatctatgtgtgtatagataaataatcaatgatatatacatatgatcaatgataaatatggttactgaagttcttatttctgcaaata

SEQ ID NO: 1328 - DNA, 201 bp, Bos taurus
aataagtagggatgaaaaacaaactgtaactgaaagatcgatatttttcgcttttgcagacaaaacagctaaccctgatctgcagacaaaggagacagcagtatgttgtctgagatcatagccacacccttatctctacgttctcttttgaacagtagtgtatattacaaccagaattatattttaagaaaatataacaat

SEQ ID NO: 1329 - DNA, 201 bp, Bos taurus
gagttaaggcacatggcagaatacaagatagccataaaaataattgtgtttctatacaccaacaagattacttctcagacttcccaggaagtgaggacaaagagactgagctatgatgtctccttatgactgcccttcctttagggaaggacctgcccacaggatgctgttccctgacacaaaaacacaaaggaaagcaaa

SEQ ID NO: 1330 - DNA, 201 bp, Bos taurus
gggatggtgaatcgaatagagattcaggaagaggaagaagagttgggaggaccttgaagctcctgccccttcctacacgcctggccctacatttctcttcacagggctgatcttcattcaacatgctctagggctcaccttctctcagaataacttctttctggaacaggcatggcctccttccctccaactgtgcgccgg

SEQ ID NO: 1331 - DNA, 201 bp, Bos taurus
taatctggaacagactgagttctgagtttgttttgttttctctttataaatcaacccctattaccaaacaaacttggcccatagaaagataagttgcttcacttttataccacacggacaaatttcttatcgctaccaccaaattgactactatggggttattggaattgcaacattggccaaaacttagccactgcttct

SEQ ID NO: 1332 - DNA, 201 bp, Bos taurus
gcctggacaggcacagctataaattattatcatatccatagaaacaaggaaacaagggaccctgctagtgaaccatgaggttgccatagagaagctcaagggggcctacttaaaacccaggcaactttccttcatgttcctggaactcttctctgcctccactgccagttctaactcttaaccctggtgggagttcatttc

SEQ ID NO: 1333 - DNA, 201 bp, Bos taurus
ttcctatgtagttctctacctacaacccttcacttacccgtcatcagaatataggatatagaccaaactgcttaaggtgggggaaaagatttctataatcggaccaatttctctgcctcatctctcatctgtgcctcttgtgtacactttgctttcatcacagttctgaaatacatcacagttctgaaataatctctgtac

SEQ ID NO: 1334 - DNA, 201 bp, Bos taurus
aagtcaacgtttattgaccaagtgctaggccagtgttatttcaacatgttacctcttgagcgatagcaagggcagcatcacctgggaatgtgttaggaatgcagattctcaggcctgttccagacttcctgagtcagaacctctgggatgggggcggggtcatttgtcttttaacaagcgctccaggtgcctgtgaagctg

SEQ ID NO: 1335 - DNA, 201 bp, Bos taurus
ccagagcctgagaaaccaggagatggatgtaaggagagagaaaatctggatactttgaggtgagaaaaaaacatatattagctgttagggaaagcaaaaactctgcctccaggcttacctctgaatggaagggttctcctccccagggaggtggaggcagtgtctttgggatggaggcactttctcttagtcactgtgagg

SEQ ID NO: 1336 - DNA, 201 bp, Bos taurus
ctccaggaacatgcgattgacctggtaggcaagacagtatctgaaaccattcactctccaacaaaacagaaatgggttaaattgatgttaagtgttggaggaattcatagaaatcatagcagtcaggggaagctgcatagaggagtgggagaaaacaggacccagttgctgagatgtgtcagtgacaactttgaaggcttg

SEQ ID NO: 1337 - DNA, 201 bp, Bos taurus
cacttctcatcttcctccagaaatcatttggtgatctttcaaaaagatttgaaataaagcaccgccttcagtgtaaaaattttacgtggtatctgaacaatatttatccagaagtgtatgtgccagaccttaatcctgttatatctggatatgtgagtattttcctgttcctttttatttggtatactctttgccaccaat

SEQ ID NO: 1338 - DNA, 201 bp, Bos taurus
catattctaaataccaaatcacacagattctgcttcctgcaaagcaaaacacaaatactgctaaacatgtgaattgcaggatactacttacaaaagactgcatttgtcttggtaaaagtatcctccccaatttcactggaataggaagttcctttctggccctcatatttgtttacatgtcattacttgatgaaagggttg

SEQ ID NO: 1339 - DNA, 201 bp, Bos taurus
atagcgtaggaaccataataaatgatctcacaaccaaagagaccatgggtagtaaacagcgtaaactgtggaaaactggagatgcacacacaggccaaggtgggaagccactacttaggtccaggtcatttcacctccatgttctcccaatataacccactctaaaatctggccaatgccccattcacattcagaagcaat

SEQ ID NO: 1340 - DNA, 201 bp, Bos taurus
gagtttttaaatgaaatgacctcttgcattctatatttgaaagtttccttatgtaattccatgtatgtgatttataaaggtatggttagaacctataagatggttagattttagagttctctatccatgcacatagatgcataagcccacacatgacaggtcacatgatttccatcccaccatacgactgtagcggtttca

SEQ ID NO: 1341 - DNA, 201 bp, Bos taurus
cccttgaacaatattgggtctaaaccacaagggtccacttagaaatggatttttttcaacaaatgtgtactgcagactgcataggccctgcttggttgaacccacaaatgcagaattgggaacatggaaggcaggaggaccgaacgtagagttatgtgggaatttttgactgcagggaggatcggtacccctacccgccct

SEQ ID NO: 1342 - DNA, 201 bp, Bos taurus
aataagaatggtatccattgaataaaacaacataaaaatcaagaataaaacatgtttttttccccatttgacgtaatttttgagtgacttccaataatacgtagatttgttcttaatgccatattttttaaaaattggttgtgattatggtagaagtatagggtacacaatagctatagtagctattaataataaactacc

SEQ ID NO: 1343 - DNA, 201 bp, Bos taurus
acttccctggtggtccagtggttaagacttcatcttccaacgcagaggcaagggtgtgatccctgggcaagatccagtgtcgtggggtgtggccaaaaatgttttaaaaataaataaaaacacaacatttcaccttgactgtagccccattaatgaagaagcctccttggcctcaaagattttatatgacaaaggtgaaga

SEQ ID NO: 1344 - DNA, 201 bp, Bos taurus
tctcaactgtcctcagtaattattttggctgaataaagtctgaagcaatgaaagaggtttcaaagttctattacagaatccatgagactcaatatagttcataagcagtgaagccttgggaagaatcatggcaacttatttagattaaaatctaacaactaataaaaacattattcttgttgtagtcatcatacacagccc

SEQ ID NO: 1345 - DNA, 201 bp, Bos taurus
ccatgctttgtggtgatgatgtctctgtctttgtagagctcataacccaaaatcttgagagccaaggaaaataatgtttaactctccaacttatttacctcttcaactaatgtttaattattaactatttcccaagaggaagccacatgaaaaaagccagttttttcatgaggaaaaaccctcatgaaaaaaatctcaaaa

SEQ ID NO: 1346 - DNA, 201 bp, Bos taurus
ctttaattcttaatgttacctatattattgaacttggctatagaagaaggattcttacacaataaaatgaaggttcttattatcttgggaaaaaaaaaaaaccagtaaattatggtgtaactctggctttaatctgtgtttcagaaaactgtgagagtagtgatcaattttaagaaaacgcagaagacaatagtaagagtt

SEQ ID NO: 1347 - DNA, 201 bp, Bos taurus
atggttttcagcttgaccctgtcactttcactagtcaattctgtttatgcactaatttttttttcacagacaataaaattcagtgatgtacgttgctgttagaagtgtagtttttgctgaaggcaatcagacttactgactctaactaaaataaataattggagatttctaatcactaaccaaagcatttttcccatagta

SEQ ID NO: 1348 - DNA, 201 bp, Bos taurus
aaaatagtgcattaagttggaaataccttttaggccaacagaatcatacaggcaggcagctgtatacttgatgtgttatgggccctgatttggcagtctcttcacagataaagctctcattgcttccagaacgagctggatgtgaatcaacacagaaagcaggccctaaatgatgatcctataattgtatcctatttatta

SEQ ID NO: 1349 - DNA, 201 bp, Bos taurus
ccagttacttttttaacccacaattgcgcttccaaatggtagatttacaccatcctctgcaccagcttttaataccgtttccatagaaggatgtagggccatatgatgtaattgaaagatactggactgggaatccacaaacctagtttttaatagggtcctgctgctgagtgatgtgatattagcctattgcccactttc

SEQ ID NO: 1350 - DNA, 201 bp, Bos taurus
acaattatatctgtggataaacattatgggtgaataaaaatagcaattgtaaaatgatttaaaataggttaaatgattaagaaactgaggttctggactcgtaggggtaggtatgggcatttaaagatgttgatggtataatttgttttctatttcttcatatgtcagggtttttgtttgtccaagattttgataacacta

SEQ ID NO: 1351 - DNA, 201 bp, Bos taurus
ggtgggcagagccagctttcaaaagcaatagaagcctagatcttactgtttcccaactgtcattctcctgccaaggcccttttaaatagggtttggggtccgcctttgtattacatatgcataacttccattagtgttaatcacatgctccattttagagctgttttggcccctccggttaaatgggcgtttaaacagttt

SEQ ID NO: 1352 - DNA, 201 bp, Bos taurus
caccaccaccaatctcatgactccaaacagagaatagaggtaaaaaatcatttgaatgctctctctccaagcatctttttctttttggccaagcctcccattgattttacccagaaggcaaaagaaccaggacagtttacagttgacagagatcaacctcctggggccaaaccagggagaagatgaatgaagaaatgtctg

SEQ ID NO: 1353 - DNA, 201 bp, Bos taurus
gcaatttcaatttatctctgacagtgtgaatatgacagcagaagctaagaaatatatgcgtagtcacacaaagtgaacacgcgagaacccaaacaccaaatgtatgctcacacagcatatgaactgttcactttttcttaaccaggagactccacttaacaaaaggggagaaattgcaacctagttgttaaaatttctgtg

SEQ ID NO: 1354 - DNA, 201 bp, Bos taurus
ttttcttacatttgtgaatttagtgccaccaaagaccaacagcactggccaagggctccgaaaaatagacaccatgaacacttcctatatctttttttttattattattacgttagatttggccatcttttaaaagctgatcattatgttggtaaaattataccaaaatataaattggtgtacttatttgtacaaagaaaa

SEQ ID NO: 1355 - DNA, 201 bp, Bos taurus
tctctcatttatgacattataattgctaaaagtttatactatgcaaaacatgattctaacaccatgtacagtatacccacaactttattttcatactttactgtataaaagataatattttcataaaattttataatgatggcgagctttaaatttagaagaaaaaaatccagattagaatagtaggattttttcccatca

SEQ ID NO: 1356 - DNA, 201 bp, Bos taurus
tcagtctagtttcaattgaattggcttctatttcaagccttgtaatatcattgtcagatgtaccaataagtcattatttccaggaatgaaacctacaatacggtggcatatcccatcctcttagttacaaaaaaaagactaatacagatggaaagaataaataaatccatagtagccttgtgagtatgtgagtcactcggt

SEQ ID NO: 1357 - DNA, 201 bp, Bos taurus
gattcaccagtctttttactgagcacctactatgtgctaagtaccatgctaaggctggagaaagaatgagagaataggacacactctggccttccttgccattttcatttctcttgctcttggtgcttcttcctcaggattcagctcctccttctcttctgatcttcttggccgctgtcatttcactgaacatgcagacac

SEQ ID NO: 1358 - DNA, 201 bp, Bos taurus
ttcacctctgctcttgactttctggcttagttatacataactttacctacaaactcctttcttaatatttggaaagactgtggtacccaaggagataaagggcaatagaaatgcaagaagctagtgatagtgtacttaacctttttattttgatcagttacatattgactcaacttccttagaattttccagaatttcttg

SEQ ID NO: 1359 - DNA, 201 bp, Bos taurus
aatcaggtagatgtctgtcttctctagctttagcagcagccatgttcttttgcgtctactagagctaacattctctgggctaaggtggttttcaagtaagcgaatgtccattcgtatatattgtggcttttaatttcatctcatgatttagttcacattcaactatctagttgaattgatagcatttttctctgtgaattt

SEQ ID NO: 1360 - DNA, 201 bp, Bos taurus
gcaacctcttgtatcagagtagcaccttcatagcctggaaccacacagcctgaaagcataaaagctggcctctaaccagggaaaaatcaactcccatcacaatagacagaataaaatacaatgcactttgttttaaccagagcttccgcaagtttaaagcgtggagggagcttgtaaacccacattcctataagtaattga

SEQ ID NO: 1361 - DNA, 201 bp, Bos taurus
agaacagtgttaatactctgaaatcctcactcagctcagctttatatttatgactttgttttgtgtttttctgtcttgcccttcattcctctattatctaggccagagaaatctctgctggagacttgtggcttcagtttgtctaacttcttaaagccaagacatgggtctctgcttctctctcactcggcttcttttatt

SEQ ID NO: 1362 - DNA, 201 bp, Bos taurus
ccctcacttttttaaaatgttgaatttaatcatgctattacaacctagtaattgccacttttctgaccacggctcagaactaaatctatcatatttcatttccctttgaagttctaaaggaatttaatcttgaaaagtcatttatcatatccagatacctgacacccatattttgtcaagattacgatttctgccaacctg

SEQ ID NO: 1363 - DNA, 201 bp, Bos taurus
ctagactgactgtccttccccatctgtaccataggcactgtgcctgacaccttcctcaaggcagggacagatgcagaaaatattggcccctgcaggtacacagctccatccctcactgggagttgtagtcaaagacaggcacctgccttacccaaggtcatggcccttcccatgggatacctgtaaccggtgactagctgc

SEQ ID NO: 1364 - DNA, 201 bp, Bos taurus
ggacatagagaacagttcattggaatcgtcttttgcagattcttctatagtttcaggtacttggcgcacacacatactttactgcactaattaactactttcagaaaaatcaattgttgcattgataacattaggatctattaaacagagggaggaaatttgggctttggggttttgtatttgtattcagataatatttct

SEQ ID NO: 1365 - DNA, 201 bp, Bos taurus
acttagtgaaaaattgggacaaattaaatacctgcctttaaatatctatccctaattgtcaaacttaatgatctattcatagaagtatgcataaactgtggaagtttctaattttcatacatactctatgcatttcaaaattgcatgttttgttctgtgcctttttgttgttgttgttctgtgtgatactcaggttccagg

SEQ ID NO: 1366 - DNA, 201 bp, Bos taurus
attaatgcaggtgaaatcctatcacagagaactccacaggaaaccagtattaatgaaaactcccaatggatcaaagtggagacttctcagaagctctaaagtataactccttctttaaaaatcttaaactgcagcatccagagggaatatctctaataaagaaggcctcaagtattttaaggtgtttatctttgaaggggc

SEQ ID NO: 1367 - DNA, 201 bp, Bos taurus
ttcaactagaagtaagatttgcctgtacaataattaggccatgcttcctaaatccacaactgatgctgatctttcttagcataagatatgctctctaatacgtataatcttggccttgctcacgagcctgcttcagacagatcgtaagtcccacttgcacccctccatttcttccccatagcatatatgttggagtgaacc

SEQ ID NO: 1368 - DNA, 201 bp, Bos taurus
gtttagttcctctctctcatacagggtacaatcattctctgacattcttgataccctttattctgaatatccacagaatcctaatttatgtatctattcaagtttggaaatacagataagccttttagtctcatttttgtaaaataactccactttgatctgtaaagaaatatctctattttaagcaggcaggctaattgg

SEQ ID NO: 1369 - DNA, 201 bp, Bos taurus
gattaactgaagaaccaacacaaacagtaaattctgtgagcatgattttcagctaaagacagcatgtagactggggctttgggatctctgccgatacttccgtatggggatgaagtaggggggcggagaagacttctaatccctaggtgaaagagctgtgaaaacaacatgctctgcacatcacctgaagttgttcccttc

SEQ ID NO: 1370 - DNA, 201 bp, Bos taurus
tagtatcatttttcaaagacaacttatgataatatttcagaatattaatttctagtcttttttcttttaaattaataatgtttatcattatcttatgaattaaatagataacaactgtagaaactttagaaaatttagaaagtagaaagagaaaaattacacccaaccatactagagatggccaccacgaatgggtatatt

SEQ ID NO: 1371 - DNA, 201 bp, Bos taurus
tacctgaatgcagtggcctgaggacttgaaaaaaaattttttttttctttagctctttttttttgttggtggctatttttaaaatggtctttaaaaagtccggagtcctaaaaattctacacagaaatgtaggcaaacagaatggcaaagtaacataaggcagtgtttcaggcaaatttatgataacataaggacagctta

SEQ ID NO: 1372 - DNA, 201 bp, Bos taurus
gtcagggcctaaagcctccatgggccaattcttcctcattcctcccttctcactcactcctctcacttcctctactgctccttccggtcttcttctctaaatacgtgtccatcccttaatgcaacttaaaactatttcatatgatcatcatctagggtttattttagctataattaattaaaagccaaactaacaatgact

SEQ ID NO: 1373 - DNA, 201 bp, Bos taurus
caatcagtgcctccctgctctcttggtctggacaccagtgcattgaattgcatggtcaggcagatataacagctcaggaaccacaagtaccaattcctgaagtgttctgaattctagcttaggattgtgtgaagatagaaggacttaatgaaaatgactaaaccacatgtagtgtgagaattatgttccttttacttccca

SEQ ID NO: 1374 - DNA, 201 bp, Bos taurus
gactagaaaaatagttagtgtcacggccccagtagctgctccatactgggatctattgagcatctccagcaggcaaggttgtaaccttaaattacactgatgtggccagttgcaatttatggataactttttccactgcctggcttccctgatagctcagttggtaaagattctgcctgcaatgcaggagaccccggttcg

SEQ ID NO: 1375 - DNA, 201 bp, Bos taurus
agcaatatcagtggttaggagcagttggtgtttgggactccagggttgactctattcttagtgattccaaatcagaggtgtgggagaaaatgggaaatgtctggtaagtctagccaaatgttgaggaaactagaattcagatctagtccaatctatacacacacacacacacacacacacacacacacatacatatatgta

SEQ ID NO: 1376 - DNA, 201 bp, Bos taurus
cactttttaataactggcctctggagaagttgctaccgcagaggttactcagcctgtgtttcgctttgctgtccctgtgggtccgggcagggctgccacttggacaggctggtcccaaaggcccctgactgaacacaagtagcgctctgaccccccccccccccggaaagccaggggacacccgctcctccaccttctaca

SEQ ID NO: 1377 - DNA, 201 bp, Bos taurus
tagacatttcttcaaagaatacatacagatggccaacaggcacatgaaaagaagctcaaattgcgaattattagagaaacgcaaatcaaaatcacaatgaagtatcaccataaggccatcattttaaaaatctacaaataaatgctggagagggtgtgaagagaaccctcatatatctgctgttgggaacggaaatggtgc

SEQ ID NO: 1378 - DNA, 201 bp, Bos taurus
agatttgaagttctcctaaaataaatttcaggcaaatatgacctcattatttttaacttcagagttctctatctggttcatagaggtggcagtaagctgaccagaacactagaggaagagaaaataagagcaagaactgtccccctatcctgttctctgaccatggcagccagccctttccatctctgggtcactgtttcc

SEQ ID NO: 1379 - DNA, 201 bp, Bos taurus
atatcattttgggtccttcaggaaatagacatcaagacagtatcagacaagctcaactatgaggaaactcctatggaagataaaggagaagggagcaggagtaggtagcaatgagcccacagtgcaggtctgacacctgtgaagggagaacaagaaggaaggattgggtagaaagtctcgaactgtagtacagcttcaaga

SEQ ID NO: 1380 - DNA, 201 bp, Bos taurus
cttttccatcatggctaagcactgtgccagctgcaaagcagaaatgttacaaggtccatctctattttcatagagcagataatgaagggtagatttggagttgagagacaataaattagtaactggtatagttatacagtttagccagcttctgagtggattttcacaaaagataaattaaaaatagatctttcattttgt

SEQ ID NO: 1381 - DNA, 201 bp, Bos taurus
agcctggtgggctgctgtctatggggtcgcacagagttggacatgactgaagcgacttagcagcagcagcaagcatacttatagtgtctagctgtcaggacaggtgatgcagacatatgtacagggaactagtagagctgcagcaagtcttcagagcagcagtctcctagtgagggttgagcctcttctctggccctccca

SEQ ID NO: 1382 - DNA, 201 bp, Bos taurus
ctggcttttgataaaggtaccccaggccacctttttaatcccaaactgagttaaggcttgggtctaggactgagactgctcagagcccttgatggaaaggcagtgcccctgggccatgcggtatagacctgagagttttggttgcagaaaccctggtagtcatctaatcatctttaggatctgctcatctccatcatctcg

SEQ ID NO: 1383 - DNA, 201 bp, Bos taurus
ccctgtctgcttacagtatctttgcctctgcccccgtaaagtgtactagaaaagcagaggcttggaagcccttggacaagtttttccctccctagagcctcaattgtgtaatctgtaaaatggggccctctatctacaaaactgatgcgtgagaaagatgcgagagagaaaagaaaataccttctgtttggtaggaggcat

SEQ ID NO: 1384 - DNA, 201 bp, Bos taurus
aatattttaatgtgtggagctccctgtctgttccgcacccatgaaatcaggccatacatgtagaacgtgtatgcagatagccatttacagattgagcaccgaatgatggaacggcccgtcgatacctcatctgagttggtcaaaaggcggaaataattctcctattatttctgtcactgtcagggttcagttgaatctcta

SEQ ID NO: 1385 - DNA, 201 bp, Bos taurus
aagtttttggctctttttctgcttaatgtgcactggccagctctctggatggtaggcatccataggagggttttcagtggacagtcagtgatataggaaaccctgccacaggaaggcctgcaagccactcagcctcctgctgctgaggtctgctccttcagcagccagccctcatgcatggaacgtggtaagagagcacaa

SEQ ID NO: 1386 - DNA, 201 bp, Bos taurus
cagggccaatccaggcagctctgggtagtgaggggattgtaggagtgtctgcttagagactccaaagtgatagatcttcttggagccattccatttggacgtggcctgtttaacacctttctccactcagttgggaatatttagggcttctctgctgctgctgctaagtcacttcagtcgtgtccaactctgtgtgacccc

SEQ ID NO: 1387 - DNA, 201 bp, Bos taurus
cagcctggaaagaaaagtcaacaagcagtcatcttcattgttgtgtgactgggacactcagggtgctgccgtgtacctttgctttcaaaggccctttaacgttaaaaccaaacatagcctacatgggaggaatggcatatagtggctgaccttggtgacattttgtgtacaaggcctttggcctctccttaaatcattcag

SEQ ID NO: 1388 - DNA, 201 bp, Bos taurus
tttgatcgtcagtggttaaggctgaaggtggtgggtggtgaagattaggaaacacactatccatagtgatgtgagataacaaaacagcaacactttttaatgaacatcaagtctccaaagtggataatatggctggtattaactctgctgtgaagatttcagattctcaacttaaatcaactgactttttttttttttttc

SEQ ID NO: 1389 - DNA, 201 bp, Bos taurus
aaggcaatgggaaatttaaaaaaaagaaagaaagaaatggatgacatgttcattccctttgagaacagcacccagttgttttatatgctattttcacttaaacccaaatggccaaaactgagttgcatgatcatatttagcagccagagaagctaaaaaatgtaatatttgtgcttggcagctacatgttcatctgaggtt

SEQ ID NO: 1390 - DNA, 201 bp, Bos taurus
agtgatgcaccccaatccactacttgttaacaatggagtgtaaaaaaggagggaggcagaggtggggaaggaggaaggacttaccaaatgaggtttggggtattatctgtggatttcatttaaacattctctatctcaccctcaatataatggaaaaagtaaagttgggctttattcacgtatatgaatatgtgaaattca

SEQ ID NO: 1391 - DNA, 201 bp, Bos taurus
taaggtgaatttgctctgggggatgttaataccacataatataggtaaagggacatgtggatgttttccagatcctgctaaagacaattctgagcttcaataggtgaacatatttcagcatctggtttagggggccctctgtgatttttatttgggggaaaacctagacatgagatctaagtaatttaattcactgttcct

SEQ ID NO: 1392 - DNA, 201 bp, Bos taurus
ttctgaataaatacaagaaaatgcctctgcctgaaactttggtttaattaaaaatcatgacgatctgtttattacaagaggccctgggctgtatatgtggacatctgagcatcagtggctttctttttttaaatttggatataaagtttcaaatgacacaaatcaataagcatttgtggtcaggccataaaacaacgattt

SEQ ID NO: 1393 - DNA, 201 bp, Bos taurus
cctcgccccaaccgcttccatctcccccgctttcccttctggccccccaacatgacgagacagggggctttagccggccgggggcgaccgctttgtgcgttgcggggagcgggacccgcccaaggcgcgcccagcgggggacgcggtgaccgaggggccgggagcgccgggcaggtaacgtatcctggaccaggagctggg

SEQ ID NO: 1394 - DNA, 201 bp, Bos taurus
acttctctttgtctgacttgctttacttagtatgataatctctacgtctatctgtaatgttttaaatgttaataattattttaagaaagcttatagagtactgtagacttaatccattaattttcactcctccaggcaatgtaagaagaaagcttatgctattattacaattttataggttaggaccttaagaaatccaaa

SEQ ID NO: 1395 - DNA, 201 bp, Bos taurus
cataaagatggggccccaattcaatgattggtatccttataagaagagatgtaggaaatctttctctctctcttactctgtgtgtgtgtgtgtgtgtcttgggaagacacagtgaggaggaggcctttgcaagtcaggaaaagagctctcatctctcaaatagtgaggaaaactaatactggatttctagcctctagaact

SEQ ID NO: 1396 - DNA, 201 bp, Bos taurus
ttatttaatagtagtgaaaatgctgcctcttagctgagccatattctttgcatgcattgattagtggtgaatatgatcatttccatttcccagaaaaatacctagacacataaaaataatacttgatgccacagtgaaacaggaatccgagttcttgtttgtggagccaaagaatgaacttcacgaacacacaaacactca

SEQ ID NO: 1397 - DNA, 201 bp, Bos taurus
tattttttattcctttattcttctcactacaatttgggattctctaaactcaatgtttacatgtttgtggcaatgtaagagctgtacattcccaaatggcgaattatactcttcttagaacttttaatttttattgcattaataatggcattttataacttggcatagttttctgtgtatctgaatttttaaaatgctcca

SEQ ID NO: 1398 - DNA, 201 bp, Bos taurus
aggtgttgaggtcttctctgaaaaaaaagaaaaagaaaattccatcctaaatcaattaagacctggcccttacagacttagccctttaacaataccaacaaaattacagatagaaacactaattctcaacaaaccttggtgtatattaatcagatttttcttcttacccagaccagtgaggtaaggaactacaggtaaaag

SEQ ID NO: 1399 - DNA, 201 bp, Bos taurus
tgaaagacaagaggtgagcatgtacacacctggggcaaataaggccagacagtagtaagaattcaggtaaaaatgtagtgtgtaggtcaacaaaagaatatagaaaccacagaggccacagatataagggaaatacacactcatattctactccacaaaagtcacaggagctcacaaaagaacactggtgacaggagtgac

SEQ ID NO: 1400 - DNA, 201 bp, Bos taurus
ctcctttcatcagccaagggtctttgttctctcttgtaagtgtcagtttcttctcttgataatgagggactttcaggcagcatttcaggttttttttactaatctaatagtctatgaacttttccccctgttggggagttaaaaggtggatgaatgtgtgtacatctctgcagacaggctgcttttcctactgtagcattc

SEQ ID NO: 1401 - DNA, 201 bp, Bos taurus
agggatggcctctagaaactgaagacatcaaggaaattaattctcttctagagcttccagacagaacttaagccctggtaacatattgattttagcccaacgaggcctatgtcaaacttctacctatagaccatagtattatacatttgtgctactgaggcttcaagtttgtagtgtatgtggatgtgtgccgagtcactt

SEQ ID NO: 1402 - DNA, 201 bp, Bos taurus
gcctgcatgcctacagtccatgctctgcaacaagagaaaccaccacaactagagaaaacccacacacagcaacacagacccagagcagccaaaaataaacagataaataagtaaaataaaaaccaataccctctgagtgatactgcagaaagcacttcctacactagagctttagtctaccagatgaaaattataaaatag

SEQ ID NO: 1403 - DNA, 201 bp, Bos taurus
gagggcctggatagaataaaaaaggcagaggaaatttgaattggttctctgcttaaccactaggctgggtcatggattttattgcccccctgcactccttattctcaggcctttagttccaagactggaatccacaccattagctccttgctttcaagctttcaaattacataacttgctttcctgggtcttcaacttgca

SEQ ID NO: 1404 - DNA, 201 bp, Bos taurus
gtatagttaggagcataacaggcatgtgaaagctttaaatttgcattacaaagcactacagaaatgtagggaagtaatatccttgttaataactctcatgaacattctcctaagtgtagattttaaagagggcagagagctgctaattctgctttaaagaaaccacagcctcaggacatatacatgttaagaatgagcaaa

SEQ ID NO: 1405 - DNA, 201 bp, Bos taurus
taaatgttcctattgttcagtaaacagaataaataatagttactactattgcccaagctcttaactataacacttcatagtatattcagattccatatctgtataagcaggacccataagatggctgctgtcttattctctgtacaatccctgcttgacctggccctgtctcacccttatcttaagggcatgattgccttg

SEQ ID NO: 1406 - DNA, 201 bp, Bos taurus
atatggttattagaaaaagtagatttctggatgagtgagagtgaaaactttcttagaagtgaaaatatttattaaaaaaataaagattatattttgaaaaagtatggaacagatcaggggttctccatgtgtgtacaaagtcagtatgattttgataatagtactatgataatatctttcacccttacttctcatgaatgt

SEQ ID NO: 1407 - DNA, 201 bp, Bos taurus
agctaaaatgttaatgaattatggatgagatgagacagtgaattgggttggtgttacacaaaatgccatctggttttattttttaggaacacttaggggggggaaattgtttttctttggctactaccaagggtgagtcatttctttatttcataattattttctgggacaaacatcctctgagatggccctgactgtcca

SEQ ID NO: 1408 - DNA, 201 bp, Bos taurus
ggctcctcatgactgcttaacactggtgcaccacctcctgtcccctcataatgatctacagtaaattccattggataatgttgacttttcaaggttcaccaatggtttttattttaaagatgacaatggcaaatagtgtgctgagtatgctgtcataatttgttttgatgttgctgaggcagcatctttaatttgtggcta

SEQ ID NO: 1409 - DNA, 201 bp, Bos taurus
agatgcagtgatcttagtttctgaatgttcaggggtttttttctttttttaaccattaggttatggtgattagtacttgcatttccataagcatttgtagggggcacataataaatatatgagaataaacatctttggaagaatgtgtctgtgacatatctggattagctaggtggtcaagattgcatgtgattttgttat

SEQ ID NO: 1410 - DNA, 201 bp, Bos taurus
tctttaatcttatatattccacagttatgcttctccaaccaagagttttcatttttctctattatatctttcttaccagtaccactagaacattttcttcggaaagttgtgttactgtttaatataaacaagaacaaaacaggccttgcaatggtgaagatggtacattttcttccttataagtaagaatgtggtatcact

SEQ ID NO: 1411 - DNA, 201 bp, Bos taurus
agatataatccaaccaatttaggactaataagcaggtatataaataaatatacagtatgtccaagggcattaccttctgtgggaaaaggtcctctctgttctttcttatttctctttctcaacctattcctccccctgcctacaggtatacacagcctcttcattctaaaccaaacaaaaggaagcccccccccccccgaa

SEQ ID NO: 1412 - DNA, 201 bp, Bos taurus
aatttacattcccaccagcactgtaggaagaacccatttctccacaccttctccagcatctattatttatagcctttttgatgatggccattctgactgacgtgaagttgtattcatcgtagttttgatttgcattctttaataataagcaatgttgaggatattttcatatacctgttggccatctggatgtcttctttg

SEQ ID NO: 1413 - DNA, 201 bp, Bos taurus
gtcctcgaagatcacaagtacagctgctgaaaccaatctaatttaaccctttactaaacattcccttgctagcgggacctctgcataaagaagaggtaaactgtcttgtcttcctcatctaggaaaactatgtgttgttttgaagttcaggacaataatatccagaaataaaatttgctgtgtctatatttctaaataatc

SEQ ID NO: 1414 - DNA, 201 bp, Bos taurus
tattcctttccttcctatttaatgcaatataatgaaaagtacacaggactgactgtgtactaagtctctaattttggatggccactaacaaatttgggcacgtcacactgcctatttctcagtttttttccaaatataaaatgagagatcttaatgatgccccagatcttttcaagacctatgggtattctttgttttact

SEQ ID NO: 1415 - DNA, 201 bp, Bos taurus
gatgccaaagtgaaaaaataaaaaaacttaaaaaaatttttgtggtcacttcattcttccattcatccagaacatattatgcaagacaccgttcaaaaagtacaaaacgaaacaaattggattctaaagtgttaaatctcatctgaaatacaacagatacttctgtaatacaaagtagaatatgatcagagccatgtgtga

SEQ ID NO: 1416 - DNA, 201 bp, Bos taurus
taaaatgccttcagatgtgagtgtgctcatgtaaggaacagcatgcaagtggctggatctgtttaacatgtatattctggtacagttagctcagtcacacgggggatgatgagaccagatcttgatgcaaatagcctggctctgagatcctgacagtgctctgtgttttctgaatagaaaagagtgaaattcaaggaattg

SEQ ID NO: 1417 - DNA, 201 bp, Bos taurus
cctgctccacctgggtttcatgcatctggcacatcaccctcaggtctctacaccggtgttaccttcttggtgcaatcttccctggccactccacataaataggtcccagcctctcaccgttgctattatctattgtgatactttggttgtttctttggccacctgatgtgaagaactgactcatttgaaaagaccgtgatg

SEQ ID NO: 1418 - DNA, 201 bp, Bos taurus
gaggctcgagccaatccaacagggggcggagtgcccaaatcatcgatcgcctccattccccgccttgttgtcccgccctacccctcaggtcaccttgcggagtggggagggaggttgggcccaaattttaccatctagaaacttgaaattcaaaatgtaagcggatcgccaagttcaccagactaaatttagtggatcttc

SEQ ID NO: 1419 - DNA, 201 bp, Bos taurus
taagctcaagactttctgagatagagaccagatatggtcttagtgtgatggagatcagtgaatatatgtggctaaagcaagtaatgtgggcaaggtattctgagactcaaatctctagaatattgcacacacacacacacacacacagagggctgaaaaattacagagccaaacattcataaaatctctcttagaaatata

SEQ ID NO: 1420 - DNA, 201 bp, Bos taurus
atgagtctgggtggactctgggagttggtgatggacagggaggcctggcgtgctgcggttcatggggtcacaaagagtcagacacaattaagcaactgaactaaactccagatcaaacagtacagaggatttataatgtaagcacaagagtcttctgcctccataggcttcttccagctctcagcctcaccattctgagtg

SEQ ID NO: 1421 - DNA, 201 bp, Bos taurus
aggcctcagcatcagttgtgctcagttttaagtgtttattctagaaagctttctagcacctactgtgattttgtgactgacagtgcacactgcagagaggggcatggccttagtctggtggccaggagagttccttctaagaccacttctacagttattgcttcttacattactaactatacagaaaaaaggatgacagtt

SEQ ID NO: 1422 - DNA, 201 bp, Bos taurus
gtacatctttgatttttgtaatattttaaaaatatgaggtcgtttggcccccagttttgctgctacctggtataaacccatataagttgaatacaagcatatttctgacttgctaaatcttggccatgacatgcaattgaatcagtcctgccagccatggggttttactaccaaggagtcagtacacttttttgctgcagg

SEQ ID NO: 1423 - DNA, 201 bp, Bos taurus
tctaaggagagcttgtggatctgagccagtggacacagctctgctaccctcacttccctgctgatctcatcactggggcctgggcatcacaggctgtgggtaccagaacaccacttcctacagactgaaaggaaggtaccatcattgtttggcaacaagaggccaaacagaagcttggagaaggcatggtgagggtggtgg

SEQ ID NO: 1424 - DNA, 201 bp, Bos taurus
catctcaccctatttctctcacttgctcgcctttctacccttgactcaattaaaagctttttctcttatattcgtggccagccctattgcctgtatccaatggaggctatgccaagtttatgtcatgaccttccttcctggctaaatacattttaggtgggagttcactggttaagagttggcattttcactgctatgggc

SEQ ID NO: 1425 - DNA, 201 bp, Bos taurus
actaaaaggaaagttgaatccaaaagggctgtgtagaaaagtacagccaaacagaaaataaaggaccttttcctaattcccctgtcagactagaagacagacaaaataaaccaatggtgggcctttggctcgcatttgtagttatcaggtcttggtactgtgtacatctgtggacatgctttccatcaccatagttgtcac

SEQ ID NO: 1426 - DNA, 201 bp, Bos taurus
gtcccgattacctcgctgggcctcattctgttacttcaggccctctgctgtctggctctggagccctgcatcagccaagatcctagccagctgaagaagattgagaggcaggcctcgcacttgagcctgggaactgtcactctgtttctctttagacttgtgacaggatacgcctttccaacgggctgtcagtttgattcc

SEQ ID NO: 1427 - DNA, 201 bp, Bos taurus
cttcctcatcccttatttagagtatggcccatgtgcctaactttagcttggactttcaaccagctgaatgccagagatgctcagtgaggtctcatcactcggggtgggcctgaaattcatgttccccagcactgtatgacccctgataacactattcagctgcagccttgcagctggcactctgctagacctcaaggaatc

SEQ ID NO: 1428 - DNA, 201 bp, Bos taurus
tctcccacacggtgtcacagaaggttgaaagcactggtgttggccaatacaccctgagtcattgtgccacgagggccagtgagcaagacctcactcttgtgggggggtaggctttccccacactcagaaggcactgctaacaatctgggttgcttttggaacaggaagtaaggcttggagaggtgggccttagactcagga

SEQ ID NO: 1429 - DNA, 201 bp, Bos taurus
agaaattgactgggtcacataaacgaaaaggctgaggatgtttgcttcaggaatagcttgatctagaggctcacatagggttgctgggcttgttctctctgtctgtctctcgctatggggcggcaaatggttagatagcatgactgactcaatgaacaagaatttgaacaaactctgggagatagggaaggacagggaagc

SEQ ID NO: 1430 - DNA, 201 bp, Bos taurus
acagatttgttcatacatatctatctatctcaatacttatgtgctcagcattttgctaattctgaagcatttactattatgaacacatcaccaagtacttcggaatcgcaagtcagaacccctaattttcctcacgtcatctcagacaaaagcccatccattcaatacaccattactgacacctagtacataacagacatt

SEQ ID NO: 1431 - DNA, 201 bp, Bos taurus
gagatgaagggcaacaaagaggaagagaagaaaatggtgagagagtgtgttacatctatgagaggggtgggactggggccatgaaccatagccacttgctctaattgtatcatatgagccaatccatagcattttagcaacaaagcagaaaacactctaaagcacaaaagagaaaacatacttaggccctctgcaagggaa

SEQ ID NO: 1432 - DNA, 201 bp, Bos taurus
atggcgctcccactggcctatcaaccagagaaggtattgctgaggctcctcatataagacagggggcattgaaatgtaaggaaagagggccaggatttctgtctgtccaggaccaattctaactgttagaaagaatgaactcagtaagaggccacctccatgcacagcccacccacaggagaggcaagaagaccctaccta

SEQ ID NO: 1433 - DNA, 201 bp, Bos taurus
aacgcctgcagtgagggttaacgtttgagactgccagatgcaacaagtgcacttgaacctgtctcccaaacttcagagaattatgtagtgacgatagatacttctaatttcaaaactagagttcttaaaaattaaccttataaaatttaaccaaggcagcacacatttcccaagtgacaggtctgtgcaaaatattggtgc

SEQ ID NO: 1434 - DNA, 201 bp, Bos taurus
cgcaagcacacaagtggcgggaagtgaagaggggcgtgtgtgtgtgtgtgtagctgcttctcttccctttatttcctcaagtgcctgcagctgtgacctccggcctgaaagccgattggcaaaggagccctggaggccctggtctccagtgttacacatttgtgtgtccacagttacatgcacccttgggaacccatctct

SEQ ID NO: 1435 - DNA, 201 bp, Bos taurus
tgatagggctaggtatggagtgctaaaggaacacaaagggcaagtctagttttcagggaaaggaggaggcaggatacatttaaggatgcacagaggttacgcaggcaaagaaaggttactgggagacctgaaactttagctaatctgtgaaaatgatcttagtgtgaaaagattaatattgaagattttatatttgtttgg

SEQ ID NO: 1436 - DNA, 201 bp, Bos taurus
gtttccatttgggtaaacatttatcttaacatttaagcttcagactcctgagatgacccttgggataaaatgacagactcaggtttgatttcttctgacaattcaaacaatactccacaaactaaggatcttttttttttttggaggataaatgactggctaggagcattaatgtcctcaggctttgctagaggcctgtaa

SEQ ID NO: 1437 - DNA, 201 bp, Bos taurus
tgatgaatgtgttaattaacccaatagagggaatcctttcagaggtatacctttcaagggtatatacattatacccttgaaatatcttatattttccagagttatgcttcagtaaaactggaggaaatagtttggtgaggccagtagggcagaaaagctaatttctgggattccactactaaatgtaactgttgcagctta

SEQ ID NO: 1438 - DNA, 201 bp, Bos taurus
gttctccttttgcttcagtcttttgcttccactgtctcccagagtttgctcacattcgtgtctgttgagtcggtgatgctatctggccatctcatgttctgctgtccctttctccttttgcttcagtcagcatcagtgtcttttccattgagtcagctctttgcatcaggtggccagagttttgaagcttcagcttcagta

SEQ ID NO: 1439 - DNA, 201 bp, Bos taurus
caagaaaacattgtattaactctttttcttccctctggatattctaaacttaagaggaataacaggaagatgtaacatgctggccaaagtcactgaatacataatcttattcaatcaatgtaattctatgaagtagatgctatttctgcccattttatggatgaagaaactgcaacttgggtggttttaatttgccaagaa

SEQ ID NO: 1440 - DNA, 201 bp, Bos taurus
gaccaggaggaattaacacattgtggggattaatagtttcctggtatgaagtttgacacacttgttggtaggtaatttctagagaactaagatatcatggaaaaaaaagtggcaaaataatatataaaacccactaacaactaataacttttaatttatatggaggttaattatataaccaatgataaatgctatttccct

SEQ ID NO: 1441 - DNA, 201 bp, Bos taurus
ttcaccaagtttaccagggggaagggggttttatatataaatacattgtatttataaatacattgtaaatacatcgtattcagtgtttggccaaatatttcctctagcttatgtgaaaacaaaattcatctctattaagtgcaagttttgtctgtgctgtgatttctgtcatcttcctccctattctctaacacaaggcct

SEQ ID NO: 1442 - DNA, 201 bp, Bos taurus
atagagcacaaagagatcaacaaaggttcagatcccaaatctcaatacatggatacacccaatcttttgctcaaaacatctgaaaccagagataaactgcatctaaataaactgcagcaaaactcagcttcacttcaactacagactaaaggtggtcagcactcaacacaggcctgactgagaaaaggacatgctttatag

SEQ ID NO: 1443 - DNA, 201 bp, Bos taurus
cgattcctattcctgtttgctttctgtcccgtctctctctccagcatcacttctgtcttttgatagtaacagttaatttcagttgcagcagttgagttcaaaattttcagtttgccagcacacccaaaactgacgcatttctacccacttagacacacaagtacaacctcaggcaggtacttcttagaaattcaggaagga

SEQ ID NO: 1444 - DNA, 201 bp, Bos taurus
tggatttagagaagccaaatagtaagtacaaggtgagattctgcctatggacatagttaccctcatgggtaaaaaatccgtttcccttgaacctgattttgattcaaatggaatttgatgacaattcatataatattggccatcttgtggacttggtggtatactgcttaaaatgttgaggagtaggaagaagaacatgac

SEQ ID NO: 1445 - DNA, 201 bp, Bos taurus
gggatgtggcgccagccagggagccggccacaaggtgctcttgcacgtgcagtgtctgctgttgcccctggatggctcacttgatctgctcataggccatgaatttgatgtctgactcaggtgcaatcttgagcacgttaatccattgccacgccacagggagcgcacgcccctctcttggatcatgctccttccggaggc

SEQ ID NO: 1446 - DNA, 201 bp, Bos taurus
ctaatttatgatcacgagggagctgtgtcaaccacaaattggcacttgccatctacaaggattaaatcatgtgctgctacagttgctgctgattttaaaccacctccttgaaaggagtataaggtggagagcagaaatgagacactctgtcgttggggtgggagaactggcacaacaggtcttcaggtagatattttcagg

SEQ ID NO: 1447 - DNA, 201 bp, Bos taurus
acacacttgcttacttaggtgttcccagcgcattgcacccttgcaatgtatgcactgtttggacatgatacgttcctgctttcagttaattaatacatcataaggaaatttctaaatgacaaagcccctggatctcacaaacaagcctaggatattatccccaaatcctgttttcactggattttttttttctcataatgt

SEQ ID NO: 1448 - DNA, 201 bp, Bos taurus
tgaggatgcaattcatactttggaggaatcatgatttccaaatccatttttcaactaatgagcccttgatggctaatgatccccagatgtactcattgccaaggtgaagccacactcaaatatggacatgtattcccacaaatataaaaacagcggtgctttacaatttttttttttttgccttgaaatgaagagtctttc

SEQ ID NO: 1449 - DNA, 201 bp, Bos taurus
ttaaataaatgtgtgatctttgaagtcttctttcacacatttgagaaaaatttctcacttcatctattagttaaatattcggcccatgtacattttatgtatgtaggagagtcatgatttttactccaacaagtcaatctctgatgaccttcaccaacctctactctaggtgcaagtgcacttccctggcctctggtgttg

SEQ ID NO: 1450 - DNA, 201 bp, Bos taurus
tggaaaataaagagagatctataattttagtttacacagcttacagtaaagcttaaggttaaagcaacaaaacatagcaaaacccaacttgcatcaacagaggcaattgctttaaggtttcataaatgaagaagaagaaataatagagctaggttttaaagtgatcccagaacatgcctgaatctatttgttggtagacta

SEQ ID NO: 1451 - DNA, 201 bp, Bos taurus
agtcccttccttcaggattatagtagatttaagggaactgttcacattaggtcaacactcctccttggggacaaggccacatttgatgactaagaggtaatggtatacaaaagtctggtctttttgcttcaatttgagataatactgcaaggccatctaaggaagatggtattgatctattatcaattcttattataagta

SEQ ID NO: 1452 - DNA, 201 bp, Bos taurus
atgaagactctatagacacagaatcaactggtaggattgattggactcaaaatagtgcatcagaaaacccaatctgtatcaattcagcaggaaaaaaacacagcaaacttctgaacccaaaacccacactatctcctgtaaaattttctaggtgctatattttcaaactgaaaagatttgtagagcacagctttcatgagt

SEQ ID NO: 1453 - DNA, 201 bp, Bos taurus
ttagatagaggcctaatattcttaatattttatggttctctttactttcacaactttttttgataggcttaatgagatacaatacctgagaagtgaggatgagattattttccttaatatttaaagtaataagcatgcaatatttactttaaattgcataaattaattaatcaaactgttaattatagtgccaagcatttt

SEQ ID NO: 1454 - DNA, 201 bp, Bos taurus
cttctgacctgcacagtccatgtagggtggtaactacagcatctaccagctggtaaaacctgctggagaaaatctcatgtgcaggcacattgattctttgacaagtgtatttgtatcacctatgccctaagtccttcttgatcatcttttttatttcatctttctttgccgttttccagatcctatgctcaaattttacca

SEQ ID NO: 1455 - DNA, 201 bp, Bos taurus
tcaaggattaaaaagggttagtaggacacctttgaatttattataatttgcccattttcattgtgaatagaggcaagctggggcatttctcaagctcataaaggaactagatgatgaaaaaaaaaaaagtatagggaggcaagtgaagatttgtgagcaacacaaattttctcagagcatagggaggagacctaggaaact

SEQ ID NO: 1456 - DNA, 201 bp, Bos taurus
acttaaccttctattttgaaattataaataggttggtatatattttgaaacccaaaataaatacaacatattctttagaactcagtgtgtctatatattaatatgtatgcatccatttgactagctaatagtaagttatttggaatataatgtgaaatgctcctaattttactgataggaagattgaagggagtgagctaa

SEQ ID NO: 1457 - DNA, 201 bp, Bos taurus
gagactcctagaaaaacagcggtcttggtaagcagatggagtttcagtcagaataataatacaaaatttttattcaagcttacgtcctcccatttacatcctcttttttcttatctgtgccatatctggaatctaaggtacagaatttagattgtttagcaatttgcagtacaagttagtttgggtaatgctgacttacgg

SEQ ID NO: 1458 - DNA, 201 bp, Bos taurus
tttcttaaattatccttttttttctcctaggattttatatgtaataggaaagtatttactaaattgacctttctctaaaaatgcaaagtaattgaaaaggtcggtgagttttaacctgagaaatttcctttcgaatctctcaagtccaggtgttatatattctgaattattttttaaatggtaactaatatccttactgtt

SEQ ID NO: 1459 - DNA, 201 bp, Bos taurus
cccaagagacacaacaagccccactaatattcacagaacaggtactaggggccaagttccctgagggggtctgatagcatgatggccactgctgcttctcaccttgccccctaagcagcataatcctttctgctctgtccatggagaagaggaggcagggcctctcctattgtgtcctactccatgctaactcaacattgc

SEQ ID NO: 1460 - DNA, 201 bp, Bos taurus
cacctgagacactatagaagacaactaaattatttcctgagggccatctcacaatccccttgatatggtgtcttggccagattttcaattgaaggtcattcacactactttcccaacagactgaacagactcttctttgtcatgaagtcctcattctcagccaccaccacctcaccccgcagcagcccctacttctcaatg

SEQ ID NO: 1461 - DNA, 201 bp, Bos taurus
ttctcgttataggtttgtggctcatgtcagtgctaagaagagggaaatgagaaaggaaaacataaattgggaaacagtgtcagagggcaggccgagataatgcaagtaccagaaagcagaggaaaagggtgttgtgtgggaaccaaaaccttgcttcaggtaggaaatgtcagagaaaaatacagtcacgttttgaaatta

SEQ ID NO: 1462 - DNA, 201 bp, Bos taurus
cattagccttttccccctttatttaaacttctaacttcctcatgcacttatttaagcttctagctataggtataaggggttaagggagccagcactttaattgaattctcgatgcttttaagtctgaatgcaaatgaaatagcctacttaaaaggctttgaaaaataatttaaaacactaaacaaacatataaaatcgaac

SEQ ID NO: 1463 - DNA, 201 bp, Bos taurus
agctcaacgtgtgaggttgggacaggagaggagcttgtagatctaggtggagatcagtgcatttgacatttcacatcctaatttaagggacttgatttttatacagtggaatgagttggctggattttgccttcttgatatgtgccttttgtagccaggtatagaatgaacttgttgggaagtcaggcttgtaaataagaa

SEQ ID NO: 1464 - DNA, 201 bp, Bos taurus
gaaaatggggatcaagttgaagaaaagtagaatgctttgaattgagagattcagtcagtggaaaaaggaaaagaagactgatggtttcacttggtacttccggtagggtaaagaagagaggaaaggatgtgggctgtgtgggtcaggggctggctgattaaatgacagtggaaatgctgcttactgccagcgtggggacag

SEQ ID NO: 1465 - DNA, 201 bp, Bos taurus
ttcattttattctcttttacattaatcattaaaccaattttaatcttaaatgtctttaaaagtctgcccattatcaaccctgacacagtgttcaggatgcttgtcccaaatttacctaacctgtgtttctggcaaggtgtttctgtaataaacagaagagcacctagttcttaatatacttatttataccaggttaatcgg

SEQ ID NO: 1466 - DNA, 201 bp, Bos taurus
cagtttgtgtgttaacaattctgttattcagaccattgtgttgaatcatatcaggacactgagaaatacatgaccatgctttttttctggaagaatgtattttgtctttcactgctgattggaaatagaggtttttgtaatgaaagcagataaacagcataggttagagataatgagggcaggcaagaaaggtgtgatttc

SEQ ID NO: 1467 - DNA, 201 bp, Bos taurus
ctacctaagtctgctctgtagtttcagttaggtaaagtattgttcacttcttgcactaaactgctgtgttttgtggctacagacagctaattagctggtatttttcaggtggctgcgttcctgatgaacagaacatctctctggctctctctctccctgcccccactatctccgtggccacagtccattttcttttatatg

SEQ ID NO: 1468 - DNA, 201 bp, Bos taurus
gtggttaaagctagaagaactaatgtgtatgcccaagaattcttttccagtaatttgtcaatggtttcctttggcctgggatgttttaacccagttaactcattctgtttaggcagtcaggttggtttaccagctgatagagagaaagtactcactttcagaaacctgcaacgtgcaaagcaacttaaaatacataaaaca

SEQ ID NO: 1469 - DNA, 201 bp, Bos taurus
tatctttatgatactagttactttcatagaaatatccctaattcatcaactctatcttctgttgagaatgcgtggaattcagcaattttaataagcagttaaaattatattaaaaatgtaccacccaagaaaaatgaccagaaacctaaatactattcacacattccatcataaaaaactaaagttgaaaatatacaccat

SEQ ID NO: 1470 - DNA, 201 bp, Bos taurus
ttatttaaggagaaaaaaattcaaaaactgcctgttatatatctcttctacttcttcaatgcctaactcaaatttgatatgcttctctgagacttttcctagactattaacaaaattgattgctctttcatcatgtcatttcatgtcactctaataattctgttatatgtttatgagagatagaaaataatttttgaaatt

SEQ ID NO: 1471 - DNA, 201 bp, Bos taurus
tttactgacaaaagtagtctctgcatacttaatctattcttaaactgttaactttagtaactatgatatgtttactgacctgataactttaataataattccatgtttactgtctccaaatattctcctacggagaccctgatggccttcaagaaagtccagtaaaatacataaaaagagcagggacaggtagctaaatgt

SEQ ID NO: 1472 - DNA, 201 bp, Bos taurus
ggcagataatcatatcctgacttcttttgttctctgttctctacttgagttagatgtccctcctgccaaattgactttggactcctaaaagtcaaatgctgtatttttttcagtgttgatacactgtactggaccaagaacatttggtgcctgactgaaattctttgtttctaatttttccagtattaaaatgagcatttg

SEQ ID NO: 1473 - DNA, 201 bp, Bos taurus
ttccgctcatcttcagatcattctcatagatagttgctttgtgagtagtcataattctggtgtgtcaacaggaggaagtgagttcagtttcttctcactccaccatcttagctacctctctctccatattacagaaattatcagaaacaaagtgtaggttactatttccagattttagattacaataaggtaccactgtga

SEQ ID NO: 1474 - DNA, 201 bp, Bos taurus
atcaaatcatttggaagttgtggttggaaattcctagagaccactggtaatggtgctaaatttcttttcattagttccattcattagcttcaatagctgactatattaactagatctcacttatgtattaatcccataacttactaatgttaagaatgtaatttgattgttaatatatatggctttttaaatatatggctt

SEQ ID NO: 1475 - DNA, 201 bp, Bos taurus
cacagtttttaaactaatacttcagttaccatataaagtgagatgaaggaagaagactttgagaataagcagactataagaactaaggaggaagagaaaggcaattgttcatgagtattattcatattattgttagatagcctgcagcttgcctctttcttgacttccaatataaatgctaaagacaaaagtctttatcat

SEQ ID NO: 1476 - DNA, 201 bp, Bos taurus
ttaaatctttcacatcagtctccttcaagcacaggataaagcatgcctccagatattgagaaactacaccatgaatatatgcctggcactagaaaatgattttctggcctatttggtgtagctgtaatatatgtcttaaaaaatgtggaaagagaagagaggcaggttaagtagtatttctagagtaatgtgctaaggcag

SEQ ID NO: 1477 - DNA, 201 bp, Bos taurus
tactagttaggataaaacaatcaaaatgatatgatagcacctttgaatagaaaatttttgtgtctttgctgactatgacaagctcagcatgtgtcaacacgctgatcatacctctgaaaatattagcatgacatggtaatacattatgtttatcaaagactcatgtccagataaataaaattatccattgtgtttttcaaa

SEQ ID NO: 1478 - DNA, 201 bp, Bos taurus
tcttcctataagtattaatagttgatgagaagtaaaaagtgtctcaaatagttagcagtttgattatcactctttcgaatgcaatccttttaccttaactgtgtaatcccctaaaatatattcacaatggtttgattgctataaatataagctatttcaaatatcatagcttaacttttaaatatttaaactgtgaattat

SEQ ID NO: 1479 - DNA, 201 bp, Bos taurus
ttatctgcatatctattaaaaaagggaggagaaaataaaactaaaattttaattgaaactcacttaaagaaacctcagggagctattttaattgtggccccgataaagaatatttgttaagacatttcttagagctctctgtccctccagttcagttcagtcgctcagttgtgtacaactctttgcaaccccatggacttt

SEQ ID NO: 1480 - DNA, 201 bp, Bos taurus
caggacctgctgctaatttgactggccaactagtgaaagacttaagtgctttcatgttaaaatgactcagcagaggtagaattatgcactagagcattaataaaaaggccatttgttctaacaaaaagttttgcagtttcctagttattctctgaaagtttagtgagacttctagattacagatctcacaatttgcataat

SEQ ID NO: 1481 - DNA, 201 bp, Bos taurus
gtacttgatcagtgctgctcaactaactggtgataaagcaggaataagaaccttggtcaaatgagatattgcccagtgttcttataccatatgaccaaccccttttttatatattgatgaaaaacttactgtagttttaacatattaattttttttcattttcctagacctaattttcataattagtgaataaaaattaaa

SEQ ID NO: 1482 - DNA, 201 bp, Bos taurus
attatggcatgacacatctgtagaacatttaggagactatttttttttttttaatgaggatttgtaataaactcacattcctcctcttcccacatggaagcactttagtgctatctctagcaagtcatgctttgccatgaatcatatactgtcttgatttcttcatttgtttagttaattagtacttcacctacctaactg

SEQ ID NO: 1483 - DNA, 201 bp, Bos taurus
ttttcagattctagcatgcagagatctacttctgttgagatcactttagacaggcttaattcataaatccccttgcttattaaacctgccacatactaatccaaagtgctctgtctctccctggggccagttttgaatttcatccagggtacccccaaagttatgaaccaacaaatatcagaatgtaaaactagcaggtaa

SEQ ID NO: 1484 - DNA, 201 bp, Bos taurus
cttgtggaactaaaagggaaaatatttgtgttgttttgagcctctatgttcatggcaattttttatagcagcaatagaaaactaattaaatataattattatataactatctcctatgcttctcctgggtttcccagatatacctagtggtaaagaacctgcctaccagtgcaggagatgtaagagatgagagttggatcc

SEQ ID NO: 1485 - DNA, 201 bp, Bos taurus
ctaatgaaaatacaatgagtatatctgtttgattttacccagtgtaaaatacttaatgaaaaacaacttaaaaaagaggcggtgtctgtcacagagaaacatgctaattttaaaaatccctaaagaaagagctcaggtgggacagactaaggacaaggtagacaggaaaaaaaaaaaaagacttccttattcatatattca

SEQ ID NO: 1486 - DNA, 201 bp, Bos taurus
tcggtttagagtcaaatagaaatgcagttcagtctctacttttccaattatcatatatagatgcttcatttctttcatgttttacttatttttggccatggcaggtctttgctgtggtgcgtgggacttttcttctctctagttgtagcacataggctctatattatagcatgtaggcttggttgccccagggcctgtgga

SEQ ID NO: 1487 - DNA, 201 bp, Bos taurus
tgaattgctgaatctactgttagttctagctccagaggagctttgaatcacattggtacaaaattagagaaatacaaaattgaaatataaaatgtgagccatgatccatcaagaatactcagagggagagtttcataacctagctagcaatccatttcctcattattaaatgaaggctttaacctagatctagtctaagat

SEQ ID NO: 1488 - DNA, 201 bp, Bos taurus
atttaaaacttctcttagaactagtccattacttggaaaatacttggtgaaaatactgcagtaaaactatagattttgttttctctttatgtgttttagacatacttaagaaggctaaccaaataggaaaacaggatgactccaatgtagaatttacacattgacaaaatggaaacctctctctatcatgtcccatattaa

SEQ ID NO: 1489 - DNA, 201 bp, Bos taurus
agctaaagacctgggacatggttatgttgacaaaatgaatcatcagttacttttgtgctagaaaaagatccagacattcagacaattgttttaaaaggctgtcttaccttgcagtgtgcaaagaatgaattaaagcaggttgggagaccaatagcaggctactgtagaagtttatgtaaaaatatatatataaattgagag

SEQ ID NO: 1490 - DNA, 201 bp, Bos taurus
caaggaattgctgttaagagtgacaatagccatgcctcagtgtgcatagaggttggctcggaaacaatgtataacacatgtgaggaatgaaagattgaaaggctttcagctgtcccgacatgtggatgagccagttggctgttcccactcactgtccctttgtcatagtaagatcgccttcctctggagggtgtgtagaac

SEQ ID NO: 1491 - DNA, 201 bp, Bos taurus
aaaccccttagagatacatgcaaatgctgttatgatctggtatctacaggtaggtagaaattaatattgagatttcattaaaactgaaaattggccagatacaggaataccagatcttaccatgatctactatcactactcccttactatgatctaatatcactacaagttctctaaagagaattatgtacaaaagagggc

SEQ ID NO: 1492 - DNA, 201 bp, Bos taurus
tttttcttccagttagaccgttttctgatgaaaacactgaggctctttggatcaagattttatgaaggggattaaaaatagtttgtctgctttatcattctctatatcctgaaacactaagctattccttatgtattacccatgttagctcttatttatagtcagttgtagcagataatagcagataattttgttaacaga

SEQ ID NO: 1493 - DNA, 201 bp, Bos taurus
atgtcgaggtataaggttttgaaaatcttatctctagtgcatttatttcatcgatacagtttttaggcaaccagagtcagctttatctttgtttattgagattaccatataattttttattctttattttgttaacatgatgtgtcacattgattgatttatagacattgaactatccttgaatcccttgcataattaaca

SEQ ID NO: 1494 - DNA, 201 bp, Bos taurus
cttaagatagaagtgtgttgaactagtgttgaactagtgagttgaactagtgaggtcagtgggctgcagccctgtgagccaaactgacagagaagtaaattccttgagatttgggtagaacttgcctccttctacttcttggccatatgagtgacctggcagcaataatccaatctttgattatctttgcaatccagatag

SEQ ID NO: 1495 - DNA, 201 bp, Bos taurus
taaatcatatttatttattcttcatagaaaatactgaagcatttattttactgatctgaaaatactctgtattaataagagctgctactcttgattttagatgtgaatagattaataaataatgctcatgtattgattcttatgcttttcctttgttgaatttgattcaaaaatatttattgtgcatttaatatattatgc

SEQ ID NO: 1496 - DNA, 201 bp, Bos taurus
ggtgggaatctttctatgacatatttaaggagcaataaaagaaaaaatttgcaagctaaaaatgaagaaaaaaaattttttggctaataaaaccataccacaagcaaattctgaaggcagataacaaagaagaaagtctttgaatgtatatcaaagataaaggattaacattcctaatatattcaggaacgtagtcttgag

SEQ ID NO: 1497 - DNA, 201 bp, Bos taurus
caggagtagctagcagagaaggcgccgagcacttatggctccttactcagatgcacatgcctggtctccccttacttgtcaccaaggtgccaaagggctgcgttaggggcggagctaagggcagctcctggaatcctgggaccctgtaacactgtgcaggtgccttgggtgggtcagtttaagtgctgtcctgccttgtcc

SEQ ID NO: 1498 - DNA, 201 bp, Bos taurus
gtgttgctggcaaatgaaatggtctgttctcccactggacaatgccctacctagcatgggtgcctgatacttggacactaaaattctctcaccatcaataataatgtgttagagcaaggctctggaatgactttgagttatctggtaaatgagataatgaatttttcatattgtttaaaccacttagaatgtgtgtcttat

SEQ ID NO: 1499 - DNA, 201 bp, Bos taurus
cttaaagacattctcatgtctgtaaatgtctagaagtttatgccttcatttcctaaaatcatttttattcatcgctcttcttttttcttagaacttggaacaggaaatgcaacatttaaaaatattcactatcttaccccaaaccataactcccttatagactttcttttgttccccttgttggacacaaataagttcgat

SEQ ID NO: 1500 - DNA, 201 bp, Bos taurus
gtttaatattgaaataatgttgaaaatctgcttcttaattttgccttcttaagcctagttgtttcttcgctaaattaaggccttatgcctaagttccactatcttttaaagcatcctacttcagttcagttcagttcagtcactcagtcgtgtccgactctttgcgaccccatgaatcgcagcatgccaggcctccctgtc

SEQ ID NO: 1501 - DNA, 201 bp, Bos taurus
gtaaaagcaaccaactctcggagttttttccatggaggctgcctctgaaacatgccatccatagttgagtaaaaggttattaaaataattccatcagcacctctcaataataagccctagcctgcatcagcactaactagcactgcacagtgacccatacatataagacccaattgggtgggccatgacgtctgagaagag

SEQ ID NO: 1502 - DNA, 201 bp, Bos taurus
tccttggacatttccaggcattggacttttccatcttaggagtcttaactccaaatttttagtatcatagcataactggaatgcatataattcatcaggacactatgcagctcatttctgtatttcattgctgctaaatatttcaagaaactttttttgttttcttctctcttaagtgaggctcctacttataaacccctg

SEQ ID NO: 1503 - DNA, 201 bp, Bos taurus
agtttcatttaattctctgtcacacctcctttcattccaacaacaaaacaagacattcaatttatcgctaaatatcagcttcaggaggggacacaatagaggtctcaggtgctctctgaaacaaagctagggttttccaaccacactgcagatgaactattttcttaaaacacatatttctaagtcaataaaattacaaag

SEQ ID NO: 1504 - DNA, 201 bp, Bos taurus
cctacagcaggctggtacctaccctgggccctctggactccacaaacagcaataccaagggtcccatccaccagcagtccagaagcctctggacaacacatggcctggcagacagctaggatgaagtcagctctgccaagcagcatgcccagaggagttggcctcacaacagaaaggcccatgaagcccccgtgggggtac

SEQ ID NO: 1505 - DNA, 201 bp, Bos taurus
cactggtgcatgcatggcagtggaggcagtgcagggaatcaggccagggatgtgcagctgaaggggctagctgtagatcagcccaatggtacaggtcaatgactagagatggggccaaatctagacccacaggcatttgtgggggcattggccatcatcataaattcccatggcatcatgatctcaacactggcaggtaca

SEQ ID NO: 1506 - DNA, 201 bp, Bos taurus
tatcaatacaatgaccagcaaagaatatgggctggtggagtggtggaaactcaggcaaggcagaggaatcagagtccactctgtgtcctcttgtctcattttgaatggcccaaatatttgtttaccagagatttgctttccatctccacgtgaactgccttcctcccatttgaactgccaaacccctacctctcttcctca

SEQ ID NO: 1507 - DNA, 201 bp, Bos taurus
aaaaaaaactagaagaatccactataatttgatatttagaaaattttccattgtacacaggatttcatttcattctgtgaggccattcaactttgttctatagtaaatatttatattatcacattataaatatctgggtttaaaagtttaagaactggcctgtaaataaagtaagagaaattacagttatagaaaaacagt

SEQ ID NO: 1508 - DNA, 201 bp, Bos taurus
ctcaagatatgagagtggaaattaaaaagggcaggcacccaggtgcacaagctattaaaaaatgtactctcgggtctggggcagagcatccgagcaccgtgtattgactctgggcaaagacagatgctggagtgccatttcctccatttgaatctgtataagtgttgtgacccaggaaagttatgtaacctgtcatctctc

SEQ ID NO: 1509 - DNA, 201 bp, Bos taurus
gcaaaagagtcagaaagatagagaatgaaatatcattattattggaaagacaggaatggtctttccaaaacagacacgctgagggctgttgctttatactctttagtcccaaaatagggaatgagatgggctttcagaacttctagaaagtaggtcttcgtctgacccctgtgttggtgtcccctgaaacaggaacagaga

SEQ ID NO: 1510 - DNA, 201 bp, Bos taurus
actcagccgtacatacacatgtattcattctgccccaatccccctcccgtccaggctgacacataacgttgagcagatgtactatacaataggtctttgttgttatccgttttaaatatagcagtgtgtacatgaccttcccaaagcccctaactatcccttccctctgatagccatgagtttgttttctaagtctgtgag

SEQ ID NO: 1511 - DNA, 201 bp, Bos taurus
tcagcatgaaatctcggatcagttggtgaatttatttcctggaaatgaatgaactaaactagttaacccaatggaaaaaaagctggttagtatcacaggcggagaaggcaatggcaccccactccagtcctcttgcttggaaaatcccatggatggaggagcctggtaggctgcagtccatgaggttgctaggaattggac

SEQ ID NO: 1512 - DNA, 201 bp, Bos taurus
tctttccattttaaaaccattatatcacttccatagtacttaacaaaatgaatcttgtgtttttgatactgaaatttttatcttctcctttgataatggacgttttcctaagggcaaagagtatttttcctcaagtatgtacccttcagagagggattgaatggctcttgtacctactaggtacttgataaatgtatgtgg

SEQ ID NO: 1513 - DNA, 201 bp, Bos taurus
tgacctgtaagattcttttcagaataatcaccttgggcctcatgtgcattcagagaatctgtcataacagggggacaccgagctccctgtgcactgatgctcagggttctcatctcagggcctgacctagcacttccttccctgcttgacacctgaaggtctcagtagagttcccccacttggtaagggcactgcttttct

SEQ ID NO: 1514 - DNA, 201 bp, Bos taurus
atactagccaaattcctgaaagaaaaaaaaaggtcagcagaaaatggaagggcatatttaagttgctgaaagaaaaaaaaaaatctttatcaagtaaaccatccttcaaaccagaagacaaactaaaaacatttgcaataaataaagtacagaattcatctctagtactttgtgttgtgagaagtgctagaaagaatcttt

SEQ ID NO: 1515 - DNA, 201 bp, Bos taurus
gtagttgattgccggaatgtggtatttttattttaaattttttgaggaacctccatagagttttccatattggctgtgccaatttacattcccatcaatactgcacaagtgttctattttatcctcatctttgcaaacactgattattattattttttttttttaagtagtcattctctcaggtataaggtgatttctcac

SEQ ID NO: 1516 - DNA, 201 bp, Bos taurus
aagtagggccctgagatcccaggaacggtcccttctcacctagaacgtcaaacaaattactttattgcacatactgtgcctaaatgactaagtgcctctgcagcagtttcaggcctgtgccagctgtactgccagacagcagaaactaccaccccaccccagccccactccgggtcagagaaaggactggaaattgggggt

SEQ ID NO: 1517 - DNA, 201 bp, Bos taurus
agcagtatctggccaatctgtcctgtttttgccattagcagtttgtttcccttaactgagcttctgtgactttccttacacacagctcaagtagtttccatgacactgtggataaggcccagagcttatcatcatggtgccctgagatgaagttaatcaggtttaagttgtccatgacagcaacacaaactggactgaatt

SEQ ID NO: 1518 - DNA, 201 bp, Bos taurus
aacagcaaatcatataaaataatggcttagtaattaaaataaaaactagaatacttttcttgatagctggtacctgaataagtgttcaaagacaggaatatagttcaactcaggcccagattcatagaatctgcctaaacagaaattgtggtaaattctataagctaacatctatatgttcaaaaaagttacatggaaacc

SEQ ID NO: 1519 - DNA, 201 bp, Bos taurus
gaacccgagtgcccacctctatcctaggggcagtagatcacacacacctgcctggccccagagccctcttgtagggagatggggaatgagacagaggaaggacattaaagaaggttctgtaaaatgacaagcaacacccaaaaggggatcctctacagggaaacctcatgaaaaattttgcttaggatttatttaatggct

SEQ ID NO: 1520 - DNA, 201 bp, Bos taurus
taaatgaaatacctgtctacagaaatacagttgatcttagtcatggctctaatcagaatatcctagttgcttcaggcacattactgaacaagatgctataatcatttttttctcttagaggattcaaataaataagaattatatatcacatcttaccatcccagtctatgactcacaaccctaaaaagtgacagggggtag

SEQ ID NO: 1521 - DNA, 201 bp, Bos taurus
aggcagcagtagtggccagagagggtagaatgtacacactcagcagcaggacccagctgcaggttccagtgtaatgacagaagctgatgtgcacgcacacatacgcagtggcaaaggcctcaaccagcaagggttagggccaactctgggttagcactagctgctgtcggggccctgattgtgagtgtactcctgtgggtt

SEQ ID NO: 1522 - DNA, 201 bp, Bos taurus
gctgattttatcagagacagaactattttccatgaaataaaagactgttacacctctgcctaactggaatccaggctctgtcttcctttctatccaagtgttggccaaacccacttgggataacagtatccccattcctgccacccaaatgttgccaccaaatgactatagctccttcttcatttgaataagaatcctgct

SEQ ID NO: 1523 - DNA, 201 bp, Bos taurus
ttccaggcgctgccacacaaatcagaatttgcgaatttgtcagaccctggtcagtggaaataaattctgaagagccggcctttcctctaccccaaataatttgggttatcaaaagatgaacatcaaagctgatgactgaaattttcccagccaagtaggcctttgatttgcttttactacttacacactaagacgttagtt

SEQ ID NO: 1524 - DNA, 201 bp, Bos taurus
aatcttggcggggggctcatggggtccaccgagggccaggaagccctggagcctgtggaggtgaatgtgcgggaatgagcccggtgcttgacagatgctcaggctaggggccgcctgcgttgcttacggcactgaacgcactccctccatctcttccttccttcccttccaacgccccaaatccctcttttctttcttttt

SEQ ID NO: 1525 - DNA, 201 bp, Bos taurus
cattgacttgttgctgacttgtgggtggtgcagctgtcactaagtcctgtatttccttccttcttcctcacaaggtggcccacatggtcctcaaggcgcacgccagggcttggcaccactacaacagccaccaccgcccacagcagcaggggcgtgtgggcatcgtgctgaactcagactgggcagaacccctgtccccag

SEQ ID NO: 1526 - DNA, 201 bp, Bos taurus
tgtgaggcaaggtggcctgaggaaaaaagaactctcctgtctttctgagttttttgtggaatgcccttagtttgtttcttagaattaggtttggctacaaataaatgtaaatccaaattaacaatgacttaaatacacaaaatttcactcttggatacagacagtccaaggctgtttaccactcttagcaggtatctcatc

SEQ ID NO: 1527 - DNA, 201 bp, Bos taurus
tagtgggagcatgaacttgaccttccttgttcctggggcacatgcctaaccaagtgctcatggaccactaagctgtggggtcagggtgttctttctgaggtagggaaatgtggtccaggtctaaaaagcccacagacagcctcttaagggctaccgtactagcacatcctgaaggagtttaaacatccattgtagcccccg

SEQ ID NO: 1528 - DNA, 201 bp, Bos taurus
tgctcagaaaacaggctgaaaggttaaaaacagaccactgcggcctaaatgtgtcacctggctccttcaggagctctgctaatcagtctatctaggcagtgatcacagaaagactggccggtggcagagagctatcacgagggaaggtcagaaaaccaagaggctgcctggcaacatggagctgccttttttatggaattt

SEQ ID NO: 1529 - DNA, 201 bp, Bos taurus
tgattgaagtcatatggttctcaattgaaataagagtgagcaaaaataatttttggcctctaatgactgttctttttcttttacaactctgggcaaccattcacattgtacatacacatgactcttgctgtcaataatggccagccttgtaacttcgtattatgttatgagaatatgtctgtgttctaataaatgtctgtt

SEQ ID NO: 1530 - DNA, 201 bp, Bos taurus
atgtgtatcagaatcccatggaagcttgaagacacacattactgtgccctattcccaaagtttttggttccttgggtctggagtggggcctgaaattgtgcatttctaactagttctctcattccatagttcatcaggcactctatctatcagatctaggcccttcaatctatttctcacttccactgtataatcataagg

SEQ ID NO: 1531 - DNA, 201 bp, Bos taurus
ctgaggccacccagtactggagtctaaaggttctatggtagggctattgttgacctccaagaggatttatgctgacacacatctcccaggactgctgctctcagtgctcctctccttgtggtgggccactgccaacccatgcccctgcaggagatgctcaaacactcacaggtaagtctggctcaatctcctgtggggtca

SEQ ID NO: 1532 - DNA, 201 bp, Bos taurus
gcagggtggcagaggggccctggttatgttctctggcactgaaattccccagtccccccccaccagtaaatcctttcactatcccagctgtcagcaaagagggcccaggaaacctgctccccttccttattaatttccaagggtttctcctgtccagattcagcccaaacttgaaatacaaaccaatttgcttctttcctt

SEQ ID NO: 1533 - DNA, 201 bp, Bos taurus
ctgggcgcactcccaggggcatggaggatccagcgtaaggaattcttacgagaagcgagtggagccagagttcacaggtaaggccatatgctgcttccaccaggttgcctgggtcactatgacagggtaacagctgcccctccccacaagatttccttgttcagaggtgggatcctggccccaccagcttctcccagctcg

SEQ ID NO: 1534 - DNA, 201 bp, Bos taurus
catgtttaccttgtccactgcgtatctgctgtgccagttagagtgctgacatgtaggaaatgcttagtaaatacttgtggaagggatggccaaatgccatggttgattagagaggtctgttacaggtagtggagggaccagtcatgatgtcagtacaaacttttgttatcacaggattggttaataatggccaaacaattc

SEQ ID NO: 1535 - DNA, 201 bp, Bos taurus
agatctgagcttgcagatggccacaaaacgaaagatagaagtaaggcaggaagataaacaagggatcaaggaaaactgcatgctgagtggggttaccctctaggccccttgcctttcccagcaactggcatgcaggcagccatatgtaagaatgcaggcttggagattggaggacttctgcctggagacatcatctagggt

SEQ ID NO: 1536 - DNA, 201 bp, Bos taurus
tttctaagagctcagcatttaaaacccatttgtggattttcatcccaacgtgttaaattccagtattcctagtctgatatgtgggggtggcctcatcaatctcgctcattcttccagcaacctttcatacattccatactccaccctgtgtgctcctgcacaagcttgccttgctggtcaccaatgtgtattttattttat

SEQ ID NO: 1537 - DNA, 201 bp, Bos taurus
gtctcggcaaaaggctcatgtagtgtacaggcctctgctaaggcagatggtttttctggaccagatcacaagctgggattaaacttttgcaaatgaataatgacttggcctcctgcatagctggtgtccaaactgaaagttcttatttaactatcagcacaaatcgcgggcagtacccaactcacccatgtgaggagttcc

SEQ ID NO: 1538 - DNA, 201 bp, Bos taurus
cttcccccgaaaccctccaagaccagcaggtaggtctggctcaggtttgtatcaaattactgctgttgtccctgttctagtgtgcctgcggttttgtgtatacctttaagggtaaagcctctctttcccccagtcctgtaggcgcctacggtcttatggaaaaacctgaatgaactttctggccaatccaatatcttaacc

SEQ ID NO: 1539 - DNA, 201 bp, Bos taurus
aaagagttcccctgagaagccgtgcacattttttcctcaagagttggtgtcacttgccattagtgtcgacagtgcgtggccacgggctttcgcttctcctaacttccccggtgtcaaggctacccaggctcttctccaggtgatagttcagactggcagttctgatgttctctttgattcctcccggccccacggacttaa

SEQ ID NO: 1540 - DNA, 201 bp, Bos taurus
cgcattgtggccctgtcgaggctcaccaggctggagctgagagacgacttcctgcacaggctgcgaatgctgcaggccccgaagaacaagcacgtgatcacgctgctgggctactgcgagaacgataacatcatcctcacagagtaccatccctcaggctccctgggcaacctggaggccatgctgaatctctccaagtac

SEQ ID NO: 1541 - DNA, 201 bp, Bos taurus
gctgtgattcatggggtcgcaaagagttggaaacgactgagcaactgaactgaactaaactgaaaaatgaatggattttgttagctttaaactcaatctggaatggccagaaataggcatgtccccccttaatatgttttaaatgacaacctttcagtgcacccttttcaaaatagtcataatttagcttgataacctaaa

SEQ ID NO: 1542 - DNA, 201 bp, Bos taurus
tgcattctttcataatagttactgctattatttccatttcagggatgagaaatctgaagcttagataggtcaagtgacttaactaaagtgacacaaccagtaagtaggagaggtggaatttgaattcagtcaatctgggtcctgatccttacccttgcttacgtaagatacaataataagttaatagcatgaatagagaca

SEQ ID NO: 1543 - DNA, 201 bp, Bos taurus
tacactgaacacatatttatacatgcacacaaacagggagtcagtctaccaacttgtttgtggtgggaatacaaagttgtagtgatttttttctctcaaagatcttgcagtttagatggaagtaacttaaaatacaaataagattgccttccatgggcaaggcactcaatgaatatttgtagaataaataaatacataaaa

SEQ ID NO: 1544 - DNA, 201 bp, Bos taurus
agtctttaggtgattattaagattaaattagatcataagagtgggccctagttcaatgagatcatgaccttttaagaaggagaaagcaatttgtcttcacctacatgtactgcagaaaggccatgagaagaaaacactgtgagaaggtagccttatgcaagccaagacaagaggcttcagaatgaaatctaccttgttggc

SEQ ID NO: 1545 - DNA, 201 bp, Bos taurus
gaccccaaataatgatctcatttctcattgtttccttggaggccctgcctccaaacacagccacactggaggttccgaactccatgtgggaatgtagggggaagcacaaaccttcaggccataatgccagataagtcttaataaaatatgaatttaaaatcaatttaaaatataaatcagtattttattttttatatagtg

SEQ ID NO: 1546 - DNA, 201 bp, Bos taurus
tgagcctttttctgttcttatctaacaagaccattttaaagcatctaagaatcttgattattttaaaatgtgtactctcttgatttctgtgacaccataacctcttgcttctactagaacttctatactgtcctttcttcatttctttgatgaattttattatttttgttgttctgtttttgttttttcctacaagtgtta

SEQ ID NO: 1547 - DNA, 201 bp, Bos taurus
gaatattaatcctatcattttactatgcctgttatactttgatctactttagcagaatcatattattaaattatgattttaaaccagaagaatttgaagttactcagaccattaccagctatatcattttccttggagctagaataggaatttcacctcatacgtttatgatacattcctgtttacatttactcttccact

SEQ ID NO: 1548 - DNA, 201 bp, Bos taurus
tagagaggattgttcaaagcaaggaactacatcaggttgggggatggtggagtgggggtcttcactcgtgtaactgcttcctggtaacatcctactggtacttttatcttagatcatttcagatacttgttctgtaatatttatacaggcagcaaattctgttgttgtcactcatgcttgctatataagactgataaaatc

SEQ ID NO: 1549 - DNA, 201 bp, Bos taurus
agcgatggagattatagctcttttattgattattgctggccaagtcttttaaagaacatcttaactgtgttatttcatttaattcttacaacaaatcttggttcagttattcatagattattgttgtgggaattatagcttagagagatttgagggccttgctcaaggtcacccacttaataaaaatagctttaatttagg

SEQ ID NO: 1550 - DNA, 201 bp, Bos taurus
aactacacaaaaaatgtgagcgtttttgattctctagtcaagttggaagtcagtgttgttaaatgcaatcctatctgccagatttatttttgcttaccatggtcctaatccaagtagcctggccatgtaaaaaacaacctttaagactctcctgcagcttcacccagaaagatgcttacacagacacatttgcacagacac

SEQ ID NO: 1551 - DNA, 201 bp, Bos taurus
taaccactagtttgctctctatatctgtgaatctacttctttttttgttatatgttttagattctctatataagggatatcacatagtatttccttttctctgtctgacttattcacttttagtggttgtcattcttattacctgacacatcttcatccctttaggatagcaagtgtggattttaaaaatctgtatgttgt

SEQ ID NO: 1552 - DNA, 201 bp, Bos taurus
atgggattctccaggccagaatactggagtgagttgccatgccctcctccaggggatctactcaacccagggatccaacctgagtcacagatatctcctgcataaaaaactggcaggccagttctttaccactagcaccaccttttatctctgctgctgctgctaagtcacttcagtcgtgtccgactctgtgcgacccca

SEQ ID NO: 1553 - DNA, 201 bp, Bos taurus
tcagtcactgtgatgagaggcaatggccttgacttctgtatgagcccaaagacctatgccagggaaaacatcaagaaaaacacattaaagaggctgtggagtttaacttctgaaaactggattctggtttaggaagcaaaaaggacataaactcagatatagttttcagttctggttctaaaattactgcgtggtaaaccc

SEQ ID NO: 1554 - DNA, 201 bp, Bos taurus
caagtgacagttttccatacccctccattctattatgacatccgagtttatataaatctaaaaatatcatactttatgaatgtgagttccctttattattttacaccaatctcatatgcagttgtctctcactcatgaaagtgaagtcaaatttagaagagctctgaaagctcatgtagcacttccagtatggtctgtgca

SEQ ID NO: 1555 - DNA, 201 bp, Bos taurus
tggcaggtggtcacgcctggcctaccagacttctctgcatgccctgagttttccagttgaaccactgtttaggtgaactgggtagtgacttttaactgatcctctagctcaccttgtggccttagtttccaagttccaaaactcctccaaaatatagttcccaaacgcctctcttaattgtgttatggttagttcctatca

SEQ ID NO: 1556 - DNA, 201 bp, Bos taurus
gggtctactacgggtatggcctaaggaccaggcccttcacgcattccaatacaaaacaccttgagatgttcatgcagtatcattatggcaaggaaagtgccaattacctggaattaaatagcccataagctaagagcctagttctctagtttctaaaatcaaggtccagaaaagcaattctatggtttaataggcccagtg

SEQ ID NO: 1557 - DNA, 201 bp, Bos taurus
gggaggcaggaatgggggttgggagatggaaggtaggaaggtgggaggtagaggtgaggggtttagcaggtgctggccgcgaagtctgatggtttgatggcaggcattctgcttccatcctgagttccatctggactaaccatcaggtgtgggtataatggataaacaaagtgcagcatcctttgttcactaataggccag

SEQ ID NO: 1558 - DNA, 201 bp, Bos taurus
cataggctggtgaaaatgtaaagaaactaaacatagggaagatccaggatcaaagccaagctatggatcttgtcagccactgtgccctgtgcactttcaacatgcacatgattatctggaatatgcatttacatcattatttgcttgatatacctatgttctagtgagtaagtgtggtagatggaatatagtcccccaaag

SEQ ID NO: 1559 - DNA, 201 bp, Bos taurus
gtttgtacatttatatttttattgacataaaacaagccagttatttcttcatatcagtcattctggcaaagagattatggcatctgaaaatcattattgagtttcttaatcagaatatccataaaagaatttctgggcagcatatttgaatttaaagtgtaaggaatgctatactattctgccaaattaaggcattgagat

SEQ ID NO: 1560 - DNA, 201 bp, Bos taurus
actattgaagattcacaggagaaaatatgaaataacaacctgagaaagtccagcgagctgcagagcgtcgagactattaaaacaaggggctcaatgggttcccttgtgatcgatcagaaacactgtagcccccagctcgaatcaagtgctgtgtgggcaactgtgaatcactccccaaatccccacctcctcatctccaag

SEQ ID NO: 1561 - DNA, 201 bp, Bos taurus
tgttcaaacactgatcaaatgtttgttatgtgtctatcactgtgcaaggccatggatacagagaaaacagaacccaacccctcctcaaggagtgcctcttagaggagagagattgatctggtttgactgacaaaaataggtagtcaatagggaactcaaactggggctatggaacaacctagaggggtgggatggagtggg

SEQ ID NO: 1562 - DNA, 201 bp, Bos taurus
gggcagtggggaggcaggggcttaggaaggtcctgcctgggggtgagctggggtcttatgataagggaacaggtggccagtctgggaaaatctggcgtgcatgagcttgtatcccaagctgaggtggcacgagctgtcctctgatgtggagtgtgaccttagggcccctgttggtcagcaataggcaatgaagttgctgtg

SEQ ID NO: 1563 - DNA, 201 bp, Bos taurus
agaattagggccaacagcccgcttgcaatgatgtgtggctgcaggagctaatctccattcagcgccttgggtgccagctgcttcccacctggtcctgcattcatccctgcaaacaactttctgaggatccccacacatgtttttgccagtgagagacacagctgtgatatccgcaagaacttgagtctggttaaaaaccat

SEQ ID NO: 1564 - DNA, 201 bp, Bos taurus
atcttgtcctgtaatttgccccagggccctgaaaaccactgtgacccagtgtgttaactctcccaagtaatggcctgtgaaaaacagatgatttacctgtagttctgaattaatagtggtggtagagttgagcagagtgaatctcctggaaagactgacctgcacttggtgaggagtgactccatctctgggtagactacc

SEQ ID NO: 1565 - DNA, 201 bp, Bos taurus
ctggcctgccagactagttgctaataaatggtgtccttctggaggatttactttgtgcttgagacagtgttatgtgcttctacacagtatccctttcaattcccccagcaatccttcaagagaggccaccatcaccctcatttcccagacagctctgcaggatgcagtgctcagccaagttcacacagccagcaaggggca

SEQ ID NO: 1566 - DNA, 201 bp, Bos taurus
atgttttcaaaaatataatatggtccattccctgcacttccatgaagttctgagctcaattcattcactgtctcttcctattctgtccccacccatcagattgtgatttcctgaaagtcagggactatttctacatggcctttgaatgccctccacaagtgttgggtgcctggaataggccagaggtgcagcacattggtg

SEQ ID NO: 1567 - DNA, 201 bp, Bos taurus
ggcgggacctttgacaacccgtaggagctgtcctgccgccattaagccaggtccagagggcgcgagagagtcctttcctggccgccagagtcgagcggtccgggcatcttatagctgtcctgagccaagtaagtcagggtgcggatacccgcgaggccctggcttttgagctcagggaaacctccgttttcgatttccacg

SEQ ID NO: 1568 - DNA, 201 bp, Bos taurus
tgggcaagccccaaaggttcacctgggccacaaatgagatgggtgggggaggagccagacaatgaggggagccaggcatgggggaagagaatgactgtttctaaacggcccccaaggtgccaggctctgggtcttgtaagtgtcataacctctccatgcggagatccctttataactgactgacatgaaggagcctgaggc

SEQ ID NO: 1569 - DNA, 201 bp, Bos taurus
atctgttctgtttccagcctcgttctctagccacctgccagttttgtaagctcctaatagcacttcatccaattccctttttgatgaagtctaccagaggcttttgtggcctgcaagcaaagaaggctgactgatgcttcttcaaaggaacacaaagtcacagccctgaaaaagcacaactgagaggaagaaagcgataga

SEQ ID NO: 1570 - DNA, 201 bp, Bos taurus
aaatctgcagtcccttcgatggagcaggttatacaaggaaacaataaatgtgagaggcagcagcactccttaagaggtctaaattgaattgcattgactttttacaaagccacaaattgcttatcttattcaagtgcctgagtgtttgctttttgatgagctcagtacaaagataccttgaagtttggcagcagcgtgagt

SEQ ID NO: 1571 - DNA, 201 bp, Bos taurus
agcattgaaaaatcagaagatttcacatgaaatttagatttccacattttgggtttttttttttttttttaaaggaagctccggaagtaccaggcccagattcctttctgatcacaatcagctcagcagggatggcatggacactgccccttcagagggtcgtgcctctgccaggcgccaccgtccccacctctccctgct

SEQ ID NO: 1572 - DNA, 201 bp, Bos taurus
ggggggttgtagccccaggcaggaggcttgcgaggcctgtggccccctgcctgactgaccttgggctgtccctccgcagagctggtagagatggctgttaggctcacgggctgggccaggcagagccctcacagtccctcaggccctggtggggagtcacccccttggccttccttgcttgatcccaggtggacctccctc

SEQ ID NO: 1573 - DNA, 201 bp, Bos taurus
acttaggttgcagcatgctttatttgatgataaagggaaatatccctacagtggcaggatatgagagggaaaaggcagccctggggccagcctcatggagtttcacctgtagtgggataaacagcaaaaaacaaggaagtagaaaaaaaaaaaggaactgcaggctgtagtcagggcaggggatgggggatgtgaggtccg

SEQ ID NO: 1574 - DNA, 201 bp, Bos taurus
tgctggcggggaggccagggtctcagtcccggccctgccacctcttcagcccgtaggggcccttggcattaagcaattaccgtgtaacccatggccggagcgccttgaggactcctccctccgaagctgagtctcccgggggcgccagggtgtccatgagtgcggctggcagcatggcggggccatggctggcagctgggc

SEQ ID NO: 1575 - DNA, 201 bp, Bos taurus
ctcaaggcccagagcgctccgtgagatgagccgcagctgtcgggggtccagtgttgcagctgtcttctcccagcccactctgcagcctctctgccctcccatggccctaggtcccaggacgctctctataaacagcctgctgggtaaacacagccccaggggagcccagctggcaacacccatccatggatgaagagggtg

SEQ ID NO: 1576 - DNA, 201 bp, Bos taurus
cagcttcttcatgcgacactcaggcaagagagcagaggcccaggggaggacagctgctgcttgaaggtacctaagttggtagcatctgaccttccatgaaagagaaaggaaaatggccaaagccattccacaaacaagcacagacacacagaggtattcttccaccagccaagacacctgccatcaggggtcaccggcctc

SEQ ID NO: 1577 - DNA, 201 bp, Bos taurus
gtaagaatgggcctgatacaacaggaggcctgtctttataagagagacgtcaagagagctctctctgtctgcaaaatgggatgagaaccctcaccagagctggccatgctggcaccctgatctaggactgccagaaacaagtttcacttgttcaagcctccccgtctatggtattctgccatggtagcctgagctgaataa

SEQ ID NO: 1578 - DNA, 201 bp, Bos taurus
tgccacccaccccatcccagcacccactcacatctctgccccaaagccatgttctcagccaggcccactctgaccaccttaaagaacattgtgggcatgtacacatgcccttggcccactcaggctgtatttttctaaaaagcagctctttccatttcccagtagtctataaaattcactcagttaacttgcttatgggtt

SEQ ID NO: 1579 - DNA, 201 bp, Bos taurus
cagaggagagaagaagtgaggcgcacacagagatgccagcccagaagtgaggggcccgcctcagggtgctgactcctgagcacgaggagcagaggcctcatcaacaggtacaagagctgtggtgtgagtccagggctctgatcccaatttctgggctgtccatggaggcccctcggagaaggcaatggcaccccactccag

SEQ ID NO: 1580 - DNA, 201 bp, Bos taurus
agaagaagtggcctcactatgtgggtgtggtgactggaaaagaaatgggtgtcaaccacctacctccactcactggtggatttttaaaagaaaataatgacaacagctgtcttttatttattaatttatttcgccttaccttgaggcacgcagaatcttagttccccaaccagggatcgaaactgtgctcccttaagtgga

SEQ ID NO: 1581 - DNA, 201 bp, Bos taurus
gtgcatcatctctctggtacattctgattgcctgggcctcttctttgtgatcttctggtcagaaagctgtggttttaattacctgctctgctgtgtactttctctgactgccattgctcctggggccaagtagtaggaatacagagagtaaaaaggcaagggcaatttgctcccactttcttgggttcatcactcacctga

SEQ ID NO: 1582 - DNA, 201 bp, Bos taurus
ccaaaggtgctggggcaaccaggaatagtgtttatttatagtggaaaagcgtcagccatgcacgcaagagaactgggagagtcgtgcacggtggctgccatgcggaaatggccccttcagcagaatgatcctggggctgctgctgctgctgctggtaagtcgtttcagtcgtgtccgactctgtgcgacgccatagacggc

SEQ ID NO: 1583 - DNA, 201 bp, Bos taurus
caggttttctctctatggctgtgggcttacaatttcatgaacttgagtccagaagtaaaataagttccccttttctaaggcctgagtttgggtctttctgatgcatccctggtctaatttctgtggctgggttgggggagggggttgtgtccagtgttttgattggccagacctagatcttgtatccacctccagaaacaa

SEQ ID NO: 1584 - DNA, 201 bp, Bos taurus
agaagatacatattactgtaaaagatggctatctttgtgaagtctaaaatcagtgtaggtgtgctgtgtgggatggccctctgtttgttaccccttcctgtgctaccctgtagagtctccagctccctctgccccgtgctccaggagttcagttctggcaattcttcccttgctctctggcttttgtttggcccatggaag

SEQ ID NO: 1585 - DNA, 201 bp, Bos taurus
agttgactgtatcaatttaaaggagagctcagcaatatgtcttaattaaaactaagcatacaaactctgaggatatacacacagggattaggaaagcttacttagataaaccagaaggagaatggatacactgacttcaaagaaacaactccaaagaagctgtgttatatttgaagacaaaatacccatccagggttcatg

SEQ ID NO: 1586 - DNA, 201 bp, Bos taurus
tgtgttttctctacagtattaataatatgagtcatagcaggtaagatggattctgggagggagtttaatttgaatttggccttgagggatgtggtacaaaaaagtgggggcacattccaggctttgaaaaaaaaaaaagatgatcagaataaaggtatgggaatggccacctaggtagaccagggctatatgttggaaaac

SEQ ID NO: 1587 - DNA, 201 bp, Bos taurus
actgacctgggcccttcattggagaaagttcatcaacgcgtgacccaagcccgagccgagcctattggctctaaagtgcatattctttaacacctgtgttagtaccttctatgtgggatggcctcacataacactctctgtggttctcaatcatgagaatgtcaaggcactgaaggattttctgctcttgacccaaactgc

SEQ ID NO: 1588 - DNA, 201 bp, Bos taurus
gttctggagagcaatgacaagtgttagaaaaagcatagaatatggtctaccatttgatgctgtgatagcagggaaatcataaaggccagaatcctgtcctaaatcataaccatccctcttccaggtgagatatctatagaagacacacacaggatccaccctgctgatctcaggtaaactgagttaaagcatgtggggagg

SEQ ID NO: 1589 - DNA, 201 bp, Bos taurus
ggcattagccaggtacaagggaagcagtgctggtctctaagggaacagactgggctcaggaacaaccctgttattttactctgcatcattccagtgtgggactgattcagctggagttctgcactcactagaagcttggtgagtcacctgcctgagtctcattttcatggatctataagatgatagtgacttctaggattt

SEQ ID NO: 1590 - DNA, 201 bp, Bos taurus
agagttggacacaactgaagcaagttagaatgcacacacaagacgtaaaatgactccatttgaaagaaaatgatttccctctcacaaaagagttaaaaactgatatccctggacaaattgcaactttaatccctgtggttatgcacagacccaggttccattcaatcattaggatgatccctttgcactgtctatatccag

SEQ ID NO: 1591 - DNA, 201 bp, Bos taurus
caacagtatagaagggttccctttttccacaccctctacagcatttatcatctgtagatatttttttttaataatggccatccagactgatgtgaggtgatacttcattgaatttctctaataatcagtggtgttgaccatcttttcatgggccatttggtccattgacagaggatgggtaaagaaggtgtggcatatgca

SEQ ID NO: 1592 - DNA, 201 bp, Bos taurus
tgaactgatttgtccatggccatatataattatagtccaattggttcaggcagggaccatccaactgcccagacattcattttattataagccttgattttagctttaattaaataataatttattcagtaccttcttcaaagaagtctgctgcgattaatacccatatatctctccaaatgtctatatatactgtggaaa

SEQ ID NO: 1593 - DNA, 201 bp, Bos taurus
atataggccaatagcctgaaagcaaagcttcaatatattgttcatactatttctcccttgtattctgtattcaacttgtgccatttcttcaaggctcttcagtgctgtagaagggcctgtgtagaagagaggaaatttatttcccttttgccctccaatccttttgctataaccttcttctggccctcttttcacaagggt

SEQ ID NO: 1594 - DNA, 201 bp, Bos taurus
acgggtctttgtgagacatgatttacatatatatatatatataaatcatatatataaataaatcaagaccaacaagtgctggccttatgttcactatctgttctcatggcttctttatcttttcctctctgcttcttccttctgccccaatgaccttcctgtgcttccactgggacgttagcacactcccacctttgcact

SEQ ID NO: 1595 - DNA, 201 bp, Bos taurus
acagcggttcctttctgaatgcggctgcctcgctccgatttgcagtatgccctgtgcctccttatccatggctttcagctctcccctaggcagaaggctctagttgggataccttgcaaccaatggtcatctgtttaatagggttgggagttttggcctaaaagtcatgggccgatgtagtcaaacgacaagatcaatggc

SEQ ID NO: 1596 - DNA, 201 bp, Bos taurus
ttaaaaaatcaagacattggaaagtgcacacgcacaagaaaaggagatgaaaataaacactacatgcttcacacccagagaaaattatgaatcatatctcataccatatgcttcctaaacgttttttacacactgtcatgattatttagtggcacagtctttttaatatagcagtatgtttgaacttatttctatgacaat

SEQ ID NO: 1597 - DNA, 201 bp, Bos taurus
gcccaaagtaggtcaaatacacatgacctgatattcctggggaatatggggccttctgctttgtatatgttttatatatgacaggtccttagcttccatgtcgcctttgtgtcagtctgagttggtgtccttttgaacttatacagataatgttccttacgtcacttctgatgcccttttctgtttttattatattttgtt

SEQ ID NO: 1598 - DNA, 201 bp, Bos taurus
taacttatactctaacagctttctgtcactgttgcaaatgtgtagacagataccgtctcttatcctgagagtgttagagaatcacagtaaattacatgcatggaggtgaagaaaggtctttggcattaaatcccaggctgggacttcctcttcatcccatatggattgttaacttgccaaattcaaggctacaaagtattc

SEQ ID NO: 1599 - DNA, 201 bp, Bos taurus
ttcatctcaatttcagagaaatagctggtcagatggggccacccataccatttattggtcatgtcagcctagtttccatcccccacatatgaaaaccagacaaagagaggcctactgataaattaagggggatggtaattgggaactgaaagtattttcatttctcaatttcagaattcaaatttgtgtactctcaaaatg

SEQ ID NO: 1600 - DNA, 201 bp, Bos taurus
aataaagagtagtttcagaataattgtagatttcttggaaaaataatatctcctcgtacttgggcctccctgttttgagaagttaagagaggatagattcgattgggaactgtggacatattggttactgcaatgttgattgattaaaaatatacttctagaactggcagctcagaatttctgctcgaatgtctcctccct

SEQ ID NO: 1601 - DNA, 201 bp, Bos taurus
tatagtgcctatatgggttacaaggtggcagttgggcaaaatggctgggcaaatgcaagatgacattatcatggtgcctctttgatgtcttagatatacaagaccttctctcacccttaattatttgaaaaagattaagcaagactctgcatttaagggttgagttctaattgagtcgagctgtgtgctgttctacaggaa

SEQ ID NO: 1602 - DNA, 201 bp, Bos taurus
agatgttgagatctcaatattgcaagggagtgagggtcagaaagaatagattgtatgcccaatattacacaatgatgccacgatgctgaccatttggatgcgaatccaggattccctcttcagaacatgtggcacctgaggattccaagctccccaaataaacctttcatttagaattttacaaccaggatttcaatatat

SEQ ID NO: 1603 - DNA, 201 bp, Bos taurus
ctgttactgaatgcatgttcctgtgtctgatgcacaatgaggccaaacaataccagaatgttggagtttggagcagagaaagttttactgtaggcccaaaaaaggagaacaggtggctcgtgtcccacaaaacttcaaactcctggaaaggtttcagcaaaccattgttttaaggccaagtgaaggaggggcatggttggt

SEQ ID NO: 1604 - DNA, 201 bp, Bos taurus
tctaagaagtagcaccttttactaaaagtgaaatgaagagatctaggtttgaactccaggtcaactgccatcagatcttgggacactagtaggaaagcaactagcctaaatggacacattgtctttatttgcagaatgaaattgatgagtatggtaatggaactcttacaacttgtggatatgctatcatctccatgtgta

SEQ ID NO: 1605 - DNA, 201 bp, Bos taurus
tgggaacagttggggaactacttggggctggctagaaggtggacacaatgaatgacatgttcccagaatggaggtatacatgcacaactgtcccctgatgatcacactggccctagcccctgaattaattatttgcttgcatgactgtaatgaaaaagatgtgatgcctcatttattaatgtatccattttccagtagttc

SEQ ID NO: 1606 - DNA, 201 bp, Bos taurus
aagcctggtgtctagggcttactcaaaagaaaaaggtttgttcaatttccttccttttcctatctcttttaatctcatttaatgacttgacaaggccactactatcctcagttctaagatcaacaaagctactttaccagctgagccaccagggaagcccttctccaggccagattacaaattttaggcatctaagcttga

SEQ ID NO: 1607 - DNA, 201 bp, Bos taurus
taaggatcctagggctggttttttcaaaacagtttttatgcccttgagtaataacagagatggtactaacctgacttccttcttttgttagactattgcccactacagggtagcaggagcaggatcagaacaaaagaagaaaactggtctgtacttcattcatggagtaattattacccaatactctaagggctgtgttgg

SEQ ID NO: 1608 - DNA, 201 bp, Bos taurus
aggtgtaagcataaaaacaggaattaacatagaatatgctaattaatgtagcaattagttgagcagaagcagtgggaatttgtgggataattagggtaagttggctatagtcagtgttgagggttttgaaaaacaagatggggagtctggttatcatataaagacaataggaatttctttttttgtttataagaattccag

SEQ ID NO: 1609 - DNA, 201 bp, Bos taurus
tagatactgaaatctcctctaggtagcagaagctaacaattaattatgctgcccacaaacatgtaaaccccagaagagttggaacctgaaagttgatgacgttgactcctgcttacctcaccactaatgcatcagaagaatgcaagactgtcactatcttgatcattattacatactcctgatcatgagccctgactgtaa

SEQ ID NO: 1610 - DNA, 201 bp, Bos taurus
agtgccctgagttttgtccctccccttccatggaagaagaataaaaatacagaggagtggcatgtgccaacagcatcactgataccctgtgtgttttattcactcacatttatcagagtccctctacacttaactcttggccaaagctgtcccagcctgatttcagtatgctacctgcatttactgacagagtatagcatt

SEQ ID NO: 1611 - DNA, 201 bp, Bos taurus
acctagtggatagcttctagtttcaggggaagagaaaggccattagaaaagaaagtcagaaggaattacagagactggctgtcatgtgaccttatttaacccccagtaagccatggtccctaaagagatggtactgtggtataaaggccagatgcagctcaaggtactattaggatattgcaatgattcaaaggcttttcc

SEQ ID NO: 1612 - DNA, 201 bp, Bos taurus
tcatgacttttgtcctctcttgttcaagtagggccatgtgactccagagtcaccttcctgtgtagtatatttgggtttcttccacaggtgcaataatagcgttctccttacaggcatccttgctgcagtgccctgagcatggtatttctcatttactgcctcccctcctccacagagctccactgttactgcagtctgctg

SEQ ID NO: 1613 - DNA, 201 bp, Bos taurus
tcaaaaccttgcttatgctggcttcaattttttgtacattagttaatgaatcagcatttcaggacatgccagattggcactctgctgtccatcagttgaactggttattttcacaactgttagcacagtactgttttgtgaatgtcattgctgcccacttttatgacttaaaaaaggaagaaaatggaaaaatgaaaatgc

SEQ ID NO: 1614 - DNA, 201 bp, Bos taurus
cttcttggggaatgtattagtttggcaaaagttttgataggtgaggtatgggatcatcgtagcccagactggagaacaaaatcatcaggtttccctggggtctttgcatgcttttgtgcttaagaatttagaattaatcccatgtgcaataggaagcccttgaaggattttaggaagatctgccttttaaaagggattccc

SEQ ID NO: 1615 - DNA, 201 bp, Bos taurus
acagaggacttgtcaagtctcatgctgttctctctgtatgctagaaaattctcatattttcctgaagatggcaaagacatgcgatttccctgtaataaaattgtgacctggttacaactcctctaaaacacgtaaatatactatgagaataaagctctcactattctaaatctgtgatgtgatcaacttttattttgaaga

SEQ ID NO: 1616 - DNA, 201 bp, Bos taurus
gtttatcatactaaataaagtcaggcaaagacaaaaaccatatgatatcacttaacatgtgaaatttagaatgtgacacaaatgtactagaatatagagagtggataaacaacaaaatcctactgtatagcccagggaactatattcaattccctgtgataataatggaaaagaaaaacaatgaatgcatatatatgcagg

SEQ ID NO: 1617 - DNA, 201 bp, Bos taurus
tgtgctgccacttgaatttcgatcccaactcagcccccagggtggccagggtatatgactcagtgcaaagcaatagccccttggtggtgaccagcctgacggatgagcttaagaagctggccaagcagggctggtactggggacccatcacaagctgggaggtggagggcaagctggtcaacatgcctgatggctccttcc

SEQ ID NO: 1618 - DNA, 201 bp, Bos taurus
tgatttggtgtagcttaaagacactcagagatggaaattgtcctctaaactgtgcgtgtctcccagaatccaagtgctagagtgccctcagatttctaaaacaagcactagagctcacaagggtttaggatctccctcaatctctgatgcttccatctgtaaaagttccatgctcctctcactctgccttccctgctgctc

SEQ ID NO: 1619 - DNA, 201 bp, Bos taurus
aaatgctattatagacaaaggaatgaggtagtcaattgattgatttttaactgaaacaacaagcctgggggaggggaaaagtaagtcaatgtatagatactgtcctatttgacattatttaattttgcattaaatagaataccaatattatattttatcagcatatgctatgttcttttatattaacaattaaactcatga

SEQ ID NO: 1620 - DNA, 201 bp, Bos taurus
tttaagtaaataaggaagctgaggtccagggacatgcaagcacaagcttcaggatcatgtggttgtctctgtcatgcagcttcaatgaccattgggttccctggccccattcatgacacagtcctttagtaaccccatggaactctgagggcaacactttgtctttcagacctcagcagcttttcctgatctcttaacaac

SEQ ID NO: 1621 - DNA, 201 bp, Bos taurus
gatttagaggttggttttattgtaaagaaatttgctgaaaatgtgcagcagtgattccaatgagactgatgatggtgtattcatattagtccactaagttatcatcttttatttctccctgagctggaattcagtgcagagaatatttttgacatttaaataagataaaaaagaaaaacattgtctacccaaattattgag

SEQ ID NO: 1622 - DNA, 201 bp, Bos taurus
aagtagtagatttcaagaccccacttccaacaatgaacagatcatccaaacagaaagtcagtaagaaaacaccagacctgaactacgttttagaacaaatgggcctaacatatatagagaatatccatccaatgacaaaatacacattttctcaatcatacacagaaggctctttgagaaagattatatattaggccacaa

SEQ ID NO: 1623 - DNA, 201 bp, Bos taurus
ctcataaattagaacatctcattacagaggcacacacctgagccagatcacacagagccctccctcctcttgcatacataccacagcgtctgcaggactcgatgacactgcttttttccctgtgagacttcaccatgctgctgtgcatccttctatgtctttccctgtgatttaactcctggaccacatccaaacccagaa

SEQ ID NO: 1624 - DNA, 201 bp, Bos taurus
aaaaaggtgggaaatatgtaagtaaatctaaacgaaagctaaattgataaaacaataataataatgtcttgtgagcttagaaacatagtacaactgaaatgatggacatcaacaccacatttataaaggagagctaaaattaaaatattcttgggttttgtattgtttaggaaaatgacaataatattaattaaattttga

SEQ ID NO: 1625 - DNA, 201 bp, Bos taurus
ttttgctaatttgacatctattccccctctgatagccttgtgcagttgcttttccaatcactttaaatcttgccacctcattaagaagaggcccaatgttcccggtgggaacttgatctggttagaggagcacatcagggcaaaagatgcagggctagcataccactgtcatcaccctccctgccagctaagaggcctggg

SEQ ID NO: 1626 - DNA, 201 bp, Bos taurus
agaggactgactcataggtggccacagggaactgctgcctgctgtcttaagggagtataaagccatgggtaaacccactcttgttctcaccaagctgccaaaagttagcttcttgtacccagaaaagaagacaagatctgccattttgttcagttcagtttagtcgcttagtcgtgtctgactctttcgactccatggacc

SEQ ID NO: 1627 - DNA, 201 bp, Bos taurus
ttaatgtcactactaaagtttcgggcaatcttgataattccagttaacaaatatttattgtgcacctgccgtatatttgggtacagcatgatgaacaagagaaagaaggtgccttcaaagactttagtgggaaagatgaaaaatacaaaacttatgtaaacacaggatctataatgcaagggcatatgatatgtaacagct

SEQ ID NO: 1628 - DNA, 201 bp, Bos taurus
ctgattgtgagcaaactgtcagcaaattaactgatcagcaatttcccaaacatccacattttccattgacatttccggtcacacatatgttgatacacatcgcttcaaatctaggatctttttcttggtgccaacaactgggagaaaggagcataatatctttcacttctcaggcaaagagtgattgcctttcatttatcc

SEQ ID NO: 1629 - DNA, 201 bp, Bos taurus
ccaggagaaaggagcagtgaccccacatgagactgacccagacttgcccatgagagtccaggagtcttcgctggaggcgtgggtcagtggtggcctacagcggggtagggcacactgcgtgcagcagtgcatgaatgggaccttttgaaggaggtccccattatctccattacctccaccatagtttggcctcaggtcaaa

SEQ ID NO: 1630 - DNA, 201 bp, Bos taurus
aataatagaacccaccccatggaatgagagttaattgaaagtagagtttactcaacaacgaatattgtaattacattagagaaaaatctaaaacaggcataatggtgttaactgaatctccaatctctcttcagcaaggaagtcacataactcttgacaaacccctgtcttcttagttctttgtggcctctgatttttatt

SEQ ID NO: 1631 - DNA, 201 bp, Bos taurus
taaaaagaattattatttccaaattctgagatgtttgaagtatctataagtaaaacatctaatttttaaaaatttcatcaagatttattatgtgtataaacatactggcagaaatagtgctaaaggaaatacagtttcaaaaagagtgaataatagtccatatttcttaagcattttttccattggatattagccataaat

SEQ ID NO: 1632 - DNA, 201 bp, Bos taurus
ctcattctagttgagatttacaactttagcaaatttttacttttccattggagaaaataacttttattccaactgcaaatctctgttggttttagagttataacagctccacccttactacacaaacctacaaagtaactcttctacaacccacaaaataggcatgatatgagctccccctactggtacaagactgttccc

SEQ ID NO: 1633 - DNA, 201 bp, Bos taurus
agcttcactttttgtggcgtatgaagtgatagaattgatttatgaagtgttctatagccttatcatctcaattgtataatatttttaaatattcattattattaaacagtatgtaaaactccattgttgtgaacgttacttgtttcaaatactttcagaaacccaaacatagtgttaaacatcatttataccgtgacattc

SEQ ID NO: 1634 - DNA, 201 bp, Bos taurus
gaaatatatgctataagtctgacctcagtgatacatatctgtaaaatccatgctcctaaaatattgtttttaaatttctaggacttaaaggatatgtatgcagatgaaagaaactttccattttgcttgcaattcattaacactactcacagtaagtcagtactagtataaagactagagatgtcttcaagaaaattagtg

SEQ ID NO: 1635 - DNA, 201 bp, Bos taurus
atgtggttgcaagagtttgacatgacttagtgactaaactaccaccactacacattaaactgactcatttttatatggtaattatttctcaataaagctgggagaaaactcctcctagttactgtgtggcaacaattgagatttcactgccttgatcagtagagtaaacctcttttctcaggaaaggtcagtggcattgaa

SEQ ID NO: 1636 - DNA, 201 bp, Bos taurus
caatagaaaaggtctggcctctacgacctgaggccctcagtccaatagctataagaaactaacccagtccaatctaaatgtgcttgaagagttccaaatgtgaaggccatcatcccagcacctgattgcagccttgtgagacctgagcagaggactcagtcaagccacgtcgtaaatcctaactgacagaaattgtgaaat

SEQ ID NO: 1637 - DNA, 201 bp, Bos taurus
caacccagcctctggcccttgcatcagctatagactcttgtcactgactatttgccaccactgtcatcacacttctgctgctgccatccaccctggtcccgtgctccacacttttatttgggtactaagctttttttttttttttgagaaggaaatggcaacccactccagtgttcttgcctggagaatccgagggacggg

SEQ ID NO: 1638 - DNA, 201 bp, Bos taurus
gccaggcaggagccagagtcagcctggggggtgatggagccgaggccatcactggtctgacggtggaccagtatgacatgttgtataaggtgactgtgccacctgccaccttctcttcaactggcctcccatctgtagtgaacatgagccccttgccacccacaaaaaaaagaaaaagaaaaaatccaaaagaatctacag

SEQ ID NO: 1639 - DNA, 201 bp, Bos taurus
tattcaagacaaacaagctaaatatctccacccttccctgtgatgcagctaaaatacaaattataaaactaaaccagtaaacattttctacaagatcacagttgaagagcctgaaaaagaaagctactggattctcactgcagctgatgagtgtgaagtgttttgactttcaaaattcatggattataaaaagcatcagtg

SEQ ID NO: 1640 - DNA, 201 bp, Bos taurus
ggctaagtaaggatctccaaaaacctaatcctccatgaaaacaatgagaacactggcaaaaaaaaaaattgtaaaactccattttttcacaattctggaaatcaacaataggattaccacactatgagaatgattaagtcacaaaaaatggttgtgtcacagtaaaaacagagaacttagtggcattttcattttccctat

SEQ ID NO: 1641 - DNA, 201 bp, Bos taurus
tctcagcttcctctgggcccagcgttgctctctggctgattgagcctcctcccagctgctgctgctgctgctatagacacctctaaatgtctgatacatgcgctgcctactccacggcctaggccatgccttccttgagctctgccatggaatcatctcatctttcatcacccctggcccaagacagtcacttcattctca

SEQ ID NO: 1642 - DNA, 201 bp, Bos taurus
cagttctgcctgagaatcaggggtcctttcctctaaaatgccatcttctagggcatgttcagaacctttagggcttttttcagtgtggcctttgagactccttgagcctcttgcgggcaaggggagcaaacttgtagaccccaggtttttctgttgagagctgtggtgaactggggccgctgtggtcttcagcagaggggg

SEQ ID NO: 1643 - DNA, 201 bp, Bos taurus
ctttgagttattaggggacttttcacatataaatattgcagtgcatgccaggggatgtggtgtaaaaatgaattatgaagaagctaaagtagagcgaatccacagagccaaaatttggctcttttagaagacttttttaaaaaatcgacaaaacttgggaagctggtaaagaaatcaaatgagaaagcataaatagacagt

SEQ ID NO: 1644 - DNA, 201 bp, Bos taurus
atagttttgagggttaaatgaattaatacaaataagtgcttcaaacaaacagcagagactcattgaatgttgaaaactaagcaaaaatccattatgtttatatacattctgaataagtaaatctactcccataccattcaggaaagagtataaaattcatgtatgtgtatgtgtgtatgtgaaagttttgtttttctttct

SEQ ID NO: 1645 - DNA, 201 bp, Bos taurus
gcatctttcagtctatgtctaggatgagagttccatgaacagggggactttgttccacttaccgttgcaactctagggcctatctgcctgacacatagaaagcattcaagtaaatgataattgtttgagactctatgatctttacagatgtagagtattggccaaactgcaacatcctttataaacaactaagaagattct

SEQ ID NO: 1646 - DNA, 201 bp, Bos taurus
gggaagcagcctctagccttggaatgtcctgcttgatgagtgtttttgtttatttggtcccttgagccacaacagtctctgctaacaaagtaatttatgactgggggccccttagccaggcagtatcagctcaatctctgaaaaggctagaggttaaggtcagtgatggagccaatcaaccatgtttatgtgactgattcc

SEQ ID NO: 1647 - DNA, 201 bp, Bos taurus
ttcttacaaggcagaggactctgggccatgttcaaacaaggaggagtgtttcagtaggaaaagaaagtgcttttttttttttttcttttctttttgcatcatgccaagggcccagggttcaaagttctttagcacacacacccagcttccatatctcaggtcacagcatccatctcttcccagccagggctctgacttagc

SEQ ID NO: 1648 - DNA, 201 bp, Bos taurus
aaatatccctcaagtgtagtgcagaaatgctgtctaatgttctcaagagaaagaaagccatgatatatcttacaagagacagtatggcttctagataagccttatccaggcacaagttatagtgctattggccatgagttcactgttgatgaacccacaacgtatatcacatagaatgtcttcaaacaggaatacacatac

SEQ ID NO: 1649 - DNA, 201 bp, Bos taurus
gatgcatctggttcccagcagggcacagagctaatgcagctgaaaaagcatacagctgtgactccaggcatcttgtgaatgaccaggcctggcttgggctccctgcctaagttcaaagcatgggttttcatctgggagtcaggttgcggtgggaggtgggaggaaataagtgaatggctcggaggatctcttcaaaccaca

SEQ ID NO: 1650 - DNA, 201 bp, Bos taurus
tgcatagttgtgttattctgagctaaatgtaagaaaagtcatatggtgctgttgagctagcatccagatattccaggggtacagaattcaggtgggcccacgttggtttggcaatgtttggtagtagttctccactccagctagaatgttcatggggatgattctgggacttcctggacagtgtggcagcaatccaggggt

SEQ ID NO: 1651 - DNA, 201 bp, Bos taurus
aataagttaatatttgcaaagtaataatttggaataatgcctggcactttgtacagagacagtaaccacagagtaatttgaatgctttataaatttatatagggaagctttatcgagagaaatatgtatgtatatatgaagttataaatagtaatgggagtagctactaaagaaaacaggaatagcagacactgggatggt

SEQ ID NO: 1652 - DNA, 201 bp, Bos taurus
aggagactggcaagcaggtggcctggtgaaattcacatgatggacatcatccctcgaaactttagtggcagatgacaagtcagttctgctctttcagaaaaaggcttaggccagactgcctgggtttaaattccagctgcactactgactaaattttacagaagttacttatatattctgtgcctcagtttcctcaaccat

SEQ ID NO: 1653 - DNA, 201 bp, Bos taurus
tgccctgcttaggagactagaggaggccacacagccctacagccccttgattcccctcataattgcccagacacatgggaaggaagggctcagacagcccatgtggcccctgatctcctattcacaccaaagtcaaatatcctctccatgcttcacccacaacccagaggaccagctgtcctccagattcatggtcttcaa

SEQ ID NO: 1654 - DNA, 201 bp, Bos taurus
aagactttctccatcccaccaagccccctatatttcctccaacagggccaggacaaaaggaaagagatctggcccaaggtctgcaaactggctggtggccggtcaccaaggcacacgtctcccatgtccagtccagaacgcccatctttactgccattccctgtccccccaggcccaacccactggctgtccaactggctt

SEQ ID NO: 1655 - DNA, 201 bp, Bos taurus
atcagtgaaaatgtctttttacatttaagttttaagatcagctttattaaaatatcacttacagtaaaattgaccctattttaaatgtatcattctgtgcattttgacagatatgtacggttatgtgaccactaccacagtcatgatacagaatacttctagcataccaaaaagctccctcatgatcctttgtactcagtg

SEQ ID NO: 1656 - DNA, 201 bp, Bos taurus
caggatgcagtgcatgtccaaaatataatccaggagagccattgcataagttctcaggggagttttccattacctacaggccctttggaaatgtggcaggataggttttatacagatgcctcccctgcaagtttattaacatgttcttgttatgatctgtatgttttcatactgggttgaggcattcccaaggagaagggc

SEQ ID NO: 1657 - DNA, 201 bp, Bos taurus
ctacagttcagattcttggagcagaaaaggcactcttcagagccctcaagtctagacgagatacccctaagtatggtctcatttatcatgcttcacttgtcggccagacgagccccaaacacaaaggaaaggtgagttacaattttcctggcgcaggcctttttttcctccaaatgattttgatcttattctatagtggtc

SEQ ID NO: 1658 - DNA, 201 bp, Bos taurus
gatgacaatatatagtcttgacgtactccttttcctctttggaaccagtctgttgttccatgtccaattctaactgttacttcctaacctgcatataggtttctcaagaggtaggacagataactctaaattatgtataacagcttttctgtagtaaatcacttttttatgctagaaaatttcaagcaccttcttataatc

SEQ ID NO: 1659 - DNA, 201 bp, Bos taurus
gttgctagcccagaaccctttgtcatactgttccaccgcaaagtcctcaccatcaagaccacatccttgacattcactcctgcgttgccttgtgacatcattcacaaggtttcaaacaagggaatgtgatccatggcaatctgtgaactgtaagggggaaggtaagctattgctacctcaattctcacgtgctggtgactt

SEQ ID NO: 1660 - DNA, 201 bp, Bos taurus
attcagattgaaggctgggctggaaaacaaaatattgctttactgtttatttttatcacaccggtttttattaaccagatctcctgtgatgagggccaggcatctcggcagcatgattctgctgatggagaacatgtgtagttaatctccacatgctctgatccataggccaggcttgggaaagccagtgtgccgacaagt

SEQ ID NO: 1661 - DNA, 201 bp, Bos taurus
gaggggcctcagctgagaaaagaaacaagggcaggcacatcacatagctcgtacgtgtctgtgtggcccctttggtcctttattgtcttatttcaggccacgcaggtttgggcaatgatgacctagttaaccggatagactttgtcctttttagaagtaactaagacgctggccatatcaagcacaggcagagtcagaaag

SEQ ID NO: 1662 - DNA, 201 bp, Bos taurus
tgtgactcagtgcagccccatcctgactatgggactgggagtcagctgggggtgctcagctccatggttgctcattctgggatacaggccgcttctcatggcatgttcctcctatggcgatagcagcatcatagagagttagtcccatggtgtagagtatttcaggacttttgctcatgtaactcctgctaacatcccatt

SEQ ID NO: 1663 - DNA, 201 bp, Bos taurus
agtatggtgtactgatttcccagcactgctgtaatgaagtacctcatactgggtggcctaaaacaacgtgcttttctcatagttttggaggccagaagtattgaaatcagggttggttgctcaggaggatgggttccatgcctgtctcctagcttctggtggatgccagcaatccttggccttccttggtttatagataca

SEQ ID NO: 1664 - DNA, 201 bp, Bos taurus
acaaagttgaaggtacagaggacagaagcagccttctggtccagagaagttcaagatcttgtccaaggagtctgactcagactgggcttgcatcaattaattttactacttaaacagtggaattgccaaatgttaatggttacattgtgagagacttcagacaacatccagtcctattctgtcttttttttttatcagttc

SEQ ID NO: 1665 - DNA, 201 bp, Bos taurus
accttatctagttcttagagagggtatgaagctcaaatgagatagcaaatatgaaaaacctttgaaaagtgtgccccctgaccacagcgatatcattcatgtgagatgatggcctggagaaatcccagatttatacaagtcacagatgctgttgggcataagggccatgctgggaagctcagacataaaatgagaggctgt

SEQ ID NO: 1666 - DNA, 201 bp, Bos taurus
caactgtgaacttgaggaagctcttgaactctctggggcttggtttccatcagtataagggggcgttcatgggattgttgtgaggataaggtgagcaaacgtatttaaaatgaagggcctgatgatatgaaagatgttataattaaggtcatcaatttagagaagttcagaaaaatctctccaaggttccatctccctgct

SEQ ID NO: 1667 - DNA, 201 bp, Bos taurus
gatcagttaatttcccccatagccagctccctcctccttccctgctgggagcttctagcatgctgtgctgtgtagccagggccaggttacttatgataaagctgattaaccaaattaaccaagtgctttgctgtgcacatttacctcccactgtttactctttggccattttagtgcttgtaaacatacatatatcaaagg

SEQ ID NO: 1668 - DNA, 201 bp, Bos taurus
cacaacagatgctcctaattcaaaaagcagaagaaagaaatacaaagtaaccacatatctggggttctgaaatcctgctggccaggctggggagactccacgcagggtgagggtagttccttgattagcccaccaactcaatggacatgagtttgggtgaactctgggagctggtgatggacagggaggcctggcgtgctg

SEQ ID NO: 1669 - DNA, 201 bp, Bos taurus
aaaaattgggcatgatctctgagatatctgggtagagaggtaaggaggtaaagaaacatgttaagtgggaacatgaatgtaaatgaagcctgtttcttccggagccctgaataatttagatgggagaaaggcagatttcaagattgaggagagagttggggtttctacagtttgaagggtacatgaagcccaaggaggaca

SEQ ID NO: 1670 - DNA, 201 bp, Bos taurus
aaggccctggtatagaggctttctgataaacccattgaatcctcacagccatctcttagggttggtattgtactttagagacaggaaaatcgagacccagtgaggcccagtgtcctgtccacaggcacagggctctcgtaggccccacgcaggccttgggcagagtccatgttgattttgaggtagagcagttccctgtgt

SEQ ID NO: 1671 - DNA, 201 bp, Bos taurus
ctcacattcttttcctaattgattttttctcatgtttgtgcttgatttatctcagtaacgtggaacactgttctgagttcagggccagcttataagctttgtagtcagtgttaccctttctgtcttgaaaaagtgaaagtgaaagtcgttcaattgtgtctgactctgcgatcgcatgaactatacagtctatggaattct

SEQ ID NO: 1672 - DNA, 201 bp, Bos taurus
caggtgaaagaagtaaggaaactctctgggcctcttttaataagggcactagtcctatttaccagggctccaccctcatgatataagcacacttttaaataccatcatattgggccattatgattaacatgaactttggacacaaacattccgtctatggcaatcatgactaaagagcctcttgatgaaagtgaaagagga

SEQ ID NO: 1673 - DNA, 201 bp, Bos taurus
caaactaattttttaagttctggctaattttcaaattagtgggccaaagataacatgtaaaactaaatattttaaggcaatgaatctaggcatcaattttcagataaaattcttctggcctaatttggcaaaaaaaaaagaattgtatgcttttagcttattacattcctaaccaatacgaagagaagtgaaaagcaaagg

SEQ ID NO: 1674 - DNA, 201 bp, Bos taurus
ccagggctccttggacttggggtacttacataaccaccatttagtaagggccttctttacatcagacttccctgatacaaacagagacctgcaatgcgagagacctgtgtttgatccctgggccaggaagatcccttggagaagggaatggcaacccactctagtattcttgcctggagaattccatggacagaggagcct

SEQ ID NO: 1675 - DNA, 201 bp, Bos taurus
tttatttctctgatgatatccacacacttgatcttcttcacattttcttctgcacgcagtgagggcctgatcaatgaggaatgactatctgttgattacctcacagctttcacccactgtattgcagttcatgcatcctgctgtcctgcttcctttttaaatagcaccattatcctgatggctcctgcacagtgggtggcc

SEQ ID NO: 1676 - DNA, 201 bp, Bos taurus
acaactgaaagcatttttaacaattctgaataaaacatgccctcacagctgcggcctcaagccccaactcctcacttctgtacctctacgtttgtgccaaacacattttgccatccaaagagtggcccagagccactcttattacagcagcattacctgggaacttgttagaaatgcagactatccaatggcaccctagac

SEQ ID NO: 1677 - DNA, 201 bp, Bos taurus
ttgagaggcggaagcggtcccagctgactggccaccgaatgctcttttcagaatctccaacccggcgtggcagctgtcccttcctgcctggacattagtgtaggcccctcatgtccacaccccagtgctttttgcacagtagtgacgagcttgcccctggagccaggaagaagctctgagctctgtaacctgaagctccaa

SEQ ID NO: 1678 - DNA, 201 bp, Bos taurus
accaaagtaacgtggaagaaaaataagcagtggattggtataatggctaattaattattagagttttgaagtccagaatacatggaaacaacccagaggagtggttgcaaagctacagaaactcattttaccacttttcaattctgcctgcctctctttagaagtagtgacctgataataaacctcaaactaatttgttaa

SEQ ID NO: 1679 - DNA, 201 bp, Bos taurus
ataaaacacatgtgtaagtgtgggccaaattcagacccacattccaccttagtataagtcaaggggaaactcaagttccgagaagataagaaacatgcataggccgagactagcaggttcggtggctagggttcaaattgtgctcggttggaccccaaagctgagcacgtgggagcctgggaaaggacaaggcaatcattc

SEQ ID NO: 1680 - DNA, 201 bp, Bos taurus
agtgtttaagaaagagcaagaaggccagtgttgctggagggtgaggagatggtgtaagatgaagctggagaggtttctagggccagatgaggaagtgcctcacaggcacaattaagaattttgaactggattctagatgtgatgtaaagccaatggaagggttttgagcagggaactaaaacgatcagatctatattctga

SEQ ID NO: 1681 - DNA, 201 bp, Bos taurus
tctccccagaaatcccggagggaccacagccctactgacaccttgatttcagactttgggccccgagaattgtgagaataaatttctgatgctttaagttgcaattctgtggttgttacagaagctctaggagactaatgcaccaggttcataatttcttttttaatgtaatttttagttgagatttaattcacatgccat

SEQ ID NO: 1682 - DNA, 201 bp, Bos taurus
tttaatgtgtatgtataaattttgtaaggagaaaaatgtgaaaaagacaaactaaacaggttccccatggcatgagtctatagccctatttcttcccaaaatgtggctttaacatagttacatcagaatcactttaactggtagctgaaaaagtttaatcctgtcccatcccttccaaaactactaacctagaatctcaaa

SEQ ID NO: 1683 - DNA, 201 bp, Bos taurus
gttgatattctaggataacttttctttttctgcccaaatttgctttccttggacttaataattgtctttttatatttgtctatttatatttatatttatatttgtctatttatatttattttctatgtacaacatatagcactaactcaaggccacattcctctagttgtctgtctctttttattatattcatctgtatta

SEQ ID NO: 1684 - DNA, 201 bp, Bos taurus
tttgaccttggcttcttggtcaaatgatttttccattctaattgctcttgtgaatttgctacattgtcctacttttcacctgctttcatcttccaaggccccttttctgtgatcttttccgccccccctgccttctccaccagaatctcagccctgtagagacagatgccttccaaatcgaatatttccacccttttgctt

SEQ ID NO: 1685 - DNA, 201 bp, Bos taurus
gcctcctgccccattttccttttgtgaatgaatcagagaaggagttcagaactgtggctgcagaagactgaggcaaatttgccttcactgcagcccagggtgggccatcctggcttccatccaggctttcatcttggcttctgagttggcttgactcttctttttttaataacagaaaaataaaaataaaacatttttatt

SEQ ID NO: 1686 - DNA, 201 bp, Bos taurus
ctccttttgctcaccaccattgctatcactcagacaccaactcactcatccattttgccgagttcaaatttcttgagagagcaagagaaagctctgattgtttctccttgagtcaggtgtgtccatttgggcccaattagtcgaggctgatgtggtaaggacatttgaacaaacgtggccacctaggcccatgtcttaggg

SEQ ID NO: 1687 - DNA, 201 bp, Bos taurus
aggttcctagaagttatggccagtgctctaactggtagtcttcaccatatatcttctgaaaacctgttaaatgcagtgtgttcattttgctggatgaactattttcccctggccctcattaatcagcttcttcaaaaggacatcattgatgatctgctgacgtcaggtaggatgtcagtgcgcagtgtgactgaaataagg

SEQ ID NO: 1688 - DNA, 201 bp, Bos taurus
gaaagagatttggaataccctgggtatttagtactgtgaatgagaataggaaaaaatgtgataagtaaacatcatggagtattacttgacaactagaatcaaaggattaaatatacacatgcttggtgaaaaaagttggaagcacaaagagatatacactacaatatcatttacaaaaattaaaaaaaattatatacactc

SEQ ID NO: 1689 - DNA, 201 bp, Bos taurus
aggttgagcagttatgtcttctttcttcaaacctaccaatgcttctctgtaataataggtataactgggtggcattgtggctctttgtgacagagatgaccagggccggtgactctcctggtgtttcccttccctacaggcccagggcatctgcactggtgaatatccagcttatatatccacctgttaatgtcaactctc

SEQ ID NO: 1690 - DNA, 201 bp, Bos taurus
aatgcaaagtctatgttccttagtttttagttgtcagattttagcttggtaattacaaaaattattctaaagagaggacatgcaaggtcgtggggaggcacctatgtccgatcctgatgagattcagaatttgttctatgggagctgtaaatcaaccaaaacttgctatctcataacaagcactgtttgattcttggcagg

SEQ ID NO: 1691 - DNA, 201 bp, Bos taurus
gattgaagatactccccgtctatgcccatgcaccactctatgcatgccctgcagaaagtgaaggctccatacatacctaaatctgctgagttttagcattggtgtaccctcgacacaaagatggctgccaactaaaaaaacctctaagaagggctgaaccactgggccacactgtgttgggggaagcagttgagaaggaaa

SEQ ID NO: 1692 - DNA, 201 bp, Bos taurus
gagaacacaccccaactgcattgtaggaaaggagttagtcaactggttaatccgaaatggacacattgctacaaggtaatgggtcttaagaaaaatttatgaatttatttttaatgacatgtcataaaggaaacagcttgctttgtgagtaggatgctgtttgatttctgcatttggtgtttggggtgttagttactcaac

SEQ ID NO: 1693 - DNA, 201 bp, Bos taurus
gggacagccagagcttggggagaatgctagccgattatcgggccagaggaggaagaatccagcaaaaaaactcagacccttttgcttactcaaaggaggcatcaagcacctcaagtggaaaatcaggaagcagaactgaaggtgatgaagaaaaagggttgattaccagtgatgcagtgtggtcgacaaaggtgagcaaga

SEQ ID NO: 1694 - DNA, 201 bp, Bos taurus
cagagtctaactgaatatagcatgaactgaacagtccatctttactggaagcaaagactcatagaaagtcagtgtaattaatagatttgatgttgcaagcccataggtgattattatttatgaaagacaaatatgtcatgctcaaatcatcaagctaacatagcaccattctttggtaagttttcagtacctgcaaatgct

SEQ ID NO: 1695 - DNA, 201 bp, Bos taurus
ggaaggaggccctacggcatagacagtttgatgacacaaactttggtctggctgaacaccacaggaaaaaactacaccctcccatcaccctactgcaggtggctgcagacactgggccactatgagcacagctctgtctcctggttggagggagtctcagaaactgggtggctccattcttcctgtacatgatggactggc

SEQ ID NO: 1696 - DNA, 201 bp, Bos taurus
atcacagagttgggccacctagttctcctatctaggatattcaacagggtacagagctgactaacaacatccattagccatgcctttagagccattaaaacggtcacatcaaggccacactttcccccaggctgttgtcagcaacaactgagcatggccagggtatcggaacaggggcatttctccccgatgcacaggcca

SEQ ID NO: 1697 - DNA, 201 bp, Bos taurus
ttgtgatgaaaacccaaaaggtacacatcagacttctttgtataccaacaatgtcatatgttgcttgaaccaggttggaattgtcagggccactgagaaagtttcagctccattgtttataaatcaaacaaacaatatagatagattaatataacaaaataactaaaccaaaaataggtgctaaaaacagggcctgacact

SEQ ID NO: 1698 - DNA, 201 bp, Bos taurus
attgaaaattttgtcttcttcctcaaattacttttccatgttattaatctgcatcaaattactttttaaagcctctttaataggcttaattggtaaacaatagactgaatgtgtttaaagtgtacagatcagatcagtcactcagtcgtgtccgactctttgcgaccccatgaatcacagaacaccaggcctccctgtccc

SEQ ID NO: 1699 - DNA, 201 bp, Bos taurus
tccataattaaggggattggatggtcctatgagtgaatcagagttggtcaaacatgggatatacagagagccagacaacaggcatctcgaatggcctacccgtacttgtggcaacaagaaatgttgttcacatccggtccatcctagaggaaatcagtcctgaatattcactggaaggactgatgttgaagctgaaactcc

SEQ ID NO: 1700 - DNA, 201 bp, Bos taurus
gaattgtgacattatcaaaatgtaactaatttctgttgtttctttcccataagtctgtaagctccataggaaaggagactctattttctcccctagtttatctctggtggctaacataataacttatatatggtaggtgctatatacacattcattgaatgtattaattgatgcttaagaaatatttattaattaattttg

SEQ ID NO: 1701 - DNA, 201 bp, Bos taurus
gcccgactgccaaaaaaaaaaaaaaaagaaatcactctaccagacctctgaagacattcatgtttgaaatccttgaggcatatgacaggatgatgtaaaataagtaaggattttatccactaaatttgttctggcaaatgtgctctacattggatggtttccatttttctagctacaaaaattgatcaacattttataagg

SEQ ID NO: 1702 - DNA, 201 bp, Bos taurus
acaatacccaaacacaaaaaagtccagcaaatccagtataccagttttttccctcctgaccaagaagttatttgttctggcatcttgtcaatataacacaaagagtccatacaatagcaccaaattgtataaatagactatgagtttgatctgtaatttgaatgcaaatatctccctacctgtattatagcagatgtaatt

SEQ ID NO: 1703 - DNA, 201 bp, Bos taurus
tttacctgcatcagccttgactgaatacttttattgtgggttgggtggggagatgccctacacatttataagtaacgctaagtagaatcttgcaaaacttcaagagtgtagtctgaattgtgggatttacgtatgaggtactggacagattgttcactgctatccattttcaaatagacaaatttcaaaagtactaaaatg

SEQ ID NO: 1704 - DNA, 201 bp, Bos taurus
tcaccttctattcagctcatcaatcatacagagaaacagtgcctcaaataatgggactttaacagatttagagttggtgttctaaagaaaataggcaaggaagaataaaatatttgataaagtggcttaataaatactttaaagtctatactaaagttgtttttcaaataatggttattcagtcttaagtgttacatacat

SEQ ID NO: 1705 - DNA, 201 bp, Bos taurus
caaagtattcagcatacttaaagaaactgttctgcctttcttatttggtcccttttgtttaattttctggggaatgtctgcactttgagtgcattagctacaggccagtgcttgcctagtgcattgggaacaaaggtaggatgcatgaaaagctagaagaagaaatgggatggggggcaactgaatattctgaaagcttca

SEQ ID NO: 1706 - DNA, 201 bp, Bos taurus
tttgcaaccattcatgagcatgaaaaccttcaccccataaagaagagaaaggaaactgaattaagggttagtaatagagaactatagaggccaaagtagtgttgtatctgttacccatgggactccttgcctgcaattaaatgcttatagtagaagaattagggccaaaaaaaatgatggaacttcatgagaaatgaaatt

SEQ ID NO: 1707 - DNA, 201 bp, Bos taurus
agaagattcagatcgtatatccagggtggccttgcaggaaaaacgttacatctccctgaagaggggctaagatttcctgtggcaggttttaccatggtcccggggcctgaaatgtcaatcagcagcatgttgtctttcacccctccccattaaaactggtgtaccagaacactaacagtctcctaactaagggaattgtag

SEQ ID NO: 1708 - DNA, 201 bp, Bos taurus
ggatggcccttcagagttgtcccaagtcaaagataggggatggtggctgtgacccctgcataaaccagtcattctgtgttgagtggccttaggaagggggcaaaatcttgagcaaggaagtttatttttagctgagagctatgcctgtacctgttcccaggtgtagatcctaaaatgccagtactcagcagctagggtagt

SEQ ID NO: 1709 - DNA, 201 bp, Bos taurus
cttggagacaaaataatacctgtgagtgtctcggcccatcagggatgcagagagttccttttaaagttcacttttggaggttgtttattccacagcaattcaagcctgggccaaacagattatttttctggcttaaaatacattgtggaccacaagggaaagaacatgaatagtttgcaaacttccagcctttaaacaaaa

SEQ ID NO: 1710 - DNA, 201 bp, Bos taurus
tcttacaagcagccagacgaccagaaaccaacagaaccaaaggtctgttggaattttctcttcttagattggagtttcttccctcaagaactttcagtcatggtgtaggtatggagacatttctctgctctgtgagaaagaacaatgtgggcatgacgataaatttgttcacttatctgacaaatgtttatcaggtgcctg

SEQ ID NO: 1711 - DNA, 201 bp, Bos taurus
caaagagaaaattgttttttcctttatttttattgtatgtacatgagatgataggtggtaactaaatctactatggtgatcatttcgtaatgtgtgtgtgtgcgttcagttgcttcagttcagttcagtcgtgcagtcgtgtccgactctttgcgaccccatgaactgtagcacgccaggcctccctgtctatcaccaact

SEQ ID NO: 1712 - DNA, 201 bp, Bos taurus
agttaccataatttatctgaaatgcgatttgatttctcataaatcttatttacaagctttttaggagatggctgctttgtgaaacatgagacatctgactagactttactcttctccaagaaactgactccaaagtttaaaaacaaaagtaagaacaaccttggtcaaatctgaggggttaaaagctcatcctgctcaatt

SEQ ID NO: 1713 - DNA, 201 bp, Bos taurus
ctcagacatatagagaacaaactagtggttactagtgcaggaagagaagggaggagaggcaaaatagggatatgggagtaagagacacagctgctacctataaaataatcaacaaggacatattgtatagcacaaggaaatatacccattattttgtaataacttgaaatgaattacaatctataaaaatattgaatcact

SEQ ID NO: 1714 - DNA, 201 bp, Bos taurus
tcaaatattaggtgtgaccagatccttatcctggacaatgttgtgatatggagatttaattttaccctgcagtttgatggaactttcatggccagagtcaatttcaagtaaaattatctgtcccagcttaatctaagtgaaaggaaacattttagagatttttgtaatgagcactaccttccagacagggagttggcccac

SEQ ID NO: 1715 - DNA, 201 bp, Bos taurus
acactaaaacttgtatgcaaatatttatagcagaattattcatagtcatcaaaaagtagaaatgatccaagtgcccaacagttgatgaatggttaaatactatatagtatattgatacagtagaatcttcagttcagttcaatcagttcaatcactcagtcgtgtccgactctttgcgaccccatgaatcgcagcatgcca

SEQ ID NO: 1716 - DNA, 201 bp, Bos taurus
aaacctgggatgaaggtgaggaaatagtgagactgaataaaacctttggcttttttatcacagaagcctggtgtcaagcccacatccggccatggatcatctctccaagcctagacttgttctaagcttcctgtgttagaaatgcctactcacatatttgctggtgaagccgaccttggcagctggatcacagtcatgatt

SEQ ID NO: 1717 - DNA, 201 bp, Bos taurus
caagcttccacacgtttccttaatccccacatcgggcactgtatcttcggctcgaaaatttccctttagtttacaaatagtccatccaatgcttgtccatgactttttagaaagaactctcctctccccactcgcgctcgcggttaatttcacccacagctacacttcctttcctttgcaacgcaacgctctcctaagccc

SEQ ID NO: 1718 - DNA, 201 bp, Bos taurus
aaaactgtagctttgattagaaggactttttctggaacctgaagagctttaaaaactcctgctgcccaccctgggtcccaggccctgcccatggaatcaacgcaggcacgaggcatcactagtgattaaagatccctcgatgatttcatgtgtggccaagtttgagcaccatctcctggtgtctttctccccctctttagc

SEQ ID NO: 1719 - DNA, 201 bp, Bos taurus
cgtctcctttaccttcaaggacccctcagcacaaagtttgcaattattttcccattaagaagtcagaccagggagagagggtaacaccagggagagagggcgtagggtctgagaattaatcagcctgggaaaagctgggtgactccttggacccacgggtagctgagcccacggcccagggagagccctgaatttgtttta

SEQ ID NO: 1720 - DNA, 201 bp, Bos taurus
ttcaaatagggaaatactttaaaaaagtaaacacataagcataactttcgacttctgcataaacgcctccttttcccctcctgcgtgatgaccacctcagcggccgttgaaaacgaaatacatcattctggaaacctgaaaacatctatgtatcttcaacctggaacaaatgtgtcaagatggacttgctaatgtggaaaa

SEQ ID NO: 1721 - DNA, 201 bp, Bos taurus
tttctccttctggccactcctccttaacttctcagtttcagtgtggttagcatactctccctgctgccctgactcactccaggagtcctccctgctcctccgcccctgtgccccggccgtctctgccatggtgaacctcccatcctctccctggtgaatgactctcctcctgcaggccccttgtctggggatacaggaggc

SEQ ID NO: 1722 - DNA, 201 bp, Bos taurus
atgagttcctggagaagggtcatgtgtccatttctgttctgctgcccctagtacctagcaccaagctgggcacactgtatacctattatagatatcacctaagtcatctatttcctattcattataagcttctctgtcacttctctgtcttttcttgcatttgtcattcacatcttatattttagcaaagtttcatacatt

SEQ ID NO: 1723 - DNA, 201 bp, Bos taurus
gggaccaaaggggaggagccactgcttcaggaaacccagcagaactccctgaaccatgaaagcagatgcctcagcagaaggagggggccattccatgaccgcctcagtgagacggtaaataccagactttgcccgtcacctgccgtggggctgcccttccctgtgggggccttgccctctctctcctgctcattccatgtc

SEQ ID NO: 1724 - DNA, 201 bp, Bos taurus
gaatcaagaaggggaggtgggacgagaaccatgggccaaaggacgaagacacctcaatttagttggattattggcttgaaatgagaatttttgaataaaacgtggctgtgtgggcctcatgcactgacagagtctgaagcgctgaaattatgcagccagaatcaaagctgttgaatcttgtagaaataaactgaaaagaaa

SEQ ID NO: 1725 - DNA, 201 bp, Bos taurus
gttgaagatcagggtgccagctttccaggttctggtggaagtcctttaccaggttgcagactgctgacttctccttatggcctcagatggtaggaggaatgagggagttctctctggaacctcttttataaaagcattagtctcattcataagggctctgccctcatgatttaattaccccaaaggcccacctaataccat

SEQ ID NO: 1726 - DNA, 201 bp, Bos taurus
tcagcctataatacatccaacaattaaagttgcagatggaattaatcagctgaccttgaacaagctgaggagattatcctggattatctaggtaggcccattgtaatcacagtgtccttctaagtgaaagagggggtcatgagaatcaacttcagagtgatgtaatgtgagaaagaccttattggccattactgactctaa

SEQ ID NO: 1727 - DNA, 201 bp, Bos taurus
tgcttttcctgaaccagctacctccctcttccccagctctccactgcaactctgtttccaatcaccaagttagaaatccagctctcccatcagattgctgggagaacgggcctgggtggaacagcatgcttccagtgcaaataggaaagaaaaaaaggcaagagggtagcaagagtttcaatggatttcagggaatgacat

SEQ ID NO: 1728 - DNA, 201 bp, Bos taurus
atggcattgtaactaaacaagaggaagaaggctcattacccagtgatgattgaaataactaatgcaactttcggcgtctcgtcagtttcagaggagatcgcgaatgtgatttggtttatacaagatgattgtattgcattcagagagggaatgttgttcctgtagagattgtttatagatttaagtatgggtgaaagatgg

SEQ ID NO: 1729 - DNA, 201 bp, Bos taurus
tggggatccgatgtctgcccttgaaaaacaggtctgctttaactcagggccctgactctcctggagggacacagaacattctcctgaatgcactcagaacatgagctccatgttcaagggctgcagagggttgcagtggcccagagaggaggctagcccattgtggggaggggaagcttccaggctgtggagggtgtgagg

SEQ ID NO: 1730 - DNA, 201 bp, Bos taurus
aaaacaaagaggagagaggcctggactttccaggggttgcagtgtgaaagtctgggggagagggaggaccctggcgataggccattgcctgggccgggtgcgaggtatagcacaggaacaagtctcagcacccccacaggacttcctctctgcctttcagtacagcagagggaagacaggcagacctaaagctcagggcac

SEQ ID NO: 1731 - DNA, 201 bp, Bos taurus
gactgctgttccacagccatgtttggaggaggccactatagctgcttctaacaactggaagccacaactatagccaaggctggaggtgtagccaggaccgcggggccaggcccccaggagcctcagggatactgagctgggtttggtggggagactggggagtcaagagcctccaccggcgcaggggcgaaagggaagcgc

SEQ ID NO: 1732 - DNA, 201 bp, Bos taurus
gaaacactctccgagggtgagctattattttgtcatcatcctcatcttctctgatgagggagggggtggccccgtggcctcaagtcagagggagatgggcagagagagggggctggattctccctacgctgagataacactccctccccaggggcccggcagccaaaccactaccctgacaattagcagaggcctttatca

SEQ ID NO: 1733 - DNA, 201 bp, Bos taurus
gactctgaactggggctttgggggaagtgaagtgtgaagtctgggatgagggatcaggaagaagggccaggagggttcaaggccagaggtctggaaacaggggttggttcccaggttgcctcctccgccacccaagacttctcagctccagatcaaagtcctggcttcagttctactggcctggctgagaccctcctaggc

SEQ ID NO: 1734 - DNA, 201 bp, Bos taurus
aagcccaaaaggccccctgggactcctaccgctagatgctcagctgagtcccatgttctttttcagcaaagtatcccatgattcagaccctaagtgagtgcgggggccttgcccacccaagaccatctctggggaccaagacaggctgcagggagaagctgggaggctctgggaagaccacccagccccagttgctccctg

SEQ ID NO: 1735 - DNA, 201 bp, Bos taurus
tcctccagcagcttcatagccataagcatctgcccggaaaagacagatacatcactgatttctcaacagagtcttgcaaagtgtgatgtcagacacgtccccttggccataacattggggttggtgtcctagcaaagctggctctgtgccaagctacccagacattgggtcaaactcttgattttcacaaggtgtcctgtc

SEQ ID NO: 1736 - DNA, 201 bp, Bos taurus
tttcattgtgtattcttgcttgttcctgcatcaggtgttcataggtgtgatttcctcactggactcccacaggccaagcccagggaacagggctgaatcaggagggcctggggttggggtgaggaggggacggatggaggcgggagggagggccaagaaacagacccacaccaaacaaaaccctagggccttggctgggca

SEQ ID NO: 1737 - DNA, 201 bp, Bos taurus
actgaggttatttaagccctaagtatttctttgaccattttctcctgttctttagtggttcctgatttcaccaagtttgaaaatacatttatttaaaattctccttgtaaaagaaactaggctaagtacaaaagccataacttaaaaaaaaaaaaaaaacagccttataaatagttaatttaccttaatgagttttcagat

SEQ ID NO: 1738 - DNA, 201 bp, Bos taurus
ttcttctctttcccaagcaggtgaggcaggagggaggcagcgggcagagccttaggttgggtggggaagttcagatcttggccactggcttcttccctcttggattgctaatggctcaactctgtcatcctctctctccttttccagaaacccaaggccatcttgtgtccagccctctctgccctggttgtctacttgaag

SEQ ID NO: 1739 - DNA, 201 bp, Bos taurus
gcttggccatggccacctttacccaggagccccagttatgcctgagtcacctgtctcagcgtggaagtatcctcatgtccaccctgaagcatctgctttcgcccagcttcctgcatcacctgggccaggcgtgagttgaaaatttcaattctattatggatgggatggacggggggcaggcaggagagaaagagctgacag

SEQ ID NO: 1740 - DNA, 201 bp, Bos taurus
tgtctgattggctgctcttgggaatccaaatatgtagtacagtccatctaagagtctttcactagtgctccacccccatctgctgtgtggatgaagatggcagtgccatgccttggaaaggtatctatgcagccagtgtccaatgccatccttacgagaatgataagggacctacacagtctatttgccaggacaggccag

SEQ ID NO: 1741 - DNA, 201 bp, Bos taurus
ttctccaagggacctttgtttcttttaatggagaatgatatgtagaaaacaagacctgggtgccaggcgtgctcattgttattgaggtatcactgcttccgggtctcttatggagagtggtaggaaatttgtgtctgattaaacacacacatatgatctatctatatatctatcaatcatttatcaatgtgtggagaaaac

SEQ ID NO: 1742 - DNA, 201 bp, Bos taurus
ccttcgggtgggaggactgaatcagggtaggggggcagccggatccaggcattcagatgtccaggctgagtctcttctctggctgttttaagaacctacattgtcatcagcccctttgtaggggcctcttggagacatggaatgcaatgaccttgagttccaggacctcctgccttgatgtttactagggagaccctggaa

SEQ ID NO: 1743 - DNA, 201 bp, Bos taurus
aaatcctctatcccatggccagagagccctgacagcagagagacaaacaggtgttctctgtcctcacatctcatgtctctgggatgtcccttcatgctgcgcaggaagcatggcctctcttagagtcacccacacatggctgggtgggcactgtgctgtctgtacaaaaaagccagccggaatctaggtagtccatggggg

SEQ ID NO: 1744 - DNA, 201 bp, Bos taurus
cccaagttttggtttaatggtctctctttccccatgaatacctaaaacctgttctgcttcaaaactgagcaatgcagctctcctcctccagaattacaaccgctttagtagagggactgagggctccgttcacgtttggttctcactgttaagacctcaagcatcatgcagctactgctcagtcaatagacagaggcagga

SEQ ID NO: 1745 - DNA, 201 bp, Bos taurus
tgaataactgattagatgctgaggacagagaaagactcaagaggatgcagagaggcttgagagacaaattgagatcaggggatggggaggctagagaggcagacagacccaggccaatgctgaaggggaggtggtccgagagggataggcagagggctggcaggaagtgagttgggggaggggtccaggggtctgcctgca

SEQ ID NO: 1746 - DNA, 201 bp, Bos taurus
tctttctccccagttctctcagaccccacccacacccagcagaaagccctgttcttttcatgttgttttcctgccttagtgaccttcaaggcccaattagggaggatggattcaccctttagatgacgaccccgaattattagtaacataaagcttggctttcccaggcagggcctggttaattgcctagaagcatgaagc

SEQ ID NO: 1747 - DNA, 201 bp, Bos taurus
cactcagaactgaggatgcagatcagttcagaatgaatacttaaaacaatctggagtttaaggcaagagagggtttttctgccactctgtgaatctcatgctcataaggggactctcagcctgcctgagtgctggaggacctggctatgtgcatgtttcaagctcctggaagaaagttccaggaagaatctgcctgtagca

SEQ ID NO: 1748 - DNA, 201 bp, Bos taurus
taggggactccttgctgatttcagtgaggagggcccatcctaactgttgaatgacctacattcaagcttagaggtggccctaggaggagctggagaaagattgcaggtggggaggagagcttctcagtgggaattccaagaggagcagtccaggtggcctacgggtcatggatctcagggtcctaagggaaaaattgcctg

SEQ ID NO: 1749 - DNA, 201 bp, Bos taurus
ttgagagccaatgtatttatcttattcagagactccagctctttaatttgcccttgacaatcttttaggcctgaagcatgaagctttgtagacttacaaggatgacacctcttcggtaaacaggctcatggtgtctctggggtctgtaggatttctggccagatggtcagcgcctctctctgactgtctacagctcagctt

SEQ ID NO: 1750 - DNA, 201 bp, Bos taurus
ctttgtcaagcttatttcctgatacaacaatgaatttggctacagcaacagagtgatggacctcatggtctacatggcctccaaggagtaagagtccctggaccaccagccctagcaagagcatgaaaggaagagagaggtcctcaactcttggggagtccttgccccaccttgatcctccagcacactgagaaatctccc

SEQ ID NO: 1751 - DNA, 201 bp, Bos taurus
aaaatctaggattaatatgtttagaaagtaccatttaggaaaaatatatagagttttcaaacagtgcaattgaaagtttgatgtaatgggctatgggcaaggcatatggaacttgccattctgtatttaagaatctgcattcttcaaacctcggggaatcacatcattctgactcttccatatcaccttatggtgcctcag

SEQ ID NO: 1752 - DNA, 201 bp, Bos taurus
aggatggtgctttgactagtaataaattttatgacattcagagggagactaatgacttgctaagaattgtgggtgagtagtgatatagacagaaaagaatcgccagggtcctatggatttcagtatgatgaatacatccaaaacaactggcatatcaagggagatgattgcattaaggcaactcattttgaacacctctta

SEQ ID NO: 1753 - DNA, 201 bp, Bos taurus
ctatggccaactaatatggagggttagacaaaaccgttttcccatttctatcctgagaagatgggcaaaaaataaagaagtcaactcctcctctcctctccggccatgatgatagtattcacttctaacataggttattctcatccaaattcagtttcctcattgaattcaatataatgtgtgatcccacatggcagaata

SEQ ID NO: 1754 - DNA, 201 bp, Bos taurus
atggttgagaaagctgttgaagattggaatgtggaaaaggagtgaaagaaggaattctgaatgggagatgctagaataacacatgtaaaaggaattcttagagtggaaccaaagataaattacaggaagctgttctgaatctaccaaatacatgaaatgagagatgatttaactttaggatgtttcatatttcagcagtgg

SEQ ID NO: 1755 - DNA, 201 bp, Bos taurus
tttaacttgggcttagagaagatgttgcccccccttcactgatcttttctggtatatctttcagaccatgttttccacttggccttacagaattggagagaacaaatcatctaggtcattggctttcaagtttgacaacatgttgaaatcagatgcctggaccttacctccaaaaattccaatttaattggtctgggttag

SEQ ID NO: 1756 - DNA, 201 bp, Bos taurus
atcttacttgggaaatggagtttgcagttaagagaccttgacacaataagattatattgatttattcagttggacctccaatgtaatcacagttcagttcagttgctcagtcatgtctgacttttggtgaccccatggactaaagcatgccaggcttccctgtccatcaccaactcccggagtttactcaaactcttgtcc

SEQ ID NO: 1757 - DNA, 201 bp, Bos taurus
cttctctatcaaactgatttactcatttatttgctctatttaataaatattcttgagtggttaaggcattaaattacaaatcccttgtgcctttaaaaaaaaaaactgttatcaaaaagatgtttcttaagttattcttttaaaaaggaatctctcaagttcccagcattttatagacacactccatagcttttttattac

SEQ ID NO: 1758 - DNA, 201 bp, Bos taurus
tgatttaacacaattatccttaagtgactggaattttaatttttgtgtagttgtgttttctttagtgaacagtgcattacttgtgtacattttaaagaggaggaaaggggcaaggactacaaatatattctgctcagttgtaccctgggtgcatgccatggggtagtcctgctgtcttcctgacccagctgatggacagag

SEQ ID NO: 1759 - DNA, 201 bp, Bos taurus
ttcccaaggaggtttacagtggattgatgaataggcagtctctgtctcagcttaatcaaacctacggatttgatactcattctcagttgaaaagacaaacagatgtccagacccagggacagaagtgagcatttcaaagcagatcatctattatattttccccagttattgtggacaaaattaccatcaaacagaattatg

SEQ ID NO: 1760 - DNA, 201 bp, Bos taurus
catctgggaaagccaatgcattagagcacagagagcaagtcactgaaaataaatgagaagcaaagtggagagtggaggctagaagaccagctactagtcaaccaggacagttggggaacagagtcaccaagtgatgcagagtccactcagggatagtcactatgaatgatgatacaaccagagagaacggagacggctcta

SEQ ID NO: 1761 - DNA, 201 bp, Bos taurus
aggcacgaagatatagacagtaaaaagaaaagatttctaagattctgttcatcgttgagtctagtaggggaaccaagagggaaatcaattaagtacttggcgttgttaaaaacattgccagcaagataggctcaaggtgatgtggggtgtcatgtagcttagactaagaggataaagaagacccctgtgaggcactgactc

SEQ ID NO: 1762 - DNA, 201 bp, Bos taurus
caaagatcccctgttttttctctcttctgcagaggtgctacaaaaatcactgtctgccccaggaaaaacaccccaagctgaacagagcctccttgtgagaaaatggacctgcagaagtatttaaagggaatgttatcttttaattaaagaagtgaagggctccgggcaagcccagaggccactggctacaaaaaaaaaaaa

SEQ ID NO: 1763 - DNA, 201 bp, Bos taurus
ggccccaccctcaggggctctgggagcttctttggctgaaagtgttttggcagactcagctttctctgtcatcagtttgaattcatgggaaagggcaagacgccaaaagtgcttgcaggtgaattctttgtccctttcaagtgcatctgacttacacagatgacttatgtgggtgtttatcttatgttgggaggattatca

SEQ ID NO: 1764 - DNA, 201 bp, Bos taurus
ccagtggtaagatgatataaatgtgaacttcttaaaaacacactcagaccatgttctcatgtctacccagagacacaaagcttcctgaccaaccaccaattccagcgatgcccagttcatccatctttgactagtagaccctgctgatagaactaacactctttgggaataggaaagagattgatgcgaagaaagaagtgt

SEQ ID NO: 1765 - DNA, 201 bp, Bos taurus
ccccctaatctccctccccatttcctcccctactcaacctccccaggagctagttatgagtgtattcaggcagatttctgcatggaagctctagccaaagaaatgtgataaattcctagaatatataccagtccttcatgtcaaagcagcttctggcatgaggattacactaggatttactgaacttggttcatctatctt

SEQ ID NO: 1766 - DNA, 201 bp, Bos taurus
aagcattatgtttcctctctgtaaagtgtagctcatttaactctattctaaacctgtcgtgagactgaaatgattcaattttccttttgggattataggcagacatttacataagcaatatgtatttattgtagaaatattggaaaatactaaataaagagtgcacagaataaaaatcataccactctgggttactgctct

SEQ ID NO: 1767 - DNA, 201 bp, Bos taurus
aaatgaagacaaaaatagaaagaatggatgggggaatccaggaaaagaagcttctaaggaataagaccctttcacgatggtatttattaatattgcttgccgtctgtggtcttatttggatgaacatggtcagtttggtgagagtactcacacaggcgctaatgagggaggaccagatcttccttaatatttgaccagacc

SEQ ID NO: 1768 - DNA, 201 bp, Bos taurus
acatcagacctcacctgaatgaaacataaagccctgctacctgaagccactgaggttgttagggtacatttgtttctgcagcaggatctggcctgcctgaccaatatactggtagatgtagtattattcactttagttcacttcagtcgctcagtcgtgtccgactctttgcgaccccatggactgcagcatgccaggcct

SEQ ID NO: 1769 - DNA, 201 bp, Bos taurus
ctatggagaactagttataagtgttggaaaagccaaaaggggaagcagggaaagcaagacaacccaatggtctacgaccacaggaacccactgctacccacagctctgaaggacaatgagagaggtatgtgcaggctgttcccccaaagagctgtgtagccaaggccatcaggtgtgaaccagagtcacagaacagatgga

SEQ ID NO: 1770 - DNA, 201 bp, Bos taurus
ggttttggcgccagctatgctgttgacaactgtcttcctgggcagaatgttcacttttgaccaaacaaacaaatgtccaaggcacatatagtcaaaaccattggccagaggacatgtttatagaaagtcccaggggatatactttgctcattcaacagtgaatgaacttttgtgagcatctagaagactggtcctccgtct

SEQ ID NO: 1771 - DNA, 201 bp, Bos taurus
aagcacaggggagcatcagggcatctgataaacctgagaagaggaaaataaaacaaaaagtagacagatttccctgggaaatgcgaagggtccatttgaaatccacaacttgaaagggtcatggctaccccagcagtggattcaaaaaaggagtttcccaaggattcttgaagaggctggggcagggcagcccctgtgaac

SEQ ID NO: 1772 - DNA, 201 bp, Bos taurus
cagtcccagcatccctcgggcgctatgctcaaaaagcacagatttgttggtgcctgctaagtcacttcagttgtgcctgactctttgtgaccctcaaactgagaatgaggctgtgatgggaagccccgccctgccctttgcgtgcatgttaacagtgaggcccctctggcagacccaggctaggtcctgagtgcacctcag

SEQ ID NO: 1773 - DNA, 201 bp, Bos taurus
aaacaaaatgaaaacagagaaaagaatttataaggtaaaactttttgacttgaataacaatctcccaaattgtcctccttcgttcacacagcaaaggtcctccatcttagctgtaccaccaatagcaggtgctggggtgtgtgtgtgtgtgggggggactcctgcctgctgactctcagaagcggccttgactccaggaac

SEQ ID NO: 1774 - DNA, 201 bp, Bos taurus
aagttctaatcaagaatctccaacatttaccagctcaatttcagaactaccatagaccagtaagtcctttgtgtctccaatcttatcttttgaagaacaacgtcctaggcctgtcttaccactgtatgttaggtgcaggtggagcagataacctgtctctttagtctctcgggtcaagagtaattatactcgaggagctgt

SEQ ID NO: 1775 - DNA, 201 bp, Bos taurus
taatccaacccctctggttaatgatgggaaagttaaggctcacagcagttaagtgttgtgttcagagtcttgggaggagacaggagcagaactggggctacaggccaggtctcctgatgatagttggttctaatcctcatggtaggtatgccatggaggtctctgccctagcttagtgaaatcgaaatagccagagagggt

SEQ ID NO: 1776 - DNA, 201 bp, Bos taurus
ttttaaaaatggataagtggtgaaatcaatacctcacaagtgtgcagcgctttctctgagtcaggcactgtccccagaattttatgggcattgtctcctgtgatcgtcacatgagccctttgaggtggagtctaagattacctccatttacagaggcgacatgagactgagactgaaaatctacctgtcttagtctgctca

SEQ ID NO: 1777 - DNA, 201 bp, Bos taurus
atctcattagatttttatgggagatactgctaggtggtggtggatatactgtcattttctctaggcagttcattacatctattcattcagcgaatgaaaaggctcatttcatccacaagagagctgatgaagttcatggaaccaaattcctctacttttttcccaagttgagaatatttatctatctaaacttttttactt

SEQ ID NO: 1778 - DNA, 201 bp, Bos taurus
tcttcacttctctgcccagaaactgctgattaaatcagtctgccccttccccatctgtccgtctgtcttcagtttcaggtgaaagccagaaaagagaataacccaccttttttaatacaactagagaccttgtactttggtgaataaaagagactcactgggctatttataaaggttcccactggactttcatttctttgc

SEQ ID NO: 1779 - DNA, 201 bp, Bos taurus
agagttttgagttgtgaatcaatgaagcaataaataatgaacacactcctgtgtagttagaactcctaggtttcagggcatgtttttcttcatcaagtaaaatcaaaacatgttcatatatgggtaaaattcttagagaaaaacaaagtttatgtagttgttgtttagtcgctaaatcctatctgactcttttgcgacccc

SEQ ID NO: 1780 - DNA, 201 bp, Bos taurus
taacaacaacaaaaacacacaaagaagctaaagatttcactatttctacccccaaagtaatgcaagattactttcaagactttggatgagacccaaaaaattttttaaaaggccaataatatttttttcatataaaagtaaaagctaccataaaatgtcctttttttcccctcccccatcacactgattaaatttttctga

SEQ ID NO: 1781 - DNA, 201 bp, Bos taurus
ctcctccctatccattaaaccactgaagtctctgtaactgattctggactcttttttcagtcttgaggctgagcaaataagggcttgcaggcctgtggagaacatcctaagacgtagatgtgaaataacccactcagtgcctctttaaacctatatcctggacgtttactctgatttactcatgagaaaaggtcttcatgt

SEQ ID NO: 1782 - DNA, 201 bp, Bos taurus
gcctcctcagactcctatctctggtttctcaattccagtagatcgttgacatctgccttagtttcccttcctgtcctgcttcctgaaacctctatccatacagtaacctgaggttatcacaggccttacctcttttatttcccatttcctagggtcaccctatttcattcagatcagatcagtcgctcagccacgtccaac

SEQ ID NO: 1783 - DNA, 201 bp, Bos taurus
tcactggactggcccgctcggacacaagaaagagacggatatctgggcaaatgcagtctaggagctgatccaaggtttgctgcaaaagcaagccctgccccgcgttggccagcaggtggacagtcatggccgggggctccggcatctcatccatcgtgggtgctgaggatgacaaaggatgctggcgaatcgggcccgcag

SEQ ID NO: 1784 - DNA, 201 bp, Bos taurus
gcataagtaatcaaaagtgtttatggttctgttaatttgctgaaaggggaacttaaatggatagcaaggaaggaaatccaaactatcaagcccaatatttgcttgttaatttgctgaaaggggaacttaaatggatggcaaggaaggaaatccaaactatcaagcccaatatgcttaacctttacagtacttatgatgttg

SEQ ID NO: 1785 - DNA, 201 bp, Bos taurus
tcagtgtcaccctaagtgactctaacattcagtgggttcttaagtttcttccaacaactttaaatttagaaaaaaggacaagatggcacgagaatgaaaggtaagtagcaatgaaggactgaaaatggaacttctatttaaacattttactccatcttttccacttcaggctttttgaagattaaaacccaatagctccta

SEQ ID NO: 1786 - DNA, 201 bp, Bos taurus
tccgtctgtgtggcctgcggacctggaggctgatgtcagccagctagaagctggggctgtgtctccagtgctaatggtgtttgccggtactgctgtggctgtgctagaacaagctcccaagatggccgcctccagggtccccagggaatcccaggtgccttctgtctttccaggtggttctgatttaggctcttttcagat

SEQ ID NO: 1787 - DNA, 201 bp, Bos taurus
ggcttctatggaagaagcattctaaaaagtcaagacctaagatgcaagcactttttgaacttctgcttgcatcatccttgctaattcgcattggccaaagtaagtcctatggctaaggcttgaggggatgtggaagggacttactacataagaatgtgaacaccagtgggtaaaaatccatgggggccaccagtgtggcag

SEQ ID NO: 1788 - DNA, 201 bp, Bos taurus
gcataggccattggtccggcattaacctattggggagaagagaattggctaagaacggtaatatctcctccatggagtcctctccatggctagaaagaggcgcctccaccatgcggcccccctaattctctcacatccccttgtatctgtcttatctgctgtctctagaccagtcagtgagcgactagaggacgcatctga

SEQ ID NO: 1789 - DNA, 201 bp, Bos taurus
gaatgtattctttgaaattaaatgcatcagagcaataatatagtctccatgatgttaggatcatccttagcaaaattctaatgggaaatgtaaataccagatatttctgtttcccagtcatctctaagactgtataacacaagaaactggcttatttgacatggctgattagacagtcgtcttaggaaatacttattcatg

SEQ ID NO: 1790 - DNA, 201 bp, Bos taurus
tgcaataagaaaagtcaaattatgtgcagcggtgacagctccagaaggaagagaaaactgtgaaacatttgagataaacttccaccaacgactgcttttaattcttaaaagtttgtgactaaatggggtcaattatatgatcttcaaaagttagctatgtaaaaactgttctgagccgtggctggatcaatgagctattaa

SEQ ID NO: 1791 - DNA, 201 bp, Bos taurus
ccagctcaaatggccttgggtgttgcagagttgatgtctctgtgaagtccctaaattttatagtggggagtcagcactctccttcctcaagctggtccaagctgcaggcccccagtctccattatccttacctcctcttcctactggccatatgagcaagtgtgttctcggctctgacatccactagcagctattgactca

SEQ ID NO: 1792 - DNA, 201 bp, Bos taurus
gagaagatttttgatcagataacaagagcagtggaatgtctttcagcttcaacataaatacttctcagcatataccaaattctaatgtgtgaatcttttatttatttagattattagtgccaaattgacacccgtagtatttggtcagctggttcattatgttccatagtgtatctaggatcttcttaggattattgtggc

SEQ ID NO: 1793 - DNA, 201 bp, Bos taurus
cctctgtagggttcttttggactttgtcaaaagctcacaggtcctagctctccatgttctctctgcatccaagttcctgtcatttcttcctctccaaatacaatcctttaagtctataggtggtagcagcaccagtgaacttacggttgctctatatcctgtgtaccctttgcagtcagtctgtttgcgtataagtccttc

SEQ ID NO: 1794 - DNA, 201 bp, Bos taurus
tcatgtgtttagatttatattattctaaaactttatgtatttaaatgcttcttgtttccctatcctatctcaatataatgttttgcttgttctgtctttggactcaaggacaaattttattataggaataagtaagagctatcctagatgtagccctcttcatttgcaagaagtacagggaccagggaaatttacttacaa

SEQ ID NO: 1795 - DNA, 201 bp, Bos taurus
aaactagttttcacggttctagagactgtaagtgcatgatcaggttccaggctgcatactgctgacctattaagcacactcacatagcaaaagaggccagtgagctctgtggggtcactttactatgatctttaatccccttcacgagggtgccacactcataaactaattactcccaaggcccatcttctaacaccataa

SEQ ID NO: 1796 - DNA, 201 bp, Bos taurus
aggatggactctagcacatttggtgtgatgatttacagaaggtttacagaaaaaactgcaaagtaggttgggaccagatagcaagaatcgtgaagggccttgtgcattaagcagaaattctttcagtcacagagtaccaattaacagtggttaaaaaggaagttctttggaaggaatgatgctaaagctgaaactccagta

SEQ ID NO: 1797 - DNA, 201 bp, Bos taurus
tttctaagatcccgaactgaacttgtttcttccccatgcaagagtaaattattttcctgttctcttcaagtttcagcttgatgcatgcttagtcacacagctgtgtctaagtctttgcaactccacggactgtagccaaccaggctcctctgtccataagattctccaggcaagaatactcgagtgggttgccattttctc

SEQ ID NO: 1798 - DNA, 201 bp, Bos taurus
tacatggtaagggaaaggaataggcaaagaagttacaattggaaagactattacaaaacaaacagaatatggggagctaagtataaaagatgatttgtgtcgatcaaataacacattattgattgtggattatcattgacagtgggatctccaaatggccatactttgtaagcaaaggtattataatatgagtctgcaagg

SEQ ID NO: 1799 - DNA, 201 bp, Bos taurus
gttcctggccctggtaagagttctttacctcttataactttcccatcgtttagaaaacatttccatcgcctgtttttaatatactatcctgactgttcattgtttggccatcttttccatttgtagcagtttgtatctcttaatctcatacctctatcttgcccttctgccattctgtctcacgctggtgaccactagtta

SEQ ID NO: 1800 - DNA, 201 bp, Bos taurus
aactagagactaagtctgaagtcatgttagtttggtctaaagtatacttaagcaaactgtcagtacttctaaagttcaggatttttatagaatgcatataagatagtttctcagtgagaagttgaagagagaaccactgtaatttgattttgtgcaaatggaaaaaaaaagtcaaaaatcattacacacttagtcataaac

SEQ ID NO: 1801 - DNA, 201 bp, Bos taurus
tgagtcaggttccttgtttatcaccacatgaacagttctctggtatatttttagcacaatgtgttatcctagactgatcatatgttcacagattgtggggcgcctgtgaaagactttccactgtacttgctattgggcaaaatcacgtctgctacctggtattcatgcagagtaaactgtaatgtggagacagatggtatg

SEQ ID NO: 1802 - DNA, 201 bp, Bos taurus
agtaactagcttagaggcagtttgttatttgttgtcagagatgagaagagagctgtcacattcttttctcaccaaactcacagagaagttctgtatgaatcggagataaggcttagtatggtgcaatggagccaacatatgtttgctggaacactggttgcctgtgacaaatgactttggaaaattctgaaaactctgtgc

SEQ ID NO: 1803 - DNA, 201 bp, Bos taurus
cagctctcctgtattgcaggcagattctttaccatctgagccaccagggaagcccctcaaccatctactgagtttgaaaatctagaaaaggccaaacctacaaggataaaagtcaaagtatatattaagtcactaagcaaggacaccagctttagtgctgattcatgcttcctttggcagaccctggttgcacggccttta

SEQ ID NO: 1804 - DNA, 201 bp, Bos taurus
tgagcacgcacacactgctgatttctactttttgtccttcctccagccactactgagaaattttccaaagctgtttttggccctttatctaaagcatcaggtgttattattatagtttctcattattttaagcatttcttctatgctaatggctcagatctctgcctccattttgttttcttgggtaattctggcctgaat

SEQ ID NO: 1805 - DNA, 201 bp, Bos taurus
aaggaccatgagggagattcctaagcatgtatttttatttttatctaaagaatgacctttcctaaactctgtattagtttccttgccaaagtggtctaatatacatgcttgtttgaatgacctataaagaagttaatttacttggtatggttaaaacacaaaagcatttaccattttctcctgggaatccaccatccccag

SEQ ID NO: 1806 - DNA, 201 bp, Bos taurus
ccatttaatgaggtgactgactggggcagacctaccaaaatctaccttcagacccaacctgtcactggagtttcttgatgaggtttcatgcagttatcccatttggtaaataatagaggcaaattatttaataaaagtagagggaaaatataggcttgctttcctttttcaagcacaaacgttgggtttaaagagcgagat

SEQ ID NO: 1807 - DNA, 201 bp, Bos taurus
ggctcccgaacttcggccatagtctcttctcacccacaagtgtgatgtactaccaatgacttctacatctgtgaagtaagaaaaaggccatttcctgatccgtctcatagactattatgattattttcctatttacagaaaccatttttttaactctctttcctctaagtatactttattttatggagtatttacttttct

SEQ ID NO: 1808 - DNA, 201 bp, Bos taurus
aggttgatgcagagcccctgtttgagtttcctgagaaactcaattcccattggctgtcatctaattcccattggctatctattcttataataaattttctctttgttaatactttaactggggttccttttttttttttttttcctttgtttcaaacaaaagctggaagttactaacaccaagaaaagtatacaggtaact

SEQ ID NO: 1809 - DNA, 201 bp, Bos taurus
aaaaaaagaatctgaaagtgcttcagggcaatgaattggaatatgaagaatctaggagtacatcttcattttctaattcataatttcagtttatggaaacgttcagctccattagaaagtagaattttctgtctctgaactcttggatttggattttatcatgtctgatttttttgttttcattttcaaagctctggtttg

SEQ ID NO: 1810 - DNA, 201 bp, Bos taurus
aaggagaattctcaaccattggactactagggaagtgcccctgcctacaatgttttaaaggtgtaaaaactgttagctatggtagcccattggccatcatttgccacctcatattaatggtttgcaaatcacagattaaagactagagctactaaaaggctaaagagaggaaagagttttgatagtttgaccttaaaccat

SEQ ID NO: 1811 - DNA, 201 bp, Bos taurus
gaaaatgaacaaaaagtgaaaattatacacatgattttggtacagtttatttaatcagctgtaaacatgtcataaagactactggccatctttgtgtgttggagaggaagtcatagtcttcatcatttttttttaaattgtagctatgggatgctgtaaatggaaaatgtgtggcaacattaacaggccatgatgatgaaa

SEQ ID NO: 1812 - DNA, 201 bp, Bos taurus
ttaaacaataaacatttttttccccacgattctggaggctgtaagtctgatatcaaggcaccaactgatcttgtgtctgttgagggaatacttcctgtttgcagatggccatcttccttctgtatcctcttatggtagacagagagagacatgacctcttccacagctctccttataaagggctatggtttttccagtggt

SEQ ID NO: 1813 - DNA, 201 bp, Bos taurus
tcttatggttgataataacaagacacaggtagagaacttataagctttctagatctttagggccatgattaagagtaaaagtggaaaatattactttatgtgtgtcataagtgactatatattttaaggtagtggaccataatatttacatgtatgtctgggagaagaaaaggagagagagaacaagtttgattgaccaat

SEQ ID NO: 1814 - DNA, 201 bp, Bos taurus
ttcagtgaaatataaacaactacaaattttgttgagttcttgatcatctggcaaatcaagacaaagcacaaagatatgttagttctgaacaagagacaatttatctcatgaacaaaaagcatctgtggtcagaggacaaatctttgacagttacaatcatgcctaaaaggccaccataattacaatgttaatgtttctcaa

SEQ ID NO: 1815 - DNA, 201 bp, Bos taurus
atgctaactcctaccaccagaaggtaaatcccacctaatagttcagccaggaataaattctgaatgacctgaacttgaaggggagttgtgggagcagaaagccctcctaattaaaggccagttcattagcactttcatacatatggattagccatttaaagcgaagttaaatagattggggaaagatttttaatgtcaaga

SEQ ID NO: 1816 - DNA, 201 bp, Bos taurus
aagacccggctctagcggacggtggctcggcccgggtcgagaggggcgcaccagttggcggctcacggtcgtaccagaagtatgagagccaaggtagccaccaggccctggaacggcgcgccccgagagccccgagctggcacggccggagaaccagggtaggcagagaagagacgcttgcaaggtcggccaggggtccgc

SEQ ID NO: 1817 - DNA, 201 bp, Bos taurus
ggtggggcatcaaccctccctgcagttgtaaattcttttataatttccctgtccaccctcctcattgaacattttatacttgtggattcaatcaaccaccggtcatggggtactgcagtaaatatttagtgaaaaaaatttgcctgtgtatgaacttgtatagttcaaaccatgttgatcaagggtccactgtaatataac

SEQ ID NO: 1818 - DNA, 201 bp, Bos taurus
accatggctcacatggggacacacacacacacacatggctctttcaggttccttccccacagacctctccacggtgctgtagtgtcaggtcatggccctcgacttctccgagagtgagtgatccaggacagcaagacagaagccccaatgtctttggtgaaccagccttggtatatttttgcaattcctcttggttaccca

SEQ ID NO: 1819 - DNA, 201 bp, Bos taurus
atgtcttgaagggtttacctgcaaaaggcggtcccagcaacgcagagatgccgttagcacagatgatgattccgtaggcattggccaggtgctcaatccctaccaagtcttccgtcaccacgggcatcagggagaaataaccgctggaaaagcctatcagggcacagatgactgccaggccggcataagtgtgcatcaagg

SEQ ID NO: 1820 - DNA, 201 bp, Bos taurus
agagaagtccaaagaggaagccactgatgtgtccaaagaaggaactattgtaatgttcgctcataataaaagagaggaagagaaaaaggagtaattgtatgcagaagaaaatgtggaggaaatagtgttttgtagcaaagaagaaaaggaaaagggaaggagtaaaaaggaaagaagagaagcaagggcagtaataaattt

SEQ ID NO: 1821 - DNA, 201 bp, Bos taurus
actaggtctcttcagtggctccctactgcacttagaataaaatcccatctcccacaccttggtcaacagggatgagctgtctctggcctccagccccttcttgttttctcatcttacttccttggtggctatttttctgctgtctcttctttgaggtggcccagatacatctttttcttttctttcctgaaaagatacaga

SEQ ID NO: 1822 - DNA, 201 bp, Bos taurus
aagggagtgccttccatagcaaagtcctggccactctcagccttgggggtggttcctggagcaaccttgaccaccagatcagatggagccacggagagggaggggcggggggcctggtgggagaattatccttaaccctcttacacaagcttcccttttccaaatttgctgttaaagaattccatgctgtattggtcctag

SEQ ID NO: 1823 - DNA, 201 bp, Bos taurus
ggtcttcgtggcccagccagttctaggccaggacataggtcttactagactttctctgttctctcccagggatcaacaaacgagaggccaagaactgcaacgccatccgccactttgagaacaccttcgtggtggagacgctcatctgcggggtggtgtgaagccccacccctgccctccaggccccgccccatcttccag

SEQ ID NO: 1824 - DNA, 201 bp, Bos taurus
ttcgggggctctgcagaggaaaaaggcccaggggtgtgctttggaaacagagttccagttttgtatccagctcttcctgcacccctggcacagaaggatctccaagccccctggcccaaaggaggtaatgttgctctttcttccctaatgctgcgatccctggccatctggacccttagccccacagcgccatctgggggt

SEQ ID NO: 1825 - DNA, 201 bp, Bos taurus
cccccgcccatgtagtggcctgagacagagccctttccaagccccagagcccatgcctggtgattgtgaggagagggtgctttctcaccagaccctctgcttctgtcaaattgctcttctggtgacaatttgggaaccagtgttgagatccacgctcactggcatcacatgtgttttaaatgacctcatttccaaacttgg

SEQ ID NO: 1826 - DNA, 201 bp, Bos taurus
caaaggggccaggggctgaggcccccaaacctgtggtctaaacaagcccctctcagccgggacagaccacctaggaccccacgtgcctggagaaggttgatggtggccacgttaacctgaaagccatccatgctgtagcagatccccgctgcagggctgttcctgtggtcaggaggctgcactttgtcctgtttgggaggc

SEQ ID NO: 1827 - DNA, 201 bp, Bos taurus
gctccgggtgctggccgacccgcccacatgggggcagcagttagaccccacccacacaacgggcgtctttggagactattggccttgccttggtgggttcgctgcattcaacaggagataccactctctacagcactggggttgatgggaggttgaaagatgacaggtcttgagccgggttgtttgctctgaaggggtgag

SEQ ID NO: 1828 - DNA, 201 bp, Bos taurus
gattccaggatcaggggccctctgaggcaggcctaaagagaagaaggatgtgtccccaacagaggcaaggacgacaaaagtagaggcaggcatggtgggtgctcagtgaggagggtggcccagcagctcaacctgcccggagtccagagcagaggagacagaactgccaggtggaccccaaatgctttcaacaaatatttt

SEQ ID NO: 1829 - DNA, 201 bp, Bos taurus
ggaaaagaaatggccgagaagcatttaggagaaggaatcaggaaattcctgactctacaagggatgcagtgagaaagctggcctgttacacagacctgcctggaggcagccatattgggcggaagcttcctagtgaggcgaagatgggaccggcgttcagacccaccccaccccaggccaggctgaatctgctttcaaggc

SEQ ID NO: 1830 - DNA, 201 bp, Bos taurus
ggacgttgatgtggccccgtgaacgactcaggatggaggggtactgacagccgtgctgttccctccctggaacctgggctatgttcttccctccacttagcgattgggaaaaccgaggccttgccagcagccaggtggatggggaggtgtctagcccacgctttcaaagtaacactcttgaagcacctaagtggcaagaga

SEQ ID NO: 1831 - DNA, 201 bp, Bos taurus
aatctgataggcagaacagtgcattacagcctacactacaaaactagtataaggctttctgtgacaaatctatgtcactggctgcaattcaaagtattaacacctatcttcaaaaattatgaacacgataaatttattcagtttaaaaagtttaaaaataatacttatgattccatttaataagaggaaatacaataaaca

SEQ ID NO: 1832 - DNA, 201 bp, Bos taurus
tgtcccctgaggcctggtgctcagacccccgaggtagaggccttggtagggtgggacttacttcggggcagtgggcatgtggctggtatgaggcccataggtgcctttgcaggacagggcaggattgtttcttagggaactggagcctgggtgtgagtttgacaccctctcccatatgctctgccccaccccctgtgtgaa

SEQ ID NO: 1833 - DNA, 201 bp, Bos taurus
tgagttagttttcagctcaatgattaaattagttgcttctgtaccacagcatgaaattcggactaaacctgttagtataaccttgctccataaaatgtgtactttatgtaaggccttaagtgataatagtagtttttattgaattgtttgttgagtagaatattttgccatttatgacttgtaatttagagtttttaaaag

SEQ ID NO: 1834 - DNA, 201 bp, Bos taurus
ctttccagaaactgcattttaccttctagtttaactctggcatgtcagttgtttcctctcacccctgcccccagcactcctctctctgagatgaggtgtgtaaggcatgactcttagaaaagaacagtagaccagtgatcgtgtgtagccaccatgcttagatacggggtacacatgtgtacctcctgcctgtgttttggg

SEQ ID NO: 1835 - DNA, 201 bp, Bos taurus
cgtgagttgtttcagtggcatcaccagagccaaaagagtggaagggacatgaaaaagtggggacgctaaatacatacatgcctttcaaagagctttgccacgccagaggctgtgacagggagcttgacagaagcagggtcctgaagatgtttgtgagaatgaggagggtttgagcctgctggcaggcagcgggtaaggagc

SEQ ID NO: 1836 - DNA, 201 bp, Bos taurus
gtcacaaaccatggagctgaatggaaggagggctttactaaattactggactggtttttacactccacccaccaactgtgcaaaggcattttgttacaatacagcttgtgtggttcaaccttctctgttgtcagttagctggtccaaaaaaccaaagggaaagagctgcttgtttatgtttcataaatgggttcaactccc

SEQ ID NO: 1837 - DNA, 201 bp, Bos taurus
ttatggaatcttgcttcatgtttatttagagcgtcttcagcagtttcttggcaaataccagctgttttcttcagactgttacacattttttctttacttgtaaagtgtgcacttgactgcccagtactttgtaggtgctctctgtgagttgcagaggaataggaaagtaatcaagggcttcccaattgggaagcgccacta

SEQ ID NO: 1838 - DNA, 201 bp, Bos taurus
agttcgtcaacagcttcgtttcctgtctgacatctgctgggagatttcccagttggttctctgtcaagccgtgtggccatgggccactcagtccctttttattggacctcagtccctgttctagaaatccagatggctggactagatggtccctggggccccttcctattccggccgtctgaggaggaaaggaggggcctg

SEQ ID NO: 1839 - DNA, 201 bp, Bos taurus
ccgttgttggaggctgactcttacgtgtccttgaagctgaatgtttaagttcctagtacatggaagacatggagggtaaagtgtaaatgagatgtggcctctcctcttggagctcacaactgagtgtgagagagatgtgtaaattgatttaatacataggtagttgctgtgaagcactttgcagaaagtggtttgacggaa

SEQ ID NO: 1840 - DNA, 201 bp, Bos taurus
caggcctgtacccgcccctccgaggccgctcgctctccagctaggccaggctgcggagccccgcccccacactcctaccccagtcccctgagactccatcaccctggcaacagccagagaaaggcccagctaaaatatttatggctcaaaacagtccagaggcttcagctggggagagagggggaaaagctgatgtcattc

SEQ ID NO: 1841 - DNA, 201 bp, Bos taurus
tgttgggccagaaagcaaggacattgtcaaggaataaggggatcatgtccaaaggatgtacaggagccaaaaagaaaagcaagatatcgattgaaacacactgactatataaacatttatatggccctattgatgctcagagaaagaaggcttcaaatcaaccaagtatcattaaataccattggaggtaaccagggcata

SEQ ID NO: 1842 - DNA, 201 bp, Bos taurus
ctagggcgtaggggtggccccgggagttcccatcaccccaactcctgcagttgcccattcagctcctgctcaccccacggaactcagccaccatggagtctcaggccctagtccatcttcagcagggaataaggacctcatccctggaggcgtccaagcgcttgataaagccagggaagagagcgttctgccttgcacgct

SEQ ID NO: 1843 - DNA, 201 bp, Bos taurus
acatgtgcaccacttctacccggcagggcccccccgccgccctgggtctcataccatacattctagcagtattaaattgattttggtttgctacacacaccgcactggtttaggcctctgcgtctttagacattatggtcttcttagtcctctagagtaaactctttccccatactttgcctgggaagcttcttagctggt

SEQ ID NO: 1844 - DNA, 201 bp, Bos taurus
gcagagccagcccagaggaagatcgtcatgcacaaggtaggccagtctgtgcaagtctcaatcagagaggaggagccggccctcgcgtcttctcagttctgcaatacaggagggtgggcatcttgcttcttcttgcacagtttctcactagattgtgacttctttttccttttatctggagtggccgctgtccttgtgttt

SEQ ID NO: 1845 - DNA, 201 bp, Bos taurus
ggccctgacgtatcaggggtcagggaagtcttctctgaagaagcgccacttgggctgagaccaagaatgagtcaagaggaatgtatagtggccttctaccccctctctactcctcatgcgttgctctcgttctggtaagaccaccccagtttccctttgaaaacagctccctggctgttctcagcccgtccaggtgggctg

SEQ ID NO: 1846 - DNA, 201 bp, Bos taurus
gcccattttcaggctgccctgtccatggttggtgaagcccccaggacactggagaacccctagctggagaggcagagggaagcagggcctgagtggggagcgatcattgcacttggaaccacccagcacaagtgcatgtgagcccagagctggtccaggggacacggggcggggtatccaaagcttctgccacggacatca

SEQ ID NO: 1847 - DNA, 201 bp, Bos taurus
agggggtcagcagccctctggtcctggagatggagcccctgggtctggatagactgagatgcctgagctgagagcctagctctgcagcctatggaagcctgggcctgcctcccccagatgaggtcaggcttcctctgcaggctcctgggggaggcttgggccaggccagctttgaggaaatttccagaaagtctcctgaga

SEQ ID NO: 1848 - DNA, 201 bp, Bos taurus
taggctcctctgtccatggaattctccaggcaagaatactggagtgggttgccatgcccttctccagctggggcccatcaattaccttgcagcttcagaacaaggaagggaggaggaaactgcctttgctgtgggtttggaagtggggagccctgggtttgaattctggatgattcatccctttctggctgtgggaccttg

SEQ ID NO: 1849 - DNA, 201 bp, Bos taurus
ccccgagccccacgccctcgttagaccccaggctttggcctgttttccagtccgggttctgccgtgtcctccctatgggaccttggggaagtcacttaacgtctctgagctcagggccctcatgtgtgagttgaagatacaaacatctgccttagggggtgggggccagacttagatgtggtaacacctgtgacactcagt

SEQ ID NO: 1850 - DNA, 201 bp, Bos taurus
atgaaaatatgatgccttgtttggcccactggtcacagaggaatgagagacccatggagtaaacttgagctgaacccatgatttgcagccaagcctagctcggcccaaccaagacaggcagagccatagctgccaaggctcagatatgggtgaaaataagtaaatgattattgtttgaagccaccaagtttggttggttta

SEQ ID NO: 1851 - DNA, 201 bp, Bos taurus
aagggcccctggttggggtactctctggatagacacatctcccagcaatggtgagggattcaggctcctcccgtcctgggggctgccacctgaccacccacggtctctctggccttgtgttccagtttcctcactttgccacaaaggctgacctgtccatagctggctctgccgagggttctacacttaaagcgtctctac

SEQ ID NO: 1852 - DNA, 201 bp, Bos taurus
cctgggcccacctgggctgagtctgaggatctcggggaatatctgggcagggatccaggaggcaggtggatttatgagtaagggcttagctcacggggccgcgtgtggacactgatttggagtacagccgacgcgctcattaacatctctgggaacatgccagcgttcacctggatgtgtgggcctgtttgttcctttgcc

SEQ ID NO: 1853 - DNA, 201 bp, Bos taurus
gttgcgtacatgtaccacacactcttcacccactcattggtcgatggacatttagtgtccttccacgccccggctattgtgaacagtgcggctctgaacactgggatgcatgtatccttttgaattgcggttttctcagggtacatgcccagtagtgcacttgatagctaataagaagctgctgtatagcacagggagctc

SEQ ID NO: 1854 - DNA, 201 bp, Bos taurus
ccatctgtgggtgggtctggcagataggccgctcttatgctgtggtcgtccttcaatgacaggtgtgaagggtcttgcagagaatctgatgcacagcagatggtaacagtcacaaggcccccttctttaattcagctgcaaactgggccgttatagggcaagctccatgaacagatggggcatttctgggatgggcaagag

SEQ ID NO: 1855 - DNA, 201 bp, Bos taurus
caggaacacagggccaatacccatgtttccacccagtggaaaactcagggtctgtgtactataaaaccagatgtgtttggaaagatctgtacaggctaggggcagagatgcaggtatgggccttgcaggtgggagagactgaagtcagagtgaccacccacatctgaccctgctcggtcatcctacccctggtcccaggtg

SEQ ID NO: 1856 - DNA, 201 bp, Bos taurus
gaagctccaccctgactcctagggcctgggaacctcaagtcccgggctccaaccaggttcccaactgttccctctaggcctcagtaaattcgagtaagacacaatgcattcattcatgcagaaagtttttactgagctcagacatgagtcctacgctgggcacctggggctctgggcttcctggaactggcctccagtggg

SEQ ID NO: 1857 - DNA, 201 bp, Bos taurus
ggtccaggtatttctatctgagcagggccccagcgcgctggcaggcgaacaatgaattcagattctgctgaaaagcttttggacaattaaagcacatcccctggcccccagcccagggctgggcagtgtggggcaggaggagagagagacagagagggacacctattggactcggccctggtaccgagtgggtgggaagtg

SEQ ID NO: 1858 - DNA, 201 bp, Bos taurus
gaccaccatgtgtgaccttcttcctgccctcctctgccttcgctcctgtgctccggacaccctgtgtgtgcctggaacccccgcacaggcccttgtcaccagctcttctctctccctgggaagctcttctctcaggttttcagggttcactcatctttcattcctcacaggccttccctggctcccaaccttaaagccgga

SEQ ID NO: 1859 - DNA, 201 bp, Bos taurus
ttgtttctcaacaaaatcagtgggaaccgtaaatttcagtcttgtcttagaaactttgatttttcttacgttacacagattccacttatttcattaaggctgtttattttattagtagccatcagagctattccttaagattaattcctatatgattattcatatttggtactgtgtagatagatatattttttttaatct

SEQ ID NO: 1860 - DNA, 201 bp, Bos taurus
tgagctctgagaccccaaaatccaggaggcatgactgtgccaggatatggtttgtaataactgtctgaatagattctgccatttggcctccagagagataggaacactccccatcccaccagcactgctttaaccctttccctcctagagtcaacacctgcatgggcccgggtgctgcatcctgctgggcagcctggagat

SEQ ID NO: 1861 - DNA, 201 bp, Bos taurus
ttcctgggtttctccataaaagcagtcagattaatacccacccctggggttgccaagtactttgaatctgaattcaggcacaagtgtcgctacttgtttaagtagtgactcgtatagctagccataaagcacccaacaggctgaggaggagttggttagacagcatcaccaacttaacggacaagaacttgagccaatgga

SEQ ID NO: 1862 - DNA, 201 bp, Bos taurus
cagtacgaggagccccatctagaaactctgggcagacacaggatagcctgtcaggtgtcatcttgcaaagggcagactttataaggaccaagctaagctgaagaccagagtgaatttctcatattcattttcaaagtgaaaaaaatgagaaaaataaagatttggacaaggacatataacaaacgagatacagaactagat

SEQ ID NO: 1863 - DNA, 201 bp, Bos taurus
tttgggtatcaggtgaatgaatggacacggtcttggtcctctgggagctatggcccagtgctggaaggacacacacaggcaatttcagtgagttttgggagcccaggggatgggcattaaccaggcctggggagagaggaaagggtatgaaagggtcagggaggtttaggaaaaactccctggaggaacggaggccttaaa

SEQ ID NO: 1864 - DNA, 201 bp, Bos taurus
ttttgcctgccagggccctggagcccctaggtgaaggacagtaaggatccttcagcctaagctcaccccatataagcctgtgcatccaactaggactgcagaagggtctgcccacaggcagggccctgctgagggtatggctggtgccctcagaggcaaagcagcagcagaatggtgtgggggaggggagaagcaaggatt

SEQ ID NO: 1865 - DNA, 201 bp, Bos taurus
atggggaaaaacactgaaggcactgttatctatgaatgatgataataattcctacctcaaagtgatatggggataaatgagttaatacatataaagcacttagaatagggataggcagatagaggcgtgttagtcgctccgtcgtgtctgactctttacgaccccatggactcttctgtccatgggattctctaggcaaga

SEQ ID NO: 1866 - DNA, 201 bp, Bos taurus
gagtgctcagctacttgctggcccttggtttttagttttgatatcagttttcagaatttatttaaaggaacatgcaagcatgggaactacaaccactaataacagtgagagagggtgttcaacaggcccctcctatggcctctgtgtcctgcgcccatcgtggggagcaagtgccacacggagagcaaggactggacctga

SEQ ID NO: 1867 - DNA, 201 bp, Bos taurus
gatgatgtgggctggggcaggtgcgacctagtaggcagggcaccaggcaggggtggcatggaggggcttgtgtccccacgagtctgggggccctgtgcctcgcctctcctgcccctgaaactgttaaactaattaaggctgtggagccgcaggattaatcggggcagctcggcgcgggccaggagctcaggtagtcgatta

SEQ ID NO: 1868 - DNA, 201 bp, Bos taurus
aggccctgagctctaggaacagggagtctaagagcaggacccccccacccagttcacccagaagtgaactgccttgttcctcctcccagaaaattccaaacggctccgctcatgaaactctggcctgcttcgagctcaatttccccactggtaaaataggtgtgtccccaaggcccacgccactgagggataaaggatggg

SEQ ID NO: 1869 - DNA, 201 bp, Bos taurus
tcagtgtccctccaacttgtgacacattctggcatgcttccactaaattctcctttggctgagtcagctcttatccctggcctccaaaagcactttaactactgcatgctggcacagtgacacaggaccagagttagtgggtctgaggttttccctgtgatctcaaactgggctgtccctaagaaatgggcccatctagtc

SEQ ID NO: 1870 - DNA, 201 bp, Bos taurus
gggcatgacagtatgtctcctatacatacatgtgacatggcacatttggcatgtgacagataaaaaagcttgcattactgtgacttggccattttacaacgatggcagagtgtagcagttgtgcccacctgtacattttcttgatggaactgtgacacctgatacggcttgtggtggcagtgtcagaggcctatatgacag

SEQ ID NO: 1871 - DNA, 201 bp, Bos taurus
aaaaaaaattttaaaaatcttcaccaaatctgtgtccataatcaagtgcttaaatacaacactgttttatctttcctgaaataaaagctacatttatgaacactcatgcaaaattaaacagcatataattcctaaggccttcctagctttcttcacaatttaaaatctggagacctggatattcttacacttgcatttttc

SEQ ID NO: 1872 - DNA, 201 bp, Bos taurus
tcctgccccaaggctaccgagcaaggccttgcagcaaggctacagaagcagcatctaggaacaaggtcatcttgggaactgactgagctcctttgtaaccgcggccagaagcccccctgattatcaccagcaggctttctgaccccagttcagttcagttgctcagtcgtgtctggctctttgcgaccccatggacagcag

SEQ ID NO: 1873 - DNA, 201 bp, Bos taurus
ctcttgccgcagggttccttttctctctcctgcccatggactcaagcttcaacaccattcctgattgcccttcccgacatctccttgctacctcccgagtttccctctcccctaagcctttgatctaggcccttctccttcctcggggtccctgcacccgtcctctccccagcgtcccccatttttctggaccctctttcc

SEQ ID NO: 1874 - DNA, 201 bp, Bos taurus
ctttgccctcccagataaccgcttggcccccttactgttagttgggtttctgaatcactgttgaaagtgatttgcttgtgaacaagaagataaggccagggtccttagagaggagcttcccgctttgaatgggagattggaataggtaccctggaaattaccgtccacgttcaagcctaattccaggtcttctctacccga

SEQ ID NO: 1875 - DNA, 201 bp, Bos taurus
gggagtcgatgactgtggccccgctgaggcctcctgcaggcacagaggatgcggggcgtgagccagggtcgttctcatcctttccaccccaaccataagccaccatttgccaggcctcctctaaatacctgggcaggctcccaggcacaactcagggagactccagggtcaccagcctttaaaggcacatctgggatccag

SEQ ID NO: 1876 - DNA, 201 bp, Bos taurus
ccaggcacaggaaaagcaagccaacctgagctgcactgcgctcaattcagctcagactgggctcaagcagccatgagcaaaaatagcttcggatttcacccgcaaggacactttagcaggcctggctgagcagtaagctccccgcccctggacgtattcaagttgagattttccctctggagaaggtcagaattcatgttc

SEQ ID NO: 1877 - DNA, 201 bp, Bos taurus
tgcctcgagtggccatctgtgaggctcagagccacccagaatggtcaattccctggcaatcgatacagagttagggctaagaagaggtatatcagttccacagcacactaatttggcctgtaacctgaaaaagtgaaatgaatctctggtgaaccagattctggtataaaacatgtcagggatcaatatttctggcttgtc

SEQ ID NO: 1878 - DNA, 201 bp, Bos taurus
ttccacttgccttggactgtgactcatcgttcattcattcatttattcattcattcactcaataaattcttactttgcccactgtatgtgaggcctgatggtggatacagaaatggatcagacccacccctgtcctcaaggacctctcaggacacatacaaaaataagggcaacagagcaagtgctgtgggtgtaatgcta

SEQ ID NO: 1879 - DNA, 201 bp, Bos taurus
ctcctccggctggctcaggaaggcctgtccttgaatctgtagctgccagttctaactgttaaaccaatgcgacgtgagtgagagcgggacaaagagttgacgtgtctctgaaaactaagaaagggcctcagaaagatccaacagaggagaactgtccaaagaagaagagaaatgccgaattgagtgtgggcaagaccatga

SEQ ID NO: 1880 - DNA, 201 bp, Bos taurus
gcccctctctgccccagttcgagtcacacctcaatttaaacggctacccttaccctgctccttcccacacacacacactctcccaggctcagaagcccccgttggtgtggccccagcagcctgactggttttcttttttctttttttatccaagtatctttgcttttaggggcttccctggttgtgactcgtggagtcgca

SEQ ID NO: 1881 - DNA, 201 bp, Bos taurus
agaatcagttattgaaactgccgtcctcattaagcagaaaagtgggcgcccgtgctcaaggttcgcggtccggctgggcgtggagagaagctaggccaggtggacaggaggtgttggcgacgtggtgggcaagcagagcagcaggtattaatttgctgtaaagtaaggaaatttgcgggcctggaggaactctcccagtgc

SEQ ID NO: 1882 - DNA, 201 bp, Bos taurus
ataatttatgtccttctccttcctgctgtgtcaacttggggttacataactgaacttctctgtgagggagcccttgggggcctccaggaggcagggttggtggtgacataaataaatatttctctgctctctgccccgggcttgggctctgagcaaacaccacagcctgaaagggaggccatgacaaggaggaagctgggg

SEQ ID NO: 1883 - DNA, 201 bp, Bos taurus
ggcagtccctcagagtcacccacgtgctttgaaaagagatcaaagtcgctctgcagagtccatggaacctaagtctctgagggcacggccagacatgcacatggtttcttacaaccatccaggtgatgctaatgtgtgaccagggtggacagcagcatctgaccacagacaggggatgacttacctaaaacctgagatgtt

SEQ ID NO: 1884 - DNA, 201 bp, Bos taurus
cgattcagcatgcacaaagctgttaaagaagaaacagtggaaccctatcaaacaatgactcggatctgcgtggtctacggcctgctactggagtggactcgctctcgacaggacactggggatcagtgctcaccttgtttgacccccttcccagccctgagatctgggtgttctctgaggcccatgtttaggggaccatgt

SEQ ID NO: 1885 - DNA, 201 bp, Bos taurus
tctgcttggggagacagggctggtgtctccaacctgcacgggcagcctgagggagacgggctggggagaaggtctgaggaggagcacacaggccgctgggctggttaatggacacggcgtcgtctggctggacgcgcagagggtagattcaagcacgacgtggggcttcagatcaggacacctcccggggcatctccgggc

SEQ ID NO: 1886 - DNA, 201 bp, Bos taurus
gtgatgccaggcagtgtgaggtggggtcaaccaaggaaggcttcctggaggaagagaatgttgagccagctctttaggagggctgaggcccagatgggcaaggaggagggtggtggtgaaaatggcactccccttgaacacttggcacttccacaccatgcggaagcctgtcaaagcccagctgttggccctctgccctgg

SEQ ID NO: 1887 - DNA, 201 bp, Bos taurus
gctgtcactccagcgtgaaggatgtaaagaataacaggacagaccccgcccccgtttgtcgctagaattaaagtaaataaccggccaaagtgcttgacctggaacctggcacttggaacgcgcccggatacaaccagtggtgtctggggctacgttcttaaattggccctgaactagttcgtcctgtttcaagtcccgtgt

SEQ ID NO: 1888 - DNA, 201 bp, Bos taurus
gctaaggtgcaggtctccccttctgtctcctccttcgtgcccagggtctacatcagggccaaacccagtaaggacctttccaggtaagaggcctatcccacattcccacctggaggagcatggaagccaattccaggggttccaccaagaagaccctagggtttcagcatcagaaggtcctcagaggcccggggataccat

SEQ ID NO: 1889 - DNA, 201 bp, Bos taurus
ggaggctgggcctaaagccgttgtccaggagactcaacctctgctgtctccatagcaactgggacagccatcgtcctccctgctgaatgcacagggggcccttcgattttgttaagacacagtagccaggcgggtccagatttctattccagttccacaatttcctggctgcttgaccttgggcaagtcatgatccctctc

SEQ ID NO: 1890 - DNA, 201 bp, Bos taurus
cactcaattcaacttaaaacaggaaaagatgtaaacattggatctgttgccataactcaggctctgttccctgaatagaaacatggagacagcatttggggtaacatagaaaagagtagcttttcgtggtttgtcaggcaaaggcggccacagtgggctaatgccctcaagactgtgtgacccaccctgtaggggacagtg

SEQ ID NO: 1891 - DNA, 201 bp, Bos taurus
tgaattgttttccacagtggctgcaccattttacactctcaccagcaatgcacaaaggttccatagattcacattttattatatgcttttgcgatgtgagactgtcccggcatgaataaaatagacaagtccatgcttttaagaaacagacattcagcagagggagttgggtaatacacaaataaatattaatcttttgat

SEQ ID NO: 1892 - DNA, 201 bp, Bos taurus
cagaagaaagaacagcaatggaacaggggaaattattgagtctgaggaacagaaacaaaaaagatagaaaaaaaaataccatctatttggccatgaattaatctcaatagattttttaaatatatatttttcagagtatcttctatgaccatgactaaatgaagttgtgaggcttcccaggtggctcagtgataaagaatc

SEQ ID NO: 1893 - DNA, 201 bp, Bos taurus
cctgaaaagttagcacatacccaagctgtaaagtagccagagttgtgtcttaggctaaaatttgaactccaggacaccagagggcagagaacagggaagagtcctgggcaccagccaggcctgtggcccccagcactgccaccccagctttacttcaaagcttcagttacccctgcaggcggggggccgggccttgggcac

SEQ ID NO: 1894 - DNA, 201 bp, Bos taurus
gaagcttttcacaaaaatggcaccgaaggtgaagaagggagcccctgccccttccaaagccaaagcaaaggctgttaaggccaagaaagcagtgttaaaaggcatctacaaccacaaaaatagaagatccagacgttgcccgccttccagtggcccaaaacactgcagctaaggaggcagcccagatattcttggaagagc

SEQ ID NO: 1895 - DNA, 201 bp, Bos taurus
agccactattataggtctgggagggcccatcgaggatctgtctgacttatgaagtcactcgtgctcagggaatatgcattacttgccaggaacgttgacccgaggctccagggggcacagtggcctccggatctgaccaaatggcaaaggggttgtcttgggttctgaccaccgtgaacgtggtttaggtgtatggagtgg

SEQ ID NO: 1896 - DNA, 201 bp, Bos taurus
agctccgtgaccttggacttgttagttgaccactctcagcctctagttcagacattcccgtcatctaagagccggaacctctaacacaggggttggcaaagtggcccactgcctgttttgtaataaagtgtcataaataaagttttattggcacacagccacacacattcctttgtctgtgaccgctttcccgctccagtg

SEQ ID NO: 1897 - DNA, 201 bp, Bos taurus
gggggtcgatccagactggcctgacctggaaggccttctgtgggctgccctggcctctgatgctgacggcacctccctccaccccaggccaatctgctacttatgagtccacaccctcttcactccactgtcaagcttttgctcttggttatacccccgccgggaacactttctctgaaaagatggggccatggcaggcag

SEQ ID NO: 1898 - DNA, 201 bp, Bos taurus
caaaatacatcccaactctaatcactaatcaccacttcccctggctctacttcggtcagcccacgccaccatcaccttttatccgggttactgcaacgacatcctaactggtctccatgcctccgccccttctgagccctacctctctctaccctactctctctgtcttcaacccaggagtcagcatcatcttttagcaca

SEQ ID NO: 1899 - DNA, 201 bp, Bos taurus
gtttggaagggttaaggcagcaacctaacaacgggagctaacgttttatgaggattatagcccaggcactgtgacaagcattttgcatgggtggccttatataatttttgcaaaacctgcgaggtagttactattattaactccccttttaactgagaaagtggaggcctagagagataaaatgactggccccaaatcaca

SEQ ID NO: 1900 - DNA, 201 bp, Bos taurus
ggccaggccgcggccctcagcctgctgctgaatcacggtgagctctcgacacggcttcgcctctttgagcctccgcttcagcagctgtaaaatgggaacaatggtgtctgctttgtgggccggtggtaagcgacgctgtaatgagagcgcttgtgtgagtgcttctctgaactcggacgttctgtatgcctgaataaggta

SEQ ID NO: 1901 - DNA, 201 bp, Bos taurus
agctattgatgaggaaactggacacctcggagaggtaaggtaacttacccagggtcaccaagcagggaagcagcaaagccaagaccagaacccaggcctgccctcttccaaacctgtgctccgtctaccaggcgacagtctgcagtgtctcaagtgtacatgtgcccctggttcctctgtcacgtgttcgtggcgtgggcc

SEQ ID NO: 1902 - DNA, 201 bp, Bos taurus
tgctgaggatgagccccacccactgcgtacatcagtggaacgccggccctagctttcctgaccgcaggagccgccgagtggaaagggggtatcgtctatgcggacgtggggccttgaggagagggcgcaccggactcagagccagaagactctgactcggtctgtcaatctcacagaagcccaaccctacgccagttttct

SEQ ID NO: 1903 - DNA, 201 bp, Bos taurus
atttaaaataaaaagtacaatttgacttttatttccaagaatggctataaatactactcccagacaggcacagtaagtgaaccatttttaaagtaactaggaatgcttctctaataaatcataaaattaaaagtggaaaaagtacccgaataaaaaaaatctttaagttacaaaaaagtcaagatgtgggtttggtgggct

SEQ ID NO: 1904 - DNA, 201 bp, Bos taurus
gtccagaggtccgtgacaggttgtgatttttgccaaagaatgagtttgaatcaaataccaggggttccttgtgaacaagtgagccaagctactggcctcagtaaagcctccctctcagcgcagctttttgtgtacacgttcccactacaaagaaactcccaaagtggttaaaacaaaacaaacaaaacagaactttttttt

SEQ ID NO: 1905 - DNA, 201 bp, Bos taurus
tccccgaccacacgcagggtcgtaacccatcatcctggcacgtgaaaggcggcttctagtttagggagtactttcacaggcacttgcaagagccccagtgcgtgcccactggcctggtgatgctgaggccttggggagtggttccaggggtggggtggggcgcctgccagcctgctagcttggggcagctcagggcaggga

SEQ ID NO: 1906 - DNA, 201 bp, Bos taurus
tgggctgccagtctcctccctcacctctcaccttcgtgcagatgcccatggaagctccagtcccactctaggcctttggggacgtagggcctcacaggacccagccctcccttctaggttctcctaattaaggtgctgtgtgcatcagtagaaggaaatgtgggatgtggggacgggtcagggaaggcagaggacacagca

SEQ ID NO: 1907 - DNA, 201 bp, Bos taurus
cacaatgctttctgaacaattaaagccgtttctgcctagttgcccaagccagtgatgattctggaaaacaaaaaagaagacctccaagtttactgggccctgatcagccaatggttaatctgtggtttctcctcagttcaattcagtcgctcagtcgtgtccgactctttgcaaccccatgaatcacaatacgccaggcct

SEQ ID NO: 1908 - DNA, 201 bp, Bos taurus
ctacaaggctgaggtcctgtccagggctgaatttgccagcagttcggagtacttgcctcctttcgagtttaagatggccgagagacccgagatctactctatgcctgagcccgtgcccagtgaggactccttcaaggctcaggtctcctccgggtttgaggagctgcccaagatggcggcctccaagtccgaggcgtctct

SEQ ID NO: 1909 - DNA, 201 bp, Bos taurus
ataacagcaacaatggtccgacttgagggcctgtgacattgtcctggtttcttcctgcctccacctcccggcgtccacaggccacccccatgaagaccctcatctgtgttccctttttgaacgtatgaaaggatttctctgggatccctgggtcaaagggcacacatcaaattccgccagactgcactgcaaggtgtctgg

SEQ ID NO: 1910 - DNA, 201 bp, Bos taurus
aggtcccacccagtcggtggcgctccacgcctgtgggttttgtatatttctgttgatgacacttgttagttgctccccttcttgatggcccttggctctccgtggtaaattcagcgccatctggatttattaattacatctgtattccaacccaaggtgcatcctctaacagggagtcaagctgagcatgccctttgaaag

SEQ ID NO: 1911 - DNA, 201 bp, Bos taurus
tttaagataactcatgtatgtggttactatggtgcctggccaggccaggcggtttcagtcagtggttcccctaacactcccacacccatgtctatggcccgtccacttcggttgggtgcctcctccaatgaactatgttcttccttcatttcagagctcacttttcaagaaaatcgaaaagtcatcactgtcatatggacg

SEQ ID NO: 1912 - DNA, 201 bp, Bos taurus
ggcaaccagattgggtagacggtggagggggagatgcatgtacattattcagtgtcagcttgcggggtggaaggaaaggtgaaagccactgcctagcttcgttccctcgaaataaaatcctaaatgctgacttgaaacatatggctgtgctttgaggtaaatctcaagtctagttcctcgtggatacccaaaacagctaac

SEQ ID NO: 1913 - DNA, 201 bp, Bos taurus
gctgggtgggtagagggcgtccctgaactgaccttagagtctggaaagctagctgtgtaatctcgagtgcgtcattctacctctcttggcctcttttctcgtcataaggtgggagtcacgatacttcacagcgttggtggtgctgtgctgaaaggcttcggaaatcgggagcagggtccaggctgtggctcacatcagagg

SEQ ID NO: 1914 - DNA, 201 bp, Bos taurus
ctgtgcttgggagctgaactgacccctcctctttctctctctctcgaggccactacgatgctcgggcccgcgtcctcatctgccacatggcctccctcctccgagcgcccttggaggagcttgacctcctggaagagaccttcctcgagagcctgaaggaaagcaaagaggaggactctgagtaagggacccctggccctg

SEQ ID NO: 1915 - DNA, 201 bp, Bos taurus
agtcattagggcagagtgagacggggagatgaccttggatggtgaatgaacacccagcaaaataactgagtcacagagtaagaacagaggcctttagagcgccctcccagctcctctggttatgtcaagagaaagtctcatgctgatgctactgtatctttaacgtccctccaacatctaacaaggagaaagcaggccttg

SEQ ID NO: 1916 - DNA, 201 bp, Bos taurus
gtttatagatatttgtatctgccactaaaactggaagctccttaaaggcctgagttgccccttgctcatctgcacactcccaattcagagcacaaggcctcggacagtaggatcttctaagaaatattttttgagctgaattgaattcattcactcatttccttattcattcgttcttggcatccttaacagcagaactgt

SEQ ID NO: 1917 - DNA, 201 bp, Bos taurus
gagttctgttatgtgcagactaccagaccctcacttgatccagtgcaggatggcctggattgcctcctgatcatgcggtccagagccttagaacttgaaaccaattaaaggagagaagcacgaggccccgtgctgtgtcgtgggcgtgctcgtagggagcagagggtctgtcaggagcagactccagggatgcgtcctgag

SEQ ID NO: 1918 - DNA, 201 bp, Bos taurus
aggggccccaaggctgaggcttgctaagtcaacatcatcattacatttcttgtttcctcctgaaaattcgggcttgttgtatgagacggctgttccccagcggccggtggaaggctggggacgtttcccactccaggccagtttgccgggcctcctggggacgtgggacccgcggcccctccaggtcaccctgccggctcc

SEQ ID NO: 1919 - DNA, 201 bp, Bos taurus
agagggtgcctcagggtcaacgccaacgtggtcccctggccccccacttgcaggacgtctccaggaagagtgagcgcagcgccctgaacgaggtgcacttagtgctgatgcggctcctgagcgtcttcatgtccaggaccaagtccggatccaaggcttccgtatgcgaggtgtgttgctctgggctaatggctgtgggga

SEQ ID NO: 1920 - DNA, 201 bp, Bos taurus
tgggggccccagatgcagcacgcagcacagcccctgtcggtatcgggggccagccctcctcggtgcggtcactgagttcaccactgaggccttatcaggcgccgcttctctggagcgtctgacctgagccccgttcacgttcactgtgctgggtgctctacctgattcagtcatcacagcgaccctggcctgcccccgttt

SEQ ID NO: 1921 - DNA, 201 bp, Bos taurus
ggctgtcacagtcacgcccggctcccggcccagcctgcttcctgccgccgctcctgtgcgcccacacgtccctccaccctctgtcccatcaacttggtcacaccagtagagggattgggaaatggccgcgcggggcaggggtgggacggcgcggggacacccttccttcctcttagtcactcgtctaactttcagcacatg

SEQ ID NO: 1922 - DNA, 201 bp, Bos taurus
caattatactccaaaataaaataaaaattaatttaaaaaatagaataaaataagggaaatgatggtgattcccctagccagggctgctgggaggcctgagcgtaatcaggtgtagccccaagtgaccagctttagagacggcagctctagggtttagctgaaggtcacgggactcacatgacctgtttgaatctcgcctta

SEQ ID NO: 1923 - DNA, 201 bp, Bos taurus
gctgcccacccccattcatcccgcctgcgtttcctgagacctgctgtgtgcctcaggtggttccagatgccagagacgcagagggtagacgtggcccctgcgctcacgagagccaagctccatgagagatgggaaaggaggagcagtgtcagtgagaccccttcagaccaaggggcgcgccaggaagagtgggacaggggc

SEQ ID NO: 1924 - DNA, 201 bp, Bos taurus
ggttaaggtggctgtgtggacccctggcggcccggaagccagagcagacctagaatccaccaccttctgagtctgaaccgcttctggggtagacgtgtgtagggtaggggcccccgcgcgttgcccctggggcactggttactcctgggtagccagggtgcctcaggcctggagacggggaggtgggagacagtggaggtg

SEQ ID NO: 1925 - DNA, 201 bp, Bos taurus
tctttggagagctctgttcaagtctctcggccatttttatatgggtttctctatttcttatttattggtagaaaaagttaaccttctggacatgggtcctctgtcaaatattaatatgtgcaagtaccttctccctttctgtcggttgcttttcaccttcttaatgtgtcgtttgatgaacagaagttcttgatttaacat

SEQ ID NO: 1926 - DNA, 201 bp, Bos taurus
cattttcagagagggaagaaaaatagcagaaggctggcgtggctttttttttttttttttttttttaggaggcattctcaatgagaaggggaatggaaaagagagagaaaaggagaaagccggcagacaccccactttaaagggaaaaagaacacatcacaaccacagccacaaatcctagatgggcgcccagacaaaacc

SEQ ID NO: 1927 - DNA, 201 bp, Bos taurus
gccagatatgacatttattgccaagccacactgtagccagagggacagcgtggacacaaaaacgagaaacagttcaaagtggctttggccctgagcctaatgtctgtgttcaaaccccgactctgccgttttccagctgtgtggctttcctcgctggtagaggcctgtctgccccagggagctgtccagataggtgactag

SEQ ID NO: 1928 - DNA, 201 bp, Bos taurus
agcagaggggatgaggctggaggccaggaggctgttaggaggctggggcgcaatcccaccccagagaagacaggcccgagggagggccacagaggggaggtggaagagagggtgagggcaagccgccccagttccttgcccacctctaagtgctgttaagtgccctgtcctgtgggactcagagaaaagccatcccaattg

SEQ ID NO: 1929 - DNA, 201 bp, Bos taurus
ggcctcagttttaccatctgtaaaatgggtggggaattggaaatttcagccctgtggtgcaagacacttgttctacccatggaacagtgggtggagaatccgatcctgtcggtctgggggccaggtcagaggtctctccatggtgccagaggctgctgtgaatgtctctggttggggagccccatcctctgcttcctccct

SEQ ID NO: 1930 - DNA, 201 bp, Bos taurus
ggtccctcctgcgggctcagggctggggcagggagtcagcccagctcttgggggaagatgtggaaggcgtctggggacacaggtgtgactaggcctcgggtggcagttggagtgtgggatgcagactgggacaggcagcttccagaaacctccttccacgtttcacccccttgccagccggctaagggtgaaggagcctcg

SEQ ID NO: 1931 - DNA, 201 bp, Bos taurus
atttccagggtgaaggttaaggcaaaatgggtgagaagaatgactaccctttccacgaatgctcaccactatgagcttgggacacaagcctttacataccgtagcccagcagggaaggccctactgccatccccatttagcagataggaaaactgaggctcaaggagattaaatagcctgtgagcgtagatagcggctagt

SEQ ID NO: 1932 - DNA, 201 bp, Bos taurus
ggtgattaggccagtggacagagaaactctttattaaattatttgctgctggaatggccccttctcattctcagaaatgtggccaaatgccaagaagtaggtttggtatcagcagacttgaagcgttcccactgagctttcaacatgaaggcaaattcaaatcccccaggtagtgcatactgtgaacttacaaggccacac

SEQ ID NO: 1933 - DNA, 201 bp, Bos taurus
tggaatggtttagccatatgataacatttccaagaattaagtccagtgagtacaccattcagtgtaaccatatagtgacaaagagggtaccagctttaagtatcacctctgcccatctttgttggcaaggcgggtggtaggatggaactcaggaacctcatcatggcagtcctcccacaacaccttctttctctggatccc

SEQ ID NO: 1934 - DNA, 201 bp, Bos taurus
tgcagcgggtgagaaagggtggcatcgtgtctgcaggatgagggcagggatggcaggtccatcatggggactgatgtgactcatcaggggaacgagagacgaggcccaggggcccggagcgcaggccaagcgcgaggacgcagaggtggagcccgcaggcagttttgccagctgcagaggcctccaccccattggtcacat

SEQ ID NO: 1935 - DNA, 201 bp, Bos taurus
ggcataatcgaactaccctcattagcatgggaagattgattctggatgctaagtacttagcctagcgtctggtccagaagaagtgcttactcaataatatcgtcatctgtggtgggggcgacaaggacacgcccggaatctatcatcataatggcctggattttaactctgactagacccagctgccaatgcaggagatgt

SEQ ID NO: 1936 - DNA, 201 bp, Bos taurus
tccggctgagctgcaactatcaacagacacccacccccaggggccgtatgaaagaatgattgattgttgctctaagctactgaacttggggttcacttgtcattcggccagagctaactagtacaaacggtcacatgacgatccacgtgaaaacgtgtattaggtattagctagtttagctctcggtggttagtcacctgc

SEQ ID NO: 1937 - DNA, 201 bp, Bos taurus
ctctaggcatgagcagtttctaagaattaaaagctatgagggagaaaggatgagaggagggaggttagtttacactggagacagccagcagacaagcatcatgagttctactatgaaaggaagcaaagaaatacagcagatgtgaagaggtatgggaccccaggaggtctgggtttttttaagatgagaaataatacgcta

SEQ ID NO: 1938 - DNA, 201 bp, Bos taurus
ggccacctcaaaccttcccatccaagacaaaagatatcacctccagccccacatgtggagggcatacaataagccaagcaccagaacgaagccgtatattgtaagagaacaaggctgggcccacattctcaaacacctttattctcggtgttcctctgggacggactcttggtaattaatcgtcccatttcagagatgaag

SEQ ID NO: 1939 - DNA, 201 bp, Bos taurus
ctgtctccacacagcactggttaagcatgtgagctcccgagccacagtcctgggttcagatcccagctcggccacttactagctgtgtgccccggggccttgtttctggtctgcgggatggaagtagcgacagcatctacccgtggggattaacaacgttgggaaagtcaaatgaggcagggcctggcaccgagcaagccc

SEQ ID NO: 1940 - DNA, 201 bp, Bos taurus
tattcccaccacggccctgctaggaagcctgccttatttcagaaaaggatactgatgctcaaacaagtcacatgactcaccccaagttacccaaaatgacaccccaaatgtgggccaccaacaccctcatcgcttccctggtggctcagatggtaaagaatccacctgcaacgcaggagatcctggttggatccctgggtc

SEQ ID NO: 1941 - DNA, 201 bp, Bos taurus
gcacgccagccggccgctctcagcccatttcccagcagcttcgggagcccaggatggcgcgagcacggtgaatcattaacctgcagagagaccagcagctacaggatggccacccaccaccctagaggccctgccggcccaggcctccctgtgcccagcccacgcagccgagctgggctcgcaggtggcccctctggctgg

SEQ ID NO: 1942 - DNA, 201 bp, Bos taurus
gaaggtaaaggcgttgctcaagacggctgcgggcctgacgagtggagtgggtgcagcggctgcctcctggctcccagcctgggcacccccccaaccctggtggtctcaaacaagccagggcctttgaacccctcttatcagatagaacggagggctgcttatcagatgtaatgacgataccgctcaggaggagaagcagag

SEQ ID NO: 1943 - DNA, 201 bp, Bos taurus
agaagtggctccattcaagtgagatccaatcagagcccatcttggaggtggaagtgtcatttccagcctgtctggtaggtgcgtctccctgggtgacattcgttacataagccgcagcacggcacacctaagtgatgaatgtcggccgcacacccatttggaaagccacaccggcttcccctgggagaacactggtgtgga

SEQ ID NO: 1944 - DNA, 201 bp, Bos taurus
actggccacatttgaagcgctcagaagccacgtgtggcggcttccacgtcatactggcatagaagtcttccgtcgtccgagaaggttctgacagcaccgcctcagagcagcagttctcagccaggccgacgttacctttcggggtgcttttcaaccatcctacaattcacaggacgtcccccacccccagcagacaaaatc

SEQ ID NO: 1945 - DNA, 201 bp, Bos taurus
tgatccagtgactgttggcaatttgatctctggttcctctgcctctttgaaaaccagaatcggaaatgctaagaaggggccagataacccatgctttgacgagccctccaggtaatggttctgctgctgcagctgctgctcctgaactctgaggaccgctgtcccgaagctcgcattcatccctggccactgccccaggcg

SEQ ID NO: 1946 - DNA, 201 bp, Bos taurus
cgtctcacggccggttgaaagttgactttatcacaacccctctctgtttcactttttggcatcaggtagatctgaggtcagaccacgacccctcgctttccgcactgggactctgggccgctcactaaggactctgtcttagcttccctcgtctctaatactcgagatgtgtgtgctcagtcgctcagtcgtgttcggctc

SEQ ID NO: 1947 - DNA, 201 bp, Bos taurus
gttcctcctcatgtgctggcagtccttcctttctctctccctttgctgatttcttctcgttgccccgaactccagggactctgtccttaggcctcgtcttcatagacactccttcgggctttagatgcctcctaaattcatgtctctagccgagacatcaccccaagtcttcagactcagatggccactcaaccatattct

SEQ ID NO: 1948 - DNA, 201 bp, Bos taurus
tactccacctctccgggcctcagtttcttaatctgtaaaatggggataaaagcagtccccgcttgacgctggtgaggaatgagcgaatccaagcgtgtcacacccttgaatgtgcctggcctgtgtcagccccctttgtggtggtggtttggggttttgtttttttgaccttgcagcttgcaggggatcttcgttccccga

SEQ ID NO: 1949 - DNA, 201 bp, Bos taurus
gcatctccgggtgcctcctcaaccctccgcagcagcaggctcggcccaggcaccaggagccatgcttttcctctcactgcctggtcctcccgggagccgacgtgcaggaatggaggcccctaaaagggggtctgaaggcctgggatttgcactcccttggggccagctcagcgacagtcctgaccttggagaggcccctgg

SEQ ID NO: 1950 - DNA, 201 bp, Bos taurus
caactttgctcgctttcgtataaatgctatgtatgtaattacagggaagttattatatattatatataacaactacagggaagcctaccatgcttccatgttgccacacgtccatggggtcacagagtcggacacaccttggccaccgaacaacaaagtaactcctgttatattagctgttatcatccacactctacctcc

SEQ ID NO: 1951 - DNA, 201 bp, Bos taurus
agcataaaatgtatttacatgaacaaaagaagaagaacgctcacaagaaaaatgaagacccaaagaagtgcccaggcctaagtgcctgtataccagctgagcaaagagtagtcgctgtagaagagtgcctaagtgacgtggtggcgatggttgttgctaagccatgtccaactcttgcgacctgatggacgtggcccacta

SEQ ID NO: 1952 - DNA, 201 bp, Bos taurus
cgtgttctccctacagttttccagtaaaagccagatttctgctgctttgaaattctgtcagagtagctcagaggtgcagcctgggggccttaggagccacacttggctgcagtgtccttggaacgctttcacatcgagcctcgaaaacccgcttctggtggtgctagtgaggcccacagctaggggcccagaggccatttg

SEQ ID NO: 1953 - DNA, 201 bp, Bos taurus
tcttgaggcaggttgtccaggttggactcagaggatcagggactgctctgcacaccccctgtttttctcaggagttccatcaagctttctaattgaagtgatccgtccggattctcagaggctgtcctctgaaagggctgctgaggggtcctttgggaaggaaaggattccctctgcctggttaactccttcaagtgcaaa

SEQ ID NO: 1954 - DNA, 201 bp, Bos taurus
tggtttcataatcgcccacttgaacccgaatggaagaagtaaaccttccctgttgaggcagagccccggccaggctatggcccgagcagggtccatggaccgacttggtgacagtctgtggggtacggtggtctgcctggggggtggggagggcggacctacagccacagtaccggcagggatggcgcggcacccccgggg

SEQ ID NO: 1955 - DNA, 201 bp, Bos taurus
gcgatgatttcttagatatgacaccaaaagcatggacaagaaaagcaaaaatagacaaactatttcaaactttaaaacttctgcacagcaaaagaaacaactaacagagtgaaagggaaatctataggatggaagagaatattggcaaactataaaactataaaagggcttagcatctagaatatgtaaagatctcttata

SEQ ID NO: 1956 - DNA, 201 bp, Bos taurus
attgctctctggccagagaatggagattccacaggtggtttttttatggtattaaaacaaatacacaaatatgagaaacaaatgacgcaccccagacaaacggcaattacagaatcaggccaataataactaaaataatggactatacacatatacatatacacccataaaccaaaccaaaacagacaaaaaaataataat

SEQ ID NO: 1957 - DNA, 201 bp, Bos taurus
ttaacctcatgtctcacaaagtccaagtccagcctctgaaacaggtacagaggggtcagccacagagaccctgtggctgtctgtagcctccagagatcctatggctgtctgtggcctccaggctagttgaagctcacagtgagaccaggttagtttcacattagctttaaagagaagaaacaatgaagactcctgacttcc

SEQ ID NO: 1958 - DNA, 201 bp, Bos taurus
ccttggaaatagaaagtctcacaaacaaaaatcatatgcttattcttaagctggtgaatgattcttttcatgttcttaagaagtaaaatttcttaaactttctatctttagaacaaaaaagtcaacatactcattcctccaaattctggaagtaagataaatggccagggatgaagagcccttagaaaggtacagaaataa

SEQ ID NO: 1959 - DNA, 201 bp, Bos taurus
attttgtgttggaagggccagttttggcttgatgcagtgcttctcaaaatgtcatccccagacctgcaaccttggcatcatccaggaacatgttagaaacacaaattttcaggccccattgcagatttactaaatttggaactatgggggtggagcccagtaatttgtgttttaataataggctctacaggtgattctgat

SEQ ID NO: 1960 - DNA, 201 bp, Bos taurus
gtaatgtcccagatgcatttgccctctgtcttccccaaatatctgtcagcacaatacctgtaggtctttgaataagaacaaatctagttttactcttgtgatctatgaaggggctcactcactttggttttcatgtaatttgtgctaagttatcatatatacctttaggctaccaaagcactagtgaatgcttctccagga

SEQ ID NO: 1961 - DNA, 201 bp, Bos taurus
ggcgatataccctgggctaaaggccatcctgaacatgcttccatcacagcatctccactctccaactacgatacacacaaaggcggggtaagcccttatattaaaaggccatgtctattagaatactaaaagatctgccactttcctcattaaggcaaaccacatctaaacgatggtgataggaatgtgtctgaattttct

SEQ ID NO: 1962 - DNA, 201 bp, Bos taurus
cgctgcaacaagccacagcagtgagaggcctgagcgccacagctgcagaggagccccggctcaccacaactgagaaagcccttgcacgacaacgaagatccggtgcaaccagaaataagtaaaaggactgcaaaataataataaagttgaaagggtaagctgagaggctggcacctcatcctgtgagcaaatgggcaacac

SEQ ID NO: 1963 - DNA, 201 bp, Bos taurus
atatgtacatatacatatatatgtatataaagaaaaaaaaaaaatcccaccaaaaaaaacccagaaagagaacctggtctgtgaggaaagctaatgaactaggccttgaacacagctgaaacttctgagaaaacccagatggtcaattagaaggcagttagatatgtaggtctggatcccaaggaagcaacgagagaggtt

SEQ ID NO: 1964 - DNA, 201 bp, Bos taurus
cggctgcctgctccctgaaccgcccagccaactgggccaccgaggggggtgcagagtcgtccacaatggcgttggtctgtgccggcctttcctggcaaaccaaggggaagccaaagttaaccagaaaatacgcacctggcactctgagcatcagcacaaggggccacgcgagatgcctgctatgtgacagtgaggtcttct

SEQ ID NO: 1965 - DNA, 201 bp, Bos taurus
agtcactcaaggtgacttgctgctgcagcccacgccctgcttgggccttgactcagtcacgtgagaacccatgaccacaatgcagataaacttggccaccaccttgctcccgggtctcagaatgtgcagcgtagaatcctaccctccatagttctttgggctaggaagaggcatttatgagatggagcagtggaaatgggg

SEQ ID NO: 1966 - DNA, 201 bp, Bos taurus
aagatggattggatatcagacatacctgatcgtcacaaagaaacatcttttcccatagctcttctgtgggagacaaaaatcataagttggcctccaagatctccatactttggtgtatatgcctctcattagctccttgatgatgtaaaggacatgtgactatgatgagatagcactcctgtgattatattattttatcct

SEQ ID NO: 1967 - DNA, 201 bp, Bos taurus
gaggccatgaaggccccggggcggctaagctgactgtaggagcgcggggaggacgcgggcagaggaggcgcccacagctgtgtggaaggggcagagggagtgtgtctcagctctcctggcctggattcctgtttctcccttgctaacttcttccccttctctctcccagcagaggaagaagaaccccaacgaagtcgtgta

SEQ ID NO: 1968 - DNA, 201 bp, Bos taurus
ttgccagaaatctcacagttcagaccaaaatatcaatacttgggcccaatctcctatgtacatagggatctcttaaaatcattctgggggcctggagtcctgaggagtagacagagttgccagtgctgtccttatcttctgggtaatggcacaatccttcccgttctgctctagtaggaagacttagaagtgaaggcctga

SEQ ID NO: 1969 - DNA, 201 bp, Bos taurus
cccgtgccctgacctctgtacatgctcttctctccttctctcacctcttccctttttttcttgtggttccctcctgcccatcctccaatgtcagctcaaagggcctttcctcaggacaacctctcctcatccccaaatcctctgttatatcctgtcattgactgtgtaccactggttacgatgatggttttacatttatct

SEQ ID NO: 1970 - DNA, 201 bp, Bos taurus
gaatcgggcggcctaccgggagccaccagagcagctgacagagctttccagaagacaagaagaggagggtgaggatgactacaggcatgaagaccagaggcacgccggccgagagacccctgaccaggctggccgatgatccgggcctgctgcaggctggggccagtgggaggattaggggtcatccccctgcctccaggc

SEQ ID NO: 1971 - DNA, 201 bp, Bos taurus
gaatgcacataggttaggtgaccaccagagccccgctggtggccagttgcagcatcctaagttgcgactccaggatgggatgcctgaggcccactgtgctcgctctcagctgcagcatccccggggaaggatgagagcacaccaccctctggtggcggcagagcagacatcagccaggccaggcagcgcagtgtacccagg

SEQ ID NO: 1972 - DNA, 201 bp, Bos taurus
tacctatggccaattcatgctgatatatgccccaaaccatcacaatattataatgtaattatcctccaattaaattaaattatttttaaaaagaaccaaggcatgtgatatctgagagagaattccaagcagagagtctgagacaggcacttggactttttgaagaaggaaggaaagccttatgactaataccaaaaagat

SEQ ID NO: 1973 - DNA, 201 bp, Bos taurus
aaataaataaatttaaattaaaaaaaaaaaaaagcctcaaagacataactttctaataaagctcccagtgccaggttttgggcctattttaagatgtaatcaattgtgcttcaaacattttggggagagagcatggcattctccacccagctccatgaggtgtttatgaaataaaatgcgtgacctacttgatacttgtct

SEQ ID NO: 1974 - DNA, 201 bp, Bos taurus
gctggcaaccctctgtggatgagccacctctgtctgcctggctcccgtccacactggggcccccccccaccgggtggaagtatggcagagggcccagctgcggtcagccacacctgcccacctcaagcacagagaagaccactaagaaaagatgagaaaactatggtgtcagaaaccatgggccagagctatgaagcagcc

SEQ ID NO: 1975 - DNA, 201 bp, Bos taurus
ttccaggcaggagtactggagtggggtgccattgccttctccggctcccatccctaactaccctttataaaataagtccacttcttcagagaaaagggccgccacaggaattccctggcagtccatggttaagactcctcacttccactgccgagtggcaggctccatcctggttggggaactaaaatcctacaaatttgg

SEQ ID NO: 1976 - DNA, 201 bp, Bos taurus
aagagttagtgtccttcattacctatctctatgaaatgaactctttctttaatatcctgcagcagtatttcccaaaatatgtgccttggaacagtggttttgggaggaaaagaggtgttggaaacaagtaagtttggaaaaacctgtgtactatcctctgttcccactttaacttctaggcgggagtgacagggcacatta

SEQ ID NO: 1977 - DNA, 201 bp, Bos taurus
tgacaatttgtttttcttcccctgtaatcatcaacttgttatataactctagatttctgaagttaatttgcctaaaagttgtaactgtatttagtgaaatcttgctgataaatagcactagacttgtggatgaacaaatttcatttccttctaatcttggttgtaccccatatccgtaggataattaaaaatcttatcttc

SEQ ID NO: 1978 - DNA, 201 bp, Bos taurus
cagagcatgggctttgggccaggcagtctgggctcagcagctgtgctgtttcttgtcatcttgtgagctggttacttagcctctctgagcatcacgaaaacgaggtaccaatggccaaccgactgagttgctatgaggattactcccattagatgtgtcatgatgctcggcacacggtaaggcctcaggagcggtggctgc

SEQ ID NO: 1979 - DNA, 201 bp, Bos taurus
ctaataatcagcttaattccatgctttgccattgtgagcatagagccctgggtcttggtactctgtccagatcctctgcagtacaggccttcagcaaatacccatgccagctcttatctccgtgaggctactcagctcacttgtcttgagccatggtttccaggcatttcctctgacaatgttccctaaggccatacctta

SEQ ID NO: 1980 - DNA, 201 bp, Bos taurus
aataacattacaaataaacattacaataacattacaaataagcttcattggctaaaaggactttgagagatgaagaagggccacagaagcaggttggaaaggtggcttgattgagggacgtgtcggaatgaggctaattcttcacacactagtctctctccctttgttgagccctgcaactaaaggtctttaattatagaa

SEQ ID NO: 1981 - DNA, 201 bp, Bos taurus
aggctggctatttattcccctggccccgttcctgtgcagtcctgacatgctagctttgtcctttgaccaaagctttagctgctgtcagatgtcttttccacacagctttcttgggggcctgtaactgctcctcctcactcaatccctgagctttgaggtggaccagctccctgaagctccctgccgtgggctgctgtgcca

SEQ ID NO: 1982 - DNA, 201 bp, Bos taurus
acaaatgaataagacagaagggatggtaatgataatattaccattttatccaagtgactaacattgactgatctgatctgaacattgaagactacatgctgtagcttcaaccttgtggatttattcatgctaaagccccagatttaaatctacccactcagcctcagggagtgttgggctgggactggcatcctctatccc

SEQ ID NO: 1983 - DNA, 201 bp, Bos taurus
cacgacgcattgcatcgtctctcccatctggccccggagatgggaaggaaagaccaaattcagggtcagaccagcctgtctacttcctaagccctcaagattcagtgagagctaaaaacctccccttcctcacagatatcttatggcatccctgggacttttcttgttcctcagaatgcacaagcctcagaatgcaggagt

SEQ ID NO: 1984 - DNA, 201 bp, Bos taurus
aaagttcttttggaaagcataacttttggcagagtcaccttgcaaatctataaatgaatggcaaagtcaatccatgtttataagcatatatttttagttgataggaatattatatatatgtaaataccttttatgatggccattccccaaattctttaaaaataatattacattgatgatattgggtgccatagtccttcc

SEQ ID NO: 1985 - DNA, 201 bp, Bos taurus
attctggcctggggaattccatggactgtatagcccatggggtcgcaaagatctggacacgactgagcgactttcactttcaccagttgaagaagggatataaattaggccaagaatctgaactgaagtgtccaaatgggtgtgacagtcatcagatgagcctgacatgacgatcttatgcaaggaaagggaaaaaaaaaa

SEQ ID NO: 1986 - DNA, 201 bp, Bos taurus
ccaggaggggtatgggatggtatgctcaccctctttctcttgctgccagataatactttccttcagaattcagctccaaacactcccaatgctccatacatgcaactctgacccaggaggcccaggcaggaagccccttcagaatcgaccctgagcagatgacctcactgagaagcgtcgcgtgcaaggtgccggtcagag

SEQ ID NO: 1987 - DNA, 201 bp, Bos taurus
aaactatttattttttaaaatagaaacacagagagccctcaaaaagaaagccaccctgcatgccctcagagcccctccttcctttttttatgtgtaactatcaatgtatatcaactgggcatgcaatcatatttattgtcactttcattcatgtcatgcccttgcttatatggtttagatatgaattattgactgttacac

SEQ ID NO: 1988 - DNA, 201 bp, Bos taurus
agagaaacctatggagcttgggttattgatcaaatgcagacacgtcattaaactggtttttatcttctgccttgcattgcactttccagagagagacaacggggagtttgaggtggttcactatctggtgatgtagacataggaatggattagtctccattaaaagcaacaggaagagttttttttttttttttaatagtc

SEQ ID NO: 1989 - DNA, 201 bp, Bos taurus
tttccaaagaaataagagaaaaatactgcttccaagaaacaaatactagcttcatgggcaggaaagtttacatgggctccaaagactgtgtgaagactttcgtttaattccacttagtgcagaatacaattataatagaatattcagggaatgcttccttgaaaaatactgcttccagaatacaattataatagaatattc

SEQ ID NO: 1990 - DNA, 201 bp, Bos taurus
cagaaatgttaagtccaagctaatgttttgtgtaaatcctggaagggcattgtcaagtcttattttgtagtcactagctccaaacaaagggccttttccagtttcactatttccactcacctttttcaataatgtcaagatgatacagtatagactttagcgtggcctccaaacacataactatatagttgatttcttttg

SEQ ID NO: 1991 - DNA, 201 bp, Bos taurus
gtccataagtatattaggtccatgttaaaaaatccttgatattcgatcctcttaaaacctccaccctcagaaaacatccctgggttccaatagcctatgatatttatttatgtttttggtttatagaattaatatgtaaaaataccatccatcatgttttattggtccaataattgtgttatgtctatattgccactaata

SEQ ID NO: 1992 - DNA, 201 bp, Bos taurus
ggtcactaattaaaatcaattttatgtccagaagagacttctatccaggtgtgtgttatgacaacttggcgctccaaatatcaactcattaaaatgtctctatattgctcctcttacttcactgtttccatgccttacctccccttcaaagcacacacacgtgcacacacacacatacacacacacacagaggtgagctca

SEQ ID NO: 1993 - DNA, 201 bp, Bos taurus
agaaatggtatgtaaaaaagtatcaatatattgtaatatagtaaatgtaatatgtgcactttaattttagtgtaccctagcatgtggatgtgaatacttttctgaagctggtagttgaatgaagccctcctttagaagtttaataataataagattagcaatgataaaatttaacatttaatagactcttagtgagataaa

SEQ ID NO: 1994 - DNA, 201 bp, Bos taurus
attgatttccacattcattcctaatttgtaaatcacagattttcctgggtgaggcctctaagcagtctgatcattttgctcttttaggagctttgttttaggagcacagggtgagagatggaggggccctgagagagagttcagcagccaccttttaaaataaaggaagtggggaaaaaagtctctctatttctcccaatt

SEQ ID NO: 1995 - DNA, 201 bp, Bos taurus
agattcaattagtttaaaacatgactgatttgcaaatccaggaatatatttcataaaataatgtacattcaagtatctactttatgtcttaggacagatgtgtgatgtctagtcctatgatatatacataaaacacaaagatgcaagggttagctgttagaaccagagttcagaggatccatgtagcctaggtgatatttt

SEQ ID NO: 1996 - DNA, 201 bp, Bos taurus
gattccatgcttccaaagcaaggggcacaggttcaatccctgatcagggaactaggatcccacatactgtgggtatggccaataagttaataaaacaatttgaaaaagaactgtgagacttaagaatccaaatgaaggagccacggttaggcatttgttaaatatctctacttttctgcttggcctatctaggtgatagtt

SEQ ID NO: 1997 - DNA, 201 bp, Bos taurus
ctaggacactggtaggaatttactttggcaggatacattctactcctaagaatctacagttaccaccctgagggcaatcctgaaatgatgagaaatggacaaaaattctcccacctctcatgcttcaggtagacaattctgaaaggtattctgtaagttcgttaggttgtcccagtgaaggccagacctcacacaaaggtg

SEQ ID NO: 1998 - DNA, 201 bp, Bos taurus
agtttcagggaatgactgacaaaatcacaaataatcattgcagggtaatcatagctcaggagctgctccacacagttgttggcatgactgcctgtgaagatgtgattacaggatagaaaagtccatgcagctggactcacgatagagtggaattctttgcagaaaattggtgaaccactgcaagctcttaggttgaaggta

SEQ ID NO: 1999 - DNA, 201 bp, Bos taurus
gccatcaccttaccagagatccaagtactcaaggccctgtatattttggccattgaaatgataaattattgaaaaaacagaaactaatttcttttccatgcttcagttctatgtcccaaacaaaagtacaataaattaaaattgaatgaaaattgtgataaagcctcatgtctaatgaatttgagatgagaaggaattatg

SEQ ID NO: 2000 - DNA, 201 bp, Bos taurus
acaggaaagcctacattttatgcagatatttatgattccaaataattcagtttagggggtcccatgcaccaggtagtgggcttcccacattaatgactgcgatgatttggtggtttgttgcgcctaaaactgagggtgtctggacaatccaaaccagtggtatttttaggtagtatagggcttaacagggcagtgtctgaa

SEQ ID NO: 2001 - DNA, 201 bp, Bos taurus
aatataaggcttatggccatgtcactcaatacaatgaaatatctccctgatctttatctgcttttgtccttgtttaagcaatgacactatcaccaacagacatggcctacattgtctacacgagatcacacaactctctcatgcatatactccaccctacgtccccatcaagaaaaaaaccctgagagattcctgagcagc

SEQ ID NO: 2002 - DNA, 201 bp, Bos taurus
ctggacaaggtttctactcatgaaaaccaaatgatcacatggtaacagtgctacagatgttggaggacaatacaatattaattaactcttaaagatgtgtgttgatttcaaagaggttttagggcagtttatctgccctttcctatttgtaaaactgaattgaaaagattttttgtggaattcaggatggcctcagcaaga

SEQ ID NO: 2003 - DNA, 201 bp, Bos taurus
acaattgtatacttcaatttaaagtatacacataattttaaaaattgggagaaggggactaacatatctatttttgagcatggccacaccctgtaggaaagagaaactgcctgagatcctacaagaccagggtccccaaagcataacatgacacccaagttaaatacaggccttagccaaccaaacataactgggaaacca

SEQ ID NO: 2004 - DNA, 201 bp, Bos taurus
acagggtaaaataattcatcctctaagacgtcaattcttaactgggctctcaataacctgcatggcacccacagggaaaaccatatgaggagccttccagcagggcaagatagaaaagtgttttccttaggaaaataaataaataaataaaattttcatttagttacgaaaacaaaaaattcataacctgtatataacttt

SEQ ID NO: 2005 - DNA, 201 bp, Bos taurus
ctgctcgactctggggaattcagcttctctggggggccattattccagacttggaggaatatcctactgccttagagacctgtggttagacctgggtgtgactctgtgggccctagaactgaagatcaaatcaccatgttcccagggcagaaaccacttcttcagcctagtttcctaggcaggagtcgcactcagtctcag

SEQ ID NO: 2006 - DNA, 201 bp, Bos taurus
tcctcggcctttgctggggttccaagttacctcagctttaattttcacctgcgactctcattattaacaagctgcatacttccttttctggatccaaacacaggcactagcaagaaggcctagggaaatttttctatactaccagaaggcttatgaaatcttaatgagaggacgatctatcagcctaaacacgttcagatt

SEQ ID NO: 2007 - DNA, 201 bp, Bos taurus
ttccgtggaccaacagcaaggtgtttacaaggctgtactccttccagaagctagaggagagagtctgtaccttgcctctttcaaattgtagtgggcgcagcgttccttgccctgcggccgccttgttccaggtttcaaggtcagcgtcatcacatctccacctgctgcttcctctcatcattttctcctctgtgtgtaaca

SEQ ID NO: 2008 - DNA, 201 bp, Bos taurus
tggcatgaaaataagctatgcgttttaccccatttagtctaacatttgtaacattcagaagtggtcatataaacattttcttttgcatgagtgactaattgtcttatacattcttcactaataagagtaaatgcttgatgaaggagagagaaaagaatagaaagtctcagtcacatagattcaaacattccacatgtaatg

SEQ ID NO: 2009 - DNA, 201 bp, Bos taurus
tccttctttagaactgcagtatcctcttctacccaagaggagttcaggccagaagacaccagatcctggcctctccgattcactgccccaagtcccaggcgagacaatgaaaactaaaggcgtttctggtaatcggactctgagtcttcctctgcaacatccgggtgcgagaggagtgaataggtgactgtgttctcagcc

SEQ ID NO: 2010 - DNA, 201 bp, Bos taurus
ggccccagggcgggccggctccccgccatcgttcctccgggaccaccaggatcgggaaaattgcccgacaagcatttaaggaagcctggaactttggcccgcagactccggctttcaacatcaacaacactggctggagctgcacttgcgcctgaagttccagataaggcaagatggggctcctctggtgctgcggccatg

SEQ ID NO: 2011 - DNA, 201 bp, Bos taurus
ggtagatttgaaaacagaggggaataacactaatgctttattcttgtcaagatcagggtttacaaaccattgcccatgacctgttttttatggccagtgagctgagcatgggtttacatatttaaaggttgggaattctctgtggtccagtggttaggacttcaagttttcactgtcaagggcccgagttggagaactaag

SEQ ID NO: 2012 - DNA, 201 bp, Bos taurus
agaactcaccatagatatataagatgaatctctcattgaagtcttcagatcccttttggtttatccgggctttgtatgaaccagcatctttcagagtcagcttgttaatagacaaagagttgttttttgggatgtttattcgccctttgtagcttttgtctaaaaacaaaatctctccacttgggaatgctaaaaccaaag

SEQ ID NO: 2013 - DNA, 201 bp, Bos taurus
tcttggtgacagctacccttcatcagaccacttcaggggtcccatagaaatctgcactgttattttgggctagtcattagcttgcagtggatgagggccacagtgataagtaaggtatttatctattaatttgctaaatataattcaacccctccagctcttttgtctgtgacacattgctgcttatggggagctggtagg

SEQ ID NO: 2014 - DNA, 201 bp, Bos taurus
ggaggccacggcgctttcagcccctggggccacgttccagaaaaaagaacggctgtccagctggatgcagcagacaaggcagagggggtgcactttgaaattggaaactcgggccagatcctagtccccccttcccctgctctggccaagaaaacatccatatcctggggcaatggctagacacccacagtccagatcctg

SEQ ID NO: 2015 - DNA, 201 bp, Bos taurus
aaaaaacaacagtttaacattctgatcaggactgatatattttgctttgcctgtaagtgcctgagccatttgctggcattgggccctacgtaagaatgccgtggaacaaggttctcagttaatggcaaagcaagtacagtaatgggcacatgacagtggggcccactgctcctaaaaatacctttttaccagaagcttctg

SEQ ID NO: 2016 - DNA, 201 bp, Bos taurus
tagcaaccatggtcactgcctgggggcttttggacagataggcccgaacttgttacaacttagccacttaaaagctgtgcggcctagggcaaaatgcttaacccctctggacctcaggtgtctcatctgttaaatgacaccatctgccacaacattctgtaaaggctgtaagtaatatccaaaagggccttagtgtgcagg

SEQ ID NO: 2017 - DNA, 201 bp, Bos taurus
gctgtcccctactctgggggaaagatctgtctccccaacatcgccccatatgcagtctgtggatgcatctgtttgtgtgggagggttagttgtcaggcccttggcatctcccacctcgtccctgtgccccactggatggtgggtgccccatctctgtacctgcacctctgtgcacactggcttgggctagaagggaagggc

SEQ ID NO: 2018 - DNA, 201 bp, Bos taurus
tggtagccgtggcccacggggacctgctggagctgggccccccggccaaccacaccccctgtgtggtacaggtgcacacactcaccggggccttcctcttctcccttgagtcccagaccaccattggctatggcttccgctacatcagtgaggagtgcccactggccattgtgcttcttattgcccagctggtgctcacca

SEQ ID NO: 2019 - DNA, 201 bp, Bos taurus
tgcaggccttgatggttaatgtagagaacattttgctgtgggcaagagaggaaggttgtttacagctttctctccccagacagtgacactgtggtctggcacgctacgccctatggcctgaccttctgggggtggccccggtaccctctgggctggcaatccacagatggggtcttcaagggatttcccccaggaagggtg

SEQ ID NO: 2020 - DNA, 201 bp, Bos taurus
aggaagaaaaggaagggcacaggggagaaggtggaagagggcattgagggaggagctggcagagcagctgaggctgggaggtgagagcaagggcccctgcccaagtcccatcggacatggttgggcatttgagccaagttttgctgagaagggaaaggttgcctcctacttatcaggggcggaactgctgggttttgtgag

SEQ ID NO: 2021 - DNA, 201 bp, Bos taurus
cagctgttgtgatcatcccgactgaagtagaaaggaaccctctagggagaaaggggcagagctggagtcatgatggaactaaccctaatctgcctataggcggagaggccaaaggaggggatcagctacatgactccactgtcaatttcctcatccatgtgtcagatatttattgagcatctacttacttgccgggtgctg

SEQ ID NO: 2022 - DNA, 201 bp, Bos taurus
tcggctcttcgcatcagatggccaaagtattggagcttcagcttcagcatccatccttccaatggatattcagggttgatttcctttaggattgacccaatggccctgattttgcctatctattaagttttggcccagagacacccttggagatgaaagagacatggacaagactcaccaattttcccaacacagggaact

SEQ ID NO: 2023 - DNA, 201 bp, Bos taurus
aaatgcctttccccaaggtgctccgtccaaatgggaggtcttactatggctgagggttaggataccttgtaatatatgaggacagggaaaggaaaaccccggagggcccacatgatgactgagtgaggaaatctttacgctggtggtggaaaattataatctagtctactcctgggtttggctggatgtcctgtttaaaaa

SEQ ID NO: 2024 - DNA, 201 bp, Bos taurus
caactcagatgttcttttttgccatgttggccattaataattgcttcttgttcacagtaatgggctatgaccgttatgtggccatctgcaagcccctgagatacacagtcctcatgaacaaaggcgtgtgtgctaggttagtctgtgggtcctttggcactggccttgttatggcagttctccacgtaatggccatgttca

SEQ ID NO: 2025 - DNA, 201 bp, Bos taurus
tacagatagatctgtgatatggccctgccaatttagttgcagtgcaccctacaaatgtgtactctgcatttcatagactttacggttttcctgagggcggtatgatgtctatctttactgaatccaaaatagatctgcaggattgaacaaaatttgcttaattatacattgttctttcttttggccaaaacattcttttgt

SEQ ID NO: 2026 - DNA, 201 bp, Bos taurus
accagctacactgcagcactgagcaactgagctacactacagacagctggggtcgataggtcgtatttagtgctggccaagaggagtcttggagaaggcaatggcaaccccctccagtactcttgcctggaaaatcccatggatggaggggcccggtgggctgcagtccatggggtcgctagaagtcggacacgactgagc

SEQ ID NO: 2027 - DNA, 201 bp, Bos taurus
gtgatcccctcttgccttctgtgacggtggtggaaatgtacttagaggccacagagtctgatgttagagagctgcttggggcgcccgcgttatcatacgtctgcagaagaccatgtgctaccaggccagatggacaccacctatttctctgccaacatcctgaacttgtgggcactgagcagcagccagagggttatgctc

SEQ ID NO: 2028 - DNA, 201 bp, Bos taurus
agttttaccttcctgagttactttgatggaacaccagttctgatattaactctttcctgacagcccaatggatatggcctttggacctgaaatccctggacagcccttctggagccttttatttttagctcagtttatcctacatctttttgctttaaggtcaggcctgaaaggaaaaattggtctgtgtgtgtggatagg

SEQ ID NO: 2029 - DNA, 201 bp, Bos taurus
gaacacagtaaacttcaccctactgactttgtgacttgctccaactgatgccacgtgggcagaagtgacagcacactggcctggagcagtggctttacaaagcatctcatcctttgtctctttagcactcagaacatccaagaagagaagagcaggcccccaggagctgttgcttctttttcagactcctggtttgagaga

SEQ ID NO: 2030 - DNA, 201 bp, Bos taurus
tccaagtagcctaggcaattttggaaacgaatatcaaatttggtggtctcccacttcctgattttaatcaaagcagtgtggtattggtataaaggcatacatggaacagaccaatggaataaaacagacagcacaaaaataaaccctcacatatatggtcaaattatttttgacacagttatcaagatcatttaattaaga

SEQ ID NO: 2031 - DNA, 201 bp, Bos taurus
aacacagcaaggtgtgcagcacaggtagagaaagctttgtggcggccttcagctgagggcatttgcagaatcaccacaatgatccggaggtaggatagggtgatgaccaggaaggaggccaggatctccactgcatggatggcatccataatgaccaccagggatgtatctgtgcaggccaagctcagcacaggggtgaag

SEQ ID NO: 2032 - DNA, 201 bp, Bos taurus
tacagatgaagaaaccaggatctgaattgtgtagtgagttgcccaaggttaaccgattatttagatctgtttaacatagagttagacacatgaattctctcgggggaaagtaaacactgggcttgaattcattccctgtcctgttttagtttgtgtgactctgaaaaattcctgaattatctttgagtcacacataagttt

SEQ ID NO: 2033 - DNA, 201 bp, Bos taurus
ctcactaaagggctctactagctgtggcccagaccttgaggaacagtgaacctcaccacccccccaccccattcctatctctgtgacccactagcagtgggttgtctttctgggccacagtctgtgagacttggtttccccatttgggtgacctgaggagactgaacaccatttgggttggattcctggctctctcaggga

SEQ ID NO: 2034 - DNA, 201 bp, Bos taurus
caatgccacgtggccaagttcaaggcattgtcagggatatactttccacaagacactagcaaaagtctattctttacctcctttgtctctggcactgctggcattctttgtttcatggccacatcactgcagttgtcaaggttgaaggttggaatcttcaaatctctctattttccatcttcatattgccttcttctttgt

SEQ ID NO: 2035 - DNA, 201 bp, Bos taurus
caaagacaggaaacccagaatttaggggaaaagcaagatacctcagcaaacatttggcagccccacagacccatacatagtagacaaccttcaaaagagctgtggacctggagtcagtgatactggaatgaaactaggctgatattctcgatctctaggttggggaaaccactctatacacacatgcataccacacattca

SEQ ID NO: 2036 - DNA, 201 bp, Bos taurus
cattacttgtaatggctaagaaaaggaaatggtctatcaatttataaataaatttatggataaacaaaatcaggtagggccataaaagtgtgtcagatcagatcagatcagtcgctcagtcgtgtctgactctttgcgaccccatgaattgcagcacgccaggcctccctgtccatcaccagttcacccagactcacgtcc

SEQ ID NO: 2037 - DNA, 201 bp, Bos taurus
agcacacaaatttagttgcactatgtgggatctagttctctgaccaaggattgaacctgggactcctgcattgggagccccagtcttagtcactggaacaccggggagttccttgggatcaatcttgatttttcaccccctggaaatgataggcaaggtactgagggtgtcttcctgtgggcatagggacagagaatagaa

SEQ ID NO: 2038 - DNA, 201 bp, Bos taurus
cccatctctgggcctcagtttccttcacctgtaaaaggagaggaccaagctagatagacagtgctccagcttccctccagctctgatagtctgaggctctcaactaaacataactttggccttgcctttaaccaccccacagccagccccacaggaacccacccaccggctctggagacccatccacagacccttataaat

SEQ ID NO: 2039 - DNA, 201 bp, Bos taurus
ttagaagagggccagccttttttgttctttccagctttcaattgattgatgaggtccacccatattaagaaggacagtctgctttactcagttggccaatgcaaatgctaatctcattcaaaaacaccttcacagacatacctagaacagtatttgtacaactgtctaggcaccacatggcccaatcaagttgtatgtaaa

SEQ ID NO: 2040 - DNA, 201 bp, Bos taurus
tatgcgtgactctcttcctctatttatacaggaatacttgttttcaaatataccctgttcccactgctgaccccatgaaagcagaattgaaagccccattcggtttctgtcaggcctggctcacagatgcttatacaacatttattcagtagatgtttactgagccctgcctagatatctgtcatgtgccagatgctcata

SEQ ID NO: 2041 - DNA, 201 bp, Bos taurus
ctgggcctgatgggggaggatggactctagactgtgtggccctgatggggctctgtccactgatcatggctctgcagcgtagtgactgaggcccatttcatctctcagggactggctagggaagtgctgacttggtagcagagacagcagagctcactaaatgatcacttgcttcccacgtattctattccctagcagtta

SEQ ID NO: 2042 - DNA, 201 bp, Bos taurus
gggtgtatgtatagctacagtacagaggagttaagaggcattttctttcaaagagaagtaaagggcagcatgtgtcaagctgaaataaaggaggaaggcctccaggaggaggacttcaggatgaccttcaggaggcaggtagacctgactaccagcagggggaagggctgcttcagtagaaagagctgtagctgggaagcc

SEQ ID NO: 2043 - DNA, 201 bp, Bos taurus
cactccctcttttacctcctccccacctgggtggcccacttgccccatcctgcctcagccctctcctgcctgatgagcttgcacatcccaattgccaccatggcacccgcactcctgggtggccagctcaccctgagcactgcacccccctcccacctggatggacttgtgtgttccagcagcctccagagcagaaagctg

SEQ ID NO: 2044 - DNA, 201 bp, Bos taurus
tacccacagctgaatgtgatgtggtttccggctgtcagggtcacaccaaggccattcaagcatcctctttctgcaccctctccactctcaagctccatcgttgatgctaagggcacatttgcaaggccacagcccaaggctaacctgaagatccaggacaactctggcccttccagagaaaggccccaggacagatcttat

SEQ ID NO: 2045 - DNA, 201 bp, Bos taurus
gcaggacatgtgggcagtgctgacttaagaaccattatgagactatttcattattttaatgactggttgttaaacaatgtgtactgtggaatacataccaaggagggaccgttccacccccgtgcctgcctctcctcactccccagctcctacacagcatgctgttcacccatcgggccatggcggagcagctggctggac

SEQ ID NO: 2046 - DNA, 201 bp, Bos taurus
taaatgtctttgctgatgcgtttttgttttgtttccttttaatagttttgttctggtatagttgatccacagtcaatgcacacatttaaggtgtataattctgtgcattttgacgttgtgtgcatctgtgacactgtccccatagtcaagaaaaggagcatacccatcagcccctagaagtttcctcgtgcccttttgtaa

SEQ ID NO: 2047 - DNA, 201 bp, Bos taurus
atctgagaggtgaatcccaggagctttctagagggtaggagttggaagccgccctcgaaaagaggcactttccaggcccggatgacaggaagcttgtgggcacaggcagagggcaaatgtagggacgggaaaggcaccgtccagtttctggtggggagctggggcatccttgcctttttcagcttggcaagctgggcctgg

SEQ ID NO: 2048 - DNA, 201 bp, Bos taurus
gggcccttgggagagcagggaagcagaatgagaaccactcgccctctgagttaactttagccaaccaaagaggctggaaacatggaactcactggttcattatgggaaagaggctgagaggccactcaaaggacttacgggcatgtgtgggcttggatgaaaacaggaaaccaaagaaagctcagcaaggagttatccaaa

SEQ ID NO: 2049 - DNA, 201 bp, Bos taurus
tgcactgggaggctccccttctgtttggggcttgatgacttttgttgtagttggagctttggtgttcctgctgatgtcatttccatccacatacccccgatctgatccactcagtgttgtcaccagatccgatttgtaacccactgagaggccagagggaaataatcgccctctcccaacctctttctagtggtctatttg

SEQ ID NO: 2050 - DNA, 201 bp, Bos taurus
agctctttgtggctgtggagatgctctcagctgtggtcctgatcaaccgggctctggaagccaaggatgctagtggcttctggagcagtctggtgaaccctgccacgggcctggccgaggtggacagggagaacgctcagcggtaagaaaggtgtagcagcatgctgagggaggggatgggtgatggagagagtgtagcca

SEQ ID NO: 2051 - DNA, 201 bp, Bos taurus
gaggagaggaggggggaccttgtcagttggagggtgcccctgcccttctcagatctgcctctgactggggtcagcattcacatcactctctggccttctttatttgttctacaccttcccgtggagtcccaaagcccagctcacagcccgccctgagcactgttcttaggtcctcctcccacagggactggccaactttat

SEQ ID NO: 2052 - DNA, 201 bp, Bos taurus
tctcctcggctccctctttggttttaaggcagatacggagtttctcggaagcagggagaaaagggggggaattgagatagatgcgcgcgtttttttttggtttatgtttttccttcggtataaaaccactgtagaaaataacttctcttagaaaaacaaaaaacaaaacatagaagaaaaaacaaagggctatttttcttt

SEQ ID NO: 2053 - DNA, 201 bp, Bos taurus
atcccactcttcaccacctaattctagccccgcctgcctcccacgtgcctcttgctgcctccctgcattggagctcttcctgtgccctgcagccaggcctctctccacacccagcccacagttcagtcagtcgctcagtcgagtctgactctttgtgaccccatgaatggcagcacgccaggcctccctgtccatcaccaa

SEQ ID NO: 2054 - DNA, 201 bp, Bos taurus
agcaaacagccaagacatgagacagcagttgaagtttattcttgggaagaacaaagtccccccactccaatctcctgcaacagtccaggaaggtttccccagggagccgtgccccaccacatggtcatctcactcttctgaatcccaggttccaccaacgcccattatgatgctgctacttgggtgagaggctcctccaaa

SEQ ID NO: 2055 - DNA, 201 bp, Bos taurus
catatggtagcctcatgtctgttgaaggcccagcaagctcccagctcccagggaaagaaagcctactttcgggaggaggaagagaaccgtagccctgccatgttcccagaggcccagaattgagccacagtaggtagcagctatcctttcgtgatcagaaagttttgagaagcaggcatcaatcggcagagtggagtaagt

SEQ ID NO: 2056 - DNA, 201 bp, Bos taurus
gaaccaatgctagctcagtggagagaaggcaggatggagggctctcatgcccctcttaatgcaaacagggcagagaggaggaacggagagagaagtacccatggcaaaggttttggcctgtgtgaggggcctgaaaggtcaagcagttgtatgctatgaatgctaagttgtttcagtcgtgtccgactctttgcgagtcca

SEQ ID NO: 2057 - DNA, 201 bp, Bos taurus
agcagggccgttgggcccgggccaacaaggacacctccaggctgctgttgctgtatgatgaggacatcctcaagtgagatccactccaggaacaggaggatttggcctttgctcaggcttatctgaccagggtaggcaaatgctgcttcctgttcctgccagcccctctcaacaagactgattttccttcaggggagatgt

SEQ ID NO: 2058 - DNA, 201 bp, Bos taurus
gggcagtagttaggtaacatggaacggtatttgagggggagccatttcttatgttcaaattcttcactggcttctaatcttactcatggaaagcagaaggatagttttagagaaagatagactccaggatggaaggactagattttggtttgggcaagagtccacgggagatatcaaggcagtgttcatgggggggttagt

SEQ ID NO: 2059 - DNA, 201 bp, Bos taurus
tcatctacctctgccacccgccccagtattcatgagaacctgtaaaaatttccctcatcaaatgtgatcagcccccaggaccccaggatggcccagtgcccacttcaggcaaagggagctgacaggtctgaatcggagggggtgttcctgtccctggagtactaaggaggccagcacacagttcaggcggcactgcccttc

SEQ ID NO: 2060 - DNA, 201 bp, Bos taurus
aatgtttacacagcgcctggtgctgcaaaatcgctccgtgagcaggaactatcgttactatgagccaatagttctgagggccagggggccaaccccgggagcaacagaagcccagccctcctgccttccctcctcacccggtgagtgtgacgctgtcccagggagggctccggtagagcctgagggagcacagatgtaggc

SEQ ID NO: 2061 - DNA, 201 bp, Bos taurus
catatgagccaaggtctgggtgctttggctgtggcactggcaggcctggaccagcccctgagagcctgcccgagactttgtcactcttcacgtggccagagcccgcccccggaagtccaaggatgtgtgccatctggacgcccaagcttgtggaaagaggttagaggttagaggtggctccctccacagccagggcccaaa

SEQ ID NO: 2062 - DNA, 201 bp, Bos taurus
gagctggcctctccaaggccatggacagctgcccaggttgaggttgaccgtttctaaattgatgcaacttgaacaggtcacacttccactgcagaccattcttcattcttgggctgggaagacagttatattgtcttcctatatatgcttttattaaatatgccattagacaagatgggttcttccacatgataaccatat

SEQ ID NO: 2063 - DNA, 201 bp, Bos taurus
acttcgtttccttccccagactcatatactattaccagtttcttgagtccatgcacatattagcctgtttttctttctctgttttttaaaataagtatatgtcatcttctgttctacttcaccgtgtgcctcagaggtcattacaaataagtgtgtatagacccaccacataaatgctccattgaatagatttacagtttt

SEQ ID NO: 2064 - DNA, 201 bp, Bos taurus
tcccctcacccctccccgccaccactcaaagtcccgttcagtggccaccccttcagaggtgtcctccctgattaactgcacggggagtgatgtgcttcccgtcttcatggcactctgggcctctggggtatctcactgggatgcagtggtgtcttacactgtctgcacctctcctcctgcaccagtctgctgcttttgaag

SEQ ID NO: 2065 - DNA, 201 bp, Bos taurus
ttatttttctctcataataaaaagtcttgatttgagcagctttggcttgatgtagttggggtttctgtgattcttatggcccttttttcttagttgaaatttgcaactcgagtcatcatatccatgttccagtcaagaaagacggctagttttttccagaagcccccagacacactacctcctacatcattggccagaact

SEQ ID NO: 2066 - DNA, 201 bp, Bos taurus
ttaagaatttgactttcagtgtaggggacacaagttccatgcctgatcaggaaactaagatcatatgtgccccagggcgactgagcccacacaccgctcgctacttctgagcccgcacaccacaacagagcttgctgcgtgatgcagtgaaatcctgcgtgcgcaactaagacctgatgccaccaaagatgtatttttaaa

SEQ ID NO: 2067 - DNA, 201 bp, Bos taurus
cccaggagttggccacttctgagcagagaatcctcaaggtcattctgcttctagcaggctttgccctgctcactggcctgctctttatccaaatctagaaagctccaagacaggcaaggaaggttgggtaccatgtgcccttgacctccctccccctctcccagtgtgtggggaaaagcaaggagtggggaagggaggtat

SEQ ID NO: 2068 - DNA, 201 bp, Bos taurus
ccacaccccacccctcggcccgtcagcttccctaaccactcgccaggtggaggggtggtgctttgtgccaggtactgtaggctctgggggaatcttgcccggattgtcatcacggtagggcctgtggtgccagattgcatagccaggaattgtgtttactcaggtcccaaggagggcctggactccatcttccctgattct

SEQ ID NO: 2069 - DNA, 201 bp, Bos taurus
ctgtccattaatagacatcattaaaaggataaaagacaagccgtggactgggagaaaatatttgtaatgcacatatctgataaaaactgtcatcacaagatgatattaataagtaggtaggtagatagagatatataaaacacaggaaactctcatttgaaaagtggacaaaagacgtaagctggcatttcacaaagaagg

SEQ ID NO: 2070 - DNA, 201 bp, Bos taurus
tttagggaattaggcatactcatgtttggttgttggatgtacgtgttggtaacctttatatggggacaatttgaaatagatataacaactacaaacatatgtactctttgactcaggaatctcacttttaggagtttatcttgtagatatactgcatgcaacatgacaaagatatgagagtacacatttggtagatgaatc

SEQ ID NO: 2071 - DNA, 201 bp, Bos taurus
gctggagtttattgggacacgccggcaagctgcctctccagttgtcggatccccagaggaaaggggcggttggtgtggcttggcctccattgttcgggatataggacgccatgcggtaagggttgtggggtgctttggagatgtttcgggtattcgaccgaaaactttaggaagttggtccaaaggagtcggcggactgga

SEQ ID NO: 2072 - DNA, 201 bp, Bos taurus
ggcagttcagcctctctgcattttcctattccctgccatcatggccctttcctctcctgggaacccggaactctgctccaatcctgggctgtcacaaagcattaaaccccaggcagcacttaaccccattgtctctccctactcttgaccatccacagcgcccagcagaggacaaatcattagggagggagagagccttgg

SEQ ID NO: 2073 - DNA, 201 bp, Bos taurus
gcaatggacatggccaacatgaacaccaccccagctgccgtcgaataccatgccaggccgcaggccattgatccgtacagtgttggtctggctcctggccgtggaggagttgaacttactgtgttccttctcacagtaccggatctcatattccaggatgatgccattgggctgctcgagctgtggccatgacatgatgct

SEQ ID NO: 2074 - DNA, 201 bp, Bos taurus
gctacgcggccatgagcaaagaactctagcccatccaaagtagctttctgggtctctgtaatagaactattcttagaatgcccaaacctctctcatcagagtctccctgcactggcctgctgggggtcagggacacttgaacctggcagtaccaccatctcacagccagccatttaattcatatctttgtgcctcatgttc

SEQ ID NO: 2075 - DNA, 201 bp, Bos taurus
gttcgttcagaaaccccaaactcctaagagtcccagcacagaggaaatgtttggttcttaatgatagggacaggatcatttaggccctaaggcacgtcctttacagaatttcctttgaacttaacaggaagctaacggagactaatttaacttgaagagggccccccttgaatatggtgagataggaaacaaaatttagct

SEQ ID NO: 2076 - DNA, 201 bp, Bos taurus
gaggttaggggaggagaacctctcactcacatccctccaactctcttgtgctcatgagtcatcctgtggcctcaggccagtccttccaagttctgcctccttctgtcctcaggaaaaaatgggcattgtaaaaatataagcacagcaaaaagctgaaaaggttcagactcctcacagcaaaaggccactgagatgccagat

SEQ ID NO: 2077 - DNA, 201 bp, Bos taurus
actatgaggcacggccaaaaaaaaaaaaaaatttttttttttaagtaaatggttaatttagaaggaaagaaaaagctgatttgagtcctaggtcttctgcttaggccggtcacttcatctgtttgagtctgtctctgtgtctgacaagtgggaaaattagtgacccctaccctgtgcctcacatgtgagaataaaatgtga

SEQ ID NO: 2078 - DNA, 201 bp, Bos taurus
attgagcagtccattgacaacatcccagaagcctaggggaggggcttgcaaaggctgtgatgagaatgcttgggaggtacttgatacagtacttaatttgagggctctggagtcaagtagaactgagctcaaatcctgcctgttattgtcaactttataacttattgataagaataggtaccacctattgcccaatttcta

SEQ ID NO: 2079 - DNA, 201 bp, Bos taurus
tatgactttcaaccataatacctccagccacagttaacaagggttgattacttgggaaggagtaatagtcctcaaactttctagttccaaggcaatcagggtacaaacataatcaacacagacagacttatttctaaataaataaatcttatttgtcattcaataaaaaaaggtataataaggcttaaggttttcagacat

SEQ ID NO: 2080 - DNA, 201 bp, Bos taurus
ccaatcagtactcataaggttttcatggtcaatcccagacaaatccagagcaacaaccaatctgagtcatgggacagttacgttcccagctgaggcccagcagcaacactccgcctcttgtttcagctctcatcctgccaagtgtcccattcacggtctacttagtgctgtttttcaggtttgtttttgcgggtgatttca

SEQ ID NO: 2081 - DNA, 201 bp, Bos taurus
tcttcattgaatttgtacaacggcaaattcacaaccaggacttgtccttgtctatgattgtggctattgatgaggtctccttgttccttgatacggaggtactgagcagtgaagaccgaaaggagaatgctctgcagacagtgggcacaggggagccttggtgtgacgtggtgctggccattctggcagatggcactgtcc

SEQ ID NO: 2082 - DNA, 201 bp, Bos taurus
gtatcgagcgccgagcctagagaacggcgctgggtgaggggcttggtggtggcagcgcagtctccataggcgttatgagtttggctgggggccgcgccccccggaagaccgcggggaaccggctctctgggcttctggaaaaagaggaggaagatgagttctaccagacgacttatgggggtttcactgaggcaagagccg

SEQ ID NO: 2083 - DNA, 201 bp, Bos taurus
aaggcctgctcccagccagtgtcctgctccacccaaacttcagtcaggggacacaaatgacagtgaagtttgccaaaagaaatcaagcatcagcgagatgttctggccagaattcaggaagaatgaataggacagaaactatccaagcgatcttgttttgcacacccaggacagagctaggggatccaggtgcaggcatca

SEQ ID NO: 2084 - DNA, 201 bp, Bos taurus
aatgtagcgcataaagcatcaccaggcgggcagcatcaaactctgtcactctggggttctgcaggagcctctttacgttctgaaaaaacagagaactgttctttatcctcccttcacttgggtgatgtataatatcttagttctaagaattattgaatggtagtgatacatctgactaagatatcatgactaagatcactg

SEQ ID NO: 2085 - DNA, 201 bp, Bos taurus
gatggacactggttaagtggccaacatgttgctacagcttttgaaaagaaaggaaaatagcaatgaaatattttaggaagcataatctagcaaaggtatgctagcagatagaaggcctggaaatagacccagttatatatatgtatgtatgtatatatatataaaagttattctaagtctagatgtgaccctagtataaat

SEQ ID NO: 2086 - DNA, 201 bp, Bos taurus
cgtgaggtctgcgtggaccgagcctgatccctccgcagctttatacccggcctggtcggcaaacgaattcaatacaggtcaggaagcgaaactcggccagcgttgatgttcagtattttctttacgtttgtgtctatacattccagtgggatgaaactcctagatctagaattactgtttcaaaaggaacacacgtttata

SEQ ID NO: 2087 - DNA, 201 bp, Bos taurus
cacttggcttgataaagtgcacagactgggatacagggccaagtgagattatgttgtatattagatttgtgtgtattttagtggctgtaaatgcacatttcctaaggatgcatcctgtggcaggcctgtccatcaggatgttaagcagtgaaaatttgctgaaagccttcagtctattgctgaggagaaagctagatgcca

SEQ ID NO: 2088 - DNA, 201 bp, Bos taurus
ctacctcccctagttcgtatgcagtcactagtccatttggaccagttctgccctcatactgatgttatgttttcttgtggacagccagggcctggggagcatttcactgtcccattctgggcttcctttccactcctggagaggcatcaagatgttaaaggtataggaccctcatttcttgtggcccttaaggctcttctg

SEQ ID NO: 2089 - DNA, 201 bp, Bos taurus
tatatctgctcaaggagacgggaccatgggagtctggtctgccagcccccacagggcagagcaggccttggggtggggcctccatcttgtaggagactgagtagccatgatgccgaggcttggaatgagactgtgtcagtgttgccactagcacacggcctaagcttgtgtcagtgacttccatgtctccgcctcagtttt

SEQ ID NO: 2090 - DNA, 201 bp, Bos taurus
caggggtatatgactctgagtctggggctgggctggaaatgagaacacagagaatcagactgtggggaaagactggccccctaagccgggtcatggccccttcaggcttccttcttctccagcagcaccaggcttcctccttgtcatcttgctgccttcctcactaactcagaatccccagacatgcagcaacctcttttt

SEQ ID NO: 2091 - DNA, 201 bp, Bos taurus
gtctgactggcctgagacaagaaaggacaccaggcagggagtcaggcgacctgggagagatccagtgacattggacagagaagagaccaaggccacctccatctgcctggggtggtaggctcatggctagggacataagctggtatttagaagcatcccagcctgacttttacatcatcaggccaagtggcctctatctct

SEQ ID NO: 2092 - DNA, 201 bp, Bos taurus
agacaagggaagagcaacgctaaggggaaagggcaaagatcaaagatcgtcctagcggagggatgcctcaggagaaaagagactccctcgtgctcgcattccagaaggagtgatgagtatccactcagtgccagggccgcggaataccaccttagtcaaggtcactgcctaggattaagctaaatgggtaaaacacgaagt

SEQ ID NO: 2093 - DNA, 201 bp, Bos taurus
tctggcctggagaattccagtacagtctatggggtcacaaagagccagacacgattgagcaactatcactttcatgaagccacactcccagggttcactctgatatatgcatgctctcctgggcaggagtctcattgctcttcatgtaatcactttacacatcactgttaactccctgatacatccctcttagtatcgatt

SEQ ID NO: 2094 - DNA, 201 bp, Bos taurus
gcctccaaaccctccagaacacaaacttgaaacccacacccttggggcgccaggacagtctccgcctcttgagagagaggaacgtcttacctcagcgacaggggcctcaacaagttccccctccccagggccggcgcgccgggtagctggagcagcgggcttcccctctgggaatcccatttctcccgcgtccgccggccg

SEQ ID NO: 2095 - DNA, 201 bp, Bos taurus
ctgaggtgcctggaacaaaagcagggtactgtacctgtcccctgcacacaacaccaccaaaggggtggaaagaccacctctaagctagatccccagaccaactcatggccacccacattgttaatccttttaacaacccaagcagtttctctctgggagcaagccagggcacctgtttctcgctttcactcccttgtacta

SEQ ID NO: 2096 - DNA, 201 bp, Bos taurus
ccactgtcctctatctaatgccagttccagtgagttcctggaagccccctgcacattagcaaagttctgcccaccaaggcctgaggggaaacaagactcaggtcagtccagcacttctacctatgacccaggttcttatttagtttttgtaatcaggcctctttttcctcagtttcagcacttcttattcaggtggagaag

SEQ ID NO: 2097 - DNA, 201 bp, Bos taurus
tccctctcacgtgttggggctcctggagctaagacagcacagtggctggtacctaggtctctccctggggaaagactctgagaagccttgtggcctgctctcctctcctgctcaatttgagcagagaaatccaaggctgccaccctcctcaccccttccacacatctggcccatatggatgaatattctcaattcccaggc

SEQ ID NO: 2098 - DNA, 201 bp, Bos taurus
gttaattgctgtgctgcaagataccctgtctattggcccctgtagaaagttaaccttgtttttcatttatgacaatttgcttattgcacaattgctttagggttaaatgaattatattaagatgccttgaaattatattatagcactccttgattaagaagcaaaaacgttttctgtcatttactcttaaaagacttaaaa

SEQ ID NO: 2099 - DNA, 201 bp, Bos taurus
agggcttccattgaagtcttgaacctcccaaagtcatctaagagggtttgaatcagtttattccaaactcctaaatgttgatattttgacctcttcccacgaatcataaatgttctcaataatatttaaaaatggtgaatccttcctaggtggttttcaatttccttgcctagatccatcagagaaatctccatctaaggc

SEQ ID NO: 2100 - DNA, 201 bp, Bos taurus
cgcggatgccctccggtggctcttccaggtaatgacaacacaaaactgcccagagagtagagggtaggctctttattgggaggtgattgctgtaccacaggaagataggagtcagaggagacacaagcagtgtcagccccagaaatgtggatctcctctcccagggaatatgtttcttcagaaaatcccacgaggctagga

SEQ ID NO: 2101 - DNA, 201 bp, Bos taurus
gaagtttgcattctcttagttaaaaattgctgtgtcaaaggacatgacaatttcaaaattctgaaagatatttcaaaatgttatttcccatccagaaatgggattcctccaaggcttcatttatatttgctaatggcttagtatgtttcctcattcttaaatcatatctgtcaaaagtgtataccaatgcatcatgtgaat

SEQ ID NO: 2102 - DNA, 201 bp, Bos taurus
ttgacacaaggaaattccttgaaactgagaatggagagtggaagggagggagaatgtctcctgatgtgggtggccaggaaaccgggggccaggaaagcatgagaggagagagggagagaaagagagagagagacagagaggggaaaaaaacacaggattgaattctaatcaaaatgctatgaggcgttcacaccaggcctt

SEQ ID NO: 2103 - DNA, 201 bp, Bos taurus
ctctttccaaccctgtctttagtgacatcctattggtagtttgaaattctatatttacctcctggaaatttgcagattctacagactaatgcttctgtcccctttggagactttattttaccctgctcctctgaagaagatgactatagcattaagccatgggagtggtgaagtgaaactgtttccagaaattttagcccc

SEQ ID NO: 2104 - DNA, 201 bp, Bos taurus
gaaggaccaacaattaattgactaaaccacaagaggtccctaggtagatgttgactttcatcacttcaccttcctcctctatcagtggggttgaagacaatggctgcaatgaaaaacaggcctgtcctagagcagagaaaggaaagtaaaactatttctccaagggagagagaaaaataggaagctagcatttacaatctc

SEQ ID NO: 2105 - DNA, 201 bp, Bos taurus
tggcatctcagataaacaacaaatatgtttttagtataagttctaaaaatgcatggggcacatttatcctgtaaaaaatgattgattgggaatttcctggcagtccagcagttaggactttgtgcttgcactgccggggtctaggtttaatccctggtcagaaaactaagatcctgcaagctatgaggggtggccaaaagt

SEQ ID NO: 2106 - DNA, 201 bp, Bos taurus
cttgcctggaaatttccatggacagagaagcctggcaggctacagtccatggtgctgcagagagtatacaagctttttaagaagaaaagaaaatgtcccaagtgggttctgtgttcttctgcgccctggtatgaccttggatgtctttggaaatttcacatggtgtaatttcagtgttctctctaacagaaccagaatcgt

SEQ ID NO: 2107 - DNA, 201 bp, Bos taurus
tgtccttgaaccattcattgtatttagcttttttttttttggccttaggagattgttattctgcttatgagctggctcctttactagaatctaattcctcgttagaggaatggccatgtcactgttagcctgtattactgacagctgtgcacaatgcttagaacttagtagattcccaggaaatatgtaactccttgtgca

SEQ ID NO: 2108 - DNA, 201 bp, Bos taurus
ccagaggggcaagaagagggaagggtgttatctgagcccatgagaactggaatcaggaatgtggcgttgcttaataaggagctgtgactgtacaggcaccgccggaatcatagcaaggccgggagggattgagggcattaaatgctctgatctctgcttctcctccactactgatgcctcccgctggctgagccccaagaa

SEQ ID NO: 2109 - DNA, 201 bp, Bos taurus
gtcaccacctccgggcaggggctattttggatctgagggtgtcagcagcataaaaggaccgtcgtggaagttgtggccgggacacgggcagagcatgcccggttctctccccacgtctaaactggagcctgaaatagctgtggggctaaagaagctcagaatagcttttggcttcaccacaattccaggccgagcacaaca

SEQ ID NO: 2110 - DNA, 201 bp, Bos taurus
cctcgtgatggaggccaactcctcattaggtggtcacaagtgttgctgaatctccctgtgaatggtattctcaaagaggctgaccacagctggccccagtaaggctttgcaccccccttccaattccaaattgactgaccaagagcacctgttgcccattgccagacagtacagcagctgtagagtgtggtaggtgagggt

SEQ ID NO: 2111 - DNA, 201 bp, Bos taurus
ggccttggacacaggcagctctcactaatgagggcccaaggtaaagtgaaagctacttgaacttgtaagctgcacacagtttgatatgttccacagcctatacacagatccactggcaaaggatggaagaccttactggctaaagatatattggagtaaaacttctaacagatcactggctgaccactaagctatgctgat

SEQ ID NO: 2112 - DNA, 201 bp, Bos taurus
ctgactcactactctgaatttcacaaagaaacacgacatgagcataatcacataagtagcttcgccccacccagcagtgcccaccccgcaacagagcccccgttgaccagagacttgacaaagcactcaccaactagccttcctgctgagacttcccactgtcccttcagtcctttggctctaattattggtaggacattt

SEQ ID NO: 2113 - DNA, 201 bp, Bos taurus
aaatggtgacgctggctatactatgccgctcactcacagccttaccctttttctcttccgaggcccaagccctgaggccgccccgcccccggccctttgcttaataccgcccctccccggagaggacaggggaagatgtggaatttccaaagcttattggatgctggtggtgtcactctggagggcggcggggctcgcagc

SEQ ID NO: 2114 - DNA, 201 bp, Bos taurus
cgaaagggcccttgaatatcttgtgaagttcatgcaaaccccgagttcaggggcagaaccccttttaccttgctctggggagagggccagggcactgagcacttcctccagctcctgaatttgcttgaacaacttctgacccttgtctggaagagcctggatgttcaccgatgccagtgtgctctggaaaacagatcctat

SEQ ID NO: 2115 - DNA, 201 bp, Bos taurus
tctatttcatttttaaagatctcctgagggggaggagatgccctcagtaagccattccaacagttaactactcttatttgccttatgttgaggcggccgaatgttgaaaagcaatctctctacacatccctatagagttgtacagtttctgttcacagtgggagaaatatgctttgtattactctttctctgccaaattac

SEQ ID NO: 2116 - DNA, 201 bp, Bos taurus
aatttactgtatcagttagctattgctgcataacaaatagcaagctttggtggcatacaataatagtacagatttttgttcacaagcctatggatcagctaatgagagctggatgatctaggatggccttagcttggacccctctcacagtcgttgaataggctagcctgggcacgtttccctctcacagtcgttgaacag

SEQ ID NO: 2117 - DNA, 201 bp, Bos taurus
ataaaaagccctcctgctacgaggtcatgttggcatctaatccatttttgcaactcaacatttcacagcctcccagaaactcctaccgaggccccttcacacttccttccctccaccaccaccctctctgggtgtcacacctagtcatctgaagtcctctgttcatcacagtctcacacctctggtgacctgtctgccgag

SEQ ID NO: 2118 - DNA, 201 bp, Bos taurus
tccccctggttcaagccaccttccctctcacctgaattactgcaacagtctcccaattggctgcccacctgccctctactctcaacatggccaagccatcgtttaacaactcaagttgtctgacatctttactctgtttaaagcttcagataaaaggcaagacctcacaggacagggccctctttgcttctccaccctcct

SEQ ID NO: 2119 - DNA, 201 bp, Bos taurus
attcagcccaacccagtcagatgttagagagaaactggccaaaatgatgtgagaggtgaaggctctggctactacccaccaggccaactgcccctcagatttgcatttctgagactctggactcagaagttacctcttccaacccccacctcctaccttcctggcccacttgtgcccttggacctcggaatctcctttttt

SEQ ID NO: 2120 - DNA, 201 bp, Bos taurus
cccctcatcttcatgtttctgcactgtttatccagcttcatctctggttgccctcctacatcatgattgctttttcctcactctcatgaccaggcactttccaaagacaggatccatgtttcatgtgtccagcccagctgctgctgctgctgctgctaagtcgcttcagtcatgtccgactctgtgcaaccccatagacgg

SEQ ID NO: 2121 - DNA, 201 bp, Bos taurus
atagagagaatacacgtgttaaataagcttcgtttaagtatcaattatggtccttctggcatttcagcactgtttttgagggccagtttagacagtgaaacaagcaacaaaaaagcacaaaatgtggaacacgtgggcactaaagagatcacaaataggattgtgtctacagtacaacggccaaaacatgagggcagagtt

SEQ ID NO: 2122 - DNA, 201 bp, Bos taurus
ccaattacttggaacgtgaactttaagtaggctgtgacttctgttggtggtagaaaatagtcctaatgtggccaaggctacatgtttgagcctcaggagacgtactttgcaggcagaaagctgtggtgtgatggctgattgtattagattgtcttattcctctcttctttctctctctttgctttagttttataatattaa

SEQ ID NO: 2123 - DNA, 201 bp, Bos taurus
ggttttggctgccaaagcagttggccctatgcttgtactgttggctgagctgcccagcgccagccagggcaagggtgtgggtggtgccagaggtatgtgcggaggcagaggcctcagatgctgaggcgtctgacttcaggatgagagctccagattcccgagtggctctttattactcacaatacactcagattaggagca

SEQ ID NO: 2124 - DNA, 201 bp, Bos taurus
ccggggctcacctgcattggcgttcttgtggatggataactgaagaatggaaaggatgcaaacattagacagctgggcctgacagcccagggagggagatttttttttttttttttggctgcgacatgtggcttgtgggatcttagttccctgactaggggattgaacccaggcccgtggcagtgaaaaagacatcctaac

SEQ ID NO: 2125 - DNA, 201 bp, Bos taurus
aaatagctgcacactcaaatggctcatgggcctggtgattacaggaaaaagggccaggaataccgggcgagaggaaggagaagggccagagatccctggcgccatcttgccctttgagacagttcaggcagacagcaacgtcagacagttgcccaacaagaacagcagtgggaggccggagaaggcagctggatggtagac

SEQ ID NO: 2126 - DNA, 201 bp, Bos taurus
ctccatcctccaaccttcctttttaaatgtccccacgtttattacatgttcatcttttcttaaggagtgggtagcaaatgtgactgaccaagacatgacttaagtaaccatcacaaagcaaaggaaaaccacctggatggcaggattaaatgatgtgtgtgggacaagaacagagaaccattccatctacttttgtgagtg

SEQ ID NO: 2127 - DNA, 201 bp, Bos taurus
aaaaagtacaatattaagagcataggcttctgggttaagagaaatttgggttgaaatcctagctctgcccttattagctgacctcaagatgtctcaatttcttcatctataaaatgggggaaataatgcttacttcataacttatcttgagagttaaacgaaacaaggactgtaaaatattacaatgcctggctcactgtt

SEQ ID NO: 2128 - DNA, 201 bp, Bos taurus
ggagagcgagcttccttctcttctatactgttctgctttgcaatgagtctccagagcccacagcctgcaactttgccatctccgtcctgtcatcggcccttgctggcttcttttcaacaccattccaagcaagccaaccaatcacacttcagaataatcctcaagctggccaatagcaggacaggctgttcttagaccaac

SEQ ID NO: 2129 - DNA, 201 bp, Bos taurus
tgtggtctatgcagtcatggacagcctgggagatgtcctctgtctaactggccttcaaacactgtcctctcaaaactcacaatcacagtgaggcaaagcaggaggagaacactcaactagggccctgtggcttggcctggaaacttagggatacagagttctatctatttattattcaaataaattacacaagggcaggag

SEQ ID NO: 2130 - DNA, 201 bp, Bos taurus
cctaaggcccacttgactttgcagcccaggatgtctgtctctaggtgagtgatcacaccatcgtggttacccggattaatatgacacccaaaagagaacagagatagaggccccatactagaaaaatacttcttaatcactcctggctcaggatttcactagtactctgcagagcatgggggcggggcagggtggggggtt

SEQ ID NO: 2131 - DNA, 201 bp, Bos taurus
gagtataagtgacccccaaaatgttctactatatagacaaataagctcccagccagggcaataggacttatgaaagaatcgatggtctatctcttcttctttctcaggttttggttcccagatgtgcaatcctagaaggaaagggaagtggggatggaaagagaagagaaggagggaagaatggacattctctgagatgtg

SEQ ID NO: 2132 - DNA, 201 bp, Bos taurus
tgataagaagaaatctgaggggatacgtaggcagttcaggaaaaagaagcctaggaaatggaggaaaaatcactaaattttatcactttagtctctctcacctggacaaaaaagcacaaccaccataccaataaagaactaattatctgtgccaataagtaaaacataagagacaaagaaaaaaatctaaaaaggaagaaa

SEQ ID NO: 2133 - DNA, 201 bp, Bos taurus
cccagtgcctaggacctaaacccagttaaatttgaatctcatgttgggatccaggctttgattccccgtgcaccccctgccccaagttgtccgagtgggttggatttgcagtcaggattaagaaattcccatttagagtgctgggaaaatcactgaggattttggataaggagatgagtgagatgaaattggaattttagc

SEQ ID NO: 2134 - DNA, 201 bp, Bos taurus
atatattcaagttttacttatgacttcagttaaaagaaaaaaccctctacctatgaaaaaagtttgcagaccattatcttagatctttctgaagccatcagcttatttctgcctgttgttctagcattcaagctttccatttactcagaactcagttaaccatttctttatatgtagttagtgcctactctgtgccagggg

SEQ ID NO: 2135 - DNA, 201 bp, Bos taurus
gtgggtggggagggatggtgacagcggagctcccaagtggttgggaagggaaggaaagggaatttgtatctattgcttctgatgtatcttctgtagtggttgcctctaccttctaggcctcaggactaccacctataatgtatgtctttaatcatgggcgaggatggggccaggcttatagactgactcagacagcaacat

SEQ ID NO: 2136 - DNA, 201 bp, Bos taurus
aaggtagctcaggctcaggtcacgtaatggtggtcgtcagtacctccagaccagcctttttcggttagttgtaaagatctgcaggttggcctgtccagggttacaaagggaccatgaagaactgagcctggggactgaaagagaggatttccttcaatctggaaacatgaaggtgatcagtaggcctgggtctcaactccg

SEQ ID NO: 2137 - DNA, 201 bp, Bos taurus
aatgaaactcagagagtcctcctcagtttttccctagaggaagtctctgctcagtgagacatagttatcccccacacacagataggcctgacctaccccagacttgggacattgctgttctaaccaaactcacatatgtaaacattttccggatttttaattacttccaacgcagagaatacatttggaggcccttgccag

SEQ ID NO: 2138 - DNA, 201 bp, Bos taurus
agaaccagggcaaataacatgaagccagacccctgcttcttcctggccctataccctgccggagccaaggcgcctttggggtctgcttcattgctggtctctaaagaccacttctcaaccccaggcctcctagaacacatgcctcccctctcctctcacctggcagaagtcagtttctggctctgaccctggccacagacc

SEQ ID NO: 2139 - DNA, 201 bp, Bos taurus
ccttccagcctaggtgtctcttttaagtaggatgcaaggcttggtattttctgagattaaagaagtcctttctttggggttcaggtgaaattctttgcatcaactacttaggatagtctggacatggcaatttttagccttgtatgttgttactgcctttgttacttttgtgtaatagcagagaagttcagttttgtctgc

SEQ ID NO: 2140 - DNA, 201 bp, Bos taurus
gaaactagtgcttttatttgtctaaatattgtggttagtgaaattaaaatatctcactttaatacagtgttcagaaaactattgtaatgtttttcaaaatgctgtgttttgttaagccttatgaatttctgttaaaaataaagcgaagtaaattttttattaccttagagatacagttaatggaagttatttatagtttaa

SEQ ID NO: 2141 - DNA, 201 bp, Bos taurus
ctttcctgcatgttcttccagatgttgactggctgacttcttgggactagcagacctgcctcttggtgtgatcccgttttctgctttcaagagatttttcttatcaccatgcccatgactgttaggtgggtcccttttattcacatttttatgaagaagagacttatgttttatatcagactgattttcatttaaagtgct

SEQ ID NO: 2142 - DNA, 201 bp, Bos taurus
aactaaagtgttttgtgctaagctcttcacaagaacactgagtttctaatataaagaaaagcagtgtctctgcccaagtgctctggacaccatctgagtgcagaggtagctgcagcccatccagtggacttcttgaatgctcattaagtacatagttggaaaacgacaagatgttatctcacttctaagggaagtttttca

SEQ ID NO: 2143 - DNA, 201 bp, Bos taurus
gtttgctcagatttttccccactatctgtccatcttggatatgaggatgtttctttctttcctgcaggcaaagggagaattcctctcacctgagggccacaagtggcttcggggatgaaggactggaggacagagagaacttccacttctgccagtttcttcagattccttcagcttaaaatattcagtgtgccaaatggc

SEQ ID NO: 2144 - DNA, 201 bp, Bos taurus
ttatttttggagtttcccatcagagaactggccaaagatctggaagcatttatttatatccctagtatacgggagagggccttctgctcactggccatcagttctcattacctccaaaacatgcttgcccgggtccacctgggtcttcaggaccacaggttctgctgcatctcaggtctctgaaaggtcctgggacttttg

SEQ ID NO: 2145 - DNA, 201 bp, Bos taurus
gaaagacttaattcactttcctttttctatatagaaaagatgacaaaactgttgttatataaagaggtgagaaaagagtattcaaacaaaaactgcagagaaagaaaagtattgcagcagtgtgctaggcaattaataaaaacattgtattacttttccgtatcttgtgatatttgtgaaatatttcaacttcaagagtcc

SEQ ID NO: 2146 - DNA, 201 bp, Bos taurus
atctccttgacattataacttttggctgtacgatcccctacagttctctcatggatgtcaatgatgatcagacaatcagttttaaagaaaaccattattagagaaatctaaagcaatcaaatgaaactcaacttatatatagtataaaccactatgtattcagtatcagcgaaaactgtccagtgtcttgactggagtaaa

SEQ ID NO: 2147 - DNA, 201 bp, Bos taurus
tctcctaacaactcaacatttcttatattattttaccatcatgattactctcttccaaatacagtttgatcctgtgcttagttgttccgtcttatctgactctttccaactctttggactgtagcccaccaggctcctctgtccatgggatcattcaagtaagaatactggagtgggttggtgggttccattttcctcttc

SEQ ID NO: 2148 - DNA, 201 bp, Bos taurus
gataccaagcgagggtcctggcttccggagtgagccacagtgccgtgacagcaggtctgcagagagagacacattccacaggcagaagcgttccatctcaatgggcgagagccgccctgacgcatggggtggctagtttttaagggctgggtaacttctgaggctaacaagcaggaagattgctacaactcttttggggaa

SEQ ID NO: 2149 - DNA, 201 bp, Bos taurus
gggccttgcagactctgggaacacgtagggtgttaagcctgaaaagagaagcgggagatggtaggaggtgtctacgaaccaacgctatcacctctttggtcttgggaaggggatgaaggccagagaagtgtttctgagcagaatctgacagactgctgctggggagaggctcctgaaaataacaacccccgaggtcctgaa

SEQ ID NO: 2150 - DNA, 201 bp, Bos taurus
tggtgacgtaggccagattggcaatcttcattccatacagcatggaggagaagccaggggcaggggtcccaaagctgccgggagcagaggagactggggagtgagggccagggggcggcaagctggggagggcgtctgagagccactctgtgcgggacaggatggggctggggacagagactcaggccgggacggcaggac

SEQ ID NO: 2151 - DNA, 201 bp, Bos taurus
atctggggccccagctcctaacgttcttaccatatccttctcctcgggattacagacttcccaggaggcctggctaggaggattcggcctagacagtttccagaacctactgatatctttctgattctgtcactgcctttgcccaaagacctctgctgcctctacctgggcctctctcaggaatcctgtgctgccttctta

SEQ ID NO: 2152 - DNA, 201 bp, Bos taurus
tagacttaaaggcaaagggctccaattgacccggcctcctgtgactgggctgaggatttatagagaagttctgggccttgacaaattaattcctcttaacgtaacaaagggtaacagctccagaagtcctattccactgtccaaagcccaaatgccgtaggaagtggacccgctttcccctcctgggttggcctgccattc

SEQ ID NO: 2153 - DNA, 201 bp, Bos taurus
acgtagtgaggtgtggaatgggtacagtggttggcttaagaagtcaagtctggagcatgtggcctgtggacaaggtagggaaaattccctgaaggcctgggtttggctggacatgtggtgcctgaagacagagtctgcatctcagttctgatttcacagatcctgccacttttctgaggcttctcctggccacatctcaga

SEQ ID NO: 2154 - DNA, 201 bp, Bos taurus
cctagattcaaggaaaaggacaaaatgacctctagatcaacccacacatacttattgagcactagctgtttgccaaatactctcatttaaagtctttttttcccagagctatgctattcctctagagcagggtctgccaaaatacaacccttgggcaaaatacagtcacctgtttttgtcaataaagttttattggaacac

SEQ ID NO: 2155 - DNA, 201 bp, Bos taurus
ccactccaccccacccccaagttacaggttttatcactatctcctctgttctcccttgtgagtagaaaagggacagctcttttctagctctgcaggggtcgagaactgtttcccaacttggctggagattcctctgcctggagagcagtgccttgtagatactatagctgggcccttccagggacacctagtagagccggg

SEQ ID NO: 2156 - DNA, 201 bp, Bos taurus
ctccacccactagtgtcggtcacccttcccttcccaagtagtaacgtccaaaactgcgtccagacttttgtcccaaggggcaaaatcacctgagtctccagtcgctgggttaacccccccaggggcccacagaggctggcgctgtgaggcaggcctgtcgagtgatggtgcttcagccgcgattagtgggcaaatgtttct

SEQ ID NO: 2157 - DNA, 201 bp, Bos taurus
ctgaatggccagtttgagaactacccaggtcttttgttcctctggcctagcccccaactcctgggattcttccacgtccatcattccccaggagaggttttatcgatcttagagtcatggcccgtgagagctggtgggcggaaagcagtgccgtgcacacagtgggaactcagtacacgtagcctttattattattgcaac

SEQ ID NO: 2158 - DNA, 201 bp, Bos taurus
catgtggacgggccttacattgtgcagtcttgacactggggcaccctgggaacctgctcgatgtcagtggaaggagtgaggggtggcggaacaaggttccggtgagttcaggcctagcattcctcacttctccctgtccgcttacctgcccctcccatgcatacatacacagcccccactggagaaatgtcatactagaca

SEQ ID NO: 2159 - DNA, 201 bp, Bos taurus
tcagggccgagagatgatgtggaccactgggccgtgcagtgcccagatacactgcagagctggtaaggagatgtagtgtttgcacagaaaacaccagaaaccatttgccaagtgtacagagaagtgttttcacaattgctcattgctgggggaataagcattctccttctcacaggaagttcctctacctgaaatgtgatg

SEQ ID NO: 2160 - DNA, 201 bp, Bos taurus
gcattagtgagtgagttcagactcccatctttttaactctttaaaataatacgtcaaaaagggaaccttccccttgaaaggataattctcccgtgtcccaaagcagcttgtccttggaacagttttaaaaatgctgcttgaaccttgagcctctttggcccaggttatcccaaaagggaagtttccctttaaacaacaatg

SEQ ID NO: 2161 - DNA, 201 bp, Bos taurus
atcttttctcaggtcaggaaaagattaacccttggtctttaaactggggactagcattgtccgagcacacccagacagctccagctgtggtttcgtctggtcgtagtccaaaatttgttaaaatggaaagtgatggatgaagatggaggtgagacaaaaggaactggactcaagcctcactggagaggcaaggtgagtttg

SEQ ID NO: 2162 - DNA, 201 bp, Bos taurus
tcctatgagccagtgatttcctttatgttagagtcatcactgtactggaaatattaagaatctgtgtgcttcttgttggcctgtttggaatttctgcctgcgagatgctgtggaaggttttgttcaacctgttcttgaaggtaaaaagattttgactcacagtcctttcatcatttttgtgtctttcaggccaatgagagc

SEQ ID NO: 2163 - DNA, 201 bp, Bos taurus
caatccttttttctgtgagcacaccaggggtcactgtgtggcattagagccttttgcgggaaaggcttttttttttttttcctgtctctctgacgatcccatggtttgggttgctgtctcacattatctccgtcagactgttctcagggcattcaggcccagtgcttaccctaaggactgaagatgcagcccatgcctccc

SEQ ID NO: 2164 - DNA, 201 bp, Bos taurus
accaagaaccaaaggtaattttcccatgtcagggtgttctttttatcttatgtatatagaaaatttttctttcttgattcttagttatctatgatacctctttttacctcctctcccatcctccttttcatcgaatacatatcatacacaggtgaatgcttaagccaaagctttcatttgagggaaatgtttgagaagtgt

SEQ ID NO: 2165 - DNA, 201 bp, Bos taurus
caccctgagaaggggcagtgggaaagataggcaagaccatgtgcagccatgcctgggaaatagtgtgcataccatcagaaagacggtccaccgagcccagtgggccaaatgaccacacgaggacctgcagtgaggggagtgaacagtgggttctcagcatgctgcacgggccccggaaatggtgaggtgacctctaagatg

SEQ ID NO: 2166 - DNA, 201 bp, Bos taurus
ctccctgacctgccaaggccactgagcagcaggttacagagccaggattggaaccaggtcttggtcttggggttagagggatttgatcaggcagccttgctgctgagcgtaatgcaggccccaacctgatcagaaagtaaaatggggtgtcttttacatgctaagcattgcgctgggtgctttatatacactgcgtacagt

SEQ ID NO: 2167 - DNA, 201 bp, Bos taurus
ccttcacccagagatgcacaaaaggtggtggtgccaccacatgggccacagcactccctggggtctgggacgtcggagaagctgagtttggagcctccactcccaccacaccagcccctctaggcccacacctgtgcagaggccactcagaggagctcagccactcgtctgagacggcaggctctgcaaaactcccaggac

SEQ ID NO: 2168 - DNA, 201 bp, Bos taurus
acagagttaagctaccaacagattccctgagcatcatagcagcaggatgatctctccttttagtgccttgtcaaaaaccaaaaaatagtgttgaggaaaagctgccattgcccattgtggcttcagtgttgaccccttgcagctgtacaactcaaagcccctagctgtctaaataaagtgctttctccatctcctttagaa

SEQ ID NO: 2169 - DNA, 201 bp, Bos taurus
gctaatctgcaaaatgggataacaaaaatatttacctcataataatccactcattggattacataaaaagatgcttgcaaccagtactctgtgtggcctacagtgaattcccaataatagttatcaatatgctatcctcacttcccacagtaaaatagttattttcaacatttaagaaaatcgtttctatcagggtgagta

SEQ ID NO: 2170 - DNA, 201 bp, Bos taurus
gtgtcaggttaaatgctctcaccttctttgggctcttatccttctgaatctatggattggacagaactgggtgttctctggttctacctcttaccagcttcgtaactgttggtgggtcatctctcctcttggagcctcaagcttttcatctcagttgcctagcatatcaggttcacaggaaatatttgctgaatcaatggg

SEQ ID NO: 2171 - DNA, 201 bp, Bos taurus
ggaggcctagaagtaacctcccctcgctctcaggctccagggctgaaccttttagggagctgggtgctgtggacgggaggctcgggggcctcaattctcctgtatcctgtttgattcccgaagacacaggagggacgaggctggaggcatgtgtgtgcctgtttgtgtgcgggtgcccagggtcagggagagctgagggtg

SEQ ID NO: 2172 - DNA, 201 bp, Bos taurus
ggtcgagggacttgtccaaggtcaggcagcgagtcagttggaaactgggacaagaatcagcgtgcgtgtgctctgtaggctcctctgcatccctcactgggactctgctttggcctggggatgacaaggggctgcagagatataagtgtgactctggtcagtggggacttcggtaccttggctcccaggtcatcccacctg

SEQ ID NO: 2173 - DNA, 201 bp, Bos taurus
agtagggatgtgctgccacctggaggaggaagggagcactgcagcaaggaaccaggacagcccctggagtacctggagatcaccccttctttcattttcagcctcccacccaggagcctcactgaagcagctcttcccaggaaatgggcttggagaagacctccctttctaaccagaggtcatagttcatctggaagtcct

SEQ ID NO: 2174 - DNA, 201 bp, Bos taurus
gcagaaatgctggtaagcagggttcatggcaggggaatacatcatctttctgatttctaagagcctttctggggattcttacagagtgtgagccaggacataccgattactctatgcacaaactgccctttgaggtctcagttcatacattttctgtgtcacgtgtaaatcaaaagtggtactgcttctgtaaaactaaag

SEQ ID NO: 2175 - DNA, 201 bp, Bos taurus
gccacacctgccctgggcaaccaaggtgtgtggtcacttggcctatgagggaaactttttctccccagaccaaatctctgtctccccagaccaaagtctttgtcccacatctcagcctgacactggccctctgtgcttctatcacatatgggcacttgcaaaactccatgatagattctgctccggcctgttctcctcggt

SEQ ID NO: 2176 - DNA, 201 bp, Bos taurus
gaaagacagaccatgcattgctcttcttttagaaccattggttcacctacaatgagaccatgactgtggagagtgtgactcaggctgtgtcgaatctggcgctccagtttggagaagaagatgcagacccaggtgccatggtgagtgtggtgactgcgccaagctgtcttgctgtcctgtgggacttagggtgtctgtcct

SEQ ID NO: 2177 - DNA, 201 bp, Bos taurus
acctgaggcagcaggaatttaagatcagagtctcagctttataaggaaacaagtgtcttaccccacaaagcaccagccctccacagggtccctcttatgggagaaagacagctcagaactcatgatccttgaagtagggcaggagctagttaacacacacaggatgtcagtacattgacactaaagaaatgttgcagaact

SEQ ID NO: 2178 - DNA, 201 bp, Bos taurus
gccattttcattagggtgaaatatttgaaaactagaactgtttttcacttacaggcaaaataaaacccaaatgagtaacataacaattataacagctctataaatgatattgaacacagatgggccaacaaatgctgccaagtaagtaagctactggagtggcctggaccttctgcaaagggtttttcatttctagacaga

SEQ ID NO: 2179 - DNA, 201 bp, Bos taurus
cctttgttacctgtcccctgcctccttcactccctccccatttttgaacgtgggttgctcctagggaatgactttaggcaaggtgaatcttttcagcccagggtgacataaagagagggactcaactgagagctgtctgttaatactgacagctactgtcagtcctgagggggattggtgggcagtgcactatagaatata

SEQ ID NO: 2180 - DNA, 201 bp, Bos taurus
tggaattatattaaacttatggatgacactggggataaattcaattcttatgatatcacaggtcactaaccagaatcatggcctgaatctccatctattttggtcttcatttatattttttcagttcagttcagttcagtttccagtcatgtctgactctttgcggactgcagcaagacaggcctccgtgtccgtcaccaa

SEQ ID NO: 2181 - DNA, 201 bp, Bos taurus
gttcttcatcagtgatggtggtggtggtgatttcctctaacttgcagataatgtatgtaaagtgcccaatagagggcctggcattcagtagcgtgtggacaagcttcaggtactcaggtagcctgcagggcaatgggaccactgagtcctgggtctcatttcacctgtgcaagaatggccttcattggaacactggggccc

SEQ ID NO: 2182 - DNA, 201 bp, Bos taurus
attaattagagacaagcctctttgagaaataattagacagtgccacaggtgatatgatcctctctaatgccttgatgaacatggcagcaaaatgcacttggcatagcaattgttatagataagaagttgactacaataatcttgattgttcacagtttgatgataatcgtatgagaggttttgtagatgattatggtggta

SEQ ID NO: 2183 - DNA, 201 bp, Bos taurus
aactctcctggacctacctcttctttgtttctgttcatttcttcaacaaattcatattgaggcctcactgtgtgaaatcgctgtgattctgcagaattctaaaaggactcagttctgaaaaaattctcaaattagtaaatctatctgtaccaaagcctcaaatagatctatacttggaccctaaactaggaaatgccacac

SEQ ID NO: 2184 - DNA, 201 bp, Bos taurus
atacatagtagaaatttgagagacacattatttggagtataggaggaagagaggaacagattgtcccaaattccctcttatgtaaaatgggacttggatgttttgttcagattggtgttctagagctagtgagtgttttaggcatgaggctttttcaagagcattattaagatatcaaaaagcccttgtttagtgtcagaa

SEQ ID NO: 2185 - DNA, 201 bp, Bos taurus
ctcaaaataactcccatcaagacactcagttaaaatggtcttgttgggaaaactttgatatgaataaatagctgtaacatagtagtctctcaaaaataccgtgttcccaggggaagggctgggaaagggtaataaagaatcaggattagacctaaaagatatatttgtgttagactctggagggttgaatgaaaaatttgt

SEQ ID NO: 2186 - DNA, 201 bp, Bos taurus
tatcacaatagtattttcccagtgtgtataataatcacctttttatttcgccttttatagctactcctaattatgtggccaagtttttaaactatcaatccatgtgtcatctgtaacattaccttttcatagcgcttgtctaggttttcatcatgtattgtgctttattcttcttcctgggccatattctctttttttatt

SEQ ID NO: 2187 - DNA, 201 bp, Bos taurus
tttgtcttaatattggcctttgacccatcttcagattcttgctggtgtctgtgcatgctaagttgtttcagtctcatccgaggctttgaaaccatatagactgcagccggccaggttcttcggtgcacgggattctccaggcaagaatactggagtgggttgccatgtcctcctccaggggatcttcctgacccagggacc

SEQ ID NO: 2188 - DNA, 201 bp, Bos taurus
tgtttttacgtcctcactgaaactagagaaatatttctgaaacaaaagtataattatatagtatttcatgcttgaaagagttcagtgacttcccatttcagttcagttcagttgctcagtcaagtcccagtctttgcaaccccatgaactgcagcatgccaggcctttctgtccataaccaactgccagagtctacccaaa

SEQ ID NO: 2189 - DNA, 201 bp, Bos taurus
aataaaataaaatatttgagccactctaagaaaaacatgacagaagtaaactgtagcaagttcatagaaaatgagaacaaagaatatggaaagaaatgcaatatagaagctataggtatgagagaactgtcagaggttcaaaaaattataattttgtgctcttacagtacctaaaaataaaaataaaacctttaattcatc

SEQ ID NO: 2190 - DNA, 201 bp, Bos taurus
ccataccttgaaaaataaggggtctatctcatatcttattccctatctacagtcttcctagtgagtacccaatgaaggcctataacaggttgtgaatggataagtaagtggatttcaatagaaactatgaaacagggacttccttagtggtccggtggttaagactctgcacttccaatgccggggccccaggtgatccct

SEQ ID NO: 2191 - DNA, 201 bp, Bos taurus
ccctggtttaacatttggaggaagtgccaaactgtcttccaaagtagccacgttgccttctctctcccagcccacatgcatggcctcatgagtatgggcagagaagagaagactcagtcctggtctgtacatggatggctctgtacgatgtgcaggcacctgaaagtaggcagctgcagcactgtggcccctcaatgggcc

SEQ ID NO: 2192 - DNA, 201 bp, Bos taurus
catgtaagtatatgtatattccctcctggctctgcttccgtgactcaattactcccaggttggagatgaacacaactaattacgtctcttagaagaatcacatctttcttttaacaagtactcagcaaacaatagaatggtaagtcgcaccttcaagttagccaaaaattgtcaattataaactataattatcagttttag

SEQ ID NO: 2193 - DNA, 201 bp, Bos taurus
tcttttaatttaagtttgtaaggtttatactcttttaaagcatggaacccattaatgccaaccatgattgcttttcaatcccttttctccttctagctttatgatgtgctttgttttctttaattacggcatgatgattcattatttgcactgtttctgttatgaactgagttagccttttggcctttcccaactaataat

SEQ ID NO: 2194 - DNA, 201 bp, Bos taurus
agtaacaaaatatgcagagttgccacagtccaggtttatatagcttatttaatgttgggatgagaattagaaactccttttatatacttttcaagcacttgatcaggattttttactaggcagattacccaaaggtctctagaaatcttatcttaatgggagtagccacagtctttgaatgagttcagttattgaacgtgt

SEQ ID NO: 2195 - DNA, 201 bp, Bos taurus
atttggtcctttaaaaaacaagtgttttctctcaagtgatatacatagtaaggcttaatgtcattttttgtaatagcttttgatttgtttgacgaaggctctaaaatagtattttaatataatggcatctcattctaatacaaaagggagaagtatgttgcccatatatcagtcactttgagtgattaatcaaagtctgaa

SEQ ID NO: 2196 - DNA, 201 bp, Bos taurus
agtaatctttctgtgttattgattttacttctttgggaacttgtaatagagataatttatatacttgtaaatcaaaataaattgatctaacaagtaatattaaatataggattaaccaaaataataaggcctagaaattacctaccatatctgacttcttttcccacctttctactgaacctttgcaaaactctctcatgt

SEQ ID NO: 2197 - DNA, 201 bp, Bos taurus
actttgtttcaaactttcttatcattgaatcaagttattcataatttccaatgcatagaaatctctccatttgtcccagggccactgtaatcatcttaaaattttcaattttatgattcaactggaaaagacaaatctgcatttcacttttggccttatatatatgcccaccatttcacaactaaatgcaagaaaaaacag

SEQ ID NO: 2198 - DNA, 201 bp, Bos taurus
gtggaaataacagtatgtctcagatatgctttaaaatactatagcacaaaaaatggggggcagcaatatataaaaaaaaaaaaacaatgactgttaaagcagagacatgactaaatgaacttcattatacaatttgctcttttttgtgcatgctggaaaaatttcattttataaaatcataagaaaaagtatactataatt

SEQ ID NO: 2199 - DNA, 201 bp, Bos taurus
ttgtttccatgtacagattgatcagtccttttcatattgttcattattcatgtatagaaatgcaactgatttttgtatgttgattttgtgtgtgtgtgtgtggggatcttcagggttttctaaataagatcgtatctacaattcaatagaaaaaaagaaacaatttcaaaataggcaaaggactggaacagattttttttt

SEQ ID NO: 2200 - DNA, 201 bp, Bos taurus
tatttaaaacctttcaatgttatgttgtccttaacatattaccagccatgtaccttggcctctatgtgttatttattaatttatcaaggaaatctattgtctatagcaaactagttcaaatgtaaatcaaataatttgccatgacaagtaaacagaaatgtttactcagtaagctttaccttatggttggtcttcaactag

SEQ ID NO: 2201 - DNA, 201 bp, Bos taurus
actagtacaagttaggaaaaactcttttttttgtttgtttagaaatcaatttcaaggctatgctgggagcacgtgctatgaccagctttctgacacacatgaatagggaaaggatttggtcccatttgttttacaaatggtccttcagttaattatcataaatatgtgatccaaaacaccttacttttatccataccagct

SEQ ID NO: 2202 - DNA, 201 bp, Bos taurus
gtatcagtaaagtgaaaacaatttgtaacaagaaatgagaaacttgtacataatatgttttaaaactctctgccagcctctgctaacatctgccacgactgctaggtattcatgaaattttcatttgcttgagtaagttgataactgtgtggtaatgagtctgtcaactgataatgctgtgtcagtcaggtggatgaaata

SEQ ID NO: 2203 - DNA, 201 bp, Bos taurus
acagtttgcaggctggggcctgttggatttgaatctggagtctattaattactaattgtatatcttgctgctcagatgtctagagcacctgtttccatatctgtaaaactgagttgggagctgagactgtgactgaggagggaaggcaggagactattgctgctccgttcctccctacctctgacagctgctgggctccct

SEQ ID NO: 2204 - DNA, 201 bp, Bos taurus
ctgagttgggagctgagactgtgactgaggagggaaggcaggagactattgctgctccgttcctccctacctctgacagctgctgggctccctccagtgctctgagaagctatgagagatcagcagaattcatggttcccagagagatttgaattttttaaagatgtatattttttggatagctaaacttctatctctagc

SEQ ID NO: 2205 - DNA, 201 bp, Bos taurus
tcctgaagaaaatcatgtttaggttgatatcaaaagattgattaggtctaagttcactgcccagctacacattagactcatttgggaaactttaaaacacgtaaatgcctggggaccctccccactccctgctctgtcattctagatgttagttctggagttggacccatacatctatatgttttaaaaactctccaggaa

SEQ ID NO: 2206 - DNA, 201 bp, Bos taurus
cagcaagggtgacaaaggagaaaacgtgagtttcctacttcttattgagggggattattaatttaatttcttttgctattaactatggatatttcttcatgttactatttccttatgtctccctatagtattactactatattacctctgcagtaactattcagtttgagatttggtcaattctaataaaacctcttttca

SEQ ID NO: 2207 - DNA, 201 bp, Bos taurus
atattgtttcactgtacaacatagtgattggatattttatgcattataatcatcacaataagtttagctacaatctgcacaccaaaatatgactcaactcgttaacactaagaaatatttgaagcttatgcttctctggagaagtactcttgcaaaaatagtatgaaattcaaaagatacacttaagtttcaatgcctata

SEQ ID NO: 2208 - DNA, 201 bp, Bos taurus
ttccattaatatggtgcaaatgacatttctgaaactgctgactgcctctgctcggcaaaatttcacctattactgtcatcagtcagtggcctggtatgatatgtcatcaggaagctatgacaaagcacttcggttcttgggatcaaatgatgaggagatgtcctatgacaacaacccttacatcaaagccctatttgatgg

SEQ ID NO: 2209 - DNA, 201 bp, Bos taurus
gtttctagaatagctgtggagtgtcagacaaaccacttttacacaaaagcaatgagatgggctaaagggacaatttgttggaaaacctgagttagaaattgatggccaagttttttttttagaaatggctggtggctcagacagtaaagcataggcctgcaatgtgagagacctgggttcagtccctgggttgggaagatc

SEQ ID NO: 2210 - DNA, 201 bp, Bos taurus
tcttggctaaataattaatggcattctgtttctctcttaaaagtatctcagtttagatgataagtttatatgatcccctatttataatgtgtgaaacctccaacatttctttttggccatccactggcatttaccttacctttacctttaactcagggcactgtgcatccttttgcttacaaagttagcactgaaatcctt

SEQ ID NO: 2211 - DNA, 201 bp, Bos taurus
cagtgatttcccttggctaattggaaagattagcagtgccacaatgaaagaattggtgataatgaaaccaaactaccggcctaatgatacaattcggatcccattagtagactgtagagctcaatgtataagggctgtcagaaggagatgaagggccagaatctcatcagacactcctcttttaggcttaagcttgctata

SEQ ID NO: 2212 - DNA, 201 bp, Bos taurus
gcagaaacaggggctcatctgttcagtgactgcatgtagcagcagcaggattcaccttgagtgatcacttagagtagttggacagatttgggggttctgttattagggccagtctcacagctaagacatctgctttgttcaatgcttgacaaaagttttctaatgagaagttgttagctaatatatgagaaagtcgattct

SEQ ID NO: 2213 - DNA, 201 bp, Bos taurus
ggggaagtcttaaccactggatggccagggaagcccctggtttatataattctgttaaactttacccataaataatgtcacagatcagggggaaaaaatccgttgtcagattctaggccctcatgttgggtatggggattactgtcactgaaaaccacgttagctactactgggaacatggctcatagctgcttgcccctt

SEQ ID NO: 2214 - DNA, 201 bp, Bos taurus
ggcatgtgggggtaggggcattccctgctcacacttggccgtgaaccctgcaaagggctgcagaaacaatgccaaaccgaaatggctgtgcagcagcagacacaacgcctttgaggccaggccgggagcttcccggcgctaaaacctaatgtgtaggggcggtggaggggggaacaaaagaaagtcagaaatctcacgtgt

SEQ ID NO: 2215 - DNA, 201 bp, Bos taurus
aaagcaccatatatagaaagcaaacctgttgctttttgtcggtgctggcacagccccagctggccactaggtggcagtagtgtcctagcaacagtaaaactgcaagcctagcacttagtgaaaccctgagcatcccacaattgacccacctggctacacacagctttgaggaacagacagaattattagtacaaataattc

SEQ ID NO: 2216 - DNA, 201 bp, Bos taurus
caaatgagatcaatctaatttgatctaattagttgtccacagaaaacatttttccagaagagaatggagcaaccagtataaaaaaataataataattgaacactatactgagattatagaaactcattattgcaaatactatgggtatgggtaaataatagttcctaatcagagattaatgtttttaaaccagtgactatt

SEQ ID NO: 2217 - DNA, 201 bp, Bos taurus
ttaacccctgctctctgcaactagagaaggcctgtgtgcagcaacgaagacccagtgcagccattaattaattaattaatcaattaaaaaactgccaaaagacacttccatttgtatgctgctggccacgcctgcttgcaagctggaaataaaatgtccattgcaaatggtcacaaatctgaccttctacaactctgggaa

SEQ ID NO: 2218 - DNA, 201 bp, Bos taurus
tattgtagaatggactacaattttctttttaattgttgctgagcacctaaaattctaaaaaattaattgtttacaacccaagtgaacattttctctgctcgtcggattttgtttagtagaatacaaacaaagttcacctgcatgctagctttcttctactttgaatattaacatattggtaggcaacacatatttggtgcc

SEQ ID NO: 2219 - DNA, 201 bp, Bos taurus
tccataacacactgaatacctaagacaaatgtcttttttaaggttgctttcaatctgtccttcaaagatatctaagcctgtagttgtctatttcatgtgcatgaattaacagtaacacggtatagagagtaacagtgccaattctagaatcagatcaagcatagtctgattccatagctctatcaattactaaatttaggg

SEQ ID NO: 2220 - DNA, 201 bp, Bos taurus
gtctttccagcaaaaagagtcaccctggaaagctgtacacatccatatgggttgatattaaaggagaaccacagttactatatttacaaaacagtgtacaaagtaagacgtaatttttggtaaattatagagctaagtataactgtcctgatatgccaaaatattctggaaagataaatacactatagtgctaacactact

SEQ ID NO: 2221 - DNA, 201 bp, Bos taurus
ccccataagccatgatggcctgtgaaacagtccagctcagagccttagcagctgttcccttggagggaaacccttttcttgagaacatccaccatttactctctcacttcttcgaggcctttgctcaaaagccttcaatgcatcccaccgctaccacattatttaaaactgccttctctgctttctgctattctttgcttc

SEQ ID NO: 2222 - DNA, 201 bp, Bos taurus
agcatttaacctgcacaggagtgcttatttatagctgcttagtctttctttaatatttatgatttatgtacttggtggccctggtcttggcggcagcatgcgggatttctagctgcagcacgcacacttagctgtggcatacaggatctagctccctccccagaggtccgatctgggccctctgcttgtaagcgcaggggc

SEQ ID NO: 2223 - DNA, 201 bp, Bos taurus
ctcgaggccgcagggcctccagcggcggccggagggcagggcggcaggtgcgggagaggcgggagccttccccatccgggaggatgtgccccggaggtcgtaggccggggcgagagaggaaagactcgggagcccgagatactggccccccgggagcggtggggcagtcaggggcgactgtagacggccgcgtcgggagca

SEQ ID NO: 2224 - DNA, 201 bp, Bos taurus
gaagaaaaatcgatctttattgttgaggaggtatttgtctggttaacccataatacaaatgcacagtgcacactagaggtgagataggtggccaaaaggggcagagaaaaagtttatgtttaaatgttccttgtctggcaactcactccagtattcttgcctggagaattccatggacagaggggcctggcaggctactgt

SEQ ID NO: 2225 - DNA, 201 bp, Bos taurus
ggggcccagagcttcatttgaatgtttttaaacttttgctgttaccaccttgaaattctgaatactttttgaacaagggtccccacatgttcattttgtactgggcctcacatattatgtagcagatcctgctttgaggtcattaactgtcatatgaactgttagaaaataccgggtattgggaaaaaggtgaatgagatg

SEQ ID NO: 2226 - DNA, 201 bp, Bos taurus
ttaagttcattttttggtgtcactagtccaagattttcccacctaagacattaacatttggggccagataattatttattagtgtgagaagagatgtcttgtgcatcataaaatgtttagcagcgcccttgtcctctatcagctaaatgtcaggggcagcatctccccttcctctcagttgtgatgaccaaaaatatcttc

SEQ ID NO: 2227 - DNA, 201 bp, Bos taurus
atgaattccagcctgataagaaactcaggcctccttttaactgttttcctctcctacatccaaaacaaacatactgcaaatcctcagtgccagctggcaccctggccacatcacattgtagatcatatttctacctctatcatccgcacctcagtttatttaaaacacaaaatatcataaagtaaacacccaaagcagcct

SEQ ID NO: 2228 - DNA, 201 bp, Bos taurus
tgagagatcaaataggtctgtgcataaaagcacacagtaaactagagaaatgtatattaaactagttaggcaaatattaggcattccttatgaacaagtgtgtatagaattagtgtagaacacttagttcaaaaggtcttctgatccataacaatatttcatttgcctttggtcccaccaaaggctttactgcaattatat

SEQ ID NO: 2229 - DNA, 201 bp, Bos taurus
caccttggaagccccatcaaacaaggtcagattgagtcaacggatatccagggtgcagttccacaagggaaggacagaagtgagacaggccagggcaggagcagcaaagcccagagagctgaagtgcttagaggaggggcttgtctgagttgtcgttcatgacacagcagccaggggagagaggagatcctgatccttctt

SEQ ID NO: 2230 - DNA, 201 bp, Bos taurus
aagaatgaaacttgcaatcccaagctctgatttcctaggataggaggggggctgaaggatgcatcgattgccaatggccaaagatctaaccaaccatgccgatgttatgagggggcttctccgacggctcagtgggtgaagaattcacctgccactgcaagaggcctgggttccatccctgggtcaggaagatcccctgga

SEQ ID NO: 2231 - DNA, 201 bp, Bos taurus
cacaatatcactgaaagctgtagggttctttcctgtcctttatgtcagcaaaaatattttcaccttctcagtagctctttctcacattttagcttctctcgtgcttttctaattcagaaaataccattgcaagtatgttaaagggtttaaagtttagtaggaaatttttaattctcactaagcagcactatcacatgcatt

SEQ ID NO: 2232 - DNA, 201 bp, Bos taurus
tgatgatatgcccagtgcattatgggtaggtcaatcagaatggagaatagcaagcaacagagtgaatgctggtaacttccaggccccagctatttcttaagctcacactttcaattctgaaaattgggggcagtctaggaaaggttccaggagaggtgccagcaaagtgactggaggcctatggctggggttatttaccaa

SEQ ID NO: 2233 - DNA, 201 bp, Bos taurus
ataattcctcttgttattgttttagggattatacattataatatgtataaagctctttgtaccacagaaactctcatctctgtcttttgaagtcttgcttggcatttagctgatgcatttacacttcagtttaactaagccaggtctaacaaattgataaatccatcatcattgttttttttctttaaataaaaggcttgg

SEQ ID NO: 2234 - DNA, 201 bp, Bos taurus
cctgactctcatattaacagggcccactgtaactgggaaaactgacccagacaaactctaacaaaactagtattttttagactttatactctaaaggtgaagaaaactcctctgggcctaagaaacacacacatataacacccactcacccacccagcccctccccacacacacctatctctccatcaatctaaatagaaa

SEQ ID NO: 2235 - DNA, 201 bp, Bos taurus
tggggaaaaagacaggagacatgtatatttgcttggtgtaccagttgttcctcatgagaataggcttatcaaacaagtaaataaataaatatatgtgtcacgaacagaaatgtccatatactcaattcactgaattgttgattattaatgatcattggggtttccctgatggctcagtgatcaagaatccacctgcaatgc

SEQ ID NO: 2236 - DNA, 201 bp, Bos taurus
cagtcagtggagaaggttttcgacaaagcaatggcatatatgactgcatttgcaaaacaaaatctaaaataaagtttatgttactgatttatcattgggtttccatattggaattttggcactttagatgaatttgaaatattcatatactgaatttttaaattgctgtgatggtaacaattgattcatggatagttgagt

SEQ ID NO: 2237 - DNA, 201 bp, Bos taurus
atgtggctttatgcatccctgtgattctccatcttgctcgcctgtattgtttttaaatcttgacccaaaaatagttcaaataatgtattctttaatgcctctttttccccctcttaaaaatatagggactttccctatatttccttcatcacttcagagttacagttactggcacataggtctcaaagaaatactgattgt

SEQ ID NO: 2238 - DNA, 201 bp, Bos taurus
agatgctgaattataattttctttataaattatcagcttagttgagagaagctcaccattagaactcttctcatttaaatcatgcttatttgaatatatttatgtacaggttgacaaagaatctccttttgcattatattgctttttctgaagccagagtttctcactgtttggccttcgttggtctatgcaggagatcag

SEQ ID NO: 2239 - DNA, 201 bp, Bos taurus
aaataaatggattggcctcagctgactcaattggaaaatgagacgcctcaattccagttttgactttctaatgacttagcatgctacctttgcaaatgatgtaagctctttgggccttggtttcctaatctctgaaatgaaggaactggactctatcgaaatcctttccagcttaaagaatggtgatcctggatatattct

SEQ ID NO: 2240 - DNA, 201 bp, Bos taurus
gtccatttcagaatccaacagaaattgcatcactaataaggcaaatgaggtttttaaacagttgcttctcatctccgcacaagagggcagcctttcaccagaaccaaggaaacagttgggcagaactttgtgttaatttgtatagagacccctccaatcatagaacttccaaagagaagacctctcttgctataaagaatg

SEQ ID NO: 2241 - DNA, 201 bp, Bos taurus
ggagagctttatgcctgctgctaaatgtctacaaatcaatatttaatattttgaaacatgaagtcttaattatccatctcccctttaagcgtgaaaccctcactgagtgaaaataaaaccatttgttggctgatggattgattgccacttattagcacttttttgatctgcaggtcagattgcagggctccattccaaaca

SEQ ID NO: 2242 - DNA, 201 bp, Bos taurus
aattgactccaagactgtcaaggcttttcatttgttgtcttgactcaagccaactgacagtaaaagctctccagccaaacaagacaactggcttcactcttcagatgatgaactctgtctgccatactcctgtgtgagcactgttaggctatgtaacttccaggtgttctggccagtccttttgatcaggcagggctagga

SEQ ID NO: 2243 - DNA, 201 bp, Bos taurus
tgttagatccccccaccccctcaggtaagaatgtatatgaatactgttggaagaaaaacctaaattcataagtataattaaagttgtgtcacattgctttgacctatctcatcttctctcccaaaatagaagaggaaaagctctaatgaaaaaatactgttgagttcttaataaaacatttacactttaaagtcatgctat

SEQ ID NO: 2244 - DNA, 201 bp, Bos taurus
gtgaaatggcatgattagaggtttccttccaactcaaagagtctatgatcaggttattttacttgagaatatacatttttcaattcctttttatgtgaggtgaaatatccagttcaaacaaaaataagtttccgttctagaagttaccattcatgttgttgttggtgagccaaagttatttaactaatgcaagtttaaata

SEQ ID NO: 2245 - DNA, 201 bp, Bos taurus
aagtaagctacacagagaaccaaaaacaggtcattggcttctgccctgcaattcacagtaactgccagcaatatttctacataggggaacgcgctttgcacgacagctctccttgcaggaaatctccatcctggggagttgaaattgcattaggattacttctctgcaagcacactgacaccaatatgcaatatgtggtat

SEQ ID NO: 2246 - DNA, 201 bp, Bos taurus
tgcagcacacacgacatacatcccctctccttcctccctctattccctcttctgctgctttttgccgctcctccatatttatgagaggggaagggtgagcggtggctatcacggccttattatctgtttctacagagtatgctcctttgtcttttacaatttctctctattcctttctttatctgcagcccaaatcctatt

SEQ ID NO: 2247 - DNA, 201 bp, Bos taurus
tctggagccttaccaacattccccaataaaaaccagagctgaaaccctgcaaacagtttctagagccctaaatacacattgagagaaaatcatatttctccggattagatgagggtaaacaagctatagaatatacattttataagattccctggttaaaattctctaagctattttgaactctcattactaccattgatt

SEQ ID NO: 2248 - DNA, 201 bp, Bos taurus
caattgtattatcatcttactttgtcttgagtttcaacatgaaagaagagaatcataactaaggtagagagagggcatgtgaacaaatgataaatgcaccggattatttcagatgacctgaaatatctcagagtttgaatgttaatcctgacaatgaacagaaaacagattccaataacaagggattttccgctgctttat

SEQ ID NO: 2249 - DNA, 201 bp, Bos taurus
gtagggctgaggtgcttcgagggacacaaacagaagaaagagtattcaaactgatgttgccataatgtaaagcttcagtggggactatcttgggaattttgtaggaaaaaaagaaatccttcttcttaatacaacattaactctgcttccatcgtggtttgctattcctgaagaccttagctccttagccatataggagaa

SEQ ID NO: 2250 - DNA, 201 bp, Bos taurus
ttagaggtaagcactgtacaatggattaaaaagtaatgaattctaattcagaatttacctccaataaggtgtgaatgcgggaaggtcctaccagctcatggaagtttagtttcttcttccataattcaaggaaatggaggagaacagaaaatttctaaattctagaaaatccatgatttttatgtcactcatcaattactt

SEQ ID NO: 2251 - DNA, 201 bp, Bos taurus
tctaagtgatatcaaggtgtttgtttttaatctgtccaaaatcttcctatggacaaatgcattattgaagaattatattttaatttatcttcacgccgtgcttttgatgggcatttgcattaacacaatatgattatgcttctttacactggtatctattcaaattagaaattacctgcacatacagtctcaggtggtggt

SEQ ID NO: 2252 - DNA, 201 bp, Bos taurus
gtaaaacaaaagagaaccctgtctgtgcgtgtgtgttctctgctcatgctatgtagagaagcgttttgtttgtttgcagtggttaacaaaaatctttttcttgggacattttgacctagtgctttgaatctttaacaactgagttgctgataccctctgcagctgccagagttcagaggtttttttccccttcatttgacc

SEQ ID NO: 2253 - DNA, 201 bp, Bos taurus
taggagaaagctttcccttacttggggtgtgcagtgaacgtccttgtgctattcaagcatgtacctcatatggctcctggccaaccacacagcgcatctgccccatgaggaaggaaactggtctttgactgcattcagctgtcaggaaggacccagtggccatgggagaccactgcacactaccgttgctgatcatattgc

SEQ ID NO: 2254 - DNA, 201 bp, Bos taurus
tagttgattaggctccaggcgcaaatatggtttgactccaagctgcaaattgaactcagagcatgctcttctcatggctaatagcagaagcatgagagacgaaaccaaatcatttaacattggtacctgctaaatcttgctcagagctgcctacttggagccagcatcagggcttctgcctctccttgtccggccaacagg

SEQ ID NO: 2255 - DNA, 201 bp, Bos taurus
gagggagtggatctaggcaaacaaaagcgtggccaaaatgacttctactgtcaatttccatggagcatccagagaggcttttgctcactgtcagaattgataaccagaaagttatggcctagggtgagatgaaagtgaagtgaaagtgttagtcactcagtcaagtccaactctgtgaccccatggactatagcccaccag

SEQ ID NO: 2256 - DNA, 201 bp, Bos taurus
gcaatgagcaattggtacagaactcagtagcctgtaagaaaccataaaggaatgctttacagaccttctgtttgccttaaatcctgaaaatacatctacattagagttattgagttttttgaagacatttgggacttcttaggaccaatcctgtttttctgtctttaggagacattgtgctcccttcgtcattgtgcttct

SEQ ID NO: 2257 - DNA, 201 bp, Bos taurus
ttcattgctgtattaataataataaaggcatgctaaaggaatgaaaaagcatcattataaaggggatttgtgtgtgcattgaaacagtatgggtaccttgtggttcccacaatgaagatgtaactattttcatatacaagttattagcttaagttgttctttattacaccataactttgctcctatagtaacatggtcgaa

SEQ ID NO: 2258 - DNA, 201 bp, Bos taurus
tgatactcaaaatatatctattgaattgcatcatagataaaatttacaataaagtgagtatagctacatggtgatgaaacgttattgtgaatagtatagactttgaaggaaagaaactgctctcaaaaaagttactgttaccttctagctcctctcactctccttccatctctctgccactcacattcctcccactttcaa

SEQ ID NO: 2259 - DNA, 201 bp, Bos taurus
cctacaaaattccttaacatgtgccaaggcccttcaggatccaacccattctcctttcccgcctttcctctcactgcaacttaacctgtaccctgtcttataggcccgtctgtactggccctttggcttaggtatattcttttatccaaaacctctgaatggcaaatcatattcatctttcagaatccagttcaaatttca

SEQ ID NO: 2260 - DNA, 201 bp, Bos taurus
ccaaatttccatttgtcaacttgttggctctaaatttggcccccatacacggagggcaaagagagacccaagaaagaggcagaccacttcagattggtaggcagttattttaataagccagtgaacttacagatgaggcttgtgttggatggccacaagatgagtagatctctgcaccccaccagaattttagaagattat

SEQ ID NO: 2261 - DNA, 201 bp, Bos taurus
ctttactagttgctacaagcagagagactatcagattaatgcagaggaagcagagagaggtttggaatatgaagggcagttggcaagccaggtccttcctatgttgaacaagcagttctggcccaaagaagtgaaggctctacaaggtgaggtttacaaagttcttcacacagcaataggagtctatcttataaaacgtcc

SEQ ID NO: 2262 - DNA, 201 bp, Bos taurus
cttgctgctgctggcagtacggctgtgggtagtcctgagtcctcgcgctcctgtgcctcggcggtctctcagcctcttggtggtggctggatctggtgagtatacgggccttgactggcgggctagggtcgggaactacaaaacccagagtccatcgcggcgctcttcggcagcgccagtaggactttttgcagctttgaa

SEQ ID NO: 2263 - DNA, 201 bp, Bos taurus
ggctttcaagctcaccttcatatccttggatcaccctcattgaccttcaaaccaacctaggaccccaaaggtcttggcccatattctgtgtatggggttcgtactaggctaggagtaaaattcagactaccctagttaaatatatgttggcacacctgtgccggtgtcatatctcaaccaacaggccttgacctgtggtga

SEQ ID NO: 2264 - DNA, 201 bp, Bos taurus
ccatcctagtatgtatttgccatgtgactttgctgcttctcctgctgagaagtgtagcccatttttttgcctccttgaatctgggtaggccttgggatttcggttgacacacaaaatgcagcagatgtgacatgagagttctgaagtttaggtctaacatgcatggcagctgctgcttgtttggagcattgccctgagatt

SEQ ID NO: 2265 - DNA, 201 bp, Bos taurus
gtgcagctgattgggataatctcccaaatgatgcaggcccaacttaaaacagtccgatgttctaccacattctgtgcacttggcctcttccagccaactgacttggtgtcctgctgacacccagcctgcctgtgcctcccactggctcagcttctgctctgacagcacggggatcagggaaaaagagaagaaaatcgcatg

SEQ ID NO: 2266 - DNA, 201 bp, Bos taurus
ggttggccagcgtcctgtagatgctgatgttgagacctctgtggaaaattccagtgggctgcacacttgccgcagaggggatcacgggcttgcggaggaacgcggccttagctagtctggtccagcttacctttaggttggcccactgggcaacagagcctgggagaggcacaccctcaggtcagcctgtttctcaatgca

SEQ ID NO: 2267 - DNA, 201 bp, Bos taurus
tggccactgcatctttgacactgggcaaattgtttttcctcttaaatctgcgtttattatgaatacctagtcaatctcttaaggattaataatccataatagatatctctttgtctaaactgctaaagtgtattcttccctaccatatgtaagttattcatgaataacaccatcaagtgaccgaataagaatgcagacttt

SEQ ID NO: 2268 - DNA, 201 bp, Bos taurus
aggagatcttcccaacccagggattgaaccctggtcttttacattgcaggcagattctttaccactgagccaccagggaagccccttatttttctgtaactccatatcacctcaataaaaaaattggaaccatacctcatactgcaaacaaaagaaacagaataatttctaaactgctcaaagaatgaataaaaagaaaaa

SEQ ID NO: 2269 - DNA, 201 bp, Bos taurus
ttacctcaacaaaccctcagacgttggcagctttcccatttgactccagtgaccctgatgagcagctctccaagcagccactcctaaacagtatgcctaccgcatattgggtactcttttaagtactatgtatgagggctgtaaacaaaatggtcaaactttctgtactcttaaaattctgggggggagaaatgacttaaa

SEQ ID NO: 2270 - DNA, 201 bp, Bos taurus
gacaatgaccagtgtccatttagcctggcctttgagcctggctgactcgctcctctggatgtgtcagttaatttgcccgtgaaacccactggtctgctagttcaccttagaagggccaacccctcctcttattccatttgcctaaactcagagtaggttttggtttcttttcatcaaaagcagcttgatcagagagaatgc

SEQ ID NO: 2271 - DNA, 201 bp, Bos taurus
ttcttctcaggtactgggattctggccccagagctgatcctgtggaagacttccgatacatctggggagggtttgcctatctgcaggacatggttgaacatgggatcacgaggagtcaggcccaggaggaggttccggttggaatctatctccagcagatgccttacccctgcttcgtggatgactcgtgagtcggaggtc

SEQ ID NO: 2272 - DNA, 201 bp, Bos taurus
gtagctattaaagtagaaaatatgcacaccttcaggacaacaatacgacacttagttatcttacaggaaaaacattccctgatatataaagaggcaagtatcaagaatgcttatggccacattgtttattctagcaaaaacctgaaaacaacctacctggtcatcaatactgaaaataaataaattatagtatatttatat

SEQ ID NO: 2273 - DNA, 201 bp, Bos taurus
tccttcctctaccccatcccatctcttcaaatttagcatgtcttctgttctttcttacctactccaacttacatagattgatgttctctcagatcccctccttttctctccactttaattcccctgcatttacagtctcctctctgcttcaattatctacttttccctcttgcctcaaaggaaggaacattcctctgtagc

SEQ ID NO: 2274 - DNA, 201 bp, Bos taurus
ccctggctggccattaaaacccactcacatcagatatttagaaactagaaaggtagaagtagcaaggcacgtttttaagcagcactagactagaatctcatgttaccatagaagttggcctttttgatacacatgaaaagatagttgttttgggtaagactgctttgttatctgaagttttctgtttttccaaccagcttc

SEQ ID NO: 2275 - DNA, 201 bp, Bos taurus
ccagggcctgcacttgcatgaggggggctaatatcagtttaagaccctgcagagtcacaaacaaatgtgagtccttgatatgagtttccccaacctctcccccacctctcatggccgtctcgaatgccctttagataagacctctgaaaaaattacgagaactcagcttcttttggtttgaattgaccactctgttctaag

SEQ ID NO: 2276 - DNA, 201 bp, Bos taurus
attgaaagcatacaaagaactcatacaactcaacatcaaagaaaaaacaaataacctgatttaaaaataggcagaggacctgaatagacatttttccaaaaaaggtggccaacataaaaagatgccaacatcactaatcgtcagagaaatgcaaatcaaaacagtgagatatcacctcataccggtcagaatagctatcat

SEQ ID NO: 2277 - DNA, 201 bp, Bos taurus
aattgttacatttatgccagcttctgctcttttcttagtttttcttctttctctctccaaactagaccttagagccagctaaaattgacttcgagagctattgtcagaaaacaaagaaaaaaaaaaaagaagaaaacaaagaaactctactttttgcctgctatcctggctaatcatggtacatgttctaagatctatgta

SEQ ID NO: 2278 - DNA, 201 bp, Bos taurus
ggcatgggtttagtttcaaagagcagaactagaactagtgatcagaaattaaaggtaaatttctaagcattcttagaactgtttgctggctcgcttattcagcaaacatttaatggtagataaataaaactatggtctctaatcctccccaattttctttactgatactttcatgcatttacaattcactatcactccaat

SEQ ID NO: 2279 - DNA, 201 bp, Bos taurus
tccctgatttgcactggcctttaatttctaggcatctggataaaatgtttattgttgactcattgcctaggttataaagtgatccttgtctcttgctgagaaatggatctagtagaatagcccaggccttaaaatcaggcagatctgagtttggattccgtactgccaaattaccagctgtgtgaatttggttaacaaaga

SEQ ID NO: 2280 - DNA, 201 bp, Bos taurus
gggtatgaagtgatagttcgttgtgattttgatttgcatttctctgatgtttagtgatagtaccttttcaggtacctgttggccatttgtttcctgctggtaccctgattctttccttttgtctcactcagttcagttcagttcagtccagtcgctcagtcttgtccgactctttgcaatgccatgaattgcagcattagg

SEQ ID NO: 2281 - DNA, 201 bp, Bos taurus
ttcaagacctgttccctcaccctaccttcccatctagaaagctgcctgtcccagacccctgctataaaggtatcctgaaaccatcactagttccttatctgccgtgaaccaacaacatttggtttcctgacttggcttgatgattacagtcttatcttcagtttttgagtgggtgcaattgagagtctttgaactttgccc

SEQ ID NO: 2282 - DNA, 201 bp, Bos taurus
gaaattttaggttacaatttagtcacgtgcattaatttggaagttattagttcccagataattggatagattggaattgctactctaattgcactaagttttgtcttgctctaaaacagacactttagactgtcaagaaaagaatggacttctcctttggtgggtgaggtgaaaactggtactcaactgatgtcccaattt

SEQ ID NO: 2283 - DNA, 201 bp, Bos taurus
ttggttggttgagcacgacagcctatggtggaaagcgcagccacgggccagaggaagatgaagaggaaggcaatgcaggacacccgcacgggcaccaacacggtccccatgaggacgatgtaggcccagcgccatgcgctgatatgcgtgtgctgcacgaaggggttttccactgccggcgggaacagggacttgttcatc

SEQ ID NO: 2284 - DNA, 201 bp, Bos taurus
ttacttgacctctcagctatatctgtcaccagtctattgtgattctctttaaactctttgctggtttccaggataccactttccccagattctgtttgtttacttattaaatatctacaaagtgcctacaatggtggattgagctaggaaatggggatacaataatctcttcacaaagatctacaaacaggcaattacaac

SEQ ID NO: 2285 - DNA, 201 bp, Bos taurus
cccctggtaagaaccactggtgtagaggaagctgtgaggtgcccatgatgggcttttcaaactgtggatcactcagtacccattaaggccaggcttctcaactgtggttgaacattgaaattgtcgaggaagctttaaaaaatgctgatgcctggcttgcactcccaaattctagttgattggggggtggtggcctgggtc

SEQ ID NO: 2286 - DNA, 201 bp, Bos taurus
cttttgacttaagcctttgaagctagcaagacactcctttaaaaagccctttcccatttgtgacaccagatgcctagctgccctgcctttcagagaacttcagtttttctaagacaacaccaaacatgtttggcaaatggtgtggtgatagggataagacataaggctgtttcttagcaggtcacagaagtccctcagtaa

SEQ ID NO: 2287 - DNA, 201 bp, Bos taurus
gaattaaggctaagattgctgaggtctgtgaggggccatatttagatacctgtgctgtatccagtaggtcagagttcacaaactcaaactgcttccagatctgatgggccaagggtaactgcagagtgccccctctaaaggaaataaccactgctcagagttaaccagatgttgcggtgcaggaactgtaagtctagtgtt

SEQ ID NO: 2288 - DNA, 201 bp, Bos taurus
ccttcaccttgccaactagtctgcacctctttcaggaagaacattttcctgtaaatgatgatccctcaagtgataactttagattttcttatagaaaaataatatcttgtgatcctttaataacagactttactcatatcaattcagcatttgatcaccgcattatttattcattaaatgagtcagttaactaatcctcaa

SEQ ID NO: 2289 - DNA, 201 bp, Bos taurus
attgatttccttattgaaaggggaaatttggacccagacacagacacacataaaggcaagatgatgcaaagaaacacaaggagaaggtccaagtccaggatggaggcctggaacagacagtccaggagagaggcctggaacagacagaggctttcctcacagccctcagaaggacccatcttgattttgaacctgtagcct

SEQ ID NO: 2290 - DNA, 201 bp, Bos taurus
ggatcctatatgttgtgtggtgctggccaagaaaattaaaaacacagggcacttgttgacacttgtgagttttagaagtctcctctaagagcagcagctacccaggggccagttctcattttgcagttttgtcctgaatttaccacaggcactagaattttaggtccctataacatattatatactcgaacatactaagta

SEQ ID NO: 2291 - DNA, 201 bp, Bos taurus
tgtgggcctttacacgtctccactcttcattcctactgctgcagctcaatgatttagtggttcctgggagcaatggtatctgtactgcagccagtgtttaagattggtacttaccacacttgtattcaggattaattcagtgccaggaagggatcagccatgactgtgggcctaaggttgacagaagatgagccccacaac

SEQ ID NO: 2292 - DNA, 201 bp, Bos taurus
gcttacttctgtcatttcattaacctcataataacatgaccttgtaatttatgaaattgaatttttgggccctatttgttcagttttagtgggtcttactatacacacaagactagtataacaaaaggagagcatgtgtgctagctgtggtgtgaggtaaggaagcgagggaaagcctctcagagggatatttaactgaaa

SEQ ID NO: 2293 - DNA, 201 bp, Bos taurus
ttttaccctaaatagaccatccaaagaagctcctggctgaaactctggctaggggcttcagatcaggggcaggtggccttgggcagggagtcttcagggtgttcctggcattaattttgctgaaaagagcctcacaagagacccagtctcccctcctgcatgagtggcaggcattgggcctcggagagggcctccatgcaa

SEQ ID NO: 2294 - DNA, 201 bp, Bos taurus
agtctgtgtattcatgaaaataagccatggttccttgtccttgtgagtctgaattgttatacagaatttttatattgtgtgtgctatgtttattgtgcacacaggtacatacatgcagaacatactaattgaattattctaaaaacacaaatattttgcaggctacagacacacatactaaatatctaaatctacaaactg

SEQ ID NO: 2295 - DNA, 201 bp, Bos taurus
taacctctgagccaccagggactccattctcttgccttgggccacacaaaagttaagagtgggtcaatgcctaaagagagatgggtattgacattgggcccaccctcccctggggagtagtcctagagaatgcaactacagaggcccttaggtgtagctgggcaacccaggtaagatttcacacacctttctaatctcata

SEQ ID NO: 2296 - DNA, 201 bp, Bos taurus
gcaaacaggcccaaactaatgttacccatttcttttacccctgtcttgttgtccctttgggttaaaatctttgacgatacctagggaatgacatgcagcttcccgagactctcgtggcctatttatccttatggagtgttagtccctcagttgtgtccgactctttgcgaccccatggactacatacagcctgccaggttg

SEQ ID NO: 2297 - DNA, 201 bp, Bos taurus
gggaattttttatttctaatatggctaatgcttcagatgaagatatgtagcttctaaaaatagcctttcagtattttattttttaagtggaaaaatgcatgcatgtggtaaacaagttaatcacatatatacaataaaaatatcttcctcccattctagactcacaattcctctctccagatgttgctgttgttaaatatt

SEQ ID NO: 2298 - DNA, 201 bp, Bos taurus
tccttgaggcttgattaaaaaattaaatggctaaactttgcctcaatattttgcattgggattttgagtgacttgatgattcttttcagggtgcactttccttttcttctcttggcttgaaattaagaggtaggagaaaaggaggatgctcccgctgtgcagttgttcttgagttgggctttaaatgaagcatgtagaatt

SEQ ID NO: 2299 - DNA, 201 bp, Bos taurus
acatgactgagctactgaactgaactgaacttatattgaatatgtttttgaagtaattgaatttttttactctttttttttctgtgcagaaattttatatttttatgtaagcaattcctttatgtaatcaaaatttatttatgtaaataatttctttaaaaaattgcttctaggttttatcttttgttttacaaagatatt

SEQ ID NO: 2300 - DNA, 201 bp, Bos taurus
tgcagaaccaattttgataaaatgtcctacccataggtgctcaataaatatttattcaataaatgaataaaagaatgaatctctgctccccatcctgtcctcccctgctttccagtctcttctctttgaccctgaggaatcagcagctcaaaggccttagacgaaaactgattcagataagtcattttaaagtgggacctc

SEQ ID NO: 2301 - DNA, 201 bp, Bos taurus
aaacctatctgaggctaatggccccctgagctctggctcctattggaggcagctttgaagactacatttgaagaccaggaagggtgaggaagagggtatggcttccctgaggtctggcctcaaaaggcaccccacaccccaaagatccagggccaaggcaagcctgtaaacacagttgctatgacgtatgatatagctacc

SEQ ID NO: 2302 - DNA, 201 bp, Bos taurus
ttctagggagtagcatagcatttgcaggtattaattgtatttgtttattgagcttcaaaaactcttttgcaaatgcaaacatcaagacattcaacaattctgtaagtatgccatggaatagagaaactcaaaataacaggtttgaaaaatgtctggagaatagttcaaatgaggaatagttaaagaactgaagatgtcctt

SEQ ID NO: 2303 - DNA, 201 bp, Bos taurus
gagacaatgctctctatcagaagattacattctaattctgaaaaatgtgtaaatattaatatcaaatgtgttctgactcatgagtaaaacagggttggccatggagcaattggaagtacagtttagttcagttcagtcgctcagtcatgtccaactctttgcgaccccatgaatcacagcacgccaggcctccctgtccat

SEQ ID NO: 2304 - DNA, 201 bp, Bos taurus
aagagattgcattttgcatgaagttggcagatttgggaaccagactatgcaagcaagccaacttcttattccatgctccatatctcactgcctctgaagcagagagccattaacaaaattttaaaaacttattactcctagaataatattgtattgacagcaactgtaatcagtgattcatgtaactacaaagagaaaaga

SEQ ID NO: 2305 - DNA, 201 bp, Bos taurus
atcttcctgacatggggatcaagcccatatcttttgcatctcctgcataggcaggtggattctttactactgcaccacctgagatttaagagaaaatgactactcatcagctatgccttgatgaaacattatttctaaatttgtagcattatagaaggtgtagaggagacaaataagatatattatgtgaccccataagag

SEQ ID NO: 2306 - DNA, 201 bp, Bos taurus
tccacatttgctggcatattgagtgcagcactttcacagcatcatcttttaggatttgaaatcactcaactggaattgtatcaactccactaagtgggagagtgcaaaaaatctatgaattcttgattttaaaattattcaactattaaagtgtactcataacaaagttgagggcacaaacttcagaatcagatagaagtg

SEQ ID NO: 2307 - DNA, 201 bp, Bos taurus
ttaaattatgtttaaaaatattttaatcatactttaaaaaaagtgaaataaatttttttctttaattcaagtcaatttaattattttaaaacactcatatgccaagatgaactcatatattaaggcaaattccaattttatatagtcatttgattaattgtgtttcattttaaattgctagtccagggagagaaattttgt

SEQ ID NO: 2308 - DNA, 201 bp, Bos taurus
tatactaaatcatatcatttaggttttgctaaatgctcccaggtaaccttgaagttatctctcatagtatctttctctctcatttgcaaggcttgtttgagaccttttcccactcgacatggaagttttaagagggtaaagtccatgtctctcttgtttgccaatatttcctaagcattgagcacaatgtctggcatgcaa

SEQ ID NO: 2309 - DNA, 201 bp, Bos taurus
aaggtcactcatcatattcattttagggtatcaaccagaaaagaaaaaacaaaattcactactggcatttaatccccactaacaaaatcccaacagggccctcagtgatacaggactattattatacttgtcctaaatcaatgagctcctttttccaagttaactgttactaactttcaactgttttctcaaggcctcctc

SEQ ID NO: 2310 - DNA, 201 bp, Bos taurus
ttatacttctgctattttgggactttgggtccctgtctctgtgattctcatggtcaaaagtcagttgtcacagctctatgaatcatttatccaaaggccagaaacaggaggcagtgggagagtatgtgcctatcttattttagcaaggagaaaaagtctttctaaacagttttccatcagaattcctctgaaggcctcgtt

SEQ ID NO: 2311 - DNA, 201 bp, Bos taurus
ggcgacctagaagattagtggcaacacgtgtgagctacaaaatgaccactgctttgcttctccccttcaaatctcctgcaagaatatctgctatggccactctaatgggacacgtgcaggggagggaactctgggaaaggcagttcatcctcaccaagttgacactatcaagccaccctgccaggtcagctgcttccatgg

SEQ ID NO: 2312 - DNA, 201 bp, Bos taurus
ttgctgcatatgataaatcagcagtcatcattccagtatgctaatgtgtcactcaggtatattctttagatagtggcctgttcttttaaaagatgatgctttaacttggttatggcaagttggacatggacaggtagactggagtcatgaagcgacaggtgggccaacaggaagatgattaactttatcccttactttccc

SEQ ID NO: 2313 - DNA, 201 bp, Bos taurus
tactgctgcaatgaacacaggggtacagatatcttttccagccagtgtttccattttcttcagataaagacccagaggtggatcatatggccatttttaattttttgaggaacttccatactgttttgtatagtagtcttgccagggaaatcccatggacagaggagcctggcaggccacaatccatagggtcacaaagaa

SEQ ID NO: 2314 - DNA, 201 bp, Bos taurus
caagctgtaggagcagggatgaaatgattagatttttatctttcctcagtttgaagccattaatgaggtctgtaatatattgttctgcccaggaatcaccgggccagcaaatttccctcaggcctcagaatgcagattgaatcaatgttttttcacttggctccttcttcttctggatttcctttttcacagagcagttac

SEQ ID NO: 2315 - DNA, 201 bp, Bos taurus
cagggcaggcctctctctttagagggactaccactaaaatgtagatgagaatggagccaaccatgtgatgatattgggggagatcatctaagtagaaggcgcaagaagcttaggatgtgtgcagatcagaagggaggacacttggcctcagtgtcagaagcctggggaaagttaagagtaacagagacctgcaggcaagat

SEQ ID NO: 2316 - DNA, 201 bp, Bos taurus
atgaaacaaacacaacacagaattaaaggaaccctgaaactgaagaagcaggagatgaagttcaaagatacagagtctggaaagaaccaaggagaatcacgtgacccatatcaaggcttaagggccaaaaggcaaaaggaaaggtcaaggttgaagctctgacaactcatttttattcatttcctttacacgcgttcacaa

SEQ ID NO: 2317 - DNA, 201 bp, Bos taurus
cccacagtgtgggctgtgccctcattcaatgactactggctcccacttagcttctagacttgagacagtccacccaagcccagattctgttgggatctcttgccatcaggccaaagttctatttgaatagcaatttcaaaatgattctaggacaaaagtcaatcagtgatcagtctctgttgatgagccagcagcagccaa

SEQ ID NO: 2318 - DNA, 201 bp, Bos taurus
gaaggtgacaacccctagcatgtagtagcagcagcacacttaactaaaccaggggtggacaaactatggccataggccaaatctgtctcattgcctacttttgtaaataaagtcttatgggaacatagccacacccatttgtttatctttgtctatgtatgcttctgctgaatagttgtgacagagacctatgtcctgcaa

SEQ ID NO: 2319 - DNA, 201 bp, Bos taurus
tctctgggaagattctcttactagatatttctttactttgcttttagtggtattactgtaaatcatgtcctatatattgaatctcaggatgctgcaaatgagaggaaccataatatgaaaaatcttaggatgctacaactgtgagcaaccataatacaaaccaacatttcatacagaagactcagggggcttagaaagttg

SEQ ID NO: 2320 - DNA, 201 bp, Bos taurus
ccgaggtaggtataacggaagagtttataaaggctgaagcacaaaggctgatggaaagtctaatgcagcatcagcaaatgatggagtcgaggaagatatttcatcaggaacaagtgagactaatggagacaaacagagtataccaggaggcactgcaacagagggccatggaacgtcagctccaggtactcatcaattatt

SEQ ID NO: 2321 - DNA, 201 bp, Bos taurus
agcattccagaggctcactgttcagtagaatgacctttggggaatcctggcttagacctcctgatgtagagcacagaggccttttcccaaggaagtcctcaatcaaaagagcccaagtgaaagaaagtggaagtgaaagtcactcagttgtgtctgactctttgggaccccatggactatacagtccatggaattctccag

SEQ ID NO: 2322 - DNA, 201 bp, Bos taurus
gtgtcataacaaaagaatttcaaacagaatggggaataaagaaaagtttcttttacttatactgtttattatttctcagtagtatgtccacctcagtgtactgctgctgtgtacacacaattttatttaaaaatatgtttaaaataagaataaaaaaaaaaaaagactggaaggggagagattaaaatattatgtctgagc

SEQ ID NO: 2323 - DNA, 201 bp, Bos taurus
acatctagccttactcagtgtcattgctctgtactgctagtgtagtgaattataggtcaggaaatgatataaatacagggggcaaactgtaagacagccagtttagggagagtcagtttgcgttacagatctatctgcacattttcatgaggttaagtttaagacaataggaaacagttgttagcatgaatgtaatgaatt

SEQ ID NO: 2324 - DNA, 201 bp, Bos taurus
gtcaaaactagtggtggtcttacatagaatttgatacctttcttcttaagtactcctctgttggcccaataatgtgcccaaagaaccaaagttagaatttccttacttccctttaggagtatctctgtattcaaccactgaaaatgtaaatatcctgaaattggtatctcagaattattaaacattgtggtatgcacctgt

SEQ ID NO: 2325 - DNA, 201 bp, Bos taurus
tttgttaaggtagagaaggtggcagtgaactagagtgggtctcatagtcagataactgagttagaagctgccacatacttgctgaaccaagtgtttcaatcacctccctgaaactcaacgttcaagaacgataatatccaccttgcagggcaggtggccatatatacctgtcagagtaccaccaacaaactgcacatctga

SEQ ID NO: 2326 - DNA, 201 bp, Bos taurus
gtcctttcttttgtttgtttaaacaaaattcactcacagctgcaagcagcacaatgaaagcacattttaaaataatcagatgcttttggggcctcctgctgccagaacaacttcagtccgagttgctgccggctgcctttcaaggctgcagcctctggcaccaactgtctgagggggtgcagtggagttgaaagccattgg

SEQ ID NO: 2327 - DNA, 201 bp, Bos taurus
ttttttgcttaaagaccctttggcatctccaccaaatttctggattaaaaaaacctgtgacattgggtaaaggattttaaaagttattgtgtgaacaagagtccctaggtgatccttcttatgcaatattttagacaatttaattctgttccacaaaatatagaatctgtgactcagggtgattttttttttcttcttcca

SEQ ID NO: 2328 - DNA, 201 bp, Bos taurus
aaatatgggtactactaaagaagcaaggattatcagttctgtggagcaagaattctcttagctattctagccggataatgcactggctgatgtggcttcacccaaacgtcgtctcttttagatgtaggaagcccactctaaccattcaaactttcaactttaggaggaaaccaagtggaacagtgagagaacaactcccag

SEQ ID NO: 2329 - DNA, 201 bp, Bos taurus
tttattaattgtggctctactttttaatgtttccttttttcatctttgtctggctttattcttgtgttttttctaactttttgagtttaataataattcaataacattcagtctttcttcttttataagaattcaagactgcaatttttcctctatatatcactttagcttcactcctggctggatgaatcacaagctgga

SEQ ID NO: 2330 - DNA, 201 bp, Bos taurus
aaacaataaatctaccctcctctcctgccctgcaaaccatcactccaaacagaaaatgtggaaaaccttgcaagaaagttggattctgttatatttccacaccttcaaagttcagataatttgggaattcttcaaaatttggatgtagtttcaaaccaaatctaaacattttttttgtttttccacaacaaataaaattca

SEQ ID NO: 2331 - DNA, 201 bp, Bos taurus
caggagttgggtcatctattagacgatgcgtgtatgtttgtatatatatgttttctaaaagctgaccccaaatctgaagaatgtgaagggcaaaaacatagctgtgtaactggcctcttgaaaataaaagccaaattgaatgagcagaaaggatgggcacttctaagatggggctgctggatggtgaatacatgtgagcaa

SEQ ID NO: 2332 - DNA, 201 bp, Bos taurus
atctgactctggacctacatgatgactggctcctgtgtttgaaaaactctcacatgaaaacaagggacaagacgtctctactaagagatccgaacaaggaccagagtgcggaagttaaagtgtgaaagtctcagcccaacataaagaattgtgtgacaatgagaggaatctagttcttaggggctgcaggccctaacagtg

SEQ ID NO: 2333 - DNA, 201 bp, Bos taurus
gtgtgttccctcaagtctctttgatccctcaaggcagcagtgagccccaggctctggaaagacaggatggctgagctgcttgagagaagcctttgcacccgggggatcggctggccgctcacacctggcgctgtgccctgggctgtcctctttcactcccaggccggcaggaaggcaagagctgtcacctgacagactgcc

SEQ ID NO: 2334 - DNA, 201 bp, Bos taurus
gagtgtcatggaaataattattagcttagatcatggtaacgaaatgcatataagagtctgaagacatgtaataacaggatttggcctatactcgagaagtttgtgaatgattccccaagaaaatgacttgagttattcccaaaggacgaagagtggtaagaagagtctgccagacagaatgaacagcatatacaaaggccc

SEQ ID NO: 2335 - DNA, 201 bp, Bos taurus
gcatagctggggcaaaggcaaaggatgttgagcatctgtacagacacagtgttttgcaaacccaaatattgcccactctcttcatatactaatcacatcccatctgtcaccaagtgctgggtcctctgtccctgagatccatctgcttctccccaatgttatcaccacttccttggacaactgcagtaacctcctcagagg

SEQ ID NO: 2336 - DNA, 201 bp, Bos taurus
atttattggaccacatttattcatacaaacatgcagaataaatggaaagaatagattacattttaacttgcatttttcaaaagcaagatacagtgagtaactataacagttacccaactcaaaccaacttagcaatcttcaatggttactgcacaccacagggagatatttttcattttgaagcaaaggagaactatctcc

SEQ ID NO: 2337 - DNA, 201 bp, Bos taurus
gttagattcctagtgaggtgactaagatcccacatcccaaggagcaactgggcccattagggcacctcaactgctgggccctcatccagcaagtaagatccgaggcagacaaataaatagataaatatgttcttaaaaaaaagtttgttaaattttctataaggaaagagaggttggtggcctaaatgaaggattacttat

SEQ ID NO: 2338 - DNA, 201 bp, Bos taurus
gccttctaatagacttgtggttaattatgcaaatgatagtttgtgataattggtcagttttatgaacaacagatttttaaattaaggaggttaataagggagatgattattgtgcctcgtgtgctgtgtgctctttgaaagtaacaacaacaaacttgaaagcaagtaagacataccgagcctcaagagattgcctgttcc

SEQ ID NO: 2339 - DNA, 201 bp, Bos taurus
ccagaacatctgacttttgcccagtgtgacctcttctcatggcttcctgctcccagcactgagccagtccctccttattccccctggctgctgctgctattgctatttgttataccagctgtaccctgaactcaaggtacctgtttctttttaggagttgtaaagttaacagatgctacagaaattttgtaacatatgatt

SEQ ID NO: 2340 - DNA, 201 bp, Bos taurus
ctcaccattctcaatccagccaggtatgtacatggctccatttcgctggggtgatgcattctgagaggctgtgttgactcctcccagagcccacacttttgcactgtatctaccatttgtgtcataagctgtaaagtaccttgaatagataccatcatccttagtagcatcagcaccttgacagagaaatgaaggaattaa

SEQ ID NO: 2341 - DNA, 201 bp, Bos taurus
taatcctgtactgtattaattatgtagaagcagtggttacatggttaagtgattgggctttgaagttaggcttcctgaattgaaatcccagctttgctttctactggctgaatggccttgtgtgttagtcgctcagatgtgtctgattttttgtgaccccatggattgtagtattctctaggcaaggatactggagtgggt

SEQ ID NO: 2342 - DNA, 201 bp, Bos taurus
tgcttttctctgatcccctcactcctaagactgctgttatcatctgcaggggcttacttcccagtgacccaattgcttcatagtatttttcaaaaatacactaatttcagaaactggccacattttttgcctaacaattgctaacaatattagtgttgccttttaattttaaatcatagtacttgtgttacatgcttgacc

SEQ ID NO: 2343 - DNA, 201 bp, Bos taurus
actgaacctacagaggttcaataatttgcttaagattttccatgctatttctgtttttatctcttctttttcctaatgcagtagtactcagcattagtttaagtgtctaaaactgtccagggtttaaatagaggtatttggaaaatagagctcagctgaaggtcaaatcataataggagcttagcatattgagaaaccatc

SEQ ID NO: 2344 - DNA, 201 bp, Bos taurus
ttcaagagcttgactcccctctttcctgtggtaggaatctgtcagctcacattagaattgtacagcgtgaccggatgttatagaggcagacaagcaagatatgtctcactgatgcatctggacaggaaaccttaaatatggttttcttttcttaaaaaaagaaatatccagcacatgtgtttttatttttcttctcagcat

SEQ ID NO: 2345 - DNA, 201 bp, Bos taurus
ttcacttacagctgttccccttgagtgagggttacactcacacttaaaggacacagattcttattatttaggaaacaatttttaaaggactatgacacaacacaaaatctcattacatagttcaaaagatggtgagtgtggtgagggtggaagataaagctgtaacatttgtggagcccttacatgcatcagaaattctgc

SEQ ID NO: 2346 - DNA, 201 bp, Bos taurus
ccagaaactgaagtcagtcagtcggtcaatatacaaacaagtaaataaaacacagactttaaagcagcctactatctagtggtcaccaacctagctaaaagaattatgaattatttcgccttctgctacaaccttcaaggcacatgatagcacttttaaaaaatatgttctgtaacaaaaaagaaaaactaaagtagaaca

SEQ ID NO: 2347 - DNA, 201 bp, Bos taurus
ttcccgaggccggtggtagcggctcttgcagccccggagctggactctgacgcccgcccgggctccagctcccgttgccctcgcatcctccttccgttctcctcgctcagggccctggctgaggttttgtttcccctcggtgctccttgggcatccagcctgggaactgctggggtgctcgaggtccccctgggctctgtg

SEQ ID NO: 2348 - DNA, 201 bp, Bos taurus
aaatttggggcatttttggccattactttttcaaataatctttctgtcccattatttctctcctttccttctgggactccatttacatgtatgttagactactcagtattttcccataggtcactagatctctgttcatttttgccatgtatttttttcctcttcttcagataacttctatggatctacctttaagttcac

SEQ ID NO: 2349 - DNA, 201 bp, Bos taurus
gaggtgtaaaaaacaatacatatgtattatttcttatagtttctgtgggtcaggaacttgagagtggcttatttgggtgggtttagcttagggttttatacgaggttataatcaacatttgctagctaggtaatgctcaaaatccttcaagctgggctttagcaggacataaactgagaaattccagatgtataagctgga

SEQ ID NO: 2350 - DNA, 201 bp, Bos taurus
tggccaggattctgatgagaatatgactacaggaaaatccagttttaaaaacaaagtttgggtaaacaatgcttctcccaataaaaagaggttaaaaaaccggaagaaaccaatggcctgaagagaaagctgattttacaaagtcataaacaaaagacaaatgaagaaaacaactacagcagaccaacaaagtagcttcag

SEQ ID NO: 2351 - DNA, 201 bp, Bos taurus
tgaaaactaatgacgtctccatgagggtcagaaataagtgggttggtgaaattgggatttagtgagttgaactggttatttgagaacagtttaggcacctgcattaaatcaatgaataaaattgatggtgggtaagtcctactgctaatttggacatataaatactgatatagacaggcaggaagacaaatggatggagac

SEQ ID NO: 2352 - DNA, 201 bp, Bos taurus
caaaatagggcgtgtatgagctaaaaagtaacttgggccagagtataacagcatgagggaactcctctcaaagcaggcaacatttgagctgagcctaaatcataagaaggaaggggccagctgtgtgaagttctagagagaagtttaggcaaactgtgtggatcacaataaactggaaaattctgaaagagatgggaatac

SEQ ID NO: 2353 - DNA, 201 bp, Bos taurus
ctcccacttgcctcccctatcctacataggaccaagtgtgaaggtacttcaatgctaagggtagtacacagtgttaaaagtgcctgggccctggagtcaggcttggattcagatccgactgtggcactcaccagcagtgtggactcaggcaaactttcttaggcctcagtttgcttctgtatgaatagtgcctaccttagg

SEQ ID NO: 2354 - DNA, 201 bp, Bos taurus
agctcagcatctcaggttgatgagaagcacagtgacccaatctcttgattactagccagacaccctgcggttcctgaggcctccctgtaaaaacagcccagcactgtctctgaggttcagggtccctggagtcattgggaaagtatgttccccaagtgcctactatggtcttggccatggattgttctagccaatataagg

SEQ ID NO: 2355 - DNA, 201 bp, Bos taurus
atttggggaaggcttcttagggatctggaatggtgggtgggatttgtattggcaggagggaaggaattctaagccggagaaacagtataatcagaagtgtgatggtagaaacatctcaagcttgtgcagtagcacaaggaatgccctgtgaaacacagatggatgttgaggtacaaggggaagtgactatgaagaagaagg

SEQ ID NO: 2356 - DNA, 201 bp, Bos taurus
ggcagattctttaccatctgagccaccagggaagcccttttattttccagctacttctatctagattgtgcaaaatgtgtagccagtagctcctgtgtgtatgtatcaaggtctccctctcccatttacgtattctctgggatgagtcttacctggtccagcctgaaatcagaacacaccttagaacattcacatctggcc

SEQ ID NO: 2357 - DNA, 201 bp, Bos taurus
agcatgtgatgatgtaggatttgccagtggattggatgtggcagcaagagaggtgtgttaagacaacttcaagtgttttgatccaaaccactacaaaagttgaatttcttttaatgatggagaggtggcagtaacaacagatttggggatgggtaggaatcaagaattcagttttagcgtggtacttatgttgtagagata

SEQ ID NO: 2358 - DNA, 201 bp, Bos taurus
aatattgaatcactatgttgtacacctgaaaccaatactgtaaatcaactatacatcaattaaaaaacacagatggccaacctctaggacgctgtttccacagatctgacattgactgtcattaaacatgtgtctgtggggcttctgtaaacgtgagcagctgggttggccctgctgctagactaagtccagggctcttgg

SEQ ID NO: 2359 - DNA, 201 bp, Bos taurus
ttttgtctgtaggagactcaaaatcaaggaaaactagtcttctgtggaacatatagttttccttttgctttatcttatagggcattctaaatctcataacaaattagatttctttcttttgactactagaaatattagagccaagtctgtgacccatctctagtaaatatataaaaacatgtgcatacaattttgtgtgct

SEQ ID NO: 2360 - DNA, 201 bp, Bos taurus
aactctcttcactcatatataatagaaaaaaaaaatcatatctggcctcaatggattttatagtattttgaatgttcaacttttaaaaaaaatcctactttttatcctgagattggaagtgtttcctgtaatttactttccattaagttaaaacacatatcaaatgtcaaacaataatcagtatcaaggctgcaaagaaca

SEQ ID NO: 2361 - DNA, 201 bp, Bos taurus
actttgtacatacttgctgagtgagggcccaagagcagctccagccatacaacgtacagacacagacgtggggaacagcttgttcagccactcaggtgccattatgcagagccctggcccaaagggatacaggccttcctgtctccaggtctcttccctgggttcaggtgagagctgagggtgcagaagtctgacttcttg

SEQ ID NO: 2362 - DNA, 201 bp, Bos taurus
atctgactgtgcatgttctaaaaacatttactggcctggtgtgtgagatccctgtggtgaaagcccatatacattgaacatggctctgctattctttccacggttggtaagaatgccaaggcccgggcctgaactagagaagtcttagatgtgtctctgctgcctgaagggcttggcatgcacatctctttgcagctggct

SEQ ID NO: 2363 - DNA, 201 bp, Bos taurus
tagagcatgcagcacagagaaaatgaaaagagctttcttttgttttaaaaagaaaagcctctagaagcaaagcttaactgttcagtgcaagagatcactagtaaacatcagattaatgccaaagatgtgtataactagatttgatttctttcaagctattctagcctccttcatataccgctagaacaactcaaaatggca

SEQ ID NO: 2364 - DNA, 201 bp, Bos taurus
agctctagatgacatacaagctcctgggcctcaggacgccaatgcggcttggtagtctggggcagagagatgaacaaccgtttccccaaatttgtattgtatgctgtcacctgggccttcagaacaaccccaagtcttatcaagctgcgctcatggaaaaaagtagcttcaccccaacagtcctctccctaacctcatttg

SEQ ID NO: 2365 - DNA, 201 bp, Bos taurus
actctctaagagctgtgggatgcctccaagcaatttatttacttgaaatattttcaaacatttagtaaatgcctgattgagaagtagattcatatgaaagacattattaaaaagagattgagatatagcttgctcagaaattttcatatgacaccttcttttgtgtgatcagagaatgatttgcctaaattctaatatttc

SEQ ID NO: 2366 - DNA, 201 bp, Bos taurus
cttaaatgacctccacaagttttagaagatacaggggttatttgaattattatgattcatgaacaattagatcacatttataatcagcaatgcaaaatatcttttagtgtatagtcctattttaatgatgcttcatcaagttgaaaataattagtgttaaatagttatttgttccgaatgattaaagacacatcaagttaa

SEQ ID NO: 2367 - DNA, 201 bp, Bos taurus
tgatctgtttaggataccagccttataatgcattcacccaggatgtaactacctgccaaaactttgctcttcattttctaaatttcttgattaaattatggatccttcttgcctctttgggccacaatacctatagatattttaataacatttattggattctgcttatttcgtatctgcatatctgattctaaacatagc

SEQ ID NO: 2368 - DNA, 201 bp, Bos taurus
agcctctggaagaatggataaatggtggcaaagatgttcaaacaaaatgcagtggtagtttgacaatgatcattctaggcttgatctcagaaaatatttaaattaactatttccattttaaaataaaatatttaagttcacaagtagcagcaaaaaaaaaaaaaaaatcccagaaatgcatataaaaactgaacaggatgt

SEQ ID NO: 2369 - DNA, 201 bp, Bos taurus
tactgggcagtaatgtaatgtgagcacatttgagttgcaatctgagaaatgtcaaggtgctcccctctatggcagtctgctcaaaaccaataccaggccgtaagatgaagacaagaaattttgggaaaaaaaagtagacatgtgatttttttgggggggggaggtcaacttcgatgcattttgtacatctgtttgaactgt

SEQ ID NO: 2370 - DNA, 201 bp, Bos taurus
tgaactgaaagctaaaaaaattaaaattacaaaaacgtatgctatgtccaaaccatcagcttaaaagaaatggagtgactataaacctagatattttatcctattgcaataggcaacctcaatgtccctcagtgagccccaccccctctattcacatgtatgcatgtgtgctaagtcgcttctgttgtgtccaactctttg

SEQ ID NO: 2371 - DNA, 201 bp, Bos taurus
aacttctgcacagactctatcgactgagtatgattctctttcttggtcaggagagaacaagatagtgcctcttccatacaggagcttttgaaatattcgagaaaaaagcaatcatagattcttcaagtccctccctcattagggtaacatttcatgtttcttcagctgttacttacaggaaatggctttcaattcccccca

SEQ ID NO: 2372 - DNA, 201 bp, Bos taurus
caattcaaaacccttcaaaacatggacagagtaatggtaactaatgcagtggtagaggattttcctgaattgtccacatttatttcatcagaaagatagtgtaatatataaagttcaaatgagtttaggatcttttagtcctgacttccgtgtggtaccttaatttacccttttatatccctatgagtatatccctttgct

SEQ ID NO: 2373 - DNA, 201 bp, Bos taurus
tttgacattgttctgtgtgtagaaaaacagaaagagcctcatttcccagtatgcctttaggaatccttaacatgaagggtaggaaacacccattctgccttcttctttattgctggtagtcagtgagatcactaggtaagggacaagtagtcaagctttaaatgatgcaataagtaattgcatgtagactgtgataacact

SEQ ID NO: 2374 - DNA, 201 bp, Bos taurus
catattcaggtaaatgtaaaaatggtgatatctgaataaggttgatgaagtttatctgtgtcagcttcctagctgtgatactgtgctacagctatgaaaaatattaccagtgagcgaaactgaatgatatatatatatatacaaaatgttacattttatagaaatgtatatgatcccacaataaactcaaagtagaaaatt

SEQ ID NO: 2375 - DNA, 201 bp, Bos taurus
ttagagttaaaacaactcaatgttgtgggaaatgaagtagactcagatttctggtgtgtcagtgcttagaaaagagctatttcttgagctaggacacattgattcctccatttagttaaaattcaccgtgtacccggcactagtctgagtgttagggacagagcaataagaacaaggtctttagctcatgaatcttcagca

SEQ ID NO: 2376 - DNA, 201 bp, Bos taurus
gataatacaataatcctacgcctatttaaaataatctgtcaataattaataaccttccaaaagagaaagcaccaggcccagaaattttcatgggtgaactctactacacatttaagggatcagttcagttcagtcactcagtcgtgtctgactctttgcgaccccatgaattgcagtacgccaggcctccctgttcatcac

SEQ ID NO: 2377 - DNA, 201 bp, Bos taurus
agcacctaatattgctagtgcctagaacagtgtttattgaatatttgttgaaagaaaaacttaaagaatatgttcacaggaagaacagaatttcatgaaacattatttatagctctaaggtaattttccatattccaagtctttccatgtatagaaggtcaaatgacatttttcattgctgttttttactggaattatacc

SEQ ID NO: 2378 - DNA, 201 bp, Bos taurus
tttgtattatcacttccccgaagagttatttggtaatgaaaaatgttggttatcttagcacagttacacaggtacaagcaaaactataatagattcataagaaacaaacaaacaaacaaaaatgagtagggtagcctgtgtattctgattgaaggtgcagagtctgaactggcagaactcttcacatagccagttgagtgt

SEQ ID NO: 2379 - DNA, 201 bp, Bos taurus
taagtgctacttaataaagtaattaagtgttaaagaacctctggccagactgttgtttgtcttctgtttaaaaaaaaaaaaaatgaatacgagacaaaaagaagccttttaagtacagccaggaggccagagggaggagctctcctgagacaacagcagagcctaataggaagaagaaagactcctcttttttcctgacaa

SEQ ID NO: 2380 - DNA, 201 bp, Bos taurus
acagtgtacatccctttttacatgcaaaggagatatgctaactaggttactaagaatctgggggccaagagggagtcatccagaagacaacaaaagtccatgaagaatggggcacttcccagcatctctcaggaagcaatcggtaagagagtgttggctgaaatcagttatctggcacacaggagggtctgatgttgattt

SEQ ID NO: 2381 - DNA, 201 bp, Bos taurus
agacacatacaactacatgatctgtttgggaaaaatgaaccattgaccatagctgatcagtctgagattcaaacgctctaagcaccagaatgtcatggtcactgttcacccatagacccagtaatgcatcatggcagtggacgagccacccactgtgcaaagtatttccaaaaaggctcttggttccttgtttcttatttg

SEQ ID NO: 2382 - DNA, 201 bp, Bos taurus
agggaggattcccaatgacaccacacagagaagtaacattagttctagtaataaaatagtatttaactaaattacctttgtataaatatctacctggtaccatgtattaaaatattaaggactcagacccatatgtgtccttctttgaagaataatatccctgcagtggctactaacagttaaacctgattctgtgtttat

SEQ ID NO: 2383 - DNA, 201 bp, Bos taurus
ttgatatggattcaattttcttgtattcattgaaaggttttgtgaactagcatatgttctttcttggagaatggtccatacatgtttgagaaaaatgtgtactatgaggctgttggacgaaatgttctataactgcttgttaggttcatttgatctaagatacagtttaatccaatgtgtccttatccattgtttaaagta

SEQ ID NO: 2384 - DNA, 201 bp, Bos taurus
caacaagtcatcagagaccacagaaccacataattctactctgccacagcagtctttatttcaaaaggagtggtttccagcacaaggaaacatgcttccttagatgctacacttcaacagtgtgctgagacaggtaactctaagaaaaaagtagtgaaattaaaatgagaccatgtctttcatataattttcttctcctat

SEQ ID NO: 2385 - DNA, 201 bp, Bos taurus
ggtaagacatgctattacagtaaacagggattcatgataataatgggaatgagaggatccaaacagtaataatagaggactggagagaatatttgcttccccagtggctcagtggtagtgaatccacttgagatgcagaaaccacaggaggcaagggtttgatccctgggttaggaagatcccctggaggagggcatttca

SEQ ID NO: 2386 - DNA, 201 bp, Bos taurus
tatttttgtgtaattctctcacttctgccctctgtaatgtgccagctgcatctgcaggatcacttctttcatgatagcaaaatggctggagcagttcaggtttctgtaaccatatccttcagaaagagtgccccagtgctaacatgcaaggagaaagtcttgggttttgaaccatccctttagcctccatttctccctgga

SEQ ID NO: 2387 - DNA, 201 bp, Bos taurus
gtgaaattataagatagcgatccttaattctctagtgcagtttgataattaggtgtattcttaatggtgggtgaggcccctaattatacaattaaggttcgaaaacctcttgaaatcctaacgtggagaatacttccacacaaatggccttgctattatttttaaaaatccctgtaatatcaaccaaatccagaagaagaa

SEQ ID NO: 2388 - DNA, 201 bp, Bos taurus
caaaggaatgctatttccaaaggaatattcagagctccttgaatcatttgctactttatagacacttagatgacaacaattctatagataaaacaaataacaccagtaggtgttattaatctctctgggtctgaccacaatgtacatagataatatagatatttatcctatttagctctctcatgttgtccacatctgaaa

SEQ ID NO: 2389 - DNA, 201 bp, Bos taurus
gggctttgttcaggatggttgatggtgttctgagacctggggagagaggaatagcaactgtagtacttgttatacactagagagatctggacgctgagcccgaagaccagactgaaaaacacagtgtgagtgactgcctgctggctgacaaggagcaagagggacacagccttgccctcccctccccaccgcatgctctgt

SEQ ID NO: 2390 - DNA, 201 bp, Bos taurus
caaggcaggaacaatgtaggtatctggcccactgccacaatcattatgtcacttctgatgaagctcgactttccacgattcaggaccttcacagcacatatagattccagaatataccctggaactaaaaacatttatggtttgctcagtgtgccctgatgtatgccaatgtcttagtcttccattcttccttaaaatagt

SEQ ID NO: 2391 - DNA, 201 bp, Bos taurus
ccaagtgcattccttcactcacatctgaattggcaaaggctttccctttcaaatttaaaatctccattctctttctcaagttagggttttttgtgggttctacagtcgggttagtgggtcacactctaaatccgattcctaattctgttgttgaaggacacagcttcaccacgtgcaaaacaactgttttgccgtgacaaa

SEQ ID NO: 2392 - DNA, 201 bp, Bos taurus
caatagaaaaaccaggtttctccccacagcatattgttgatatttttaacatttagcaagatacatactttctaatatctctaccatgattaagctgatttattctgcactaaacaattttatcttaacacctatccctgttatccagcatacaatgccttagagtttagcatacctgattttaaattctgactttgctat

SEQ ID NO: 2393 - DNA, 201 bp, Bos taurus
gggtttaacccgtcatttataccagttagagggaatccatgaaattacctatggctaggcactttggaaagtttccaggctatttttcaaaggttaaccgatactgctggtcacccttgccaaacagaaatacaagagggagagaaatgagggaactgagaaatgaggatatagatatcctttttaaaaaaatacagtttt

SEQ ID NO: 2394 - DNA, 201 bp, Bos taurus
ggaggttaagcagtttgtttaaggtcacttgtccataatgctcttaaatgttatgatcttacttttctagacaaaagattttaatagactctgagaaagtatgacaccccacaagcaatatgtccttattttggagcatttaactgacactgtgctctgtgtaaatctctaaaagaagaaaaaatgtgggaatataaggta

SEQ ID NO: 2395 - DNA, 201 bp, Bos taurus
tcctcacatctgtgggtatctctcaggagaaatgaatcattagctcaagattagtagcaaaaactactaatcgcacatttgagaaaaatgtaagaaattatgaagaatcagagattaattcctagaacaagtagcttctaaataatcatgctgagaggaaagtgatctcttcatataggaaggaaaagtataaaggaaaga

SEQ ID NO: 2396 - DNA, 201 bp, Bos taurus
tttttcccacacaaataaagcttaagtccatccatctgtctgttcaatgagtaaaagaatatcaaattgattattctcattctactacgtacagccactttcacatcaaataaaattattttcaaaagttcaagctttaaatgcaattttgaaaacaatcaaaagattttactgctgtgattcaaatgaaaaacaaccttc

SEQ ID NO: 2397 - DNA, 201 bp, Bos taurus
atgtattctttgccttctgctattgtcattttagtttcctatactgtcttgcacttgaaggtgaaattaccattagtgtcaatggataatccaggcgtaggctaaaggaaacacaagactttggcaacaatgacacaattctccaagtgaagcaagaatgtgaaaaaagtatgcatttcacatttaaagtattctggtgat

SEQ ID NO: 2398 - DNA, 201 bp, Bos taurus
attcctcatgctgcaacctccggaggaacaaggcaaatggctgccacataatgtgcaatggaggacttgagagtaacacactttcataatatgtggtcaacaaggagaatgtcactaattagaagccaaggaacaaaccatttgcaaatgaattagtatatgaaccataccctagggacccaaaagacttcatttgctttt

SEQ ID NO: 2399 - DNA, 201 bp, Bos taurus
catctgtccccctggtaaatgcagttgtgagggcaaatcagaaagcaagtctttccccaggggaagggagagtgcatggtttcctcttcaatgaatatactattatatgaggagtttataaagttaatactattgtgaactcaagtaacatttttaatgtaaaaaatacaatggctcagaggatgttctttctttaggtaa

SEQ ID NO: 2400 - DNA, 201 bp, Bos taurus
caggaaagttcctaataacctatttttaataacctaaaaacagatttcccaatatagggcctatatagatctgtctcatttttaagggttgcataacatgacactgtatgagtatactctaatttttctactcaatttccaactgataggcatcttgaaagtttttaattgttttctgtgataaaaaagctacactctata

SEQ ID NO: 2401 - DNA, 201 bp, Bos taurus
tatctgtaggcttccactattagacttttgtttcctcggtacaatatatagacattaatgtatcttccaatatctatttcaaaaaaatctcttaacctggcaagtaagaaagttaacctctctgaattgagaaaaataaaacacaactcttttacaattgttgctatatagagataacatttaagtgatttgattggttag

SEQ ID NO: 2402 - DNA, 201 bp, Bos taurus
aagataaaataaaaacataaaaataggcctatgtaagaaacaaatcacagttttctacaaggcaaatagcccagctgataaatcatttttgttctgtctgtcctgtgtgaagaggctgaagagatgacacatctcttaaataaatctggaagcttttctcatttaaactatctttgctgctatatttattccagaaactaa

SEQ ID NO: 2403 - DNA, 201 bp, Bos taurus
cttctctcctggtgccagaccaacaaataatatcaaatcacaataataaatccagcagataaatgctgagcctcttaattggggaaaagaactatacaattgtgacaatgagaatggcaggattcccaaataataatcaaaatagaaggaagagaatttatgatgcacataaggttggagtggtaactagcatgtgggaag

SEQ ID NO: 2404 - DNA, 201 bp, Bos taurus
gattgcacctctccctttttgatgaaagaatgaagctctcctttgcttctgaaccaaactttatcttgttctattggcacaaatgacagtgggaggaaggcgcgttattggggatcaactcaggaaggtaagtaacagaccagtgaagaaatacagggcctaggtgaaagaatttcctggccaggtaggagttggtctgct

SEQ ID NO: 2405 - DNA, 201 bp, Bos taurus
catgccatagggccatgaactaattcacgtgactagcaagcatgtgttcaagtatataataacaagcctgctcatgtctatttacaaggcagatacccagccctctggatttcttaggtttaaaaaaacacagtttattttccaaatcttggcaggtgcttacgtttggacctgaatacatttcattacatttcactgtca

SEQ ID NO: 2406 - DNA, 201 bp, Bos taurus
tcattcctcctgtaccaataaagcaatgctccatgaaatgttttgttgaaacatgagaactactaatcaaatggaaaggtttgttccttgctacttttgccggcagtagtgagaatttgggcaacgtttctcactcaaattgaatttactcttctttaatttggtctggaggaaacagtagtgatggaagttctacagaga

SEQ ID NO: 2407 - DNA, 201 bp, Bos taurus
ttacatatggcatacatttctcatggtgatcaaatactaaatagattcctgatattacaaaatgacagttcatttatggataattggaaaggaaatgcaaaaataaatgaggtcctgtgaatatactaactaataactagtaactaatagtcagaaaaataaatcagtatgtagatagatgccataatgcaatttcctttt

SEQ ID NO: 2408 - DNA, 201 bp, Bos taurus
gtaattttggacaaattctgagaccctgactttgagataggcataattataggaaaaactttcctaaaattatttgacatatttccctaggaatttaatggtctagtaaatatttaaaaatgaccatttcctcaaagggctctaattaggcatatttatttaattggtatttcagcttcataggttatcattaatgttgtt

SEQ ID NO: 2409 - DNA, 201 bp, Bos taurus
tctgaagagacaggatgcctggactcttttacctatgatggatggaacgtggggcaaatggcaaccaccaaaaaagtggataataagaaaacttctaaaatgttaacatacccttaaagctcgagtgaggtctagaggagaaatttagaatctccaggaacctcagacataagaaaaatctgttttcattcaaaagctttt

SEQ ID NO: 2410 - DNA, 201 bp, Bos taurus
gagatggaagaattgtctaatgcagaaaaagtctgtttaaaatttgtcactactttctcccctcctccattgtatgttcacacattgagttacatagtagctatagtttcatctgaggtcatcttatcattctggggaactagttacaaataagagccatatttttttatggcatgaggcaaacacagcatggtactttat

SEQ ID NO: 2411 - DNA, 201 bp, Bos taurus
ggaaggtaagttggaatttacagaaagggaagagaaagctaaggaagaacagatcataacttttagctaaaatgaagttgtcaatggaaagagagtgagggccagtttacacaggcacagtaagcaatgtgagaaagtttctagcaacttaattcacatagtgtctttattcagtttgatgaaaattggactatggttaga

SEQ ID NO: 2412 - DNA, 201 bp, Bos taurus
gtctcctgagctgcctggacctcggaagggcacaaaatgcatgcccaaccacgtctgtgcctttgcgaagtacccaagaagctgaacctgagcctgagcaatttagacctgggaagtgcacaaaatgcagggcccactttgaacagtacccctgaagagcaacctggagcctgagcagtgtagactgagaaagcacacgca

SEQ ID NO: 2413 - DNA, 201 bp, Bos taurus
tttaaatgaaaagctacattctctactggtaataagatttaattcatctaattataactctgggccagagtccaccaataccttgactgatgccatctgtacactactgcccataccatccctcaccctttcaattgcttcaaacataattcaagaatgtagttctaaagccatactgtgattttgtacttaaagtggttg

SEQ ID NO: 2414 - DNA, 201 bp, Bos taurus
ctcagtcatcataaaatgagaaacctatttgctttctcaactaactctattatatagtaaaattcatagcaaataggtactcattgaacttctaaggaagatatcatcatgatgatttgcttatgtactttttgttcatatatgcatatgtacacatgtgtgaggctatttgcattttcattgctaaattaatagaattat

SEQ ID NO: 2415 - DNA, 201 bp, Bos taurus
taatgaagctgctttgttgacaaatctatcatataattacatcactaatgtagcttttttgttatcaaaaatcagtccagaaaggccaaatactaacaatgttttgagttgcttgaataatcatacattgatatgaactttattaatgatcaaaatttatataaaaatcattgcactttcaattcatgcaaaaactctatt

SEQ ID NO: 2416 - DNA, 201 bp, Bos taurus
atttagatgtagagtggggacttgggctggggccctgaggcagccctcatgtgggggtcccaacacacggtttactttcatctgtatagtactgtgctgacgggcacaggcctcagagaacctccaacagtgcatgttgttgttgctattgtttagttgccaagtcatgtcccactcttttctgaccccatggattgtaac

SEQ ID NO: 2417 - DNA, 201 bp, Bos taurus
aaagactgttttactatatttgttaagtattcctttgttttgatgttatcatgaaatcaaatttttctactatcccagttgcagtatggtaaactacactgttttggcgattacttttcctttcttctaactgattacaaaccaaattataaaatgctggaagcattcaggcttaaataagttttcaactttaaagcatga

SEQ ID NO: 2418 - DNA, 201 bp, Bos taurus
cataaagatggggtattgtatgatcccaggtatattctgttgacattttaatgttttaaacgacaaattatatcaacagaaatcccatatgtaaaaggatgttctttaaccatttagtccattgtaattatcaaatctttggttgaaatcaagtacattttacagtcttgtttcatagtgtgcattttcgtatccttgctc

SEQ ID NO: 2419 - DNA, 201 bp, Bos taurus
tacactactactatctcactagtccccttttctcagtcccttttccaacataattcttatctcctatttttctcttaagtgggttacgtcctacaggttcgattctctaccattttattagagtaggtagtacatttacagttattataatgtttatatcattatatcatgagtttgagtaagctccaggaattggtgatg

SEQ ID NO: 2420 - DNA, 201 bp, Bos taurus
ttttctccccagctccccaaaccctgtccctctccatgtccattcccctaatcaatttcatatctctggcaactaatttccccaggaaatgatgctatagtagaaccagagaacagcatattggaacaatacaacacatctaagatttagtgaataaagattctatgggttgagaggagtaaagaaaatttaatcagtaag

SEQ ID NO: 2421 - DNA, 201 bp, Bos taurus
tggtgatggacagggaggcctggcatgctgcaattcattgggttgcaaagagtcggacatgactgaagcaacttagcagcaacatattatttttcctgggaatgttagagtgcactgtgatcaaagcatagtaaatatgtaggttgctgctgctgctgctgctaagttgcttcagtcgtgtccgactctgcgagactccat

SEQ ID NO: 2422 - DNA, 201 bp, Bos taurus
gagtctctctcatactttgactctctgctggctcttctgtcatcagatctttgaccattctgccttcctcttcagttttgggaacacatatcattgggcccatccagaataatctccctactttaagtcttaattccatctataagatctcttttgtcttgtaaaatatcatatttaaaggttccagggattagggcaatt

SEQ ID NO: 2423 - DNA, 201 bp, Bos taurus
aatattttattgtatctggctctgtatctatcttccagctgcttgggactgatgtgatacttgaaatgataaacacaagattgaatttgtaacaggtatactttttatagtttttcacatcatcttcaaggtattttgggcacttgtagctttatagaattagtagcaataaaaataagtaggatggataaggacagtccc

SEQ ID NO: 2424 - DNA, 201 bp, Bos taurus
acttaatgggatatatgcaaattttccaaacacagcctgaaactgtcatacagctgttgttattttaagatacgcatgatctcctctttctgttctaccccctttgttttcactaagtggtggcagcatgtttgcaagcctagtctggcctatgagaaatggcaatagcatttgctgggttccactgagaaggatcattac

SEQ ID NO: 2425 - DNA, 201 bp, Bos taurus
cagactgcacagatttgaaagctgatggccattatatgggggggaaaagcatttgaaaacatttgagtttagtactgagacaagagaaatataaactgagagtggtttctgttgggaacttgaaaatgcttctgctgggtaaggctgctaatgtcaaagagaaaggaaagaaaagagcaaagatatgtatttctttagctt

SEQ ID NO: 2426 - DNA, 201 bp, Bos taurus
caaattaaatatttttaagttggataatcactctaataagagtaaatttagaggtagtcaggaaatttgggctaaaaagaaacttttcccaagttcacccatggctccatctcccatcacagtgttcaatctatggctgtatttccacaaatcattttgcttttatatcagagagagaaatgctaaaggtaatcagtggga

SEQ ID NO: 2427 - DNA, 201 bp, Bos taurus
accagttctttcccagggaattctatcagcagagcagtcagttatccctttgttttaggctttccctcccagagatgctactctagaaacaactcccctacgtctaagcagacctgcggctagcttaggtacactgctacttgtttgccggtcctcagaatatttttttcaaaggacccactctttctctcaccagcctca

SEQ ID NO: 2428 - DNA, 201 bp, Bos taurus
aagatgctaagattgtgtcagggaattataaaaagtccagtacaactagattaggaagagtgaaaagatgctgttagaaggtgagcccaacaaaactgatggtttcagagacttagtgaagtaaaaatgttagtcactcagtcgtgtccaactctttctgaccccatggactgtagcccaccaggcttctctgtccattca

SEQ ID NO: 2429 - DNA, 201 bp, Bos taurus
ttaaaataaatagcttccacctcctcccccaatttgcctattactgtctctgatgatatacaatcccaagtgaaagtgttagtgaaagctttgttaatacatattccctacattccaatcccagaaaagttatagttcaccagatcctgttttatgtcttctgtcatccccctgttggtcactcttccattctccctagtg

SEQ ID NO: 2430 - DNA, 201 bp, Bos taurus
ttattaggttttctttcagtaaatttttataagaatccttattatcttttatattacacattcataatcataataatcattcatttgaatttatatattgcagaatttattgtctacaacattgttacacctccatctcattttcccttgttgacatctgtcttctaaattcattattatttgattcaggaggtatcttga

SEQ ID NO: 2431 - DNA, 201 bp, Bos taurus
atggataaatattcaggcaggccagaggtctggtggcaattgttctgattaatggaagaccatagatatccagtgcccctctttgcttggctcactcatcggtagagcttattgcctgagggccacaattaagcaattatctgatccacaggaggtgttcagtcatgttcactgaggagatgcacagtgcccatgaaatgc

SEQ ID NO: 2432 - DNA, 201 bp, Bos taurus
atggttgctctggagtataaaactttacctccaatatactgccaaaaatactgaatgattccatacaacatgttatttgagcttttacagaaagcagttttctgagattttctttctttatgcccttgtgttttcttgactttttttacccagttccagtttccttagatatgttcagaggataacatttttaggacacat

SEQ ID NO: 2433 - DNA, 201 bp, Bos taurus
tgccatttccttttccagaggatcttcctgacctagggatccaacccaagtctccttcatcccctgtattaacaggcagatactttatcactgatccacccggaagccatttctatattacaaattgatatattgacatataactagctaaaggctaaaaggcagcatagtattattctagagtccggggcagtatctgac

SEQ ID NO: 2434 - DNA, 201 bp, Bos taurus
aatttggatatatgcatatttttggttttccaagatgaataagttgtagagatctgctatacaacacagttaacatacaactggttaacaaaccagtatcaaacactgcaaaatactattcacttgtacattatatgttgagacaggagaaactaggatgaatagaaacaatcaactttatccagattttttaatatcata

SEQ ID NO: 2435 - DNA, 201 bp, Bos taurus
aaaaaatgtttaaagaacatatttctatcacctagttaaacccatcagtaaaaagtctgatattttaggatatacttaaagctaattatggaacagcactctctctctgtacccctaaacacatctgctggggttttgtagtctcattttttaaaagttcactaacattaggaaaagcctgctattttcaagtaatctgcc

SEQ ID NO: 2436 - DNA, 201 bp, Bos taurus
atgacagtatatgtatactaatccttccctatactgtaaaagctttgagtaggaattatactttctcaaatcctctctctaggatacacaggagaacagggaaaggactctcatagcttaggtaagaaagataagaagaaacaggcaatttcaagaacagaagtgcagagattcaagcagaaagcaggcctggcaacccca

SEQ ID NO: 2437 - DNA, 201 bp, Bos taurus
ggcctccctgggatgggttcttggctacccagtcccctatcccagacttcagccagcctccatcgacactctcacatggtaactgctgccattcttcaccaaggaaggggcctggccatgagattgggtacggtgggcataagggccactcttcaccaaggaagaggcctggccatgagcttgggtagggtaaggataagg

SEQ ID NO: 2438 - DNA, 201 bp, Bos taurus
ccacactcaccagagcaagagagccttcgccccactccctcattgtatagtgtcttcaggattgatttctccatcttgacaggaaccaggaaaccgttttcattcttcctggaaaccttggaccttactcttgattgtcatcaaaattcccactagtcagttctcttccactgcctcagtcccatttttctttgcacttct

SEQ ID NO: 2439 - DNA, 201 bp, Bos taurus
caagaatacaatagcatcttactaatgaggcatatttttctgtaatctatatgtggaaacttggttttgggaaatactttgactcatcagctctttttccccttagtaattttttgcaaaagaaacgctacacatacatcatgactaatcaaaattttgttctggccctgccagatatcagtatgcttcaaattaacagag

SEQ ID NO: 2440 - DNA, 201 bp, Bos taurus
tgtttccttgcttccttgcaaggtccctttaagaaccagaaacatcatttgaaactatttctcactgtctgacctgcaacttaccttcccatcatcattactgttaaactactgatttaattcttggctcaggtgtgagtttcttaaattctgtgcttcctatacctctccaggaagtataactggtcctatctccttcaa

SEQ ID NO: 2441 - DNA, 201 bp, Bos taurus
ccaggaactgcaggccctgaggctgcctaacctcccaaagtgcctttgcaaccagatggacaggagaaggaccttgccttcattctggagatccatatctggagattcatacccagacaaatgccatgtctaaaggatatgctgaaaatccaaactccagaaaagtgtgaaatttctcttggaactgggcctctaaataat

SEQ ID NO: 2442 - DNA, 201 bp, Bos taurus
atatttagcacctgaatttaacctggccaaaaaaaaaaaaaaaataccactaaaatgcagaatttgttataccacataaagcagctaagtgctgacctctagtggccatactgagaatatctttatattaataccactactgaataatctttgcatgctaagtcacttcagtcgtattcaactctttcagaccctatggac

SEQ ID NO: 2443 - DNA, 201 bp, Bos taurus
ctgactattctttctagtccttaaatgcagggttcccccacagctctggtcttgtcatttttctcttattactctgagtaactggattttatttccatggattcaaagtactcagaaatcccattctgtaggtcccaattctaaatgctcacctacctcttacagatagccagctgaattgccccacagatttcaaactct

SEQ ID NO: 2444 - DNA, 201 bp, Bos taurus
tattggttaacttgaatctgtaggattgcacctatttgggtgctctgttcaggtaagtagtaagattgaaaaaaatgatggaaataggaagtggccccaaccaacacaacattgtaaagcacttgttctccaaaaaaaaaaaaaaaaaatgtagctcctcatatactctttatgcctagaaaggttgatgtccttgtatga

SEQ ID NO: 2445 - DNA, 201 bp, Bos taurus
agacttacaagatttatcttctgcccacctttctagattcctttcccaccactctcttacttacactgtgttcccaagatgtatcaaacaacttacagtttcctaaacaggccccactttccaccttgacccatgttgttccctccactgggaaaaaccttttttcctattcctgatggaccttctgcaagcacacttctg

SEQ ID NO: 2446 - DNA, 201 bp, Bos taurus
tggccttgaagtacacaatgaagcagggaaaatgctaagagagttttgtcacgctggttggggaactaagatctcacaagctgtgtggcatgaccaaaaaaaacaaaaccctgtaagatggcaaactcaaaaaaatgaatattaaagagatcataattccagggaaaaaactaaaggctttgaccaagattttgtctgagg

SEQ ID NO: 2447 - DNA, 201 bp, Bos taurus
tttattactctttgctatcaacactgtactcatatctgatttttacatccagtcatccttgttgtttttacttctttgctactttaggataaagatacagcattcactaagttatttaataaatgactagagtagatctaagattcaacatgatgagagtcattagcataatatgctagtcatacatttgattaaacctgg

SEQ ID NO: 2448 - DNA, 201 bp, Bos taurus
tgtcccagggcaccagttataattaccttgacccaaactactttccagcaaacagatgacatggaagagaacatcatacactagtcctcttcaacacatagcaatggtatcattgtgaattatgtgcacagtttggaaagattctctgctttccctgaaatgacactcacagcatgacagcttcctgagtgttctcgtcaa

SEQ ID NO: 2449 - DNA, 201 bp, Bos taurus
cagtgctagaacccaccccacccactactcttacctattcttcccctactggctccactccaccaccttaaaaactgaaatctacccaagtggcctttggtagaagctggatggaagcaaacattaccccagaaaactctgagatgaaatctggggcttatgttcccaaccttagcaggcctagcatccagcttggcaggg

SEQ ID NO: 2450 - DNA, 201 bp, Bos taurus
attgcttgttagttatgtggtcttgggaagtcagttaagctttctgagttttagtttaacagagctaccttcttaagttattggaaagattagcaatgatgtatgtaaaccataaagcatagcatctgacttattggaggtactcagaaaaggcaagcacctgatttattgtatctgttgcccttcccctccaaactgcta

SEQ ID NO: 2451 - DNA, 201 bp, Bos taurus
ttgaacgtctgtatgaggtgtttaattttgaaatacctgacccatgacagtgttagggattggtgatatacggttaatatgcatggagagcacttctttatggccttggacttctcatgactgaaagtttgaatatgaagacagggagaaggaatctcatctgagctttggtactttcctcgatggaaaaaacaactcagc

SEQ ID NO: 2452 - DNA, 201 bp, Bos taurus
ttttaccaatatggtaatctatttaaatatcatttagtgaaaaaatgttattatggtagtagcagcctgttataaatgaaaaggtatgctttttgaggctctgtactctaattgtctagagcagtgaaaattttttatctatgtaaaatttatttttgcacccattggttgctgcttcctgactgggccaaggatgaatgt

SEQ ID NO: 2453 - DNA, 201 bp, Bos taurus
ggtttactcaagttctatttcatctgatttctcatttttttcctcaggtaaccgtggagaattttttacgggtgttaactgggaggattccatctagcacgcctcggtcaaaacgtcttctttctgatgatcggagcaatattcttatttatatgacaggtaattttcaatttagatatttaatgatagaatatgctgact

SEQ ID NO: 2454 - DNA, 201 bp, Bos taurus
attgtaatggcctctattcaaatgttcttgtgttgaaataacagactccacggatgggccagccgtggctttgagttgcttcggtcttaaaagctaggaggaagctgatgacaaagctggggagagagggaaaaggtatgtaacataatgagtatgactcaggcttcaaatataatcggatattgaaatcactgaggtctg

SEQ ID NO: 2455 - DNA, 201 bp, Bos taurus
aatcatattttcctaatgtacccttattcaattataaagttattttcaagtacagttactttctaatatcaaagaataccacttggccatctatgtcatttgtcatgcttcttaattgcagattgtttctgagccacttttttcttcacttttaagtagggtgaaacttccataaatcagaatctactgaattatcccatt

SEQ ID NO: 2456 - DNA, 201 bp, Bos taurus
aaaatataaattaaacactagaattctcttcaaagcacacacacctgtcatcattacatggatcataaagagacgtcacagtttaaaaaacagaaacagattcaaagacatataagacaaattatcaaaggcatagtaaggttaaattaggagtttgggatgtgatgaggacacagcaggaagacaaatctgctgggctgg

SEQ ID NO: 2457 - DNA, 201 bp, Bos taurus
acagaggctttaaaggtgatggaatagcccctcaaagcctattttgagcaggactcctgcagagggccctgggagagaaggaggtagaagttgctcatgaaaatataaaatgttaatgaagaatttggaacataagcaagtgtctaacgatgtgacagtgcataaagcttttccaaggaatctgatgaacagccagttttg

SEQ ID NO: 2458 - DNA, 201 bp, Bos taurus
tactttgacacagactttttaatcttcctttttttcttccacaaaatcacctcaggtaccacaaatccactttattggaaaccataatcttgtacttaaagaacaactcagtgttaaccccaggccctctggacacctttaatcaggtttgggtgagtcctgaaatcctagaatgcctgagtcagggcttgagtcagtaag

SEQ ID NO: 2459 - DNA, 201 bp, Bos taurus
ctcccagcaccagaatcttttccaataagtcaactcttcgcatgaggtggtcaaagtactggagtttcagctttagcgtcctacattatttagtgatttactaaaattcagcttctgtcctacctcactaagataaaaaaaaaaattcgcttcctaattcctcaatccaattaactccagtttcaattcacgtttcttttc

SEQ ID NO: 2460 - DNA, 201 bp, Bos taurus
tttttgcgcggcgccccgagagggcgaaccgcggagggagggaccggccaacggcggccgggaggtggcggacgcgctggccaagccccggaaaaaactgtagaagtcttgagaagaacaagggagtggaaaaattagactagtttgagtcttggttgggaaggtgagtactaggtagtatcatcagaaagaaagtgtatt

SEQ ID NO: 2461 - DNA, 201 bp, Bos taurus
attttcattttgaatggattttccgttccaagatagttagtcatttatgccctcaaagcacttttcaaattctgttattgtaccaaacatattcatttatgtatttattgttcatccttgcttctagaccataaattttccagaacgggaactgtgtcttattactgtttataccctacaagcccagcacattaagtgagg

SEQ ID NO: 2462 - DNA, 201 bp, Bos taurus
actgctgcctgaggccacagagctgtgtctcactttggcagcacatataccaaccctggaatgagttcagaaatattagcatgactcctgtgcaaggatactcagtgttttatttgaggttttggccactggagtaaggcaagaaaatgaaataaaagctgccatgagtggaaagaaataagcaaaactgagtattcagag

SEQ ID NO: 2463 - DNA, 201 bp, Bos taurus
cccaagctcccctcactgtgtgtgcacagcagtgtacaggcagaggttcttccttcctctccaaagctactctgcgcttgtgcttctgatcccatcccttatctacatggcctttctttcttcatgatttccccctctttctctcttgcaccttccttttcgtcaagttttccccacattgcaccaactcctgcctcaaac

SEQ ID NO: 2464 - DNA, 201 bp, Bos taurus
aacaataatctagacaaagggtcaggcactgaaatgcagttaaagtataagaaaagtgtcctacctaagtgcatttgacagaatggagagaaggctcagctcttcaagacccagacacctgcctggagacagattttggattcttgtaacaaggtgtcttttctgctattttcaaggtagattgaaggaatacaaaataga

SEQ ID NO: 2465 - DNA, 201 bp, Bos taurus
actcagtgaagcttcttggagacgggattacatcatgtgcccaatctctactctgaataactgtagccttccctggacctgtggtttttctaaatggcccgtgattttgaggatgtgaggtattgtggatagcccatgtgatttctagtttcagactattcaagctaccatagaggcccttgtctcaagggccgtagtttt

SEQ ID NO: 2466 - DNA, 201 bp, Bos taurus
gatattatatctatgaaattttaatgcttcaatttggcccacatggcatgaattagtgagccaagattctatcaggtccccttttcacaagaagaaattatcactaaaagattaagaggccacagctctcactaaaggttaccttcccagctgaaggatgcaatggctatggaaacctagcatggccttcctacaaaacaa

SEQ ID NO: 2467 - DNA, 201 bp, Bos taurus
aatccacatctggcctgtgaagtttgcagtcatttgttgcagtttctgaataattattttgaattaaattctctgcaagaatggatccaggtgatatgaaccctaaagctgatatgattggggccatgaaggtcttacaaaaaaataaaattacaaacacaaattaggtatgaaaggaaatacttagaaggaacaaataaa

SEQ ID NO: 2468 - DNA, 201 bp, Bos taurus
cagaaggggtaaacagtactcctagtgtgtagtttaaaacttctaatgaatgggagtaacatatattggaagatgccaagtaagaagcagcagcaaccttgttttatagaactgccatggcatacctgataaaagggacacctcagaaaatcttcactggcttgattatgattccaaccatgtgaccttcctaccatgtgc

SEQ ID NO: 2469 - DNA, 201 bp, Bos taurus
aatctgcgctggcaccacagcaggtccagagatcagcacagtgttgggcagcatcctagggaggtgagagggactgtgactccagcaagcaaaaagactgggacagcagtgactcaagaaaaacatttattattcttattttttgacttattctgtagattcttttgaattttctttttcttttttcttcccccttttccc

SEQ ID NO: 2470 - DNA, 201 bp, Bos taurus
aaaagagtagtgtcaaaatgcccactgagttgtatcccttgctggggtgttagaataatgccaggctgagtacaaattggaagttcctgtcgtataacagatctagtctgcgaacggatggggaaaaagtaggcaagtgttcttggtagactgagcaaaaagaaaaagaaaaaagaaagcacttaatacattttttcctag

SEQ ID NO: 2471 - DNA, 201 bp, Bos taurus
aaaagcttgaaggagttgattatgcaatatatgaagagaaaggtgatccagcaaagagctgagatgtaggcctgcgggagggagcttgcccagtgtgtttagttcatagaagtcagagaagaaacaagaggtcagatcaccctggaaggcattataagtcattgtaaaaacttgtacttttactctaagagaaacagggga

SEQ ID NO: 2472 - DNA, 201 bp, Bos taurus
tctgagggtcaatacccctgtgcctggaaagtagggatgagcccccaagatggaaggcagtgttcagctcctagttaaccccatatggcctatggaaaaaggacagatctgttactagataattctctgttaccactctttgagataaatgacacaagagattctccacagcaatagatgatagcattgtgaaggccatga

SEQ ID NO: 2473 - DNA, 201 bp, Bos taurus
gcatttgagcaggaaaggggaacagagtttctacccagtcattatttagaaagttgaaggattaaagaagcatttagttagtcacatatttactcagtgattgcaaaagtatgtatctagatacagccttccgagcatttgcttccgttattaattttccaataaagatagcataagtttttcttcaagagctataggaaa

SEQ ID NO: 2474 - DNA, 201 bp, Bos taurus
ttccttctcactatggttttaaatttgcaaaactttgatttctaatgagactaggaactccttcatttatttacttccctgaatccagattccttaaaatgttaaatttcatattctaaacttttgtattttggtgttgttcatactagacatttcgtgacataactgataagtacaaagcaagcaaaagaaactcattca

SEQ ID NO: 2475 - DNA, 201 bp, Bos taurus
cacacacatatcccaggccctgccaaagggcacttttttccccctaatcacaccattcatgaatttttgcccttgtgggagtgctttcatgcctgttgagaatgcatgacttcagctatttattctttactaggtacctgctgctgctgctaagtcacttcagtcgtgtccgactctgtgcaaccccatagacggcagccc

SEQ ID NO: 2476 - DNA, 201 bp, Bos taurus
actgactgaggctgtggcccccacgggccccacttctgccttggacagctggcagacattaccccaggcaccacagctgaaaccagcactttcatatgccacactcacttgataatggccactacctgtctctaacaagccatcaagatcactagtcatctcttccccacaaaggctcctcctgtatctcctgtaacaaca

SEQ ID NO: 2477 - DNA, 201 bp, Bos taurus
tttattactattaaccttcaaaagtcaaagatgcaacagtggttttcttcccaatcattaaaaacactgagcaatcagagggccccagttaggctgggatttcaaagcatgtatttcaggcagttcatttcagttcaatcggtctgtcatgtctgatctttgtgaccccatgaaccacagcacgccaggcctccctgtcca

SEQ ID NO: 2478 - DNA, 201 bp, Bos taurus
agacagcaatgatctaaaggcaaaacatagggcctctaccccacttcccaccctcgctgctccctctctgatagggaccgccaatgtgttaatatacattgagaaaggggcccaaatgccagaaatgtcaggtcacagagcaagctgaatgagagctgtggctgaagactcaaagcacaaccactcttcagtgtccaagag

SEQ ID NO: 2479 - DNA, 201 bp, Bos taurus
acagctgctgtaaaatgcaggtcagagctggttccctgctaggaataagcaaatacagctttttaatacacagtacatgaagtactgcatgtcaccatccggggacatgctacattatgcaaggtcaggtgtgggggactgcacccaacccctccctggtcagtcaatgtcatctaaccagatttccagctggagcttctc

SEQ ID NO: 2480 - DNA, 201 bp, Bos taurus
gtggcaagaggtactttataaaagaccctgtgagagggaagatactgtcatgatgctcaatggaaacacaatctggcaaagaagttaaacataaaaattaagccaggaccagtgaaatctctagggacctcacagaggcaaactcaaaacggctccagatcctatgggattcacacattaaacaaacccttctgaaaatca

SEQ ID NO: 2481 - DNA, 201 bp, Bos taurus
acatgacttagctactaaacaactatacatacacacacatatatatatatatatacacacatttacatattcacacacatatttatacttaatatcttttaattccaggaaatagtgcaatgaggaaatataaagcaggatgagggagtctctaatatccactgtctgtgacactcatttttaacacaataccttgtattc

SEQ ID NO: 2482 - DNA, 201 bp, Bos taurus
ggtgaaaaaggatggagggaggcaaaaaagcagtcaaagaggaagtgatgcctaagcagagacataaagggaacaggaatttgacccataggtaaagaagggaacattccaggaagagggaaatgtgtgtgagaagaaaaggagactgaacagactggcaggagatgatcctgaaaggccatgcataccatgctgaggagg

SEQ ID NO: 2483 - DNA, 201 bp, Bos taurus
ctttactggggttgaggatgagttctctagtggtttatgagttgacttttcataagatttataacataagagcaggaattagggttcagaaagggaaaaggggtgacattattttgctagcagctgtgtcatacagctgacagtaagttgattcgagatggatgcctttgaaatggataccacaacaataaaaagtttaat

SEQ ID NO: 2484 - DNA, 201 bp, Bos taurus
tttataatcttttatggaccatccagtttcatgaataaaacttatcttaattgtggtgatttaataacaaaggaaaggggagagggggagattctgaataggaagtaatgaagaaacaatgtacagagatgttttaaacaacataccaattagcttttcctccattggtgatccacatcttctgaccattaataatatact

SEQ ID NO: 2485 - DNA, 201 bp, Bos taurus
tctttgcataaggcctaagtcatctcttaacttatttttcacagtattgcagatatgctactaccaacatgcatgtttgatcatttcacagtcttaaagtcatggccctccatcacctctgctgttgctgctactgctaagtcgcttcagtcgtgtccgactctgtgcgaccccatagacggcagcccaccaggctccccc

SEQ ID NO: 2486 - DNA, 201 bp, Bos taurus
cttcctctctctctgttttttttttttttttgcaggactgtacatatttgctcctaatactgtctcaaattaaaggccataaacaggctttggaaagacagatgaacagaattattttgaaagatgcatgatatctaacacacaaaaaaaggacttaatggaaaaagggccataaaatatgccactattcaactaaagagt

SEQ ID NO: 2487 - DNA, 201 bp, Bos taurus
aaagtagggtccaaatttcttctctgccattcccatggttgtctgccttgggggagtccctgcagttcttggatgaattgtaagagatgaaagaagataacgtacaggaaattatctggcaaggacttggtaaacaaagacctccacaaatattattccctttctatttaattagtatctatattttccagatgagattgt

SEQ ID NO: 2488 - DNA, 201 bp, Bos taurus
tgaatctgcaaaatcttctctccaggaaggacaagtcaagtcttggctggtttgggtatggaatttccctggacgtgaggctgagattttgagaggtcaagctttccctggggatccaacgctcatggagaaagcagatggtttccaaagtaaaaactagaaagagagttccccaaaggggaccagatcttagatttttgg

SEQ ID NO: 2489 - DNA, 201 bp, Bos taurus
gaatgtttttggagatttgttatgcaaatgaaatctaacaaaatcctctctcagtcttactctttcccttcctcgtctttctctcctttcttctttttcctgcccgccatttggcttctttgatgtattgatgtatcgctcataggacccactgcctcttccttctctattggacctaactgtttttgttttcatacctaa

SEQ ID NO: 2490 - DNA, 201 bp, Bos taurus
agtaaataaataataaaaccattgtgcagtttttgcatacatgtatgaatggcaagtaaacaatttggtcactggcaaagatttcacttttcctcttgaatgacatatttggaggaaagactcttttcagttatccttggaatagctagagaaagtaggccatttctatgatagtcagctgtgcaaaaagttttgacagaa

SEQ ID NO: 2491 - DNA, 201 bp, Bos taurus
gggacttgcaaggaagtttaaagatcctctagtccaggggatggcagactttttctgtaaaaggatagatagtaaatatgttcaactttgcaggccatatgatgtctgccattgtagcacaaaagcaaccttagacagcaattcatcaaacaggggtactggaactagtctcccgtgggctggatgtggccctagggcagc

SEQ ID NO: 2492 - DNA, 201 bp, Bos taurus
tcaaaattaccttactaattcctgtaacctccttagcactcaagctccttttaagaaatgagccataagcagtagtcttggcaacaagaagataatagggaataaatattttatcatcaaaaaggctatctggtttcctatgaataaaagcccatctccaagttgtcttatttatttagttgctgaatgcaatccgtgcca

SEQ ID NO: 2493 - DNA, 201 bp, Bos taurus
ctctggatcaccctttgggttacgggggaacccattttaggttgctaactagcactgctgaaggagagaaaagaaaatgagattacagcatcagagttgctgtggtgcgagctacatctttctctcttcagtgcatatgttgtaacctacatatgtcactccctcactcttttcgtgcaaatcttttatgcttgacaataa

SEQ ID NO: 2494 - DNA, 201 bp, Bos taurus
tgctgacattatgacatgcattggcctctactttcctttcaggtggatggctcatagtctttgccatcatgctgcagctggtggtagcctgccctgcgtcgtgtgcggtgtgcaccaaagatgcaactctctgtcaccaactaacctatatagtaggtaataaaaccgatcactctaaaaatcagtgttcagtgtacttgg

SEQ ID NO: 2495 - DNA, 201 bp, Bos taurus
tctggagttgggaaacagacattccttgagaaagaaagattaggaagtttcactgaaatggcattcaccattctgtggtaaggcagagacagtgttgtcttgtgttagcctgcatgtactacatcgtagatggcaatagccctgatagagaccagtatgaaaggcaaaactgaacataatacagtgcctgaaacttctgac

SEQ ID NO: 2496 - DNA, 201 bp, Bos taurus
gatcaggatttcaaaaagagccttgtcctccatctgcttatgaagggaatatggtttccagaggagaatgaagggctgggaatcatcatttatatctagacacataatgagatttttcatgtaataatcctaacaaattttgcaggacaaatgggttctgataaagatctacaacaaaattttttagatttaagatacttt

SEQ ID NO: 2497 - DNA, 201 bp, Bos taurus
actttgctttaaagcttgtatttatattttttcctgacttttctccaaactcatttatgtcagggcctatattgtcttcatgtttgattttatagtggccgacaaagtgctgacacatggtaggtatccagaaaatattttgtcaagtgaattgtgtcataaggtatccaaagcttaattaataataatggccttctcaga

SEQ ID NO: 2498 - DNA, 201 bp, Bos taurus
ttctgtgctgtttttcatatggttccatctgtctgaaatatctaccaccctccttggccatctgtcaaactcctgttcatacattctatcttaaaaattaactatcagatgaaaatttccctgatatggcgaagaggttgtaaaaatcgactcttctgttctcccatgccctttgtgtgtacctgacatcatacattatag

SEQ ID NO: 2499 - DNA, 201 bp, Bos taurus
atctgaatatacccccataaagcaacagtctctagcagcgtacaatgcttctccaaatggagcttctcagaaagtaaaaaacggcagctgatgggttgagctcagaatactttgtcaggtgattacactgtgccccggtcttcaaccctgtccactgacagactgttctaaagagattaactctatggcttggacactgga

SEQ ID NO: 2500 - DNA, 201 bp, Bos taurus
ttattagctcattaacccaaaagatgttacttgtttaaaaattatgttttacttaaacgtgtttaaaatttcaggttacttatatcaaagtaacctacactatgcagacttattgagaaaattattctgtctttgggcaagatagcacagtgtacagcaagcacatttaacaatgtaaggggaaaatatgcttaacagtgt

SEQ ID NO: 2501 - DNA, 201 bp, Bos taurus
acaacaatatagtctgtgataaaggaagaattcttcagatgggaccaaggttgccaattgcaaataaaccatcttatattaatttccacatgttgatttgcataagtatgaagcttgcatgaggtcaatctttctattgaaatatttagggtaagtgacctaaacttgaattccacttttttagtttgcttttcattgatt

SEQ ID NO: 2502 - DNA, 201 bp, Bos taurus
atatccgactctttgtgaccccatggactgcagcatgccaggcctccctgaccctcaccatctcccgaagtacttctttaggggatcctaaagagagctcccctgttgtccaggccctcttctctttatatgttcctagattctaatttcctattattgtcaaaatttctacttagctccccagtctttagccatcattta

SEQ ID NO: 2503 - DNA, 201 bp, Bos taurus
agattgagtagtgaaggacatgaacagaaatcctcacctattttggcttgcattctaataaggctgttatacatatggataaataaatgaatatatatgcgtatattttggtatgacctgggggctcagtggtaaataatctgcctgccaattttggaaacacatgttccacccatgggtcagaaagatcccctggagaaa

SEQ ID NO: 2504 - DNA, 201 bp, Bos taurus
tggacagaggagcctggtaggctacagtccatgggttgcaaagagtcggacacaaatgaactactttactttactttaatatgaccatcagttaagatcaattgctcagtcatgtctgactccttgcgaccccatgaatcacagcacaccaggcctctctgtccatcaccaactcccagagttcactgaaactcatgtcca

SEQ ID NO: 2505 - DNA, 201 bp, Bos taurus
aattgttaccaaacaaggttcatgtaccagatacctggtgaggccaaataaactgaaatatcagagtctggagcagagaaatgtttattgaatggccaagcaagaaaaagcagtggctcaatttcaaaaaccctgaactctctgatggcttttgtggaaaagttttgtgggcccaatttgagatgagggttgtaggttatg

SEQ ID NO: 2506 - DNA, 201 bp, Bos taurus
gtcccagagaaaaaaagtaattcagatgcttgagtctccttagccttgtgtttctccccagtgtttttctcagtgctcaagaaaaccttttcccacctagtgtgaaaagtgcaatactgcaacatcatgaatctgcattccacgttttcagtccctcttccttcagagtcacagagcacaggatgacagtgtattttaggg

SEQ ID NO: 2507 - DNA, 201 bp, Bos taurus
cccttgaatagtaggtgctctgtaagtattgttggataaaagaatgctttctggaaaaactgttgatcggtttattgaaaagatggcaagaatttactactagaagtattatattagccttgctacatttaattacagcaccaaaattattagtaaaaagcagtttatagttttggtgtacaggtctactgctctgcaaat

SEQ ID NO: 2508 - DNA, 201 bp, Bos taurus
tttccaaatctttaatttctcattcctttttgcttaacagttccttttcagttcatctcttgcttcagaagaacatatctgtgccctcaacactttgcttggaaaccttctgtgctaaatatctaatatcatagcttacatgttctcccttctgacagttcaaccttgttcttagccactgtctgtctccttcaatttcca

SEQ ID NO: 2509 - DNA, 201 bp, Bos taurus
acatttgagcaggaacttgaaggaagtggaccaggtagatatgaaggaaagagcattccagccccagggaaaatctggaggcctgaggaccagtacagctagagagaaatgagatcagccacagaccagaagacagagagtcacaagggtgaacatatgtgacgatgagggccattgtagtggttttggctgttgttccca

SEQ ID NO: 2510 - DNA, 201 bp, Bos taurus
ctccgtgttcaaagtccatggcaagtctggataaagcatgtccatttcatagttatgacttctgttgctttgctctttgaaccatgtagaaatactataacaggacagcttccaggtctgagaatacaggtctgagagtacagcttattgacacctcaaggtaaacggaaagggagaagcaattcagtttaatgttcacct

SEQ ID NO: 2511 - DNA, 201 bp, Bos taurus
cagatgtagctaaaaccctttagatactaatagtgttctatttgtctatttctctttggttcctaaatcagtgcctcaagcataggagatatttaataataatttgatgacaaaattaatctttatttccattaataccatatcagagtgtttaccatcacccgtgactttctctaaagctctttttttgaactgtctgta

SEQ ID NO: 2512 - DNA, 201 bp, Bos taurus
ccgtatgaaatattcactaagtttttcaatggcctttggagtcaacgttacaattactaaaatctggtggtttattcgaaaaattctggaacaaccatgtcgatccatagtcatccaaagcttgggccaaaatttttccaaaattctcctttcacaacttcatccactagagaaatatgttggagcaactgtatttctaga

SEQ ID NO: 2513 - DNA, 201 bp, Bos taurus
caatttgcatagttaggtcttcaagtgcagaacttttgaaataagacctattgaaattttattgtaactatcaccttcataagcagttcgattagctcctcactatttgtgatcttctgcctattatttgattggattgttttcatgctgttaagtatcatgagctgtttgtaagttttggagacaaatctcttgtcagtc

SEQ ID NO: 2514 - DNA, 201 bp, Bos taurus
agtgtgtgtgcaaaaagtagaatcctaaatacacatagcatttgcttttgtacatttaatgtgtctgacctttgtaccacatgagcttacaatttaattacatgatggtactagcaagactacaaaataaaatcactcaatagtaaaacatacatacaatataatgttgcacactgtgaaatatagcaaatagtacccagt

SEQ ID NO: 2515 - DNA, 201 bp, Bos taurus
ttatggctaaacctgcacacatttctgcccagttttcatagggaaccccaactccaggtgttgggaaaacagttgaagtcccaaccctgtaacttccaaaaaactatagctaatgtggctccaatgaattcaaagctacagagaatggcaaggcaaaacaattgcctaggaaattattgatgaactaagaaataagcagtt

SEQ ID NO: 2516 - DNA, 201 bp, Bos taurus
caccactgtgaaactgagggaagttgaaaacccgcagtttcgtggattttttcccacactgtttagaacacaaattactaatatcagaaatgaaatgagacatgtagtgggattaaaaagataataatagaataccatgaacaactctatgcccacaaatatgataacttagatgaattggactaattccttgatggacac

SEQ ID NO: 2517 - DNA, 201 bp, Bos taurus
gttctttagagcatttgttttgcaaacttactgtttctcattcagagtttaacttgctttttcctttattgtttttccagttttaagaaacttgaaatttgtttatactcctttatagtaactacctttttttgtgtgtattcagtaggcatctggggaagaattaatttaaaaggtgcaaaatatctattagattaatat

SEQ ID NO: 2518 - DNA, 201 bp, Bos taurus
acatctgattgttgtgtaagaacacagactagtacaacagtggtctggctttatctccctggctgttgtccttggggagttagttctatataatgcttcagtgtaaaatatgagactgaatggagaccatattgatacggtgctcaggaaacatgcataatatccgtttgactagaatcccctttcctttgcctctagtga

SEQ ID NO: 2519 - DNA, 201 bp, Bos taurus
gattatgaaggctgataaatccaaaatctgcagcattggtctatggtatggaagacccatggagagcagatgttctagtttcaaggccatcaggcaggaagtggtgatgttgcagaaaaagtcagagggcagttggctggagaattctttatttcctggggaagggtcagtctttttgttctagtcagactttcaactgat

SEQ ID NO: 2520 - DNA, 201 bp, Bos taurus
acaaggtggaggaagaggcagatggacagccatcttgctatgctggttactgagggcctcctccactgtagatgcactcaggtggcatggaagggaggtacaaggtccctgtgctctgtgcccactgtgagaagagcatcacacaccttgctctcacacctccttcctaacagactccagctctggccgtaaaccatctgc

SEQ ID NO: 2521 - DNA, 201 bp, Bos taurus
agaagaacttcccttttctctgggaagttccctgggagttgtgtagttaagattctacacttccaatgcagggggtacagatttgactcctggttgaagaattaagattccacatgccacacgatgcagccaaaatttttttaaatatcattttctttgaaatgttccacaattacattgaatgattttttaaatatatgg

SEQ ID NO: 2522 - DNA, 201 bp, Bos taurus
ggaggcctggggtgctgcagtccctggggtcgcaaagagtcggacacaactgagcgactgaactgactgactgacttcattttaaccataacaaaaatgtctcctctgtactttttgtggccttttttgggaagaaattataaagaattcagagaaataaacataccctaacccattcttagtgacttatgataataatta

SEQ ID NO: 2523 - DNA, 201 bp, Bos taurus
ttaaataaccaaacttgtcataatttgttatagttccacaatcagaattaattttggaattctgaagtgggttggaacaaatacttaaaaatgcagatgtagctttggaactgggtagtgaacagagctggaaaaattctagctaaaaattcattattgagaaagcctagactgccttgaacatagtgctaatagaaatat

SEQ ID NO: 2524 - DNA, 201 bp, Bos taurus
ggaaatattttaagaaattattgaggttagagtttcctgaagttttcctaaggacttatgtgttgcatgatttttaaaaaattcagatggccagtacattctggcaaatcttgcttcagtttagttcagttcagttcagtcactcagttgtgtccgactctttgcgaccccataaattgcagcacgccaggcctccctgtc

SEQ ID NO: 2525 - DNA, 201 bp, Bos taurus
ttaccactgaaccagcaaggaaggccttacacactgctaagagccattaaaaattgacttctcttcatgaaatgtcaataagatgtcgaaaggcaattcagtatgttgctcacatgatggcccaggttcccaggagggatacttatcttacaatgtgggaaggggttctgctgtacaatacttggtatcctagacaatggg

SEQ ID NO: 2526 - DNA, 201 bp, Bos taurus
aatcctctatttaaacactataatcttgggcagaagtagagtctaaagaaaggaaagtagtcctacagtgatggaagtgctaatgatttttagataaatagcacatcaagtgttgaaagtgaggtatttaagagaaaaaaataataagctttactctaaacaaatgacctaatgatttgtcaaacatcaaagagcatattt

SEQ ID NO: 2527 - DNA, 201 bp, Bos taurus
cacaaagcaatactatatcagaagtctgctatttttatgaaggtattttactaacaaattgaattggtatgaggaataacagtcttccctcatcgtgaagctccttacagaaataattgttacgtgaaatgtttaggatatgttcattgctgaaatctctctctctctctctcatacacacacactcgcgcgtatgcaaag

SEQ ID NO: 2528 - DNA, 201 bp, Bos taurus
atatacaaattataatgaaccctgatgtatgaattgtacatctcttttaagaagaaaaatatgattgattaacactgaagcttcctctgaattcctttacctcttcttccctcacccctcagaggcaacctcattcctaaatttttgtatttatttgtacattaataaatttcatgcactttcactaagaatatgtttatg

SEQ ID NO: 2529 - DNA, 201 bp, Bos taurus
cactacaaatgttagctgttttcaccaaggatatacttttaaattaaattttaatgtagagaaaaatacaaggtcacaagtcacaaatgtatagctcaataaatgatcacaaagaaatgcacctatggaatgcccgctgatgtcaagaacaaagaaccagaaaccccctcataacacttccagagtatttaaatctcctta

SEQ ID NO: 2530 - DNA, 201 bp, Bos taurus
tactgcaagaaaacagatggaaggtgaactttacctttccatttcctctaaaacatagtcagaatatcacttgttgggcctgaaaacacaataagaagaattgtaagaaaatgaaaataatgtcgtgtccatgtgacaatgagatagaaaccagaagtactatgaggtcctttatggaggttcctccagggtggccagtgt

SEQ ID NO: 2531 - DNA, 201 bp, Bos taurus
gtcactgggagacgttgattctctctttcccttggccttcactgcagaaatatgtagaagcacaatgaatgtaatagtcttattccagtagaagggatgtctttttgtttattaaccatgttttaaatatcatgatttttaatcaaaacaactgtccattaaaactttaaataattagattgagacaaaattaaattcaag

SEQ ID NO: 2532 - DNA, 201 bp, Bos taurus
gacttaaaaacaaaaagtacatttccagatatcagtgatgtgatgcatatggaatgaaagtatcactgccatctataatcttagttctttgaagggaaccatggaaaatctattccttatctgtattatcagtttccaataagagggaagcttagactgcagtgataaaataaaatccttcccaaaagttttgccatcagc

SEQ ID NO: 2533 - DNA, 201 bp, Bos taurus
tccacttgagaagcacctctgaaaagagggtattgcatctaggagaaaaaaaaaagttgaaactttttgctaaagaatgacttcaggctttaaagaaaagatgtggtagtaaccaatacttctttataaagtgtttgtttcaaacttatccttaaaaactcacaccaagtaactggtagaggatattagatcagaaacaat

SEQ ID NO: 2534 - DNA, 201 bp, Bos taurus
ataattctgaaataacttctccggcttttgagctccctctagggtcaactgacacctttggtgagacttgtttaaagcccatcttctccctctattcaacgctgcttccttttcttcccttgtagaagtagaagcccaagctttccctaataaacctcctgaagagtattctctgcactacaaactaaactgtgccccctg

SEQ ID NO: 2535 - DNA, 201 bp, Bos taurus
atatcttttcctggaatctctacacagaagaaaaatatatttaatctgaaaattttttctcaggtggtagtaattctcttacaggttctctgtccctactccagtttagctaaatgagtctctcccatatattttaacattactctcatttttattcacaatttcaataaagaatgatttatataacatagcatcacctgt

SEQ ID NO: 2536 - DNA, 201 bp, Bos taurus
gaaacaaaggcttatgattacatggctagttcatgactgatcagagatttgacccaatatgtaactctaggtcctatggtattaccattataccaaacctgtataagttctatggaagagaataatgagatactgattctgttctagagagctctggcaatcataaacacatataaaagaaacaaaaggtcttaaaattat

SEQ ID NO: 2537 - DNA, 201 bp, Bos taurus
attgtaggtgctattgctttcttcagtctcttgtcacaaatggttagctatgctcattttagagcctgaaagaatattgctgcccagtgggcagaaagccgtgaaaacaagaatctatgatcttgttcctgtgagactgcaatatagagggtctaacagcaatgccagggctgagacttgatagagatattacagagtgat

SEQ ID NO: 2538 - DNA, 201 bp, Bos taurus
gtgtatttatttatagtataataatagtaatatggaataaaatacatataaagaattatctataataaaaataacaactacatttattttgaaagctttgtaaaaaccccatatctttggggatgtggtgcctttactctgctttgggtcagcagtcacgaaattaaatcatgagaacttgcttggtaaggtgataaaagt

SEQ ID NO: 2539 - DNA, 201 bp, Bos taurus
actctccctggttttataaatactctcaagcaaaagctattttaaataattcttacctttctagattcctgccttcaccttgtttttcacccaaatagccatatgttttgttagcttatggataaatttgagttagataaacttctcatctagcactataagttgatttaaacaagatgatctgtcctggcccctagtaca

SEQ ID NO: 2540 - DNA, 201 bp, Bos taurus
tagaagagaaacagatcaggtcaagcaaaaatttagctatgaaagcttattttggaggtcagagaaagcctttatatgccttctaaagaccttggtactttttcctcttcacaaaagtacaaaatcaaattttaattggctctccacatgagaaaccctaggcaacgtatgctgtctagtctgggatatggttgaggaggt

SEQ ID NO: 2541 - DNA, 201 bp, Bos taurus
caagaagcagttattttccaaaagccccagtttagcaaggaccacattctggagttaaactgtgctgtagtttcagctctgtttaatgtttagctccagactctcccgagacctgtaaccacggccactgtgtgctgaagtctagagacagaggaagaataagggagaaggcatgagacagactggagagggaaaaaggac

SEQ ID NO: 2542 - DNA, 201 bp, Bos taurus
ccacaaaaagcataaggagacacagggtagtgaaacaaaatataactatctcttttaggtgaacctgatttctgagattaacaacaggcaggctgtagtggacatttgagaaaatcaaatcttcactgataaagaaggggtacttaaaatcagctctgagcgttggcagaggtcaagacaatggactttcagtaacaactg

SEQ ID NO: 2543 - DNA, 201 bp, Bos taurus
cacaggagaatcgcccaagagaaacctgtgcatccattcattcatctgttcattttaatcaaattcaatgagctattgaaagtgctccaggtactgggggaaaaaaataagataccctcggactcttaggagtctgactacgatttatttagtctgttggagacagacaagtaagtgctttacaaagtactgttctaggat

SEQ ID NO: 2544 - DNA, 201 bp, Bos taurus
tagattctttaaagcaaaagagctcatttgtttttgtaatgaagcctggcccctgaagtataaacttcaggatgatgaggcctggccagaaaatgggagctttagtcatagtaccaccctacagttagacatctttttgcaaaagtcagggaaaataaatagaaattccttatacaggcttttatggccctaagagaaaac

SEQ ID NO: 2545 - DNA, 201 bp, Bos taurus
gccactaatgtgttgtgtatgataacaaaacctctggtatgacacattttctgtgatcattgttaattagtgacatagtaacatctgtagcaggtggttagtaaacctcatgtgttgggggtgcactccttggggaatggtttgggccagatggggtctatatggagtggaatatttgactcctttttttcttgtttttag

SEQ ID NO: 2546 - DNA, 201 bp, Bos taurus
tcactcttatctagttatcacccagactttcctccttgggctccccaagcacaatctcagaatcctcatgcatcaaagagccctaaacagaaagagactcacagatacaaaaagctaacagatggttgacagaggggagatgggttgaggtatgggtgaaacaggcgaaaggggttaagagattcaagcttccaggtataa

SEQ ID NO: 2547 - DNA, 201 bp, Bos taurus
caccctaactttccctatggtttaagcttgttggaactttctataaattgcaaccaaagcacattaattaatataaggctagttaatacaaagaatgttaattaggataaatataaatgtcccatagtgaaaggaaaagcagggcctgcccttggctggataaagccagtgcacaagccagcctcttatgtggtcactgtt

SEQ ID NO: 2548 - DNA, 201 bp, Bos taurus
tgcataatagatctgacttatacaagaaggctgatatctcaaaactcaaatcaacaaaactttattcagagaaaaccttttggctatcccctacaaaactgatgaataaatgtactttgatacgttttaagtttgagaaaagctaaagttaggtatcactttcacaactccttccttcactagactgcttacaaaacaacc

SEQ ID NO: 2549 - DNA, 201 bp, Bos taurus
acagccctaattcgtttttacttaagaaacagccatgtttggaaaaaatcaggttaagttggatggagttatagatattttaattaaagagagaacacactgttctggttacttttctatttgaaaggcataatgtttttattcatagttttaaaacactttccagtttccttaaaataatggactttctcagaagtgtta

SEQ ID NO: 2550 - DNA, 201 bp, Bos taurus
gacaagcaggcaggaaggggagaagagaaagaaggacagagagggggcacatgtcctagcacataccatgggcaggccccatgtgggcccattcagtgacgtctcatgtcctcctcagccgcatgacatactagctttggtgcagtggttaaagtgtgagctccagagccaggccctctatgggcaaatccaggctctgtg

SEQ ID NO: 2551 - DNA, 201 bp, Bos taurus
aggagcttcaattcattttgcactgggccccttaatttatgtatctggcctcgcctgtaactaacaacacttgacatccttaaacggtagtttaacatagtccttgagatttttatatggccaggattatcgtgaatgcacactgtctgggtctacgccagatctcctgagtcagaatctgcattttagaagttccctggc

SEQ ID NO: 2552 - DNA, 201 bp, Bos taurus
tgatcttgatatattctggaagctgaacactctctgtgttgaactgcagactcaaaagcatgcagggcaaggagcaggaaagctatggatcagggcatgatagtttcatggagcttcggtgaagtggccacaactcagggccacttgaacacaaattatgggcctaatcctgctgaatcttcagagttgtcagagaacagg

SEQ ID NO: 2553 - DNA, 201 bp, Bos taurus
tgggagaattagataagaaaatgatgtctactgagggtgagcacagtgcccggcatgtaccaggagatcctctcctgagatcagaggcgggcctgtggggggttggaaacgacctagagtactggacaagcagcactagccacactagaccctaggacatgcagcccaaagagcaactgagaggcagggccaaaggctgaa

SEQ ID NO: 2554 - DNA, 201 bp, Bos taurus
tgatttaactggaaacaagaacagcaataaaaacccatgtctgggaaacaaggcttgactgagccaccaccaagagacaggaacaaaactctggggcctctgtagactttggaggcaatgcatactatactatgatgctcagtctaaactcacttgaccagtgactcgaaggcatcttgttctgagtaagtttcagagtga

SEQ ID NO: 2555 - DNA, 201 bp, Bos taurus
agattacagactgcttctttgccagtggtctccagtcttagacttttcttcagtctatcttcacctcagagaaccttgtgttcatttattcaatcatgcagtcaaagaggaagttgcatttctgatatagaggaacgtttaggagcaggctaatatctatgtctgcaatcaactgtcagggtaatattagatcttctacaa

SEQ ID NO: 2556 - DNA, 201 bp, Bos taurus
tctcagcaagagactgacttggtactttatatgtactttttatggtacttttgaaaaaaaatctcttcatcttcatagacaagatgaaaaatttggggagactgcaggtgaactgtctgcacaacactaatgataaaccattaatcaacggcatacccatgagatgatctatgctggcatggccagactggtcctgtcctc

SEQ ID NO: 2557 - DNA, 201 bp, Bos taurus
gtccttcagaccccctacatagaaagcacttcccccagaaaaccatcaaagttcttaaaaccaagttagatataatcccatgtagtcccacagaacatcatatgtcttctaacataacacttgcaacacattacatgaaatttcctgttacatgtacgatttctcatatcagattgtaagctccatgatggcaggatcatg

SEQ ID NO: 2558 - DNA, 201 bp, Bos taurus
acatttaaaacatttagctctatatagataaaacttagagtaatgtagaatgaacacttattccatttcctctcattttctatctcttaaatctcttttttaaaaaattagcatgtatcactatctggcattgtcttaaactatttattcactcacttgttttcaactatcctccccaactaggaacctcttctgtcttat

SEQ ID NO: 2559 - DNA, 201 bp, Bos taurus
ccctatttcctaaatggtggtgggctgttcaagtctagtgtttttcagcctgagtagtaggacacagttacactgtgatatgagcctaggcattctggcctttctgatctactcttttgtcttgggatctgaggatggaatgactggttgtattgtgtgtctgattcactaagtagatctggggggacagtcagttgctct

SEQ ID NO: 2560 - DNA, 201 bp, Bos taurus
ccttgcatcacatagaccttaagttgcaatgctttaattctagttatgtttttgaatttattagcccagctacttctcagttaaacacacttgagaggtcggccttgaacagttgtctgagcaaggtttttttccttcccagctgttcatttctactttgttgaaggacttcatggcttctgaagtttgtgttagcattcc

SEQ ID NO: 2561 - DNA, 201 bp, Bos taurus
gaagctagctggccaggtgagggaaggcccctataggagcttagagttggtctctagattaatggggagtctttagagggtctgatgtgtgctttgggggtaaagtgaaggttggcttggtaggcaggaggaaagtaggaacctggggtcagagaagttagtttgaggcctttggtgttggggtgagggggagaaagaaca

SEQ ID NO: 2562 - DNA, 201 bp, Bos taurus
cagaggtatttccttaggtttcttagtcaggcctacaccggtgtaaaccagaggtcagcagaattgttctgtaaagagccagatagtaaatatctaatctcgtgggccacatagtctctgctgtaactactcaactctgacattgtagcacaacagtatcatagagaacatgcaaacaaatggatgtggatgtatcccaat

SEQ ID NO: 2563 - DNA, 201 bp, Bos taurus
ggaattaatgacaacttaatttttaagtgtttcagggaagaaaacatatgcataactttattctcccctaaagcatactccatgaataaacttctactaggttataaaggatttcttctgcccagaataggaatcatctgatttttaccaaactatttaacctcactctgaaaaacatatagacagtccagaaaaatgaca

SEQ ID NO: 2564 - DNA, 201 bp, Bos taurus
tcttctatgcacttgcacccatgtatataatctaagacattattctctctcaaattcttttactgtcatataccaaaagaaaaactcattaatacaattaatacttcattaacaattataaacaaaacaaatttaataatagttcattaatagttcatttaataatagttcgttaataatttattaatatagtagaggcaa

SEQ ID NO: 2565 - DNA, 201 bp, Bos taurus
aaagagtttaaagttcaaattctgccaagttagaaagatttattaaacatcttagacttttcacgaatacctcagaaaagccatgtcttataagtaagcccaggactaaggactctacctagaactgaattcaaaatgaaaataaatccactgtaacaaaacttgaaacaagttttcacttatgattaatacatttcatgt

SEQ ID NO: 2566 - DNA, 201 bp, Bos taurus
tcctaacctccagtacatcagaatgtgactgtatttggagacagcacctttaaaaagaattagggtaaaatgagatcgtttgggcgggccctaatccaatatgactggaatatttatttataaggagagggaattgagacacagataacacacagacaagagaaggccacgtgaggacacagcaagagggtggccgtctgc

SEQ ID NO: 2567 - DNA, 201 bp, Bos taurus
attataaaatttagcaacaaggaaaataagtgaccaccacactgattcaattaaataatcattatttatgcatttacatagtcaatataaaacaagatgccacacattatgagggcataaagatggataaatgcttctaggatctcacagtaaagacaaatgtatacacaaataacattgatatatagaattgcttgaaag

SEQ ID NO: 2568 - DNA, 201 bp, Bos taurus
agtatctgttttagtttgtgaatcaggagaagtttgaactagaatgagaaacacaagaaacagaaatttaatagacatggcaggaaaaacagtaagagaacgtgtccctgcatttgtaccataatgcctaagatcatctaagtgaatgcaagtaacctttttaaagtttctaaattttacaattgcaatgaacttattttt

SEQ ID NO: 2569 - DNA, 201 bp, Bos taurus
gagctgcaagatccttatgaacaaagaagtgactagacaggtattccatgccagctgcaatctgaattgcaatgtgtagaaaatctccgtgatccaggctggattttacagtcccatcttcatcactactgcagccaacatccgaatgtggggaccgcatgatgaggaactcatggagatctccctgattcatgtactcaa

SEQ ID NO: 2570 - DNA, 201 bp, Bos taurus
gttgattttggctgagacagctcacagactgacttgtatactataagaaatattattcatatagtgatttggagttgggtggaatcagaaagtactataaatctcttcacatgacattcctgcaaactccgccaggctgagactgaaacaggcttggaagccaagaggcagcacctgcacagcccactacgtggcaaaagc

SEQ ID NO: 2571 - DNA, 201 bp, Bos taurus
ggaggctcctgacctgcactctgctcttctctgcactacagtgaactcccctccattattcccttgcctttgaagaaggtgactgagtgggtgatgtaagacagagcccagtgagcactcagcaataggaaagcttaggagctacaaccaccaggagctaagacaccatagactggcatgagaccccaccagctgccccaa

SEQ ID NO: 2572 - DNA, 201 bp, Bos taurus
ttgcagggcaaaagtgcctggctcagtcctgaataaattcttcataagtgcgttttactacatattaggaaaaaacacaaaatactagaatattagagtagggatcattctttaaagcaatgctttaaactttaattttcatacagatcacctgaaggtcttattaaaatgcagattctgatgaaacagatttggtgagga

SEQ ID NO: 2573 - DNA, 201 bp, Bos taurus
caaaaactaacaatcattgtaaggcaatatgttaaatattctgaataataaaccgggtgcccccggacccaagacagaagttggtatcacagcacagaaacatttctgttttcttgccttactcagagaatacccttttctccagacttccttatctctctaataaatgccagattttattgacacatttcatctgcttct

SEQ ID NO: 2574 - DNA, 201 bp, Bos taurus
aaaaggaaccgacagcagcataagcgcctgggttctttcctttctcttccccacatggctcctgcaggcatatcaattggcagagccttggaatagtaccatttgtcaacaactggttagtggaaaaaccaaatcctaaaaagcctgggtgaatacgctttgtttctgtctgtgctcttcaatcagatgactcagagggcc

SEQ ID NO: 2575 - DNA, 201 bp, Bos taurus
gttaaggcatcatgatacacaaagttgagagctgcttcatagctttgagagaaaagaagagaaagggctccatacctccatgcatggcgtctatacggatctttagtcggtttggaccagaaagcagttctttcagcgcgttaaaatcaaagatgtttctcagcattgtagcataagcttccaccgaatccacaatttcca

SEQ ID NO: 2576 - DNA, 201 bp, Bos taurus
aaagtgaaaaagtgatttaccaagtggcactacagagtaaattgtttcacatttgttaggttgtgagaacacaaaaatgatcctagttcaaacagatggaagggacagtggcatcatcaatatcattttaaaatacgaaatgtgacaagtatggttatataatattagagggaaacaaaaggtagcttcatgaaaatatga

SEQ ID NO: 2577 - DNA, 201 bp, Bos taurus
aaaaaatgaaggaggggtggaagctagctgtagtctcagagccctcccttccagctctgccattctagtctgtgtctccctggcttctgatccagttaggcgcactttgtttgcattctgtgctgtgccaagctgattgtttgctttttgacctctctaccctgttcttctatctagatccagtgatattttttgttttat

SEQ ID NO: 2578 - DNA, 201 bp, Bos taurus
gcctgtatgaagaagatgttatcaagtttgtcctgcaggcaggcctggcccgtgaagaccctcactactggatggctcggggcacttgccactccaaagattcatcgcattctcgattttcaccgaattccacttcctctgtgacaacgcctgcttcaccaggctttctcttttgcattgaatcccttttttgttccacca

SEQ ID NO: 2579 - DNA, 201 bp, Bos taurus
ccttcattatcattcccccaaataaatttcgttattgttactctttttgtgttgtaattattctaactacccagcacttctttaaatcacaaataatgaccttagccatcattcctgcataacagaatttaacaagattttttggaaactgaggagcggcactaaggattccaccaacgattgcccaggtctatatcctgt

SEQ ID NO: 2580 - DNA, 201 bp, Bos taurus
cctgcactcagcaatgaagacccaccgcagccaaaaataaacaagcagatcttttaaaaagaaagggatgtcccaatgccagtgacaaacagaagttcccgtgggatagaggctgcggttagtattgctgtcactgtgtagtcaataatacagatacaagatcccaaaggtacaaaaagtatacgataaataccagaggca

SEQ ID NO: 2581 - DNA, 201 bp, Bos taurus
ctaaataaagattcagaagataggggatccaacgcagaaaggcagcatcagggagttccaaacagacaattctgcatcaagtctagagaagaaagaagacggcagccaagagaaaactgagagagaaaagtctccagaaaaaagaaggaaagaagaaaatgatgtattttcttacatttatattcatgaaaaatttgctgc

SEQ ID NO: 2582 - DNA, 201 bp, Bos taurus
aacagtgggaacaaaattttgcaaaatatatttcagataagaggggtaatatccaaaatatataaagagctcatgcaacttaacagcaaaaaggcaatccaattaaaaatgggcagaagaactaaatggacatttttttccaaagaagtcatccagatgaccaacagatacatgaaaaggtgctcaacatcactaatcgtc

SEQ ID NO: 2583 - DNA, 201 bp, Bos taurus
actagctgaaggtcaagtttgagaagagaatattgttattagtaaatagtaaagaaatcaaagggaatgtggactcagaggtcactggattcgacagttgcgttagtggtgcaattagaaccctttcggcaaattagtgaggactgaggacataattttgtgaagcataaagaaaaaaatcctttctctaacagaattctc

SEQ ID NO: 2584 - DNA, 201 bp, Bos taurus
catatatgtattaagcttaaatgcacacatctcggtgctaagaaaaatggatttggtaaattctatttctgtgaatatttaaaaaacaaaaacatactttttgttttattttcttattttacaggggcctttggaagttgcccaggttttcctatcggaaatacccagtgacccaaagctcttcagacatcataataaact

SEQ ID NO: 2585 - DNA, 201 bp, Bos taurus
tgtatggtttcacttgtatgtggactctaagaaacaaaacaaatgaaaaaacatagcaaaacagaaacagagttataggtacagagaacagataggtggtcgccagaagggaggtaagtaggagaaggaaagaaagaagtgaagaggattaataggtacaaacctccagttgcaaaataaatgagtcatggatatgcagtg

SEQ ID NO: 2586 - DNA, 201 bp, Bos taurus
attaacacatgaaacaacagtttccagacactggacaacaggctgcactggattttaatgcccaatagaagggaaacaagggaagggctacaagggccccagctgactgcctggaggcagtacccaggctacaaccaaggaaaggggaaccaaagagactccatgagtagcagagagagatcaaagctcagggaggccagg

SEQ ID NO: 2587 - DNA, 201 bp, Bos taurus
cttgtgctaatgtggtgccaatgtgccctgaagacacacccctgagtgacctttttcaatcaggagttgccctaagtccttcagaagtagatagtctgtcgctgtttatagtcaatcacatatgcatgttctaatgctttatcctgaaaacaaagttgaaacactttcctataacatgttaaaaatgttatctgtggctct

SEQ ID NO: 2588 - DNA, 201 bp, Bos taurus
tagggaaaaggaattaaccgtctcttcacattcaagcctgatggagcccctctatatggactgcctggtcctggcttccacatgattatcataacgtaccaagtgtcagaaattcagatgaaagcagaaaaggtctcgtaaggaaaatcagaggaaagaggataaagatggggaaactctacaaggtattcactaagagaa

SEQ ID NO: 2589 - DNA, 201 bp, Bos taurus
gtttatttaaacaaagaacaagcacgggaggatgaaacaaaagtgaaaataagggaaatgaaagctctccatcttttccatccttcctctgttgtgtatggatttctcatacatagaaaagacagaaagagatgtctggaatttgtggagtatccaaaagtaaaatagctttcatcaatctatagttcatataaaccaaat

SEQ ID NO: 2590 - DNA, 201 bp, Bos taurus
atcagcaccaaatgttggcttcaaaagcaaatgcagcagaaactactggtgcccttcccaccctggaggtcacctatagctggggtggacagccttcccatctcaaacacctgagtccctctgcctcagggctttctctgttcacagggcagagtgggacaggctggaagaacagaagcaatgtgcccaggagcaatctca

SEQ ID NO: 2591 - DNA, 201 bp, Bos taurus
aaaaaatcacattataactttgtaactacaaggaatcttaaacacttacagacctagcaggcaggttaaagcaggctgctgatacagggtaatacaacagggaacagtggagattatggcaaattagaaacaccagatttcacctaaagtcattcagattcaagtgtctgaaaactgggctggcaccattcaactcacaga

SEQ ID NO: 2592 - DNA, 201 bp, Bos taurus
atgcatttttggccaccaggcacagcatgcaggatcttatttccccaaccaggggtcagatcctcagagtcttaaccattggactagccggggaagtcccaggactagtgaccttctaaaaagaggccaagggagtcttctctctcttcatacatagtaaccaaggaaaggccatgtgagcacagagagaaccaggctgcc

SEQ ID NO: 2593 - DNA, 201 bp, Bos taurus
ctgataccttggcccagatgccaggtccccgccaccaaagcatgtatctttagtccctgcctgcctgtcattgcctgagtccaggtggtgccttcatggtatgattgccccaggatggccagcctctggggcagagttagtactctaagccctgtgatcacagtcttaggtttgctttccactgcatctagaagcaatgag

SEQ ID NO: 2594 - DNA, 201 bp, Bos taurus
aggttgatgtttttcttaaaacacaacaaaacaatttgtgatgattttaattgattcttaaatgaatgggtgaaatcaattatttagcccacaatgtttcgtttttcaacatgtgaagggagcttatcaaaccagctgctaaggcatttcatcagcaggactagagtcgtgcatctctgggcagggggagagggtggctga

SEQ ID NO: 2595 - DNA, 201 bp, Bos taurus
tgggaacctctatgtttgtcactgatcacaataagaccttcagagggtgatggccattcttctacttctgctcctcaaatctcacacaacttcctcttttcagttcagttcagtagctcagtcgtgtccaactctttgcgaccccatgaatcacagcatgccaggcctccgtgtccatcaccaactcctggagttcaccca

SEQ ID NO: 2596 - DNA, 201 bp, Bos taurus
acttctccctcatctttcttcttcctgtttccttccttttcccctattcatttgttccctaaacctctcctaacctttgtacccctctttttctcaatatgtctgagaactctttgctgttttacaggataaagaatcagatagattcagatttccctggatgttactttccttatttgtaaaatgagattaataacagct

SEQ ID NO: 2597 - DNA, 201 bp, Bos taurus
ccatgtgaaataaccccattatccttccaataaattctccctttgctgacctagtatgagttgggcatatatctaagcagtccctagaggcctgatcaccagacaggtgattttccagcacggctattttccagagcggctttttcactctagtgggcagcagtgagctcattccccttcctgcaggcctttcagcctcag

SEQ ID NO: 2598 - DNA, 201 bp, Bos taurus
attatgagctgtgtctttgtaaaaataatgcacaagttataaactaaaatttgattctggaaacaatatatttaaatataagaactatttcattaatgttcttctgaagcatttgtttaatgaaagctgagttggctgaagcttgttgaaaataaattcgatgaaacagggattaacattctttgagcttgatgttctttg

SEQ ID NO: 2599 - DNA, 201 bp, Bos taurus
tttcataataatcataattaacatgcatgtccttggttgattaggtattacttccctagtgcatactttactttttttaatcctcagaaaaaccagtgaagtagaactcagcaaggctcataattttgacaaccatgccttctatttcttcttgttcttgctttaggctttttggtctttctgctcatccacatagtcact

SEQ ID NO: 2600 - DNA, 201 bp, Bos taurus
ttggaaaattttaggtctatataattctaaaactaacaaaaatattttgtattatgactatttttattttgtttgaccctattccaattccttctacatactattgcaagacttagcatataaattaaagcatccttcgttcccttagccaaggcagtatcaaggtattccctagtcacggtattttcagtttatctattc

SEQ ID NO: 2601 - DNA, 201 bp, Bos taurus
ccactattaatacttgtaggcccttataaatcactacctccatgcagagtcttagatcaaaatacatgtggtcaggccattgccccacagaagcaactgattctttcaaaagggctgtatgtcaccttgttttgtggatagaagtaatagcctttctgttcatggctgaccttggccaagaaagaaaaatccctgttattc

SEQ ID NO: 2602 - DNA, 201 bp, Bos taurus
gccaaagtatagacatgggatactgatggcccaggaaatggtatgtggtgggttagagaaagggcattaaatagccttgaaacacatgacaagaatttcaattctctttcaatccattcagtgacaccaatgaggaaagcatcactttggtgctctgcacctttagaatctaacacttcactaatcttcatttttacaaag

SEQ ID NO: 2603 - DNA, 201 bp, Bos taurus
catataaaccacatattatatccaagacgttgcactgccaatgtttcagggccctgaatagggtctggccataaaggctatcaaataaatattaataaacaaaaaatggtcacaaaaccacatattaaccatacagttgttgattacctaccaaataagaccaactatagcttggctaaaatattgctagaaataaacatt

SEQ ID NO: 2604 - DNA, 201 bp, Bos taurus
tatgaagatgagcagattgtgatctcaggaattccacagggctggatggaaaaaggacagtcttggagggcacacacaagactgtggactgtgtgcacacgagcacacaggcaaataaagcagtgacctcgtaagaggctggaccagacctactgctagtattggagggtcacctgcagaggcagggggcagcacagctca

SEQ ID NO: 2605 - DNA, 201 bp, Bos taurus
aaatctgggacaatttaaacataaaaataaatgacgatagtaatggaattatagtccgttgagtaagatcaatttctaaatgcaaagcacgatcctggattagattctgaaacaagaaaaaacttaagttttaaggatactgagatagctgatagaatttgcatatgatttatagattagataatgatttgtttcaaatac

SEQ ID NO: 2606 - DNA, 201 bp, Bos taurus
cagtttagcctaggcctgcacatagtaggtgatcaataaagggtaacagaaaagagccaaccatggagagagaaaagaattgggacagtgtgctattggtgaagcagaagaacagggagtggccactggttctttgagagattttttattacctagatagaatgctaagtgcagtctatcactggttagacagtgacatat

SEQ ID NO: 2607 - DNA, 201 bp, Bos taurus
ggattggaaaccagtccggtggccccatcatctctatgaaatgtgtgagaaccctgacaccatgtctgctgcatactagatgctcagcttctcaagttcaatctgaatctacaccaaggggccttgtaccatagtacctgttatcattctatctcaccaatgggaagactcatatcatgcttatgtccccagggtttagca

SEQ ID NO: 2608 - DNA, 201 bp, Bos taurus
tgaccaatgaattaggaggctcagtttctaactccaactctgatggtaatgtgaggggcaaccctgatgactcactgtttttctgggctttggttttctcgttttcgtattgaagaatttgatatagaaagtctttgagcaaacttttagttctgaagcccatgatcactcattatccaaagagcagcatgtgtaccaaat

SEQ ID NO: 2609 - DNA, 201 bp, Bos taurus
cagctctgattttctcacagtgtgtctcctattgttacatataattcttaacaagccctcatatacagttctgcaggccctgaacaacttcagagggcaccatttatatcatggtctcctacctgagctcctggggatgctcagctgaatgtgatataattctttcattaacttagaccctaaaataggccagtatctcaa

SEQ ID NO: 2610 - DNA, 201 bp, Bos taurus
acgatatcacttatgtgtggggacccggaaaagccaagttcagagaaacagagcagaatggtggttgccagaggctagaggtaggaaaaatggggagatgctggtgaaaggatataaacttccagttataagatgaatgagttttgggggtttaatatacaacacagtgattatagttgattatactttattatatactag

SEQ ID NO: 2611 - DNA, 201 bp, Bos taurus
agcctgatacctgtggacaaggcactgcatctatttgaggcttattctgtttatctataaaatgcagcaaacgttcagtatttaactcacagggccatgtcatcaatcaaataaagaaaacacagtttcaagccatagaagctgtaaagtaaaatacaaaatatagtatcataacaatagctgacgtttattaaatgttat

SEQ ID NO: 2612 - DNA, 201 bp, Bos taurus
taaggtggtagagggccctgaggggatgaggggaaagcgaagaaattaacataattaactggatagtgactgcagaggacccagggttccacacatcttaagcagcatgggggaatgcagaaaaggcccacccgtctcttgagtggccggacacctcacccagaacacagggggactcaacaagatctccgaggccaaggg

SEQ ID NO: 2613 - DNA, 201 bp, Bos taurus
tgtcctccacctgagatgccttcctcatcctgtctgtctgtttgactctttatctttgttgaagtcccctatttcaaccttaactcccctgggaagactccccttgttcatatagccagcaggggtctgcagttacccacacttccctgtggtcttcccttcctgacaacttacctgtggatgttgtttgcttagccagct

SEQ ID NO: 2614 - DNA, 201 bp, Bos taurus
aggccgagcctgcctgctaccagggtgtgattgttcttgtgatttggcaacactgggcaaacgtgtcccatcagggctgagctaaaaataggtcctgtgctgtggggcccaggaaaatcagcagtcgggcacatacaggattggccaaccaggcagaagtaaacagccacagtgccccaggggcacagtgggcaaagagag

SEQ ID NO: 2615 - DNA, 201 bp, Bos taurus
gggcgggtgtgttgactgcccggtgtgggcggagcaaaaggcgtcccggtccttgccgagggcaggaagtgaagaggccgggcttctctggcgaggtgtgcgcgtgcgcataggtcgagtcggcggactcttcgcttttgctactgctggggtctgtcctggtggggacgcctttgctatagagtgggccgggccccgggg

SEQ ID NO: 2616 - DNA, 201 bp, Bos taurus
agagtcattgaagtgagctcttcgtctacaagaacctctcctccctcaagggactccagtacacaaacacatacccacactcatacactctgattagatgcaagtttttgccattcctgccttagccttcaacagcagacgctttatgatggcccagtgaacgatgcagaggaaaaatgggaacttttaaggatcagatgc

SEQ ID NO: 2617 - DNA, 201 bp, Bos taurus
agaatcaacggattatacatttctaccatcttactgattcttcctaactcttcctatgacatggacttcactaccatgtctctttgcctttgccaagaacgtgccttccattaatcacacattgaaattctccttagtctttatgaatagctaaagtgattttctgtggtaaaacattctttttattcctctagttgccat

SEQ ID NO: 2618 - DNA, 201 bp, Bos taurus
aaagggattgccatgacaggaggagctgattaatttgtttaatcacagccagaggcccagattgttctctggacatggcacagtcagttggccctcactctggaaccatctgaacaggagctcatctctgcccgtgggcagtgtcatgcacaggtcccatggccactgaaccaactgacctcaaggcttgacagcagtagg

SEQ ID NO: 2619 - DNA, 201 bp, Bos taurus
gttggtagcatttgatacacacctgaatggcttcatggtagaatgcctatagataggacttggggacaaggatgtatttaagtaaaagaatgcagaagtgcaagcagactggaaaattccatcattgagaattttgagtaaagtgagtaaattttgagaaaagtgagtaaaccaatttgatgagagcagaagatctttaaa

SEQ ID NO: 2620 - DNA, 201 bp, Bos taurus
actccggtactctgtggccatcttccttctacttagtcacagccaggtgctgctgaaacaaaaggctgctcagtacctggtgtccccacactggcccatccgcactaaagcatgtctctgagccagtgggaataagtatttaggtcttggtccagggttgcctatccaggccgtctgccagtgcaggagacgtaagggaca

SEQ ID NO: 2621 - DNA, 201 bp, Bos taurus
atcctctcaaggcttcattattttcaccctggtgttatctgattgaatatttcagtcacaaaaaaacttgggagatttgagtcatttcctactcaaaactgtatggaactacagctgggaatgttggtactattttgaaggttttttgttttttgtttttttttctgctaagaaataactgtaagtttaataaccctattg

SEQ ID NO: 2622 - DNA, 201 bp, Bos taurus
ggcagacagcattttccaggataaaggacttcaacattggatgagcacattcaaaactatgacccaccttcaagtcagtgttcaaaggaagtaaaaggccacacagaaaatgagatgtaattgggcaccccatggggaggggacagaacccaggaagccttgaaaagcctcagtgtggccagtcccccagcccagagccaa

SEQ ID NO: 2623 - DNA, 201 bp, Bos taurus
cccagcagtgatatcatacccttttattaagggccatatgatcccctgcaggaggcagtcagaaattcaaagcaatattatacatggctgtggttactgtatgatgatgcaatggaagatgatcctcagtccccaggaggcatggatacaggattctgggactgtttttggccaccgctcagtttttgtcttgaaactgca

SEQ ID NO: 2624 - DNA, 201 bp, Bos taurus
tggggctggcttccattccagaaaggtaaaaaaggccaagggaagagtgtccataagtggtttttatgaacaagacctgaaaatggcccttttcatttctattgatacttttggtccatgggctagaaccagtcagaagcccactcctagctacaagggaggctggtaaatgtggcccagtggtacaggttgtggtctcta

SEQ ID NO: 2625 - DNA, 201 bp, Bos taurus
taaccttaggcagaacctggaaagtcgagtatttgaccagatcatgctttgcttagcatttgtctcttttctcccagaagtggaatgtactatctttactagtgagttaatacagattacagagggtagactcaattcagaaagtcttggtagtctatagccgtaccaccctgaactcacccaatcttatcaggaagtctc

SEQ ID NO: 2626 - DNA, 201 bp, Bos taurus
tacatagtggatgctcttaaatgatcttgttattttttgagagtaaactctagcatcaaatcattaggctctcctcttgcactgttcagcagaaggtcaccaaacatcttctctgagtcaggccctagcttagaacttctaaaaggggagtctgtcatacatgtcctctagttgctcagtttggcaggggacaatgtcaag

SEQ ID NO: 2627 - DNA, 201 bp, Bos taurus
gattggaaggaaggaagctggaccagaggcctgcatgtgttctctctgggccacagatgttcaaggtgggtctgttggggatatcatttggggtacccaacgaaggaaccactaacccaggcctctccttagtctttcactgaggaatcctttgtgtccctcagtgctgctgaggaggtaagtgtttatgactgaaaagag

SEQ ID NO: 2628 - DNA, 201 bp, Bos taurus
ttcttttttgggagatgagattaaggctgacaccaaagactgggaatatatttctgcttgtacccccgctaacctccctggatgaaatttactactctgagaggcagggcagccaggcaactgtagccctctcccacactgtgggcactgtaggagactaggacaggtgtggcccaagctcaatgagagggagtgcaaggc

SEQ ID NO: 2629 - DNA, 201 bp, Bos taurus
ttaaacaattaatctgcatttgcacagtattttcataaattagtaactctttatgatcatcttttgctccactgagtcttattcactaggtgttctttaactatttcatgaatgaatagaagaaggaaggaaggagcattatttccactaccaagtccaaagggaattcagacttggccttttgtacaaagtaagtccact

SEQ ID NO: 2630 - DNA, 201 bp, Bos taurus
tctcctccctccagctgtacctgcaggcccgattcacttggcgaggggcccgcctgctccggccccttctgcagttcaccctgatcatgatggccttttacacaggactgtcccgtgtgtctgaccacaagcaccatcccagcgatgtcctggcaggatttgctcaaggagccctggtggcctgctgcatagtaagtagcc

SEQ ID NO: 2631 - DNA, 201 bp, Bos taurus
ctctgctagtggctgaccatgtcaccctggaaaaggcaattcacctctctaggcccatcattattcattcacatttctagaagtgctcctgtgggcctggtatttttgtaacggttgagacaacttgtaacgagacagctgctgcagtggaagacgtcatggcttctgtggggaaatgagcaaggccagagactgtggatt

SEQ ID NO: 2632 - DNA, 201 bp, Bos taurus
ggagtaaacattacgttattcagagagacacttaagattcaaaccacttcatatttaatcagcaatcacgctcccttccaaaagccattccaggaaaaacgtaagtcgagtttttgacaagaaacaaagctttctgaaaacttatgcacacatcccaggcctcaggggacaaacttgtggccccattttgatcagtggtgg

SEQ ID NO: 2633 - DNA, 201 bp, Bos taurus
agaagtatagcctagttaggagggtctgatttgaggacaagtggtggtcaggggtccatctaagccagaatctggagttcaagggactggatctgacccttagaggtgggaaaagtgctggccaaggtcaagcgggttgtcagaatcaccaggcctaggacagggctttaatttaaactgatccccaaggaggctcatgta

SEQ ID NO: 2634 - DNA, 201 bp, Bos taurus
tccatacctcctctggccctccctcatctgttaggactttaaccctttttgttgttggcacctcagagattcagctgctagacagtaagctccctttgatggaaccaggccttccacctcttggctggctctgtagcctgtatctcagtaatcagacgactacaggtaaatcgtttattaaaatagatggaatataagact

SEQ ID NO: 2635 - DNA, 201 bp, Bos taurus
aacactattttagaaaggtttcatagggtatatagaacagttttgaggtcttggctgacagaaaatcttgaaagagcgtcatggattgtggcatagcaagaagaggccagatctttccccgcttctttcttccttctgtcacatctggtttaggtcatcaggtaaaattaatttgttagtttcaccctgttgacatctgtc

SEQ ID NO: 2636 - DNA, 201 bp, Bos taurus
ctgagactatacttaagcattttaaatgactaccaaacttaacgattatctaagactaaataaggaactcagagggcctacctcaactttcatccaggaacataggaaggactacccccattgagaggataggaggacagtgctgctgctgctgctgcgtcacttcagtcgtgtccgactctgtgtgaccccatagaaggc

SEQ ID NO: 2637 - DNA, 201 bp, Bos taurus
aatgtcaatttccccaaacatcttcaaattccccttacttcctcccctgatagagggcctgctgtatgttcgcagggggtctgaacttccccaagctttaaactcacgtcacctacttgtaataaataaagccatggattgactatccagttagttagtaacttccccatgtaaggggaagctctgtcatgttggccattt

SEQ ID NO: 2638 - DNA, 201 bp, Bos taurus
ggcccacctccatctccttatttcacacgaaggacagtcaaggggtgcagtggacctcaggaaatgggagggcagctggtttcttgaatgctgagaaagacaggcattttcctctgggaatgagaattctgtgacgtactctgaatctctgttttctcttctgagatttgactctgggcgccttggagttgcccttcatag

SEQ ID NO: 2639 - DNA, 201 bp, Bos taurus
gtaagcccttggcatttataggctagagagagggctccaaagtggccactgtcagcacctgtatccttggggtaaaacgggctctccaaaatggctgccttcaatatctgtgttccgaggggaaactccacttgtttctgtctctctgggaggcttttcaaaatcagcagatggactgactcagtttcctttcgaattact

SEQ ID NO: 2640 - DNA, 201 bp, Bos taurus
ccaggcccactcacttggcccccactatggacctaccctccctcctgtgagaagaaccgggttcttgggatcttctctagttggaggagggtacacatcattggccaaaggccctgccctccctgctgctggtttccgccttcaaaggggaggtgtggtaaataggatgctatcagctatctgctgaggtcagggttgatg

SEQ ID NO: 2641 - DNA, 201 bp, Bos taurus
ctggctcaaaaatatagtggaaattcctcccccctcttcttttctagaagttctctgtcacaagggtaggcacatttctgtggaacttttcaataacacagggggtacagttctaaaaagtatcctgaccatttctagttagaggatgcaaaaaagtccttttttttttctcatgggaactaaagagtataaagggaatct

SEQ ID NO: 2642 - DNA, 201 bp, Bos taurus
tcagaaattctctaattatatagagcagcaacaaggacaaaacaaccaaaagaacccacaggtttgcacatgaaacacaaaagggagtgttgttccataggacagaagggatggaaataatctgctttaaaattgtctaaggcaaatctgagtgagatattgttttcagttagcaggtcttcaaaatacagctctatggat

SEQ ID NO: 2643 - DNA, 201 bp, Bos taurus
gccttccttgaataatgaatctacagaaaggaattagactgatctttcatttgatcccaacacttcccaatagatgctgttttatatgaaggtgttaacattcaaaacaaagccaaattcagtcttctttggaagactataattgaaagatgtagaattttatgggcaaaataagttccttctttaaaaacattctttatt

SEQ ID NO: 2644 - DNA, 201 bp, Bos taurus
ccacctcttggttgggtaccatcataatcccacagtaaggaaatctcagaaatcttgagatagtcctgattaaagttatcaacagaagagtttcctttagcatcatttaaggttctagtcaatgaggtgaagaaaattaataaagaaaaagaagctagaatgtaagaatggtaccagaatgtgtaattgaacaacaacaac

SEQ ID NO: 2645 - DNA, 201 bp, Bos taurus
agaggaagaaattctgtttctgctcttctttctagaatcagatcattataatgacaaaccttcaaatgtgtacagcctttaccttctacagaatgtttttgcattgcttgcatccttccaatagccctgtgattaaaaagagaaggatctttatccctattatatagatgcatccataaattaatcatctcctgacaacca

SEQ ID NO: 2646 - DNA, 201 bp, Bos taurus
atagttcatgtccaataaatattacttatacagccattttcttgggacagtggaagcatgctggacagtcatggaaggaggccagtgctccctcacagctagaacatggagtctgtgagacagggcagcgtgtggaaggtgaggctggctgcggccacgccgtggaggacttcataaacaggcagtttggctttgatctga

SEQ ID NO: 2647 - DNA, 201 bp, Bos taurus
ctctcacatgtccatcattttttatagctcagaaaccacagctgacaaaactagagcatcttgcctggtaaattttgatgtaatccttgaaacccatccttccaaatttaaactatgagtccttttcagcacacctcactaggtgatacttgaagtcctcttcttgtctaaaaggctgtgtgtttgtaggagaaccaatta

SEQ ID NO: 2648 - DNA, 201 bp, Bos taurus
ttttacacatatataggaagaaacggggaaggtgaagatctgacttggtagttggggctgagtccctaattagtcctcctaaagggccaatttaaaaggacaattacagctttcatggactctagaagccaaggatttatagccactggaggtgaccatgaataaagctcatggaaaggtctatgggagctgttgcttctg

SEQ ID NO: 2649 - DNA, 201 bp, Bos taurus
aaggtggctttggacaaccaaggcattgctggaagaggctgacagcttgaaagttgtctgccagctgtactggcaaaagctaggcaggaagtcccgccttgaaggggaatctgagtggcacatgaccatatccaccattcttaatgtatttctccattcttctgttgatggacatctgggtggattccagttagcactatt

SEQ ID NO: 2650 - DNA, 201 bp, Bos taurus
ataacttttaaatatttagacatatggtgtacaggttccatgtgaactcctgctccaggccctgcaagtgtgagggatgggcctgtccttgccattacacattcttctgcctccaggctgcatcatctgccaaagtccccactctctattggcggtgaacactgatgccccctatccatccttgcaaaggcctgactctct

SEQ ID NO: 2651 - DNA, 201 bp, Bos taurus
attgcctccatttgggcaggtgctctagtacccaggagcctgttactggactcccgtgagccacgctctatccttataataaggcctcctctactggagtaggtctcaggtctggcactgggagaagtcgtggctagagcagagggcacagctgccagataagggcagggccgcagcctacacctggctgctcagcgctct

SEQ ID NO: 2652 - DNA, 201 bp, Bos taurus
gcatgactatcttaatgctcaattcatgagataagtatagagaataaaatgtgataacgcacataggaattttcatagcatctggcccccagcagttcccccagtaaatgtccatcctcactgttccttcctccctatgggtgacggttgggtggtggccttgagaaaaagaccaagtctggctttcagttctctgcaccc

SEQ ID NO: 2653 - DNA, 201 bp, Bos taurus
cttacctaatggtgtgctcaaaatagatgtcatccatggaggctgtgacacaggggcaccctgcatgcctctccgctggcatcaggagaagaaagccatctgttagcagcctccccatggcccaggcctctgatcaatatcagaccctcctagctaaggcctgcctcctcgctcacacccccaccgttctttactttcctc

SEQ ID NO: 2654 - DNA, 201 bp, Bos taurus
ctacctttgcacggccctgtttgcattagaaagtttggcttaaggtcaggaagaatgtcagaacagggagacttctaagagacagccggttccatccattcctcttggaagtggagaatgtggcccagagaagacacccaagatcaaagagaaagtaacatgaatggggcaggaacccaggcctcctgactcccagtgcct

SEQ ID NO: 2655 - DNA, 201 bp, Bos taurus
tatcttgactgcccactgtcatcccacccctgcctgggtatagttaggtgccaccctagtaccgtatagacctcaaagcactgatcacaacaggccaagttctgtgattagcctcccctgccctcaccagattatgaacttcctgaaaggcaggggctccctcatcaagctcttgccataggcctgacatcaatggaaact

SEQ ID NO: 2656 - DNA, 201 bp, Bos taurus
caggctctgtgactttagaacaagtgccaagtggctgatttgcatccaggtacgtagtagtaggtgctcaataaatggtagtaagagtgttaaaaatgaccgagggtaagggcacagggcatggccaacctgttggttgtgagggattcccctccctcacagcccccatgtgtcctgagtatcctctcggtgcaggatccc

SEQ ID NO: 2657 - DNA, 201 bp, Bos taurus
tgtagctcacaggcacggagggttccctggagggggtagagagggaagctcagatgggcaggacaccccagaaggacagtaccatccagttcaagcacgcccaggaaaaggccccatagttggtaggtggggtaagaccccttcccaacccagccctgtcatgtactgtcttgttgcccagtacggggagctcctcatgct

SEQ ID NO: 2658 - DNA, 201 bp, Bos taurus
acaggggatttaatgtcacagcctgcagagagaactcaggcagccagcgtcaatatttgccatgtcccagcctccctggccccagctccaagatcagtacgttaagtacaacaggttcttctctgtgcaaatacacagggatagataaatggaatttaaaatggctcaggcttcgccacagggtctggactggaaatctgg

SEQ ID NO: 2659 - DNA, 201 bp, Bos taurus
cacagaggcgggcacagctgaagcgacaaagcacgcacacgcaagagtggtttttattctgtcgtttctactttcatttttgtctccatgtttcctgtaggggtcacatgggatttattggaaaaaaataacttccattaaattttttttgaatttgaatcaaagaagagagggttaggttggttacttgatatgggctag

SEQ ID NO: 2660 - DNA, 201 bp, Bos taurus
ataatttgggaatgtagccacttggcgaagtaatttgtggctaattggcttttgatgaattggtcatttgacacattgatttttggccaactggcacttgataattgatgttcgtcaaattggactgcctcccacagtgggcttggggcttgatgtctggggccaggctgtgaggcccacatgggcgcctggcaggctgag

SEQ ID NO: 2661 - DNA, 201 bp, Bos taurus
ggtacgggacttggcggccttgtggggagctataaggcacctggtgggaattatccttttggtgaacaaggctcttcagcgagatgctggctgcatacttatgtgctttttgttggtgattctggtttttacaataacccaatgtggggtgctaaagcactacctagtgatcacatgcaggaaggctgggatgtgcctttt

SEQ ID NO: 2662 - DNA, 201 bp, Bos taurus
gcctgtgggcccatcatgatccaccctaccacatacaggttgggcctctgaccttcaccccaactctctcctggctccagcctgctggcctccatacagtcctccaaatgtccttaggatcctatctcagcaccttgtcctccttgctgcctctgtcaagatagtccttcccttgctccatttacacctctgcagagggcc

SEQ ID NO: 2663 - DNA, 201 bp, Bos taurus
gctgtctggcctgggggcccatctatctcctaccccaaaaccagtaagggggaggcaggttgctcagtgtgtttgaggattggaccccaaagttcctgcaccccagtagaggctcccctggcctaaatcctttggtaggtgaccaccttacctgccgcccccaccgtaattgtgaagggattctgcgtcaatatcggtccc

SEQ ID NO: 2664 - DNA, 201 bp, Bos taurus
gaccttagtctatgcacatgtgcagcagagaccttagtgggcccaagccaactaatccttggtcaacagggtcagagcctatgcatgtgccaaggagacaggagagagtccagtggaaaataaaggaataacatttgaatcccagtccacacatcaagaaagtatagatgccttattgccttgaggtatgtgaatacaatc

SEQ ID NO: 2665 - DNA, 201 bp, Bos taurus
ggtataattttggggttccaagtagcagctgagttctaactgtagaatgcccaggttcagagaatagaacctgaagtttcaatagtaggtacaggaattcagtactcgagtctcagactttgaaccaggagcctggagttctaatagtaaaatctctggaaaaaaataaaactccagttatgagagtaaaatctagaggtc

SEQ ID NO: 2666 - DNA, 201 bp, Bos taurus
ataggtaccatgtctaccctacctgtaggaacacatctgggattctaggcttctctgtcaccgtggggactcaggcaaccaaatacaagtgagtaaacaagtgagatgatgggcccagctatcgtttttcttggcatagagaataggggctgcatccttgccctgaccatttgcttcccatttagtcacagctgcagcagg

SEQ ID NO: 2667 - DNA, 201 bp, Bos taurus
ccatcatgctacaaccattctccttccaaaacctgcagttccccaagaggctgcatgcagtctgcttcctggcctgaacccgcctaacacagcacctaccacagccggcactattgtgactggtatcctggtgtacaaagacctagctgcccaggtgacagaacagggttctctgggtgagagcaccctggctcccctgcc

SEQ ID NO: 2668 - DNA, 201 bp, Bos taurus
tctgagacttgattttaactgagaacagctgaaaacaagttgcttcagtgtcttcccacttactaattaaattttgaactaaggcttcaaatgccaaaaacccaaggacttttgggagagatttgtaagtgttttgaagtcaagcagttatataattgtttcagatgttgcatagttattctttgtagcttttctggaata

SEQ ID NO: 2669 - DNA, 201 bp, Bos taurus
atgtaacatatcataataaaaaagcttagaaaatattttagaaatgttgaaattgagatgcctgtggaccattatagtgggaaaaatgacaaaaagtcatattttaaaatacacgaacattcatttagatgaattaaaattttgggagaaagagccctctccaggtaagctcagtcagtcagtcagttcagtctctcagtc

SEQ ID NO: 2670 - DNA, 201 bp, Bos taurus
ttctgcatgttttcctcattgtgtttaatcatttacagcatttgattctgaagtgagagatatatgaccctttctttcacttgaacagttggaggccattgtaagtttaataattgtcctaatttccatactattgtgactcagggattagggagacccaaggaaagagaaaggggaatggcctgatggtggatcagtcag

SEQ ID NO: 2671 - DNA, 201 bp, Bos taurus
ccctaataattttatggtttgcaagtgggaaaaaaacaaatatttgaagagagtattctttcctaccaagttatagagctatgtttttcctttggtaaatctataagtagcagctttgctttagctggaaatttcattatgatttagttacatgacacaaaagaattagcaaaatgaataaaatattcaagattgagagag

SEQ ID NO: 2672 - DNA, 201 bp, Bos taurus
ccttcctggcttcttttcttccttcactttttgcacgtctcctctttagctagtatttaatatcactcatgaggctaatgctgtgatgggcatctactgtatgatatccgcttaatccattggtgtgaaagcaacaaggacttattttctcccttttgtaggaaacagcattccaactgttttttgacatctttaatttca

SEQ ID NO: 2673 - DNA, 201 bp, Bos taurus
atctcgaccccactttgaagaggcagcgaactcaaaatgatgaagtgacttggctgagctctagaactagtgcagagcgaagtctgggacccagatcttcaacgccaaagcttctgtgtttatgacagttcagtgccaccttcagataaagtatgacacaactaaagcatttcaaataatagttacaatcataacatcttt

SEQ ID NO: 2674 - DNA, 201 bp, Bos taurus
attataaaatcctttcctggtacacctcaggataatccaatgttttaatacttaggcaacactggcttataaagtccatggttgaatataagccttgaaaagtttgtttctctctcttttgtgtgtgtgtgtgtgtgtgtgcgcgcgtgtgttttgttcgtatatatttatatatataatttaataaataaggatgggaaa

SEQ ID NO: 2675 - DNA, 201 bp, Bos taurus
tattgcatttccaatagtaccattcatctttcagagtgaggggctgaccgctacatcagtggtatgacatttgtaaagcaacagattctcaatatattatcgcaagaatcaggcaggcgagtctcccagtcatgcatgattttttttttttccaccacaagccaccaccaccacgggaagaaacttgtctcactccagcag

SEQ ID NO: 2676 - DNA, 201 bp, Bos taurus
ggacatgactgagcaactaagtacagcccatgaagctgtatttttaaaaacatggagatttcacatagaagtataaatttctggcctctctttaagaatcaggagacttggccaaagtggacctgcactgatgcattttcacttttggctggagctgagtagctgttgcccaccttgttgttgttcagtcactgagttgtg

SEQ ID NO: 2677 - DNA, 201 bp, Bos taurus
aacctagggaaaaactgatgtttcagttcaagttggaaggctgttatagcaaaagttcttcttacttgtggtaggtcagtcttttaggctttcaactgattggacaaggcccacctacatttggagaacaatttattctgaatccactgatttattaatgaatgtcaacattaaagaaataaataaatgactcttttgtga

SEQ ID NO: 2678 - DNA, 201 bp, Bos taurus
tttgtggaagtgaggtgtgtgtttgtgtgtaagaaagaaaagtggtaaagaggatgaattttacactctgattgtcatggactagatagaggcagcaagtgctgacatagcccctgaaatgagaggccaccttgaagatccaggccactgagaattcagagaggcatatggacttacactgtctgagactggggtcaggat

SEQ ID NO: 2679 - DNA, 201 bp, Bos taurus
aacaaaatgtgttttataagtgaaggaagtcaagaacccaggaatggggtgttgggtatagtttttttgattctgtccttcatctcacggcccacattcagttaatacagatttttcttcctaatctatttcctcttctctatattgcctttttggcatctgcatttggatactaatctgcacctgaaacttaacatggcc

SEQ ID NO: 2680 - DNA, 201 bp, Bos taurus
ggataaactctactgatatgtcattgataccaagttctgaaggtcataataaggtattttgtccttcataaagttttctgttgaagcctcgtcttttatccaaaaggaaatagcatcatttattcattcagaaattacttgttaaacacccaaagtatgttttacacatggcaaaatactttaagagattagacaatcagg

SEQ ID NO: 2681 - DNA, 201 bp, Bos taurus
tgctgatgctgccggtccaagaaccacacttgaatagcaaggttttcataggaaggccttgtatcacccatgcatggcccctatctccttctaagcctgggccctgtggggtgggcttgttattccccattccacctcttgcttcaatgatagaatttaaagctacgttatttttctgagtaaccatttttggttcataga

SEQ ID NO: 2682 - DNA, 201 bp, Bos taurus
ctcatggaagcaattttaagcccattaaatattgtagattcagtgatttgtgaaacttctgaaactttgggcttgctgaaacaatctcagtaagaaccctgggaaaaggcaagtgaaaaaaggttaaaattgaggaatgagttctaaaataaatctgaagattatatggatatgcaaattgttaaaagggcattgcctgaa

SEQ ID NO: 2683 - DNA, 201 bp, Bos taurus
aacccttccaggtctgtctcacatgtttaatctcttgatttcacaatattcctaatgtgaggcagaaggttagagttatgaatacatttctgagctgggtgcttgtcattaaagatttctgcctcagggcccagaaatgagctatggaattacagatgaatcctggcactgtatgtgctgagcctcagagcctttccccac

SEQ ID NO: 2684 - DNA, 201 bp, Bos taurus
caaatgttttgaagctacttttaaattaggaggcaagattccttttcaccccttacctaaacaaaaaataaatagtttcaaggatttcaaaggaaagtatggaattattgttagattggccaatagaaaacaacccatctgtcttgctcagcactgtgacaaaggagtatttttggaatctttgacagccaagcttttgtg

SEQ ID NO: 2685 - DNA, 201 bp, Bos taurus
tgggatttgccaggcaagagtactggagtgggttgccattgccttctccaaataaggggcatagtaaggggcattttacaggtgttggccatgataaggagagaacaaataataatatagtcacagcacagagtgtggaagaaacaggatttaaatccaagtaaatctgattgtagaatccattatttcttgttgatacta

SEQ ID NO: 2686 - DNA, 201 bp, Bos taurus
tggtgagagagttgctgctgagaaaatgacatgttcatgattgtgtcccaaagagcagtaattccagtaattgctgacttctacatttttatttttgtttttccacttcactccccatgtgttaatgtatgtagatggttaggactgactccttcctgagaagatctttgagttactgtttttctttcaaatgtaaggctt

SEQ ID NO: 2687 - DNA, 201 bp, Bos taurus
tttctactttcatttcctagtggctaatgatggtgagcatttttcatgagtttattgtgcatttgtttatgttctttggttaaaaatctatccagatcttttgggcattttctgatttttttttgtttattaattgtctgagctacttacattttctgaatacaggttgtcatattcatggtttataggtaatttctcttt

SEQ ID NO: 2688 - DNA, 201 bp, Bos taurus
gagcatcagaaagctgataggaggaataataggataagttaggctttcagtaactaatacacaaaatgtgtatctaaaataacagcactttaaacaagatagaagtatatttctcttccatatacaagtctagatgcaggaaatccagagctgatggtgtggctctgctcctgaaaactactggagtcaaattctttcagc

SEQ ID NO: 2689 - DNA, 201 bp, Bos taurus
cttctctgggtcttggtatccccatctgtaaaataggaataataatagtacctaccttgtagagctccagtgaagaaaaatcacttaatatttataaataacttagtacttggtatctgtggtgtgtgctcagtccttaagttgtgtcccactctctgccaccccatcagtgtagcccatcaggttcctctgtccatgggg

SEQ ID NO: 2690 - DNA, 201 bp, Bos taurus
tgctggcctgtggaccaggttcaaggcatttattgccatcggggattacaacggacatgtcgatctgggtaacgagtgttctaaagaagtacccactgccatctgtggagccatcatcctggccaagctgtccatcgtccctgtgtgaagaggctactggaggagcaagatcggcaagccccacgcagttctttgcaaggt

SEQ ID NO: 2691 - DNA, 201 bp, Bos taurus
agagaagttatcctcctaggttatgaggctagcactatgacctaaggccttgtgttatgttagaaaataaagctgtattccatacctttggggcttgactgaagcatctcagaaaagaaccattccctgatggcaacctggggtttctccacacctgctcctccatcccccaccctcaggagccaaactcccaggagtgaa

SEQ ID NO: 2692 - DNA, 201 bp, Bos taurus
gggggcagagcagaaggtggtattcatcacaggacgagtccacccaggggaaacaccctcttcattcgtgtgtcaaggtgagttgcaagacctcatgagcgtactgtgcctaacccccatgtccaactggggcactgatggcctctgggaccatgtagccacatgcagagtccttatcttgggtgacaatttacttcactt

SEQ ID NO: 2693 - DNA, 201 bp, Bos taurus
atgtctgtggagactgctccccatctctgtcccttcaagtagcctttcaaagttagagttgatagtgagttgattttaataattgattctacagtgaagacaggcctctgtgggacagttacccagaattaggggctggggagtccggaggagcaaaacattgtgatggaatcaagaacttcatggctcccagtcttagtt

SEQ ID NO: 2694 - DNA, 201 bp, Bos taurus
ttttctttctctctagattatagctttggctctggcagcaagcagaggggagagatggagctgtcacctcagagcaatattctcatcaagttggttgtttccttcaatttttctaacatcttttcatcctgaaagactctgaatacttctcagcaactgactagatacatactgtttcaactgcaggaggccccacaaagc

SEQ ID NO: 2695 - DNA, 201 bp, Bos taurus
tttatttaccatgtgtgctaattccaacaaaagcccaggccatgctaaagccacatggagcatttcccagcactgaactctacaggaaagctctcactccaagacccacgttgggagaactggcctgtgacctcttaagccttccttcggcagatgccagcaccggtgtcaggaggttgctgctcacggcatcccctgggg

SEQ ID NO: 2696 - DNA, 201 bp, Bos taurus
atgtccagggctgtgtccgaacccagcctggagacaccctgaagtgaggggtgagaatttgcttgactgtttcacatatgctggcccgcaccatgaccccggatggagtagtggccgagatggtcccagtgaagtgatgactaaatggaggtgtctggaggctgagaaggtgtgttggccctgtcaggcctgtgggcaaag

SEQ ID NO: 2697 - DNA, 201 bp, Bos taurus
atcaaaagataacttcatgtattttaactatatttaacagcttttcataattttatattaatagtttcagacctctccccccactgagctcccctgctagatgtgtaatatgtagttttcatgtacagttctctgtgtcatcagatatcgaaaataatttttactgattatgtgatattctatcatcctgctatttttcag

SEQ ID NO: 2698 - DNA, 201 bp, Bos taurus
tgaggactagcattctgttctgtttggcctcatagctagactattatcagttcatgtgtatttgtcctttgctttatatatccatccctacctttaccccgttcctactcaaaaggccttggaattgataaagttctatagattttcagttcagtcactcagttgtgtctgactctttgtgaccccatggactgcagcatg

SEQ ID NO: 2699 - DNA, 201 bp, Bos taurus
tgtatatttatggatgatgaatttccttaattgggaactagaacaaggactaataataagaaactcaatcccaaggaaaatctggaaaaagtgacatgtgcttaacattagccgcaaaatttcatcacaaggtaaatacaggactatgaaatatagcacatattctgcctaaaagacctcaaaaagagataaatatttgtg

SEQ ID NO: 2700 - DNA, 201 bp, Bos taurus
tgtgtttctgtcattttttcaccatatatcaggtaatctcccaaagtctcctgatccatctcttcctcctttcagaaaagtctagaatgtatgatggcctttttctctcagaaagtctaaagtatttgatgtcataagcagtcacttctgttactcatcttgcatggtctgaagttcctaaggccaaagtcattctccaac

SEQ ID NO: 2701 - DNA, 201 bp, Bos taurus
tgctgagccagaggagaaggactctcagctttctaggaacatgggtgtgttgtctcttagaaacaggaccgtaaaagtggtctggctgccgagtgagactagtgtgtaaagatcagctctttgtgaggagcctgagaccctgatcaccatttctaaaatagttaccatagcataacatggccttgcatttcgtatggccca

SEQ ID NO: 2702 - DNA, 201 bp, Bos taurus
cctgacctcgcttaccggctgagttctaagccggcagtgtgtctccagtgaatcctgcaattacttaactttattgctggaaggactctcaccgctcatttctttcattcggttattgcacagaaggcaaacaagttcaaatgaaacattgtgagttttctcctactatcttgctttctgtgataaggactccttcctctg

SEQ ID NO: 2703 - DNA, 201 bp, Bos taurus
ccagggtgcattgttgggtctgggccctaggctgcaggccgaggaatgtggactctgcaggaatctgtttgctcatttcccagagcttgacatccctggcgtgacagcacccagggagtggccctcggccctatcaccaagcagttccctgttcaggatatttgcacaggggccactctgcttagtctgtattcattagaa

SEQ ID NO: 2704 - DNA, 201 bp, Bos taurus
cagcagcggggagactggcttttacggcacgtaagagagccggctgcagcccagggcctcggtgggagagcggaattattaatagatcctaccgaggcctcgggaaaaatgcaggactacgtggagtttaaaaggtcagcgtgaataacaaaaacagactttctggggagtcagaatgggtttaaaatacactcagagggg

SEQ ID NO: 2705 - DNA, 201 bp, Bos taurus
aggccctaattcaggaactgacccattgggcagctctcagatgcatgccctgtatcagtccttggccagaccctgaggacccacaggtaaaccatacacgcgccacaggatgactggactctgaagtaaagaactttccttctggcccatgtgaggggatcaccagttaacagcagggtttcttctgccctcaaggggctc

SEQ ID NO: 2706 - DNA, 201 bp, Bos taurus
ggggattttgattggggtctgtgagtgttctggaaggaaacatgcaaatgtgcatgtgaacaagctcttcaactctcagtgctggaaagagcttagggagtattgcagccatccccgctcctgctttaccgccaaagtctggtcagagggggaacaaggtggtggctggcctgaaatgagaattcgctggaccagggctca

SEQ ID NO: 2707 - DNA, 201 bp, Bos taurus
gaggagcagtcaacttgtttcctctttgtgagcagcaagcagagagggaagaaggagaggaatgaggcaaagtagcagagaacagatgaggcagggcctcaggaggcaaccacatgagatgtgagtctggggacaatagaagcccccacagtattttcaacagaacctccacaccagtctacacttccagctttacaagat

SEQ ID NO: 2708 - DNA, 201 bp, Bos taurus
cagccatggcacaggccaaggtcccctcccagagggcgaagatggtcgggatggttgagacaccagcagagatataaggaaatgattttccagggactcatggccatgagtgctcacaacctggaggaagaacttggagacaagaccagacgaccccaggttctgagacagtccacagcctgtttacttggacctggagca

SEQ ID NO: 2709 - DNA, 201 bp, Bos taurus
catccactaaccattccctgagcactgactctatgcctggcctgggtggcagagatatggagacaccccaggctgatgaggtgagaaatcagtagagaacccaaggattaggtgctgttaagagcaaaaaagacacactgatagacttcttaggggtcagaggagggacatttgggcagggccttgaaggatgagtagaag

SEQ ID NO: 2710 - DNA, 201 bp, Bos taurus
ctcttggatctcacactgctctagttgccctggccttcctgtcccttgaacaaacctacttcatttctgcctcaggatacacttgctgtatcccattcctagaaaatgccccagataaccaaagggcttgctcttttgttcaggtccctgatcaaatatcatctgagagaggctttctatgaccagcgtatttcttcatag

SEQ ID NO: 2711 - DNA, 201 bp, Bos taurus
gttctgatcaatcaaaccagccacactttgccagaatctcgtagggactctccattgcctatgagacaaaattcaatcttcttagcatggtgagctgaatatgttcagttttgagatgtcccacctctctgttgggtaagatctcctgtattccatgtggtgctcctgatggggctgttcagtctctttcctccttacact

SEQ ID NO: 2712 - DNA, 201 bp, Bos taurus
aatttcttgtgtagttttaagaggatcagcttcaatgatggctctcaattggtcgctgtcaacttttgatggccagccactgtgctcctcatcttcaaggctctcgtctctttgtgaaacttcttgaaccaccactgtactatatgttcattatcagttcctgcgccaaatgcgttgttgatgttgtgagttgtctccact

SEQ ID NO: 2713 - DNA, 201 bp, Bos taurus
cttcacgggaggtctgggaccaggaggacaggaggaactaattaaaaacacaatggaaacggcaatgtcaggttttcagagctgctggggccctcagaaatcacttggtcctcactgtacaaatgaggacacaggggctccaagaaaagggactcgctcaagttcacacagcttaggaagcacagtgcttgggctggaaca

SEQ ID NO: 2714 - DNA, 201 bp, Bos taurus
tcactttcacttagcagaaccttcaacatccctgagtctgcaaatttcaggcatcacgagtgtgtatgggaggctggcgtaacacatgaggagtgctccccgccagaagttgtacatgacatttttgtaaatcaaatccttatccttcatcttttaaagaaattctactgcaagtcccttggtaatgtggagaatcctttt

SEQ ID NO: 2715 - DNA, 201 bp, Bos taurus
agggggctgggctgaaatctagttctttctgcacctgtcaactctggggcaagtatgcatctgcccccagttctcatactggtggcccggtcctgggtgccagcagcagccctgcaggacacactgaatgaacaggagcagctcccagatggagagagggatggggaggcctgagataggctggcgaggtcagcagagccc

SEQ ID NO: 2716 - DNA, 201 bp, Bos taurus
acaatgtcgttcactataggtactgtgttgtgcagcagatctttagaacttattcatcttgcataactactttatacccattgaacagtcccccagggggtcctttttttttaaatgtatgtccatgtttactctgttcctccatttattcctatgttacctgaatatttttagcttgtcattactatgacaatcactatg

SEQ ID NO: 2717 - DNA, 201 bp, Bos taurus
tggatagcacctcatctttcattgccttggccttcagctgttcctctagttttggtgaaatggtagctgccagttagccacactggccatttgtgaggccgtgaccattgtccagatacttgtgatcaggatagttcagtacctgggagagtagctctacccagatcacttcacccagaacacagcttgttgtctgtttaa

SEQ ID NO: 2718 - DNA, 201 bp, Bos taurus
gagtgggatgccatggccttctctgtaaatgttaaatggcttcagtttgatggagaaacaattccctaggctatccctggaaagccacttcaggctccacgtattcacagggtttggggccgcagacctgaccggtgtgtgactgtgcagaaaacattgctcctccctccccactgctcctcacacgcctgtgccctcaag

SEQ ID NO: 2719 - DNA, 201 bp, Bos taurus
actgccctgaaatgcccttcaccgggtccactggagactcattctctgagctgggggcagggagatgggaggggtcttcggcctttggccagggagatcgcgatgcgccagggagggagagaaggatttgtctcaggggcttggtttgtgctgagttctcgggaccccctcctgtccctgcccccaaggcttggctggagc

SEQ ID NO: 2720 - DNA, 201 bp, Bos taurus
agagtcaggtcaggagacggtggcccgaagcagggctcccagagctcagagccattactcagccccagacacagctttgaggctgctgcctagatccccaaaaactgacctccagggaggccagcccctgttgtatctgaccccttcacaaaacaccttcccagtgactctgcaggtggacagagcaagaagaaggattcc

SEQ ID NO: 2721 - DNA, 201 bp, Bos taurus
aaggatattaaaagatatgaatgaatagccagatgaacagacacacagagggaggaagtctggaagagcggtgaacactggagcttctggcccagaggagcttcgagtgtgcctcttcctgacttcctgctcactaaccaggaagttctccaaaccctcccaaaccttttgtgtttctaaggaggcttttgacacaggtag

SEQ ID NO: 2722 - DNA, 201 bp, Bos taurus
gggagggactaggtatacgtggaagagggtctgtcggggggaacagaatagagctcttttggcgagattccacctgtgatttatttcgaaactcacacacacgctgtaattgcaaggcttttctctttttttcctggctagagccctcgagttgaggggcctgctgtggtgctccactgtttatttcaggtgtggcgagtt

SEQ ID NO: 2723 - DNA, 201 bp, Bos taurus
tttggaagcactggagaagagttcattttcttcttttcccactttctggaagatgtctgtattcttggctcctggtcccttattctgtttcaaagtcagtggcattgcatcttcaaaactctctctctctctgacctctgcttctgttgtcatatcaccttctctaactctgatattcttgccttcctcttatgaacacct

SEQ ID NO: 2724 - DNA, 201 bp, Bos taurus
ttcctacttaagatttaagatatgtttagaacttattttgtgactactattccttaatatcttgttgcatgtgtttgttaactttatgatacaggatactcggggctggtgcactgggataacccagagggagggtatggggagggaggtgggaggggggcgttcaggatggggaacatgagtacacccatggtggattca

SEQ ID NO: 2725 - DNA, 201 bp, Bos taurus
ggaccttgctgtcaatgttctttgcatctggggagagtcaggggttagagtaccaagcctgggtgcacacccacatgactagccatttgggatagattcaaacatgctgtgtctgccttcatttatcttgagacccaagtgggagaccctaaacaagggactcgaagagtgggcatacttgtcaggcttgaggtcacggtg

SEQ ID NO: 2726 - DNA, 201 bp, Bos taurus
aacccagaaatatgtgtgcctaggggaaaatgaagttctcaggtggggacttaggagagtggtgctccttaaacagtccatacacaaggtccccaagtctgcaaagcatgcccaaccctttcacagggtaggaattatgtccatctctttgttagttttcacatgtcccctacaacttgtaaacttatagctcagaagttt

SEQ ID NO: 2727 - DNA, 201 bp, Bos taurus
ggtgacgtactagaggtcacaatcaaactcttgcggttacttgtccgacagctgcaatgaaaacacaagtgtcagttataacagggttgcatcatgggcccatagagcttgagtggctatcgagagacaaagtcacatcatttcatgagccgagcagtgtaatacttggaactgggttaccaattactgtttgcacagtga

SEQ ID NO: 2728 - DNA, 201 bp, Bos taurus
tctttcccttacacaggagtgggggtggtggacaggaatgaaacaccttaagctcgtctcaatgggcttttcccactgccaagaaatggcccaaaagagaatgtagttcggtttactcatttactcatgagtaaatttttactcattttactccgtgtcctggtgtgccccagagggccagttttagctacaataattagt

SEQ ID NO: 2729 - DNA, 201 bp, Bos taurus
cctaaaatgcaattgttcaaaatattaatagaacgagaagtcaaaagttaaaatggaatgaattctgttcaaattgttgcaggaagagggacccttcccagggcccgaaactgggctcttgtctaacacttggaaatgaattgtctgaggagacacatgtgctgacaaagcaagagattttattgggaaaggtaacccggg

SEQ ID NO: 2730 - DNA, 201 bp, Bos taurus
aactggcttttgaagtctgtagggtacttaaatggtcctttcctttctagtccaggtttcccagccaacaaaatctgcacagcagagttcgggaatgtagggtgcaattacggagtgatggtggtataagaaggtaggagattcggagtccaggtcaagtatgacttggccaaattgcttgctatctctggaactcatttt

SEQ ID NO: 2731 - DNA, 201 bp, Bos taurus
atatctactaatggtcatgctaaaaggaaaggtggggaatccagggtaaagcaagaagagttctttgtactttttcaacttctctataaatttgatgtcttgtatttacaataatattacaaaagcacacttaggagccaacctcaataaaatctcactgaccaaaagaagggacaatgtgaacatcaacaaagataataa

SEQ ID NO: 2732 - DNA, 201 bp, Bos taurus
tgggctctgctagtgctggactttgggagtctgatttcttttttctaagggacttgacagataagcctttgcgataaggctgtccttttagtcatagaccgactgtagctaagctgcttggttgtgttctattagaggagagatactgaagtccatttctgaggggtgataggatagtaagatttcaaggtctccagaaat

SEQ ID NO: 2733 - DNA, 201 bp, Bos taurus
aacaactttgacttttcatatgtatactacattttgtctgttaacaggttttttccaccttttggctattgtgaataatgttggtaaaatactggtgaatatatctgaatcctcgtttctagttactttgaatatatacataggagtagaatttctgggtcctatggtacttgtgtgtttagattcttgaggaattttcag

SEQ ID NO: 2734 - DNA, 201 bp, Bos taurus
gaatggttgcaattaatgatatagccaattgcctctctttctcagagatatttgtaaggctgttttatttttgcccgggtggtcatttaggaattgagctgcttttgaataaataacaagagttggttgtgtggaagtatgagcagaggcctgactggttgtgtggaggaatgggcagaggcctgactaggctagacagtg

SEQ ID NO: 2735 - DNA, 201 bp, Bos taurus
taaaacaaggtctaacccagaacactgttggtacccacattacagtacttaccatacagtactttaatttgggttacatgactcccttccccactggattgtgagcttctggtgggtagggttggcatcttgctcacctctcttctttcagagaaaggtatctaatgaaagtaggaaagcaatacacctggccacattagg

SEQ ID NO: 2736 - DNA, 201 bp, Bos taurus
cactgagccaccagggaagccaataaatagcaactaggcaaatgccttaatttgacctaatttatttgtgtgtttgtctgttcagccactatcaaacatccattctgtgtgagagccagtgctaagtactaagactataaaaataaatcttggaacttccctggtagtccagtggttaagaatccatcttgcaatgcaggg

SEQ ID NO: 2737 - DNA, 201 bp, Bos taurus
cagtgtcccacagaaagcagaggcctgcaaggagtggacgtataagacacattccattttcaaaggaaagcttctctgttactagttagaaagaatcttttcccattttaagatgctgtggaatgccctaaaatcttggtttatgaacaacctgaacttggagtaagacttaaatgatgcttaataaaattcttctatatg

SEQ ID NO: 2738 - DNA, 201 bp, Bos taurus
ggccagggcacactctgctttattcacaaaggtctccaggtcgtagtctggctgctcagccatctcggagagctccagccagcctggcccttgctgcagcgacacaagacggaccttgtcaggtcaataatgaccaaaccaatttagcaaatcattcccagggctctaccatctgcaatgcggatgcctgttcctctagcc

SEQ ID NO: 2739 - DNA, 201 bp, Bos taurus
ttccttttgtgccaaaaatcaatagagtaatcagagcaacaaggggaactgatcaagaagagtcccatggtatgagaataatgaaacctctagaactttaaaggttaaaaccattaaattggagatgcttacatatgccagggtctccaacatattaccgtagacataccaccactatagaaaaagaagccgtcccttaaa

SEQ ID NO: 2740 - DNA, 201 bp, Bos taurus
accacaggtgcgaccacctctgggtccattttcagggctactagatacccaccgataaaagaaagtcaaggtcccatggggtgggaatgccaaggacaccgtgagcccggtaggccactgagactccagaatctctctagaacagaactcacctgcttacagctgataagaagacgccaatggacctgagcagcttatcta

SEQ ID NO: 2741 - DNA, 201 bp, Bos taurus
ggggtccctgtcgtgttgtttggagggtttggctcactgttgccagagcctggcaaggaagatgtgcccgaagagctgaagggagacatttggcagtactccggccccgcccgaggtgctctgccatccaggccaggcttgcattgcccctcctcccagccagagactggtcagccaagtcctgccccagggcccctaggg

SEQ ID NO: 2742 - DNA, 201 bp, Bos taurus
cggaagcttcatctcattcattcactgatcactttgtgaggccaccaaggtcaagggctgtgctgcttacttctgggtgcacagcatctaacacagaacattgcagagattagggcctcagtaaatgtgtttcagaggaataaatgaatcttcctgtgaacgtatatatctgctcctagttgcaaaactcctcaaaagaga

SEQ ID NO: 2743 - DNA, 201 bp, Bos taurus
aatattgctcagcatccctaaaactttagggaacatcagaaactactacagaacttgttaaaacacaaacagctaggccctgcatatggagtttccagtttagtgggtctggggtgggtcctgcgtgtttgtgtttctaaattcccaggtgatgatgacactactagcccagggcccaggctttgagaacactggcctaga

SEQ ID NO: 2744 - DNA, 201 bp, Bos taurus
atgtggtgcctcccctgccccctccccaggccccccctccacaggctgcagtttcctggtggtccctcatcaggatgggcctcccaaggctctcactgtggctcctcactagtgctccctgaatgggaacaagcatttgctgtgtccgggtccgggccctgttgaaacttcaagtgaaagccgaacggcccttctttattc

SEQ ID NO: 2745 - DNA, 201 bp, Bos taurus
tttatcaccgctactattcaaatggtatcatttactttctctaattcaaaaagagaaggaaagcaataagaggtataaacattagaaaagaagaggcaaattgtgattatttgcaaatgacactatcgcttacatagaaaaactcaagaaaatcaattgacaaactattagaattaataagaaaattcagcaaggtgacca

SEQ ID NO: 2746 - DNA, 201 bp, Bos taurus
aaagcccaccatgaccaagaacaatatactaagtctcatgatacaactctccatggtttcgttattatccccactttacagatgaggaaactgaggccctgagatgttaagtagttgacccaacgttatacagcttctaagagtcagagccctcgtgcgaagcaggtggtttgatctggagcctgtgtgctgggcccatgc

SEQ ID NO: 2747 - DNA, 201 bp, Bos taurus
ctcttaggggaaattttgttttctatttccgtctgcttggtgaagttttttggtaggtcaactatcctgttcaaagtttgacttttgttttaaataaagctatcttaaggggaaatcttaacagagagaactccaaaccactcaggagacaacagactgccttctttgattgatatgcagaagtttctaaaagacaatttg

SEQ ID NO: 2748 - DNA, 201 bp, Bos taurus
caagtgtcatgcaaatcagccaaaccaggattgtgtaaaccatttttggatttagtaagtgtggatctcagaaacagggtgaaacaaacgtacctaaaacaaacctgctccagctctaaagagccgcgcccctccctgaagctcactgacacgaggctgtgtctgagagcccagacaggcactggaggccccgttccttgg

SEQ ID NO: 2749 - DNA, 201 bp, Bos taurus
cacaggcctctaacgcagtgcctcacacatccaccgtctcatacgaaacacacacggcatcagacacacacaagcaacagaggccatgccaccctcatccctgctcacgcctacaaccactcatggctgtgcccacagctctccccttctcaggacaagtgacctgatggctcttgtggcgcgaggcggcctgagcctgtg

SEQ ID NO: 2750 - DNA, 201 bp, Bos taurus
ttaggtcaccgctttcaggtggcaggaaaggtcaaacaagaaaggtttccccggacctgagaagcaggtctgcaaggacagggcccaaaatcagtaaaacatttatcctcagggctcagagatatctgtcctagagctgggcttgtgctggtcacctgccaggcccttgcaggcgggagccaaccccaggccctccctgca

SEQ ID NO: 2751 - DNA, 201 bp, Bos taurus
aggcctcagagaaagtgtgccatgcggcagaggtttgtgtgtttgtccaagttgacgaggggacagagactgggaggtggtccctcaacaatcagcctgatccaatttgagctgtgatcaggccagtgggcagagcctgcagaaagccccgaggggtggagaagcctgagggtgggcagaggccccggaccgccagaggcc

SEQ ID NO: 2752 - DNA, 201 bp, Bos taurus
ttttccatctcccacatcaagccttgactctggacttgataatactagaagctgcagagctatcaccgtgaactgacacagatcctgccctttccaaactaaagaggttaacaggtgatttatgatgtgtgcataataattaactgtgcaaggtagaaaattatggagcatgattaaatgggctgtaggagcaaagagaga

SEQ ID NO: 2753 - DNA, 201 bp, Bos taurus
ggcatgctgcaatccatggggtagcaaagagttggacacaactgagcaactgaactgaactgaactgaaccgcatccagtgatcacacagatgtttaatcttttcgataaccaccagggtgagctgtttccttaatgaagagacacaggtttgttacattcagcaactcatgtgaagtcactcagccaggaaaccttaaga

SEQ ID NO: 2754 - DNA, 201 bp, Bos taurus
ggaaacatggagtcttaactattgtacctccagggaagtcctatactagaggtttcaattagagctgaaagtaaagcttctgaggcttaacaatttatgggaatggctatatatcttttcagtagttaaaactactaagtagtttcttaagacacatgttctgagtgccaccgaagtgccaatatttatactgtctaaatt

SEQ ID NO: 2755 - DNA, 201 bp, Bos taurus
tttagctttacgtaagttagaagtaaataaataatgctctggaaaattgaaaaatacttattgggaagctctatattaaatctaaattcttgacatttccggtcccaaaaactttttttgagtacagcattttattgaatcagtttgtttcaatatcattggttacccctctaaatatgtgatttaaaaaaagattgacaa

SEQ ID NO: 2756 - DNA, 201 bp, Bos taurus
cttcagagtaaaacttcttaaaagagttgccttcatgctacctctatttttctgttttctatctacttttcaaaacatttcagcctggcctccaactccaacacaatgctgaaactgctcttgtcaagggtaccagtgacctcagtgttgtcagatccagtagacgctttcagcaaaatttgacacagttggcctcctact

SEQ ID NO: 2757 - DNA, 201 bp, Bos taurus
caatgaatgatatggcaggggagccacaggcccagaactgtttttcctacaactctactaaggatgtgactgtacaggcagcctccagggcagccagggctgtgggtgcccatccctgggccctgtcacccctgtaagccaaggactcaggcttcctttggatggtgactctcttattaggatgagggacaagaggtcatt

SEQ ID NO: 2758 - DNA, 201 bp, Bos taurus
caaactcacatgagtggaaatactcaaggtattttttttttcctcaagctattttttaagtgggcagaatttgatgatttttttctcaaccaagtcttgctgttcataactctcccatgtgttgtggttcaggggcactgtgcctgcattatcacattaaggctggagaacagtcttaaacagcatgagactggaatatag

SEQ ID NO: 2759 - DNA, 201 bp, Bos taurus
tacctgctccccatcttaggaagctcaaggcaaggcctggctctgtctcaggagccataatattacagtggattttgctgcagtaggattggtgatgtgcatgtgaagtgagctggccctctgtgaccacagtccagggagggaggcggtacctaaaaaggcaaggagtggaaggatgatgagggacagggagcagggagg

SEQ ID NO: 2760 - DNA, 201 bp, Bos taurus
tcccccaagaattccgtgacttttggtttgggcaatgggatgaggatggacatagtggcaaagagaagatggggcctccagagggatggggtgctccaaactcaggactgcacccaacacaccctccatcccatccaaggctcaggtcctggtggctcgagacctctcagatctgccccctccctctcctacttctaacaa

SEQ ID NO: 2761 - DNA, 201 bp, Bos taurus
gccctctgtgtgcatgtgtgctttgggggccaggacctgtgtcccttccagcaaactgtgcttgaagtcaaattcaaaaatggacagtcaccagccttgcatgggccctgtcacggctgcatagcacaccatggtcactgtagactgcagtgcccagatgggaagggcaaaggcaacccacacacgcggagagcacgggca

SEQ ID NO: 2762 - DNA, 201 bp, Bos taurus
tggggtgtaactcccagtccttgaaaaatgtcttcagggaggttcagaagcgtctacttcccctttacattagatgattccaaaagagccatgtccctggtggccagcacctcatgttcgttctctgggtttgctttttcacgtccagtgcctgatcatggccaggttcaccgaactggaggcagatgagatctgacaagt

SEQ ID NO: 2763 - DNA, 201 bp, Bos taurus
atggcccctttaggtggcctggccgtcccatgcccagcaccctgggatctgggttcagccccagtctgccttgcaactttgtctccactggtcctctgggggctctacagggcctgagcacagcctacatgatgtggctgtaactgtggctgtaggcacaggccagctgactgtatccatgttctctgcacctgtctttca

SEQ ID NO: 2764 - DNA, 201 bp, Bos taurus
tgaaataattggtccctagattggcctctcatgtgaaactcttgccttgacaactgccttgcagctctgtctggtacccattatcctctggaactgatgggggcctgttggaactgagatcattgattgcctactcaacattaactcccttgttcctaacagaagtctgtgtgtgttcaaggaatcccctttcctaaatgg

SEQ ID NO: 2765 - DNA, 201 bp, Bos taurus
agggatccagcagagtgagccaggacagagaggccttggtgcagtgtggggtggagccagctcagactggctctggagcgcttgttgttcagtgatgccacgttagaagcttgaaactggccatggagggagaatatataccgcagttagcaaatgctgcaaatcagggctccacatccctgaaagcccattgtcgagcat

SEQ ID NO: 2766 - DNA, 201 bp, Bos taurus
gcatagagggtagcctcaaataccacactgaaagaaaattcagtagatttttagaatctcagagtttggaagaggccttaaaaaatctaccttggcctgcatttcaaaattccaacactttgtatttcttgtaaaatgtcttgtcttaaactttccccaaagttgttagggacttaaaacctcctcaagcaactcactcat

SEQ ID NO: 2767 - DNA, 201 bp, Bos taurus
aagttgaagccttgggcccatgcaaggcagaaaatggacctgggacagccacatgaaaaaacaaatggatccctcaaatgtttactcctcagtgaaaagacgaggaagagtctctgcctgggccatgggtaggggaactgagtcattcttctgataaaagctttcccccatggaaatccaaggttcagatatagtgtctgt

SEQ ID NO: 2768 - DNA, 201 bp, Bos taurus
tatattgtcccacattgaggccctctcactgtgtctcttcaccgccactggcagcagctccccaaggtcccgtggtgactgacgctgattaatcacaggacgcccaggagccagaggaggccgtcttgggaacacctggcccagagggccaggcatccaccatgctgagaactggcacatccgcagtcttgtgtctatttt

SEQ ID NO: 2769 - DNA, 201 bp, Bos taurus
agcagtttcctgaaaaagaagcaaggtggactgtccaatgactgccatactaacttctcttagagaaagactgaggtgcagagatgttaagcaactggcccctagccattcatccaggatttaaactcaggtcccacccagggtgttaaccttgccatggcactacaatgcttaccaagacatagcgcaccccaggcccaa

SEQ ID NO: 2770 - DNA, 201 bp, Bos taurus
accagggaagtcccctagaagcagagtttgaccaccttcttccaccaggtggtaatgtttatcatcatgatccagcagcagagcgatagctgtggcccgggtcctggactctcagcctgcttccagctctggaagcctgtcatcctggatgctaggaggctctggaagtcagggccagcttctaatcccagctgtgccacc

SEQ ID NO: 2771 - DNA, 201 bp, Bos taurus
aggagagagagctgaactatggatgccctttcgagaggcatctgctgaaatataattttcaaaaagtgtgtcaagagaaaggacatcacctgagccaatgggcagcatttatggcccaagacacactgaggtgcccaggaaggaggctgaaatggcagcctgcgaggcaggaaggaacccaggagcttgtgtcatggaacc

SEQ ID NO: 2772 - DNA, 201 bp, Bos taurus
gttaataatatttatctctaagaagagggatttagttttcttctttaaacatctgctcaaattgaaacacttcatcctctctacactctccagacttaaagtcatttctgcattccccactgtgttgtattaatatgtgtagtaggtatacagtagcaggtgctgaataaaccactatatcctaaacttctgccacacttg

SEQ ID NO: 2773 - DNA, 201 bp, Bos taurus
gcatggaaaagattcattggcaaggacaaaatatattcaagaggagaagcgcttctggctcagcagagaggagggagaaaagcaatcaatcaagtcaatttttgattctcctccggaccaacagagcaaattgtccctcaaaataataactttggcacaccgcaatttattctgcacgcccaactactcattaagagccca

SEQ ID NO: 2774 - DNA, 201 bp, Bos taurus
tttttggcctcgctgtaagacatgcaggatcctagttcctcaaccagggattggatccatgcccctcctccccacaacagcagtttgaagtcttaaccaccggaatgtcagggaaggcctaatcctagactattttagattcctggaattcagtcttccccagggtagctacgtcatctgccttcatggttaccactctgg

SEQ ID NO: 2775 - DNA, 201 bp, Bos taurus
gggatcttcccaacctagggatcaaacccaggtctcctgcattgcaggcagattctttaccatctgagccaaacctttgggaccactaaaaggcccccttgcaaagttagcccagagtgccctctgctgacactgcttcttattgcgcctcctgtctctgaccttatgtggcctacattaattgagagtggtttggctgca

SEQ ID NO: 2776 - DNA, 201 bp, Bos taurus
actcctgggaacccctcggtggaggaaggaagctccccagaacctgcccttggctggaacctccagcccagagtcaaaccccaagctcagcccagaatccaaccagggcccctccccaggcctccagcgagcctttctctcaccttgacccctggcccccctcagtaagcttctacctcttctctgagcccccactgctct

SEQ ID NO: 2777 - DNA, 201 bp, Bos taurus
agtatttaataaacacttgaaagctggaaagctaattttgtcagattctgatttttcaagaacttatcttctaggaaaaccataaatcctaacaggtactgtaaaacaggcttggacaaaaccaagagataagaaattctactattagtatctgcatatgtaacctcaaagagtcagttgatctctgtgtttcagcttcct

SEQ ID NO: 2778 - DNA, 201 bp, Bos taurus
cacagcaagccccagcccccgaggagcagaggacaccaaggtgtgaacgcacatacccatctcttcaaagtggtgtggaacagagatggagctgcaatagtcacagagatggaggtcagggtctcaggaaggggacactggacctgggccttgaagagtaagtggatgatggccaggcagccgaggtcaagacatgccttc

SEQ ID NO: 2779 - DNA, 201 bp, Bos taurus
agggagccccctggctggagagaagccgagctgggcctgtgccgcggctggagaaggacccagagacgctgaaggttagggagcgagccaaagacctagataggtcgcagggccagacacggtcaggaggaagccggggcaagatccagacgggctgccgggcgaggccaagggaacactcagaccacaaagaatcccagg

SEQ ID NO: 2780 - DNA, 201 bp, Bos taurus
ccacttgaccttggctgatgggggtagaggcaggcttggagtagagggaatattgtctaaaggttgtctttctaagctgctccttttctggctctttgaccggagaaagcaggcttttcttggggcttttttctgtacccattacattttgaggttgctggcttctccagtacccaatcaaacatatttgaggcaaagaga

SEQ ID NO: 2781 - DNA, 201 bp, Bos taurus
tctagcagccagcatcctcttcgtttcctgctcaacttcttgatacaaaagaaagctggctccaggcatcttttgtgactgtcttgaggtccattagctcgtgatggttcaagggtgccctgggccagtcaattataactccatgtgttgggtcgcatggaacacagtagggctcctttagcccaaaaggccagagatgtc

SEQ ID NO: 2782 - DNA, 201 bp, Bos taurus
cttccttctcatcatctttcaagtatgtgttcaagcccaggcatggaaaataggttcatcccaccagccaagtcagttgatttctagtggctccctggccgctagggacaaagatgctgaggcttaacctgggctcgacagactgatcagagatgcctgccagtgctggggatccagcagggtaggacacgtgattgccat

SEQ ID NO: 2783 - DNA, 201 bp, Bos taurus
aagctctcccactgactcacaacacagccttgtgtgaaagtcccttccctagaagcctcagtttccttacctgtaaaatggaacaatgaggccagccagtctgccctctggaggcagtggacaccgtcacatcatgcgtctgaaggctggtgtcaaccccagagaccaatgtctctctctggtgtgacttgcatccctctg

SEQ ID NO: 2784 - DNA, 201 bp, Bos taurus
ctgaggttccaacaggcaagaaaacgtcaaagcccttggcctgttttcgggactcatgaagctgaagcctcttgggttcatcagaggggcagccaatcttaccccttagaatcctcgggcctcaaagacagccttcagtttaagagcagctccggacccctaggcttcccaggtggcactagctagcggtaaggaacccac

SEQ ID NO: 2785 - DNA, 201 bp, Bos taurus
agactcttccaggtacttcaggctcattatgaagatgaaaagggccactgcttgagaaagtacctggtgagttcctgggcctttagtcctttgtctctgagtgtttgttttcttcctctttgagggtcctgcagtttagctagaaaggtaggccttacacagcttcaccaatctgagaatgtgcccatctcgcacgttacc

SEQ ID NO: 2786 - DNA, 201 bp, Bos taurus
atggcccatgccttcttcaggatctgctctaaggccaccttatctgagtcccttcctaatctgataaaagagcatctcctcccctggccttctccactcccctcactctcttatatactgtatatttatttggttttatgtctggcgccctttctctggtatcagggactttattattgtatccctgggcctggaacaggg

SEQ ID NO: 2787 - DNA, 201 bp, Bos taurus
gccccctcccggtaacggccggggggcggtgcacggaagacgtcattgccacattttaatcaaaggaagtcctttctggggtccagcctcgacttctcccgcgggggccgtttgcaggaagaaaggtcatagggagctcaatagtcctgttgccggctaggctggacaccaccttgaggcccaaatggaaggaaccacctg

SEQ ID NO: 2788 - DNA, 201 bp, Bos taurus
atagtgtcggtggggcccttccagctggcggtcctgaggacctgcttgagaagggctgcctctgggagatgcacaagcttctggaggagatctgcatgtccctgagccctggccacaggctccttggctggaagaacgctctgggagtgtatccatcccaatctttcgacaagttcatgaagtcattagatataaagtcgg

SEQ ID NO: 2789 - DNA, 201 bp, Bos taurus
gacccaggatgacaaaagggtgcccatccctgaagcaaaaggcaggtcacagcatcttgagaagcactgaggcctggccctggaagttggtacaggtggattttgccgaggggaggatgctgttaagtgagaagtggggatgcgggaggcctcccctcctcctgcctcccattcaggaaggtgacaaagatcaggcgaggg

SEQ ID NO: 2790 - DNA, 201 bp, Bos taurus
aataactggagtatcagtggccagtccgctcttctgcctgttctccaaaaggtcatttgtttccatcagactttggatttgtgctgggcaagaagtaaccatctctggcaagacctggcatctgggctgctgtttggttggatggaggcagctcccgtttaatttcaagcagtgattgccaggcttccctgattgataatc

SEQ ID NO: 2791 - DNA, 201 bp, Bos taurus
tccctttgggacaggcctagtggctttcatgcagattcagagccctcaaagattcccggtcacacaaaagcaggcgaatggcccactcttcatgcaacaagttcaatgaatatctgcaggatggacatttgccactcatcccaactctgcactctgcccccctccttccacagtaagcacggggtcccaccaggccaggca

SEQ ID NO: 2792 - DNA, 201 bp, Bos taurus
cactgaaaacttgactcaacaaatttgtcattattgtctgagcaagctatagcctttgattgaatttgtcaaacatgataattttattgagcaagccaaattacataaggttgcatttgcactcctaaattaagagagtgactttagatatgaaaagggtgctacaaaaataagaattgcatatgtttcgaattttcccga

SEQ ID NO: 2793 - DNA, 201 bp, Bos taurus
cacctgaccttgagctggatttatcagtccccaggaggccagtcacagacaggaccggctggtgctggctttcctggacccatccagccatcagaccatgggagccattagaaagtttcgggcctggtagtgaatgcctctggctgtcccagtgctgcagggatattagccgtatggtgggacccgggacagttgaagcac

SEQ ID NO: 2794 - DNA, 201 bp, Bos taurus
ccatcgagtctgcctcttcaatgtccacgccctcctgtccactccggtcgctcagctcaggccttcatactttttgttggcccttgcctcgcagttgacgcgaccacctcttctcacacctgctccagacagttctacactccaagtttgaaaacccacattcctgagcttctgactttggggccggtctctcttggccag

SEQ ID NO: 2795 - DNA, 201 bp, Bos taurus
agcagcccccgggcgccttacccagccagactgtatctgtgccccgggcaaggtgctggggctccagtggtggcccaaaccagtactgcccatccaggtccaaaacgtggggtctcatggaggaagatggcagtcagcacactaattactctgagattagtgcttggaaggacagaaacgtgatttctgtgagtgtgagga

SEQ ID NO: 2796 - DNA, 201 bp, Bos taurus
agcacccagcatggggttgggtgcagtcacaccagagtgtgagggaatgagcgcacggctgatggagtgaatgttggggcccgatgtggaaagcgtgtggtgtctggacctgccaagaaaagtgtgctgcaccacccttggtttctccaggggggccctcgcccttcctctcctcctagtaccacagcctactttccagca

SEQ ID NO: 2797 - DNA, 201 bp, Bos taurus
caaacgagcataaaaatctcaagttacagattttacactctaggtcataatacttctaaaaattaacttttagttattaataccattcacttgtaaaaaaacacctagaaacatctgaaacctgctttactcttttaactaacgatgattttaaaatgaaatcattaaatagggaaaaaaagaaacacatagatacatact

SEQ ID NO: 2798 - DNA, 201 bp, Bos taurus
tcctttgactgataaaatgtggtctgagatgtgccacttctaggcagaagctttaagagccagaatatggcttgacatgtatcttttttctcctctgctacaatgactggccaagttccagacagatgcttctccaacatcctaggttccaaagggagcacagcgaggtcacagctgcaggagggccacaatgaatgtgta

SEQ ID NO: 2799 - DNA, 201 bp, Bos taurus
tgactctacgaggccgtttttctggtttaatatccacatcatagtgatacacatctattttgggaatctgaacctggaaatggttggctaacagtcgaatgggttttccgacagttccaaggccaggacgacgaggtggctgaaacaggctggctggaggtcctgaagagattgaaagattatttgatgtactattgtttg

SEQ ID NO: 2800 - DNA, 201 bp, Bos taurus
aactccaaggagagtttgtttttgattagaatggtctttgggaaaaatggaaacgttccagttaagggaaaggagtcagaatatagacacaaagcctattgattcttctttagcagtagtttagttccagcaaatcacctaaaccatgacatttaacaaactgtgctcttaacaaagctaggcacacagcaaaggcaatga

SEQ ID NO: 2801 - DNA, 201 bp, Bos taurus
gaaagaaaagtgggcctggaggaatcaggctccctgacttcagactacactacaaagctacagtaatcagacagcatggtactgacataagacaaatacacatcaatggaacagggtagaaaggccagagataaacccccacacctatggtctaatctatgacaaaggaaacaagaatatacaacggagaaaaggcagtct

SEQ ID NO: 2802 - DNA, 201 bp, Bos taurus
aacaataaaagcaaaaataattcatactaatagctgcagaagcacaattctacagaggtatgaggagccagttccaactgtgtcccaatctacagttctacaacttccctgttattcgttctaattctaaatttctgtgataccattgttatatataaaatacaatgttttaattttcatcttctctcccttcttgccaca

SEQ ID NO: 2803 - DNA, 201 bp, Bos taurus
gatctaaagttttctaaacctaagactatcaacgataaacttcaattgctcagtatactacagtgaaatgcaaataagaactgataaagtgatagatgttgataaatatttgataacacaagtacagtaaaatgtcaatgacagaatctaaatgttggtcattatggacacatcctgcattttttttttcagttttgctga

SEQ ID NO: 2804 - DNA, 201 bp, Bos taurus
aagaggaaggcctgggagggttccggcctgaaggtcctgaaggttggccacgactgctggggcttctgcactgctgggtgcaccactgggggcagagttacgaaacgaacactggctgtcagtcccggggggaggcagtttggcctcaagtgggagtggctgggattggggtggtggggtacctcatgcctagttccggtt

SEQ ID NO: 2805 - DNA, 201 bp, Bos taurus
cagtctattaattacaacgtcaacccccatatcaaaagctaaactcatcacatctactcattcccctcaatcttggccgtccttctgtatttcctatttcagtgactagtctcaccattaactcaccactcttacagaagccagagtcctcagctttcttcagctttcctcttgtggcccccaactcaatgatttatttaa

SEQ ID NO: 2806 - DNA, 201 bp, Bos taurus
ccaacccttcaccagaaatcttcagagatgtctgggcctctgaggtctgacccagatgccataggacttggtgagtgacaggaatttcttttccctctcttgggctcccctgccctggccttgcttgctttcctgggatcatcgttttttcccagccatggccaacagcatgcatgagctgggtggggggaccctacctaa

SEQ ID NO: 2807 - DNA, 201 bp, Bos taurus
gccttgcccctcccttccctgtggcacctgtgaatttcccccattctctgtctgtcttgacttatctagccttggttgagcaaactcacccatcagcactgagtggggcccagagggaggggtgacgtgcccaccatatcagtcttcctctcggccctctctaagttttctccaaatgcagctcctgccttctttacagtg

SEQ ID NO: 2808 - DNA, 201 bp, Bos taurus
ccatagtctagctttcatcgtgaacctgccctcatcattgttccctgcttgaaatgacctccattcaaaatcctggttgtcacctttcaatcactgtgcaccttggattcttagcaacctgatgctgtgggccacttcttcctcctggaaaccctctcctcccttcggcccactctcctggtctttgtatgaatacttagg

SEQ ID NO: 2809 - DNA, 201 bp, Bos taurus
tcagaattcagaaaggggaagctcagagaaaaagaagagaaggagttttcctccccctgactcctcatttaaagggaaaattccctccaatggaggtgggcgggttaagaaactccacagcctctcctgcttcattgtgaatcagtcgtgttcaactcttttgaactcaacattcaaaaaatgaagatcatggtatcctgt

SEQ ID NO: 2810 - DNA, 201 bp, Bos taurus
gatgctgtgtttgcctcctcgaggccacaggagtgaagtgagccatggacatggctggattccaaataagcagaaaaggggaccttaaagcaaaggttctatagtgtggccacttgccctgcccctcttgctatttatatcagaatgggaaaaatccttcaaatggttcaacaagaagtcaagtttttagctccaccccaa

SEQ ID NO: 2811 - DNA, 201 bp, Bos taurus
ccatgtcctattcattgacggggccccacaggctaagttcatcatcactacgtgcgtcgaccgacacagcgcttccccaggtgtgatggtggaacacaccgtgaaatgagaaaaggggaggagaaaagggatggaaggatggaaggaagggagggagagaaggaagggaggccagaggggaggggagggcggaggggaaga

SEQ ID NO: 2812 - DNA, 201 bp, Bos taurus
ctcacgtatttttgcctggagaatgccatggacataggagactggcagacttcagtccatagagttgcaaagagttggacacgactgaagtgacttagcacgcacatacacaggcttcactattgtatcttcagtaccttgaacagtgggttcaatttgtgagtaaagggtacccgctactacccctattaccctgagcag

SEQ ID NO: 2813 - DNA, 201 bp, Bos taurus
gctggctcctacctctccctccacgtccatctctttctcctttctgcaaattctccatctttccctgttaaacatctgcttgtcagctgctgctcaaccaggagtgttgtcaaggaaggatcggactgctttgtagaaggccctagtaaatatccactgaattgggcttgaattctgttctttccatagccccagccagtg

SEQ ID NO: 2814 - DNA, 201 bp, Bos taurus
cagggaggatatcaccatgggcatcccacaggatgcatagcacttccctgctggctggtaggatacagggggctaaggcccagacttggagggagctgtagagtctgggggaagttaaggagaaagcaaagccagttatggagccaggggcagccccagcctgagacagggtaacctttcgtatgggccgcctcaaccagg

SEQ ID NO: 2815 - DNA, 201 bp, Bos taurus
gcgtgggcctgatgtaatcacatgggtccttgtaagaggaaagcaggagtttcagagttagagactgagatgtgataacagacgtagagggtcagagagacttgaagaggccacactggtggctttgaaggtatggaaagagaccgcagggggagaaacgaaggtgacttactaaaagttggcaaaggcaagccaacagat

SEQ ID NO: 2816 - DNA, 201 bp, Bos taurus
gagtcgattatagtgcttaagactgtggcctctggaatcaacctgccaggttttaagaactaattctaccactgatgaggtttatgaccttcagtaagttactttgccttactaggcctcatttgtgtcatcaggaaggtggagataaaaaataaataaaaacggtacctacttcataaggttgtcttaaggaacagatgg

SEQ ID NO: 2817 - DNA, 201 bp, Bos taurus
gccaagcactgggtctgggaatatgtcaaccagctcccccacattctgaaggcaacttgacttgaccctcagcctccatagactgggaggcaaccagaaccccatgttcccatccaggcaggggcccaggaaaaagaggtgctggaggaagcttagagtgccatcagggagtaggtaatctgtatagagccctatgaagaa

SEQ ID NO: 2818 - DNA, 201 bp, Bos taurus
cctttgaaggggaagtcttttttgcagctgctcctgggcctctccctgttgagttcctttggatctgtgcctcacttttccattttccaggttggagtgtctgattgctggccatagtcttaaatgaccatagtcagaaatctttattctgaacactggatttctacagtaagatccatggatttactcaccaattatgta

SEQ ID NO: 2819 - DNA, 201 bp, Bos taurus
ttccaataaccattttgccttttttcatttctttctcttaggaattatatgtaatatatacttacatgtaagtaaattaggtccttgttactatatctctgtataaattgaggccctgtggggaaagtaatattaggaagcaaagggagcctcaccacctcctggtgggacaggtggcccagtccatgcttcccaagggca

SEQ ID NO: 2820 - DNA, 201 bp, Bos taurus
tgttggtgggtccagctgaggcctgtcgggggacctgctcggcctcggagttggggttttgagagcaggagccctccagggctagcctggggtctgggccgcacaccccagcaaccatcaagcagcaggaccaggggcttccttgaggttccagggaccaaggcaggaggggggtgtccacggcctgtgagccgggcggaa

SEQ ID NO: 2821 - DNA, 201 bp, Bos taurus
tctgggcgggtgtagagaattagtacttgatcttaccgaagtggggtggaagtgagcacagggggatgagttccattttgagctggaggtgtaatatctacagccatcaggcgaggttgagcaggctcaggaaagaggcctgaagttaacgggattgattagttaacagaattctggttatgacggtattcagatcaggta

SEQ ID NO: 2822 - DNA, 201 bp, Bos taurus
ggattaaatgaaataatgtgctccatgtacttagcttggcgcctggtacaggacaagcaccacgtaccccttattgcaggcctttcatcctgtttcaaattcttccacatcctcctggaatctttagggtctggtcctgtaagaccctttctggccatttgcatccccatttggtggctacgcacctgcaggtgaaaccgt

SEQ ID NO: 2823 - DNA, 201 bp, Bos taurus
cctggtggggcgggtggtgcaggcatcgtgggtctgcactgcgcggcgtggaagcagcggcctgtctttgaagagcatgttgaagtagcatccacgcgtgcacttgggtctgaaaagaatcctcggacgcaacctggcagtcctcccgtagcgcaggccggtttctgcccgaagctcctcggtcaggaggctttctctacg

SEQ ID NO: 2824 - DNA, 201 bp, Bos taurus
gatgacagaggatgcgatggctggatggcatcaccgattcaatgattagtttgagtaaactctgggagccctggcgttgcagtcagagccggctaagcgactgacctgaactgaactgaacgtttgctgtgaccgccccctgctggaataattcccgtactgcctctcaatcgactcagtccccaagatgacttcaactgg

SEQ ID NO: 2825 - DNA, 201 bp, Bos taurus
ccctacacagagcagtggaagcctagtggggtccgcatcagaagaggattcacagagcctgcacagaggcatggggacttccttcctgtccaaagtgcaacaggtcctggagcctggcaccctccgaaccccactgtcattacaaaaagctgccttgcccactgatggtttaggtaacaggaagttctactccatgaggca

SEQ ID NO: 2826 - DNA, 201 bp, Bos taurus
agtgctaacctgagaaggggcaacttgctgccttaggggatctgcatggggggtgctgagacttgaggggtggcgttagcaaagagtgagcctcagaagcgggcctggaggaacatgcgggtcacaagaatgttcacctgtccctaagccccaactccgtccctttgttaacaaaagacagggctcaccattaagttccca

SEQ ID NO: 2827 - DNA, 201 bp, Bos taurus
ggagtttacagagggagcagcttggggagatggaagggagccagggcagggcccttgcacacctgctgacatctgggctctgtttcgtggcctctgtacatctcctataggaagcctccgtaccaggggtggggactggggaggagggcaggacagccctgctttgaagatgggtactttcggggacacgactggccgaga

SEQ ID NO: 2828 - DNA, 201 bp, Bos taurus
gtcagctcttctgctctcttcacctcctgggggcaataggacccagtccaaagtctggttccttctcttcacttcgggcctcagcttgactctctccctgagctctgggctgagaattagcatcctctctcccctcacccaagggtgggtgcccatagcaaggccacccttctctccaaagagacctctccccagtctcct

SEQ ID NO: 2829 - DNA, 201 bp, Bos taurus
tcacacggagggaggcgcggccagacacaacaacactgagccttacttgcctttctgaaccccacttgccctcgattccggggttccctcccagatgtgtgacgctgggaggccaagctgtggaagggcaagaggcgaattggacccaactcaagagatctggtcattgctaccttgaccttccaagcatcttcttgcctt

SEQ ID NO: 2830 - DNA, 201 bp, Bos taurus
gatccttggtgtggatcagcctcttatgtggtccattggaatttgctccaagagcctggcctggccacacttcagtgcagaccaagttggaagggcatccgtcactgtgtcataatccttgaggcagctctccccagacagcaccggggttcagggtgcagagcctgacctggaacgctgcccttatcctaagccagacac

SEQ ID NO: 2831 - DNA, 201 bp, Bos taurus
agaacacagggcagataaggagtcagcagcttgcagctctggaggttgcagcagaagattgctgccacggaggtgagcacagggatggaggtccaccccagcctatgatggtggccttcctggaagaggaggctgcgtctttaagcagagaggaaacagtgcagcctgaagctgcagcatttccttcacctgagctgcctg

SEQ ID NO: 2832 - DNA, 201 bp, Bos taurus
cattctgtggccttcgaaaggggaagcaggctccaggaaaccctgtcctggatattcccaacagagctggggcttctgtctacccgtcagaacagctcccgctcagacaaggccccccggagaagagcccagtaactcagttctggggagacaaggaggcgtcccagccctggtggcctctatctgcctgggtctttgaaa

SEQ ID NO: 2833 - DNA, 201 bp, Bos taurus
agtgacctatgtcaggatctctccttacatggccactctcccatgggggcagttactggaagttactctggagatgcagagtaaagtaaggttaggcatccgggctgtgaagtcggccaggctgggctcaaattccaggtcttctgtcaatgctgtgtggccttaggctggctctaaccctcttcttcaccctcatctata

SEQ ID NO: 2834 - DNA, 201 bp, Bos taurus
tctttcttgtcccaggagggcctctgtgtctaaaaagtcacagaaaccagcacaatattgtaaaacaattatcttccaatttaaaaaaaagaagaaaaaagtaatgaagaaagctgctggaaaaaaaatcacacaagtgtaaaaggaagcactttgttttgctgtgttgtgggagccccaccaccctcaaagaagctgagt

SEQ ID NO: 2835 - DNA, 201 bp, Bos taurus
aagtatttataagtctgttgtgtcaaagccatcagtacctgcatcccaatgctgcacttctgtccacttagtctggcatcagaggggctggaaaccacctctctccatcaaccccctgggagcacccctcttggctaaacaccaagcatgcttacaggcagcagcagctaagttgtgatgccacgtctggagggtattgtc

SEQ ID NO: 2836 - DNA, 201 bp, Bos taurus
gggttcaaggaccaggattgcatgcgcgtgttcacgagcatttgccatgtgctgtgtggggcatggtggacccaggccaccactggccttctggagctgctgcttctggtcaggaggacacagaccgaggatgtgcagctcaataagtgctgccaggggatgtgtcagggacatgcccaggatggccagtgatcccgttga

SEQ ID NO: 2837 - DNA, 201 bp, Bos taurus
aatgccccagactgatggtcagaagaaagcagaatggccaggagctaaatcagcaggaaatcaatgcctgagagatggagcagtctgtttttacaccgtacttgaagcccaagttggccgattttcattagtttttgaaactttctttaaacaaaggtttttgcagccatacaatacttgaaacagatgcaagtaaagccg

SEQ ID NO: 2838 - DNA, 201 bp, Bos taurus
ctcagggtcgcagggtcacctcagatggaagtcctggtgtggccagtctggggtcctttcctttccctccagttgacctccacggacagaggctttgacactgaaggcttttctggccattcaaggcactaataaacttgaagcaaatactcaaaaaccctacacaggaagctatctatagtcaatatcttgtaatgaact

SEQ ID NO: 2839 - DNA, 201 bp, Bos taurus
cagaacaacaaaagactgtttgtcgtgctaacgggctctgcctggcctgtgacccgggagacaacgctgttttctctgcccgataaaggaagcgcctttacgtaatgactccgactctggcctctcctgagttgcatggattaggaatcaaatgctcagtgaatgatgcccctcttaatctcaaattctcaggaatttact

SEQ ID NO: 2840 - DNA, 201 bp, Bos taurus
tagctagttctgtttggcaaggcgccttttctaaaattcatactgtcatgtatgtctttgatcactggatgctgagaaaattgcacacctttgtgccctgtgacagcaggtccaccacgaaaggaccatccctctgagacctgggcaggatatggctgaatttcccacttggtttccatggaaggaagcccaggagaggct

SEQ ID NO: 2841 - DNA, 201 bp, Bos taurus
ccagcctgcactgctgtgaaccaaaacttagattccctggtgtctcacatttcactgtcctctttgggaccaagaggagctccccttcagaaaattcgcatgcatctattcttggatagggcttccctggttgctcagatggtaaagaatctgcctgcaaatgcaggagacaccagttcaatccctgggtcaggaagatcc

SEQ ID NO: 2842 - DNA, 201 bp, Bos taurus
gctattctgcatataatgattcatgtcaagctctgggccaggcctgtgagccaggcctctcaccgcagcaggtggtgaaggcaatggtagtagaaacagttagctgctacggtctgctcgcactttccctccctgtcaccctgacccaaataaccctctggcagaagtggtttttttcgcccttgtggcttcagaaatcag

SEQ ID NO: 2843 - DNA, 201 bp, Bos taurus
ttaacgaagaatattctttctctttgtgtgagttttgatgacattaagacaagagcgtggtggaacacagaaccaggggaaggagagtgtggtgagccaaggaggtcctgagagccattggggaagggaagggtggtctgggacaggggtcagcatgccttctctgcaggaggccacagggtaagtactcgaatccttgca

SEQ ID NO: 2844 - DNA, 201 bp, Bos taurus
ccccttcaaacctaaccaggtcctgtgactcagaaaccccagtcagggagctccaaagagactggtcactcacctttcagaggaccaataagaaaaaagcgatctctgtgacgtcccatatacgtggcatctgaaaagagatggatgtgagagttggactataaagaaagctgaccaccgaagaattgatgcttttgactg

SEQ ID NO: 2845 - DNA, 201 bp, Bos taurus
ggttctctttgactccttagttcctcgtgggcctacagaatgatcgtagccgtgaccccgccatgagctcaggtcttgctcgtgtgcaggagccgtggccacgctgagcctgatgtccctgtgggtgtgctttggggcgtccggggtggcatgtgccctctagatgcatagacttgtcatctgagatgacgtccctcccag

SEQ ID NO: 2846 - DNA, 201 bp, Bos taurus
ttgttggtgtggaggaaactcacacgtttggtgtcagaactgttgtagatggagaatgtctcagtcagtgatgccgaagggcccggagcagaaggagccatagactctgaaatctgcacagcaggtttgtgcgccttgtctgacccccgggtactgtgaaactctcccatcagggccgcgggcccctgggggtgactcact

SEQ ID NO: 2847 - DNA, 201 bp, Bos taurus
gcttggttccagtcccatggactagggggcttaaaaagagtcattcattttctcacagtcctgaagcctggagagccaaggtcaaggtgatgccttcctccgaggcctctctccctggtttgtggctggccctcttctcccgtatcttcacaccagtttcagtctgtgtatctccgtgtcccagtctcctcccgttagggc

SEQ ID NO: 2848 - DNA, 201 bp, Bos taurus
actccccatgatgtagtcatcagctgttgttaccgtgtgttttggtaagaaagcctttcatctgtttctctttgctggaggttcttggcctttgagggtcgaactcattgcatcctccgtccttcccggatgggacgtttaaacattaaaaaggagggacgtgtagatggatgatgccctaagagtcacattgaacgtctg

SEQ ID NO: 2849 - DNA, 201 bp, Bos taurus
ctatacctgtgtgcctgtgcggcctgtctagtccggagctgtgccctctgcaggcactccgggaaaaataatcagacacgaagacagttgagcctctgctggaaggtcgtacagatgcaacaggccaatgaaggatggtttgccgacgagaggaaggaaggtaggacaggtgacctcttgcctcaagtctccagcctcagt

SEQ ID NO: 2850 - DNA, 201 bp, Bos taurus
gaggacagacgctggagcctggagccggggaggccactgacaccggccacgtgagcacgtcacgcccctcccaggcccaccccagggtcctggccccttcctctccaggactattacaggcgtgctgatggactcgagtggctaggcagagggtacccttagaaactgctttatggccgttcatgcatcttggtcttagaa

SEQ ID NO: 2851 - DNA, 201 bp, Bos taurus
acagggggctgggctgcaatgggagagccaggcaggtgtgcagtctcccagccttgcacaccatggtgggctcttgatgagctggtatttctggcttacgcgaaccaccagtaacatgcatttccccggagcacaacagcccctgaaccccaccggccccttttccacgttgggaggaaatgccccggtaaagagagtagt

SEQ ID NO: 2852 - DNA, 201 bp, Bos taurus
ctcccggctggtggcctcatctccacctctgggcggcagtgctgggctacctggaggtccagtgactcctcatgcggccgtctttctgtttctcttctgacgccctcttctaatttttatgagtacactggactcatgaggataattcagggtgatctgtcttcaggccagctgattagcagccttactccatctgaattc

SEQ ID NO: 2853 - DNA, 201 bp, Bos taurus
cattaatacattcatgtgcccatgaagtcctgaaaatattgagggctttaaagcattttcaagtgctaagaaaatgagagttaaaaactagataatgatcgcggttttgttgtgaatgacagcctttcaaagcctccacacgaaacgagtccttggcaaggacagtggtcttggtgaaggagatgagtgataatgaaagct

SEQ ID NO: 2854 - DNA, 201 bp, Bos taurus
ccggcctcagggggcagcaacggccacatgtaggtgcgggcaggagagtgcagcccacgggcagatgctgtagctcatcccctgggccaccgctcctcaggatggtcacttctctgtgtaacgggggtggcggcggggaatgcagacaaagcggcaagagagggagggaagggccattttattgaggatagatgccagaat

SEQ ID NO: 2855 - DNA, 201 bp, Bos taurus
agcgaaaaagagtggaggtatacggcctggctgggaggaggtgggagtaacagagggcgtaaatggggagaggggggcctgcctggctggccgggaagggcgttccaggtctgtgactggaaactgctcacatgctgaaggcagtgttggggaaccccggttgggtacctgaatgtggggccgtccgtgtcctgcaggggg

SEQ ID NO: 2856 - DNA, 201 bp, Bos taurus
tgagttaacacgacacaccatcacctgggaggctgttagcatgtgtcagctcagcactggtgagtccagcataggtcaaagccaggtgcacaggccagccgccaccatctgactcacgcaaggagatggggtcatttctaagggagttctttggaaaacactgaggctctgcggggccagggacttcagggggctgggttg

SEQ ID NO: 2857 - DNA, 201 bp, Bos taurus
tgggtccctcccccatcctttccatgtctgttctgatcactaatcatgtgaaggtccctgtgggcagggcagagccttcctgcccactcctgagtccacgatcagcagaaccgggcacagagcagagcctgccattacctgcggggtggcgagtgcagctggagctcactgtgtctgcaggtgaggtgagggcgaggctgg

SEQ ID NO: 2858 - DNA, 201 bp, Bos taurus
agggtatctctgtcatgagcctagaccccgaatgtgacatcttctctaaggctctgtccacaccagaaggctgggacccccgtcacatcctgggtccccacggcctccctgggatgatgccttggctctgctatgagatgaggtgtctgggcgatcaaggccactgtatccatgatacagacatggatagtggcagcagcc

SEQ ID NO: 2859 - DNA, 201 bp, Bos taurus
atattgtcctatggaggctccaagggccctgggagtgtaggatgttagaagacacgatgctctgagatttcccaaagtctttgcttcccacgctctgggagaggtggtggtaggccctgggatcatgagacttgcagcccagggtgtctgacccaccaggactgtggaggacacactctggtctctgatggccccagtgtc

SEQ ID NO: 2860 - DNA, 201 bp, Bos taurus
ctgtgggaaatgcaatttcgtgggcccctgtgggctccgtccttcgctgcgtggatgcccccacagccaggaaacagtgggcaaatgggacagccaaggcgtgggaggccctgaggctgagtcagccatgtgacacctcttggacacagttcagctgttgtcacggcccctggagtgactcaaactctgaatcccatggat

SEQ ID NO: 2861 - DNA, 201 bp, Bos taurus
caatctggacatgaacgtgcctggatggatgtttcggtgcatttccagagctcaggagagagattggaagggtgagagctcatgcccccaggcgggcacacgggacaagagtgagcaagggctcccgagttgtctctcataatgtccacccacgtcacaagctcagctgcctcactgcgcatgccctatctgaccacatca

SEQ ID NO: 2862 - DNA, 201 bp, Bos taurus
cagttgctcacttgtgtctgacacttagtgatcccgtggatttcttcaatttccttaatcaacatttaataatttttagcatacagctcttttaccaccatggttaagtttcatcctaggttttttgttttttttttttgatgtgattttaaacaggattttttttttaaaggttattttcctgatattttcttattaaag

SEQ ID NO: 2863 - DNA, 201 bp, Bos taurus
ttttaggatataaaattttagaggacctccacagttaggacactgaataagagaggggagaaagtggaaagttggtggtgggtggtgtttgtcgttagccggggggtatgttcccgtaatgctcttgatctaaaggaatagcttaaagattttaaagataaaaaccacagaccttgagaacctggatcctgggaataagag

SEQ ID NO: 2864 - DNA, 201 bp, Bos taurus
agtgctggtctggccattttgggtttatttgggcttcaggatgaagccacagagtagcagctcagtcaagctccccagaccctaggccgacaatgaaagttgctcagtcgtgtccaactatttgtgatcctgtggactacacagtccatggaattctccaggccagaacactggagtgggtagcctttcccttctctgggg

SEQ ID NO: 2865 - DNA, 201 bp, Bos taurus
ggcgtagacggtactaagatttcaatcactctccaaggaatgatgccagtctgttgcttggctttcagtaggagggtgaactgatcagatctgcatttagaaaagattattctggccggctagaggttgttgcccagatccacgttaagagtcagcagtccctggactaaaaggtgtcaggctctggtaggtcactgacag

SEQ ID NO: 2866 - DNA, 201 bp, Bos taurus
gcccaccagtttcactatgttctctgtgtgtctttgtgtcttctcttcttataagaagagctccaggtcgcaggcgccgggatggaaatctgttcagagctgtggttcgggcatcccagggccagactccagcttgttggggtctgcttggacctctgtccaagctgtgtggctctgagcagcttcttcactctctgatca

SEQ ID NO: 2867 - DNA, 201 bp, Bos taurus
gaggccgcagaaagcagggccatcacgttagagagcatctccgtgtccgtctcagcatgtgcaggagaaggtccccgaaggttcttgttggatgagtgactggcttttcctttcagttctacggccccaggatcggagcgctctacgtccgagggcttggtgagcacacccctctctacccgatgctgtttggaggcggac

SEQ ID NO: 2868 - DNA, 201 bp, Bos taurus
tcagaccccagcgtgaggcctggcgcagggaaaggacctctctgctgggcactcacgggtgactccccaaatgcccttctgcaggcactctgcttcctgggggcctccttataaatacaccgtatcctgagagtaccccagggaccctgagtcccttgggctgggccagagaaagctggtttgttatttaaaagatgttcc

SEQ ID NO: 2869 - DNA, 201 bp, Bos taurus
gggcccgcggatggttgaatggcctgtgtcgaattctctggggaattcttccttcatcccagtgccctggtggaggacacagccacaggtgtgcacagtcttcatggtgggcatgtggcccagcaggccaatcagagtattctccgggatggatgtgtgatgcaggccgagaggtttctcttgcagccactgagtgaggag

SEQ ID NO: 2870 - DNA, 201 bp, Bos taurus
gggtcagcagttcacaggatcactgtgtgatctgtctgatttgactctagaaacaattagcattttcccccaagggcccttaaagtctaagctgacttcacatatcatccagctcagtgggcagtcatggggcatcctggggatgggggtgcagcctgggggtggcttgcacgttgtcctcagggctgggccctgactgtg

SEQ ID NO: 2871 - DNA, 201 bp, Bos taurus
gcaaggccagtcaacctgagaatggtgggagatggtcactttggtcacatttgccaggattatgtttgtgaggacctggctgagcagaggtggacagctaagtcatggccacctcagctgtgagcacaggggcacaggaactggctgggtaccagggtgtgcagccaacgtgtgtagggcagaccctcaactccaccctga

SEQ ID NO: 2872 - DNA, 201 bp, Bos taurus
caggcactgctggtgctgcaggagctcagatcacacttgagtgatgagagtttgcaaggaaaggattcaggacacagtcactacaaatattcaatagatccttgaaagcagcgatgggtttctctgcttcaccctggaggtatttgtcaggctcaactcagaagcaggtttactgaagccactgcagtagccccacttggt

SEQ ID NO: 2873 - DNA, 201 bp, Bos taurus
ctgaatgggtgcagccctcacagctcacagaccaaaccgcggccactgctgatggccaaatgccccatccttccccacagagccctccgggcctgctccaaggagcccactgagtaaagcggactgcccagtatgtgacctcaaaaacagaccccgagatacctctccctggagtcaggccgtgcagctcctgctggaagc

SEQ ID NO: 2874 - DNA, 201 bp, Bos taurus
ggttcacggctggggagcagcagctccatgaggctgctaggaaggctgttttggtggcccctaatagctccaccccgttagccttgggccatttctgccctgagtgatgcgagcccgtgagttgcttctaaatgagaaaggacagtgcaaggaatgggatggcccttccaagatgaagcgagaaggactctggctcctgtc

SEQ ID NO: 2875 - DNA, 201 bp, Bos taurus
gacttccataaatagaaagccggccgtgcagtctgggctatcttccgcccccatgaacgtgaccctgggaaaggcagctcacatgccaggccccaaagccgtcctggggctggcgacatgcagtgcgccaaacacagacgtgggcgcgcttgccagcctctgaagctggcgcccaggaggaagctgatgggccaggtcccg

SEQ ID NO: 2876 - DNA, 201 bp, Bos taurus
ccccctggccgcccacggggctaggctcctggggcggcacctctgctgggggtccacttagcgctgcagagtctcccccaggatcacacgcgcagactcaagtgacctgtcagctggcccactggcgagacccggtcacagagccaccccgttctgaaggggccgaggcgctggaggacgggggctggtggggccgccgca

SEQ ID NO: 2877 - DNA, 201 bp, Bos taurus
ctttggtgcagacgaccctgtggatggtcgacagggcgtgggtgtctccagcagaggggcttcagcccgagaaatcgtggctcgcagagggtttcctcccgcccggaggtcagaagatgacatcgcagaaacaaaattggcagcaaagtggctgaaatgagatcttttcttagatcttggcagaggagaggctgcccttgg

SEQ ID NO: 2878 - DNA, 201 bp, Bos taurus
ccttctgggaagccccctcatcttgccacagcagctgtagccggcacttatcaggctgtgagaactgtcgagagtcccttctcagcacagaccaggccaacactgccagcgggcatggtggtggcagccgccctgtggaggggaaccctcctcaccaggagccagacaagaggctgcaccttggcctgccagcctggccaa

SEQ ID NO: 2879 - DNA, 201 bp, Bos taurus
ggccgtcagggccagccgcccccgcaagactcacgtattcctcctccaggttgaggatgtggtcgatggcttcctccacgttctctgggagccccgtcacggtcacgcagttggggtcgggcgccccactctgcgggaagcggatgtccacctggaaggagtgcacacagccagggtgggcgaggccccgccgtgcgtgag

SEQ ID NO: 2880 - DNA, 201 bp, Bos taurus
agagcgcttcaaaatagcatatttgtgcataaagagggcctccagacctcaggaagggggaaaaaatggaagaaaaagaacttctgtcgggaaaagggattgtcccgagaggaggaagagggcccagtggttgtctgaccctcgacgcctgcccctgtcgccggggccgcccgaggaccctgctgctttctgcgccacgtg

SEQ ID NO: 2881 - DNA, 201 bp, Bos taurus
cagccacgccaaagatagcagaagataatggcgacaacttcagtacaaagcacacacaaatatgcatctatcgatacaatgtccagccatgtgtaaggccggggacacagcacccagaacatacaaagaacctctagaaatcaataagctgatgaagccgggtgtgagcccacgcggctggggcccgcgctaggtcctgct

SEQ ID NO: 2882 - DNA, 201 bp, Bos taurus
tcgggtggggacatgcgccaccctgggctctcctcatatcagcaatcttgtaagcagcccccagagacctggctgcaccaggccatgctgacctatctctcgggctcagtgtccccccggcgacaccccgccccaccaggggctgcgcctagctggacagctgcagggctggaaggccctggctgccttttgctcccgggt

SEQ ID NO: 2883 - DNA, 201 bp, Bos taurus
gtaacagctccgaaaccagcagtgctgggggcccagatggtggagaaggaggaccctgagctcacctcctcccacagacactcagagcaacattagtgagagtggccagaaaactagcagaaagggggacccaggactgaagacataacagacccacagccagacaggcagccgtggtggggacacagcgtatggagagct

SEQ ID NO: 2884 - DNA, 201 bp, Bos taurus
cccgttgtaccccgtgggaaacccaacactggggccgcagctcgaggaaaaccgcgaggagccccggtcatcgggagatgagggcctttgtttcctgcatgggctggagagccatcccaagtcttctctccaaaatccacaggaggcttgactcccttttcggccactcagtgggttccaagagatacccatcgagactcg

SEQ ID NO: 2885 - DNA, 201 bp, Bos taurus
aactcgagatgaggccctattcccctgcagccaagaaagaggaaacctgagggggcccttgcaactctaatggaggcctgaggttccctgagatcccgtcgcaactagagagtaaccctgagcttcctgctgcaactcgagaaaatccacgagattcccccctcaacctgagatgaggccccattcccctgcagcacatcc

SEQ ID NO: 2886 - DNA, 201 bp, Bos taurus
tgcctactgtctgtcagcctcagctttcctgcgtcctggggcttgctttgttgtggcccacctgacaaggaccctgtgggctttgggcctcacacctgagtgcatgtacctagactctctttgtcccttcactgggctcaatttgtctgtgccccagaaatagtttcccattccaggggctgtggaccaactctggcctgg

SEQ ID NO: 2887 - DNA, 201 bp, Bos taurus
acaggcctacactggcaccactactgtcttccttcctaattattctatattctttcaacacctggtccaggtgacttctttgtaggatgacccagatttttgctttgttgggccaggaggtcttagaggtcttatcttccttggatgtcctcagttctctagtgataaggagtctcctagttctcatacaagtcctccttg

SEQ ID NO: 2888 - DNA, 201 bp, Bos taurus
ccccaatagttgggatgatcttcccactcattaacatatgaattcacccagcttgcaaaaactagccacaccacattccatggcctaagcacttgccctctgtaatggcccatatcctttagagtgtgcttctctctgaatcctaacaaatccacctcttacctatcgctgtgtctctaactgaatttttgcagtgagaca

SEQ ID NO: 2889 - DNA, 201 bp, Bos taurus
catagatattttattggaagtatgaattagaatcttcctttatggatatattgtgatagcaaaaatatcagaataacttttataaatattaataggaaaattgttaataaagctttagtgtatctgtattgggggacataatgatttaagagcaacatacagctagtagttataacatgaaaggagcccttattccaggag

SEQ ID NO: 2890 - DNA, 201 bp, Bos taurus
tggtgacagttagctctgtgtttcccaaaatccaggaggctgagacacacctgagatgataacactgaagtcatctccatagggaggggcctcagtgaagtacctcttaaagtcctgtgacccaaaggacatgacagtcatggttaagacccaccaaagagagagggaaagctgagctgagcagcagaactggccaccaaa

SEQ ID NO: 2891 - DNA, 201 bp, Bos taurus
gttgataagatctaagggaagcagtttcaaggtctcaagggccacatctcagacagaacaaaagatgattttgatgtagctgtcttttttatgctttgcactttctagattttttcagcctcaatcttcagaaaccaagggaaatcccacccatgactgatgcttgagtgtgaatattttcatcaaattgagcagagctgt

SEQ ID NO: 2892 - DNA, 201 bp, Bos taurus
ttcatagcatacagtatttttttggattctaccttttggcatatgtctgctacacattatgtgtatgatatctctatatttttttccttagaaagacatattgtacttctttaatttatctatggaagacatttagaaatcaacccctcctctgtgttttacttatttccttccctttgtccttctttccctctgcacttc

SEQ ID NO: 2893 - DNA, 201 bp, Bos taurus
ctgcagtccatggggtcgcaaatacttggacatgactaagtgactgaactgaactgagaatcatcacatgaggattgtcgtctttcagtgtctgtatctgtaggcccccttattacatgtactgtgtgacggtttgctccacttgaactattcaacagcctaggtacccatacctttagattttcctacatgaagactact

SEQ ID NO: 2894 - DNA, 201 bp, Bos taurus
aggggatgctgagctggccaggtgaggggggtagagggaaggtaaacaaatgggcagcaggtcaaagagagagcagcttatcagcaatgctccagtttccaggccattactaagggagtgtgattataaccttcccctgataggaggactaggacatcactggaattctggacctgataaagtcatttgaaatgctttgtt

SEQ ID NO: 2895 - DNA, 201 bp, Bos taurus
attggtgacacatgctgatacttctttcatttcagtcaaatttgatcacaaccaaccaagctgcaagattattggtgactatgtttaaatttttatgattcgtaactactctgaagcatagttcaggtagtacagtagcacagcttgtaaacactttggagtatgtcaaaatatgaacccaaagtgttttacatactgtta

SEQ ID NO: 2896 - DNA, 201 bp, Bos taurus
gagacggataagagatttatggatgtttcttgatgggagagcctgactgagatggaaatttcaggtgctggaacagcggctatgtggccctggagcagctgttaggagagaccccatgtctaagggcagagaaatgccagcaagactgtaggtgttggagccgtggctgtgtggcactggagcaactttgaggaaatactt

SEQ ID NO: 2897 - DNA, 201 bp, Bos taurus
aaaaaccaaaactattttggggagggggatactaaataattattataagttatttcttcaaaattgacaaaccacccagggaagatagctaggaaaacgtcgaggatggaaaaatattgacagacggagagaaagagaaagggggatatatattgagaatttaaatcatgacagaaccttactaacaactactgatgctaa

SEQ ID NO: 2898 - DNA, 201 bp, Bos taurus
catcatcattctcctggttccaggcagtctggggtatttgtgcttgtgggaggcatctagttaacttcttccacctggtggggatctgcaaaatatcacaaagacatggctcagaatattattcatagtctctgaggaagagctaaatgtccttgactttgtttaatgactaaatattattttgtcttggttgattgtttt

SEQ ID NO: 2899 - DNA, 201 bp, Bos taurus
tcttttggtaactaaggaggtcaaacccattttgatttctggcctaagatgttcaagattataatttaactgcacatggaacaaatcataatcatgcatggaaaactgctcaggccttatgactaatgcccagtgacattaaaacagcttgaaaaatcttagaaaatccatggagtatccaaaccctgaatttcatatgtt

SEQ ID NO: 2900 - DNA, 201 bp, Bos taurus
atccactgccaacttccaataaaattctcttttctcaaattgtatagcatttcaaaaattatggaaacctatgttcttgtgtttccagaaaattagtcaatgtgtgatctttctgatccaagaatatgactttttgacgtgagtttcctttaagagctctttaagatatagaataaacttatttcaaccccagacctccca

SEQ ID NO: 2901 - DNA, 201 bp, Bos taurus
cagtataaattaaccttgtgctgaaattcatttaaatgaagtcattccctgaggtttataagtgtgtctcattaagattatttcacacaatagatggttttaaattcaatggctttcaagaagattacaaaactaattcacttatgtgaataaattatttattcatatatggcatccctcaattagagtacacacgcactt

SEQ ID NO: 2902 - DNA, 201 bp, Bos taurus
tggctacccactttagtattcttgtctggagaatcctctggacagatgagaccagtaggctacagtctatggggggtgacaaacagctgaacatgactgcatgactaaacacacacactggttgcatagttcaattatatcagagtgctataacataaactcagacatatttgtttcaaaagcttatattcttaaccatta

SEQ ID NO: 2903 - DNA, 201 bp, Bos taurus
tgtgtggcctctctaaactctggaaatccacacactccatgatctttatgccttgaacactctactgaatacacaatgcccaagttctaacctgccaatttccattcatccaccaggcctcagcttagattcttccatatgaacacagagagccttacttcactctcaaatgttaggtattttcctacatcagctacattt

SEQ ID NO: 2904 - DNA, 201 bp, Bos taurus
aaggaaataagtgatggagccacacccttttaggtatatggctgcaaacttagtgttaataagtaggaaacatgcagctcaatacttgggcaggccccttccttaatccacgtcagatcgtccagaagcctctccccctggagtctctggtgcacgcgtcttgaggggccacgccccttcaggaataaaaaaaaaaaaaaa

SEQ ID NO: 2905 - DNA, 201 bp, Bos taurus
cctctggcatcatgaaatatgccagaattttcattgttcaaaaataatatgtgatccaaattcaccctggggattcttgataagaatattttcaaaatccgaaggagaaatgtcttccaaatcccatccatatcctagtgttcctggaataaacaggatgcttagtattattttccacactcagagggttgcatttttcag

SEQ ID NO: 2906 - DNA, 201 bp, Bos taurus
tgggccagactaagataaccgtgatggctgatggatattgttgtatttgccatttcctttacataactttaattttcatgccatcataaagtaaatgtttgctgaccagccctggccacagaactgtaaagctcctgcagccgtggtgggcagttctcagtgttgtaaggtgcagtcaccagccttgtgactggcaggaca

SEQ ID NO: 2907 - DNA, 201 bp, Bos taurus
aattaattctccccaaaggcaatcataagaaggcaatatataatgctttttttggtagacaaaataagtatctgtttgtgcagatggccagtgaaaaataaactctttcagtccagagactctcactgtgggatctcaaggcaaccatgtcacaattcaattaagggcctggaaatgcagatttaaaccaacaggctacgg

SEQ ID NO: 2908 - DNA, 201 bp, Bos taurus
ttattcataagaagggcctgggggaagggaactacttcatcttggcctgcaaagcatgatttttatcagcctttgcaactcaaagattttggttttcataggttaagggttaaaaatataattggcctatgaagtgaagtgaagtgaagtcactcagtcgtgtccaactctttgtgaccccatggactgtaacctacaagg

SEQ ID NO: 2909 - DNA, 201 bp, Bos taurus
ggttagagaactggatgtggccatctgtgactcttttggtcctggtgtaactcagcccaagctgcaaacctgtgaaagagggctcttcactcaccagtaacgggtcaggtcctccctgttggccagaaaccctagatggaaaattttaccaagaatatgttgagcggtggaggcaaaagtaagaagatttatactttctag

SEQ ID NO: 2910 - DNA, 201 bp, Bos taurus
agtttcagaaacagaggtcagagcatgtgcgttgctagaggaaaagcatatttttatgttccctttttcaacttggcaagcagatggctggagccttagatgagtgccaggaagaaacagctggcaaatcaaaacatactgaaagtggttagaagtgcttatgagcatttggaagaaacaacatttttgaaaaaaggggaa

SEQ ID NO: 2911 - DNA, 201 bp, Bos taurus
gcaagaatactggagtgggctgtagtaccctcctccaggggatcttcctgacccagcgatcaaacctatgtctcttaggtctcctgcattggcaggagggctcaccatgtgtcacagcaacttaactgctgggtatacatctgagaaaaagaaaactgctactttgaaaagatgaatgcaccccaatattcatagcagcac

SEQ ID NO: 2912 - DNA, 201 bp, Bos taurus
atgtgcttcagaacagctacttttcccacactccatccccaccctcaccctgcccccagcaaaaggatgaagggagttttcttggcctcttacttggaaaacctgattgagttcctgagataaaacctcaccaaattgtggaggctctcctcacactgggcctctgggttttcagcccaaactttcccatgcagccctcca

SEQ ID NO: 2913 - DNA, 201 bp, Bos taurus
tctttacctgtttttctataataagtggaccaaagcccctaaaactgtctcttcaattagatcatgagtccaagaggtgaacaatttaaaacattgcaaagatcatggaggcattttcctaaccaactgccctaatcctgactcctcttttcttcggggcgtctcttcctcatatgttccttcatataaaaaatgaaatat

SEQ ID NO: 2914 - DNA, 201 bp, Bos taurus
tctgacatgcgccatattgggaagtctcaggtgctaagctaggctctcctggtgtgtgttatcctaacattgtttgaccaaacccccatcaatattgctggaggtctctgaccacccaccacacactgtgtggcccacgagagggcagttctaatgagaacagccttgatcccatcatcccagagcagctgcaggacctca

SEQ ID NO: 2915 - DNA, 201 bp, Bos taurus
agaagctgggagagaggcccagggcagcttctcagaggcctcagaaagaacaaaccctgatgacaccttgatctcgggcttccagcctctgaaactgtgagagcatagacctctggcctgaagtcacccacctggtcgtattttgttacagcagctctaggaaactaatccaacagtagagagcattgagtcagaacactg

SEQ ID NO: 2916 - DNA, 201 bp, Bos taurus
tgctatcagcaggtgtgaggggagcagggctgaagcatttggagagtctcatcagggcttctttgctggaagcaagacccagacagatcctcgtgctgagggagggccaaagtgcaccagagcggggaccagccaattctagctccatgctcaccggagctgagcctgactccatgatcctctcttctgacttccctccta

SEQ ID NO: 2917 - DNA, 201 bp, Bos taurus
tgaaatgttttccagatctacttttcaacaaccgccagtgactacttgaagaggacagtggttcacgcctacgtgtgtttaaagaagcagaaaacattgtgtgcatgtgtgtctggtgtgcaagcgaaaagcctgcccagatggaaggggctggaactcatgcttgaagctgcaatcctttcaagtcagcacacatggagg

SEQ ID NO: 2918 - DNA, 201 bp, Bos taurus
gctcttcatttcaggagaacgcatgccttcctcagtaaacgcgttggtcatagccaccttcaccagactgtgggctgatctggggattggactgaacattcacctctcaaggccattttttttgttttgttttgttttttgaggcatagcaagatctttggactaaatcctggtggtccctcttaaaccatgtaacttata

SEQ ID NO: 2919 - DNA, 201 bp, Bos taurus
caagacctggctcccttggcactaacctggccatggcagctctgccatctgtctgtcagcagctacaacagtgtatctgcaaacacgagcaggccctagatagcagtcatggtgatgcatcttcagatgtgacctccaccaaccttttcaaatttcatatgcaattggagggccccaaattttcatgttgatggcttccag

SEQ ID NO: 2920 - DNA, 201 bp, Bos taurus
gctgcagaagtgaagtggtcacaggcctcgccttgccccaccccagcagccttgggagaagcaccagtcgaggacctgggttccctccctccagagcactcccaaggccagtggcttctgtcggtgtccactctctcctcctggacaaacaatgccccagggaatcaggtccacactaaggtgtcaggagcaagagtgggc

SEQ ID NO: 2921 - DNA, 201 bp, Bos taurus
catacgtagagtgatgaagaaaggcctcttgctgtggtgacatctgagtaaaaacccggaggaagagagagagcaaagcatgggtggacacctcgctggcgggagaaaaggcaggtgcagaggccctaaggcagggtttgctgcagtgttggaggaatgggtgcagaggggcacgatgtgggggtggggaagtgggggatg

SEQ ID NO: 2922 - DNA, 201 bp, Bos taurus
aggagcagccctgaggtcacaggttcagacactccactcagagactgaccagaccttccccattctcctctggtttcccagcatgaacatagtcagtttttcccaggactcaactttggccaaagatagatgtatgtgacaaaaagagcctatgcctgccggggaaggcagacacagacacagacaccctagatgatggtg

SEQ ID NO: 2923 - DNA, 201 bp, Bos taurus
tctgccgaggggaacacacagagctctcttggtggccagacgttcccctctggcagggggaacctttgtctctgtccccctcacccccgactctggagcaatgtcttggccctcacagtagaagtgagagtattgaatcaggagaagtagccaggattcccactccccccgtggcacacgcatgggccctgcacagggcct

SEQ ID NO: 2924 - DNA, 201 bp, Bos taurus
gcaacagttggtggaacatttaaaccctcaggaacaacatttctcagcctccaagacttcagtaactggaaatgccctccaagagcagtcaggccccatgttggggctcccttctgggcggttcccttctcacaggcttggcttcttagccctggtcacaactggccactgtggctttctctcggcttattcactcaccat

SEQ ID NO: 2925 - DNA, 201 bp, Bos taurus
agccgaaacctgcttccagcggaggccagagacccacttgtcctgctgcccctgtcaccaagctgttacccagtccaagcctactctgctcgctgcactacaggccaattaactgagagacctgctgttgaggcaaggaatgtatctttattgggaaagctggctggccaagaagatggaagaataatgtctcagccttct

SEQ ID NO: 2926 - DNA, 201 bp, Bos taurus
aagtagaaaagagcgtaaatgctttgccaaacaaagggggccacagtagactaatgccctcaaaactgtgtccagacctggagggggcaaggaggagtttcacagtctcgattcaaagagggcctaatcagctagtggacattcttttgattggttggtggtgaggtaatcaggaatcagtatcattaaccctttggttaa

SEQ ID NO: 2927 - DNA, 201 bp, Bos taurus
gtactgtttaggggcaaagcaagatggagtcttgtaatgagataaatttccttgaaattaagggttggttgtcaccccttattcatccaatcaaccattcatagagcctcactcaggcccacatccaggtgcaggcaagccgaacagtggttggtgtgagccttgtcctttaggaagagtcttaacaaacctctcaaaggt

SEQ ID NO: 2928 - DNA, 201 bp, Bos taurus
atcctccttcactgattagacaacagaggatgctgttcccagttgatgtgatcaggaagaaggattttcctcccagagctttaggtgtcttagcaacagatgctgaggttcactccatagaaaggtattttgaggactgagatttacgtaggggctaggttgggaaaaaattaaaacagaacacaataagaaaagaaacaa

SEQ ID NO: 2929 - DNA, 201 bp, Bos taurus
cctggaggtgagctcttgatgccattttactccaagtcaccattgcctgtgcctctcacctctcagagggagctgcaaagaactggacccagaagtcagacggttgtggctgcaggcctggatctttggaaaagccagcctgtctctccttcttgccctcctgctttgcactgatattgtcaggaatttgcatttgctaag

SEQ ID NO: 2930 - DNA, 201 bp, Bos taurus
actttgacatagtgcccagcgcaccgtgactgcatttaaaggaacacctggcaggcaaagcgagctgctacactaaatgacaacatatgtcatgcatatgcatgtatgcactatgacatcaattcgcttgaaaacagctttgtatttaatatttagcaaagaaccaaatatgtgtatattactcactccatattcccttat

SEQ ID NO: 2931 - DNA, 201 bp, Bos taurus
tcagccagcattgactgcatccctgctgtgcacagtgaggccccagggatccacaaggagacaggactcatcgtctggcctcgaagctggaaaagactacgtggagagcatcccaaagcatggtgagagctctccggggatgcaggaaaggcccaggggagatccacagggctgaactggagcagcagatcagcagcagat

SEQ ID NO: 2932 - DNA, 201 bp, Bos taurus
gggctgaaacaggcattgtgcggagaccaatttcctccttcccaagtccaactctttctttggtctttttatcaggtgacattggaccctgccaggtatcagaggagccgtgaatggaagagcggacaaaggagatctgattcaggaagacaagaaaaggccaccttgcaggtggccctcagaccagtaggaaaccaccct

SEQ ID NO: 2933 - DNA, 201 bp, Bos taurus
cgggtcgcaggtcagcctccccatgggaggccgcgctatgggaccaggtaacagaggtggtcgcagcctgtggatgcactgttcactgtcagatggccagtttcatgtcacgtgcccgtgtccctcagggagttacttttcagtggctgtccttactcttctgtcctcagccaccgggccgcgcttacccgaggatgaggt

SEQ ID NO: 2934 - DNA, 201 bp, Bos taurus
tgtcaacattggcctgttatgattactgtaatcacatagaggcttttctactgggtggagtaagtcaggatcctgagtcttcctcctgaccaggcaccactgtgggcttggcctgctcgttccaggtttagcaggaatcctgatgagtcaatttagtgagaattccccacccttggtgttagggactgtttacatcaccca

SEQ ID NO: 2935 - DNA, 201 bp, Bos taurus
ctagcagtgtgtggtggtcccagttttcccacatcctcaccaacacttgccattcttttttcacaactgtagccatcctggtagatgtgaagtgctgtctcactgggattttgtattttttattctgtactttatatttccctaatgactgctatctcgagaaggacatagcaacccactccagtattcttgccagggaaa

SEQ ID NO: 2936 - DNA, 201 bp, Bos taurus
aggttgccaggaaaagtggtcctaataggtaagcacctcaaaatttccaggacctggaatgagcttttagtttttggcctcccagtgatagcattcacaagcacccctcactgaacccatggctctgatgggacattggatgccagagctgttgcactagaagtgtgaagccatttcaggctggccatcgccatagctgat

SEQ ID NO: 2937 - DNA, 201 bp, Bos taurus
gtgtgattctatttgtggttcttcttttggttaactccaagtctttgaacaatatggctttttctctttttcatgatttattgacttgagatattatctacctgctccccatcatgaaaactgaaaaatgtatcttgcacgatccatatttctttttgtttttcactgttacaggatattattattttgctattttagaat

SEQ ID NO: 2938 - DNA, 201 bp, Bos taurus
tctaaattccatatgcatcatctgcaagcagctcactcttgagcctgaagatgtgcaagctgtcagtttcactcaccttcagggggatggactaaagcagcgttccactcaggactgagagctagcttgcagatttggggcagggaatccttgggtccgtggtacccagagtgtgacctagagggatgtgaaaagcttcta

SEQ ID NO: 2939 - DNA, 201 bp, Bos taurus
ttctggccgctctgggtcttcactgctgcaggggctctccctagctgaggtgagcaggggctcgtcccttgttgtggtgtgcagtctcctcttgtcgtgaagcatgtgctccagggcctgtgggctcagcagttgtggtgcacagggctcgttgcctggcagcatgtgggatctccctggaccagggactgagctcatgtc

SEQ ID NO: 2940 - DNA, 201 bp, Bos taurus
aaccgcaggctagggcccactcggactctgtagccatgaaggccctgaagccacacagtggagcctgaagcacaagcggatcaggctgcacactcattcctgttcatttttcgtctgcctggccgctctcccaagggagacttaagacacctcttagcattgggaggtcagtataaacccccgacccggatcagcctcata

SEQ ID NO: 2941 - DNA, 201 bp, Bos taurus
catctcatagctcggaatgctgaataagggagactgtatgcaaagtcactagcacatgtgaatcttcaataaaagccttgtctcctttgtgtaccttcctatagtatttctttttaacatgtatttatttatctggctgcattgggtcttcgttgcatgatgtgggatctttcattttggcacatgggctgtgtagttgtg

SEQ ID NO: 2942 - DNA, 201 bp, Bos taurus
tttttttttttctccattcctgccttgggagtgactgtgaagatcatttgctggaatgattggcaggttagaggattcgatcagatgagttcctcttagcacaggtcaaaaaggctagttagcaggagctgtcgaaaaatgccagcagcattcgaaatgggaaatgtcatgacttcgaggcagggggtgccacctggaaca

SEQ ID NO: 2943 - DNA, 201 bp, Bos taurus
cctgcattggcaggtggattctttaccatgagtgctacctgggaagcaccatccattaaagtaacaaatgtgaaagtttctgcctactagctggccaactggggcatggtcttgctgaggtgttttcaatccttctaattcttctgttctgcattgacggcatcagccctgatcagtggcagggctcggacagcacacagc

SEQ ID NO: 2944 - DNA, 201 bp, Bos taurus
tttaaactaagttttggagtaatttgttacatagcaagagataactaatacagcctggaaccctagttttcttatagaaaattcatgcaatctatcctatctacaatgaattgaattttggacatttcaagtgatcacaagatattcaaaccagaatgtgtacaagatatttggtaaaacagacctggagcctaaggaacg

SEQ ID NO: 2945 - DNA, 201 bp, Bos taurus
ttcccttgtgtgactacttcacagtttatatcaatttatatattcattctgtggttaaacattgaggttatttctactttctggctgttaaattcagtactgttctgcacatggttatgccgtgtttctgatgcattcttgcatgagtcttctggatacgtatattgctaggtcataaaatgtatatattcagatttatta

SEQ ID NO: 2946 - DNA, 201 bp, Bos taurus
attttttggagttcttatatgaacaaaatttcctgtatttttcattatcctagaaattggctgaatccgatttatatgtaatttatacaagaatttaagtgtattcaaccataaatttcaaatcaaactcatttcctgcctctgtgaaggagaaaattgaaaagaccatgtatatacgtaactttatagtataaagtacag

SEQ ID NO: 2947 - DNA, 201 bp, Bos taurus
atatcttaagtacttattgattttttaccttgaagctaataatcattactatgacttcaaaaataatgacagttgccagatgattttatattataataaattaacatgagtgaattgtcttagtgagacagcagtgattcctcagaagaaaaactttgtacagtgttctgaatgctcaggagtgctttcttagttcagctg

SEQ ID NO: 2948 - DNA, 201 bp, Bos taurus
cgatgccaggacgctcacgtaacccgtcacaaaaactcacgtgaaggagggtagatgtaacacaactgcaaattgctagactggctttcagattgtaaatcaattttgaataagattacaatgtagggtttccctcttttttctttttttctcccctctctttttgaagttcagtttacattacttcgcattcatgaaaga

SEQ ID NO: 2949 - DNA, 201 bp, Bos taurus
atgacttttcaagtgcttccaagggccgctagggtgcagcactgccctttctctacgccaaagtgaagaaagccttcggaggaaactgaacagcatgacccgacacaaggccagaagtcaagaaggaaaacctaaaggcacaaaacgtatcgcgcgtcacggcttcttttctgcggacaacctagatctcaggccctggcc

SEQ ID NO: 2950 - DNA, 201 bp, Bos taurus
caactggccattcatttggaagaaaaataaatttgatccctactttataccatgtataagaagaaagaaacagagctagaaaaatgtattagaagaaaacagaagaggatcttgggatgtggaggcctttctcagcatgatgggtaatctagaagcctgaaatgaaaagattcacagatccagctatttaaaactgaaatc

SEQ ID NO: 2951 - DNA, 201 bp, Bos taurus
ttttttgtacagttcttctgtgtattcttgccacctcttcttaatatcttctgcttctgttaggtccataccatttctgtcctttattgagccctctttgtgagaaatgttcagtacttgttaactacaaatgtaaataaaataccagggaactctaaaatattccacttctacatcacttaccttttttcaaataccgct

SEQ ID NO: 2952 - DNA, 201 bp, Bos taurus
gggaagcctggcaggctgcagtccacagggtcgcaaagagttggtcatgacttagtgactgaacaacacaaatacacaaaggcaagcagttgtgaagcacgaccttcttgtactagagaaactgctcttgggggtttcagcagcccagccgtggctgatgctgcagaagatgcactgggctcgtctttggatgctgggtaa

SEQ ID NO: 2953 - DNA, 201 bp, Bos taurus
cctgccccccacccccctaccagcccaaccctgtcgagacccctgcttccctccctctctccctcagctgggccttatctggcctgttcagtgatgcgataaaacaaaaagggaagtttctgattgcacgaacacaccctttggagagattccagctagagaagagtccgttaaggaaagtgagagcggtggcgggaggcc

SEQ ID NO: 2954 - DNA, 201 bp, Bos taurus
gtaagttgagaatgcatgacctagatgtgcatgtactgtttgcctggattcctccttacttcacccaccctgttggttcagtcctgctattgcatatgaatttcttgggccaactgtttcctcaagcagtcctgtagaaaacggaaccagttatgtctgtccacctgagggggtagactctgccagtgaattctgatgttt

SEQ ID NO: 2955 - DNA, 201 bp, Bos taurus
taaagtattatacttaacatttcagagtcttgagtttgtctcatcaaatgcatttaatcccagttcttatttttgacattgttttgattatgtaaatatcgagaatattttctgtattttacatatgcttacagtatattagagttcacttttttttctgcagaatgaaatgtgaagcaagtttaaaagtgtataccatct

SEQ ID NO: 2956 - DNA, 201 bp, Bos taurus
gttcttcacacacaccatacagctggtgcatatggtgattcctttctttggatcagaaccctgactcttctgtctttcagaggtctcagctgaaatattacctctgcaggtaggcctcctctgaccaccctgttatcctttatcctattgctctcctctactgtatttattatatgcttacatattccttgcccagtagct

SEQ ID NO: 2957 - DNA, 201 bp, Bos taurus
ttgggggttggtgcaaaagggagttgagggggagactgtggaaagacaagcagtggggctttttcttaggagaacaggtttctggaataaaggggaacaccgtgagcagtagggctttgggaaagtaagggaagggagggggctccagagacaggctgcgcctcttatggaatgtagcccagggccactcttattcatgtg

SEQ ID NO: 2958 - DNA, 201 bp, Bos taurus
cagtgaggcagcatcagagacttcgtgggtcccacagggcaccctggccccataagcttaagcctatagccccactatgtcctctgacctcacacttccagacccactaagtcaaggtctgggccttttgacttcttttgaaattctataggaagcaaatctgtgacacaaactattactacttgtgttatttggagtatg

SEQ ID NO: 2959 - DNA, 201 bp, Bos taurus
ttctacttgacacctgaaatggaaaaaactaggcaggagcatgaaatagtatttacatctttgctgaactcactgatcttcatcagtggaccaacccagcttgaattcttgcaactgatgcaaaggcctgaatcattggaaaagtccctgttgctgggaaagattgagggcaggaggagaaaggcgtgacagaggatgaga

SEQ ID NO: 2960 - DNA, 201 bp, Bos taurus
aagagctctgtgattagttatctgtactctaagtgtagtcaaataaaatttatttacttgtttgagttatttctagagattttcttgcactttaccataaagtaaccacttagttattataattttgttctttcatttctgtggctgtcaccctttgctttcccagtgctgccaaaaatagcagttggactttaatttctt

SEQ ID NO: 2961 - DNA, 201 bp, Bos taurus
cagacatgccatgacccctgcctcttacacttctctctctagccctcttcatgagaaatctcatttgtgatccaataatacacttcttcttttcagaaaccctcaatggccttatactgtctgctgatagaggtagaaacttctcagcttggcttcgtggttccacctgaaaccaccatgttggatattgttcccattgta

SEQ ID NO: 2962 - DNA, 201 bp, Bos taurus
tttttaatcctctgcttcccttgcctcttccattcttcacacttttcaaattctcctaattttctgcccattagttcctttccaatttgctgtagccaaaggagcaaaaatcactttggccaagcggggaagagaaaccagacagctttgataaatgagccaagcctgagctgcctgcagaatcgagcaaggccaggaggg

SEQ ID NO: 2963 - DNA, 201 bp, Bos taurus
atgctgttttaatggatttgtgctgtaacagcccactgtaaattcttgtgcctaatttgttctgctgcttggtgaactactttctaggccaaaagtcaagaacaaatgctaagtcaccaggtattactacattctaccgtcttaccagtggaacaagggtgagataagaaatgttctgggtaaaatggcctttgactccga

SEQ ID NO: 2964 - DNA, 201 bp, Bos taurus
tggactaagaagtgaatgatgaagaagtgagtgcaaaatggtgatcattctgggttgcaagaataacatgtgcaaaggccctgaatcaaaaggaatttgacatattggaggagctcaaagtgagagagtgcgaccagaaaatggagagcaaagaaaaaataggagatgacattagagaggtttggagggtagggcactggc

SEQ ID NO: 2965 - DNA, 201 bp, Bos taurus
gcatatatcaaaacttcaaaaaaaacatttggatatctttaaaacttagttttctgaactctgtattagtgtaaaattctgagtgcagagcttattaatgtgttgactgagctttgtgtgaagaggggaaaacctggattattgaagcagcatagccactatggttgtaggatctgaaattgtgagactgaactgaatgaa

SEQ ID NO: 2966 - DNA, 201 bp, Bos taurus
ctggaatttgtttgtcaacaacgcttcataaacaaggcagctggaaattagtgagtggcagcccagctacttgttagcgcccagctcctctctcaagccataatccacatgctgtgcctttaaggccaggggcttgctggcaactccgggctgaactctgccctccccaggcagtgagtcagactggaaggctcagacaaa

SEQ ID NO: 2967 - DNA, 201 bp, Bos taurus
tggggatgaagaatactctaggtgaattatctgtcctagtgtctctcattgtcttcaatattaatatattaatagttgctgtgcttctcatggatgagtcatatgtacctagaaggtacagtgaagtgtggaaaactctgtagtctctcatctccaaaggtaaaatgggatagacaaccaacgtataaaaatataactatt

SEQ ID NO: 2968 - DNA, 201 bp, Bos taurus
ccagcagcaaggctcccgactggctttgtcaatttgttaaccaaatccaagttcatacttcccaccaaagccaggcaagtaaatcaagagttgctggtcatgttatagtgactttatttggaaaaccagcagactaagaacatggtgggctagtatcccaaaaagccatcttcctggtgagaactcaggcttcttttatac

SEQ ID NO: 2969 - DNA, 201 bp, Bos taurus
aatctaattttatgtttgccatgcggctgagtttcagccaataggcttccttttccctaatctgtgatatgtggtaccatttctttagatatatactgttgttctttaagtacatggacctatctctgggctccctattttactcattggttaatttctctatttgtgtatcaatacaaacttatgattggttactacaga

SEQ ID NO: 2970 - DNA, 201 bp, Bos taurus
tccatgggatcttcctgacccaggcattgaacccttatctctggcctctgcaggcggattctttaccacagagccaccagggtagcccactggggtctgtactgtaggctaaagaaccatgaaaatacaaagctggacatttaaacaggagaaagatagctatatgactttcccttctgagagaatagaagacctagttcc

SEQ ID NO: 2971 - DNA, 201 bp, Bos taurus
ttgtttttctctgccaaggtaagagaggatgataaggccaagctacgacctaatcattatccctttccatagctcttcttagaacactagtgagcaaggactttgtatggtctagaggccaatgacaagatgtgctggcagattccaaaggtgtgttttactggatattaattctttggggaatactgtgaacaaatggcc

SEQ ID NO: 2972 - DNA, 201 bp, Bos taurus
agaaacatggtatatatcatttgacaatatgtactatggagatcagcatatagtttcacttgagacatatcaagacaaatgatagtagttctggctcttcggaaaatgacagtggtaggagagagaataggaacttggatcctgcaatgatggtgattgtggagatcaatgtctctcaaaatgtgttgtctaaaaacatag

SEQ ID NO: 2973 - DNA, 201 bp, Bos taurus
ccaaataagcccttgatgggtatttttgtttggaacataaaataagaccaaaaagaggtttcaaacaaggtggaagattgcttgtgaagtttactttcagacttgagaggggccttctaggatgaggctaggcttctgaggactgcgctctatccagtcttccacagattaagtgtgatatggtcagtagacaagtcagtg

SEQ ID NO: 2974 - DNA, 201 bp, Bos taurus
ctatcggactgggaacgatgtgaatggtggaagtggttggaaagaaatctccagagttaatccatgcttggcataaaacaggccctttcctagcccttgggaagagtgctctggagcagctcactgccttgcctccagtatctatttgatctcattaggccctttagccctgtgttatgtggtcaccttgagaagctcagg

SEQ ID NO: 2975 - DNA, 201 bp, Bos taurus
tctgtcttcaaagccaacaacatcacattcttttgacccttcttctgttgttatgtatctctaactgtacccagaaaagattcttacctttaagcactcatgtaagactgggcctacctggataacccaggataatccccctatctcaaggttcttaactttaattacatctgcagcgttccttctgccaagtaagatcat

SEQ ID NO: 2976 - DNA, 201 bp, Bos taurus
agagcataggccccttggagaactccagctctcatggacttaggtccatgtccattctggccccaaaaaggtggcaagaaggtggccatagaaagctgccgattcctcttggtctctgtatgaagtgtgagaggtggcggtgttcttggagagaggacacaaagtttcaagcatacattggacgaacatggcccgaggttg

SEQ ID NO: 2977 - DNA, 201 bp, Bos taurus
tttagctccatttaaagtttgaaggggaagtggcctctaagaagcctaagcagtgaaaaagggataaatacaaagggaactgggggtaataattccctcacccatcatccccagttcagttcagttcagtcactcagtcatgtctgacattttgcgaccccatggactgcagcatgccaggcctccctgtccatcaccaac

SEQ ID NO: 2978 - DNA, 201 bp, Bos taurus
gaaagcttcccacagtaaaatttctagatagaagttaaagtttctgtagactgagctgctcagattaaaagagtatagcaattcttttatactccttataaaagaaagtacaaacacatggtgaaactatttttcttgccatgtcagcattcctttgagaggaaagaaagaaaatgttttgttgggagttcttcagtttag

SEQ ID NO: 2979 - DNA, 201 bp, Bos taurus
aaccactttattaaacaagtcttctaaagttactctctgtcacatcaccttggaaattttcttcaaggcacagttatatttgaccatcttgtttatttgtgtaccaatttctcacatgactccctcattcgacttaagcttttctgtcttgttcatatataatgaacaaacagatgagccagtagagaccagattgcattg

SEQ ID NO: 2980 - DNA, 201 bp, Bos taurus
gaaggcctcctactgtcgggggagtgtgtaatttccttggttctgtctcgtcgcaacagaaatatgaagtgatggatggaccagcgttacagccctgggatgggccggagtttcagctccgtgttacagctcagttttatttagaaagtaaaggaaaatacatcctcaaggtgtgagggaatgccgacccaaaagatgtga

SEQ ID NO: 2981 - DNA, 201 bp, Bos taurus
cgcaaaagtagagtaagggaccaaaaagcagaacaaataactggccgagggcatggaagtggtggcagagagctccacggggtccccatacatttcagacaggtcgagggatttagatctgggccattctgttgaggggaaggcgatggcaccccactccagtactcttgcctggaaaatcccttggttggaggagcctgg

SEQ ID NO: 2982 - DNA, 201 bp, Bos taurus
ctgttggaacaagaattgatataatatcattttattcccaccaaaattacagtttcttgagtgcttcccttttccagaccttgataagtgttttgtatcccttatttggttttatctttgcaacaaccttgtgagctaaggccgatcactcgtctttgataactaagccttagtgaggttacccagcttgtccaaaggcac

SEQ ID NO: 2983 - DNA, 201 bp, Bos taurus
aattttaatggtgtgctcacagactgccctctgccaagcgtggactctaggagtgagggtttgatggcccacgttggcttggccagaagccacagggtgccttgatgactttgtggaatttaatgatttcattctgaaagataaattgggattggaggaggggagtaaatccgtgaggtggccatcttgacaggtgaagct

SEQ ID NO: 2984 - DNA, 201 bp, Bos taurus
tctacattaagccaaaaaaaaaaaaaagaaccccgtcgcaaagtcctcaaaggcttgccaacgctgtacagtgatgaggacatgcccccagagtaaagaactgctttgtgaaggcttcagtggagaattaatattaattctgatgtcgttgtattgataaatgggaaatttccacaaacccagctttacagaccacagagc

SEQ ID NO: 2985 - DNA, 201 bp, Bos taurus
caacagttcggacttcatggactccttataaaaggcctcagagacccccaaggggtctaccgaccacactctgagaacagctatcctaaatgaactttccatgttatccaaagaggccaccgccctctcagaacgtaccagaatttcccttttctctctgacattgtcaatactccactcactgtagtcatttccatcagc

SEQ ID NO: 2986 - DNA, 201 bp, Bos taurus
ttctggattttagtcattctaatttgtatgtagtggtatctcattgttgttttaatttgtatttctgtgatgacacgtgatggcttggggaatggaataatgaaaggaaaattgagctgtcttcctttttgtgaggctattctcaggttttctttattgcactgttttgctgaagtttcttaagtggtctcctgaactctc

SEQ ID NO: 2987 - DNA, 201 bp, Bos taurus
tacctttctctgttccaggtgggcactactgtgggctgttattacctatgcttttccaggcaaatgttactgcaaaaccattaatattattaaaggtattgtttggcctcactgtgtgtcaagcacatggacttgtgttttggtaacaatatctgtggagaaggcaatgacaacccactccagtactcttgcctggaaaat

SEQ ID NO: 2988 - DNA, 201 bp, Bos taurus
ctcctgttttaagtctcccactgtctgactgcaagattttatttattaatatattaaaaaaaaatttggccttgcagccaagatgtaggctattagtttcccaaccagagattgaacccacaccctcagcagtggaagtgtggagtcgtaaccactggacatcagagaattttcatctaagattttaaattaccccatgga

SEQ ID NO: 2989 - DNA, 201 bp, Bos taurus
tcacctccccagcctcatcccaagctcctctcattgcaggtgacaagtcaatgattctgaatatatttaagcctttggaatgcaccatggatcattctcaactccagatctttgcacattgtccctaacgcctggagcactcttctccctgacctcctaacctctccttttaggtagtctagataacagtacactattttc

SEQ ID NO: 2990 - DNA, 201 bp, Bos taurus
ttacattgaatgggtaaagactagcaagaatcttttttttttttttttcctactaatgtctcccgttgagaagggggtttcttagcatggccatgtaaattaataccgagttatttctttgaattcaaaggctatttatccaggtctaatttctttagaattaacgtgataactgagcccaacttagcaaccaaaaccagt

SEQ ID NO: 2991 - DNA, 201 bp, Bos taurus
atggctctaacagaaatgtatagaacatcccggcccatccctcagaagctgggtgcatgttctgaagtacatgtgaacactcttaagtacactttaataaatttaatcctataaataatgttgagcaaagcagaataaatatcataccattccacttcaacaaaattaaaatcaggatagggttacctttggtgggaaggt

SEQ ID NO: 2992 - DNA, 201 bp, Bos taurus
ctagctccactccagccatgctagcctccttcccgtccttcaaacacagcagactcccaccacccccagggctttgcattatcatttctttcttatatatgtatatatatatgtatatatatatatatatatatatataaatgtatttattttaattgaaggctaattactttacaatattgtcatggttttgccatacac

SEQ ID NO: 2993 - DNA, 201 bp, Bos taurus
tgccttggttggcatggtctttctcccctcacccccactgagtgccttgccctgtctccttcctgttccctctggaagtggcctcatcaatcattttcctatttttctttaccttcaatgtctcctctctaccaacccctccccttgtctacagacctgttggctttcctctcaacctaatgtcctacccctgacccagtg

SEQ ID NO: 2994 - DNA, 201 bp, Bos taurus
tgtggctgatccaagggaggagggaacctcagttccgcgaactggcctaggacagactaacggagcagttttgccctccttcatacatggcttcccttcctagtccatgtttcttttggccattttccagggagcaagaaagaagacaaactagacagtaagaagcttctcttttgagggacatgatccagttctactcac

SEQ ID NO: 2995 - DNA, 201 bp, Bos taurus
ttgaaagcattttggcaataagtatcaagaaccataaagacattaacatactttgacagtaattccacttttaggattctaagaaaatactcttaaatccacaagaggttgtgtgtgcagaaagatggcagtccacttaatggaatattttttagtgttcaataaaatataaagactcttggtttcataatttcagttaga

SEQ ID NO: 2996 - DNA, 201 bp, Bos taurus
tatgtaaaaacataaatacataatttttaggatgcacttcaaattgttatctccatagccagaattcaaaaacaattatcagtagaagctcatgttcatagtgcatatttatctttctaatctcaggaaacaaacaattttttgagaaataggaaaatactggttaagaaaagccttagtttccttgcaaattgatgtgtg

SEQ ID NO: 2997 - DNA, 201 bp, Bos taurus
ctcattaaaatctacagaggccagaatgcagtgaggtgacatattttaagtgctgagcagatcttgtgggcccacgtggcccttgctgccctcacctccacttgctcctctcagtcctctgcccgctcatgctgaccatgttcacacttgctgttcccaccattctgactgctcttgttctcatgctcactgaagtgcctc

SEQ ID NO: 2998 - DNA, 201 bp, Bos taurus
gagtcattccaatttattgaattaattgatataagtagctatagtattttgatgtaatttatatctagagtattgtcatttgcattaaatattttttgatcaatcactatgtgtaggctgctgtcccatataagttggactcagttttaaagtcaaaatcagtcatgtaatagtatgtgttagatcacatatttatttctt

SEQ ID NO: 2999 - DNA, 201 bp, Bos taurus
taagaatcttgtatacatgtacaatgaatcctgtacatttaatcacatctttgatagccatactgcatgattgtgtacattcctggcaacttaatcaagtcgcaaatactcccaacagcagcatcagtaaggaacaaggaggcattgctaaagacaaaagaaaataaattactgcttagaaatgtaaggccttgtttcaaa

SEQ ID NO: 3000 - DNA, 201 bp, Bos taurus
caagctgatccctgtgatccctgaatccaacaggagttcaaaaggattctgcgcgtctcaaagggcataaactgctattcgtttaggattttcaggcacactggggcttcgccacagaagagctgatgctatccggcctcgtgattcggccgccgctgctgaaccagctcaaaccgcagacgaatccagatgaatctgaag

SEQ ID NO: 3001 - DNA, 201 bp, Bos taurus
aaatccattaaaaaatgtatttagcaggatgaggacttcataaggcaggtgtctatttcattgataactccggagaaataacacattccagtcctagagatgtttttgaagctcatgattgagtgtagaactattctatcattaccagaaatgttcattaagcacctcgttttctcctttgtatttttaaataaatcaatt

SEQ ID NO: 3002 - DNA, 201 bp, Bos taurus
aattcattctgagaaatatcaccctccgtcccttccttttcagtacctgaggcaaaaataattgactagtattttgaggcttagagtttagggtttttttttgtgtgttttttttttaatgtgttaacaatatgggagaactatcaggacaaaaattacaaataaacaagggtgatatgaccaggtttccaaaaatgtaca

SEQ ID NO: 3003 - DNA, 201 bp, Bos taurus
tggcaacccactccagtactcttgcctggagaattccatggactgaggagcctggtaggctacagtccctgggatcgcagagagtcggacacgactgagcaacttcactttcactctgtataaaacagataagcaatgtcttactgtacagcacagggaacggtaatatcttttaataaactataatggaaaagaattata

SEQ ID NO: 3004 - DNA, 201 bp, Bos taurus
cttagagaagttaaaatgcaaatacagagcaattcaaaaagctgctcgtttactggatatatgtaaagagaacccactccaaaacttgttttccatctaagataggaggactatttggaggaatactgcaagatgcattttaatcatcatcctcattgtgatatgtctgctaattttccaagctctgtacatgtactatga

SEQ ID NO: 3005 - DNA, 201 bp, Bos taurus
aaaaaaaaatgctagcatgcttccactttctctctcccttctctgagactgccgtgagaacatgccccggccaacctgagaatgtgcctgggctggccaactgaagtgatgctgaggcttgtgaatgcaagagacatgaggaggtaaacccagcggtcgtaagagatcagctgttggccagctgatccccagatatctgag

SEQ ID NO: 3006 - DNA, 201 bp, Bos taurus
gtcactgtcattcaaggttattttcgataaggttaacttgcttgcttgctcggccttgaagcaaaactcacttcccgtgaggcctcgaactggcttaaggcggaccagaacccggtctggtttcccagtcggacccaggctgaccccggacccagtccagcttccaagtcggaatcgcttggactcccgctggtttccggg

SEQ ID NO: 3007 - DNA, 201 bp, Bos taurus
tggtgtggtatggtatagtgtagtatagtatctggagaccagaaagttaaacttataaaagtattatatactaaggttatcattttcactgatggcctaataagggagaaagcaagagttagaagagactttaggaagctctttctgttaacattgtgatgtagtatgagtgctggaaaagagaaaggatttcaggagaga

SEQ ID NO: 3008 - DNA, 201 bp, Bos taurus
aaattcaacttccatagtcacattttccaaactctgctccttggaataaaatttccatgtggtactaattcatggggtggtggtggttggggcactgaggggctggggaggtaagtccttgcctgaatatgtttggaaagtggtgagttaattaatcaaatgggtttcttttcctaggccctctcagggcttttatcatgt

SEQ ID NO: 3009 - DNA, 201 bp, Bos taurus
atcttcaaatcaatctcccaatgggaccatgatatgtcaattataccctcaaaaagcattgcaaaatatatcccctcctgtccatttccactgtatgcttcagcagtatcttttgacattcccagtagcaaatgatcttcaaacagaccttggcaatatcttctacctatagtctttccttatataacagtttgttttctt

SEQ ID NO: 3010 - DNA, 201 bp, Bos taurus
gacatatttagagttcctatcctttaaaagaacttagaagttaatggagtatactgaacatcagaggacttaaatatataatgtacatgctcaattgctcggttgtgtctgattgtctgtgatccagggactgtagcccaccaggattctctgttcatggaattttccaggcaagaatactggagtaggttgccatttcct

SEQ ID NO: 3011 - DNA, 201 bp, Bos taurus
gtattgatacctggggcaatgtatgttatgcaaaatattcactttagcagctgaaatgagaatcctcactttaatatagtttccagaggcttagaccatggtttgaactgtaattacctgcagggaaaaatttaaagatcaaaaatgtccatttgcttccttaacccaaatctactattttctctgttggaaactgacttt

SEQ ID NO: 3012 - DNA, 201 bp, Bos taurus
tcattggatctaaatccaagcataaggaaggaaggaaggtgtctactatatctattctctttaccaaggcagtgaaagatttctgagataaatccctaaggggcttctttttatatgcaattaaccagaactgtatcacttggccattcatcacgtaaagagagactgtgaaaggaatcatgcaactttctcagcccatgt

SEQ ID NO: 3013 - DNA, 201 bp, Bos taurus
ccctggtgtcctcagacaggcttccctgtgaggatgtggggaatgcactgacattcagactctatacagattccaggccaggaatccctcaaggctatgtacacttagaagggtgcctttttaaaactctcatcagttttaatgatgagaatgagccagctgcagtcccaggccttagaagctgtttgtcatcatcaaggt

SEQ ID NO: 3014 - DNA, 201 bp, Bos taurus
ttgacactttaagatgaacccccaggttggtaggtgtccagtatactactggggaagaggggagaaatagctacagatgtgaatagctacagttggccatgtgatgtgaagaaccagcacactggaaaagaccctgatgcttggaaagggcaggaggagaagagggtaacagagaatgagatgtttggatggtatcactga

SEQ ID NO: 3015 - DNA, 201 bp, Bos taurus
tgtaaatgatgttttcagaatatttgatatccctagaaaatagtatacattgtttaaaacacttgagattcaaacactaattattagggcaatttttattcttttatctctagatgagtagataagacatgtagagtcaagttatttacattctggtgaaagacaaaagcatacacagtttacaaatgcagtaaacttggg

SEQ ID NO: 3016 - DNA, 201 bp, Bos taurus
tagcaaacagcttaataatagtaagaggttttcaattagtcactttttattgagttttttattctactaggaaatataaggagaaaatgaacaaatcttttcctatttgagtccactcagtgccgtgttagaatgagttcaacatcagctctcaagagctaattcttctcgcatttttccaaccttcgattgaaaatacaa

SEQ ID NO: 3017 - DNA, 201 bp, Bos taurus
ttatgcattaattatgttgctggcatggtgctgagtgttggcttgatctttgccctcaaggaatttacagagtacagcagacagaatggaataagctagatagaccagggacatctccttctaccatacactgaaagagctagaaattaaaattagacacacattgtatattaactatagcttattgcgggtgttatttca

SEQ ID NO: 3018 - DNA, 201 bp, Bos taurus
taagggatgtcacctgaatggcctatctatattctatattatatatattctatattctcttagttgaatatttgggttattttcttcaacaatctgcagaagtttccattttcctattggccttacttgactccctactattcactaaaaggctcaagttctaagactaaatacttacttaaattttaatatttgacaaac

SEQ ID NO: 3019 - DNA, 201 bp, Bos taurus
agtgcttggcagctttggggaagttgtgatgaaacgcagaaggagagttcctaagagcccttggacaaagtaaatactttatcccaagagaagaggcccccactcagaagacttccagtgaatttcctctgagaatattctgttaacatagaaaatctaaaaactctttaagttggagagaatgcacaaaagtcgacagag

SEQ ID NO: 3020 - DNA, 201 bp, Bos taurus
attaaggaggccaagaaccctgttcaataacactaatatcaaacttcttgatagtcacatgtatcattttcatttttttcatttagaagtacactttcttgaaaacagagcacttgaaggattcatatcttttctttttcccaattcgtttatactttcttcgggaactagcacacaagtactctatatcaagttgaatta

SEQ ID NO: 3021 - DNA, 201 bp, Bos taurus
tttccggtttctaataatgcagtttcacaccatttatcaaaaattcttaccaaaaaaactattcagagaagttatacaaattgttgcagctattttacagataagggcttcagacattttacaggtagaaaacagaaacttggaaaattgaagttacttgtcaagaatagaccacaagcaaacaacatacagagctctcaa

SEQ ID NO: 3022 - DNA, 201 bp, Bos taurus
catttgttctgtgtcaaaaatgcagcaggaagcaaagcatatgattaactgacatttcatctagcctagcctatatcaataataataatagtaccctaccctcaaatagtaattttgcccaagactttgttacaataaattagtaaaacctatagattgcttgtagaaacagaggttatggaagatattttgttgcacagc

SEQ ID NO: 3023 - DNA, 201 bp, Bos taurus
tgaagaggttccaggagagttcacccaggatgatttagcagaagatgatgtcatgctgttagatgcttgggaacaggtaaaactgtattttgttcatggcgagagagtgtgcttatacttgagagctgatacaaccttctttgagaaatggcaagtttaataataaatagacccatggatttaggctatatttataagaaa

SEQ ID NO: 3024 - DNA, 201 bp, Bos taurus
cataggcactaaacacagagttcagagtccattggaaaggtggctgagcatgatcagcatgaacaagcctaagatggagtccaggccctatgaattccttcttcagtttagccttcctaatacaggtgttcttgttacctagtccaaactcactctgctggctgcacggtaggccaataaatccaagagaaaaggggttaa

SEQ ID NO: 3025 - DNA, 201 bp, Bos taurus
caactccagtacttttacctggagaatcccatggacagaggagcctggcaggctgccatctgtagggtctcaaagagttggacacgaagtgacttatcatacatgtgtggagcatcgtattgaaactgactattctataaggctgaccatcctatgaatttgttaaatctcttttgactgataaattaaatctcttgcctg

SEQ ID NO: 3026 - DNA, 201 bp, Bos taurus
ggcatgacttagccaagtcattatcctagcataggagggactgatagttagacaaggctacatacactgcattggatattttaattttacattgatgataatgcagttacatttgtatatgtgtggcaatatacttttcgatatgtgttgttaagtagaattgagtcttggctgaagaacctggccagaggagcaaaagga

SEQ ID NO: 3027 - DNA, 201 bp, Bos taurus
ggcattgggcaaagattgtgacataatagtttaagatcagtagacacattaaggtaaggatctaaaggtaccctggggtccagctctgcagactttcttgttatgaacaccaagtgttgaaaaaaaaacaatttttacacacttaggagaaaaatagactctctatattttaccataagtttaaccagttttatggcactg

SEQ ID NO: 3028 - DNA, 201 bp, Bos taurus
atcaccttatactgcatttaaaaatattccatccatccctaagctttgtttgttcacattttgaagcttttgttttccacaggccgaactttaaagcaaattggttttacacacaccttgcattatagcttcagaggttagagatgataaaattaagctggggttaaggatgtgcaggagaattagacaagcctctcacgg

SEQ ID NO: 3029 - DNA, 201 bp, Bos taurus
aagggaggatagatgttatttactaaagcaattactgagacactatcaggcttttatcattgatctagacaacatgaggataccactgggccacacatgacaaaggaagtaatgctgagtgtctacattgcctctttcagattgcattacataaacatgctgttctatattattttctattagtttatgattccaattgta

SEQ ID NO: 3030 - DNA, 201 bp, Bos taurus
tcttctgcttctttgtaagagcatagagcattaagcaactaactctgccacaggcaatcaaaaaagatttcagttagatggtgactacaaagtgtattaaggcaaactatagtatattagatacttagaaatacttattaagaaagagtggtgaaactaattttagaaagttaataatttactcaggaaaacaagtaaatg

SEQ ID NO: 3031 - DNA, 201 bp, Bos taurus
aaaagttgtaaggagagggagaggacaactttctatggttttgaccgttgtacttacatctttctataatgaacactctgcttgaagtttccatggactcccagcatgaagctagtttgagagtgtctatatcttgtacactgggtatatagaaaaaaggactaggaataataggatgcattagatacataaaagtattat

SEQ ID NO: 3032 - DNA, 201 bp, Bos taurus
atatcaaacagggaaccattcaggccatacgttagcaagcagccaagtaattaataataacacacgtggaagaaaatgaatgttttggttgagaaggagactgagaagtcagacaaaggcctgggcttcatgtccttgccctcagcagcagcaaaaataatgttatgaatagcatttaacttgaatttgcagcaaactgct

SEQ ID NO: 3033 - DNA, 201 bp, Bos taurus
ttttttaaaaacccattaaaaaaataatcacttgagcctcttaatttgactgatattttatgaattaaattaacaaacagtaaaattaaagattttcctactggtttgtaattatatgaattttatgtagctcaatgcctacatgttgtggtaggcagaatagtggacccccatacttacagactttatgaacccttatct

SEQ ID NO: 3034 - DNA, 201 bp, Bos taurus
tcttgttttatgtctcctaaattaaaaacattttaagtttctatgattagcattattatgacatttatataaaatttatattaaaataatcactaaaaacggttaaaccacaactaatttaagagtttctatgaaatatatctttttcattaaatagggatttaacacagttaaatggttgaatataaaccaggaatctac

SEQ ID NO: 3035 - DNA, 201 bp, Bos taurus
ggacacaacttggcgactgaacaacaacaaaaaaacagtattctagaacaagagttggcaaatcacacagcccatgggtcaatccagtttcccacctgttttggtaaataaagttttattgggacacttttccacccattcatttatgtagtctaggactacattgagtaacaatgtgacagaaaccctttgacccaccaa

SEQ ID NO: 3036 - DNA, 201 bp, Bos taurus
gatggattcaccctctttagtaaattccatctctcttcggctaacttcaataaatttttatattttgtgatcacaagttgccacacacatttgtttgctaagttgcttcagttgtggccaactctttgcgatcccaaggactgtagcctaccaggttcctctgtccatgggaattctccaggcaagaatactggagtgggt

SEQ ID NO: 3037 - DNA, 201 bp, Bos taurus
ccctccttagggcagggtagggagtgacagggaatttgacttacagaaagtgagtctttcaatgtcatttattttttaacttatggagtctattattaacgttctttccatgacaatctccctagatttccaaggagggaaaattctaagtctttgagaatggaatctgttgcattatgtgtactgactgaagtggctcta

SEQ ID NO: 3038 - DNA, 201 bp, Bos taurus
ttgagtatttttttcagatgtttgtatttaaacttttatctaaatgataatgtcactttgcatgagaacagcagagtgcaaaagcagatgaattttcaagggttaaaaagaatggatgagatcaagtttaattctaggacttaaatttgaagattagatttattcatctagttggcctgaaatctaagtgatatttttttt

SEQ ID NO: 3039 - DNA, 201 bp, Bos taurus
ttccttgcatatggcctgatttcatatgtctgagtagatagaaatagatgataactagttagaaaaaacaatgacaaacatttaacagtaagacctgtggatctaggcctacatgtatgtttatgttaaattaatgaaaacagtctactttatagaataaatgtagttttacaattttatacattggttgaagtttaggaa

SEQ ID NO: 3040 - DNA, 201 bp, Bos taurus
atgctttggatgtgtttaatccttgtcacatgtaatgtatatctcaaagaatctaatctacacttcatcctggtatttttctactttctgatgggttctagaataaataagaaaacctattatggggaaatattggcaaacctactagttttaacacatattgttctggcttccctaagtaaaatctttggttttactgat

SEQ ID NO: 3041 - DNA, 201 bp, Bos taurus
ttgcattcaatacctgttacactctaaagatcagaagcagaaaataagattttacattacaacaaagctctctaatgttgttcttttagcccctgctgtagtcaaggcatagagctcagaaataatgtcccctttctgaacttgtcaactatttatttcacgttcttaatttttgtttcatcttgtttcaagactgcctaa

SEQ ID NO: 3042 - DNA, 201 bp, Bos taurus
attctatggagatctcggttgggtaaggctggggacgggggccctctctcaccatattttcaggccaatactgctgatccctgtggtaaatgaagagaaaaagtggaaactctactttctggtcacactttattataagagaaagtcagaggccactctttataccaaggtgaaaggagtaaagtcaaaatcaagtgcctg

SEQ ID NO: 3043 - DNA, 201 bp, Bos taurus
gcatggggtctagtggaggaacctcctctcagtggattggaaccactaaattctactgttaccttatttataaactaaatattttaaagggccctcattacttctcttttctttttttctttttaacatatagcgttcagttcagttcagttcagtcgctcagtcatgtccgactctttgtgaccccatgaatcgcagcac

SEQ ID NO: 3044 - DNA, 201 bp, Bos taurus
acaaaacaggaaaggattattaggaagaacaaaaggaaattaaaagaggaattgagtttgatataaggatgcagggacagttttgtgatataaaatgagcgtacagtggcctattttataataaaactgataggtaaaactgataaatatatgtgaaaattacaatagacctccctttcccttcccaatttttattttaag

SEQ ID NO: 3045 - DNA, 201 bp, Bos taurus
atgtgatccaactaggtaggatttttccatttatcttggcagcagaatcattaattcagtctgtttattctggtcagttagcttacaaatctgcaatatcgcacctttgattagctttgtaaaatgattttgtgacatggaaggagctctcattctttctatatctggcagtcttgactctataaatatgtccatttttga

SEQ ID NO: 3046 - DNA, 201 bp, Bos taurus
aaattttcaattacttatgcaatatttgaatcctctttttgaatgactgcaaatgaattttatccaatttgcactttcatgtcatgaatattctcaccatagggtgatatcaactagctctcaaacttgttgaaaacttaacactgcctttctagagctactactaactggctctctagcacactgttgtcacaccttact

SEQ ID NO: 3047 - DNA, 201 bp, Bos taurus
aacaaggcctctgactataaataactcactttcttaaactatgtaatatacagctatgtctaatatgaaatgctttattttgaactcatcattttatactttttatatggcctcataataaatgatgtaggtggtttccagttaatattgtctatggatcactatatacagatctatgaaaaacacagctttctaagctaa

SEQ ID NO: 3048 - DNA, 201 bp, Bos taurus
gaagtcgttcatgtctaatagccaagaaggaaagaattgggaaaaaattaaataattataacattgaattttaaaccataaaataaatatttatgtccccgtactaatataagtacaaattttataaatgtgtatggagggacaaaagctcttccatttggatttgcaagtaaatatagaaaggatgagggaaaattctgt

SEQ ID NO: 3049 - DNA, 201 bp, Bos taurus
tctttaattccaggtcaagacctgccttctccaaaaaaaatgctgcatatcctattgtacagaccagtggcttctcttgtgtgaaaactcccaggttttctttccagtagccattctttatttccttgagtatattcccacttagacttgttggtgctcttcttggatttttaaatcattcatattatgaatgaagtttca

SEQ ID NO: 3050 - DNA, 201 bp, Bos taurus
tctcaaccttatgaatcaataaacagtgtgggatgttgcctcctcatcgattacagtatgcactgtttatttttattatggaagtgcttgctagttttccgagttaatggcaatagatctgggttgttcttctaaatccaggtgctttgtagatttatttttgagggggaaggaaagggagacgtgaagatttcttgctat

SEQ ID NO: 3051 - DNA, 201 bp, Bos taurus
tagaatttaaagaactggtggaatatgaagactaatgaaaacatccatgcaaacacacacgatcttacatgaattactgggaaaatagtgggataaaccactttcctttggttttaaggaaaaaaaatgtagtatatatacagtattatcaacaactttttattctctgaaccagaatcatctttgggatctctcagagta

SEQ ID NO: 3052 - DNA, 201 bp, Bos taurus
tcatttctaatgagtcacttctagtggggagcgggacacaattcaacccccagcaccacatgtgaaatgactcagcaagggaatgaagagaagcacttgggaaggccagcttccactcagcgcactgacatttgtcgcacatacaacggaagcaagctccaaggtgtgaggactaaaaccgtgctctgtgttgctggtgga

SEQ ID NO: 3053 - DNA, 201 bp, Bos taurus
ctatgataattaatcaaggctgaacgttctataatgaattggaaacttcacactaaatcctaactaactcgtggtgcatgtgtattgcatgaaggtataggaatgtatcattatagtagataaaccatcaaagtgaggatattttcttctatagaccttaataaagtcttcattcttctaggatgtagtagtcccacaatt

SEQ ID NO: 3054 - DNA, 201 bp, Bos taurus
gctcttaaaattgtgccttatagttttatagtttctgtatttgttcttactgtgatgtgcacattgaggatgatattctttcactggaaatgaactatacttgaaaatgtttatagagcagttgtaacaccacattttgattttattactctttgccctaaattgagaaagaaatcaattgtattccaaatagcttgagaa

SEQ ID NO: 3055 - DNA, 201 bp, Bos taurus
ttgataaatgtagaaagaacacgtacaaaaatatgttcacacagatctcagctctgagagttaaatccttcccagttaagtataataggaggccaatgagcatgtgactcctacctctggagagggtctggggcagtttgagttgagagtccttcgtgtccttcttagctcctggtttgactgtggtgtctttggccagag

SEQ ID NO: 3056 - DNA, 201 bp, Bos taurus
gtgagtgcctttggggccccccactctatgaagactccatgttttattgcacttcctagaaactccagcaaagttgaaagttactcccacccaccatcccgtgacttagccttatttttaggccccactgcagagctgctggagggggcccttcccttctgcccctgaaagctttgctttatatgttttagattatgggca

SEQ ID NO: 3057 - DNA, 201 bp, Bos taurus
gctctaaactgaaggactcaggagcctaaggaaatccactttcctttctcttctgtctttgatttttttcatacaccaaacaagatagaagcggatgctcgggggtgaggtcacgaaaaccctatccactcctcttggcaggaacaattgttaaaatcagtgtctgcatccacacagtgaagacagccaacactggcttct

SEQ ID NO: 3058 - DNA, 201 bp, Bos taurus
taatgatagggagacagtaatccaaaaagacacatgcagtccatgttcactgcggcactgttagaaaagccagcgtatgggaacaacgtacattacccattgacagataaatggataaagaagatgtaatacacatacgtgcacatacttatcacagcaaaatagttgtgatactactcagctataaaaagatgaagtttg

SEQ ID NO: 3059 - DNA, 201 bp, Bos taurus
acttttgtggcctgaaatgctccatggcagactgcacagaccttatcttctttcccttgctttagacacgtaggaggtgctaacatcacttcttcttcttcttttttttttttaagaaggagaggccccatctcttaggagatgacatattgagactcagtctaggaagtcagcataaaccacaccatagtaaccgaaact

SEQ ID NO: 3060 - DNA, 201 bp, Bos taurus
ccacattaacaaaatggagaataaaaaatcatataatcatctcagtcagcatagataaagcattccacaaaatttcacatcttttcatgataaaatcttccaagcatcttgctggagagcggatgtactgcaacatgaaaaaggccatatttgacaagcccacagctaatatcacactcaatggtgaaaagctgaaacttt

SEQ ID NO: 3061 - DNA, 201 bp, Bos taurus
tgtgtagtctgaaaaggcaatccctgtcttaaagcttccctaagttcctgtcaaaagcaaatgataactttctctagacaaatcaaccatcaaatcaagcctcaatttttccatgtatcaagttcctgggtcaccacagaacttaagtacaaagtaaactaggaaagaaggagtaggagtaaacatcaacagaaaagctaa

SEQ ID NO: 3062 - DNA, 201 bp, Bos taurus
gcagatacatattttccaaaattcaaatttctgtcctcatcagtgtgactgatgtccccaggtgaaaaggggaacaatgatgtatgaatataaggccaacactttctcttcaagtaagtgaccaaaaatgtcaacccgaatatcccattagtgagctctcagctccatggccttaacctagcttcaggggagggggaaaag

SEQ ID NO: 3063 - DNA, 201 bp, Bos taurus
cccaggcactgtcatcaggttcagatagggggaaaaaaaaaaaatggatcctgtatggtctggattagcagactctgtgagcccatgtggtcccttgggacgtataaaaaggaaaatgtttaataagtggctggtatttctatgcttttttgagaaagtttaattttcacttctgtcaagttgcccagttacaagaatgga

SEQ ID NO: 3064 - DNA, 201 bp, Bos taurus
aatgaggataatgatttggggctggaaaagtgggtggggaaaagaagaatgaggaaatactggaataggaaaaattaggacattatatgaggcagaaaggggtttacagcttattttccatgcaccgagagacttagagataaatcatggtcagggttgaaaggtgagtgtattcaggtgataaaaatacaatcagagaat

SEQ ID NO: 3065 - DNA, 201 bp, Bos taurus
atatttgatccagcattattctgggtgtttctctgagtatgtttttggacaagattaaaatttgaatctgtagactgagtaaagcagattgaacgtttgtcatgtgagtgggcctcatccaacttgttaaggcctgagtagaataaaagtctcaccttcccagaatgagagcacattctgcctaatagccttcacactggc

SEQ ID NO: 3066 - DNA, 201 bp, Bos taurus
ccgtgggatcacaaagagttgaacatgactgagcaactgaactgaactgaactgaagcaacttaacacgcatgcatgtggatatacaactgctgacatacggactcagtttttgcattttatttctggtattaaaacgtgtaatatttcttctgaataagtcaggcataattaagaacctcatgtgactatatcaggtagg

SEQ ID NO: 3067 - DNA, 201 bp, Bos taurus
tgtgaaggtagttttaatttggcttttttttcccctcagcccgaaatgaaacttcttaaggatgaaataaaattattattagcagatggttattttaatcgtcttcaaagcttttggggagtctagcattgtcaggcagatgcagtggcataacacacatataaaggtgttatgtgcaggtgcaacattttaaagaataac

SEQ ID NO: 3068 - DNA, 201 bp, Bos taurus
aacatacattttccaaaataacagtcctactaccctcaatgtcttggaaagagttacttgatacccagagagtgaagttcaactagcctagagccttggttggacaccaagcactagggggtttatgaaagaagatagcccggatagctggagccctgctctgctgtgttgacatgtctagagctcagaataaaattgagt

SEQ ID NO: 3069 - DNA, 201 bp, Bos taurus
acttacagaccttcttccatccattttccaagacctctccaatttcaagaaggctcacagtgaaaattgtattttaatacttgagttagctgaccaagtgatcaatagaattgtgtatgtgcatacaaagagtttaagacacagtaaaccagataacttcctaattggcagtgggtgtcagtgttattccttattaatttt

SEQ ID NO: 3070 - DNA, 201 bp, Bos taurus
gttttgccaagtatttagaaacatacaatcattataaagtgaatattttgacttctatcataatagatttgtcttattcatacttaacctcaagtgcaataccagagctgaaattctggacagctctagtttattgagtgaatatttcagtgcatttccaaggattaagaagatattatttcattattccaaaatggaagc

SEQ ID NO: 3071 - DNA, 201 bp, Bos taurus
taacacggagctctaacactggtccttccatcacttcaaatttttgctgtgatgagacagaactgaggaaatcacatactaccctgacgaatatggtgccatgactcagatttaatctcactgaaacaatcttagctgggcccctgtgaggcaaaagccaagcacagcagaagcccaaatcagcaaaagcttccatggtgg

SEQ ID NO: 3072 - DNA, 201 bp, Bos taurus
tgtaaaggaagtggccacgaatactacagacacaaggacctgaatgctgcagacaatccataagctgggaagcacgttcttcctacttgagccttcagacgagaactcagtcctggccaacaccttgattacagcctcgtgagattctaagtacaaggtccagctaaactgtccatagacttcatactcacagaaactgag

SEQ ID NO: 3073 - DNA, 201 bp, Bos taurus
aatcttggacaaaatgaagagtttctgtgtatattttcattttctttacaggatatatgttccagccttcaaaatccctagtgtacactgccagtgacttttgaggaccaaatttctattttaattaaattcttgcttggaaaaattagaatttttgttttatgttaatatgtccttaaatatgttaagtggcattatgtg

SEQ ID NO: 3074 - DNA, 201 bp, Bos taurus
gtcaactcaaaaccccggcatcactctatatttgcagctaatactttcacaatgattcaagatatagcttcaggaggcatctaactactttattctttcctggtagccatgcttgaacgctgctgaaatacattttattgtattagagttctaaatgaatttttcccccctattgtgttggtagatcactactgggttgac

SEQ ID NO: 3075 - DNA, 201 bp, Bos taurus
ccagtgggatttgattacagaacttccaacaggactggggaaactgactcttggaggcacaaataaaacctggaacacaccaggactgaggagaaaggagcagtggccccacaagagaccgagtcagacttgcctgtgagtgtcaaggagtctctggcggtggcgtgagtcaacagtggcctgccacagggtcaggggcac

SEQ ID NO: 3076 - DNA, 201 bp, Bos taurus
gctacaagagaaagcaacacaaggatagctgtcagctgaatatagcacttgaatttcattgcagccttttcttgatactcaatctgtactgtaattgaaagtgagaactatcagggttgagaattttcctcctgacagaagcctttttttgacatccctgttcattccacctgaactctacacttaggcttctgttgctgc

SEQ ID NO: 3077 - DNA, 201 bp, Bos taurus
ttgattagtctgtggtatggcctgtgccctgatactgttttcaaagttcccatgtggttctgatatatagccaggtttgagaaccactgacataaatgaagaagttcccatgttattaggcctttacaactactgtttatagtagtttttaccagtgaggcttgaaaactatataaatcagaacacctggcatgggctatt

SEQ ID NO: 3078 - DNA, 201 bp, Bos taurus
aagccctgcctcaaactcagctctggatctagccacaccagctccaaccccagtgcctatcaaagtgatggtacaggcataacctgagggaagactgacatgcattcacatcatagctactcctcagccaaaggtactcggcacaagcactctctataaggacactctgagataaggacaccccttcacgtctaccatgag

SEQ ID NO: 3079 - DNA, 201 bp, Bos taurus
tatatttttatcttgtatttaagattctctcatggtttaaattctttccattctccttccaaatatattatctggttgcagaatgaagctgacatgtctgcacaaatggaggtggaacatccaaacctccaggtgatatatcacatcctgcttggtctctgagttgccctctggttgtcactgcttctatagtattgtaac

SEQ ID NO: 3080 - DNA, 201 bp, Bos taurus
gctagtgaaatacaagacataaaaggtaaaatacttaatacttaaaagatactgtgcttcatgggagaaaggggaaagggttcaacaatggccattaatctacaactctcttgttaacaatggtttatttaaacatctgttaagcatttgtaactttaacaaattggcctcaaggtacttaaaattttcttttaaaacagt

SEQ ID NO: 3081 - DNA, 201 bp, Bos taurus
ctatacatattttatcaaaagatagtcagtctttgtttcctgaaacaacctgcttctcagcttatgttttggagtagtaaaaacagttttaacgcaatgcagtgaaaggcatcacaatgattcattcctttggatttgtagatcacggtggatggtaatgacattagaactttaaatgtgcgacattatcgagaacatttt

SEQ ID NO: 3082 - DNA, 201 bp, Bos taurus
agctcccaatctgtggccactgtgcagggacctcgcgcgcggactccttggctactaaataaagcgtgaagaagggtggggagcgagccgagcgcagccatcggctgcaaggagaagcagtctggcccaggttggggatatctcctcgcccggagctctttgatcaaagtttctttcctgttgaaaagaaaacctggccag

SEQ ID NO: 3083 - DNA, 201 bp, Bos taurus
tgttccaccagggaagcccaaacgttcatgtagtatttcttaaatcttagaaaaaagcgaaagtcatccacaggcccttcgacatcttttggaatttctaacagcttggtgttcatactgattcagtttcatatccaggtgctattaactatctttccttcttaaagtttgtgaaaaaaaaaatagaggtgaatgaaaatg

SEQ ID NO: 3084 - DNA, 201 bp, Bos taurus
ctattagatgaaaagagggaatacattcttttctgattcaggtgaactattaactagtcacattcttttcatattcagctcactgaattataaactttgaatatcacactaatgaataatgacattgaccttggacaaggtcagttttaggacatctgactgttgatctttgcttcaattcattgttctttcattaccttt

SEQ ID NO: 3085 - DNA, 201 bp, Bos taurus
tgatgaaagactaagatgtgagaaggtatcaagcgagcacctcatcagggcttagttctcagcttatattgagctgagttgctgttggtggcatagtctctaaacatgggctgatgtgtcactgtgcttgtaagtttggtcttcccagatggactgcagagttctgaaggacaggtggccatattgagggcgtggatccca

SEQ ID NO: 3086 - DNA, 201 bp, Bos taurus
agaaattggttgtacttactttggatacattttatatgggttaacaaatatattatccttaaaagagttaccccaagtgatatccccagggatttggcctcgtaaggctcctctatttcagatcatccaaaaattaagccaggatgtgggacctccaagaagtcatgtgttcatttccctgctttgtgtcttctctacacc

SEQ ID NO: 3087 - DNA, 201 bp, Bos taurus
aaggagagttattagatctggactagtttcctccagaaaagagaatttgagcgaggtggaagctctagagatacagatttcaatgcaaacttcctataaacatgctgcttcaatgtggcatgagctgtcccaaagggaagtttcctttcaaaacaccaaaactacaccaagatattacctcacaccaatcagaatgcccat

SEQ ID NO: 3088 - DNA, 201 bp, Bos taurus
tgacagctgtccaggcctctaacactcacagtcaggcaccccactgaattaactcatgactctccaacctaaaaagaatctgttcctgatctaattatggattcaccggtttcaggccatcattcctctgtacattctacagatgctcagagatgtcaccgttgctgaagaaaaatcacaaaatcttgtagagcaagctct

SEQ ID NO: 3089 - DNA, 201 bp, Bos taurus
atttttgaaactttgaattttcaaagttatgattttgataagccaacagtgctaagtcttggcttatgttagttttttaatttagtatcggtatataaccaaaaatgattactgattttaccagcgattgggaaataaaatcttggcactatgcttgaaacaactgcttcatttccactaaataactagaaccatctgcca

SEQ ID NO: 3090 - DNA, 201 bp, Bos taurus
ttgacatgctggttactgcatttcttgatattctagaggaagttggtgtgatctcaacttgaatacaccttgtaccctccttactagatctcatggcaccgtgaggcaacgaagcttgtattgcattggcaacctaagaaggaaaaatatagtttaagactgtcattgaatagatgtattattatactcagataaaacaag

SEQ ID NO: 3091 - DNA, 201 bp, Bos taurus
ttaaagccccattgagagtgaagtgagagaaccgcaaagctaattttgaggattggatgcttgctgagcagtcacctcagtgctcttactattactaaagtaacagcctctgtaggctcacttctccaagactgtcagttactacacgtcggtaatccttagggtctcctgcagtgatctaagccttctgcatcaaatcct

SEQ ID NO: 3092 - DNA, 201 bp, Bos taurus
aaccaccttcttctgcttcctttgtaaagctattgcaggaaaattggtcccaaggggatggtcatgtcccaggtctctgacaagttcctgggatgggcccccaagtgagaatccttggctttacacaggaaataattcaagagcaagccatagaaaacaaagcagagatgcacattccatgggcagcatgtgggccatctt

SEQ ID NO: 3093 - DNA, 201 bp, Bos taurus
caggaggcggtgggactgatgggggagctgggggcggagggccggctcccggagcccgtagtagtggtgaggtcttggatagcgaatggagcgagagagagggagagcatcagggggccagggttctgccgccagcactgaggccggaagctggccgacctcccaacccccactccccctcccgccccctaaccaccaagc

SEQ ID NO: 3094 - DNA, 201 bp, Bos taurus
atgaagaaagatatcctgcctggaatcttgaactaaagactaatctgagtggtttatcaattcctgaacagtagaaaatataaaaacaagtgcatctatactaagagtcttctaagcctagaatgggttgggaaaaagtacaactggacactgtctttcctgtagcagcattattacacatgcatgatgacgtaacaaaag

SEQ ID NO: 3095 - DNA, 201 bp, Bos taurus
aaaatgattaccacaataagtttagccaggatccatcacctcatatagttaatataattttttccttgtaatgagctcttttaagattcagatatgcattgtttcataatatattttggtcagaatttcccttacacaccacagacttttcttctgatcagatagagaagatgcacacccatactgtcttttcaaaaagag

SEQ ID NO: 3096 - DNA, 201 bp, Bos taurus
gtcccatgactgatctagtttgtcatctccacgatacatcttcagccctatctgtggtttgtttgttttatgtcatagcttttatcagattttctgtgaacgccttactgacaaatccttctcgatattgtagtatgtatcagtatttcatttccttttgttggtgaataatattacattataggtatacctgtattgttc

SEQ ID NO: 3097 - DNA, 201 bp, Bos taurus
aaatcagtttgtgtggtgtaactgactggatgaacatgtgactgagagctccttctatgacctattggggatttgggtccacgtgtgatccagaaggaacccacagatacgctagggcaagtgaccttggtcagaagggacactcatgatacttcttcagatcaaggattgtgatcagtcttgaagagatctgaatttctt

SEQ ID NO: 3098 - DNA, 201 bp, Bos taurus
tacttcaggtctggggcttctttcccatgctaccttctacagagcttacaacctatgtcttgtggcctttgcccttaaagccttgctaatgatgacacccatcagaaaggctaatgcatggtaatagaataatctttcagtggtgtgctttgaatttttacaagtcccatcagatacttattttaaagtcagaagaaacag

SEQ ID NO: 3099 - DNA, 201 bp, Bos taurus
gagggtggtgttctaaatctgagtctgtcttctccaaggtaggccagtgctaagacaagggagagctctctgtacccttggccagtgccccactctaccccagtggcatggctgtgagtaattagataaagcacacatcccactgcccttggggcctttgggtacacctgccaagtcaaatgcactttatctcagtcaagc

SEQ ID NO: 3100 - DNA, 201 bp, Bos taurus
gattgtgaaattagttttgtaactcttagttcaccagttttcttgagtatatgagggttgtcaaattgatctcagagaccttgatgaagaggccttgttttagagtggtgttggttgtcagcgtgttgaccacttgcaatatacccgcaagcttgggtgcttctgcatgttataagccaagtgaaaaaaaatgcatttgag

SEQ ID NO: 3101 - DNA, 201 bp, Bos taurus
gtggacacataaagcctacaggtgtgagaaatctttgtaaataccagacattgccatgatgtaagggaatagagcactttattgaagtctgatattataacacttcacaaatctattcaaattctattgggttgctttgaggaaaaatgtgcatagtactatagaaccattaactaatagagtatcctaaacatctttggt

SEQ ID NO: 3102 - DNA, 201 bp, Bos taurus
taggtttatttattacattcattaatcaaaaaagtatattctctatagaagagtatactttattccaagtagctatattgcattttaagaaccaggtggtgctcatggtaaaataacctgcttgccaatacaggagatgtcagagatgcgggttcagtcactgggctgggaagatcccctgaagaaggaaacagcagccta

SEQ ID NO: 3103 - DNA, 201 bp, Bos taurus
gacagggaggcctggcgtgctgcggttcatagggtcgcaaagagttagacatgactgagtgattgaactgaactgaagggtgctggtagagggaaatcctcttgagagagaaaccttattctggcctcacagaatatggaaagatttgagaaaaaaattgacacagttaaaagaaaaatggagtgttacacaaacatagtg

SEQ ID NO: 3104 - DNA, 201 bp, Bos taurus
ccttttctaattattcaataatcttcaaatcttgtagttatttcttagtcagataaaattctaatgcatgtaggggcagaagaagctgttttccacggagatgtcctagtaagagaaagagtgcgcacgtgtgtgaggcttgtcttgcttaagccaagagaacactttgtccatgtccattccatgccacagcctggcagt

SEQ ID NO: 3105 - DNA, 201 bp, Bos taurus
actattagatgtctcctgggccactgcccttcccaccaactttgtccttcatacctaaaacagatcacacattccttcagaggaggaatagaatttataacaaaattgagcctagcatttggtaaaactacaaatcagaaacttctggtgaataatcaagaagaaggaggctctatgggggaagtagggagttcaaattaa

SEQ ID NO: 3106 - DNA, 201 bp, Bos taurus
ttaaaggtttgtgcttaccaagcaaaatatgaaagtctgctgaacaaattatgaaattatggatttttaaatttcctttaaggaggtctaaaaggcaggcaatagcatgcaggggaaactagttccatccacattcagaagttctctgatgaactcctagtcttctctgactgctttccaaaccaaatggaaatgcttaag

SEQ ID NO: 3107 - DNA, 201 bp, Bos taurus
aattaacacaccatcatttaagggtttgagagaaactctagtgtggggaagaaagaaagagtccagcacttcagagcaatgggcccatggttttctttagagtttctactccaactgcagtgtaaggaccagtagtaccagcataaatgaggaacttgttagaaatgcagaatcttagggcctctctcagatgcctcggtg

SEQ ID NO: 3108 - DNA, 201 bp, Bos taurus
accattttgattatctgctttattcaccttataaaaacttcttctattaaaagttttctagtgacatgattaaaattaatagtgtaaaatgttgaaagtgtttgttttctaggctctatgtacagctttatttggtcttgagcttcctatataactagagctatttatgatgttgctgttggtaaaaattcgtttcctgta

SEQ ID NO: 3109 - DNA, 201 bp, Bos taurus
ggtcatgcttctggatgtctgtaagagttactatccagacattaaatgcttataatccattcctgagagctattatcccagaaactatacttgttttcccgttgacagcaggtggctttcatctttgacctggatttttgtgtttgtttttatctttttattccttgagaggccacgcatggcggctcaatgggtaggcaa

SEQ ID NO: 3110 - DNA, 201 bp, Bos taurus
acttctaaaagtgtattggttttacaaaagttaggaagcattcaagaactcctattgtcaaacctgattatgctgcagatggtggtaccaaggcccaggggaaaaaagtggcgttttccagactacagagattactactgaagcatcaaaacatgaaataattagtttgtcattaattctaatgagtttgcctcttaattg

SEQ ID NO: 3111 - DNA, 201 bp, Bos taurus
tagcaaagttaattttttaatccatttgttgtcaggtttttcttgtaagtaattctatgttcatccaatgttatctctggccttatatttaatgagttgagtttagagttcatcttttcaagtgacattctttctgtcatatttcatgcttctgggtaaagcttccttgcccttccatgcactaaaatggccaaagagccg

SEQ ID NO: 3112 - DNA, 201 bp, Bos taurus
atttgccctattgtatccgattctttgcaaccaacatccatcaactctactcagtcatgaattcacttacttcatacagtaaaatacagactccagccattgtgaagaagaaaagtttatctcaatgtgaatattctcctttctttaataatcctaccactttaagcttcagtgcctgattttccttttctgtatttgata

SEQ ID NO: 3113 - DNA, 201 bp, Bos taurus
aatatcatgtaattaggaataatctatatgtaaatcttattcactaccacactaaaaatgtcagcattacaaaaattaatatttaagatgaagatctactggagtttgatgttgattctattgcattttccttactttccttttcctggggttttggatactgaaaagcaaagcattgagttattgagaacaaaaacaatt

SEQ ID NO: 3114 - DNA, 201 bp, Bos taurus
agctgtgtgtgcagcattttatttattttttgcatatggttgagagttcatagctttttattgatagcctgttattgtcctaagtgaatcattctggaaactcaaatattgtgtttcactcatgtggttctcttaatttttacttcttgtattctgaatcatttagagtaagaggctttgtattgttgcttcaatggcttg

SEQ ID NO: 3115 - DNA, 201 bp, Bos taurus
tatatggaacattttcaagtctgagttctcccagcccctgttttctgtaaagctttatgagctcagcttgtccatttaaagacattttccttaaagacttgcttataggggagtccatggcaaaatgtgtgatttctgacacctttcctgttcccaacagcaccattctgaatttatgttccctgtcctgaatcctgttct

SEQ ID NO: 3116 - DNA, 201 bp, Bos taurus
tcagattccaaggtaataaattcctggtctccattaacgttaactgacataaatcagtgggaaaacagagtgagtgctccactgaaaccttgtgtaataacatttattttcccttggtgagaaacagagaaaaaaattgcattaactatagaggaatggcatctgcgcagtaagtgctttgaagacttaaagttttataac

SEQ ID NO: 3117 - DNA, 201 bp, Bos taurus
aagaacttatctgaggccactttaaatgaaagttgtgatccacaattaaaagttgcaggtgacagaaacattctgttgcagaggaattaaaagaaacaaatgtattcactggaaattttgtctgtttagtgtttggcgattggcaacagaacttcaaaaaacagagaataggaggtactactgtcatctacagactcagta

SEQ ID NO: 3118 - DNA, 201 bp, Bos taurus
ctagctctcacagtaatggctacaagcccagccaaacatcaggaagcagcttcttcaggagcttgaaagaaatcaggtctcattaaacaataagggaatgagccacacagctcacttatttcctctgcccttggaaaaatgtagattccttggtgtaaagtagagaagcaaatcaaaactaaattacctctgtgtaaataa

SEQ ID NO: 3119 - DNA, 201 bp, Bos taurus
aactgaaaattctaatgacttaaaaccacaaagtttatttcctgcccagtcagcatggcatcacaggttccctgcagcaatgctgcatgtctgccacagttcctattcacttgaggctgattgagttgcagccgagatcaagaatatggcaaagtatctagtagtcctaaaagcttcacatactatcatacagtcacacaa

SEQ ID NO: 3120 - DNA, 201 bp, Bos taurus
gaaaaaaagggtgtgatactttcagagtttcctcagggttcaccacagggagtggctggagtggttgcagtctgatgactgctaggtagcaggtatttcccttccttgggtctgacgttgaagggttgtagtcactgattccatttatagggcctttccctcttgatcatgaatctgaccattatctgggaaacatttcat

SEQ ID NO: 3121 - DNA, 201 bp, Bos taurus
aattgattctctaattaggtaaataaatgtttcctacaaaacaaacgaactaattccaactaggatacccattcccacaagaactacttccccaatagaatggctccaaccaaaccaaattccaaataaatttaccctacaaaataaatgagctaattccaactagggtgggcttgccccacaagaactagttccccaatg

SEQ ID NO: 3122 - DNA, 201 bp, Bos taurus
tgtggtatcaattactacaaaattttattttcttcagcattttttacatatagatgcacctgctctaagtattgtgtaatttgtttatgtaaagagattctaaataagctacttgagtaatttgttatgggatgctatttcagtctcagtataagttgaaagtcaggtcaatatgtaaattcgaagtcagattaactggct

SEQ ID NO: 3123 - DNA, 201 bp, Bos taurus
gtaatgtacagcatgatgattatagttaacaatactgttttacgtatttgaaagcttctgagagtagatcttaaaagttttcatcacaaaaaaatatttatagatgtgtagtatgagataagggagattaactagaatgattgtgaccatttcacaatatatacaagtaccaaataattatgttgtacatctaagactaat

SEQ ID NO: 3124 - DNA, 201 bp, Bos taurus
gaattcaattttcctaggagctttggtaattgagatcttgttcccagcaaaggcggttgcgtgaacagtgctgtcagaatgattacactaaaaatggacaaagccctatacaagcattatctcctcttatgttgccagcattcctaagaggaaagactctactgccattttacagatgtagactctggtgtagcaagcttc

SEQ ID NO: 3125 - DNA, 201 bp, Bos taurus
tttggtctatatgttagtttatacaaggagttatttgggaaggaagactatggctttatctacactcacagcatctgggacctagattagcaatctgctgatttatcaagtatttatcagagcataagtgagtgagaaaacacatacatttaagagttggagattatgacaagggaagaatatatctcggcagataactga

SEQ ID NO: 3126 - DNA, 201 bp, Bos taurus
agaagagtaagaaaggagaggatgaaggaaagtagaagaaggagaaaagatgaagggagggaaagtaaggagtctggaagagaaagtaaagagaatgagacagaagagggtagagtaaggaagaaaaaaggaaaatgcacactcttttgtcatgaacatatacaagattcacaatgttttacaaagccattgttattaata

SEQ ID NO: 3127 - DNA, 201 bp, Bos taurus
caatcgtaaaggaaatcaaccgtgaatattcattgggtggaatgatactgaagctgaagccctaatattttggccttctgatgcgaaatgtcaactgattggaaaagaacctgatgttgggaaagattgagggcaaaaggagaaggggcaacagaggatgagatggttggatggcatcaccaactcaatggacgtgagttg

SEQ ID NO: 3128 - DNA, 201 bp, Bos taurus
taagaaaacatgaatttgaaaataacagaaattatagtgatttaaatataatcaaataaaaatttaatgatgtcaatggttattccagggtttatgattgaagaggaaagtgtaatatggggttaagcattctcctctcttacactagagtcagatgatgaatttttgttgggctgttactaagcacacttgtatatatga

SEQ ID NO: 3129 - DNA, 201 bp, Bos taurus
cctgaaaggagggctgagcagaagtacttgaaggtctctgctcaagaccccagataaagatatctaagaatgaaagtacctggactaggaatggaaatattcaaacagcatggccagccaattgagtccttgacctcaactctgttcagaaacgaatatgcccaagtctggtgtggaaggacggttttcccaatgtggctt

SEQ ID NO: 3130 - DNA, 201 bp, Bos taurus
acaaaaatgctgatttttttaaaaaaaatcactttattagtctgcctggaggactgggcagatgcatagttattacttagtagacacttgtcaaccaagagtaaatacagatggaggtcaaaagcggggcaggcaagcacagcgctccaaagagggtgtgtggaaagggaaatctggcagagtgtttcaatggccaggttt

SEQ ID NO: 3131 - DNA, 201 bp, Bos taurus
aaaaatacaactgaaaaaaaatgagcagtaatgaggtattaggtcatttaggatgactgttattttgttaggtatagaattaatagcatatttatttagagttgactatctgagaggtatggaaaagtatgagcaatagggaatgatgtttgagatttgttttgaaatttgtcagagaaaaaaaaacgggggtggggggag

SEQ ID NO: 3132 - DNA, 201 bp, Bos taurus
tggaaaccgtgtcccctgcactggcagctgattcttcactgctgagccactggggaagccccttggcttcagttacttagaagcagttaagttctgctacatggaaacaacacactgttaaaagtcatcaaattctcatatcttaccatacagtcttaaagtttatgcccatttttggttatttattattcatttctattt

SEQ ID NO: 3133 - DNA, 201 bp, Bos taurus
gttgctttctttggtattcccatctcctgaaaacattccccaaggacacaaatagcggaagctttctttccatttgtctttaactttgctttcctcagcacacatctgtgcaaggcagcgtgacaggacctcaaatcagaagtatttctgatgtgattcttccacatatattgatcttagaaccaggtcttttactctatt

SEQ ID NO: 3134 - DNA, 201 bp, Bos taurus
caatcacccctgattatttacactgccttttataaaaaattctaggtcagccgacttgaaagtcctgtaataaataataatgactcattttctccaagagtgtttacagagaatttattgccctatacatcactgcctgtaccatttttttccccggtgtaacaacataatatgacctcttaaaaagcaaaataattaaat

SEQ ID NO: 3135 - DNA, 201 bp, Bos taurus
tctagaaatgtgaaaagttaattaactcattgcttcattataaaaaaaaagatgtagcagaaaaaaataaaaaattgtaagccagttttactttatgaataataatgaaaaattgaatgaaaagatttccaagcaaagtagcaatgaaagaataatgcctggaaacaaaacaactgactcgataattgagtattttagatg

SEQ ID NO: 3136 - DNA, 201 bp, Bos taurus
gtatattttcaatcaccgtgtagtatttcaaagttttatgagtgatagttgttcagttgtaaagttgtttagttgaaagaaggttatgcagtttcagttcttgaaagtaaatctgttattctttttctattctaaaagcaagtaagcctaagatatctgttaaatatatacttacctaagctggaacttttcacatttctc

SEQ ID NO: 3137 - DNA, 201 bp, Bos taurus
gggattaaaaagagagaagttaaggatctctaaaattctaatttcctgtctgcagtctttgggaagatgacagcaaaatccaaaaaagcaggtttgatggacaaatagataccatgattcacttttcacatactgcacttatatgtatggattatgtatgtacaggagaatatatgcatatctgtgtacaaagagagagct

SEQ ID NO: 3138 - DNA, 201 bp, Bos taurus
caacactgaataccaaaaaggataacccaaaatatagtcacataacctaaccaatctgccaagccagaaaccaaagatatagtaaaatgggaaaggcctgctgttagaatcttaaataaatacttatggaaaatagtttggggcaagaagctttccaagtttcaaaaacaatgcaataaagagacattaaccttaacatta

SEQ ID NO: 3139 - DNA, 201 bp, Bos taurus
cctagaactcatcactcaaatcttagtctgtgaattacccaactaatgcttctagagcataatgtatgggttggacacttaatatatgccatttgttcaaatatcacactcttagcactgtcagaaagtataaacaatttatgtaaggtcttaagggaattacctgtcaaaattgcaattgaagtaacctacggactattc

SEQ ID NO: 3140 - DNA, 201 bp, Bos taurus
cacacttattttaaattattaaacttcttaatgagacactgtattaagaaaatacatgctagagcaatgatacctgggtatccagttttgccacttattagccctatgaacttggaaaattaatctaacctttctgaatgtgagtatcctcatctgtagagtgagaatacttgtagtttctacctcatagactggttgtga

SEQ ID NO: 3141 - DNA, 201 bp, Bos taurus
agctccgccctttcaggcacttagagggctcccttgcctggggttcttctctgttgttcagcgcaccaggcacataaagggccccgggcccagcccccccaactccccctgctgtctggggtcctattctgtagattggcacatcaggctcttaaaggggcaccttgggtggggtcctgctctgtagttcagtgcttcaag

SEQ ID NO: 3142 - DNA, 201 bp, Bos taurus
ctgcattgcaggcagatactttaccatctgagacatgagggaaggccctcaattagctcaagttatttcccacctatgaggacagggtcaaaaactgcatccaagaaaagtggcactggccagcagtgtttcttatataagtcctgtcaaggttttttaggcttctaagtagtttgggaaaagaggggcagagataaatct

SEQ ID NO: 3143 - DNA, 201 bp, Bos taurus
tggggtctgtgtgactctgtgtctctctcacccccatctctccccaaaggccatgttcttctcaagccttgctgccttaccacagagtcttatcacgtctccatttttgagaggttaattcaggaagaagcgtaatagaaaataaaagttcgcataaaaggaaaagaagccaagatgcaggctagctgtgttgcaagatga

SEQ ID NO: 3144 - DNA, 201 bp, Bos taurus
actattgtagaaacacccatcttatggtaaaactggtgcagaaaataaactaattaatagtgaccataaaatccattaatctcagatgagtaattctttctgcaaattttaaaggattaaatagaaagagttagctccttgcattattggaaatttagttgtttcatcctgtgtcggttctataaaacctggcatatgaca

SEQ ID NO: 3145 - DNA, 201 bp, Bos taurus
gaaatcataaacataataaggttttggaagttgattagaactaatctaaatcataaaatctggaaaaatatagcaacatgcaaacaagttacaaattgtcattaaggtcttttgtgagaagtttttcatccttgctaatccatgtatctaatggaaatacccttccatgtgtatttattctggaatattattggaaaactt

SEQ ID NO: 3146 - DNA, 201 bp, Bos taurus
tttagtggtactactacagcttttaatatcctaagacaatcacaattgcataaactcatctccagtgttatcatacatttggattcatttggttccaacaatatgtcactgaacttctctatcacatcttatttacacagatgaataaaattctctgtagctttccctgttcagtgatatttcaaacccttgactcagttt

SEQ ID NO: 3147 - DNA, 201 bp, Bos taurus
taaactataattttagagtattgagttttaatttccatttgtactctaattcttacttggtatttttatttcctggaaaatatatggccatgatcaaaggaatacaatgtgctcgattagattagatttgttgctctttgatactagcattctggtcctctagaagctcagtggccttacaccaaaatactgttatccctt

SEQ ID NO: 3148 - DNA, 201 bp, Bos taurus
atcggcaataaaaaggaccacaccatatttaggcagggagcaactggggttgaacttttccaaccaaaacacagctgattcccagggagtgtgaaactgaacagagatacgctccatggcccaatatggcaggcgagaaaacgatcaagaccacggctctacaaagacccaggagagagactctgagggctgcacgaagag

SEQ ID NO: 3149 - DNA, 201 bp, Bos taurus
tccaggtactttattatatttaaaagctgaggaagatagataagaggctaacattcaataatacttatagtccttgctaaggtgatgacataaataagaacttgtaattaaatgtgaagataatagaagtaagttttgcattagttcattaacttcctaaataagtcatctctctttagagtacccaagaaatactatgat

SEQ ID NO: 3150 - DNA, 201 bp, Bos taurus
tgttaccaaaagtgatcaagaaagtattgacttcagaagggaaattttcacacatcatgtctgtgtatatcattacatcatctatagaaaagagtttggtcacatattcatcctcctggactcaatgcttccattactgaaaaactaaaagtaaataatgttaattatgaaaaaggctatttatataaaatttttcattgt

SEQ ID NO: 3151 - DNA, 201 bp, Bos taurus
cccctggtattattgattgcttttgtagaattttaagattcttaacctaattttatgctctgtattttctcaagtttacctaccacatctttattcatccgaaatccacagcttctagcatcttttactattctggcaaaatcatgttactccatacatagacttcatttctcttgtatgtatagagtcaggtaatgatta

SEQ ID NO: 3152 - DNA, 201 bp, Bos taurus
ctgggcagccgcagagcaaaccctatagtgctggctggtctgagagtcaggccagtagctctgtccaactgttgagcatggtctctggccttacatagccagggagcctgaagagaggtctgggcagctccagaataaaactccacggagcactgagctgtggagcccaggctacggccccgcgtagcggagaactccagc

SEQ ID NO: 3153 - DNA, 201 bp, Bos taurus
caaaaataccaactttcaaccttacacctgaagtcctgattgccaactgccaatcctcttgcagaaagtttgaaatttaggccatgagatctctaatgtctcagttggctgaatctttgattctctatgagaatatattttccttacaatatagcaatttgggccaataaatattgtgaataaactaattttcttaaatat

SEQ ID NO: 3154 - DNA, 201 bp, Bos taurus
gtgatatgtagaggatgtgtcaagtatccaatagttctggtacagaacagggaaagtggagaattgggaacagaagactggcctcatctggaaagcccacggttagtcctctcctctcaccttgcatcactggatcttttcactagcattctgggtattgcataggcttttctatcaaacagggggaggttcaaatctgag

SEQ ID NO: 3155 - DNA, 201 bp, Bos taurus
tgttgaaagaaaatcatgagggttggccatatttggggttacagctattgtatccttggaagttaggctagcataaagacatagaatatcagcatggatttatggaggccttttcttttcccattactccgaatgaccaaacaattttcaatcagtaattgaaaatgatggggaagaaattgttttatgtttagttttttc

SEQ ID NO: 3156 - DNA, 201 bp, Bos taurus
ttgattgtagatacacacacatatatatcatcatttacagatatatgtgcaatgaaagtgagaaaaagaagcaataaatatgtctttcattgtttcatcagcttagatctgagttcataattataaatctcttagcattctaagccagaagactttactgaagtcaataggagataaattaccatgcagacctttgtttat

SEQ ID NO: 3157 - DNA, 201 bp, Bos taurus
tgaagttttgtgacaattctgtgtggagcttgtatattggtgccattttttccagaacatttgcttcttttgtgtctctgtatctcactttgttaattctcgcagtattttaatttttaaaattgttattatatgtgttttggtgatctgtgatctttgatgctactgttaaaattgttctgggacaccatgatgatccct

SEQ ID NO: 3158 - DNA, 201 bp, Bos taurus
atgaaatgaattgttcctaaaacagtttatgttcagcatgagaattttcaattccttaagcatttgaaaaaaaattcacttaagaaatcacctaggcctaaaacattttcaggagataattctgggtaactctttaaattttttcaattccaaaaaaaaagccaattttatcaaaaatttcaaattccctgcatttaactg

SEQ ID NO: 3159 - DNA, 201 bp, Bos taurus
gaactatttgctgatgaactgactgtcccttaagcttgttggctatgagggaatctgggtgtttggaagacaagcaaagccaatgaagcactagccctctttggacagcctgctccaattacagaaaaagattagcagctgaaaacaaacaagtagcctgagtagtggctccccaaactctaaccgacaaagacccagccc

SEQ ID NO: 3160 - DNA, 201 bp, Bos taurus
taaatataagtcagaggccctcgtatcagaacccttattgcggttgagcgcccatcactgcaagtgtttagaagcgtttttaagcaagaggctaccactatccaattttagggcaggaaggccctcagcaagccctcggctcatggagaagccacggattcgaggtacaagcttcctccgggcgcggaggggagccgtccg

SEQ ID NO: 3161 - DNA, 201 bp, Bos taurus
tgtatttgacaacatgatacaactggaagtttgctttgccactctaagctgtaggaagtgaggaatgtgagagaaataatggccagtgcagaagcctagacttgggaggcttgtttgtcctgatgaattgacatctttgctagtaaggtcaaaggtagacaatgtttatttcctgcttcacttccaggtgtggcctgtgct

SEQ ID NO: 3162 - DNA, 201 bp, Bos taurus
aaataagatgaataaaattaattaaaatggcattgttggcagagacataaattagccactgtctggttggaaacaaaatatactggtataaaagtttctgaattaaagggagatgtgtgactgagtgaccagaaatggactgacctatagcattacatatcattgtgttttctaagcctgtcaccatgctatagccattat

SEQ ID NO: 3163 - DNA, 201 bp, Bos taurus
gagtagccttccccacttaagcagtaaaataacattcagaactgacatttacataggcgtgggctacccgttggcagtccacatggctcttctgttggctcttctttctgccaggttaactcttccacaaaatttaagcctctgatcaatggttacatccttagcggccatcccctggccacctccaacaaaatgcgaccc

SEQ ID NO: 3164 - DNA, 201 bp, Bos taurus
cacaccctgcaaccttctccctcatcctgtctttaaaaacctaatcactggggagttcaaatctcttgagcactagctacatggactccttccttggtgctttgtgataaacattgtacttcctttcaccacaagatgctgtccattgattgattttactgtacacaggcgggtagatccaagtttggtttgataatacat

SEQ ID NO: 3165 - DNA, 201 bp, Bos taurus
cagtgatcggagcatggatgccagtagtaataagagtacacgattcctcatttatatccagctgagagcaaatgagagtttctccttcaattatgctttcagtctgatttggctcagcatagtttccattaccaaaagaatgccacaaggtaattacttaagccaggttgcttaaccaacttaggtaagagacattatata

SEQ ID NO: 3166 - DNA, 201 bp, Bos taurus
gaccaccagggaagttcccccatggaggtacttgaatctataaaacaaaggcatctttgctataacaaatgttttcaaatggcccttttactctcttgaagtaaaaatctgtagataatacaacattcactcatgattttaaaaaattaatataataccccaattccaggaagcagtagaaggccttcaataaaataatta

SEQ ID NO: 3167 - DNA, 201 bp, Bos taurus
ttgctgattggtgcttttttatgttaggctcctgcactcccgcagagactgggagatgggggtggtatctttcctgatgatacatattgaagggatggctcccaggcccttgagaaagacgttcctgcattgtagaagacttaacatctcaaaggggcagaaaaaaaaattcacaattacaggttttctagagtagatgcc

SEQ ID NO: 3168 - DNA, 201 bp, Bos taurus
aaactagacaccaccaagagtttcccttgtcctgcaactgcagccccagggagcaccatggcattgatcctcaagctctggccccagccaggctagtagattccccatcctataccaggagccacaagaaaggactcaagcctctttgcccttggcctgatgactgcgtagggtaatgcacccagccttccttgccactct

SEQ ID NO: 3169 - DNA, 201 bp, Bos taurus
ataagagtggctgatcagctcagtacatgtggattacttttgatttatatgtacttttccataaaaatctttacagtgaaatttgaaagtaaaagtggacgtagcctgtcttttagcatataatactagtcactgtagcactcatatctaccagctttgttcttgatttttttttctctttactgtaaaatttctcagtga

SEQ ID NO: 3170 - DNA, 201 bp, Bos taurus
tgacaatatgtcttttgtaattgtttttgttattctttggcctctattttctaagggttttgtgtttattttttttaaccatcactattctcacatcttgtattgtgaagatgaccaaggttgtaggtagatattttcatttattatggtttaaaatttagtttcagcaagtcactattttaaagatattaaggaagaaat

SEQ ID NO: 3171 - DNA, 201 bp, Bos taurus
aggttttagttctatgaccctgggacctggccagattatgagctacctgaggacagggacttggaccaaatgtatccatcactccagagttatcccaaagatatatatactattagcacttggcccaatcagcgtctgaggaatgagccaatctttgcaatgaaggttaaatcatataacacaacacgaagtgggccagct

SEQ ID NO: 3172 - DNA, 201 bp, Bos taurus
cgccctgcatcatctgtccacatttttaatctttaaattagaaaagacgtcttcctggtggaacccagcaatcactgacgacagtacacgtaaagtgcccattgcaaggctggtccacaggaggtactcagtggattgtcattgttattaccaagtggagaatgatgctgcataaggaaaacaaagggcagggtcataaaa

SEQ ID NO: 3173 - DNA, 201 bp, Bos taurus
acaaagcctggattcgtttaccaggtggaggccttcgatccagaagacacaagtcaaaacctacccctcagtgtaagtttccttattaaatggaaaagcatcttttctgtgtggcctggagtctcagtggggcgggttgggaagtggcaatgggagggaagtgctgtccacctccaggcacagagcaccggggaggctgga

SEQ ID NO: 3174 - DNA, 201 bp, Bos taurus
tgatcatataataattggcatacttggagtctatataaaggcatgaattgtcttttacacttcacagtattgcttggatcacatggccagtttcctagtgggtgtcattaacgtaatttgaatgtaatagaattgaagatgtaaaacacacagagtttgaacagcaaagaggcctccaaaagtctgttggcccatggcact

SEQ ID NO: 3175 - DNA, 201 bp, Bos taurus
cttaggatgttggagtgataagagctagtttagttttgatttgcccttttactaatactgtcatctaaggacttcggcacaagtccttgcctgctacatcagaggacacctgagtgacaggtgctttgctgtttccaaaatctcaccaggactaccccaagccccagcccactgctgattcactgcaactgaacccagtag

SEQ ID NO: 3176 - DNA, 201 bp, Bos taurus
acaggtgaatggggagcagtgaaaggccagcgggcaggattaagccaggggaacgaggaaataagagagttgggtgaggaaagagtgagaatggaccacctgctcaaaactgaatacaggccagtatctgcaagaggccttgaagcatgcccccagcagcccctcacactgccagccgccccaggaccacagtgtgtcagg

SEQ ID NO: 3177 - DNA, 201 bp, Bos taurus
tctagagtgggagtgagacatctactgtccaagtccacctggggccacgggctggtgatctctgccgcttgtgtcccacccttggggcacagaatgttctgaccagtctgtttatggcccttttgcctcaatacaccatgcgccactccctggaatcctgctgcccccaaagtactgcccacggcctccttcctactgtgc

SEQ ID NO: 3178 - DNA, 201 bp, Bos taurus
ttttttcttctgtcattcctgggtgttgagcattgtggcagacactaattattgctcccagaatttgttctacttcatctccaaatatttgcttggcacacaactgctcaaaatagtttccattcccaagctttccttatagccatgcatctgagttactgttgttgtgtaataagtcaccttaaaatgtagaggttgaaa

SEQ ID NO: 3179 - DNA, 201 bp, Bos taurus
cagccaataaaaatatctcttgatcagagaaacaagacttgtgcatttcttcttctgagacccaggcagctactgtttacttcttaaaaatgtcatgagtcactttttaagtggtgcaagcaaaattggaattgtttcaggtggaagggagcttgtcctctgaagtgtcttaaggataatcagagatttgaatacccaaag

SEQ ID NO: 3180 - DNA, 201 bp, Bos taurus
aggtgacctatacgttgatgagaaagtagggcctgggtagtgggaaccttccctcctgaatcattcactgctaagacacaaattcatgacttctcttggtgggagaaggccaggaccttcagtgagttaggggtggggtggggggagtcccctgcattctctgagttcagaaggaagacaagtaagaggattctggcttca

SEQ ID NO: 3181 - DNA, 201 bp, Bos taurus
gaaataaaagtatatgtccatataaagatttatatatgaacactcaaagcaccttgatttgtaatagccaaaaactggaaacaacccaaattgtccatccacaagtgaatgcatgtacaaactgtagtatacttgaacaacagaacactatacagaagtacacattacaatatggatgattctaaatacaatcctgctcca

SEQ ID NO: 3182 - DNA, 201 bp, Bos taurus
taaagcattcacatttggcaatattaacttcaaaactaaaagttttaaaagtaaacacatttttttttgactaataaaacataaacgatttaacaattctcacaaaatctcacagaactgaatgaaggaaaatcatcattactttttctacaactacagaattaccaaatgttagatcataaactcgtgattctgtagtga

SEQ ID NO: 3183 - DNA, 201 bp, Bos taurus
gggctacgtcattctttcaaaagttgtgccctgtccctttccctcctattacaactccaagaccctgaggaaggagtaagggggaacagtgcagcacagacttacactagaaaaggaagctatccttgaactatttttccctcccttccagaattagtaattgtttaagtctgctttttgaaactcagagaaggtctagga

SEQ ID NO: 3184 - DNA, 201 bp, Bos taurus
gccactgcaaagccaacaatggcaatgccaaagcagtctccaatggtatcttggaaagtctgcctgctaggtatgataggggcctgaaacctgaaattgaaattaagcaagtcagaatgttgcccacctggttagaagccttcaacagcatccatgtatcctcaggaaaaagtccaaattccttagcaatgccccagtggc

SEQ ID NO: 3185 - DNA, 201 bp, Bos taurus
gtgctgggtattctagtgcccacaagggggcagcactcctcacccaccaagcaggctttctcttcccttcccgttctacagggttggtctagggtctctttctagcaggtagcttggcctaatattaggtatctgccctttccatatctaccttgagcctctccttttactgggatccaagcactttgttttctcctttga

SEQ ID NO: 3186 - DNA, 201 bp, Bos taurus
ggcttctcttttccagagattctctctgtgaaagttcagggtgtggttgtcaatttgtttcaaacctcaaacaccgatttactggcagagccaccaagaacactggccttttccatctcttacatggactgtggcaacagacacgcctgggctctgagttccaggtcttcctcactgcagcaaccctctgaaacaatgctg

SEQ ID NO: 3187 - DNA, 201 bp, Bos taurus
atggcaagaccctggtttctcaccactggactgagtttacagatgggctaggggaagagactagactgatccttggggtaatggattagagtgggagacactgtaaaaacttatgtttagcttcatttagatatacatagttacataagaatatttacagacagtttatggcacaagttattatgggcctatacatttcct

SEQ ID NO: 3188 - DNA, 201 bp, Bos taurus
tgggccacagacagcagctgctacgagtcgtccatgtcaagtaactgataccctgccccctccttgatggaggttctcttggtcacagatgtgtgacacatgcatatttatcactggccccactcctaactggagaggggactggagaagaaatggggagggctgaaattatgctcagatgatgagcagagcccttcccat

SEQ ID NO: 3189 - DNA, 201 bp, Bos taurus
aaaacagcctttgaaacagagttcaaagtatttttaatacgggacatacgagggctcacttttgtaagtcccttgggagcagaagtgctaagtctcaagactgcaagatgtaaaccatggtggcttaggggggaacagtgcttactgcaagaatgagcttcacttttggtccatttacatcttattctgctcatatgaaca

SEQ ID NO: 3190 - DNA, 201 bp, Bos taurus
ccaagtagatgagcagaattacctgcaagagaatttctgaatatgaccttaccctatcaaggatatatatcaagaggatgtattgtccctgcacttcgccgtctggtgttttcaggggtagtatatattttcaatcactgctgctttaccaggtttagattgtcagtaaattgaatcagatccatctcaatagttgtcaac

SEQ ID NO: 3191 - DNA, 201 bp, Bos taurus
ttttaactctttctctttttatcttcctatacattgaaccacacagacatttctaaacttaataactgtctcaacctattatttttcagaagagaagttgagttctcccagtggtaaataatctccctgggaacatccagagtggggctagagtgaaatttttattaattattgattcatgaagaggtaatgagaacctcc

SEQ ID NO: 3192 - DNA, 201 bp, Bos taurus
aagctttcctttaaagaacaagaatcataaagcacagagatttgctacaagccatggggttgaaaggatgtagactgtaatcttcctagaggcctttcttgtcacacaggaggtgacagcctggagagggtgagaggagagaaaggtgaggtgagtgtggagcctctgttaatgttttggccctgctcctctcccaccata

SEQ ID NO: 3193 - DNA, 201 bp, Bos taurus
atgacaccactgaagtcttgaggttttagtccatggctggactctggagctccctctccacctctttccatataagaagctcccctggtgaggccccaggctcccagggagtctccagcttacctctattctatggtccattcttagaccaagcacagatggagccgattagatttgggtggccagtttccacccaaacca

SEQ ID NO: 3194 - DNA, 201 bp, Bos taurus
gacttgctttaaattcatccattgaatgataaggcgtacaatgccagagggcctagggcacaaagggtgaaagagctgctttggccaccagttttgctcccgagtcttagagcttgtaactaggcacgttcctcatggcttcacatgatccagtccagatgtgcaaaggttccacactgtagtgtagggccaaatccaagg

SEQ ID NO: 3195 - DNA, 201 bp, Bos taurus
ctactctagagattataacatgtattctctacttcttagagtctattataaatgagtacttttgccagttcctggacaatggcaataatcttggagtattttaactccatttgcccatcccacccacccctttgtgctgttgtcatgtgttccaaatctatctatatttttaagcttcacaatatattattatcatcattt

SEQ ID NO: 3196 - DNA, 201 bp, Bos taurus
ttaaacagccatcatgtgaaagttattcacaacgagccattccagactacttttaagaacacatctttgttacaggtagccgggaatctgcgtttgtttacgccatctcttcagctggagttgtatttgccatcaccagggcctgtagccaaggagaattaaaatcctgttcctgtgacccaaagaagaagggaaccgcca

SEQ ID NO: 3197 - DNA, 201 bp, Bos taurus
ttcacataatttcaatcacaaagaatgcttttttctgtacaatgcggctgaccaaggaatggaaacatggaattgttctggcctagggcttctctaactacgtaaaaaggtctataggacacaccacagcaaataactttaaagaacttcactgtgcttctttaaataattttcttccctattaacctagtggccaaagga

SEQ ID NO: 3198 - DNA, 201 bp, Bos taurus
gtgacaaagactaagattagaggatagtacagggcacggggaagataccatacaacttgagatatttgagtcaagagagaaaatcacccagtacaatacattgtctagggatttacacatgtgtagcacaactaaaggcaaggggaagatgaacaaataattcacaaattccatttacccaattttctggggcaggagggg

SEQ ID NO: 3199 - DNA, 201 bp, Bos taurus
taaagaaatactactgaggttgccaaacatttgatttgtctatggtgtgggtttcagacactagggaatgacatcacagagatttctttttgatattcatatgtgtctgccttaaatgaactatctgcgtaatatttgctaggcccagaattgagttttccccggttgttaataacctttaatcttgacactaccatcatc

SEQ ID NO: 3200 - DNA, 201 bp, Bos taurus
tgtgggttagatcaggcttgttaaagatcacaacaggacctacttaagaaattaagcttttaatgggggagtggtatgacaaaatgatgcttcaagaagctgacttcagttaagactcataggggcttatggcatataataaaagaagaggactcaaaatgtgacaaagtagacagctaattgtaaagattaaataaagat

SEQ ID NO: 3201 - DNA, 201 bp, Bos taurus
acatgtaaaatgactacagcatcagggagagaagcatggattttctgccaagactgatttggctacttaccactgtggagtgtccaacttaatctggttcataatttgcctccaatgcctgcagtgcttccacaagcagcatcgttcatgaatttgtagaatgacttaccaagtgtcatgtttctccatatatatcttgtc

SEQ ID NO: 3202 - DNA, 201 bp, Bos taurus
aagacatcatgaatgtcagacttcacacaccttgcagactgctaataactcttaaagtgtgtccttgtttcaaattgaagtcagtattggaaattttatattatctgctcttgctgaaagtattaaaaataattctgtaatagctaagctaaaaaagaaaattgtgtctttttacaactttgccttatttttggttcaatt

SEQ ID NO: 3203 - DNA, 201 bp, Bos taurus
acagagaaccaggaaaggaggggagctggccccccttgtctgtctctagccagacgagggggaccagctcacacaagaacatattggtttaaatgagaaacaccaaaaatggcctgaacttaagaaatgataatgtcagtgtaaaataatggactcaaaagttaactagcacagcgtgcctttttcacaggggataaacac

SEQ ID NO: 3204 - DNA, 201 bp, Bos taurus
tcttcattatgcagcttctaatttataggacaaataatgaattacgtatatggaaatgctttttctaacattagtttaagagattgacacaaactagaatgaattacacagttgacaaacagcagaagtcaaagaccttgaagctgtgattaaaaaaacacaaataagtttctgtatacttccttagtcttggaatcatat

SEQ ID NO: 3205 - DNA, 201 bp, Bos taurus
ccctagaaacaaagaaacaaactaattgccattaaagtttgtattgttgtcatgactagaatcctggttatatcttatgccttggaaaacagaaatacacttgcctgcattgtagcaaactagtgtgatgggcaaaaaggaagtgaatctggctttctcatcttaaagaaaacatgactgtggccttttcaaaatgctgcc

SEQ ID NO: 3206 - DNA, 201 bp, Bos taurus
tttagcatcagtgcttccaatgaatattcagggttgatttcctttaggattgactggtttgacctccttgctatccatccagtcttacatttagatctttagtcagtactgaatctgagttttggttatctaaacaagtaaaactattgaagccattttcagctgcataaactaacccattaaattcagaatacagataaa

SEQ ID NO: 3207 - DNA, 201 bp, Bos taurus
tatggacatgcagaggtctgaggacagcctagcatcactgaaaatctgaaagaagttcaatggaagaggataacccaacgcaagggagagaaatggggcatggagctgaaggaagagcagaggtcttaatcaactttgaaaaaggaggacatgctttccaaattcctacttataaaagccactctggaataagtaaaatga

SEQ ID NO: 3208 - DNA, 201 bp, Bos taurus
gatccaggacatgacatttacctgagaaacttccatttcttccttttcctccgccgggtttctttctcaggtgagataaggtgaagtcacaaatgcatccggagaatgtgcctttaaaggcttcagcacagaccctctgttggtctcatactcacaggaagaagagacttgaaataccctcttttttgttgtctcaggaga

SEQ ID NO: 3209 - DNA, 201 bp, Bos taurus
tattttcagtatattatctgattattatctatgtctctgaccttatccatcaccgtctctctccatttcattctattacatgggccttctgctatttctcgaatgcatcaaatatttgctgcctttcaagcttttgctccggctattcccacaacctaggccactctctgggtgcaaatcttctcacagcttcctccctcc

SEQ ID NO: 3210 - DNA, 201 bp, Bos taurus
agcaaactataaaaggtagtgttggtctggcagctgattcagtcagggtgcaaaccataaaggtgaagaatgggaaaagattcctgaaaaatggcctagcgaactaatgagggagtgaacatttttctttagttctttgagttaggaagaaaaatgagacctagaaaataaatacaaagaagctttcctctgaatcagaga

SEQ ID NO: 3211 - DNA, 201 bp, Bos taurus
aggggatcactatagatgccaggcctcaaatggatcctctgggatctctacgagcctaatttcccacctgaagcccatctgcagcctgtaaaaatggagcgggggccaagaacacggggccaataaagctccaggcaaaagatgattgtgaagtgggacacaagtttttcaccttcttccaattctgctgaccatgactcc

SEQ ID NO: 3212 - DNA, 201 bp, Bos taurus
tcttcttaagggctgaatcttagtcacagagaagttccctctctgttaaaatatcagttaataatgacatgtacttaatttctctatatttctccatatgctccctccctctgtacactttcagtttcttttacatgcacagaaatttgtgtaagcctgtattcagcactaaagaggtatgggttggctatttctgtaaga

SEQ ID NO: 3213 - DNA, 201 bp, Bos taurus
gagtggttagtattatatttaacccatggtgtttttttgcacgaatctttgaaagttatgtgaaccaaaactagatagcacaatatgcttgtctactaaacaagaaagacaggcaccacaaaaaaactattatatgttgaaagtgaactaataaatatgggcaggatgtttgactcccactctttctagaatagctgggag

SEQ ID NO: 3214 - DNA, 201 bp, Bos taurus
tgtctatgctattagaagtttcagtaagtacttattatttgtgcattgaatttatttcctaagtaatcctgaagaagaaattaaatggtagcactgaataaacaagcctatatgctaataaatgtatgatattgaaactaatgttactgctttttaataatattgcaggttgggagtttttacacacaaatgtgtgaactc

SEQ ID NO: 3215 - DNA, 201 bp, Bos taurus
tgtttgaaaaacccccttaaaatgccattaagaatataaccctgtaattttatattccattttttattggcttaggatattaaccttctaatagcaactgaatttttaatgtatattcaagtacactttagaataatttgtttcatttcagatataaactgttaaaaacaacataaatgatgttgggttttgtatatgtgt

SEQ ID NO: 3216 - DNA, 201 bp, Bos taurus
tttcatatatctcagcagacaacatcctaaaacattctatacatctgtacctaaagttcctctacctttaatgtctttattcctttgccccttggcaaacacccacctatagggatggtccttaaaaaaagatatctctttttttaactttttgttttgtattgggatatgtataattatgcccaacgtcaggggcgatga

SEQ ID NO: 3217 - DNA, 201 bp, Bos taurus
tcatagagcctgaccaaaactactgaggtgagaactgaatcctgttttcaagagagtcttttatgcttctcaaaagatccaaggagaagggccagggtgtcacacagggcaatgatgataggatcaggaagattcacttactggatatggaaaattaaagattaattattaattacggaaatataaacactttaactcctt

SEQ ID NO: 3218 - DNA, 201 bp, Bos taurus
tgtcatttgcagagtccatgggttttgaggcaactttttgggggagccctttgacccaaaccagaaaaaccataatcacagttaatttctctgcaggggaagctctagcaatcactgggtttgacagatgtaacaagatcagtttcacactctagaaagggagggattccacggatgcagcacagtttcaattctagcaag

SEQ ID NO: 3219 - DNA, 201 bp, Bos taurus
tgctcttatttgctatcctaccattaactggttcaaaaataacctccatccagttcatcctggaaaagcttatggcggtgaaataaataaatatgtaagcgcattgtgaattattggctacagatgagatcacaaggaggaagtcactatagggtggaatattttgattgatagttatagaatctttgattgtcaggaccc

SEQ ID NO: 3220 - DNA, 201 bp, Bos taurus
cgtattgagtatggctcctttctgtaagtgctttagaaatggtaacagtagctgtgtgtgtgtgtgaacaattacagtaactcagtaaaatggtctctctcctccttacccaaggatttcctgctgcagatatttactgtgttccgaatattgatacgcccagagatgtttccaaaggactggactgtcatgcgcttggtg

SEQ ID NO: 3221 - DNA, 201 bp, Bos taurus
tgcctcttgtctcttctgacggcccctggtgttctttgattttggggagcataactccaatctctgccttcgtcttcacatggccttttccactttctatttatgacaaccattctctccttttaccaaactctgctcaggctcctctaagccctctacttgacgaggccttagccttggcctattaaaactgccaactca

SEQ ID NO: 3222 - DNA, 201 bp, Bos taurus
tttctgagagttgctgtcagcctgggtgaagaggaccatattactggatcactcttattttgacaaaagatcattatctggctggaacatgtcctaggagccaataaatatataataggctatttcagattctttgaagataataagcataatctcattttgactatagactgtgtttcttaataaatgtttaaaaactct

SEQ ID NO: 3223 - DNA, 201 bp, Bos taurus
gagtcctgttagattttttcccactgcttcagtaactgctttccccactggtcctctatctgggtccccggattgtgaaatattgtcatcatgcatttctcttttgttttcttttatgctccagagttggaactgtgaaaggcagcttcatttattgtttagttgaatcagaatgactgcagttccacaaacaaattggac

SEQ ID NO: 3224 - DNA, 201 bp, Bos taurus
taaaacaaagcccaggaaattatgcaaaccttgcttctcttgacttgtctgtttcctgtttgaaacatgccaagacacccccatggcagagcaagataaaacaaaagtctgtcagatctagtcctaaggactcagtcggaagtatggcccaagatggcactgtcaagatgaatggtttgttacatgatcttaaaggtaata

SEQ ID NO: 3225 - DNA, 201 bp, Bos taurus
ttataggaaggaatgtctaaataccagtatctgctggtgacgctggtgcttacaggcttgcaagtcatccattccctcccctgaacttcctcattcctttgcccactgtatcctttggagcctaatggatcatttttcagttggacattattatacattcctgaccatgaaaaataagtgtgtgcagaggggtacagaatt

SEQ ID NO: 3226 - DNA, 201 bp, Bos taurus
tgatctcatttgtaatataaaaaccatcaccaatgttatttcaatgtacaagtcattaacaaaagtagactccttttctctgtgtatcaatctagatccacaagtaaattcagaaaatgagaactcggcacatattggccacatccagacctgtttgttttctgccacactgagttgtttgtttataccatctatcaaatc

SEQ ID NO: 3227 - DNA, 201 bp, Bos taurus
acaggaagattatgaagagagggtcttaaaaggcaaacatgaaagtttctgcatatcatgagttttaagtctgcgtatccagatacttaaaaatgtacaggacctttccattgctgaaggagcttataggttttgccataaagtgtttattcactaactgtaacagtgaatgagtttaagaattgtatcactgaagaggac

SEQ ID NO: 3228 - DNA, 201 bp, Bos taurus
gccaaaaggaaagataaaaacaaggatgctagtgaaatctaaagcctctgaaacctgtaactcctattttagcccaactcctagctattaaaatatatcaataattgattaataatatttttattatttagtatgttaatccatgggttcttgtactaaaggtctatttatctcatttcctgttaccctctacaacaggcc

SEQ ID NO: 3229 - DNA, 201 bp, Bos taurus
aactgaagtaggaagaatattttcacaccacataggaggtctctattcattaactttaagaagagttactaagagtcttttttgcaatcagtgcacactcatgactttctctattcttttttaatcactgacagttttttgactccttcatgaaagaacctatcctaagaggtttcctaggtcttttagctaaccaagata

SEQ ID NO: 3230 - DNA, 201 bp, Bos taurus
ctggtgtgctgcgattcatgggatcgcaaagagtcggacacgactgagcgactgatctgatctgatctgatagagcataaatgatctagtaaaatattataggcctcaagtttggatccaagttacaaaagtaatctgatgaaagtcaggtatcttaattttgtataaaataaacaagaaaagatttacttgaacttgata

SEQ ID NO: 3231 - DNA, 201 bp, Bos taurus
ttgaatctctggtcagggaactggttcccacatgatgcaactaaggattctcaactaagacccaagacagccaagtaaatataaaaataataataataattaggccagagaagccagaacaaaagtctggcattttttagccaaactattggcagcaattggatttcttattacatgataaaactagccccattgctttaa

SEQ ID NO: 3232 - DNA, 201 bp, Bos taurus
tgcttttggaattataaatttagtgagttagtgtattcaaaaatatggagtctgaataatgaggctttcgtatatgttaggcagaacccctaataatatactatctactttctgagagttattttgcctacctccaaaatattctactagaattataaatacatgttttaaaagtgcttaatattttttattcaacatagg

SEQ ID NO: 3233 - DNA, 201 bp, Bos taurus
ctatactgttctctagagcctttcttgatgtgttagtatacattctgtcacagacttagtgtacgaggactgtcttaagttacacatgaaagacacaggagaactaatttggtcacaaaacatccccatatggggggcttccctggtggctccaaggccaaatttgcctgttactccaggtgtttcttgacttcctacttt

SEQ ID NO: 3234 - DNA, 201 bp, Bos taurus
cttttcaaaattttgaaaaaatgatatgaccaggccccatttttcacaagctgaatatatggggaagacagagtaaactgttgcaagaaatggccatgtcatcatgcattgtgttttgtggtaataacctattaaaacaggaatggtatttttgcacatattaaactaaagtattttaattttggcctttaagccagtggt

SEQ ID NO: 3235 - DNA, 201 bp, Bos taurus
tggtcatttttctttcctgactacctggagtcttatcttcaaatgcccacatcaggactgtgcaacaattcaaaggaacacctatgcagatttgatagttacttttctgtgtatcttcctcttgtaaatgctttctactgtagttaacctacaccctaatctctgtctctgcagtctctcaaaaccagttttctgcatgaa

SEQ ID NO: 3236 - DNA, 201 bp, Bos taurus
agcattggaatctgtatttttatgtttcttaagcattgaaaatatgccctggttttcttatgccctggtctacacccagtgcttcctctcagacacttaaatgactttttgagtaattataaggaagcaaccagggtggctagccttcctttgtaagaagaatataaaataaaacagtcaatagctcttatttgagatctc

SEQ ID NO: 3237 - DNA, 201 bp, Bos taurus
tcatattgtcagtgaacttaactttgttccagatgtaaaaatagaagagaattcaggcaatcagagcccaaggccagctaccagtgcagatacccaaggcgatgcccagaacagcatgggttggaaaaaaaaaataaatgaattatcaggtaaaacgttaaagaaggcaacttgattcgtttaccaggtctgctgattctt

SEQ ID NO: 3238 - DNA, 201 bp, Bos taurus
cccataatgcttatcaacaggtgtgtgacaggagaatacccaaagccagaaaaagaatcacccagtagactagaagtaagctgtgttagcactgacatggcgctgaaaatagtggcctaactggaaaacctcatgattcatggagcactaggtagagtatgcagcaatcttgcctcagctgtggggaataattggtaataa

SEQ ID NO: 3239 - DNA, 201 bp, Bos taurus
catcaccactgtagcctgttcagagcaacacacaggatccttaaggactctacatatgtgatatataagcactcgctttatgtgtattaagcaacctgaagaactactgtaccttcttctgaaccctgcaccatctgacatcaactaacctcttatccagactccactgtagcaagatcactgaagggcaccattcactct

SEQ ID NO: 3240 - DNA, 201 bp, Bos taurus
tacctacagatggcagagtccactcaaggctactcctcctggttcagttttactcactctacattctctattaccatattatacttgattccttcagacacatccagcctatcttcctgcatctcttcttgtccttcttcaatccatatttaaagaaaacaattcagaatatgttacagccttgattaagctaagcaccac

SEQ ID NO: 3241 - DNA, 201 bp, Bos taurus
tgtagcacaagtgacttagctgaggtcattaacgcatacacgtcagtgtcagagaggtattaatagaaaagcccgggcctgagccagaatttagctgacacgcccagcccaactacattctctgacaggcgtgtgacattggtactatttccaaactcttctgggcctcatttttcatacttacaaaatatggataatacc

SEQ ID NO: 3242 - DNA, 201 bp, Bos taurus
tatcagctgagagctgacttcacgggctgaccacttcatacagtgaaaaagcaggtaattaaatcttcaaatctgtaggaatccacagggactaaacagcaacaagaaattttacatttgagacattttgagaatcaggtcaatgaataaacagatatttcagatttgattccagcatatatactgacacaaagaagcaaa

SEQ ID NO: 3243 - DNA, 201 bp, Bos taurus
aggctgtttctctgaaggtaattttgcataccatatttctaacaccatgactttgaccctagaatgactgcagtcatattttgacaatatctcttattaaagtattcactcttcaaccccagacaatggctttttttttttttaatgtacaccttcttgtctgtaataatggttaaaaagagaaaagaaaagaaagaagtt

SEQ ID NO: 3244 - DNA, 201 bp, Bos taurus
aattacatgaaaacaagagtgaaaaaagaaattaatttaacaccattctatatgccagtaccattccagaatttaacaagaaacacaaaccatataaccattaaattctagtttcattgatccaaatcacctcaaaggtatccaacccacccacccacttgtctcattttaaatatttaagaatacagctttttatctgga

SEQ ID NO: 3245 - DNA, 201 bp, Bos taurus
tgttcatttctgtctaaaacattgtaatttcttaagctgttatcaagccttcaatatagtttacgggccagcaaactatagcccatgggccagccatgtttgtaaagtttttatctgatcacagcaatgcttatttatttatatatcttctctgactgtttttacactactcctggagaacgaagtagttacaacagagat

SEQ ID NO: 3246 - DNA, 201 bp, Bos taurus
cttcaaagtgccattgcattaaatcacatcagggattcaaacatagtacaggactcagtcttctataagcaagagtttctgttcacactagttcatgttttgttattgtcattagtaatatcatcattattattgaattcatcttcatttagggcattagtcctactcatcccattatagttttcattttctcaacatgtt

SEQ ID NO: 3247 - DNA, 201 bp, Bos taurus
gctgcagacctgcagggagccccagtcagcgggtcatggccttcaaagcaaccagaactctgtcaatactggaatgactttccagggcaggggtatcatctccacccttttgctatttcattcaggcccaaaggtatgatcataactcaccttaccagatttgggacactatgggataaatgtcaccttaattttggtaga

SEQ ID NO: 3248 - DNA, 201 bp, Bos taurus
ggtctgaatgcctttctggaagggtagaggcagaactggagctcagaacgcttgctatgcctttcagaaggttgagacagagaatcagttgcagctggccgggggctacgctgatgaagccaaaggtcatgctgatggagctaaagatacagtcactgttctcaaggttgacagcttcatcaacagagcagaaattagtgg

SEQ ID NO: 3249 - DNA, 201 bp, Bos taurus
gtgtggtctgggcagggcccagcctcctcccttaattaaaaatatcatcttggagtttccggtcaatagagaatgaatttccaattgctttaccctgctgaggccagtctgcctcctggctcaaaacttctaacagcagtgaatgagactctaatagtaactgatagcagctaacctttttttaagtcttattatgtgcca

SEQ ID NO: 3250 - DNA, 201 bp, Bos taurus
gagcataagtcccagagccacagggaagatagattggatggtacagcaggcgggaagtgccaaggaaagatggaagctgtacgccacttccttctaggcccgcccgaggaaacacacagtcttgatcaaatgagtaaataaaacttcctgtataagtgcaattccattttcaagtctgaggagtgggccagtcctcttcct

SEQ ID NO: 3251 - DNA, 201 bp, Bos taurus
atttccagtctaggatttcacaagctagttcatggagaaattgaggaagtgaatgagccccacaccgagtaacactatgggaaatcagaagttaactcttccgatgctgtggcccacaggactcatctgcagacaaattctgattccagggctgttgtcacctctacttccgctcgagtatttgtttgatggaaatctcct

SEQ ID NO: 3252 - DNA, 201 bp, Bos taurus
tacactgtggacattgaaccacgtgttcagttggggtgtctacatggtcaccaggttggctgttgagtcctagcttggccatctgtgctctgtggcagatattggcaaccagatcgtcctctcctctaaaagtgctgcctcatgaggagttcatggcccttagcacctggtggacagaaacaatagcttggagggtggagt

SEQ ID NO: 3253 - DNA, 201 bp, Bos taurus
tgggccttgaggtccgagttcatctccagttccaagagggcctgggagatgcccaattcagactcctccaacttctctatgttgggcttcatgatcttcacgctggaaatgaacatggcctgcacctggcagatgtggccaacacttgttgctgccactgacaccagtaggcctaggaagagcaaatcttagatttttaaa

SEQ ID NO: 3254 - DNA, 201 bp, Bos taurus
aattcctcaagaagcatcagggtccttcctagacagactggggaaggaggtgggatttacccagcatcctcattcctcctctggcaggctcctaactcacgtaagacgacacggttgagtagggggctgctgccttcgcattgtctccattctgtttctgctccacctccaatctttggagcactatgacccgggaaccag

SEQ ID NO: 3255 - DNA, 201 bp, Bos taurus
cactagcaccacctgggaaggattaatcatgcttggccttctaacaataagccaattacaaagttttctgggcatatttagactttcagatgttgatactttgtaaggccatactgcctatggggcggcaatgcactcatttattgctctgtcctaataagtgctaagtgccttaaccatcttaaaggtcctggcctcctc

SEQ ID NO: 3256 - DNA, 201 bp, Bos taurus
ggctggaggaaaacagtaactccagacccctggagcgcacatgggctagaagaagagactcaggggagggtttccagtgggtgagacccacagaaggccgttgtgtgtctgagtgacagcattttatgccaccgcccaactgctgtatttacccagctctgcagagggtgacaagtctctggaatgtgcatcttatttttg

SEQ ID NO: 3257 - DNA, 201 bp, Bos taurus
ggataacctaaaactaaagatacaaagcaatttcctctgtgcagttttctaaggtctatactagttttaaagtctcagctcagaaactgaaggttacatggtgatgaaaaaagctgagagtgagcacagtatctctagttgggaaagtcactcgtaagaacattaacttggaaaatatcctaaaaattatgtatgttttta

SEQ ID NO: 3258 - DNA, 201 bp, Bos taurus
caaatattcctgacagtgattttaacaagttcagtatattcttatgaaagtagagaagctaactggattatacataacaaatgtctctctccagtaatatgaaaaatataaattaaaaacaagtttaagatactaaactaacaaatgccctaggaaaataattggggaaggcagaagaggcttaacaatactcttttcata

SEQ ID NO: 3259 - DNA, 201 bp, Bos taurus
ggcctaaatgcaggctgggaagcagcattattgatagggccgtgtccaaatggtcctctgtgctcagcctctaatggcctaataatgcattatacttgaatcagaaatactttgagttgcagtgcttattgccattattgaaaacacctggatgctccattcatcaaggttacatccaaaggggcccatttgtttattagg

SEQ ID NO: 3260 - DNA, 201 bp, Bos taurus
attgagaggcaaggagtgtgggtgctcctctaaagaaacttatttgtgagagggagtgatgatccagataagggatagctggctagtctaccttgccaaagacaagtaagtcagtatgtggaagagaagaccctggaattgttcttagaggaagtcagcatggcacagactgaaggtatagtaggtgtatgaatgagaggt

SEQ ID NO: 3261 - DNA, 201 bp, Bos taurus
tgaggatggaatctggggctgtgtgctcagtcattgccacttcttgctcctttgtccgctatacccagcaaataggccatttgggacaggtcagtaaggattgggataagctctttctcactctgcccctattctctcggtaccttggggccaatgacaactggatcttgattcctcctgaggctgcacagaatccatact

SEQ ID NO: 3262 - DNA, 201 bp, Bos taurus
taattataaaccacaagtaagctgtaaaataatttatatgttgccaaatatataaaattcaccatttcagttttcccactcctaaaccttggggcctctctcctggaaccctatgtcttttggttccacactatactggtcactagtttgactggttttagaaaagttcatttgggtttttccttaaaaacctgaataaac

SEQ ID NO: 3263 - DNA, 201 bp, Bos taurus
aagaggcccaagaaaactcccttgctacctcctccatgtgagattatagctacaaggggcaatctatgaactaggaagtgggctccaaccaaatactgaatcagctggcaccttgatcttagacttctagcctccagaactgtaagaaataaatttctgttctttttaagatacctagtttgtggtatcttgttatagtag

SEQ ID NO: 3264 - DNA, 201 bp, Bos taurus
tattctgccttgactgtcctagggcccaggactgttttgtggttagatgacagtttttctgtaaatttaagccaagcagaaatgtctgtcctcatgttttgctgaatgtgtggcctcctccctacacggtcctctcttttcataccagagtcctcttgggtgcctctctgcaaacccaccaggatagggttaccctcagac

SEQ ID NO: 3265 - DNA, 201 bp, Bos taurus
tctccctctcaaggctctggggagaattctttcctggtcttttccagctttaggtggctgccagagttctttgaattgtggtcacaccaataccatctttgagcccatggttacagggcctcttctgtctgtgtgtcaaatcttcctctgcctccctcttacaaggatctgtatttttgcctttggactcaatagtaataa

SEQ ID NO: 3266 - DNA, 201 bp, Bos taurus
cagaagtgaccctcagattctgttacggataaactgaatagcttcacctgggaattctcactgagttgcctggatgagatgcaccagtgtgatgacagtgcgtttcctcaggtcaagaggcggggctacacctggcaactggctttcctaagcatcagacctctacaccatactggcccgtactcaggtggtccttttcct

SEQ ID NO: 3267 - DNA, 201 bp, Bos taurus
gatttgaagaacttgagggagtgagccatgcagacatctcgggaaagagctttgtaagctgaagatatagcatatgcaagggccctgaggtaggattgtgtggggcatttttcaagaataacaaggggtcatttgtgctggggcagagtgaatgcgggagatagcagtagaagaagccagagaggtaatgttaccttaaag

SEQ ID NO: 3268 - DNA, 201 bp, Bos taurus
cgtagagtttgtgaactatttcagaatatagttggggattaaatgccccctagtggtcatgtgaggcaaaaattcaagccagatgcttaatacagaacgggggtagtaagtgaatttggaatttttcaatgactatagtgtgttttcaactcagttacatagttgtgggcttatgattaattaatttgcttttaacctaaa

SEQ ID NO: 3269 - DNA, 201 bp, Bos taurus
aagaatagatgtggtagaaaagcaagaaaagactaattccagcaagctacagcctgtataactctttaaaacatgtcatctactggaaagcccttccttattctctcaagcatacatatttatatattttccataaattccatttctttctcacattatgggttcttgatggtgaattttacagtttggtttatagttgta

SEQ ID NO: 3270 - DNA, 201 bp, Bos taurus
tccactattcttgcctggagaaacccatggacagaggagcctggtggattgtagtccacagggtggcaaagagtcagacaggaatgaagcaacttagcacacacgtctatagtgcctgtttcagcctgagtacacagtagacactcatttgtatgaaagagtagtgaattcacgaggtctcctatagcaagagcggtgaag

SEQ ID NO: 3271 - DNA, 201 bp, Bos taurus
ggaacttgccctgccttgtctccatcctagaaatgccatgtgaaatataaagtaagattaaccaatgcagcatttattatgtgtgaggcactaatctaaatgttttacttttaatcctatgacaactctacaagaaagggttcctacagttatttccatttatgagaaaaagaatgggaagagggaaaaagaggaggaaga

SEQ ID NO: 3272 - DNA, 201 bp, Bos taurus
cctaattaaatgcaagatgaacacattagagagtaagaatgaagtacagtggatcagtaagagagacatcaactcaacattgaggtctggttagggattaagataggcttgataaaggacagaaatggtatggacctaacagcagcagaagatattaagaaggggtggcaagaatacacagaagaactgcaccaaaaagat

SEQ ID NO: 3273 - DNA, 201 bp, Bos taurus
cagacctcttcccttcctaactgcaactggttatcatatcaaacaaaatgactgagaagtaaagacagaatttccagtccaagccctggggccagacttccttgatttgggctccacaacctatgttgggcatcattcataacctcaaagcctcagtttccttggctgttaaatggagctaatgacatttacttggccata

SEQ ID NO: 3274 - DNA, 201 bp, Bos taurus
atgaacattgactcagtttcgcaaagagcagttacacaaaaccatagttttgataccagatgtccccacccaaggcattacctcagagcatctgttaaatcagctttatgcattcagcacacctggcttctgccttaaggaaaaggcaccctcaagtacatctcctctctaaaaggaaaactccttagacacaaggaatta

SEQ ID NO: 3275 - DNA, 201 bp, Bos taurus
agcaggtccacagcagtgatctgccactgtcatagacacaccatggcttcaattctaccttctaaatcttctgaatatttttcttgtggccaagcctcctctaggaccttccagggaagggcattctcagaagcacaaccccaacttaacgaagccaccacatgcccactgtctctgacttcagctatacaacttgtcttg

SEQ ID NO: 3276 - DNA, 201 bp, Bos taurus
gattaaactcatgaatgatttggcttgaactcttgaaagagatcaaaattgtgtagcatagcagtgtttacaggtttatagatctgcctgggccatctgacgcccttgaccatgatttattattacaggacagagattatctcagactgggctggaaatggatcttggctgagttatttactcaccggatgcaatgtgtga

SEQ ID NO: 3277 - DNA, 201 bp, Bos taurus
cacacagagccagaataaatgagtaagccctggggagcagggtagggagcagtcactccagaggaaggattcactcactcacaggatggaaaggatggagggtgcaagggagggagggctcactgggaggaattctgcatctgtgggcacagtaccagaggctctggggttgatatctaactccaacatttacaatgagaa

SEQ ID NO: 3278 - DNA, 201 bp, Bos taurus
ccagatgaatcctggtggcccagcttacctgcctcactaccctgtaactcaagtagcctgaacaggaggtttgctgaatagcacatatttttaggctctgtgggccatctggtctctggtcttagttttgccattgtagggcaaaagcatccaaggacaaaatgaaaacatgaatgagcattagctatgttgggagggatt

SEQ ID NO: 3279 - DNA, 201 bp, Bos taurus
taatatcccagccaccgttgaaactcttttatgtttgaggctcaaattgatggaaaacaaatctcaacgcctcaggacaaggctggggccaaaccttccagagagtgtaataaatacattcaagctcttaacaatttagaaaataaatttctcttgcatgacacaaataaataagaccagtttgagacggtgaatagcttg

SEQ ID NO: 3280 - DNA, 201 bp, Bos taurus
gcctttgatactcaaatgggcaagaatgaagaaactaataaaaatgaattacagatggtaataacaaccctttccttgtctaatgtagaatcaacattcaaattttctccttaatgctagtttcctaaaatatgagctttttccaagaagaaaattcaagaaaatagggatatatatatttatatatgtgtttatgtataa

SEQ ID NO: 3281 - DNA, 201 bp, Bos taurus
ctactataacattttaataagccatttttcccccaaggaactcatttattttataaagctcagaaaataaaaatggccctttacttccattactgatactatcttttgtgttctactttagattttcctgtgcttatttaaagattttccccccaaaattggactctggctatcgatactctcacaactcctttcactcaa

SEQ ID NO: 3282 - DNA, 201 bp, Bos taurus
aagatataattgtattaggcctgtcatgtgtctatgttatgctagtcaggatcctcatcactttgttctgttgaattgcaacactttttgttgaataaaactggttttcagccatatagtcacgctccattctaatttctcctacaaaatactttatatgctggttgaaattcctacagccccttcatttcatttctctac

SEQ ID NO: 3283 - DNA, 201 bp, Bos taurus
ctcaggcctacttaaaacactcagttctcagacgaaagcactgtgtggccaagcaaagcactcatctttaccagtgagatgtccacagacggccacatccgtgctggctgctacggctcacagagccagtgactggaggaagctactgtttccatgctgccgctgggcggagcccagaatccaaacctgaagcgcaggccc

SEQ ID NO: 3284 - DNA, 201 bp, Bos taurus
atggctgtttttatacaggtgttttcatttctgtggtggccgggcagtatatgctgggctctgtagtgaaggtggggccttagcagaaaaggctgaagctatgctggcattggtgacttaggtcagtttgcctcagacttcggtttcaaaactggtatgacaagtcagaatgacttggagagctactataggacacaggcc

SEQ ID NO: 3285 - DNA, 201 bp, Bos taurus
tccagccagggcctccgcttggctgaacccacaggaagctagagggcaaatgtcaacggatacatggagaaaacagcagcggggcagagaaggtgggagacgaagtgtgggtaatggccactggaggaaaagcagcatagtccacctgctgttctgtgccagaaccacagtgttctaattattgcggctttgggaagatcc

SEQ ID NO: 3286 - DNA, 201 bp, Bos taurus
tttttcatttcatagcacagttttttgatgaccaggccagcttctcaaatcgtttttgggtttctttaatgagcagtcagtggcagggagcatgcacacacagagcaggtgtgatgataaaataatcagactcattttgtgggtggttatgggaatcattctcattgttttatagtcacaagctacattgtgcacagtata

SEQ ID NO: 3287 - DNA, 201 bp, Bos taurus
gggatgtgtgttgtctgagaaggggtgtttgtagcaggaaaccctgggcgttggagtcacacgaagacgtactgtgctggccaagcaagtcagttagcttcgctgagcctcagtttccttctcagagtaaatggggctggggtgaaccttcctcctgggtggacccggccaggggagtgaagttccatgcatagtgcctgc

SEQ ID NO: 3288 - DNA, 201 bp, Bos taurus
gggacagagaggcctgggcatgctgcagtccatggggatgcaaagagtaggacatgactgggcgactgaaaacagtgggcaggtagtggacaaaagtatcattcatatcctgggtggaatggagcaggatggctcaagatttcatcatgctactcaggatggcacacaatttaaaactcatgggttatttctggagttttc

SEQ ID NO: 3289 - DNA, 201 bp, Bos taurus
tggactgtatagttcatggggtcacaaagagttggacacaactgagcaactttcactttaaaggtgaaccttgggtcttggattaatcttaaatggctccgtggtctgtggcctaggcactcttgcgggtatttagggcctaaggcttgggtcacagcacatattcactgagtttacaatgtcatctgtcagtaatgctat

SEQ ID NO: 3290 - DNA, 201 bp, Bos taurus
gtttactgacttctgttcctcttggggcctctgagtcatcatgatctggagcaggatcagttccgggtgatctcacagactcacaggggtggttgtgcacgtatacttccccagcttgctcaggccacagaagcccatcctttgcatctgtgatgtgtgtcattgtaacacccatagagctaccgtatttgaaggtaactg

SEQ ID NO: 3291 - DNA, 201 bp, Bos taurus
agtcgctcagtcgtgtccgactctttgcgaccccatgaatcacagcacaccaggcctccctgtccatcaccgaaagttacatacatttaaaactgcaacatgaacagattatactctaagtaatgacaatttaactttcaaccaacattgagtgtttgttttaaatttttactatcattaggcattggtaaatatttgttg

SEQ ID NO: 3292 - DNA, 201 bp, Bos taurus
gtctgtgctaagaaaaggtgatactctctttctggattttaaggcatttataaactgatcacaccttatttgacagaaaaatatctccctttgctcctagtatgagaccttctctctagttgtaccatcttctgcatgctttcctgcacaaattcagtttacttctgcttctatgcctttgttcaagctcctattggttcc

SEQ ID NO: 3293 - DNA, 201 bp, Bos taurus
agttaaagctgaattagttcactgtctaaggaattaggcaataaagtaaatcaaaatgacaattgagttactaagtttagaggggtaaaagtatagggctctatgggatttcatagttagaaccctcagctcatcattgacggtttggaaaaaaccatcctggaaaatacagggtctaagcttgattctaggggagaatac

SEQ ID NO: 3294 - DNA, 201 bp, Bos taurus
cttaattatttaagactgacataacaatagaaagattcctgtgataaaaaaaaaaaagcgctagctgaaactggagttcactggtacagtacacaaggtagtgaaggaaggtaaatacacatacacaaactcacaaactctagtgattgttttccatttgaaagacaaagaaaaccatatatctgcattttatatacattt

SEQ ID NO: 3295 - DNA, 201 bp, Bos taurus
ccctggcacagccagctgcttctgccagctgacgttcccggggcccagaacttgttagatgagtgagggaacatagtcacaagggccgaggggctcaggcgtaggtggcacaatggggcagggttcccaggttgaaggtcagagacacggaggcagtgaggaatccatcctcccaacaactgtttactgagcagctagcat

SEQ ID NO: 3296 - DNA, 201 bp, Bos taurus
gctgcctgacctcagctggcccgggctgcagggaaaaggaggcccagggctttctgctgacttggtgctgaacttaaaggatgagtccctggcctccttggtgcctgctttcccataaggacactgccagttactaagcagcaagaatttacatacatcatcacatgtttaatcctgcagcctccagtccaggtggttact

SEQ ID NO: 3297 - DNA, 201 bp, Bos taurus
ttcttgtttctggcctagctctagccttcggtacagctgatttttctgtgtatcttgggaagattaaagggggtgaattaggaggtgtaagtcttcagctgtcataaccttcatggcctgtaatttgtcattgtcaggttatgttccagcaagggctgaggactgtggaaaagagctcaaaacggaaggaagcacacttta

SEQ ID NO: 3298 - DNA, 201 bp, Bos taurus
tttctccgccctccccccccaccccacatggcatccccttccccatcccagacattctaacctccactccggcgaccctcgggccaaaggacaaaagaggtttgaggaggcaccagagcactgaccgctagcaggcatgcagaatgcaaaaggggtgctggccctggaagactgccttgccttcatcccaggctaagtctc

SEQ ID NO: 3299 - DNA, 201 bp, Bos taurus
tgcccattccatttcaggttataagaattcacctttataaagcacttcatgtaatataatacctgtattttagcttatgaggtatttcattgcattatgaccaattcagatgtgtctggtctcacaagcagcttggtgctgggaaaagagagccctcatgtggttgtccttggagctgtatggctggtacatggtaccctg

SEQ ID NO: 3300 - DNA, 201 bp, Bos taurus
actcttggggttcaattccaagcttctggttctacctgactggatgtgagaataccctgtcctctctaaattctgatgtccatgcagtgccctaggaaaaggaggcctggattaaaccaccaagctctccagcccatgaaacctccctcccttccgcaaaatcaaatttcaaaatgttccatatgaaggatggctgccttc

SEQ ID NO: 3301 - DNA, 201 bp, Bos taurus
acctgcatgaagttctatgcactttgtgtaagttatcaatccgcaaaaaagtcaaaagaaaatcacgtctgaaatccatcgggccaccaggtagtgatgattgtgtgtccaggaaacatcaggcacagtgcgctctggtactctgccttgcctttagtcctccgcccagggggcctccaggcgctgctcagggtggagctg

SEQ ID NO: 3302 - DNA, 201 bp, Bos taurus
cctaccccttgaccgtttgcagttgaagtgggaaccatctggtctgctgacggaaaggagtgatgctcggaggtcatttaaagaatctgagggagaactcggatcccttagtttctgcagagcttgtgtcccctggagaggagtgctgacttactttcctcagagcttcaggccccttcctgaggggaagcccagggaagg

SEQ ID NO: 3303 - DNA, 201 bp, Bos taurus
ttgctgtgtcttgtccaggagctggccatatgtgccaggacccatcagcctggcatcttgggcaccgcatttgtacggagccagcaactcatcacctactgagcagctccagggaatggcccagctgcccaccgctgcttttagatctcccagtgggtactcaccagacaatgtgtgagatctttttccttctgctgagtc

SEQ ID NO: 3304 - DNA, 201 bp, Bos taurus
tcatatgaccaaagctgtagaaacaaactatcaacctggatacagcccacaaggcttatacttgtttatcacctgtttcatttcaggttctgtaagacacatatattgtccctatcatatttatatttgctgtcttattagctattccaaaaacaatttgctaaaggttcagttcaattttactaaagctcaagtcttttc

SEQ ID NO: 3305 - DNA, 201 bp, Bos taurus
tgttcacaagttcctatgttctgttcttttataaagaagttttcttttcaccagatctcaatcggtctaacggttgggtaggcctgcagtgtggctctacgtttaaaattcatgcagaatccaatctcttctcaccatcgaagtttgactcaaaaaaatgaaaccctcatctcttatctggatcactgaagtggcctccta

SEQ ID NO: 3306 - DNA, 201 bp, Bos taurus
agcaggcaaagcaaaacagtctggtcttcattccttactcttctccattgttacgtgcttggcctgagcctgcaaaggctcccgtgccagtctggggtccggggacatttgtgacactggaaccctggaatcaggactctagcctctgggtgcagcaggcacatgaccccctgaggtcctgctgtgaacccaggaactcaa

SEQ ID NO: 3307 - DNA, 201 bp, Bos taurus
aaaaaccaaaaggtctatctgtgagagtgctcaaccaacagcaacaagggaattctcttgtaagaaaggctttgtctggggaagaccacatcgctgccaccaagtgaggtctgcaagcttgcacactgcccaccactcagtacactctctaacagccatgttaaaatgaagaagcacaaatcaagacctacccgaaacaca

SEQ ID NO: 3308 - DNA, 201 bp, Bos taurus
caaagctcttgagacagataagcagctgcatttagcttgctctgcaccattggtgattaagccaagactggtcagagagcacattcggaactgcggcccccggggacaacaccaaggtctgcatgttcggttaagaaagctgctgagtaaactcgctccacgtctcactctccttttaactacttcacttcaatgatagcc

SEQ ID NO: 3309 - DNA, 201 bp, Bos taurus
agttgggtggttctggctcagggtttcttttgaggctgtagtcaagaggatcaccagggttgcagtcatctacacttgatcttagccaaaaggccgagaagggataaggtcgcagtcatctgaaggctgtattggagctggaggacttgcttcccaagtggctccctctcatggttgaaaaggcactactggctgttggca

SEQ ID NO: 3310 - DNA, 201 bp, Bos taurus
acaagcaaatgtcctttacatagtctatatcatgttattcaaatacgtgtgctgtttattggtgatttcgctggttcaaacggcctccaaatgtattcttaagcatagaaggctatgatgtgcgttttggagaaaatacttgttagatgtgtattaagtcattcaggcatgacgtatactgttgttggccatgagttcatc

SEQ ID NO: 3311 - DNA, 201 bp, Bos taurus
cctggtgacctccaaacctgctgtgtcctgggcctttgatggcacaacacgcccagctgctgctccaattgttctccaggaacagatggccactcaattcgagagacccaaaaaggccagaggactgctgcctgtcctacaattcatctccttcatccacaacagtgttcatcccaaactgaaggactgtggggtctccaa

SEQ ID NO: 3312 - DNA, 201 bp, Bos taurus
atggtagtattcatgtctaaaagtttgatttggatcttttatatacatatcatgaactctttgaatatatggaatacagtctgaatacagttatagtgcccatttcaatgacactgtctgctcatttaacatctctgttagttctgaattgatatgtctcctcattataggttgtacttgtctgtctccccatatctgtga

SEQ ID NO: 3313 - DNA, 201 bp, Bos taurus
gaaaataaagtggaaaattatttcacatgcgtgaaatctgtttaccaactgcaaaagtctaaactgatgttgaatcctgttgctactcttacattgtttacagcacaggttccggagatcagtaaacaagcaatctatggaataatttctgaaattaatttcataaaagaaatgatgccgggcatgaccgttttaattaaa

SEQ ID NO: 3314 - DNA, 201 bp, Bos taurus
tattttacaggccaggaagctgaggagaataatgtgtccaagaccacggagccaggtaggtgctgaaaacaaggtaaatccccaggttttctgatttgctctccattccttcccacccatggccccagccaaccaccttcttacacattcagagtgttcttttatatcaacatttaaaaatatttcatgaattggggataa

SEQ ID NO: 3315 - DNA, 201 bp, Bos taurus
tagagctacatgggcagcagaggcagacagtggaaaaagtggggccctccccctgttttttcttgcttgtcgttccagaggccacacccatgccaccacgtgtaagaatcaccatgtcaaacttctggcatctttaatagggtactaacaactcagaaaactgtggccaggaggggtagcaatttaagggaagagtttcac

SEQ ID NO: 3316 - DNA, 201 bp, Bos taurus
tccccacacgcctcacttcatttcccttagtggaagtgtcaggccctttgctctcaccatcagaagagtatggagaactcaggcctgccccaggctgagagatcattcactgtgttatttcccttgcacccctcacccccaccgtttggaattaggcgactttatcctgccctggcttccaggtggcccaatgtgacacct

SEQ ID NO: 3317 - DNA, 201 bp, Bos taurus
ccgataaaatacacactcttctatctctgaaaaaggcaaatgaggggttttattgccaggtcttataacaagacaacttgagtgataacatcactggaagttatacttttttagcatttgtactaatttccaatagagaaaaaaaatgtttagaaatgtcagacgagtcattcatttatcagatgtctttttatgtaccta

SEQ ID NO: 3318 - DNA, 201 bp, Bos taurus
cctaaattcccaacagaggtaccatcaaaaaaaaaaaaaaaaagaccagatgtagagacatagaggtagcatgcttggaaaagatcacgaaaggaggtcaatagagatgggtcctgaaccaccagagggcagcatgtggtggccgtcccagggaatgaaatgtattttagggtcccccattttccccaacagctgcctgga

SEQ ID NO: 3319 - DNA, 201 bp, Bos taurus
ctatctccttggcctggggagccgcctgtccgcgggccccagcaacccacctcaggggaagatctctttttatcagaccttctcttttctcccttttgtacatttgccagaagggccaaagaagacagatagcagctaaatccgcaccaccccccaaatcccgaggcttgctcatgaagtaaatggttggtgttggtggtc

SEQ ID NO: 3320 - DNA, 201 bp, Bos taurus
tatttctctctctctctctttttttttttttttttttcatctgggcttccacattaattgaatggattcatttggtgccatttttgttccctctagaattttggtcatgaaaattaagaatcataactctcatatctcacacagtctgtgagtaatggcaggatgctttattgctctgacctttccagttttctaagtttt

SEQ ID NO: 3321 - DNA, 201 bp, Bos taurus
ttaccaagtctggctggcctggagcctaaggaagggtctttctcattgttattttaagcttaattattcacgaaagccattcccaggtcttcatctcaaccaatagccacagatgatgggccatcttcaattttcaggctgaaaacttgacatccccacctagatttccaagtgtttgctgtactctcaccaattcagctt

SEQ ID NO: 3322 - DNA, 201 bp, Bos taurus
ctgtgtcgtctgctggccctgccacggaccacaagtgtgcgctctgtacaaatcctttagcctctctactttctcagaggcaaaagagggtggccatccccacttcacaggtgtgctgggaggatgatccgacaatcatatatgagatagtattgagtgtgcgcttggcccttggaggatggtcagtgtatattctattca

SEQ ID NO: 3323 - DNA, 201 bp, Bos taurus
gaccctggcacaatacaggtttggactgcacaggtccacttatatggagatatttttcaataagtttattagaaaatgttttagagatttgtcacaagttgaaaaaacttgcaaactgcaaagcctaaaaataagggaaaaaattaagagaaagttaatgtcatgaatgcataaaatataggtagatatatgcataacata

SEQ ID NO: 3324 - DNA, 201 bp, Bos taurus
agatcatgactgagggaacagacctaacaaaataaaatttcacaaacaccagagatgaaaaagcttctcagaagaaaccattttcacctaaattttcccccgctttagtttagatttctctgcatgtccttggccttcttcttttccttatgtcctgcaatataccttgctctccatttactgttgttctgagacataaag

SEQ ID NO: 3325 - DNA, 201 bp, Bos taurus
tgtatagctgagtgtagtgcttaggtcagaagtaaagacatatatcttagcttctccacagaaaggatacggtagtgcttgcacaacagggaggcagagtgaagtcatttagacaaatgaatcacccagagacacgccagtcaaaagacaactcatagtcctcaaggttccaggagtttccaaaagtcagtggtgagagta

SEQ ID NO: 3326 - DNA, 201 bp, Bos taurus
aagatttctctggaagcaaaccacttaaaacaatccacattgaaacttacacaaaaaggagctcatccgtggttcaaagaattatcttctaaaaccttcacgttttaatttgtattaatgacatcttcttaaacatgttttgcagcgtgcagcagcacaccaataaaaaccacttgctgccctttgaactctgaatgttcc

SEQ ID NO: 3327 - DNA, 201 bp, Bos taurus
tttggcctcactggtgaggagaattctacaaatgtaactggctattagtgaactaggtccgccccaggatagtaagtaccctatccttagaaatagtaaagtcttggccaagtgaggattttcagttgataaatgtcaaaactgatacagaaatacttgctaagcttcatcagtactgacacaaaaatgtcacaataccat

SEQ ID NO: 3328 - DNA, 201 bp, Bos taurus
cacatggtagggatgagttagtattgcagcatgagtctataccatgacatctgctggtggaagcatggtttgaatatggtttggagccagaatcgagtctagaaaattcttctcctttattagatatataaaactgtaagtaaaagattcagttcttatttaagtatatttgatatggaagttctttctgttaagaatata

SEQ ID NO: 3329 - DNA, 201 bp, Bos taurus
tgtagggaatgagctttttgctcatcttttgctgagctctgtttaccagagcaaaccacaggtgcactcaggtaaggtaatacacttgtgctattcatttcattgtgtcagtttgtatgttatttcatctgttgaaggaaacaagcttggaggtgagggtttttcttaactcatttttgctgggcttaggaaaatgctctg

SEQ ID NO: 3330 - DNA, 201 bp, Bos taurus
ctgcctattctgcatatttcatgtaagttgaatcccgtatctggtctttgtgactggctcctttcacttaacataatgttctcaaaggttcattcatgtcgctgcatgtatcagaactttattcctttttatggcagagtcatgctccattgtataagtaaatcacattttgtttactcatctgtcagtggatatctgggt

SEQ ID NO: 3331 - DNA, 201 bp, Bos taurus
tcttataaaaaggaaccccaagttatgattcagttgggcacagttctttaggaaaagtagctggactgtggaatctctgccaagggctgcagagtgcttctggtgccctgatatggtggtggccttgtagatgataaatctcttaaggacaaagtttctgttttatctaccatataatccctcaagttgcagattcaggac

SEQ ID NO: 3332 - DNA, 201 bp, Bos taurus
aaatgaacataaaaaagaatgacagatgaagaaaactaacaagtggttgctggctgggggatgagagaaacaggtgaggaagattaacaggtacacggttgtaaaaacagaatcagtcacaggtatgaaatatatagcatgttgaatatagtcaataatcatgcaatacctttgtatggtgacaggtggtagctagactta

SEQ ID NO: 3333 - DNA, 201 bp, Bos taurus
agccggggctaccagaagctaggagaggcagaggaggctcttcctgtggagatagcatggtggtgcctacaccttgatttcgtccttctggcctccagagctgtgagaataaggttctgtgttttaagccaccacgcttatgggaacttgttgcggcagccacaggaaaccaatactgcaagagttttgggaacctggaac

SEQ ID NO: 3334 - DNA, 201 bp, Bos taurus
catttattatttatttatttggctgcaccggatcttagttacagcatgcgttccctgacaagggatcgaacccaggtcccctgcattgggagtgcagagttttcgccagtggaccatcaaagaagtcccttgagtctagaaagataagcaggagttaggcaaagaagaaagagaaggagatttcttaagaaggaatgccca

SEQ ID NO: 3335 - DNA, 201 bp, Bos taurus
agttttggtgtgcaggcttctcattgcagtggtttctcttgttgcagagcctggctttagggagagagggcttcagtggcctcagctccccagctctagagcacagactcaatagttgtggtgcacaggcttagttgttcagctgcatgtggaatcttccctggccagggatcaaacccatgtctcctgccttgaaaggag

SEQ ID NO: 3336 - DNA, 201 bp, Bos taurus
agcatagaacattgtaagtctcttacatgctactgtttcttggtacctggcatgtaatgtgcatttatttcacagctgaccaaaaggctcgtgtacaaaatctgatgaaaatgctagtcctcctcctaaggaggcggtactagtgataaagaacctgcctgccaatgcaggagacataagagacacgggttcgattcctgg

SEQ ID NO: 3337 - DNA, 201 bp, Bos taurus
ttgcaatccaaaatatacatcatcatggcctctatctttcccctaagaaactcctgaagatgagctttcaaaacaggcaatggagccattttaggggtacctactgggcctggaggagctgcttttagggaacctcctgaagtctaaaaaaagaaaagaaaaagactgggaagatgcaaagccaggcagctgtaaagcgct

SEQ ID NO: 3338 - DNA, 201 bp, Bos taurus
atccaagtattctggggtttaaggattttaaactcctttctcctaaaaccacagaagccaatctctaactcagtaccaggcctacagaatattcctaatattgaaagattgcagcattccatacagtaagaaaggaattttaaaaatagttacgttctaggcctacatgggcaggactttggctagctttctgttgaagca

SEQ ID NO: 3339 - DNA, 201 bp, Bos taurus
gtcctcctctttcagaatgttgtaacctaggcagaattgttggccattgatgaaacccagccctattgccgacctgtcttccactgagtagctctattgtcttgaatgtatcacttctcagggccacatttcttctgcaaaatcttcatgatgtacggtattattgtaaaatccttcccagctatggtgatttttttccta

SEQ ID NO: 3340 - DNA, 201 bp, Bos taurus
agttgttcttattcaggattttaacattgtacgttaccctagaaagtaattctatagcagtgcctcttttctctcaaaatcatgtaactggataaagtggaaaaggtgactaattttattttcagtttcagcattaaatcctttgttgtattactactttatttgtctttatagtaatatctggctaaaactgaagtcatc

SEQ ID NO: 3341 - DNA, 201 bp, Bos taurus
ccagctccaggcccctatagtaagaaagtacacataaaagaactttccatggttactgtcaatgtataagggttagcacacaaactgtacaacacacttactaagtaaagagtgaattaattcaaatgttcttgggaaaaaaatattttctatgttaccattaagctcttgcccaaatcagatatctctgggacctggagc

SEQ ID NO: 3342 - DNA, 201 bp, Bos taurus
ccaccgcctctcaatgtggtctctcccagatgtatagacgtggtggcacttccaaaaggacatgatccttgtgtgtgcaggggaggagagggaggtgttctgtctggggccccggcggatgggccattctcagtgtccactaggagactaagcagtgctgctctgaaggcacaagggactgcagcccctcattctaactga

SEQ ID NO: 3343 - DNA, 201 bp, Bos taurus
atatgatggaatattgtcatccttaaaaggggaatgaaattctgatatatgccacatgccacaacatggataaactttgaagacattagactaagcaaaatacatcagatacagaaagacaaatattgtattattccatttaaatgaagtaactagaatagtcaaatttatagagacagaaagtaaaatagtggttaccag

SEQ ID NO: 3344 - DNA, 201 bp, Bos taurus
catcatctggttcttttattttttgctaactcaaatccattttcaaaatgtaactcagtctctagaaatccttctggaattcctctggaaatcctcagatctctccagtctgattaatttgaactcttcaagcccctactgcctccgggcagaccttgggaatcctttttctcggtgctttgttgcactgtacttacctgc

SEQ ID NO: 3345 - DNA, 201 bp, Bos taurus
tgagctcctcatctctacatttttagaggcctcctctgtgtgttccctgccactgtttcctgatgcctccaaggaggacctcattcaaagtatgacctaatgggccctggtctcaccttattagcctgttcctcttcattcctgtaacctaatcctttgtttatcaataatttgtcaatcatgtggccacatcccaaccag

SEQ ID NO: 3346 - DNA, 201 bp, Bos taurus
gggggtgggtgggaggaatcgggaactaataacgagcaccactttcgactacctgaaatgtggaccccaaaaacattggccagggttagggtggtggatcgttaagtgtaattcgttgactagaagtcgcttcgggtatttccggaaggggccagtcggttctccgcgcagacggggtaggataggagaaggtgggggagg

SEQ ID NO: 3347 - DNA, 201 bp, Bos taurus
gacctttcctcacctttcccattgaattagcagcctgcatctccactctttatgagaatcaagggcatcacagccctgacactcacagcagctctatcagtatggctgtggggtacaaatgatttttgtatgcaacttacatggttcagaaaggtcatgtgatttcatagtgatcaaaggaaaatggtgaatgtttgtcaa

SEQ ID NO: 3348 - DNA, 201 bp, Bos taurus
gggctattcttctatgaaagatgctctgcctcctctacttttgacctggcagggactccctatgtcactcaaaggcctacagagtccttcataatgcaccttctctaactttccatgctctgatttgtctccagtcatgccctgggccccaagctccttccactccggccacacttgcctccttactggagtgccccaggc

SEQ ID NO: 3349 - DNA, 201 bp, Bos taurus
ttagttgccatttttttaggccaaaaggagtccaataatgacaatttgatatggtaaaacctggtataatatccatgcatcccacaaatacccaagtgcctatgttgtgccttcggccagttgccatgggaggtggaaaatgagaatgagtggctcctcctcggagcctctagtctatacagcacaacttgagtactaggt

SEQ ID NO: 3350 - DNA, 201 bp, Bos taurus
agatgaattgtttcttagaagggtaccccactgttgtctctgcatccaagccactgataccttttgtgtaagattgatgctgggcctttaaattttttttaaatttaaataacattaaatttaccatttcaaccatttgtaagtgtatacttcagtgtgttaaatgcattcacactgttgggccactatcaccgtcatcca

SEQ ID NO: 3351 - DNA, 201 bp, Bos taurus
tctatctgcaacccaaccatttctcccacctcctctgctaccactcgagactaggttacttttgtctcttaactagttacttcagttagtgaggattctgagccaagttccaatgtgtgtgtgtcagggctggggcagtgcatgggaggggtgatgagtttctccacagattccacaaaaactctgcttcatcagttatgt

SEQ ID NO: 3352 - DNA, 201 bp, Bos taurus
tgctgcacatggggaggtataatgactgtaattacttggatgacatttaaaaattaacaaattctccttcaaattcgattcttccctgtgtgctgccagcgctctttcctctaatcacgtcaattaaatgttcttacagtgtcaccctccataacaccctttaatgtagtgatttgggaagtatatttaaagcaattaaat

SEQ ID NO: 3353 - DNA, 201 bp, Bos taurus
gacagtgtcagtggcacgaagtaaccaacaggaagcggtagggagtgaatcacagggcagccagaggccccatcatacagggcctcacagggaatataaaacttggtgtgaggtctggtctgtgcctcagtttccttattttatgcagttgtggtattatggaatatgaagagtgtgaactatccagggtgtaggaggcct

SEQ ID NO: 3354 - DNA, 201 bp, Bos taurus
tccatctccactggggccatgttgtcttggttttgatcatttccctcaaattaagatttctgcataaaacccccgtgtctgtgtttggctggcagttttatggctgaccaaactgcactggccgggggttctggttggctgaatgtttacacagcctgttaatcagatgaggagaggggaatggatgtggggactgtctgt

SEQ ID NO: 3355 - DNA, 201 bp, Bos taurus
tctaggccagagtttctcagtctcggcactgttgactttcggggctgggtgataattctttgttggggggctgtcctcttcattgccggttatttagcagcatctctggcctcgcttcatacattagatgccagtaccattctaccttccaactgttattatacaaccaaaaatttctccagaatttactatatgaattta

SEQ ID NO: 3356 - DNA, 201 bp, Bos taurus
ccattgcagcagaagaaatgtggtctcagaggccatcaaaggtaaagggaggtctgtgctcaaaatgttgagaagagaggaaaggaaagtatggttagagactagagtgctattggcctgaagacaatgctttgtcagcttgaagacattgctgtcaggcaaatactagaaagcccgtgttgagagaaaccactgtattat

SEQ ID NO: 3357 - DNA, 201 bp, Bos taurus
gccccactgaaaaacacagatcagaaatagcaatacgggagtcataactgatttctgggtgaatagctttatcaagccaaaggccttaatcaaataaaaaaccattctgaataactgcatttggcacaggaaaacaggcaaagaacccaaaagatgaggccaacccatctcctattcccttccacagacacaccaccaacc

SEQ ID NO: 3358 - DNA, 201 bp, Bos taurus
ggcatggtaaaagtttagagtcaatgtagtagaaaaatacatcatgtttgaggtaatatcattatgtaatatctgtagagtaattcttttttggccgtgccgcaaggcatgtgagatctcagttccccaatcaggggtcaaacccgtgccccctgcagtagaagtctgtagtctcaaccactggcccaccagggaagtccc

SEQ ID NO: 3359 - DNA, 201 bp, Bos taurus
tcaggccagttgctggagttgcctcacaggccggcaattcatcctgatcatccttcccatgggaagaaatgatcaaataagcttgtggtcagtccattttgaatgtgaaaagccaactgaggcctatcaagggaatggaatttatgtattcagtcattggtttaacaatccaaaaaaatcagtaactattatgaggtaggt

SEQ ID NO: 3360 - DNA, 201 bp, Bos taurus
gaatggaaaaattgtgttcagcagagttggggttagtaagcagtcccaaagctttttgtaagtaaaactattggcacatggccactagattcacttgtctcatctagggctgcttttgtgccgcaacatcagagttgagtagttgcaagagataccgaatggcccacaaagcccaaaatactgactggtgcttcacaggaa

SEQ ID NO: 3361 - DNA, 201 bp, Bos taurus
aattttacaactccagatgctggaatactaatgctatgtttcaaaattctggggtgtagctctagccttattcatagtaaaatgcaatcagacataagacggatctttggggacggttatacaaagggagttcagccactaaaatagaaaagtgttctggccactgggtgtttttcatgtattgaacttgaggacaacaca

SEQ ID NO: 3362 - DNA, 201 bp, Bos taurus
taacacttctgccacagaaaatatttctgacctctgggatcctgtgtctttagtagttaatgtaaatatggtctcccatgatcagcctctaaccattgctctgtgtgtgctggatcattagactgctgtaaaggactattttattgtcctctgagtgggtctaaacagtcatttaagaaatttagtgcctgatttggtccc

SEQ ID NO: 3363 - DNA, 201 bp, Bos taurus
ttaaaggataaaaatcatcctagaaaaattaatcttttgttctctacttagtatcggttctaatcaagtaatggggcttccaataaaggggcctccaagaatttctcatccttcccctgccttgtggggacagaggacaggggtaccttggtgataagactgtggccaactcaaccctttctgtgactgtggctatttgct

SEQ ID NO: 3364 - DNA, 201 bp, Bos taurus
cacacagtttgcactagaattaaatgaaatggatccattgttaaagtctttattaccacctaccgatactcgattcaggccagatcaaaggtaaggatatttttcaggtctttatcctccagagatgtgaaactataaaaaggcttagtaacatcttctaggccaccaatggagcctaaaagagagagattctgtcatcaa

SEQ ID NO: 3365 - DNA, 201 bp, Bos taurus
gctattttcttcccatgtctcttaaaggaactggaagctctaatggctcttgtttgtttcaatcacttcacataacctctgctgttggtggcctctccaacatagattccccctttcttgtctctaacacaatctacacagtttagctgcccaactctttcccacccattccagaggccctggggaaggctgacacctttg

SEQ ID NO: 3366 - DNA, 201 bp, Bos taurus
gctcagaaaagttgaaaatcaaaatactgaaaagcatatttcaggctaaagatcaaacagctactttggaaaaaactttcaattcaccaaaaagacagaacagttgtgaaactttatgcaaacaaacagaaaatacagaagtctcaaaaaattgatcacaaaaaaaccctacaaaacacacaaaaaacccttctggagtta

SEQ ID NO: 3367 - DNA, 201 bp, Bos taurus
cacataagtagaattaagatgtagaaaagggaatgacttttggcccagggtacagtatgaacttagagttgctttaagtaaagtcccatccagagccatgacagagggcactaaactgtggccccaggtttggcaatacctggatcggagtcagactctccccagtcccagccaaattcagcctgtgtcctgtttcgggtt

SEQ ID NO: 3368 - DNA, 201 bp, Bos taurus
ttcattctgtcacatctgttccattcactcccctattactgtatagaaccaaaaataagattgtgctgtttgaacttttagggaagcaaggaggcccagaaccttcatctcctctcattactgtcaaaacaaagcagtgactttggcagcatttcaaccccatgatgtgtgttgaggccccaggaacctggcaaggcacag

SEQ ID NO: 3369 - DNA, 201 bp, Bos taurus
gggttgtttcacttgggaacactgcttcagcatgaccatccattgtctgcagtactgctttcctggagaaaaagggctcctaggaattagaaatattttgcgagtataggacaaacatctttttttcccttaatgtgcatttgttaaacctaaatagctcagtattgataaaactatgcaaccagtcaaaaatttgttcca

SEQ ID NO: 3370 - DNA, 201 bp, Bos taurus
ggagtagcctggtgagttacagtccatggggtcacaaagagttggacacaactgagcaactaacagtttcattttcataattaacaaagtgccttcccatgaattagatcatttatgcctcacaggaagcctgtaaaataagaattacagaagttcctctgcttacaaacttccagttatgaacttttcctaatccaaatg

SEQ ID NO: 3371 - DNA, 201 bp, Bos taurus
agtttctatctaagcatcaagctgatattttcagatctataatatttggcacaattctctttagtaaacattctttaagtatttaaatggaaacaaatacacttgctcaaagtaacaattcaatagtagtaaaactgatggtgagtgcagtaatacaagaattttgaaagtagagaggaagaaatgacaccatttcctagg

SEQ ID NO: 3372 - DNA, 201 bp, Bos taurus
atttgttcttccctattgaaatttggttacacagggcttttgatattctgatagtctttagtcatagcatttgctaaaggagagctattaaatgcagggaaataataagcaagtcttgttttgagcattcactgtatacccccaatttgactataaatccctaattattctaactttatttttgttttaattctccaccct

SEQ ID NO: 3373 - DNA, 201 bp, Bos taurus
acgtgggttatctttcagaacaatgtgggttatcttctttcactttcatccaaattttctatccttcccactctttcacggtcttcacagttattgctgggtaatgtgaactaacttgcttattaatgctctattatattgtacatatagacaatgttttattttttgcagatctttttttgttttgttgatttaaaattt

SEQ ID NO: 3374 - DNA, 201 bp, Bos taurus
ttacagcctttcctacatactgctactgtaataacaatcacatatcatatcatatgccatatttcattttacacatatttgcctccaactttaggttgcaaccaactgaagggttgtatttttccctgaaatagtatactcttagaacacattactgtgtggtgacagcttctcattgatggttgagagaatgaatgagaa

SEQ ID NO: 3375 - DNA, 201 bp, Bos taurus
gaaatctattgtcctttgaacatttttgtaagtaatgggccatttctctcttgctgatcctaggacttttctgtgtttttagttttcaaagtttgaatattatgcattttggtatttggcctttttagttcattcagcttattgagtctttggctgtattatgtcttggacaaaactgaaaagttttaatccatttttttc

SEQ ID NO: 3376 - DNA, 201 bp, Bos taurus
aaaaaactttattgggaagatgaaaggcagagatctatcttctgtaacttcttcagcctgacgaggggctatctagttgcggtcattgagctctggccctatctcattaaaggggctcccaggtgacttctgttgttattgcaacaggatctgttgtggggagtgactggagtccctgcatcacctttgccctgtgatgtt

SEQ ID NO: 3377 - DNA, 201 bp, Bos taurus
actgctaattatagccttctttgtggatgcagatctctggctaattaaaatttgttatttttaaacaattctatctccttggcctttttcctttagatacataggtttagttgctcagtcgtattcaactctttgtgaccccatggactgtagctggccacgctcctctctccatgggattctcagccaagaatactggag

SEQ ID NO: 3378 - DNA, 201 bp, Bos taurus
ttgtgggttttgttcttgacatcgatgttcccagtaaatctctccatcatgcctttaaacaacacagaaaaaatgtcctccttttgtgtttatttcaataccagacttatctttatctttactattttgatggcaaactttctaaaatttattacaggcttccagattttcttaaagactcatataagtttgatggtttag

SEQ ID NO: 3379 - DNA, 201 bp, Bos taurus
gaccctctttccaatccaattgctaaaattatactgagaaagaccgtaatttttagtgagagagactggatgaaaaaaataattatttcccctgattctacgtctactactaaatagtagcctactactactgctcccacagttattaagtaactgtatgatctcaattccttcaacaactggttttttggtcttgaaatt

SEQ ID NO: 3380 - DNA, 201 bp, Bos taurus
cattcggggctttcactgacctcggaaatggtcatttctattcctcttctgaaccacttgtctatttgtcttaaacaaaccaccagaatagctgccctcactgccctgctgttgctatttctgatgttaccagtctagcaccaaggttgacatctttcctcttcacataatcatttaggacaaaagaagtgttcttcacaa

SEQ ID NO: 3381 - DNA, 201 bp, Bos taurus
ctacttctgtcccaatactcagataatatagaatattaaacacaaattcagactcttctctgcttatggttaggtttatctcagaggtctcattggccttttacttcatattgctgtcattcgtcttctgtttcatcctgtaggtttcagtacacacaaaatttcagagaaagataagaatcttttgacaaagctgatctg

SEQ ID NO: 3382 - DNA, 201 bp, Bos taurus
tgtaataattgaagaggttataatgcaaagtgttctgtgatatttaacaaaagtcaagcacaaactaaataaaaatgctaagggataaaattgctaatctattataacaaatgaaggctgcaaaagtctttatggaaacctttccactaatatacaattaagagatgaatataagtaggaagactactgtattttatcttt

SEQ ID NO: 3383 - DNA, 201 bp, Bos taurus
gctggcaaacagagtggaaattataataatctcagagtacatgaaattttaaaacgcactatgcattttgataatcattagtagaatcctccttggatgattcttaggggaaaagtgtgtcatttcatacagaaagatgatttttatggtcattaatgaataataaaaatttctcaaattttttttaatggtcaagtttaa

SEQ ID NO: 3384 - DNA, 201 bp, Bos taurus
caccagtcctgtaatgaaattaagttctgatgacaaagcaaggtattactggaacttttctaggcaaacataatctatctaaaattcaccagctcataatgaaaaagcagttggcctggccataggaatgtgaattgaaacacattagaataagaatagaaaattatgggaaaatagcagcttcctggatactacttacag

SEQ ID NO: 3385 - DNA, 201 bp, Bos taurus
tcagtgcctaatttataatgaataatatagaaaaaaattagttaatagatcaaggaattggatgacaaaggtatgaactaacacttgacaatagaagagctgaatccattgctagacaaatattgatagggaagctgtccaagcatcttttataaaatgaggccttttcttaaaataactttccaagacttatttattttt

SEQ ID NO: 3386 - DNA, 201 bp, Bos taurus
aatcttttgtatgacttcttttgcttagcttttggcagggaaagttaggcaacactgaggtagaatattcaggaaagagacaacaggaataaacataggagcttctaacgcagttcatttattttgaatcataagtggtgtcatagcatgtaggtttacttttaacttagatgtagaggggaaaaaatcaagataaatggt

SEQ ID NO: 3387 - DNA, 201 bp, Bos taurus
ctacaaattatcttcctatttttacagtgaaaataattcttgtggattaaaaagtagaatcatctgatctcatacaagctttatacatcttttctagtataatatagaagtttccttgtacaattaacacatgatgtaggtttaattcagtcatgaagaatcaaacacctgtgtttccatatgttctcacttatttcacta

SEQ ID NO: 3388 - DNA, 201 bp, Bos taurus
aatcatggccaccaataattctctctgttcttatgtgtagaatctatttctccttcctgagaatttgtcctgaccaatggaacaaagcagaaaaggcaccgtgccagcgccaggcctagactttcagaggcctggcagtttccactttcatctctgaaagcctagagctaccatgactgctttccaggagatatttacatg

SEQ ID NO: 3389 - DNA, 201 bp, Bos taurus
ctctccctctctctatgagattcctaactgcagagtattaagtttatccctctgattttcttactatagtaagactgagctgattacccctttactacttcagctacgccatctattatcaggcctacatttccttccctagtcaatcagaggtcctttacacctgccttcaggcaactccattctctatctgtgaaagtg

SEQ ID NO: 3390 - DNA, 201 bp, Bos taurus
ctctgggaagatttgttatgtagcaataaacagaatagactgcaaaacaaggtgataaattattctgtaaatcctagtataaaagcaagtatatttaaaacgcagacagcagcaagatcctagaagagtagcagctatgcaggaataagcaaagggaattccagtgggttcggaaagccaagaaacttgggaattcatttc

SEQ ID NO: 3391 - DNA, 201 bp, Bos taurus
aataaatgtgtaagatgtctgctcttttgtaatacggttactgaagtgaaggtatctctctccgtgttagtgttggacctggtgggattgagatccttgtcgaagtgagatgagtcttgttgggagggaaaaaggggcatgtcaaaggtcaccagaagagcagagaaatcagttcatttgagaatgttgctgtcttgactg

SEQ ID NO: 3392 - DNA, 201 bp, Bos taurus
gttggcagggctggctccttctgaaggctcaaggggagacgccattccttgcctttgtcagcttctattagcagccagcattccttggcttcctgggcccttcccaagaggtagcaaaggaccacccctctcacctctacttttgtcatcacttctctgaccctctcctgcctctcctttccttataaggaccctgtgatt

SEQ ID NO: 3393 - DNA, 201 bp, Bos taurus
atagagtgggcttagaaacaccatgtatttctgggaagtgagaggataagcttgatgaattcttcccattcagaggtacgcatactagatgatgcaacaaggatgtttggagactgtttcctatataaagtcaaagccttagtaagttgaagacatcttttttgttttgttgctcaaatgagaaatagagttcactacttt

SEQ ID NO: 3394 - DNA, 201 bp, Bos taurus
atgaggccataagggtgggccttgaaccagtaagactggtgtcattattaaaagaagaagacatattggagctctctctgcattcacagagcaaagaccatgcgaagatacagtgaaaagacggccgtctataagccaaggagagaggccttggaagaaccaacgctgccagcatcttaattttagacttctatcttgcag

SEQ ID NO: 3395 - DNA, 201 bp, Bos taurus
agatgtggctcccagcccattccccaaatgagtggccatgctgtttactcccaaactgagaaaccctagacagtaagcggggccttgagagttcatgccacgacagctggcatccacagagattctgcctgtcccaggcaaaccaggattgtggcctctgaacacttggagccctgctttagaattgcctgttcaaatgta

SEQ ID NO: 3396 - DNA, 201 bp, Bos taurus
gagattttaatgattaaactctctttgagaacacgttgatggggttgggtgcaatcccagctccatcatggcctcactgagtttgagggtgacccaggtacgggggaagtcaccccaaagtcctaccttctccacagaaagatgagacccagtcgccttcctcacacccgtcctgggactacagatacagattcatagtgg

SEQ ID NO: 3397 - DNA, 201 bp, Bos taurus
ctgctggtccctggaccagagtgaggcctgcagcacagcccatggttgggcatgaagccttgctttgcccctcctctcctctattcctggctttaaccaacgagtgcgtttctggccacagggaaagctcgtggatccagggttgcatagacaggggccgctgtcccccaggttagggctctgatacttcaggtcactgcc

SEQ ID NO: 3398 - DNA, 201 bp, Bos taurus
gaaggagaaggtaagaataaaataaattcagataagcaaaaaggaactcaaactcggcaccagcctctgctgatggtgtctaaacgggcaggagtcatgcagggggccagtagtggtcttgccttttggttgctgtgctactttttacatctgtgctgtaaattacaagcttactctgggtaaaacatgagcatattgctg

SEQ ID NO: 3399 - DNA, 201 bp, Bos taurus
tataaaatgcttggactcagagaccttgcaaggtcattcacatttcatttttgtaattctacaaaatcagaaaaatgttgatattgttgactttgggtgctagatgaactattctgtttacctttgtgtttgtttcaaactatccatgggaaaagaatttttaaaaatagcacccacagcatatgatcagacatatccctg

SEQ ID NO: 3400 - DNA, 201 bp, Bos taurus
ctaaatccttctccagattaactcatttgtggctgtttcccatcactggcttctttgagccccaaacagaaaaaccctgctagtttctggcccaccctctttccagcagatggcggtctctgaccaggaatctcatggaccagcccccatgggaaactgcttcctctaaagagcagttttcctgggaatgtccaagaaaac

SEQ ID NO: 3401 - DNA, 201 bp, Bos taurus
catactcctcccaaggttccgtgtggccgacatgacagagtctctcacctccaccaggtatgctggtctctcagccacccatcttcaccatcagctatcagatctacccccgggccccttgtttgccaggcactgctctccacgaactcttctgcaggtgactgcttttcttgtcacattcttcagtcccactggaatctc

SEQ ID NO: 3402 - DNA, 201 bp, Bos taurus
tttctcccaggctgtggctgttcctatcattctctctcttttttaaaaactttaatttaaaaacattttaattttacttttggccacactgcatagcctgcgggaccttagttccctgaccagggatgaaacacaggttccctgcagtgaaagcacagtcttgacccctagaccaccagagaaggccctctcattctcttt

SEQ ID NO: 3403 - DNA, 201 bp, Bos taurus
cccactggcaggattgttcagacctcttggcctgctgattatggaggcagctcatttcttaggatataggatacccagcattcatatattcatactgcttctcatttcacattaaaaatgtcagcctccaaatgaacacactcactttctagcttaatggaggatcccgaagacttcatccaaaaaatcaagtagataatc

SEQ ID NO: 3404 - DNA, 201 bp, Bos taurus
tacagggccatgcccacctctggagtccaagatgcaatggcagctcacacctgcccttggagctcatgttgctcactctgtgccacctgagatcatgtggataaataagctcctacagtggccaccccttgctccacatgtccaagcctcccaacaatggtctcttgcctctctggcgggtccagacttctttccagactc

SEQ ID NO: 3405 - DNA, 201 bp, Bos taurus
gggagagtctgatggctcttaaagtagccctggaacagcagtgtgagcatcattagggcctgagaggaatgcaatgcatattcccagggccaacctagccctctgtctggggaagctctgctctccttcccccagccctgcatgtcataagaatccacatggtgcttggaaactagctggcataggaagagccaccttggg

SEQ ID NO: 3406 - DNA, 201 bp, Bos taurus
aacaaattccaatgggctcatagaaaagcagaatgtatgattccatgtttcctcatgcacaagatgtgaacaatatctcctactttgtctagtttaagtccatagaaatccaagtaacgcagtttgtagagcactttgtaataaaacagatgcccagggaaaggtggctaaggaccccaaagaccattcagtacatgcatc

SEQ ID NO: 3407 - DNA, 201 bp, Bos taurus
tataattagaatataaaatctttaaagttataaaaagataaacagtacaatataaacaaagttaaaagacaagtataggccaattttcacacacatacagaacacatgagtacacacatatgccagttcagttcagttcagtcactcagtcatgtccgactctttgcgaccccatgaatcatagcacgccaggccttcctg

SEQ ID NO: 3408 - DNA, 201 bp, Bos taurus
cagcaagcacctttctgcagatccagagtggctctgagcagctcaaactgtcctgcatctgcactcgaagaccaacacccagagccctttctgcagcctcactgccttgcagtccctgcctgctcagcctctgacctttctgtctatttcaatatccttctttcttttcattttaatattgtttttattgtttttaaaaat

SEQ ID NO: 3409 - DNA, 201 bp, Bos taurus
ctacagtccaagggattgcaaagagtcagacacaactaagcaactgagtgcacacacacagagctaagtttcaaaccaaagacttatcaacacttttttttcccagtccacaagcatttcacatggaaagaaagctaattaatgcatgttctctccggtctctgagccaccattgtgtgtaggcatttttataagtgattt

SEQ ID NO: 3410 - DNA, 201 bp, Bos taurus
agtactggagtggggtgccattgccttctccaaaaaggaacactatttccaattaaatgagcaggatggatgctatctgtcacatagaggaatttattacaggaacacttttccattttgcagagcagaaggtgtgagtgggctgtattctggtgataatttaagggaatatgtaggagttgtacttaagctttcaaagtt

SEQ ID NO: 3411 - DNA, 201 bp, Bos taurus
tgagagagggcaggcccgccaggactttagttgtcaaagaagacatttcaaggtcactagaatccattgttctgctccgataacatccttcctccttgctgagaaagcctttctctgtctgaggccagcagatccttgttcataagagcccctcggctccttagtgagtccccgggggtcatgctcaccactccagcctgg

SEQ ID NO: 3412 - DNA, 201 bp, Bos taurus
ctgtcagctgagagttgtttctactttcatcctttggcttgtggcctcttcctccattttcaaagccagcaacagccttatgaagctgtcagattcactcgtggtgaaataaaggggccaagagaatgccaagggtcctctggtctttgtcatcagaaccctgctgatccagggatctgttctgtgcttctagaactaggt

SEQ ID NO: 3413 - DNA, 201 bp, Bos taurus
ctgccatggtgagcactcctctgtgcaaaccagagctcagagtgtgagtggaggtgggacaatgcagtggcagcttaggtgttgcctgctggccagcacatacagaagacgcagctgtgtgagtatctggtgcatcagctgggaggttttgtcctgcaagaaactgaatattcttccttaagcatattgtcaggcctatta

SEQ ID NO: 3414 - DNA, 201 bp, Bos taurus
tcaagctgctctaactttatggattcattttctttctgttgagaacaaaataagacatgttgttctatcatcaagcatgtgggtagggtggggtttaatagcttctcttctgttcaatattttttatactttctaactggaacattctgtctctttacaacagaatgtgaggctggggcagcagtaagttacttctctctc

SEQ ID NO: 3415 - DNA, 201 bp, Bos taurus
accaaagggatgtctgtgaacgtcacgtcatgggagctcaaatgaggatgaccacactgaatgcacagcccctcccaacagcctgctggccagatggtccttgaaattcctgagttctctgtcctgggaaacacctcattaccggggtccattctgccatagagcagctctattagcaagcattagtgttcctgcagttgg

SEQ ID NO: 3416 - DNA, 201 bp, Bos taurus
gggcccaatcaccgggaggaggatcgccagcactggtctgggaaccacacgccctcacctgctcgatcctggtgatggccacctgctccaccatgtcccgcgctttgcgctctcgggtgaggtcatagtacaccttgccagtacagaagagaagtctcttgacgtttcctgggttctgtgctgcagggccatcttctggga

SEQ ID NO: 3417 - DNA, 201 bp, Bos taurus
caaccacgagtgccctgccacgagggtgggaggccagtggtgacacgtgtgcaacattcgctgctgctccaccctgtgcttgctctctgctgcatcctgcgcatccttggcctgcttttgtcagtcgtcactcccttccttcaggacacactcctgacctctcccctggtctctgtttctgtggttggctctccttgtggc

SEQ ID NO: 3418 - DNA, 201 bp, Bos taurus
tgagggggctggtgactgctgtctgtgccaggcctgtatctcccctcagggagcagggctgggactccactcagctttcagacctgcactcaggaagtcgcgcagacctgggcccatgaggagacgcctgtctgctgaggagccctgtcatctaagccaaactccccaagggcagcagcccaggccaggaagaggcaggcc

SEQ ID NO: 3419 - DNA, 201 bp, Bos taurus
agcagaggaaatgggaggaaagagtagaaaggggaacgtgcatgtagattatcaggaggctgaagtatgcagagaaaggagatggtgagatatgcccagcggaggggtgggcaacaggtttctagaatgtctaaaattccatttcagttgtcttgctgtgccctgctgtcttgaatttttgataaaatgcactatatattc

SEQ ID NO: 3420 - DNA, 201 bp, Bos taurus
tctgacttcagattcagtgtagaaaaaaattatattctgattgagaaaaggaagtttaggaccaggcagtcattaccctggtatattcgacgtgtagacaatgctttctatttgagaactttgagtgtgcctaaaatgactctctttgtaaaatcattcttctcgcttttaattatccattaactttgtttttcatgagtt

SEQ ID NO: 3421 - DNA, 201 bp, Bos taurus
gttaccagtagtctttggaccaaggatacctgaggctgagagcagtttatctacatgaaatgttggcataaatctgtaaacttgacaagttagcattttcctgtcctattacttggcctaagggttttgtttttggtggtgcagtctctctatattttgctggtttatcaggaccttcctcttagtagaaggagtaatgtt

SEQ ID NO: 3422 - DNA, 201 bp, Bos taurus
tctgctgatctaattgggtgaagacagagctgaaaagcgcccaaggcttcgggctgttattaaccagcggggcacattctctgtttcctgggcctcctacgctcacatgaattatctccaggatgctataaagagtaggaaagctagataaaaattatagttcaataaatcctgccacaaaagggattagcaaagcatctc

SEQ ID NO: 3423 - DNA, 201 bp, Bos taurus
atgatgtggggctgtggccatgcgtgggagatggcaacaccgcccaatgtgggaagagagcaaatgcctgccaagagcctgcctcctttagaggtggctctggaaggcctaataaagagaaatggtaatctcggcaggcagaaagtgtctacagatatggagcagataaaaatattacatgaaaatactttcaactcaatg

SEQ ID NO: 3424 - DNA, 201 bp, Bos taurus
accctcctccccacccaggggacatagcaatgtcacaacttggtggaggtgctactagcatcggtgggcagaagtcagggacatttggaaacattctaaacatcaagagacagaaatcccaatgcagatagttaccctcccttctgcctggtggccaatagcacgtctcaggtacaggctctgaatctcatcaacctccct

SEQ ID NO: 3425 - DNA, 201 bp, Bos taurus
attgctcttgatctgtgaggagctagaaaagttgaggccatgagccagccctcagactggtaacccccattgtaccccaacctggatttctcacaatagcccctattggccaaaggacaaaggtcaggcttctccttcttttgtccttccacggctgatgcaaatctcaagtgttccattattccgcggtccgaaagagag

SEQ ID NO: 3426 - DNA, 201 bp, Bos taurus
ctctgtcttccgagtatgtacctctctaaataaacctgctttcactttactatgtttcactcttgaattcttttcctgcccaaagccaaagactctcacgtggtgggccgtcccagggactcactcgagacctcaccatcctctcatatgtcatttttcctagaacaacataagtgagctaaaattggcaactctgaagtt

SEQ ID NO: 3427 - DNA, 201 bp, Bos taurus
caccagactcctctgtccatagaattctctaggcaagaggactgaggttgggtagccgttcccttctcccagggatcttctcgacccaaggatggaacccgtgtcatctgcatccgttatcaagacttccttcatgtaccttaaaaaagattcacccatctagaatccagctcgggtacagtggctcaaagtatagagact

SEQ ID NO: 3428 - DNA, 201 bp, Bos taurus
cagccaaaaaaaaaaaaaaaaaatacgtagtgagcatctcctagatgtcaggtacagttcagaggacgcagtgtgaacacagtcagtaactggcccctcatagagcttaccttctagtgtggaagaagaggtagctttataatggtgtccaaataaaaacagaaacacggggacttcccaggcagtccaataggttgagac

SEQ ID NO: 3429 - DNA, 201 bp, Bos taurus
tgatggtaggttttttgaagtttcttagacaggagagatggagacttgtggtacagtggatggcacccagctcatgaaacaacctctggctccttccttagtatacactgtggccttggctggtcctcagaagggaccgtgctaggtcctctgtgggcagagagtgaagctgacctttttatactcactttctttcccttg

SEQ ID NO: 3430 - DNA, 201 bp, Bos taurus
aacattgcaaacataaaacagcaaaaatctgtaatgtaaagaacgaagactctaaccctgatctaaaccagactgttttccccttggctccctttctttttcccttaattaagctaactggaaaggagaggttttcatccagacaaaagggcatctccctaccctaatccctaggacaaaacagagaatctggtctggaat

SEQ ID NO: 3431 - DNA, 201 bp, Bos taurus
ggtgagtttgagactatctccctaaccaaacacgaagtgcgggtattttatgtgcccagtgcagtgcaaagccgtatattctttgttcccagtggcctacataatacaaacaatgaaataaggtcaaaggagaattcagaaaaaagtctaaacagtcaaaaaataaacgcaggttcttgtagtgttggtggccacataaat

SEQ ID NO: 3432 - DNA, 201 bp, Bos taurus
attgaaagtaaaattcttaaagtcctccatgcctctctagtttgtctggctatctgcatgtgtgcatttatataaccacactcccatgaaccctcaaaatcgtaatctgcaaacaggcctgatccaacatctcctctggaagcccactctccctgaccttgacccatctggggactgacatgctgaacagaagtcctactg

SEQ ID NO: 3433 - DNA, 201 bp, Bos taurus
aagttgatatgattagataagaggtgttttttctatcagtttgccaagctggaaagtgggggaaaaatggttcagatgtacaggaaatttctgtaaagcagtatcttagtgcaaaaaaccaggttcaactcttggccttcgtgtataacccttgttcttaatggaaattggtgttgtggtttccaagactgagtgcatagc

SEQ ID NO: 3434 - DNA, 201 bp, Bos taurus
tattataatttgtgtgttttaggaggataaggccagaaggcataagtgtagttaggtcatcacctgattgactttggcaatgcaggaaaactgtaaaaaaatagattcagcatctcacaaaaaagtgtgaggttattgaatttaagggtaagtagctatgtatacttcaataatactgaagaatatgctacagaatactga

SEQ ID NO: 3435 - DNA, 201 bp, Bos taurus
ataccgggcttcctcacttgttagtaaggataattgcaaggattgtagaagtattgtaaggattaaataatacaagacagcaaagcctcccatctactgagtgcaaagtcacctgtcactgtggcataatgctgacaaactgatactgctcacagtcaggggtggagtcagacctggcaccttcctagcctagtccatgct

SEQ ID NO: 3436 - DNA, 201 bp, Bos taurus
gacactccaaatttcttcaagttgatgcaccatatatttggattatttctcttaaaaaatttttttagtgccattaaagttcagtcctctgaatttccaacatctcttagattcatggacacttgaaaagtatttgcagtatctggaatgcttgtgtattgtgcaagactttctctggtttcaaacattgtctggacctgg

SEQ ID NO: 3437 - DNA, 201 bp, Bos taurus
ccagataaatacagaggactgagatagcaaatgagatgtagagatcacttccaattgtggagatcagaaaatgcattgtccatgggttaacagacaaacaccaagtatttccttctcccttccactccaatactttgaaattgctcccacaaattgaaaaaagtgttcttatggtttactactgtattttctatttgaggg

SEQ ID NO: 3438 - DNA, 201 bp, Bos taurus
ggccagaggggcaggatcagattggtttttttcaatctccaagtgtgtgggaggaattttcccagaaaaacgagagattagaacaacaaaagaggtaagtaatatagaagaatgtaaggccaattaggtgctgtattcatagtatttcttattaatttcaaagggagtagctgtcagaaacaaaccaatttattaaagtag

SEQ ID NO: 3439 - DNA, 201 bp, Bos taurus
ccagtagttaggactcagtgctttcactgacatggttctgggttcaatccctggctcctggtcaggtaactaagatcatgtaagccacgcagtgtggccaaagagcaacaacaacaacaaaaaggtcataatagttctctctttctctctctctttttttttttggatgcacagcatgtgggatcctagttccctggccag

SEQ ID NO: 3440 - DNA, 201 bp, Bos taurus
tccaaagtccagcaaaagagcaattgtggttatgttgcatatgtcagtgtttcctaaactaatataaaacagtaaaggtttttaacagagcaaatattaatatcctctaaactgccatcatacaaaacagactgagaaagtaggttgtagtcacgtggaaacttgtcttcttgaatgttgaactcaacaaaatgaagggaa

SEQ ID NO: 3441 - DNA, 201 bp, Bos taurus
tgtagggtctctgactggatattaaatgctttgtcctaagaatgacataccctctgttcacattttgcccagatcaagtcacatggtcccattcccactataagaaagccaggaagtacagttctatcatgttaccaggaggcaggaagctgagaatatttggtaaacagcactgctgactaccacatgaccttatttgca

SEQ ID NO: 3442 - DNA, 201 bp, Bos taurus
ctagtaggttagtccatggggtcacatagagtcagacacgactgagcgacttcactttcactttcactttaggattctgcagctcctttcagtgtaaacttcctgccctctatatgtcatctcccttacttggcatttcaggtaatggagttacatgtccctggtagtataaatgttccacgatgattttcaggatccaaa

SEQ ID NO: 3443 - DNA, 201 bp, Bos taurus
agagaaagggaaggtaacacgacacttttctaagtagcttcatcaacagcaacatgaattaaacatcaaagagttgagaaggcaccaaataagagtgagagttatgcacccagtataggtttaattggtggacaaagggaagagaagaaaggaaagttgtcagatgaaaaacataaaagtaaagaattcatcttaccttca

SEQ ID NO: 3444 - DNA, 201 bp, Bos taurus
gtctaaaactgaactcattgtctttctgtcccaaacctggtcttcttcctgtattctcaatatcagatggtagaacgactgtgccctccgtgttttgacagaaactgcagcagagaagttgagtatgggcgatgaattgataaacaaaatagattatatacatctatatgatggaatatctttcagccataaaaagaatga

SEQ ID NO: 3445 - DNA, 201 bp, Bos taurus
ccacaagggaggagaacaatccttctctcctctgtgtggctgtgcagtccttagggctatgcctggcagagcagagggagagatacgggcagggctgcaggatgccccgcagctttgggagggaagtgctgagtccactgaagatggagaggcacaggctggcagtgggaaaaacggattgctctcaacatggacggtgag

SEQ ID NO: 3446 - DNA, 201 bp, Bos taurus
ccctgaaactttgcttcctacataaaccttccattgcctttatggtgaaagcaactttaaaccacattcaacattcagagcacttgtccactatagagaacaggggtcagtggataacaccctataggacacagagacacagtgggttaccttgtagattttgcaatggcagagtcataatgcctccggctgcagctgctg

SEQ ID NO: 3447 - DNA, 201 bp, Bos taurus
tcatccccgggggagcacaacataatgattgatcccagtgaagttgcactcttaggaaagacaactccttgcataatttaaatgaataggccaaggatgacttaaagaaatagaaataaaggatggcactgtggttggttaatattaatgagaaaggggagggggcccataactaaggcagagttggaaactgagctcact

SEQ ID NO: 3448 - DNA, 201 bp, Bos taurus
ccccttttgcgttatctgggagctatttattgccaagttcatgcctaaatggttcctgagcaggaaacaggtgaccagtgccagagcaggtggggccacaggctccctgtcccatcattacattggttgtggtttgcctgtggttatttttttttaatgtattcatgcctgaaaagtgaatttgatatgacacatgataat

SEQ ID NO: 3449 - DNA, 201 bp, Bos taurus
taatttttaattttaattttctatggcagagaacttgatttttgagtttttttgggagaattttatgtgtgtggtctagtttttgatcagctttttaaaatagtctatagatacataaaaacaaagtattttctctgtttgcatgagaaccttgaaattaaacacttgaaattaaaatagaaatttgtgtcattatttact

SEQ ID NO: 3450 - DNA, 201 bp, Bos taurus
cctgagaaccacactgggtacattctcatgaaaggtgtgaaaatctgattttctaaaatggatcagtaattctctatgaagggggaaggatcgataaatctttgctaagtagattgtaaaggaaaaattattctttcagtgacagtacattaggatcctccaaacaatctcaataaagtaaagacataacatctctctacc

SEQ ID NO: 3451 - DNA, 201 bp, Bos taurus
cagcagtgagccacctgggaagccccctggtgcctgcacatttctgtaaaacatgagcagtgccctctgagcaatgagcagcatggtggtagtggggccttcatgtatttgctatgtcaagaacacattttatcagactacctcagagtagataatatccccttgacattacattctacgatgtgctattcttggaaccca

SEQ ID NO: 3452 - DNA, 201 bp, Bos taurus
tagactttcatcccagctcctcaactgctaatagctacagccctgggatcacattattaaagtgtagttcatctgtactacaatttccgtgaaatagaccgtctgcgggtaccaacaacatcacattacagacattttactactatggttagtggttaagtaccatttttttcccctcttgagagcagacctttaagaata

SEQ ID NO: 3453 - DNA, 201 bp, Bos taurus
ctagctgaacttgataaagaacaagtgattgacatgatatcaactctgctcccatgaagcatagttttacctactgcacccaaatgaaataaaagattctggttttgtttgtacacaatgggcatttattttgaaagtgtatagtctagcccttatcagttctctttatggaaacccataaccattactggacatggacta

SEQ ID NO: 3454 - DNA, 201 bp, Bos taurus
caggggtctagcctgaacccctgtggtgggagcactgagtccaagatgctggaataatagagatcttcaggtcccaaggaatattaattggtatgtgtgcccccagaggtcctcatctcagtaccaagacctggctctgcccaactgcctgcagactccagggctagatgcctcaggctgaacaaccagcaagacaggaac

SEQ ID NO: 3455 - DNA, 201 bp, Bos taurus
tggcaagatggcggccagcagctctaggcaagagcatgtcactatttatggataactcaggatagccctaaccagcccaaattggggcttgtttctcaccctggaagaaagaaatctctggccaagggccagggccatgagttggattgggccttagtcacaggcttctatggaagctgggatgaagaaatgtcccttaga

SEQ ID NO: 3456 - DNA, 201 bp, Bos taurus
ggagtcttaatccctggactggcagggaaatcccaggatggcactggggttaaacatttcattcaaagaattaaaatcagaggactttgcgtttgtgagcccccagtgaactatctcagagtgctttctcttttgtaagctttcattagttacctgtcagaatctttccaaatcccttttcagctgatttcagtacactga

SEQ ID NO: 3457 - DNA, 201 bp, Bos taurus
tcacctaaatggtgaaagaatggtggagaagaagaggaaaagctgagacagctttggcttacacttggcaaagctgggtcatgaaccagataccccctccccagttatttgagcctggattttgttgaattattcgtgcagggcagtttttgaggctgttgtatggatcccagtaacctgagctgcacctggcagaagtta

SEQ ID NO: 3458 - DNA, 201 bp, Bos taurus
agagattgtttaaaaatgtgttcatgaatgttggaagccttgatatggggcacttaaaagtcacacctcactttaacatgtggagaaagaatgaaggccaacgtgtaatctatcctttgttacttaatagctgggacttttttcaagttacatgatggcttgaatttctcttcccattgaaaataagaacagcagtggcca

SEQ ID NO: 3459 - DNA, 201 bp, Bos taurus
cttttagagggagaaggatacttaacacagagagatgggaatatttctcagagattgggaggggcagatgtctgtgggtttgggaatggttcatttttccatgtggggattgcagagaggcatcaggtccttatgactagggttcccatcatccctgaaggttcccaaatcccaaatgtggtgtggatgaagcagaggcca

SEQ ID NO: 3460 - DNA, 201 bp, Bos taurus
ggaagttttcttagaactcatgatcacttatggtattagaactggaaattctttgcagataatgttactgaactcatctcctagagcaagattttggaggacaatatagaagcagaagaagataaatgactccccacctcccctcaatttttccaactgtttctttgctctttctttttccattgtaatttcatttagata

SEQ ID NO: 3461 - DNA, 201 bp, Bos taurus
cctagcaggctacagttcatagggtcacaccgagttggacatgactgaagcgactcagtaagtagcacacaggcccttcttggccagtttgtagatctatgcttcacattgtcagaggtcagctttagccaggtggagatgctgtggctgtcgggcagagtccactgggacaggcccttcctgggagtgtgcacaggaccc

SEQ ID NO: 3462 - DNA, 201 bp, Bos taurus
tgcctggaaaatcccatggacagaggaccttggtgggctacagtccttggggttttaagagttggacagaatttagcgactaaaccatcaccaccagcactagtgttgagagtacctgaaattccatccactcttgtataattttggttgttttagtacgtagacaagaggctcagtggtaaataatctccccaacaatgc

SEQ ID NO: 3463 - DNA, 201 bp, Bos taurus
cccccaagatgtcgtgtgggctgagtgcccacatgcaacctggatgggtctcactggccctccaagtccatagcgggggcctgatggtaccagagaactcagcaaaccaaagagaatttagcactggacaaactgcagtcttcacaggaaatgccgtggggccttgtgacaggaaaggaagtagagtccgaatctcaatga

SEQ ID NO: 3464 - DNA, 201 bp, Bos taurus
attttgtctattagcccattttttctttgcttttctgatgaaagatgtgatattgtcaggctaaatattgatgataaatctgaaaaatacaacatagagtaatttcaatatttaaaacagtgtgcccagagttagttgctgggccctaattccaatggagtgctgaaatagaaactctgtaactgcaatagagactggagt

SEQ ID NO: 3465 - DNA, 201 bp, Bos taurus
ctttgctgtgaaataactgtgattcaaatgtgtgtatggattctcatatatcttcagcataatacaggtactctgtaccttattgatccagaaattggataaggtccaatctcaaatatttcaggattactacaggtcacaaaaaaattccttaagatatgtaagtcttctgggaaaaaattgctcatacttaaattccca

SEQ ID NO: 3466 - DNA, 201 bp, Bos taurus
ggctcagaaacattatattcttacctgtctcagagtaaaatacagtaacactttctttggttttttaccagtgtgaatctgatttccattacatctcagcgtcataggtaataacttttggtcaactggaaagaaggacttttggaaggcaagactttgaaagaccaataaagccactatcatagaaaaattgtaatgggt

SEQ ID NO: 3467 - DNA, 201 bp, Bos taurus
tcatatagtataacttacagcagtgttcattgtattactatttatcactgttgtgtattacagctctggtacttatttatcttataactggaagtttgtacctttcaactaccttcatccactctccccactctcatccccacacactggcctctgataactacaaatttgatctcttttttatgagattgtgtgttcatt

SEQ ID NO: 3468 - DNA, 201 bp, Bos taurus
atttctaagataaaaaaggataatataacctttgtgtgaagctacgatgttgatttttttctttctgtaaagcttgtttggtcagaccatgcttgaaaattaatgtttcagcagagagcaaagaaggaaatttcaatgtattaagacaaaaacctgggaagttgggacatttatgttttcttagtaaggaaactctgcttt

SEQ ID NO: 3469 - DNA, 201 bp, Bos taurus
aaaagatagcaagttcttattagttttacttttttccttttctccttttgtgcagtaggtaaaactaccaaaaggaaaaaaagaaggagtgtccatgcctggaattcatctctttcagtgctatcagtgtagagttttcactgaagcccagggaggctgacaaatcacactcctgagccgcggttgttagccctttctctt

SEQ ID NO: 3470 - DNA, 201 bp, Bos taurus
tactggagtgggctgccattgccttctctgaatttagtgtttaaaacaatgcaaatttactttcttacagttttcaaggcctaaagtctgaaatgagcaatatgcggttaaaatcaatgtgctgtgctcttctgaaggctctagggcacaatttgttcccttgtcttttccagcttccagagtaggcctacatctcttggc

SEQ ID NO: 3471 - DNA, 201 bp, Bos taurus
agaccaggtcaaatggttaatttgataggaaagccacttcctagccacaaatatcctcaatgatagtagccaggtatgaaaaattcatccaaacaatttcgtcagctaggaacttacctaccacaggacctattactgatgttctatgaccagagatctattaaatcacaaaatggaaggacattgttatatatatatata

SEQ ID NO: 3472 - DNA, 201 bp, Bos taurus
atctctttgactgaatcctgtagaatctattttctcccttcttttaggtgcagcctttctgatagcatgattacccccaccccatcaccaccatcagctgccaactgagtttactaatccccactcttcttaacatcttactgagctttgggttcagccagccctttattttttctaataatcacaagtatgctggccctg

SEQ ID NO: 3473 - DNA, 201 bp, Bos taurus
agaggataagattggcgcagggtaaaataggcagtgatgaccctctattgtgtttgactaaaatggtacaggcatagacatcagagcttgctggtcctctgctggttaagggtccacagtcctgtagctgattgatgtgtaaagttctctggtgacatctcatggcagtgtatctctgtgcttatctctctttttttggtt

SEQ ID NO: 3474 - DNA, 201 bp, Bos taurus
ctcccactcaagaaagtgtttgcttgcaaacagtgggaatgcaactcacgtcccctggtttacaaagtgtaaattatttataaattttgacattttaattctttttataaccaatttcttagaacatacttcacacctgatcttgacaaaaagaaactcttatctgctgcccaagtgtattatgactatgactaagacaag

SEQ ID NO: 3475 - DNA, 201 bp, Bos taurus
ggagtgggacctggcccactttaacaatccaactgaaaagacatatgggaaaaagatggctttggggcagtcttgatttttttttttccccaggcttctcagagaaagaagactctaagaggccacacttaagcccctgccaactttagcatgaacaaccaaatgtctttggaattgaagtgaccttactcaaccttgtgg

SEQ ID NO: 3476 - DNA, 201 bp, Bos taurus
gagtgatactcatcatagcagcaggtgttgcggtatgtgccctggcccatgagaatagacatctaattattcaaacaagcattgggctctgcaccttaccgatgcattccaaataaatatcggccttatcctagacatgcagagagctagcctttataaccctcatccattaaatttcagtagcatttgcaatcattgtga

SEQ ID NO: 3477 - DNA, 201 bp, Bos taurus
ccttctccgccatccgtgtttatgtctctgaacgcttgtaaatctcctgggctctgagcacttgcctactggaataaaagctgtctctggagacagctccggtaaaagtcggagttattagcagagctcaacagacatacctggaaagagcatatggcagggctacagatttgtcagaaagatttaagagtatccgtttat

SEQ ID NO: 3478 - DNA, 201 bp, Bos taurus
caaagtgataggtaagaaggggatttatttaaagagaaacacactccacagacaatgtgtgggctgtcttagaagacacaaggcctcaaaatagggggtaattagcttttatggactgggtaatttcataggttgatgaatgggaggattattctaattacttggggggaggggcagagatttccaagaattgggccacca

SEQ ID NO: 3479 - DNA, 201 bp, Bos taurus
agcgacaaaataggaaactaaattcccattcttgggcaagcataactgactagtttggtgacaaacctaaggtagacatacagtatggcctttttcttcctcttgttttatgctagagcagctattttctgcttttacgaattgcatggagccatcaattatggccagtaatcttcaacaaaatacgaagagcaaaagtat

SEQ ID NO: 3480 - DNA, 201 bp, Bos taurus
aaaaacagaaaaataaaacagaagcattttcattgtaattttcaacagacgtaggagttagacctgtcttgctctttcacctcttttatcgactttgtgtctttaaccaccagtgttttattggcttttccagtttatattaaaattctgtcctttcttttagtacagtaccatttcttattaacatgcttagaatttttg

SEQ ID NO: 3481 - DNA, 201 bp, Bos taurus
acctaattcgggcgttgggaatcagttctggaataccaccaggagctctcctgccttcccaggttcaggaggccctagtttaactctcgtcaatggggccagcacttagacaagcggcaaagctcagagcccaacgcagagggcaagcccatttctgctcagggctgagggggcaatcaagtggtacaagctgccacagga

SEQ ID NO: 3482 - DNA, 201 bp, Bos taurus
tctttcgtacaaactctgacctccaagatagtgactaagtcttctccatctttataagcccactattgctcattgaattctgtcttaaagatactcattaaaagtcttctgaatcaaattcccagatatcaatacaaaaccatggaaatggtttggtgccagagacttaagcagaaggctctgttgctggaatcttttagg

SEQ ID NO: 3483 - DNA, 201 bp, Bos taurus
ttgaatgtggagattcttacaaataatatcatcctgagaatccgtggttgagcaactaatcacacactatgtgtctgacatctccaacaagcaccaccagatccatatatacaacttagcaagaaatactggactcttctccttcctggatatacacaaacacacatacactccccccacaagatacagctgactcctttc

SEQ ID NO: 3484 - DNA, 201 bp, Bos taurus
tcaacagcaatggtggtgaagatgacatgataataacaaacatacattgagcatctatgcatacgctcaggctccatggtctatggcccatttttatcaaatgttcttaatgtcattggaggtagatatttttattaccctttcttaaggaaaaggacactgagctcctaggaactgccaagggaagcgatagggccacaa

SEQ ID NO: 3485 - DNA, 201 bp, Bos taurus
tatagcatataatacacgaaaccatgtagcaggtgcatgcaagaggagaaaagaccaggggattcagaggcttctggttggcgctaacgcgtggggcccaacatgccctgggttctacagacgagtttgggtagagaggtccagctctattccgccagctgcttcgggagtgaggaacccggctggggcggggaagagact

SEQ ID NO: 3486 - DNA, 201 bp, Bos taurus
agtatttgcaacgaaataacatgaggaggtaacctgaaacactgatgtttgtaaagaaagtaattggacgaaaatgttttgattttttagatggaacccacaggaaaacttgtttgacattgacagaaatgttagctactgatattatgttaataaaaacttaagttgttactttagaatctggttttcaaatgtggaaga

SEQ ID NO: 3487 - DNA, 201 bp, Bos taurus
aagagttggacacaacttagtgactaagcacaatcaatattgatatgagcttccctcttagcttggttggtaaagaatgtgcctgcaatgggcttccctcgtgcctcagttggtaaagaatctggctgcagtgcatgagacctaggttcaattcctgggtcgggaatatcccctggagaaggaaatggcaatccactccag

SEQ ID NO: 3488 - DNA, 201 bp, Bos taurus
gttttcatgctcttgtgtgtttgctcagaggcttctctctcttccaggaaatctctttatggttcctgtgacttctccaactgcagccacgtgggctgccttgcttcttcatctgtatttattccacagctctactcttgttggcacctcggcggagctgtcactgcactttgttactgtcagctgtctgcctctctctga

SEQ ID NO: 3489 - DNA, 201 bp, Bos taurus
agtagtaactgctcatctgtggtatttaaattatttttagaagaatgacagcaattctcttcttggcacctcaattaaccataaacatctatatgacatggtgaaaaccttcagtctatgcaatgccattcctaatattttaactgccacaaaacacaggaatttgcttccaccgcaatctctacccacagaaaaggggat

SEQ ID NO: 3490 - DNA, 201 bp, Bos taurus
tgaggcttacatattcctagaaaaatctagaagggcctggctcttggccaacagggatggctaatatccccctctggttctcagcaatagttggggactgcttctatgccacatactggagagggcctccttgggtggcctgcccaatatataattgcagtgtttctctataccaactccttggccaaaaacgatttactc

SEQ ID NO: 3491 - DNA, 201 bp, Bos taurus
gatgaggaagcatatattttgacacttttgattctaaaattccaataaacataaagtcataaccttagtattatagggtgggaaacatacaagctggaaagtattagtagaagagaagagagatttggggagagagaactaataaccacacatgcatctagggttatgtggaatcacgaggaggaaaaactttatttcaaa

SEQ ID NO: 3492 - DNA, 201 bp, Bos taurus
cactgacttaggattgatagtgagaaaagaattcttcactgaaaaagtcattagctttctcgcaggttagaaaaaaatggaataaataagaaattatggatgaagaggccacatgggttgagtctcagtttttgctgtatcttgcccatatttgacagaattttaaaccatgatttaccataaagttagcaaaacttaaaa

SEQ ID NO: 3493 - DNA, 201 bp, Bos taurus
tcatagcctgctggttattacatgtaatcaatactgctaaaagcagatgacttctgatttagggaccaaaatgtttaacttttcctttgaaagtgaaccacatttctttgattatcttggccttcactgtaccataaaccaatatagaattctctgttaggaaatctgctctaaatctgggaccattgtctgaaggcattt

SEQ ID NO: 3494 - DNA, 201 bp, Bos taurus
gtccccaagaaatgaaatatgtagtgtaccataatcacttaagaaaatttatacttacaattttaattaaaaggcagaaaaatattaaaagtggtctgttcatgtcctcacaaaaatatgagtagtgatcttttcagagggtgatggaaagtgttaagagaggatttttgtgagaggataaagctttatagagaagctata

SEQ ID NO: 3495 - DNA, 201 bp, Bos taurus
acagcttctaagctctgcagatgtcagagctgaaactgcacgtcacaactgttattttatttttattatgtattcttcttcatgttctctaagcattttggatctgtgtttggtgtctgttattactttaactgattctaagccagtatttcccaaagtatttttctaagacaaaagcgtgttgttctttactgttttcta

SEQ ID NO: 3496 - DNA, 201 bp, Bos taurus
cttggattgcttgtgcatggaatcctgagccaccacatacaaagttcaactactctgagccttaggatcatagaatattttatgtggaatttcaggacttcaaaggactgttttggaaaacaaggtagaaaatcagataatcacaactgtaactaccagctgaccatagccacagaaagacgccaagggagaacttctgtc

SEQ ID NO: 3497 - DNA, 201 bp, Bos taurus
agactcaatgtctatgcaaactgtgcaagaaacagttcaggtggcaatggaatagtatttactaatgaaagatctctgacaaaggagactcctcgatgtgtcattcaaagatgactgctgaaaattgctgtgttatgtgagatgaatacttaaagcccaaattaggctatcgttttctgcttacacatgacattatttcat

SEQ ID NO: 3498 - DNA, 201 bp, Bos taurus
ggtcggggtccttggctaaggggagactctgccttgggcccaccggtgtaataaactgcactccactatctgcattgtccttctgagtgagtttgtttcccggaactcgtggctacaacaaaaattggaaaggagcagagaattactgctgtaaaatgagtctggaactttttaactttttctgtgttcaaatctgatctc

SEQ ID NO: 3499 - DNA, 201 bp, Bos taurus
gccacgggtgtacacgtgttccccatcctgaacccgcctcccacctccctccccataccatccctctgggtcatcccagtgcaccggccccatttgaacattttttaatagcttattaaactctttctaagttctacatctgagattcctcagaaacagctttctttgcttttttccccccttatataaaggccacacttt

SEQ ID NO: 3500 - DNA, 201 bp, Bos taurus
tgcaacatataagcaaaacttaataaaaagaatataaagaatgtcaggagcttctttacctcaaaaaatcaaaatgttgccatctttgggcatctgagatggggacattctgagccgctcagagaggaatagctctgatctcagtctgcagtgcttgagagtttgacctcaggcaaagaaaacacatgctacttcttgaga

SEQ ID NO: 3501 - DNA, 201 bp, Bos taurus
cagtattcttgcctggagaatcccatggacagaggagcatggtgggctacagtccgtggaatcacagagtcggacacaacttaggtgacttagcatgaatacactcaaactattatagtatctgtttgagagttggctttatacagaacacatattgtaacaccctctcaggcaatgagctgccttttgtactaacacata

SEQ ID NO: 3502 - DNA, 201 bp, Bos taurus
attatttatgtgctttccttattgtgtttcttccccttcaatatgtccccagggcatccatctttctgggggtttcattaggtttccctgagaatagttagagtaagacatgaactaacattttgcttttggcattcaaaataggattttgcagtgaaacaatgaccctcctagcaaggacattttcttgagagaagattt

SEQ ID NO: 3503 - DNA, 201 bp, Bos taurus
caacaccacagttaaaagcatcatgtgccactgaaagacaacatgattaattatatctatttacctgtttactcctgttctaggtataagacaagaacattggtggggaaatggcccattatccatgtgcatgtttaagtataatttggttaatcgaatggggagtggggaatagagtaagatccgaggaaagtcttctct

SEQ ID NO: 3504 - DNA, 201 bp, Bos taurus
ccataagtcaggctctaatatccgtacttgtaatcactgtcccatggtgccttcattaagctaaactgaacacaattcaattgctcatgttaaaaacagcgtataatgtgtaactattgcgactgtggtcagttagaactgaccctaacacattccctgtgatagaaatatggcctttatttttcaaaataaatcctatgt

SEQ ID NO: 3505 - DNA, 201 bp, Bos taurus
tgtttttctttttacttcaataaatggttttataaattttacattatgttccttagaatcacttaaaggctttactcaaactatatctcactggaaagcagttcttagagactacagtttaacaggcctgggaaagaaactcaacttggcatttttaaaagaagcccttcttctttcagtgattctgtcatgtaattagtg

SEQ ID NO: 3506 - DNA, 201 bp, Bos taurus
aagctactacagctgcaatagccaatttcattgtatgaatataaaataaactgtaaattataaattcaaagtatctcctatatgaaagcaatccacccacggacaaggactagaaatctctaaagaagtttttgtaagtggtaacaatgaataatttagtttagattcctattcctatcacccatatattgggaagttgaa

SEQ ID NO: 3507 - DNA, 201 bp, Bos taurus
aaaaacctaaggtttatagacatgaaacaactggcctagagtcgcaaaattaataagtgacaaattaccagattcctcaattcaagtccaaagttctcaccacaaatggccttagaatacggcaaaatggctatgctttcagaagtgtatttaaatactgttacaagacctggtaaaatgagagaatcataccaagaacag

SEQ ID NO: 3508 - DNA, 201 bp, Bos taurus
catgaatgaaagaggctggtcaccttataagtttttctaggtccagaaagagttctaaaaatatacaagtgaagtcagaaactggctacctgtctctagacggtgggcctcaataagcttgacctaccagaggcttttcttttcttcctgtgacctgaggcctcttaaagttaagtgcaaatcaggcagctagaattttgt

SEQ ID NO: 3509 - DNA, 201 bp, Bos taurus
tgtctttttaataaaatataagttccttgagggaaagttctggagaagttcagcatgttatagagttttaacaaaagttataagtaaccagaaaataagactccagaagatattgtcatttagccttagtaaactctgatcacacttccttaaaaaaaaaaaatcaattagttatttgtttatttttggttgtgcagagtc

SEQ ID NO: 3510 - DNA, 201 bp, Bos taurus
cactgggatgggagacactgcccagaatcaagttgcttttaaggacctaagtggaagaggtgggaaatggaatgctggccgtcagtctcttacattctcatcagataaggttcaagcttaagctggttgcccagctacagactgtgggcccctaatatgagaaactgtgggcaaccaatattgtcttccacagtaaaatgc

SEQ ID NO: 3511 - DNA, 201 bp, Bos taurus
tcaacatctgtatccagaccttttgtaggtctagagagtcctcctccatttttggtggccagtgaagtgacactgaacatcctaaggtgtaaaagcctccctacccagaagactgtgcttggagctctccagggtgctggagaacttgtttggcttctgagtaacctgtatctatctatatcacctacaacaatgatttac

SEQ ID NO: 3512 - DNA, 201 bp, Bos taurus
gagctgccacaaagttttgttttgtttttgaagacgatggcaaattaatggcatggaaggagcactagggatctaggaagatgctgactccaaaattggactctgggataggtgaagtgtgggagagtcacctcttctcaacagtataagggagaatctgagtttcaagattaactggcacgaaagtaaggttctcgcccc

SEQ ID NO: 3513 - DNA, 201 bp, Bos taurus
tttctttgtatatatgtattttaatatgggattccatatgcattcatcttgtatcttttctgttcctcttccattgcagaggcagctgtattaactggaacggtgcccttctgtagcccactattggagtgtgcattgcttaatcctctcctgcttatttaaacttgaagcctctaatgaatgaaatagtttttgactctt

SEQ ID NO: 3514 - DNA, 201 bp, Bos taurus
agaaatttataatgtggaaagttgaacacatacctttgaaggtaagcccttctaacagtgctacgtaagttcccccagattgtttctaagtatgtccctgaattcccccaaatgagattacagctaccattgtgtctttgctttttaaaatttgaaaatgttgccatagcagaagatacagatttcccttgttgtcaacag

SEQ ID NO: 3515 - DNA, 201 bp, Bos taurus
tcaccgagttgagctaaatctaggattggaacctcactgaggacaagccaccagagccaaggcaggcaggatggactggacacaggcctgtgtgttgggagcatttaagtagaatcaggggtcagccagtctcttttctataaagaaaagtctgggtctttttgctactgcttccacatcctcctgcacattagaacaact

SEQ ID NO: 3516 - DNA, 201 bp, Bos taurus
gagtagtgccaagttggcactgccttctctctgccaggcttcttgatctgttgtttagtttcttcgtggatcagcatctttggccatcaggctgcctcacacaactcattaattgtttccagttttatgctgtcagcttcagctatagctcggcttctcttccttgcagctggtatggcctcggctcatcatccagtactg

SEQ ID NO: 3517 - DNA, 201 bp, Bos taurus
ctgggcactgctctggggagaggcccacagacaagaatccttagcagcgtggaggtggcacttagccgccacaacccagaaagattctgggcagggaatttcaggggacattctgaagcaggcctggatgatggtgtgtgtgtgtgtgtatcccagtgcaggccaggaagcccaccaagacttgtgtactcccagaagcct

SEQ ID NO: 3518 - DNA, 201 bp, Bos taurus
aaggaaccaagggttctagatctggggcaaagcagtaactagatgattactagttacctttttctgtgaggaaataaagatgtgctccagtggccaaagttgtaacatttaaagcatcaaaaggataacttaagcaaagaccctgaatcaatgaaactcatgggcccataatacaccataaagagaaagtcaaggagaaaa

SEQ ID NO: 3519 - DNA, 201 bp, Bos taurus
gagattatcaataatgccatcgtgcactaccgagatgacttggaccttcagaacctcatagattttggccagaaggaggtacgggttgaggaggagggtcgtcatctagtggtctgggaagctatgggtaaatgttaatgctatcccaagagacaactcaccctcaaggtctgtgggctttttcattacctgataggtaat

SEQ ID NO: 3520 - DNA, 201 bp, Bos taurus
aaaacatgaaaatgtaaagcgctgtgacaatttggagacttacagagttaggtattatttcatcaagtcccgaatctaatattatttccccagtgaggccgtactagatctcactggtgttgaactgtgttcctgcagctctttgattgttattgtcttctctcttgctactgcactttagaccttccaaggtggaggcca

SEQ ID NO: 3521 - DNA, 201 bp, Bos taurus
gaccttgagaaaccagatggattagaaatactgaatgtcagaactggaaggaaccagttctcaccttccacagtgccctcttacctacctccctcttattgtgtaataaggaaactgaagaagagagtactttaggtgacttgccaaaacctaataaaactgttagtgacaagccaagaatagagggcagggtcacattgc

SEQ ID NO: 3522 - DNA, 201 bp, Bos taurus
catccctccccttagactgaagcgggatttgggacgtattcaggaaccaggatttggggggcagaggtctgtgatactggggaaactgacactgcagtggagcaggaagcggagactagagctccccgaaaaaatctctatttgggagggggtgggggctgagggacaccaagtgagaagtagagctaacctgctaaagct

SEQ ID NO: 3523 - DNA, 201 bp, Bos taurus
tcttaagtggactggtatttaagaaaaatgcttatgttgtcgatgccagtttcctttgactctgacagcaacctgtgctctttgttgtaaggaagtctgcctttcagccccacacctcagcagccctccacacctcctgcaggtcagtgctaaggctttctccagtgcaaagactgatgactctttcggtcagtggaaaat

SEQ ID NO: 3524 - DNA, 201 bp, Bos taurus
acttatacttttagaagttgtacggtcattgtgttatcctagccttgccagtaagagctcttagattaaatcatactgcattcaacatccagttagttgcgtcactatgatatctgataatagtggtacacatgattccgttgaagaagcagcagaagagctgaactatggacacattagagatgtgaactttaaactgaa

SEQ ID NO: 3525 - DNA, 201 bp, Bos taurus
ggaccatgccttcctctctgggcccagtgcctcctaccatctccatggcacagacctgccctccatccacatagctattcatacctgtcctggaccccagctgagctgtatgtgctgaaacaggccccgcctacactggccgccaggcctccatcagtgagcccagccctttgcattagggtccaacagggttatcagttg

SEQ ID NO: 3526 - DNA, 201 bp, Bos taurus
tctgtacgctggctgttccccctccggagtggtggcggtgaggagagaaggtaaatgggccaagtctgaatgattcggtgcagggccagggaaaagtattgtttatattttcaaaggattgttttaaaaaaaagaaaagaaaagaaaagaagagtatgtgacagagaccgtatgtgaccaaatctgggccttaacagaaaa

SEQ ID NO: 3527 - DNA, 201 bp, Bos taurus
ttccccacaacagcagagtggtcactgaacctgtttaaaacactgcaatgatcttttccattacattaaaaatataactcaaccctttaatctggcctacgaagtcctaatagggcctcgccctgcctacaatttggaccctttctcgtatctcgctctctacccagccttccagcctcatctctcttccctgagcatgcc

SEQ ID NO: 3528 - DNA, 201 bp, Bos taurus
aggcacttggtaaatgtttatccatttgtacatttgttagaagtatacataactagggtatgcattgtcctggccaggaagcacagagtctgactgtgtggtagactgaagctatcttggtttcctcattagagaaagcagattccagagaagtggctcagagaacacatgctctggtccaattacacacaggcttggagg

SEQ ID NO: 3529 - DNA, 201 bp, Bos taurus
gaaatcaggtaaggtgaagagataaattgcaggcacccccccctgccccgcccacccacaaccccagcaattccttctgttgcaaaagaggctgaattcagcacatacaggaagtgttactatgcaattggtgtaagtcaaggagagcatgatccttgaccacagtccttcaaggttcatgaagtaaacatggacccagaa

SEQ ID NO: 3530 - DNA, 201 bp, Bos taurus
gacattattactcagataaaagattaagctagacgctttacagtaagtcttaaattttataaaaaggataacttggaaagctctgtcagtctgtccctgcgagggcgaacagagctttaagaatggagcttctgctactgtagcttctcccggactctataatggagacaaacaatcctagtttcagatatgttatcaagt

SEQ ID NO: 3531 - DNA, 201 bp, Bos taurus
tgctacactaatagcaggcagctctctcagtgcaatttatggcttcacagctctgaaaattacagtcatttgcagtcttctccattagtgccctgaccccatccagttatgtctgcatgtttttggttcctgatgtttaaagcttcttgttgctttactacctgagctccccaaactgaaaatgtactttttccatttccg

SEQ ID NO: 3532 - DNA, 201 bp, Bos taurus
caaatctatatagtagtatcaaactgggcttcactggagtcagagggttgataaacactagaaaatcaagagcagctctctgcttaaggacatgtgatgttattacgtatttttttaaatgagttaaaaaaatatatatttaaaacattttactggggcgggggccagtgggtaggttgtagagcttttaaagtaaatatg

SEQ ID NO: 3533 - DNA, 201 bp, Bos taurus
tgtctacttagtaaataaatactatggctttctgggttcccacatataaaaattgtggcatgccctcagagaccagccagatatatgcaaattttaccctgtatagtttctgtctttcaggcattcatttcccttcagtttttacctgcttttcaccactcaccagtactttcaaatagtgtggggttttttgtttcaggg

SEQ ID NO: 3534 - DNA, 201 bp, Bos taurus
gaggtcttgttggaatgcttattctctccacctctcctataacatctccacagctgctcacaggaaattgggtgttatgatgctgggaagggaataaacaaagagaaaattgagaagatattgcaatggaaggaatgactcaattgatataagcctaagtgagtgtgcacttctttgggctaagctcgaggtggtacattg

SEQ ID NO: 3535 - DNA, 201 bp, Bos taurus
tgttccttgagctctcttactgtacaaggtcaaacagaatcttaagccaacattttcaaaacctcttcattccattcttaaagatatccatcaatggatactttgcgtctgttcaattaaaactaccacagcccctgtaactgttgagaaaaaccctttgtgctttgccaaagacaccagccagaaacgaccatcaggaca

SEQ ID NO: 3536 - DNA, 201 bp, Bos taurus
atcccaatatattgtttgtaaaactctgaaaggaccaactggaatcactggttctattaaggaaacaaactactaaccaacacctattaagaaggacaaaggtacacagagcctgcgacaagatttaaaggagcaaaacacccctcgcacagcaaggcagatggcagagcaagggcaggctcattcaagctgctcctgcag

SEQ ID NO: 3537 - DNA, 201 bp, Bos taurus
accagtgacagccatctgatggcctggcacccctaccttgagttagttacaagcagcactagcagctttatgtagctaaattgacatcaatctggaaaattctaggccagaagggatcataacaattctaggagataacatttctaactattatgagccttgtgtgcgttagtcgctcagtcgtgtctgactctttgtgac

SEQ ID NO: 3538 - DNA, 201 bp, Bos taurus
catcatttattgagaactccatgttctaggccaggtgctaagaacactgaaaaactgtcctgacatagacaggaggaaactgaggctcaggtaatttaaggaattggcctagagtcatgcagcttttaactacgaagctctacttctcattttgtatataaagtctactccccaaactggaatgtgcttaccctgaataca

SEQ ID NO: 3539 - DNA, 201 bp, Bos taurus
aagtcattgtaaataagtaagaatgacttacaggcatgggatatattccagatggaatctttaaaggattaatttgtcatagcttctgaggatttattatcgattaacaaagatctacaatgaaaaattgaccagtatccgtacttctgtttgaggactggtttatagaagtgtaataaaagtactttgtgaatatatttt

SEQ ID NO: 3540 - DNA, 201 bp, Bos taurus
aggtacttttcagccttttacagagaactcagactgtggccagatccgggcctctcctagaccacacctggccatagccaggtgacaagccgggccttggtagtgtgggggcgtgtgtttttgtcaggatgggaccttgtaatcacagatgttctgggacctctcacaggggtcccaaaacacttgtttaaatgatctttc

SEQ ID NO: 3541 - DNA, 201 bp, Bos taurus
gctctccaaggccagtaccacgtgttgagaattcagctggcagcacctctaaactacacgtggccaaagaggtaacctataaattcccatcaacactttacgttgcacgatatttcctttggattgatagcactcctcaagtgaggccactcccccactattgattcaaccttctagtctgtttctctgtccttgttgcct

SEQ ID NO: 3542 - DNA, 201 bp, Bos taurus
tgggaagagctgggagagcgagaagtatcctaagtgggcgtaaggccgagatgacaaccacagggaccgctcactgtgccagaggccagcatctccaatgggtcctgtgggtctgcgatgcctggtgtgagactcgccactgtgagaacagaaacacactgtgtggccactgtaggtacctcgtgagctcagagaaaacga

SEQ ID NO: 3543 - DNA, 201 bp, Bos taurus
aagctggtcttgttgcttctctcatttggaaatccccaaggcctcaccaatgcctgctggatgagaccctgatctggatgcttcttgtcctggcccggcctccaacagtgtttatatctggtccacttcccaacctgtgctgtgggcgctcagctctccatgccttgtctatgttgcttgttccctcagggcacctcttcc

SEQ ID NO: 3544 - DNA, 201 bp, Bos taurus
cctgagcaccctcacctgctgggtacataattgaagtgtggtctcccagtctgcagctgtcacggaggaattgacaaagagacatgaacagggcccaggcgcaaagcatgctctcctcggcagccttgagcacaggagaatgcaattttccacaccgtgcacaaggggaaggccacagaaagttctgaggccctggaagtg

SEQ ID NO: 3545 - DNA, 201 bp, Bos taurus
gctacacgggcttttctccagttgctgcgagtgggggccactttccagctgcagcgtgcaggcttctccttgaagtggcttctcttgatgcagagcttgggctctagactgtgaaggcctcgggagttgtgatgcacatgggccctgttgctccctggcatgtgggatcttcccagaccagggatcaaacctgtgtctcct

SEQ ID NO: 3546 - DNA, 201 bp, Bos taurus
agtatgtgcactgagccaaaggaagtcacacggtgctatttcccccatggctagactgcacagcggtggggcggaggatggccccagggactcagtcatcggactcacacctgatggcactgggaccctaatgctgaaggacaaggaggctaagaaaggagccattacactggcaaggatcatcgacccagatggccacag

SEQ ID NO: 3547 - DNA, 201 bp, Bos taurus
cttggtgatagtaccatgagtgcatggtattggtggaggccatgaagggactcccaatcaaaatcagctcttaagcttctcaggagacaacttacaccattctgggagcaaagccagcccttcccctgaattaacagtgctgtgggaaacaaagcctaccaaacactactggtatggtgtggttcattctcatggtcaatg

SEQ ID NO: 3548 - DNA, 201 bp, Bos taurus
taggactcatggaactcaacatagagttgtaccgtggctacgatttagaacagtgatatagtcagggtacacaactggctgataaggggaagaggcccatatagttcagttcagttcagttcagtttagtcactcggtcatgtctgactctttgcaatcccatggactgcagcacacaaggcctccctgtccatcaccaac

SEQ ID NO: 3549 - DNA, 201 bp, Bos taurus
tgttatattggtcaattaaaacatttgttctgtttgaaaaatcaggaactgagctcctgtaaatgcctcttattattttgctggccctgaaaataggggcatgtgtgtataaaatcccttactggaaggagttaatgatctggtaggcatacatactgatatacagatgataagcagcatatgatagctaatagaactgtg

SEQ ID NO: 3550 - DNA, 201 bp, Bos taurus
ggttcccagcgggagagcaaggcctagccataatcaccttaaggtgaaccatgtgactccctgagaagggtccagagccccagcagggtcactgccacaggctcggctggctcgcaattctcggcctcccttctgggccgggtcactctgagttaaagtactgtggtttacgtatgtctatataaagactttcattacttt

SEQ ID NO: 3551 - DNA, 201 bp, Bos taurus
cactttcaacttatatatgaatcccgtgaaatgagggggtccaaatgggatctcagtgttccttattcttcactggccatatcagcattttcttgcttacctcagttcagttcagttcagtcacttagtcgtgtctgactcttttcgaccccatgaatcgcagcacaccaggcctccctgtccatcaccaactcctggagt

SEQ ID NO: 3552 - DNA, 201 bp, Bos taurus
agccactttcggcttttgtgtttctaacctgtctcttcatgaaaggcatgtgagtttgacagcctggggattctggtcaggccgacgctgagctcaggatgttagaagattacctaaggacaacagtagagaggaggctcccaaagccacccttctaattgggggccataagtgatttattcttagcccttggtttctatt

SEQ ID NO: 3553 - DNA, 201 bp, Bos taurus
tgtaacttcccaccagggtgccctggaggtcagttaaagatatagcacctagcggtgcctttgcagaggcgctggttccggtctcctggggcaggcctgcgtgaggagctttaaagaacatgctgatgactccaaagcccaccctccttctgctctcacagggacaatgaagtggccataccaagagggcaggacagcatc

SEQ ID NO: 3554 - DNA, 201 bp, Bos taurus
gagaattccgtggacagaggagcctggtgggctacagtccatcgggacaccactgagcaacacacacacacagacactacatcttgtttttcttttccaatgcttttggtacaatacaatccaaattacctttctaagacatgaaaagactctttcacactgaccacaaaagaaaatccacactctttagcatggtggtca

SEQ ID NO: 3555 - DNA, 201 bp, Bos taurus
tcttagaaacgagacatgcttcaggatacctgctgaatcaaattcccaacttgagaggagctgaaaaaccactttccccgaaaaggcctattatctgtataatgcagcgattcgacctgttctaccaaaagaggtgcaaatccttctgaaaggaggaatcagctaagtgtgggggcccaaaaggcctctctgaaaagaggc

SEQ ID NO: 3556 - DNA, 201 bp, Bos taurus
gcatcggtgcgatagcccttcctgccagagacaagcagagctgaggaggagagtcaggaggcccaggggtcacaccgggcccgggacagcctgtctgaacgtggtgcctttccagggcacctagtctagtggggacttcagccttccttctggccagctgctcccatgccatccactggtggatttaatgtctggaggcag

SEQ ID NO: 3557 - DNA, 201 bp, Bos taurus
agtacacctctgctgcagctgtctggcctcgaagtcatttaaaagcttcgaaaaaataaaagatgccaagagtctgtggcgccctccatcattcttctcactgatggcctgctttgggcagtaccatcttcactttctacctgagccggctgtgcccccttcccttaaaaagtctagtcgtccccgccccccttcccttaa

SEQ ID NO: 3558 - DNA, 201 bp, Bos taurus
ggaggagtgctggctggctgccaggcagccaccaactcggggtcagaagggcactgagtctatggagccccgcacctgctttggccacggggacctgcgggaatgaggcaggagtgcagaaaccatgctgggatagctggtggtgtggggggtgccaggtggccccaacagcacacaaccagggttccagggacccagggc

SEQ ID NO: 3559 - DNA, 201 bp, Bos taurus
aaatctaaatttatccctctgttttggactcaaatatcattaatttatatttcacatttataagtactcatgattgtcagtaaatggccagaaaatataacagactacatgtgttgcagtagctggaaattcaaaggtgaaacagattatgactcaaaaaaatgaaaggctatgaacatcctcattaaaagagttccttca

SEQ ID NO: 3560 - DNA, 201 bp, Bos taurus
cctggcctgttgtaggttcttttgcatagttgttgaattaattgagtaatgatttaccctttaaaaaaatagggtagtggatgatgtaatcaatgaggtataggccttatttaaggaaacattgctatattattttcactatttcatctgcaataggtgcctctaattaggaggaatgttgttctgattttcctcttagac

SEQ ID NO: 3561 - DNA, 201 bp, Bos taurus
ctatgaagagtggctcagagcagtccagctgggttggtgaggaaagagctatgaaccagtgtggcaagtggggagggagaaagagagagagagaaggcccagaagtaacagagagagagatctggagaaggaggagactaagtaagaaaggaggaagggaagaaaaaaggatctagaaatagaagcaaagagcacactgtt

SEQ ID NO: 3562 - DNA, 201 bp, Bos taurus
ttttaggaaacccaattcatttttctggatgtaatgtttagggaaaacaaaatccttacataagaaataaacctgcctcccctccatgtctgttcctgatctcgtctgtcctacagaatttggacctcatagtcctacttaagccatcttctcccaacattcctattcatctggctcccttccagattaaacacccctctt

SEQ ID NO: 3563 - DNA, 201 bp, Bos taurus
acagcatacatagagagtgcccaaactgtcttatacagtttgatgaacatttttatacacatatgtgaatctccatccagattaagttttaggcaatttacagcaaccagaaggtttcccagtgcttctgtccaatctccgatctatttatactcctctcacctcccactaactgatttctattaccatagattcaatgtg

SEQ ID NO: 3564 - DNA, 201 bp, Bos taurus
gcagcctacagaagctcccactgggcagcaaggaatgtacttgctttacataagcctcccaaagcagtcatcacacatatgtaggcctttaacgaagacagtccgatgacacaatattttttccctcactttcatcaaggcaaataaggaataatatcaattttggcccctgactccaaagtatattccattttcttgagc

SEQ ID NO: 3565 - DNA, 201 bp, Bos taurus
tcagactcctgagatgcgaacacctcctccccagaaaaaaagacatttgactttggggagagggtgaaaaagtgtgcccactatgggcctggcagatacatgggaagaacctgagccccaaagaggagagggaacttgcccatggtcaccagacacagtggccctggattccaaatctgcctggctcaaaggcctatcttt

SEQ ID NO: 3566 - DNA, 201 bp, Bos taurus
ttgtccattttaaaatcaggtatttgacttcagtgtgttttttgttgttgttttggttttctgtggggtttttctttgtttctttgttttgctattgaattgtaagagttccttacatattttgtacattaatttttatcagatatatgatatgcagatatttttgccctttctataggttgccttttcatttggttaatt

SEQ ID NO: 3567 - DNA, 201 bp, Bos taurus
ataatgtcttttatatgcttaaacattaaaaagaaatgtcttactggcctgaaatttcaagcttagcttgagattcttagttcttttttttttttttgcaataggagttatactcagtaaaaggccaaacccattggaataggagaatcctttcagaagtccagttttaaatatatttgaaaacattttcacagtatttcc

SEQ ID NO: 3568 - DNA, 201 bp, Bos taurus
tccatcctccccgtcaaaagacgatttaggcaatccaaacaaactttaacacttgaagcaggcactctccacttgcaggggcccaaaatactgcaaagggaagctgaagacaggaggataatgaataaggaggtgagtagagagccacatttggcttggtgtctggccaactggctgtactgtgtttctggtcaagcagac

SEQ ID NO: 3569 - DNA, 201 bp, Bos taurus
gtgtggctggaacatgggaggagtggggagaggtcatatgaggtgtgtcaggtggaggcaagggccaagccacgtgagagctgatgggccaataagaaagttggattttattctaaacacaccaggaagccctttgggaaatttgaagcaggggagtgacattacttgattcattttttttctttttttttggccttgcca

SEQ ID NO: 3570 - DNA, 201 bp, Bos taurus
taagaatatggatctccaggcctctctccagactctccaagggggcaggaatgcacagtttaacacctgccccagtgcctcagcatcacctctaagactcccatccctgtccttctagccagcaggccagttactgaagcttctcagaagaaaagtgttaatcaacttctttccacctgctggccatggatgcctgagtac

SEQ ID NO: 3571 - DNA, 201 bp, Bos taurus
aatgtctgtatccttaaataagagacacctccttccccatttgggagaagcaaccagaatggatcctagaactcaacagctaccaagacgcccagacctctgccgtttgtgcagcacatgcaacatatatccaagtacacagaagccaaaggactgctttccttctttatggcttgatacacttaaaaagtttcaagctag

SEQ ID NO: 3572 - DNA, 201 bp, Bos taurus
actgctagtgaagggctgaggaaaacttactacccaccgggctgtttatagcttccggaaaaatgttcaagataaaagaatttcagggttccttaggttcgtttgtttagctattttgcatcttcttcttttgaataataacacccatggctaatgaactatgtcctcagaccctggattgggtacccaaatcccatcata

SEQ ID NO: 3573 - DNA, 201 bp, Bos taurus
gacagtgcgggcagagatttggtctggcctctgtcctcgggacaggacagggactgtgggaaggttgcttccatcacagaggacagcgggacaggactctaggccatactcaacaacaggacctaatttggacaacagaagtaataccttagcatgtcagtgcactaattttttcctccaagtgtactgcacatgtgcatt

SEQ ID NO: 3574 - DNA, 201 bp, Bos taurus
ctcgccctgatgttctcagagagagcaatcgtcagagtggggtgtagcttaggaagagccaacaggtcaagttcaaaaacaaagacctggctaggcctgactgttggggaaaacaatgggagtgttggtcacgaaatagggaaggagaaccacagagctccttggatctactttaagcccgctaaatcctaatgacaaata

SEQ ID NO: 3575 - DNA, 201 bp, Bos taurus
ctgggatgtccagttcactcacacagcactcctagctaacaatccggtttttcatgtgtgtgtggatagagagggagcgagggccccagtaccctcagggcgctcttcgggggtaagccaatggcttctatggtccagacaggccaagatccctaatgtgagctgcagaggttggaaaccagctgatcacttttcttgaat

SEQ ID NO: 3576 - DNA, 201 bp, Bos taurus
ggtaacagttactatactggatggagtagaaaacaatttccgtcactgcaaaaaggtctcactcaacacaaacgtatgaggatataggcctccaaatgtgattttagaagatcagttagtgccatgaagacgttaaaaattatttagaaagaaaaacagaagctccaatactttggccacctgatgtgaagagccgactca

SEQ ID NO: 3577 - DNA, 201 bp, Bos taurus
ccttcagggttgtggctttcaaaccgccagtcacatttcaagtgggcagtcagagaggaggccagggagccccttatggtgtcccctgatggcaggccacaactccttggtctgctcctttgtcgttgaattctgcacactgacttgttttagaaaattttccctgccttagctcatcaggtcagactctgatgggcaatg

SEQ ID NO: 3578 - DNA, 201 bp, Bos taurus
agggtgaggctcatagccagctcagtgcccaccagctctgacctgggcagcctctccaagtccctggaggctgccaggagggccagatgaggccgtgacacggtgatcagtgcgctctgacctccctttagccacctaattcagttgtataacatttattagtatctgatttaatcccaacattccttgaggctggcacca

SEQ ID NO: 3579 - DNA, 201 bp, Bos taurus
tctatgaatacttggtggcgggagtacttatcctaaaaagaaaataacaagtacaaaggccctgagcaaagagcatacttggcctgctgaagaagcagcaaagagactggtggggtaaaagcagaacgagatttgtttctctttcaatgtttaccattgtggccacagtttactctttgcaagattttaatataacctttc

SEQ ID NO: 3580 - DNA, 201 bp, Bos taurus
ctctaagtacgattcctcggccaagttcccatcatctgggaacttgccaataacacaaattaccaggctccattccacttcaactgaatcaaaaactctggggctgggcccagacatctgtctgcactgcacccctacaagtgattctgatacacattcaaatcttacaaccatgggtctagggtaactgcttagcagttg

SEQ ID NO: 3581 - DNA, 201 bp, Bos taurus
cagtgcagaaagcgcttccagtaactgaggctgacctgtgaggttgctgtgctactcatccactgatttctccaagctcctgtgtggaggcctgcgcaggtggggtggagggttagatatccggcacttcaggtctctcacagggtcccagagggaccagagaggtggccagagtggttcttcagacatggactgtcaggt

SEQ ID NO: 3582 - DNA, 201 bp, Bos taurus
tttttcctgtctctgtgcctttgatggggcgctttgccctgcttggtgtaccctttcttcccctgtctataaaaatagcgtttttcttttaaggccagcacgagccccactttctttttgctaacagacatcagcttacaacagattctctttttaccattggtatttaacctcgtgtggcctcatgctgccaattgatgt

SEQ ID NO: 3583 - DNA, 201 bp, Bos taurus
ggaccaccagggaagtccctgtggtgtccttgggatcactcctaatcacgatgcagatggtgacatctttcagaaatcattaactggcccattttgttctgtcttgtttcagacaggagcagatatttgtggattctttcaagatgctgaatatgaaatgtgtgctcgctggatgcaactaggggccttctaccccttcgc

SEQ ID NO: 3584 - DNA, 201 bp, Bos taurus
tctttttaacagatgtgacattccagcctactcctgccctgacataccgcaccacaggaggcattttggacttttatatggttttggggccaacccctgagcttgtaactcaacaatacactgaggttggaagttattctacccatcaatatatcatccaatgtttgctgggtattgccatgttcttagcactgagaaagg

SEQ ID NO: 3585 - DNA, 201 bp, Bos taurus
gcaagagacccaacatgcttgggagagagccaccctcagactcaccgagaaatagacattgccgtcaggcgagacgcctccgacaaccaggtcgcttcccgctctgctgtagcgatctgtgacacccaaacccacccagccagctgtccggacctggagctcgaaagtgatgatctcagcctcaaagtcaaagtcccagcg

SEQ ID NO: 3586 - DNA, 201 bp, Bos taurus
gaaaccacagcaaacaagtcaaaccaagataggtgatgacactggacagtcagtatatagaatgagagaagtaagcaagctctatatttttagaagttacataatagaaactgagctttgcatcatcccatagaggtcttaagaattggagccaaggctaaacctcgttttcttaactctgaatacagtgcattctcttca

SEQ ID NO: 3587 - DNA, 201 bp, Bos taurus
cccaggatcatgtattggaagagttaatattattgagaaggaaaaactgaattccaaaattccagctacctttcttggcctggaaattgacagttcagttcaattcagttgctcagttgtgtccgactctttgcaaccccatggactgcagcataccaggcctccctgtccatcaccaactccaggagtttactcaaactc

SEQ ID NO: 3588 - DNA, 201 bp, Bos taurus
agtgatccctgcattaccattcagattcatggaaaatgagccatcccatccaaactaatatcttttccttttacagaggaaagccatagaccaattattcgaatttaaataaaatgattaaatagaatttctgtgatcttggggatgaaatgataactgctgatgttgagggaatctgcagtgaaaaatacacccatatcc

SEQ ID NO: 3589 - DNA, 201 bp, Bos taurus
tggtcctggtgggcctggccaagtcattctagctgagtccatgtttcaggaacttgggaatcagtagcgggtggaggagagggaatttctgcccagtttcatccctgctcccaggcctgctgaaccggctctctttagtttagaggagccggagagactgggagggggctgagagagaggccagctattgttctgactccc

SEQ ID NO: 3590 - DNA, 201 bp, Bos taurus
ccatatattgtctgtccctggagtactgagaagtcataaaataattctctcatcctttctttgatctaagtttctcccctaaaatgtggattaaagctggcacactttgttgacaccttgagatgcacttagagaaatatacccattctaggtccacctcagtcagttcagtcgctcagtcgtgtctgactctttgcgagc

SEQ ID NO: 3591 - DNA, 201 bp, Bos taurus
gtctcttttcatctttgaagccttccagcacctagcaacacatcttacaaaatataaggacttggtaaattttgattaaacaattgaatgaggccatctactgagttttcatacctagtcctgagcaaaagattttgaaaatggaaattcatgttttattatatgagtatttgcatatgtacattttaggctttaacagaa

SEQ ID NO: 3592 - DNA, 201 bp, Bos taurus
tagaagacctgctgtacagcacctggagttagagtgaggcccctcctgattcataggcaatagtggatcagctacaaatgaagagatgaaagcaaccttccctggtcttaaggcctcaaggcctctcagagtcctgcttagctgcaacactctagttctctgggatactctacagaggtaaaagtgcagcactctcagctg

SEQ ID NO: 3593 - DNA, 201 bp, Bos taurus
agtagttaaggctttgctcttccagtgcagaaggcatgagtttgagccctagttggagaactaagatctcacatgccacgcagggggaaaaaaaaaaaaacacaaagaattccaagatgggcttagtactttcactttaccttctgccaaggtcttctttggtagaatatgagatgtcccactgaaaacctggctggcttt

SEQ ID NO: 3594 - DNA, 201 bp, Bos taurus
tgtgtgtgtgtgtgtgtgtaagcttcctacaccaaccggcaattttcagatgccagcaaggtgtccaagaattcaactcaattctaacactacccagaaatagcatcacattccatatgtaagaccaccctccacttcagacactagctgcaagtccaggttgtcactggttcttctgacagactggttatataacccatg

SEQ ID NO: 3595 - DNA, 201 bp, Bos taurus
aagaagagctccagggcttagactgtcttcctcccgagtgtgaagggagaaaggcagagtggggcaagggttggagggctgaacctttggccaaagtcaacggcaggaagagcagtcccagagacactgagcagcctctcactcggtagggaccatcaggtgtagaaatggaggggccggtggacaagagaggagcttggc

SEQ ID NO: 3596 - DNA, 201 bp, Bos taurus
tcaccatagagccaccgagcagatgactcacaaactgcagaacaattacaccaaatagtgactgtgacaagactcaaaacttggtcttctgacttcatctagggaggaagaagataggagtacaagatgtcctgctaactatgcaaggatttctggtcatggaatcagcttgggtcttggtctttcctccatttaactgtg

SEQ ID NO: 3597 - DNA, 201 bp, Bos taurus
tccttgttctttatactctgtctttcatgtccctgatcatcgatggtgaagggttctgctcctcagagagtgactggtactggccatggcaaattttacctactcgtgcacatccatccatccctttatcctcatccttggcaacctcaggcttcggggggcatttgggcagctgattttgttggccaggggcttctaggt

SEQ ID NO: 3598 - DNA, 201 bp, Bos taurus
gagtctggggtatgaaaccgcagggacaggtgcgctttgatcagcttccctgtgatctcacggctgtgtcctcacggacgtggccttgtgagtcctcctgctcatctctattaatacatcaccacaccgaacatattattacacatataacattatgaaacatctgcagtgtgtcaggtactgcgctaggccaaaatgatt

SEQ ID NO: 3599 - DNA, 201 bp, Bos taurus
cttgagtatgcacacattcaaattacagcatggtctatttccaagggcaagtttcttcctgcatatttattgtaggagaccggcctactaaaaggcatgacaaaagaattaaacaatcttgctgagaggacatggctcagtatgcaactcctgaaggaatccaagaaggaacaaacaacatcttgaaagcaggacgtgggc

SEQ ID NO: 3600 - DNA, 201 bp, Bos taurus
caaatgaaacaatcctgaaggcagaggtaagtggtttgctggccagtagctttgtcttcctttcccatgtattgactgcctgcccttgtggactttcaaaaatattttctggccaaacaggttccatttctcatgtattcaggcaagagatgacatttcttactggaaaagcccagtatctgttgctgtacacactctctg

SEQ ID NO: 3601 - DNA, 201 bp, Bos taurus
agctcatggtctggcccagaaagtagacactatatgcataactccaagtgtgaaagtagtagtcaggtgtcctctgggcaggagaagaggactccaggtcgcagagccacacccgtgaaggcctccaggtgacaggaaggggagctgaaggctctggaagccagtgggatgggggaagtggtgaccgacaaggatgctgct

SEQ ID NO: 3602 - DNA, 201 bp, Bos taurus
ttccagtaatagagatgtcagccccaaatggctggcaggccacttgaaacagccgcatagagacatgccagctggcatttgccgcacgctgtgtggggctcgcactagagcacaggccggtgaacattgtcattaacaatcctcgagcgatgatgtgttcctgcagtaaaaaaacaggtgatggatttgaaatgcagtttg

SEQ ID NO: 3603 - DNA, 201 bp, Bos taurus
aacgttggtttccagaggaatgagagaaacagacacccagtaaaggaaagtaattccttattagaggaaaaagctctaaggccaaagattaaacataatggcattgacataacctgatcatcgattcataatctgattaatatggtcaccactgttttgcggatcaaatgcaagaggcaggttgaggccaggaactcacgt

SEQ ID NO: 3604 - DNA, 201 bp, Bos taurus
gtgtgtgtgtgtgtgtgtgcgtgcgtgcgcgcacacacgaacagtgagtcaggcaaaacaagtcacacggaaaaacttcagcggcctctggactttctgaacttttctccaataccacatgccccctcccttccctcctatccgtgttcctcttactttcctttcaaataacttggccttacctttccagctggggctctt

SEQ ID NO: 3605 - DNA, 201 bp, Bos taurus
gctgacctatatcgggatggacatagggaggttttggttgatatactgttctctggatttgggttgagggtagaacggcattcctggtagttgtaggcccagcactgttcctcactgcatattggctgagggtctttctttccattttgagagactgtccacattcaattcttttatgactccctccatcttcaaactcat

SEQ ID NO: 3606 - DNA, 201 bp, Bos taurus
aagaagttggcagatgcttaatttggagaaattgcttacttttgcataaaactaatttttgtaagagccaggaaaatattagaagaaattatttatgtgcctaaaaattcaaacattttggttttgaacagaggcataaagagaatacatctcatatactttggaagaaagcctcagatgtatgaaactcaaaaggaatga

SEQ ID NO: 3607 - DNA, 201 bp, Bos taurus
gagcactcaagatgtccttcagtaggtaaatggataaactgtgatacatccagacaatgaaatatcatttagcactaaaaagaagtgagctctcaagctgggaaaagacatgaaggaaatgtcaccacatgctgccaagtgaaagaggtcaatccaaaatgacttcatgccatgtaatcccaactatatgacattctggaa

SEQ ID NO: 3608 - DNA, 201 bp, Bos taurus
aagtccaacaatatatgtttcatggaaatgctcaattgtctacagccagtgaaggattttctttttaagaaattaaagttttttattgtcaaagttatatatgtgggaatatagagaattttcaagctaagatgggctgttcagttggcctaaaaagttgcttgggcccagtaatacattggggtgaagctaaatgccaga

SEQ ID NO: 3609 - DNA, 201 bp, Bos taurus
gagctaaatgtagtgctttgaaatgcaagcagaatactttttaagtaggcatttaattttagtggaatttgcatttggcagtcccaattcatctgtttcaacatctgagtgaaatagccctctttgaattctaatggaatgaatacagtgaaattaaccttttaccacaaaaacatactactattctaggcgaaagctttc

SEQ ID NO: 3610 - DNA, 201 bp, Bos taurus
tcctgattgtttatctcttaaaatgttctattacgcaatgtttttctccatctttactatatttaccctgagttttggttgtcatgtctgttagttatataatcatagtttattcccatctatagttaacttccaggttttctttagattcctatatatatatatatatatattttttttttttttttccttccagactac

SEQ ID NO: 3611 - DNA, 201 bp, Bos taurus
gaagaagaaattaaaaagttcctcgaatccataataacttctatgaaattattattcattttttgaatagtctctcatgcatgaataaagagcttaatctgcccctaaagttctgatattatgaatgtgtagtgaaggtaaaaatttttgaaacagcttaatgtgctttgaccctttgtgtctctgtgtaggactttctcc

SEQ ID NO: 3612 - DNA, 201 bp, Bos taurus
ctgtctctgtagcttgtcctggggccccatacagggtgacagctgagacccaggagagcgagagcaagaactggcagagctcatgacgtaacacagcatagcatcacatcacagctgggacccccacaggcacagcatcacatctgcaggactgtgctgctcaaagaaagttacaggccaggggattcggggcaggagact

SEQ ID NO: 3613 - DNA, 201 bp, Bos taurus
ggaaagatcctgtttaggatatgcagaatcactctggcaaaatcaatcatgccacgggagttagtttcagtttggttaaagaaaatgaagaagtaaacaactgagtttctgggaaattaatatgggctcacactttagaaatagtcttgattaagtgtcaataagacaaatgagctaatgatgttgaattagaagttttaa

SEQ ID NO: 3614 - DNA, 201 bp, Bos taurus
catagattgtgtaatcagaaggaacctgatagcttttaggactaaatgactgagtagggctgattttgtaagagccagaattggtcagacaacaaatgaccgagaacttgacactgtgggtagaagttctgctcttgttggtgcctactattaattaagagcagggatcttaaggattaacatggatatttgcctctaaga

SEQ ID NO: 3615 - DNA, 201 bp, Bos taurus
gcatctcactaaagtttaaattagctattctcatatcaggcccgagtgatgacgagcacccccctcccagtaaaatgtacaaattgctgattttcacaataatgaaagcgggaaagcatagattcaattcaggagaagcttgtaaaatgtaatttcgcttttccaacctccaccccaacatgctgacaatagaaactcaag

SEQ ID NO: 3616 - DNA, 201 bp, Bos taurus
cattgtggggtcctgggtcccagggcctgctctctgtcagggtgcatttaccgagggacatgagagtccatggaataataaggcttgtcccagcattgtctgggtgttggccacttggacatttatttgttgtgtgctagaagaaacttaaaaagaacgttaaagatgcatggcccaaagattaatagaagtagagaagct

SEQ ID NO: 3617 - DNA, 201 bp, Bos taurus
ttcacacaagtttgtggcctgactcttctgcttcatgtggtctcagccaggacataagaatgactgaatggtacatagtggcctcagtcacgtgggtgcccaggagtttccctggggctctcagccaggggcctcggttctcttgcccagacccaccccccacctccggccccacctccaaggctcgacctcatggctgcc

SEQ ID NO: 3618 - DNA, 201 bp, Bos taurus
tgtggcccagcctccaccagagcctccgtcctgcagcccaggacctgtcactcatccgcaggacctgtgcgctctgcttgtcattcactgccctcacggagcgcctggtacccgttcctggcccggcacttctcaaactagatcatttcagcctctgccacgcatctcgtgtgtgtctcagtgtctggcccgtctgtccat

SEQ ID NO: 3619 - DNA, 201 bp, Bos taurus
ttgctctttctggacatttcctttgccttttttcctttgagtttgtctaactgttacgtaggtcaagtaatgtagaccttttgaagaccagcgaaacagcatgttagttgtgcttgtgtataagttttaccagctcttctccgcgcactctaataagcaaaatgattttgaactaagcgtctacatacgcatattacacag

SEQ ID NO: 3620 - DNA, 201 bp, Bos taurus
gcagcgctgggttatagacccaggcgctctcactccttggcccactttcttttctttttctttgtttttacgatttatttatttcattgtttctggctgcagtgggccttcgttgctgcacacaggctttctttaattgtggccagcgagggctattcttagttgcagagcacaggctctagggtgtgtaggctcagtatt

SEQ ID NO: 3621 - DNA, 201 bp, Bos taurus
catcaatgttcataaagaatatggtctgtgattttcttgtagtgtctggctatggaaccagcatagtcttatttgtttatgggccattttaatttttcattctgggaaatgttcatgtgtcttccactcagaaatattcatgtctcttccactcattttttaaaaatgcatacttcctaggcccacccagaacttactgag

SEQ ID NO: 3622 - DNA, 201 bp, Bos taurus
tgtaggatacttcccgagagcaaaggcacctcatgacatctaaacattggggtgcagatctcagcacagggagaggtccctggttctaaagctcatgtgaagctgggccctagaaagctcatgactgccccggggtgcctcacccctagaaggaaggcagggagcctgatgaattgtgggctgaggtcccaccggggtgag

SEQ ID NO: 3623 - DNA, 201 bp, Bos taurus
aagggccaagtttccagcccttctcctcagggcgtgctgagtgtgcacatgtgcacgcacgtgtgtgtgtgtgtgctgaacccatctcaggtcctcccggcgggaccagcaatgggccgcacttgctgactgatggaaaccagccctcggtcatctgtggctcacaggtggccaatgcctgctcggactttcatgacaaag

SEQ ID NO: 3624 - DNA, 201 bp, Bos taurus
tttcactaaacagagtcagcggcataactgcacacctgcaacaactatttaaaacgtgtaattaatttaaaaatctcatccacaatagaaacaacgagcatgagaaaagcgttaaagccttattcaggcacacgcagaaggcgacaataaacgagtcttcctgtggataagggggctccatattgcaatgacaggagttct

SEQ ID NO: 3625 - DNA, 201 bp, Bos taurus
tcctccgaccgcagtttccttctctatacagcgaggggttggatcactgatcgttcagatccagtgtcctggggtgtgtccttacgctgtgtgtcttcatggaaaagggcctggctgtggccttgggggctagtaggtcacagtcagatggagaggaacagggtgcgcctcctgtcttcctgcctaacgtgactcccaaat

SEQ ID NO: 3626 - DNA, 201 bp, Bos taurus
ctagagaggctgaagcccttgccccgagggcctgtgaccgtgaccttatctgaaaactgggtctctgcagatgcaattgagttcagatgaggatgttgggtggccctaatccactaggactgggtccttagaagaagaggagaagagacacacacactgacagacacacagacagagagaaagaaggccatgcaagaacag

SEQ ID NO: 3627 - DNA, 201 bp, Bos taurus
ctcgtggtgctgccctcctgctgagcccctggccgccagcccagggctctcctcccagccctgctgcactgatgagacctccagactccacttctcacctcaggcctgtttatcaaatgcaacaggtttagtttctgattctttggaaaattgccctgcaaggaagctgtgttaattgaggtctctgagtagccagatcca

SEQ ID NO: 3628 - DNA, 201 bp, Bos taurus
cagcgtgggagacacagcctcagggcctgtccccagagagacagacaggagagagggcgagggagagtcccaggacctgctcagcaggaagaaaggcagcaaacgcaggcctccctttctacttctcgccccttctgactcagacagttcagttaattggctcctgcctccttggccctaggaaacagggccggtggtgct

SEQ ID NO: 3629 - DNA, 201 bp, Bos taurus
catctgggcgcgcctccacacttaccagtggatcatccggcagatatttgagagggactaggtacaaggttccatgggattcccgggccccaggccgcccttcttcctcccaccatggcactgcccctctgcacagcatgcctttgcagggggtttctaattctcccgagacatcctgggtttcgttgtccccaccgcccc

SEQ ID NO: 3630 - DNA, 201 bp, Bos taurus
cactggaagctccccgccgctcccccatcaccctcacagaggtttcctgttggtctccttgttttcatccgtatgctgtcaagtagccttattaacaccatgcctgtgctggcccgaggtcacccacagagagggcaggagtcgtcagggaaccagccccacagccagacgtgcagggggtcagcgcccgggagagtctga

SEQ ID NO: 3631 - DNA, 201 bp, Bos taurus
tccagtattcttgccttgagagtcctatggacagaggagcagggtggcctaaggtccacggggtcagagtcagacacaagtgagcacacacacacactacgtagcacagggacctatgttcaacggcctgtgacaaaacccagtggaaaagaggatgaatacacaggtgcgtgtaactcagtgtttgctgcacaccagaaa

SEQ ID NO: 3632 - DNA, 201 bp, Bos taurus
ttggcctgggtggatatggtcaagggtacagtctcaaccccctgcaagagggaggtgctagggttaccgctgtgagcctggtatctctgattccctagagcagaaatgttccctagccagcaacatttcttttgcagcctttatcatgaaggaaactggtataaagagctttccccatcttgctggagatgtttacttttc

SEQ ID NO: 3633 - DNA, 201 bp, Bos taurus
cacccgagagtggcccacggcacccaaggccatgaccgcagacccctgatcccacctcacccggggatgagctgggggagcccagccccccgaccccacctgaagcccaaagggccccgaaggccctccacacactctggaatcaaaacacaaaatccccgggcgagcctcagcggcgtgcccaaggagataaggacagac

SEQ ID NO: 3634 - DNA, 201 bp, Bos taurus
gcccagaactgtggccctgcaggaagagggtctccaggctgagtggtcccactttccgttaccagccacaagcttaagagacccttacaggcgctacctggggccacaggacccttccagagagccttctctctccaccccactgggtgacgtttcaagctctctaaccctcctcaagcctccagcatgccccgctccctg

SEQ ID NO: 3635 - DNA, 201 bp, Bos taurus
aagaggcaactaagagcactcgctctgactttcaagacacatggatggttctagaagcctgcaacatcctgggaactcaggatggcaggaaccccagaggtctgggccttaacaggaagagtgaaacagaaatcaatttctgcaaggactgctgcacaactctgagtcacgtgcctggaacagaaaataaagctgtaaaag

SEQ ID NO: 3636 - DNA, 201 bp, Bos taurus
acgttgaggccccacctccagacggcacagcgtgactgtattgggagatacggcctttaacaaggtgaccgggttacaatcaggtgtcagggcgggccctcatccagcatggtggatgtcatttcgggagaaggagccaagacacagaccacacacgggacgacccggtgaggacgcagtgagaaggcggccagccacaag

SEQ ID NO: 3637 - DNA, 201 bp, Bos taurus
ctgctaacccatcagttaattaattaatgagcaatcggcaaatggcctccagtgggggaagcgtgacttggcttccaaatgctaactattagcccccttaaggagctgagacagggagggccgatcactccaggctcccagacgagctggcacacacacaccgcaaggaggctgattctcatctgcaccagcatgcttgcc

SEQ ID NO: 3638 - DNA, 201 bp, Bos taurus
taaccagtttctttaaatgaggaaaggtctgaatctctaaacatcataaccacttcaaaaaaatgtctctctaaattaaatgcaaaaacctaaatgtgattcaaataattcagtgtatgagattattattttcagtacagagggataggaattaaacagatggataaacagagaagtaaacatggacacataattagatta

SEQ ID NO: 3639 - DNA, 201 bp, Bos taurus
ataaaggggtctgagtcattggtgctcttgccagtgtttgttttaataaaggttttggttttgccaggaaggtgaggagggaaggcctcatagtggttagtacctacacctgttaatggtctcttcgtgttggttgtggggatcattgcttgcagcatattactgccgcccggtacccacgtgactctgtgacagaggcct

SEQ ID NO: 3640 - DNA, 201 bp, Bos taurus
atgccctgtctattctgtctcaggtaatctctgtgatgatcaattgtgtccttttgctgtctgaccagctgccttccatccatggctgagggcccctaacgggagctgcgtgagtcagccatgggtcacagtgatccgtcaccagcacagcactgggatgatatgttggcgcctggcctcaggaggtgttggcagtgccag

SEQ ID NO: 3641 - DNA, 201 bp, Bos taurus
tttccccctaggaattcatagttcattaatattgttgtgcaaccatcaccactgcccatctccataactcttcttgtcttgcaaaactgaaactctgtatccattgaacagtaaccattctccacttcccccaccccctagagctttcttttagattagttttagggttacagaaaaattgagcagaaaggccagcaaggt

SEQ ID NO: 3642 - DNA, 201 bp, Bos taurus
catgacagtgcctgcctggggactgacagcattcctcggggtgggggggcgggggacagactggttcttcaggtcattaacatgaagctgacattggtgctctttgcaaccgttgacaaccaatgccgctgtgcacagggagccagactgcacttactgtgtgaggtctgatttgcggtttaaaaccatagacttaaaata

SEQ ID NO: 3643 - DNA, 201 bp, Bos taurus
agaattttgactttcttctcaagatgcattctgtgctaggactctctttagtacctgtgtaagaattcctctggcgggctgcttcatctgcctcttatcaccctttagggccaccggagtcacccccagctggggtgccaagcacacagggattcacacgtgtcttgtttttctgccatggagggagacagtaggataggc

SEQ ID NO: 3644 - DNA, 201 bp, Bos taurus
tgattttccctactttcttcaatttaagtctgagttaatgacaagtatatctcttacttcccacacagatttttctgtgtatttatctttcctttgactcggtcaggacctcaggtaccattacacagcagtatttctggtgaggattgctcagtattttagcatgatgaagatatgtactggtgccatttactgagagag

SEQ ID NO: 3645 - DNA, 201 bp, Bos taurus
ggggaccttcccaacccaggaatctaacctaggtctcctgcactggcaggcagattctttacccctgagtctcaggggtaactccaaagtgtatgggatgtttaaatgtatttattctagagtttacagttccttggatttccttccaatcacctccagcatgtggtgcagttatatggatatgttgtgattgtgcattta

SEQ ID NO: 3646 - DNA, 201 bp, Bos taurus
aggaaattttaaacccctggttgttttacaaataggtcattggggttgacctttcccatctgtctggaccaggtgctgagggtatacggtctcgaggagcatggaaacagctaggaagtggctgacagatctctcccgcccagacacttgggcttccccaggtgtatcaaggctctgggaagataggaattaagtgtctcc

SEQ ID NO: 3647 - DNA, 201 bp, Bos taurus
cagaggcttcttccctgagtgggaatctgatggcgctgagagtcccccatcagcgggcctctggcgactgtggcctgcgactgtgagccctagaggacacggatgataccagccctactgctaactagaatctccataatgtttatttttcccctggaaggactatttttttattataataggcacaccctaaaagttcaa

SEQ ID NO: 3648 - DNA, 201 bp, Bos taurus
cctgaagctaaaatgcatatctgattgatattgagggataaagaatggagggcaggaaaaagaccttctctttcctgaacttgcaaaatcaatgcaaagcaggctttctctcacctattaatgctggctggagcaggaggtctgtggagccgtgctgcctgaaatcctggcgtggcccctgggagtctccaggcagttaca

SEQ ID NO: 3649 - DNA, 201 bp, Bos taurus
tttggaaggtctggggtatttggaagggccagcttctggggacggagatcacacctgggtccagggaggagctgcagaagcccttgacttcagggaagggggaggggaacctgtgtcaaaggcccggggagtctgaccgttctgtcttcatccggaggaagggctatcatgactccttttttgaaaggagggtccttttca

SEQ ID NO: 3650 - DNA, 201 bp, Bos taurus
tggtcttatacagagaagaaactatacacccactgagaccccaggaatgtacacatacagagaaaagaccgtgtgaaggccagtgaggaggtggctgcctgcaaggtggggagaggagcctcgggagaaaccaaaccttccagcacttcggtcttggacttccacctccaatagccatggcaaaagaaatttattttgctt

SEQ ID NO: 3651 - DNA, 201 bp, Bos taurus
agatgagccgtggggcccgggtgtctccctcagggccgctctgatgtccggtcaacagcaccttttgggtgagtgctcgtgctcctggcatggcttctcccttgagcctcagcaagcggggccgtggttccagcatccccatcttgccaatgtccacgccctcgaaaggacagacgcgccattgaatctgtgggagcctcc

SEQ ID NO: 3652 - DNA, 201 bp, Bos taurus
aggctgcagtccacggggccgtgaagagtcggacatgactgagggactgagctcacactaatcttgccgaacgagcagcagcgtgggcaggtgtaaggtgtgtggggccacagacgtgctcactggtgactctcccccaagcctgggctgcggccagggatgctctgggtctgggtctggtttgtgcagcagggcatccgt

SEQ ID NO: 3653 - DNA, 201 bp, Bos taurus
ctcaggccagggctctggttcaaggcgggaatcattacatggctgggtggactgctattgtttctacctttcgatgtctggaatctttagtaaagtacccagtctgtggccatctgctggcccttctggaacattttcccgtttgggacttaaacaactgacttttaaagataaggaaacttatggatctgccactttacg

SEQ ID NO: 3654 - DNA, 201 bp, Bos taurus
taaatctgtatcttttctcaaaacttgttaccttgttactgaattgttgtggcatttctcttcctgtagacgtctaagagtctatgagaacatctttgggcgttttgttaatttccctggaattggaaagccctttcatctgcagctcacgcccctgctgtgtcggcatcttgcggtgccttcagcgattgcctctcttcc

SEQ ID NO: 3655 - DNA, 201 bp, Bos taurus
atttgtcatccaaataagtatcatccttctcaggaagctgcacaacttgttctgacaagaggctattcctcagaagaatttaggatatcccttgcagtatgaccttcttggaccaggctcccaaggaatctgtagttcttcccttaataatagacttggtttttgacagttattgtaatcatcaaccttaaaatatccttt

SEQ ID NO: 3656 - DNA, 201 bp, Bos taurus
gcagcactttttagaaatgacattctcacatgtctaactcaacagaactgctatcactgttaaatttttagaggtaactgttaagttagcactggactcacgcacacagatgagatttaacacagcacgtttgcactgggaaccatgagggaattccagcagggcatcgtctcatctgtgttgtgccccttttgagtggaa

SEQ ID NO: 3657 - DNA, 201 bp, Bos taurus
aaaagaaatctgtttttttacatatatgtgtgtttatatataaacacaattttcttcctggtgtttcctgtgattccacttgctcacagcgggccgcatgcagagacctcgccccccaccccacccttcagatcagagtctctgctaagaaaaggctgcgtcgggcacctcactcagggccgtgtgcacgattcaagatgg

SEQ ID NO: 3658 - DNA, 201 bp, Bos taurus
cgcacaggttcttgacgaggaccctcttctggcggtcagacggccgccttcttgccgcgtgctcacgtggcagagggtacgtggcctgagctccagtatcctgagagtgctgacctgtcgtgagggatccatgctcacgaccttacctaaacccaatcggccctcaaagtctcgtctcctaacatcaccatgatgctgggt

SEQ ID NO: 3659 - DNA, 201 bp, Bos taurus
ccatgtcccgcgagatgccagggagggcagtctcccagcatcctctcagcctccggcattgtatcttatgggttgttgacgcttcacacctggccagctcctccccacgcgtctgtgcgtctctcctcttagaaccacgccagtctctggcttagggctcaccccatgccagtgtggcctcatcttccctaattccacctg

SEQ ID NO: 3660 - DNA, 201 bp, Bos taurus
caccagcgttcccacccttctgttggtgcttcctgtcctctgcaggctcaccacagacgtccggtggatctaagaatgtccgaccactaagagagcgtgccgctccccagagagtctgatctcactcgtgtcttcctgggcttgacttcacgcttggtgtgcaggtcacatggccagtagtcacacccctgtaacacgacc

SEQ ID NO: 3661 - DNA, 201 bp, Bos taurus
ccatggcttctcctcctccgctgtcccctccaggcaggtgaggcggctagggaagggctgtttgcgtttgagcatgggcagtgcctccgttcaagatgctcgttggccagtgggccagattgggaggtggtgcgtggtgtgggtctccaagctcagcgctgcgagttgctgcccctgagggtccagcctcagccacacaga

SEQ ID NO: 3662 - DNA, 201 bp, Bos taurus
ctggctgtgatgtctgcttgctctttcaacagtcaggcaccagaaactgcgcgttcgctcgaacttcagacacattgctttcaatatcactcgcgcccctgtagtggtgggccgtgtggagacacccctgagcagtccatctcgggtccaggcatttcctcccaactcagtgttaaaaagacaggagtaaccacagacgca

SEQ ID NO: 3663 - DNA, 201 bp, Bos taurus
gtaagcctgctcctcccaggaaggcacgcgtcagggcacttctggtgtgggtgctgagtacagagcagctggcagtgaagtgccaggagctcccaggcactgcagggtgaaaacctgtgtctgattccttcagccaccagaaacagcctcagacctgacagttcagggcgcgtccaggtctgtgctcgtgcagaccgcagt

SEQ ID NO: 3664 - DNA, 201 bp, Bos taurus
aaaatatgaagacttcgatctctcaggtgagatgatgttctccattggagcccctctctccccaaagccaggaaataagtcaaaagatgtttatagatgccaagtctagtataagtgaacagactgagtatcctacattatggaggcccacctgcccccgtggaacccgagaggatgcgaccgtttctaacacttcttgtt

SEQ ID NO: 3665 - DNA, 201 bp, Bos taurus
agtggtggtcataaggaatttaagcctgagatctaatttttaatatcctttataagtagaatttgctcatgtacatacttattaaaaactaattttaaaatagaacttcctacaaaggaggagatagcctgttcctcggtctcagagttggccatgcacacgtgtgctcttaagtattctcagtcagggtgggagggtctt

SEQ ID NO: 3666 - DNA, 201 bp, Bos taurus
catgagggccctttttggtctgccaagaagagaacatctgtttcacacgattttcttaagggccatgtttaagctgagaatatgacagcccattaattctgtccatctcagtaaaacaaaatgcttagctgagcttctgaccagtttggaaaacactaaaacagaacaccttagtacatccgagcctaaagataccaatat

SEQ ID NO: 3667 - DNA, 201 bp, Bos taurus
aagaatactataaatagagtaaaaaggcaacccacggaatggaagaaaacattttcaaatcacaaagggattaatatccagaatatataaagaacacctacatcttaacaaaataacccaattcaaaaatgggcaaaggactttagatagacatttcttcaaagaaaatatacaaatgtccaaaagcacataaaacatgct

SEQ ID NO: 3668 - DNA, 201 bp, Bos taurus
gtcccccacatcccccatgggagtttcttctcctttgctccctcctgggagtttccagatgaagtcaaagcagccccggtgctgttggcaaaggctacatcactcccagtccttggtgttctttggaaggaatgatgctgaagttgaaactccagtactttggccacctcatgccaagagttgactcattggaaaagactc

SEQ ID NO: 3669 - DNA, 201 bp, Bos taurus
accatgttgctgataagcggcgatccccagtgaggctgggggggtgccttaggggggcgtcacacctgtgtgggcacccgggccgctgacatctttcccaggtacatcaattacagttagagagtcataagaacgccaaaacggacttctttagcgctttggtacggaggcccttgcgtttaaaatcaaagccgttaattg

SEQ ID NO: 3670 - DNA, 201 bp, Bos taurus
tgaacacggactgtgtctgagctggcacgaggcagctccggttcccctgcgagctcggtacccgctgaggtgtgcagtctggcggtggcctgctttctgggcgtcgcctccctgctgtgtttcgcttctctctctctgtgagctgactgcgctcagggcagccttcctcccggccttccacagcctgtctccccttctctg

SEQ ID NO: 3671 - DNA, 201 bp, Bos taurus
cccagtgtctcgagaactgagcctcgcacatggatacttcgcagccactgaggacagcggctcgcaggtgctcagctttgcccctggccgactctcctcttgcttcgtgggcaggagtctggtgttttactggtgggtttgtgctgctggggggtgtccatggtgcagcagggcccgctcgcggccacccgtctccctggc

SEQ ID NO: 3672 - DNA, 201 bp, Bos taurus
gcacgagcctgccatctcacgtggggaggtggggcagggcggaagtgacatcacacacgtctgtctcaggaaccctgtgcttagcatttggtggatgtggatgtggccagacggcgacctctctgcaggaagagcggctgtggtcgctgagctgagaatgctgctttctccccatttgacgattgaaaaagaaatctaaag

SEQ ID NO: 3673 - DNA, 201 bp, Bos taurus
ccccgggaggccccgccctgctgtgctctggtgtccttcctgctctgccggcaggtggttttcgggtttaagtcttttctcagcccctccctctgctgggcgtgttttccgggtggcccagggcccagcactcagggcgggctcctcagggaccccgccttcccacccaacgccacgtccctccctcgtccctccctcgtc

SEQ ID NO: 3674 - DNA, 201 bp, Bos taurus
ccaggcaccaccccttctccggtattgggctgaggacctcaccacagcagacgcttggaaacgttcgttttgaaagcagtgcgctttcccaggagaggcaccatcggcccctgtgtcccgtcctgtctgtcggggcagcatggaaccaggacccgttcctggggaaacttccagactaccgccggagccttaaagatgtgg

SEQ ID NO: 3675 - DNA, 201 bp, Bos taurus
aggaaggagaggatcctgtgcttacgactgtaggatgtgcgtgtggggtgtctgtggctggacatggacactcctgcaatgctaagggaataggccatcatgtggacgttggttccggcttcagtgaacccaaggctgtccagggatctttaggctctgctccttttgctgcaaacttagccttttcagtaagctactcag

SEQ ID NO: 3676 - DNA, 201 bp, Bos taurus
gagagtcggacacgcctgagtgacggggcacgcacacacagatgtccttcagctaggctccagacaaagctgctggacggagctcaggttacaccccacacggcccaccccagggggcccctcttgtatgtccagctctcctggctggttgttcacccaacagcctgtgagaagaggctggtttactcagcgagacattta

SEQ ID NO: 3677 - DNA, 201 bp, Bos taurus
gggttactgggccggatctccctgcagacacgactcacccgtgagcgccctccccctcctgtgtcactctggctgcggcggtctgatcgtgaaggtgcgagggggacggccttccaaacacccactaatggcccgggggttacacacaggggccatctggggaattgatttctttctcggttacaaattgcaaatggagac

SEQ ID NO: 3678 - DNA, 201 bp, Bos taurus
gagaagaggcatcgagctggggaaccggccgactccagccctgagggacggctctgtgtccggcgctgtccgcctgcaatggggccgtgggagcgtgtggttccctgaacaggttgctatgacgagctgcgatgggagctccaacaagacctgggaaaccctcccagtaccctccacgagaaggatggccacgtgcctcca

SEQ ID NO: 3679 - DNA, 201 bp, Bos taurus
gtcctctttcctgataggttttctttgacttataattctgtatataaatgtgtaatgtaatattgtatttgcgtttcaatgaaacccgggggaaggctccgcacggaagcttcttcaagccctaaagaaaccccgaattagccttagagagagactcgagatacaggggaagcccctggggagggggcatgcgccgtgaac

SEQ ID NO: 3680 - DNA, 201 bp, Bos taurus
cagcgccccacctgcccaggcccagctgcggtccctgcaggctgctcccgccctctgcgtccacacacccccagggtgcttccccttgggtttccaaacacgggcctcggtctaaacccgggacacgtgtgaccacttaccgcgtcctgcctacgtgtctgtattaacacagcaccacagatgtgagtgtgtgaggactcg

SEQ ID NO: 3681 - DNA, 201 bp, Bos taurus
tccgcgtctctgaccgcccagccccatgtggccgagctctgccctggcgtcagcaaaggaaggaaagatgaccagccgtgccaggcagatccgacctcccggctggcctcggcatgagttcagggctctctccccgcacctgctcttctgggtgggcacatggagtctctgcacagaaatatctgcatgtctgtgtcccag

SEQ ID NO: 3682 - DNA, 201 bp, Bos taurus
gtcacctgggccgcgcttcgcgccgggatactgcggaaggagaagcccacgctcctgagtttgcgggtcctgaccgcccacagccgacggacgatttcctgacggaattctctccgcggccctggagacgagggagcttggataggccgctttgtgcgcgaaggcgggacttcttctcgcccgcgggatcgcggggacccg

SEQ ID NO: 3683 - DNA, 201 bp, Bos taurus
tcttataatgggctaatcagaggaatgaagacaggggtgggggtcagcttctcaggctcttggaagacagtcgttaccactcccccaacacagagggtcctcatccttactgcctggggaagtggccccagttttaaaaccagccatgaacaccccagaggctgggacacagatgacacggcgggtggtgcaggatgtcct

SEQ ID NO: 3684 - DNA, 201 bp, Bos taurus
caactatttagagacagtgtagttcatgaactaagctcatgggctccatagtcgaaagatctgggtttgaataatggttctgctgcctccagttgggcctcagtttgctcaacagtaaaatgtagagaatagtacatatctcaggaaattatcttgaagattaaatgaggaaatacacttccaatacttcgaaaaggatgt

SEQ ID NO: 3685 - DNA, 201 bp, Bos taurus
tatgaaatatatgtatgaagtttgctttaaaatagggtgttttttttttttttttggcaaagtaatagtagcttataaaaatgaaaattaaaggagtaatgtcaggggacatttggctttaaagaattcaatatgttattcttttcttttgtgtgccatttctcaagaattctctattcctcatcagttgctgcaggaacg

SEQ ID NO: 3686 - DNA, 201 bp, Bos taurus
ataacagcaacaaccaaaaccttcaattaggcaagacagtaaagaggagaattggaggacagagggttgtaacatgggacattttgtattacaaggttctggttaaaaccaaatccccagggaagacaagtcagtacctgccatgataacgatacagtgagaaagcaactcaagctaaacagaaagagactcatagacttt

SEQ ID NO: 3687 - DNA, 201 bp, Bos taurus
aaaaattggttttatttgtaaaaccggctggttttatttgtagtattctgtaactcagaggcctctgctatggtatctctcagaacattgcttatctttatttggtgtgaaaggttgttaatgtttttgtgtgtagtgactcagagcatttattttttatggaaggaatgagccactcgaagttattgtattgcagaatga

SEQ ID NO: 3688 - DNA, 201 bp, Bos taurus
aagaaaaataacatataataccataatattttccttctttgtttatacaacttcaaaaaagatgatactttcattccagcccaagaatctaacatacttgatctacttttatcacttagaaatcatttcagtcctagttaaatcacacagagtctgcactgatctcttctataggatacttcttgttaatttggacctcac

SEQ ID NO: 3689 - DNA, 201 bp, Bos taurus
gcaagcacacgtccaggcaggtggcaggcacgatcccaccctgtggagccaggacacctcaggcgagccctgcttacccaacccctggcctccccttcaacagacactgccagctggagcaaaacgagccaaatggtgtggtggttttctaatgaggctaagcagggagagaacgaaccaagtaaattttttctcatggcc

SEQ ID NO: 3690 - DNA, 201 bp, Bos taurus
ggataaagaaacaatgtcagcagtcatctgcaaaaaggttgaaatagtatatagtttgaactatagacacaagttctgtatcactggacataaggtgtgtgactagtggaaccacttaatagtattaaatagtgcaactattaaatactgaactattagttcagtataatatactattaaatattaagtttgaatattcac

SEQ ID NO: 3691 - DNA, 201 bp, Bos taurus
acttagatgaacatgagaaaatgaagtgctctgcccaaccacctcttagaaatggctgcagtctggaagaaagctgaatgtcaacctgagatgaaagtttggctgtatataatatagtgagtacataaaccacaaggaaaccataaggcaactcaagaaaaaaatgtattcaggtggcccaccccatggaccatgcctcat

SEQ ID NO: 3692 - DNA, 201 bp, Bos taurus
gaggttgagcgaatagctaactacatttagagtaagttctactgtaaagaactaaaaggattaatcttttatccaaaattaccagaattactaagctgtatacctaaggtcacattacatagtgcaaaattgaaatttaatcatgattgctagagtattaccctaattgcccaaataaacagaattaaaatcacttggatg

SEQ ID NO: 3693 - DNA, 201 bp, Bos taurus
tcacagaatcaaacaccctgatggcccaaatggagggacacctacacaggtattggcaagcaagggacgcgcgtgtagaaaccagcagcatgatggagacgggggctgaagagacagggaggaatgaaatgtgtttccaaaacccaggaagccctgaggcacagacagggggtgccatggttgagaaagtgcacagctgtg

SEQ ID NO: 3694 - DNA, 201 bp, Bos taurus
ataagctttctattcttactagaacagagtagtatacaaagaacccaggttacgttcttcgttcgtttgctgaaaagcagtcaaaattctttaattctgtcaaatcagaacactggaaagcacgttgaatactacatgaaataatgactcggtgaacatttgccttctctgcaagtgcgtgccatatgcttgaagaaaaga

SEQ ID NO: 3695 - DNA, 201 bp, Bos taurus
ctgcttacactgtcagcaattagcgggaaaagttcagaatataatgtaattatcaattactgataactcagcaaacaaaaattaacttgaaataaaatgtgaagtcacaagattcagatttttaatgatgacaagctgttctgctttctaagtgaactgactgaattcagacctcaaattggagaggtatgggaacagatt

SEQ ID NO: 3696 - DNA, 201 bp, Bos taurus
ttttgttataaaggcagaaagaaaagatttagcgagtaccatgttataatgtgctttcctggtgcatcagatatttgagttaaaataatttggtttataaggaaacttttcgaaacatatcttttacgtaaattgagttctagcaggcacactgtagatgaatttatccacagtaacaacatttgcaagtctgctgtgggc

SEQ ID NO: 3697 - DNA, 201 bp, Bos taurus
actggttctactgagtaaatttgatgaaatagtttaccacaaggattgccttttacattccaaaacaaaagcattaaacgataggtgagtttaacagaaatggatattgcactaattcttcctcaagtgcctgtattttttattttgtaatgatttgtattccctgatgtgctttatctcatgcatggctgattacaaatg

SEQ ID NO: 3698 - DNA, 201 bp, Bos taurus
gcgtagataagttactttagcctttctggactttctttcaagtgatacttgttaaaggtatcacttgaccacatgtccgtgaaagagtgatggtgtctgcattccctgcaagtagaggtttctgtaaggtgtagattcctctgggtcagttgaggagatctttttggaggtgatggagctgtaatgttcctgactgtatag

SEQ ID NO: 3699 - DNA, 201 bp, Bos taurus
ttctgtagttttaaaatagcagactgtaaaatctggcccagatcagagtttaggcagctcttatgatcactccctcttatgtccctgtcagagcacagatatattcatatggggccctcttttcataaagctgagcatctggatattgcccttgcggaaatctttcctttttaccccctaggaatcattactcttcttcac

SEQ ID NO: 3700 - DNA, 201 bp, Bos taurus
aatagtgtgaagaattcttttttagaaaagttaaatttcttcaatttaaacattctgagattataggactttggagggttattttttctcttgtatattatagtagatgatattcttaaaatttacttacttagaaaaaaataatggcaagtttatatcagctttcaaaattgtttttgtattttattgttctgtaaaaat

SEQ ID NO: 3701 - DNA, 201 bp, Bos taurus
agaaaatatttaagtattgagtaaagcttgtaatttttatgttcatagatttgtcaaaaagatgttatcttcccagcagcattgtgttatcaaagatgcaaaccttaaatcaacagctgttacacctccagcaagttatgaatttttcctgatttatagcaatcattctttttatttcttttctcagtcaagcagggaaat

SEQ ID NO: 3702 - DNA, 201 bp, Bos taurus
ttaaggtcagtaagcaggtctgactgacccaggcccctttcagattgctgcctctcccctgagactcaggacgtgtgagattgtacatgtgctttcagagtggggtctctgtttcctactgcctcaggtcttctgaacataagccctgctggttttcaaagccaggcattttggcagctcaccttcttgatgcaagaacag

SEQ ID NO: 3703 - DNA, 201 bp, Bos taurus
acccaattttgttgttaaacaacaaccaagagtgagcttttaaaaatataaatgacatttccatcagtcttgccctgatgaccacgccacccaaaatggctgttcttttgctttctgtccacccgctactccagcagtccctgcggcacccatacccgactcaccttactgaccttccctcttaatgatggatcctaatca

SEQ ID NO: 3704 - DNA, 201 bp, Bos taurus
caaaaacataataaattatattaaccataatagtttgatcaaaacacaggctcagagtagcaacgtgaactgcttaaaaattacataattgtcatttgcagaagttacaatcactttagattttcaagaaattcttcctacaactaaaatataaagacatgtttgaaacatctgtcagttgcattaattggaggttttcca

SEQ ID NO: 3705 - DNA, 201 bp, Bos taurus
cacgaggacctgggttctgccagtacccaaatgagctcggtgctactcttccctggagcctccagaaaagaacacaagcttgcaggcaccttgattccctccttgtgagatgctaaggtgagaatcagctgagtcccacagcaaattcaggtaacaaacgggtgttgattgaaacttctatatttttgtacttcatgatag

SEQ ID NO: 3706 - DNA, 201 bp, Bos taurus
ctgtagccttcaagtctctgctgttttaaaaattatctggagagattaaaaaatacagatgttaagatgcgatggagtctaagatacagatgttaatgagatcaagtaattgtgcattctcgcccattgccatgtagctagcggtgctcctgccagaataatgcatatgctccctcccagtgaaggtggatttgtcccggt

SEQ ID NO: 3707 - DNA, 201 bp, Bos taurus
tcaatttactttcccctgaggcttgcatggtaaaagtgtttgcaaaggtggggcttctaaattagaacagattctcatgaataaggttgtcttttatttactacaaatggaagaagcagcaagtctgatagctgtctacttcaagttccggacaagaataatagtatggaagaaaaggcatgtttaattttgaacaatagg

SEQ ID NO: 3708 - DNA, 201 bp, Bos taurus
ttaacattttataggtaatttttcttctactttttaattttggttgatccacttaaacctctgtacacattccacaataagtaggaacaaaagaaaacatcgttgttgtggattaaaacagataattattctaaatgtgttttccctgcaatttgaacattcatgagcaacaagactactgaaatccagctaagcattatg

SEQ ID NO: 3709 - DNA, 201 bp, Bos taurus
aaccacatgtctgttagttttttacaaaagttaaacaaaatgtagaagtcttgtcaaagtaatcacagcctaaatttatgacagatatctttgaggacttgattttttaatctactgtttaagacttaacatttgtatatgatactcttttttaaggaacaataattatttcagttaattttgaatactttttgcatgatc

SEQ ID NO: 3710 - DNA, 201 bp, Bos taurus
tgagcagaacttctaatttttatggatattcagataataaaatctcttctagtcactccaaaaaacaaaagcagtttcattcaagaaattaaagtatctacttatatatgataatcagagtctaaaattcacttaaaacttctctcctttaactacggcatgagttagtggggatcctggggtggaaaggggatgtgtgat

SEQ ID NO: 3711 - DNA, 201 bp, Bos taurus
ccagtgcagccaaataaataaatagttttaaaaaatccacattgttattttggctcctgcttgggacatatccaacattttaacacagcgagtaacccacattggcctcccgcacactttggaactgctgatcttcattttgtcgcccccttgtgcttgctctgcattctcagctctattatgtgatccacatggatactg

SEQ ID NO: 3712 - DNA, 201 bp, Bos taurus
taaaatggagagaggcctttccttagaggaatccatttagcaaaataaaaagaaaaagggaaatttggataagatcaaatatattcttcacattctgaatatttggacagatggaagaaaattcaacaggaaaagagtggatacccctaggataaaaatggcttcagtcaggcatatatgcataagcctctaaaacgtgaa

SEQ ID NO: 3713 - DNA, 201 bp, Bos taurus
tcggtgtcacagctcagtttcattaggaaaacaaagaatagtacaccctcgaagaatgagtctgacccacaagatgaatagaagagaggcctcaatccttctaggtttcctccttttatgcatttgtctcctcaccccggggcctgccctatgtaaattgggctatccaggagggctgtttgttttacctgaggtcctcac

SEQ ID NO: 3714 - DNA, 201 bp, Bos taurus
tttccaaatgctaattttatctagctgtcatatctcttcccagagagatctgtctcatttaaaactacgctatcacaaccagaagtatgtctctctctctttttttaacatctgttgctgtcatcttctgattttaatcctaatgctatacttttgtccaaacctttattaacagttatgtagacacttaatacagtcaaa

SEQ ID NO: 3715 - DNA, 201 bp, Bos taurus
tggtatctaattttcttgaagagatctctagtctttcccattctgttgttttcctctatagttctagctgaactacttctcacctccgcagtgacttacctgtgtaccattatttaacatacgtggtcatattcttttctttggggaaatcttccccccaaaattgaattctctatatttctttttgtcttatcctatggg

SEQ ID NO: 3716 - DNA, 201 bp, Bos taurus
ctggtgatggcaaagaccacgctggtatcatagtacattcttgggataagcctaatagcaaagcctctaatctagagttagtagatttcaaggactgtccatgacttctgctggtgtacactgggatttttagcaaatattataatgttcacacatttaaaattacgttcttgtatctcccaggactcttacagttaagag

SEQ ID NO: 3717 - DNA, 201 bp, Bos taurus
actggtatgtaaaactttgtagaaatagagattaactaattcaccaactaccaccaagaaaggaattaacatagctgagatttgaatctgtggttataagctactaaagtcatacatatgtttaaatacggctacattaatctcttactgtgaatccgttgcataatctctcctattccacaaggatgttataaacagaaa

SEQ ID NO: 3718 - DNA, 201 bp, Bos taurus
tctgtctgctacaagcctctgcaactacaaaggtatccagagctgtctctgcagccaagtatgtacataccactagttctggccacaacctctgcctgctgtgtccctagctcctagatcgtgaggtgctgctgaggagcccaacagccatagcagcccgtgtggggccactcacagtgctcacagaagaccatgcacgtc

SEQ ID NO: 3719 - DNA, 201 bp, Bos taurus
aaaaaactttgactattctaaagtgaaaggataccagtgtgcaactttactgtgcaagaaagctcatattcacagcctcagaagattacactacacggaacaatgaacatgcattgcaaaacaattgtgatcatttttggctatattttgtgagggtcagtgtctttttttcacaatatctcaagaaatatcttggtaaaa

SEQ ID NO: 3720 - DNA, 201 bp, Bos taurus
tgctatttcctgtaactgatgctgtgtattcactgaaaaagctgacattactgcatagtcggcttgaaattttcaatgcaccactgtgtcaagccttaaagttaagctctgtttccacagcaaccacactttagctcttcaagcatagttggactttttgtgtgtgtgtgtgtggtcttaacctacacgtaccagtaagac

SEQ ID NO: 3721 - DNA, 201 bp, Bos taurus
gcctgaagtacagtgcaaatactcttattataaagtgaatgatgagggaatttgtttccgatatctagtgtggacacaggaaatattatctattctcaaactataaggctccatgaaggcccatacttgtatgcctgtatcactataacctcagcctttatcatactgcagtccagcatatagcaggaattcactaaatat

SEQ ID NO: 3722 - DNA, 201 bp, Bos taurus
gcctggtgtgctgcagtccatggggccgcagagccagacacgaccgagtggctgaacaacaacaagatagcataatctcgcagcctgcagaagagagacacgtggggccctctagggtaattcctgcaagttgtctcaaagagacactttctgaggaccaccaagcgtctacctttcctggagagcaattaataaccaact

SEQ ID NO: 3723 - DNA, 201 bp, Bos taurus
ttacaatctagagctgtcacatacactcatgcaggttggccgctacccagttctagagacttgaatgtgaattgcaaccctctggagtcacgtaatgctttctttctttctttctttttttttggagtcacgtaatgctttctaactgggaaatacatcttaactctaattttttttactaagaaaagaaacagccttact

SEQ ID NO: 3724 - DNA, 201 bp, Bos taurus
ccagaaagcaccttgaatgggtgcttgaatgggtaaaactgcaccacaaagcgactcaaggctttatcctgcagcctaggactttctgtacaggcgaactggccgtctgtcgcgcccctctgcgtggagccccctattgcgcgcatgcgcacaccggtctcaagccctcgccggaagtcagagccggcggaagaggcagga

SEQ ID NO: 3725 - DNA, 201 bp, Bos taurus
tggagtggtacgcccgatggtttcctttgacgcagacgggcatttggaagatgtgtctgtgtgagttctggctgctactgctgggttccggtttgaaaggtcatcttttgcctgacgaggaggacgtaacgtttatcaatgagtacgtgaacctccacaatgagctccggggcaacgtcttgccccgaggggctaacttgc

SEQ ID NO: 3726 - DNA, 201 bp, Bos taurus
ctgaaattccctcagaatgggctctgggcagttagttctccagtcctgcggcgctcagctctggactcctgcccttggcccatgttgactcctcccctcccggtcacctcgagtctccctgatctgcagcatcctgacacagactcttcttcatcaagtgggccccacctccacgcagatggctgaagagatgattatacc

SEQ ID NO: 3727 - DNA, 201 bp, Bos taurus
ggaaggccacagtgtagaaatgaaagaaactagacagatgtttgcaggtcagtgttacctgtgggaagttcgagtgctgtggtaatatactatgggggtgttcctacttcttccaagtggtagaagagtaaaggacaccagtgaccctcatctgggttttgcagtgcaaataatttcatgggattctatttcctcagatga

SEQ ID NO: 3728 - DNA, 201 bp, Bos taurus
tgagacgagaaggaagcaggcctgagaagaactggggaagaatgtactgaggtctgttataggaagttgtaaaggacgcagttcagatatttcactgtaacgaaaggtgaatccattgagggccagtgatgagtactacccaggcttctgcagagatcttcttgctccccaaccccactcctcccccacccccagtagaat

SEQ ID NO: 3729 - DNA, 201 bp, Bos taurus
cctctgtcacttggaatgcattctcaacttctaaccattcctagaaaagtgtggattgtaaaaaagcttgtctctttaaatcagagactgaatcctgcatcttaaactctgtcctcaagaccttctggagatccagatagtaggtaatcagaatcctattgcagaaaagtctagaaaattaagataagccgaggataagcg

SEQ ID NO: 3730 - DNA, 201 bp, Bos taurus
tctcatctaatctgtagggcttgggaggcccagttgtcctgcctatattcttgctctctgactgtcatttgaccttggccagtcttctcgttactttgtccttaaaccactaagatgccctgacatcaagaactaccataagccccaggggcctcttgtagtggccttaatgttcattttcagcatttcagcataggggtc

SEQ ID NO: 3731 - DNA, 201 bp, Bos taurus
cctatctgttggaatagtcagtaagtaacatgcttctcaaacagaacggcacaggctgaaaggcaaggtgggaagagtgccagatttagagaccaacttgcgtttgagacctgactctaccgagcttggtcaaatcaaccaaccatctaagctgcctattttcatcggtgagataggatcatgcccacccatgcacctatc

SEQ ID NO: 3732 - DNA, 201 bp, Bos taurus
cgtgaatggaaggacggtttcactaactctttaactgaaagccttcaagtttccactcaccactggtgagccaggagtgggaagaagacatggagaaaacggatgaatgaatgtgcaccaaagcgggattcataggccaaaagaaatattaaaggaataaaatgtggaacctaggagaaaacctcaaaggagttcacgcct

SEQ ID NO: 3733 - DNA, 201 bp, Bos taurus
gataagtaaactacttctgcccagagggaaacctgccaacctcagatgcgaacggtctgcggaaaccaaaagctctggacttaccaaggtagggaatctttagagcaaccttcccaaattaagcagaaacctcaaagcgctatgttctcagagataataaacgagttctccaggacaataccccaatccacctcatcagcc

SEQ ID NO: 3734 - DNA, 201 bp, Bos taurus
agtaccaagatctggagcttaaacacttagtaagtagagccaatataagtccaaaggtgttttcagaataacatgcaagaagacctcagtattacttcaactatcaaggaaattatcactagactcccattttggtaagagaactttcctgacagatctcacaaagattttagtttgaaggctgtacctacccttggggaa

SEQ ID NO: 3735 - DNA, 201 bp, Bos taurus
atagccattcctaaagatttccagtatttagtgttatattttaaccagtttcactatggcaaatagtgtatgtccatagactttgccaagaatcatataggtatgttgaaattacagtagtaccaaagagttatgacaaagtgacggcacagctttataatttgaaactagtagtatgtattttcagagcgtttaaaatta

SEQ ID NO: 3736 - DNA, 201 bp, Bos taurus
caaaaagatacagtgctgtcttcctactagtcagccagcctatccaagtacagggcaacatacagtacttcagtactgcagaatttcacagtagtttagtattagattatctgtgcctagattgtgtagagattctcagtgtgtgatctttcttggttctgggtttgcacctctactgagcatgaacaagggcccctgctc

SEQ ID NO: 3737 - DNA, 201 bp, Bos taurus
tgttatcaaattaataaaaggtctcatccatgtgtgcagcccctctattgtacacatttttattaggaacgaaaatttcttttctctagcttggatttgcttgtgttctggccttaaccaagagttttctaaataggaacttcatgcgcatgaaattaatgacagatctgattaaggtgatttgcataaattagacatttt

SEQ ID NO: 3738 - DNA, 201 bp, Bos taurus
taagtgaataaatgatgagcatgattttggtgggataggtagagctatcaaatgttgattctggtgagaagctgctgtttattgcactcactattttcttgttaaacttgcatattaagatataataaccttgaaaagttagggtaccctgttatgtatccttcagtttggttgactgaaggatacataaggatttattca

SEQ ID NO: 3739 - DNA, 201 bp, Bos taurus
tgcggttaagactgttgactatctgctttataaaactctcagtctttctgagctagcactttttctctcttggttctctttctgtttgtgactgttccttatcagcctccttcataggctcctcattttctgctcttagaaacctcagctctccacacttccctgtttgctctccggagcagctcacccactcatagcttt

SEQ ID NO: 3740 - DNA, 201 bp, Bos taurus
aatattttgttaatcacctctcggaggaacataaaaaaattacattgataaatgtatgcaccactgtgaattctttatgactgggttgtcagtcgcctccgtcaggcaatgagctaatgtttattaagtagctacaatgggcagagagtttttgcaaggctggggggaaaggcccaaaggaaataagcgtagatgtgactt

SEQ ID NO: 3741 - DNA, 201 bp, Bos taurus
cttattgccattggccgaggccacctgtctatgtctgcccaagtaactagtgctatgcctgtgtgagcaagcatggtggtcagatgtggcaatgactggctgctgaactctgtaacttctgcaacaggtagccagaaggtggatgacgattcctgcatctccctgtatgtcacttcctctatttttcttggaccacaagct

SEQ ID NO: 3742 - DNA, 201 bp, Bos taurus
aaaacataaataaaaataaaaattgatgcaaaaaaatccatgatgaacaaagaataattaaaaaaaaaaagtctataagatcagggcccagcctgttgccgcagtgctttgaacactagctggcatgtggtgggtgaatccatgcatgaatgaaccttgaaagaaagcttcctccagcattaccccatggccagtgtccct

SEQ ID NO: 3743 - DNA, 201 bp, Bos taurus
ccatttaatgtattataaaattcaatttgataatgttttgttgataatttttgtatcaatgttcatcagtgatattggcctgtaattttcttcttttttttgtcttcatatgttttttctatcagggtgattctggcctcatagtttgagaaggataggtgtagctcttctttaaatgtttggcagagttcacctgtgatg

SEQ ID NO: 3744 - DNA, 201 bp, Bos taurus
gtgggttcctgcttccttgcagaatgacagtggcctgagcctggatctggatttttaagtccttatttccatggtggattggcagtgactctggaattttgcagaacacagcttcaacagggccaaacacatagcagaaagaagtggtgcacagatgacagcgttcttcctgattgaatatgtgggtggggctctgtgaac

SEQ ID NO: 3745 - DNA, 201 bp, Bos taurus
aattgaggtggggattaggtagtatgttagaatcccagacatacctgaatctgttctgtcaattacctttgtccctgttcagggcccctagggaagataaatgcaggcaatagcagccaaatggtaatcagaataccactttattaattgcttgagctggggccaattacccttgatgcaggtctctttggaaagaagtgg

SEQ ID NO: 3746 - DNA, 201 bp, Bos taurus
tactctttctaccaataaaacaaaataagatttagtattaaataagtctttgattaggtcagttttgatttatggggaacccattaatgtactgcacagacaggaattgcacagatttgatgaatcaacaaagcaggaaatggaaaataccttctcacctctgggttttatgagtcaggaagaacacgtccctggctacgg

SEQ ID NO: 3747 - DNA, 201 bp, Bos taurus
gacaagtccttcaggccacagctctacttctcactgtggcatttggtgaaggcctttgagccacatgaaggaaatttacttaagccagccccaggcagaattgggtaccaagcccattccctaggccacagctccttctaacctgctgcccccttgtagctgagaacggtcctgattccttctgctttctttacacttgat

SEQ ID NO: 3748 - DNA, 201 bp, Bos taurus
gaggggcttctctctcaataaatgattatttcattctccttactctataaatttggttactcaattttatattaacagtttccatgatgaatgtgggcttgctggtggctcagatgctaaagaatccgcctgcaatgggggaagatctcggttcaatctctgggttgggaagatcccctggaggagggaatggctacccgc

SEQ ID NO: 3749 - DNA, 201 bp, Bos taurus
gctggaatgtgatccagaataacatccctctgtatccaacatttgtcttgagcatttttattgcctctcttttccctcatctcatctcacttcttccctccctctgttcaacagatttacacagactgggccaaccactacctagcaaaatcgggccacaagcggctgatcaaggatttgcagcaagacattgcagatgga

SEQ ID NO: 3750 - DNA, 201 bp, Bos taurus
cagagtgaaaaattctatgagaaaagctcccgtatccagtctgctagtcctcttgtccttcccctctcccctttttcttcccctctctactcaagaactggaggcctttgaaagtgaacctactcgttgtccaaggcaaaacagaacccaggtgccatgacttttttcttgggcctcttactattagtcattcaaaataat

SEQ ID NO: 3751 - DNA, 201 bp, Bos taurus
ccacatggtgtcaggccctgactagcagggactgcagccacgcagcatagctggattctatgcccagtgccctggttgtcccactgatggtcttggtgaatgtgtaaactatcgctggccgtcaggtgtcagtcagtgtgtgatcatgagtagaggcaaaggccttgctagagtggctgggaaggaggtccggagaaggct

SEQ ID NO: 3752 - DNA, 201 bp, Bos taurus
agtggaatacatgaattaaaacctaaagtcctgcaagaaataagaggatattgtgttgtatgtagtgatttttttatttttttcagagagaatgaaattgttaggtaattgctgtattctaacaatgatattgcttccctagaaattgtctggttcttattacagagggaaatatggttgccctaaaaaagaaacattatt

SEQ ID NO: 3753 - DNA, 201 bp, Bos taurus
gtgtacctggaggtctaacagactacctcaaacttagttaagtccaagaccagaccactaacattcttttcccttttcccagcatgtttccaccacagccgcccagcggccacagaggtccctttaacatgtaagtcaggcagtcactcctctgctcaatgctttcactacttatctcatggagaatagcatgcagaatac

SEQ ID NO: 3754 - DNA, 201 bp, Bos taurus
aaaacactatacttggaacaataggtgaaactacaggaaacaggaaaagcaaacacacacacacacaacacatatacacaatccccaacaaccttttagcgggaagtaaaatcttttgaggcgagatcctctaaatctttactttaagacaagggtgtatttaaaagaaacgagatttcaatagaccttaacgaagcttga

SEQ ID NO: 3755 - DNA, 201 bp, Bos taurus
tggctgacctttagaaatcctgtagtttatttatgaatacctgttgtaagttcttgacttctattgtttgtggaagacagttggtttacatctgctaattcgcgtgaacttagttttcatatttgtaatctcaggagagagaaactcagagagagaagtttgggtcaaatacacaattagagcttaacaaatcttgaacag

SEQ ID NO: 3756 - DNA, 201 bp, Bos taurus
cttgacaatgaacaaattctattgggaagagccagcagtcctgggaatctggcctgaggagccttgctcttaaattctagagaatgaatggagcaagtaaaaaatttggcataataatttatttcatagtggtcttattgcagagcctcagagaaatgtggctataagaacattcctggcatataacagaatgtctgccac

SEQ ID NO: 3757 - DNA, 201 bp, Bos taurus
ggactgtgcagtgtgttctcaggacttataagataaatacattggaaaaacgtgcttgagagaaaagagatgtgaaaacacatggtaagcaactagggaagtgcctcagggtaaagagcagcattttagtttcattttttgttgaacaaataagaaaacgtggtcaatggaacaagtgtaaatctcctgggaaaacagatt

SEQ ID NO: 3758 - DNA, 201 bp, Bos taurus
ttatctgacctcatttttttttttcagttgcctttagggaacaatatgagaactctacttagttctaatttaaatcctatcgattcttatcaatataaatcgaagattatacaaaattatatattctattgacttggataagaggcagttcattgaattctgctaaaacagtttttatattaaagctgattcattttattt

SEQ ID NO: 3759 - DNA, 201 bp, Bos taurus
gatcaatgcatttgagtgttccacagcctggttggagactgtaagtagtatgtgaggtgaaatgaacaggaacggggacgtgacgtgtctaggataaatgagactcagagagagaaagattgctggggaaaaataatagagttcagatgtaaacatatctgactcagggactgtgctggaaattaatgaaatcaataggca

SEQ ID NO: 3760 - DNA, 201 bp, Bos taurus
cttgcaggccaaagacctagtctacaaaatcatagactatttttatacgttttggtcaaaattattttaatcaaaactatttttataccttttcaatctcatggcctaataatattttccagaggttatgtgatgtatagcaacacaataaattgacaaagcagcagacgtgagactttatagctaccttctattaaaaaa

SEQ ID NO: 3761 - DNA, 201 bp, Bos taurus
gctgtgttcactgtggctttctgctatccctttttaaaaagttttatttcttcacgcattgataatgtctttatcttcacccaggcccaattaacttcccccagcttttcatttaattagttctcatcgtccttttcaaggtgcaaactgactcctgacttggtgccattttgcctcattatcaggcccccattctaaaat

SEQ ID NO: 3762 - DNA, 201 bp, Bos taurus
aaccgctggggaattgtgagaaaagtaaaatatgttacacatataaacacacaccttcgaataagctcaatgaaagaaacaagttggccaatggttgagaataactactggattattatgggaagatgctagctcgggtattccctattccctttgctgctcctgtctctgacccaagcagttacaaaggcttatgtgctg

SEQ ID NO: 3763 - DNA, 201 bp, Bos taurus
aagcaaagtcaataacacctgttaacaaggataatccatccaacagcggacataaaatactacctcagtgatacagagaacagagatatggggcccagacaccagtctcttccctgacattccttaatgagaccctccctgttaggcaagagagcctgccttaacaatcttatcaggccacattgagatgagggaagcagg

SEQ ID NO: 3764 - DNA, 201 bp, Bos taurus
tctgactgcaaagcctcaaggttacagggcccgtacagggaagatgtttcagtctgcacacacaacccactctgcagacacttttcactttctcttattcatatgctctcaactccaaggccaccactacacgattcaaagagagggctgccacagcctgcctgggttcgacacccatccctatgctcaaccctcttagcc

SEQ ID NO: 3765 - DNA, 201 bp, Bos taurus
gccctcacttggcttaagggagtaaggaggtcctccttgcagacttcacaaagtgtcaaatgagacaagatccagggaaatcttgtaaactatggcacgcgagaatcatacaaggaaagcatttttgttggtttgtccctgtaccttcaaatgttctagaccacttttttccccctttgttattttctttttctcatccag

SEQ ID NO: 3766 - DNA, 201 bp, Bos taurus
acttcaaagaaggtgactgggctttggccatcatgcttgcccatgcagctatgtgtaacatggtctaacggagaacactgcacctgagagagatctccacttggagcctggccagggaaaatctggagaacccactgaagagccagcacatgccccccaacagagacactgcgctctgcctccttctacacagactcgagc

SEQ ID NO: 3767 - DNA, 201 bp, Bos taurus
aacttttgttcaaaacacagtttaagataaggagattgctctgtggaaaacagaaaaatagtgatcctccattttacttttggctctgccagttaattgacaaatgggtaaaatgaaggagctgaaaatgatattagcttttaaacttttttcccccttaaacaatgcagtgacttccccagccatccagtatttaagact

SEQ ID NO: 3768 - DNA, 201 bp, Bos taurus
actaggtaagcagagaaaacacaactcagctgcaaagaaactcacaaaatacacacaccacaaacttccgccatgcagctaagttcactgcatgtgttatgagccacactcctctgaatctggtgttacactttcaatccaacttcagatgacccttcttccatcacttcacaaattgcaaccctttggagacccacttct

SEQ ID NO: 3769 - DNA, 201 bp, Bos taurus
attggccaggaatgtatttccccctgaggctcaaaagctttaaagccacataaaatatttcattgttttgtgattcatggtgctaggacatcttacatcacactcagttaaagaacagggcctgttttccccacatcagctttgcacagagaaactgaggaacgcaaaagcaagtgacagtcaggagtaaaatcgtcactt

SEQ ID NO: 3770 - DNA, 201 bp, Bos taurus
atcacaaaaacgttaccataggaatgaaaacatttcacagtttggctctacttttcctgtttcacttcatatatgtatcctgtaaattaatcaaatttgacaactcatttttcctgaaaaaatactctacattatccctactttgatcacatcgtttctcttctgtttcaacaaactatacaaactctcttctctgttagg

SEQ ID NO: 3771 - DNA, 201 bp, Bos taurus
agcagaaagctcaggcgagtctgaggacaaacgagagtaggtattacggcatgtgttcaaaggaaagagccaatcaatggactgtgttgaaccaagtttcgttcttatactgctagagatgatgcagatgaaggggcagtggtcaaactgagttctatagtttctgctgggatttttttttttttttcacttaatatgtca

SEQ ID NO: 3772 - DNA, 201 bp, Bos taurus
cttatacatgaattttacaacgccagtgctgatgatccgccttctccagagaacccagggagttgtctaacagactgctctgttttccagcattggcgctcgtttccttggaatctgccgaaaggcccaactactttctctgtgtccacgatgacgacactcttagtttgaaactgtgggaagcgaattcagcctttcatc

SEQ ID NO: 3773 - DNA, 201 bp, Bos taurus
aggtacagttccagacagacattttatgtcacaagaagctctctaaatcttgactagacttttgattcagtaagataggaaacattctacttatgaaatatggcagattttaagaagcaaacagaatctttctcttttatttttaggaggggagcacctggcactataattgtacaacatttgaatgtgttaagactgatg

SEQ ID NO: 3774 - DNA, 201 bp, Bos taurus
cacacatattctactttttaatcaaatttgaagttagctttgttatttttctcttaacccacttatatttccatgtaattgtaattttggataatggtttgaaggtttctgaagaaccagtttctcaaagaacaaggaattcaaattggttccattcaacaaatacttcctggatgcgtatgacctcttttatgtttacaa

SEQ ID NO: 3775 - DNA, 201 bp, Bos taurus
attaattgtattgctcttaaaaatatgaatttgtttttaaagtgcacagttttcagtactgttacatacgtattctttagcttagattctaatctgcacccagttctatggaatctgaagtaacatatctgaaatgaactgtagtaccatgttgcttagcaacagtatgctctttagacatttccccctctcctgggactt

SEQ ID NO: 3776 - DNA, 201 bp, Bos taurus
aggatggatcgtgggagagaggtagagaggaaaataagtactgcatccttgtaaatagccaatagttgtacaagtgagtttagaaatgttttcaagagagcgaacaagaacattatggaatgagacaagaggaagactccaacctgctaacccaaattatctcccctgtcaacctaagatgcctgaaattacttcaatttg

SEQ ID NO: 3777 - DNA, 201 bp, Bos taurus
gaagatgggcttctgggtcatatggtagtttatttctaattttttgaggaagctccatattgtctttcatagcaggtgcaccattttgcattcttagttacacactaacactgtataggaattccaagttcttattaaaaagcctagacctgaaaatgaactgaacttcacttaacttttgggagaacacttcaaaatgct

SEQ ID NO: 3778 - DNA, 201 bp, Bos taurus
atacttgcagacagcaatgtatcattactacagtgttctacaaattttgctaattatgtgatctgcgctagtataagaatattaactataatttctgatggaagtttctattccaatataggtttatgacaatattaggatagtttctttgactcaaattatgagaaactgaatgaaaatgatgcaactcacactacagta

SEQ ID NO: 3779 - DNA, 201 bp, Bos taurus
gggaggagaatgttaacataaaccagtcatgatacttctctctcagttggaagttacgcaggaaactcatcatcagatctgaattctgtagtaactattttaatggccttctcagtttttattttaaatatattctgaattacttttttagcttcagtaatacttcagctatagtatataacatttatatacattttaata

SEQ ID NO: 3780 - DNA, 201 bp, Bos taurus
ttttgtagaaacatttttctcaggagttgcagttaaattatacatatccccctatacataagcattcagcatatatgaagttgggtgcagatttattaacatataaatgaccctgttaaacttcatcttcttagatttgcatctctcttcaaaggtttcccttaaacaaaattctttatctaaacttaactacgtcttcta

SEQ ID NO: 3781 - DNA, 201 bp, Bos taurus
ctaagagtacctaagtgcaaagtggggtgacaagcagagaagcttgaaaggtgagaagaggtcagccagttgggaaaggatctcctatgacgtgccaagggtgcgttgtgtgatcacttgaaagatcagccacccacttcaccctgagctctgagaagaaccacagtaatctcttagtcactaatgaacaacaaacatcaa

SEQ ID NO: 3782 - DNA, 201 bp, Bos taurus
aactgagtcagacttctaagtaatacttggtataaaacttgttaaaaagcaataaaaactccatttttttttttgttatagcatgccaaagaactgaagagatcccatatatttttataactttcatatactttgctcctggatggccttctcttagaataatttttctttcttgtcttcctagcaaattccaaggtgttt

SEQ ID NO: 3783 - DNA, 201 bp, Bos taurus
gggtccaacatagaaacaggaccaaactaggggtctgactgcggtccgactcagaaacggaccgggtttggggctggacctcggacaagttagagactggactggttccaggtcagtgtgggtccgcctgaagctggactgggcccggcgtgaagcatcagctgaatcctattgtgttttgaggccgaaaaagcaggttaa

SEQ ID NO: 3784 - DNA, 201 bp, Bos taurus
gaagtcatcaagaaatgatgatgtatcaaaacccattttttaactgtaaatattagaatgtgtgaaggggaagtcaggaaaatcatggacaattgatcccctgttggtctcttattctacaaagtcatagctcttcccaactaagacttgccttcattgggcccacccatgtggtacattaagcctgtgtccatgctggtg

SEQ ID NO: 3785 - DNA, 201 bp, Bos taurus
ctagtcccaagcttacaaactccaatactttcagtcgggaattccacctgggaatgtttggttgaaatgtgatgcttctggggccccactccaaacccactaagtaaaactgttgagtcgtgggcgatggaatctttacggtgaacatgtgtgtgatccccaccagtgtgcctctaggaatcatactttgggaaactaccc

SEQ ID NO: 3786 - DNA, 201 bp, Bos taurus
cacctctttcttactcctgagcctggttctttccctcttcctttgagtctggaaattctgaaattgatttctgtacctgtgttcataggtaattgagtccataggtagcgctaagaacagaaggcccagagattcctttagtgtctttccatcttctacctgggccttcaaactctattaaaatgccactgaaaaaaattc

SEQ ID NO: 3787 - DNA, 201 bp, Bos taurus
acaaatttcagtgtccataagtccagttttcttggcatatagccatactcccttgtttatgtattgcctgtggctgcttccacacagcaatggccatgatgagtagtagacaacatatggcataaaaaaaaaaccttgtatagtcactaactggccctctacacaaaaagcttaccaactcttgtcttgaagcactgtttg

SEQ ID NO: 3788 - DNA, 201 bp, Bos taurus
ctgcccttcacatgggccttcactgcatgccataccttgctatatcattaccagcaactgttagagaccactaatgatatactcagccattggtcagggacgcagtgggccccttccccgagtgaggggctgttaatgagtgaccgttggtggtcctgcccagccattagtcagggccccgtgtgcccctcccccaagtga

SEQ ID NO: 3789 - DNA, 201 bp, Bos taurus
tcaaaaagaagtgtaatatatttcagggcttgatattcctgagcagtcagaacagccacaaaccactgtcagtaatttagcagagacattatgtcaagcacaaaatccacacccacaacctcatactcaacgaaattgcatgcaattgcttatgacaagtccttgctggaatcctcttatcattgcaaacatcctccatgt

SEQ ID NO: 3790 - DNA, 201 bp, Bos taurus
gcatataatgaggctcaaggtctactgaaagttgaatcttctgttgtcttaggcctaatgagttcttactagtttttgttctattccccagtggccttggaattcttttaaagtctgtgccctggcccgttccctcttgtctcactggcatatttacattcagccagttgaccaaatgacttaatgaaaatttattaccca

SEQ ID NO: 3791 - DNA, 201 bp, Bos taurus
cctcccctgggtttcaatggagcccaggggcctttaatgtgtaggcattattctctgtctagaagtgaggcagtatattttcatattattctaaaacataggagctggccatgccctttatactttcttttttcttagaatgggttttgtccttctaagacagttaaggcagaaataaaatagagttaaattccatttatc

SEQ ID NO: 3792 - DNA, 201 bp, Bos taurus
gagtttctcataggcacatattaacatatctggcagaaagtaaattctttctgctccaattaaagtagcaatttaaaacttggtgaggactagtattttgaggatcagtcttttcaagttgcatattataactaaggaccacattactaactcagaaataagcctgattgtagtattatcttggcagttacagctagctga

SEQ ID NO: 3793 - DNA, 201 bp, Bos taurus
caggcaaccaggtgcttggcgagcacactgtcccaggaggaccatgcatcttaatcaccttcccggttctggctgcttggtttcccgggtgtgctgcgagagcactgtctcaggtgtgtctcctctggggagatgatctcaagctttgaccctcctggcagatgtcaacggtccaggatcccaggaagacttggttaggaa

SEQ ID NO: 3794 - DNA, 201 bp, Bos taurus
aaatcaaaagaaggggagtcacttttataagatacctgaaaaactaggagatcttttcatttgggtgaaagaacttataacaggcataacttcatggtttcgctgaagaaatatatacttaaagacttctaatcatgtttataaggaaattgatgtctccaaaagaattatggggatagaatgtggcagagacttgactgg

SEQ ID NO: 3795 - DNA, 201 bp, Bos taurus
caatccaatctacactcagcacacacacagtagttttaaagcataaaccaggtcatgtcaattacctgttacacaactttcaaaggcctttggacactggagctcacaaagtaacagttcctgcatccttctcaaacctcatctggtgcatatcatacccctttcctggctatgctcagccacctaggccttctctctctg

SEQ ID NO: 3796 - DNA, 201 bp, Bos taurus
gcctccaatggaaattttttattaacacagatgctatccccttacccttagtggttggagcctttcctgttggtcataactgggtcaagatgaaagatctatatatagatgctggggtcagttacaaagaagatattaaagattatggcattaaacgtgctagactatatattatttaagattgcattggcagagaattca

SEQ ID NO: 3797 - DNA, 201 bp, Bos taurus
aaagtttgaagtccttttctcctacacaaattttagattttggcttttcttgccttttctttgtgtccttctgactgcatatgctttctatcgtcaaagaattcctcaattccccaatttcaagtacagtcttaatattagagtatcagcttactaaattgatagaagttcctaaatattttaaaaaatcagtatgccctt

SEQ ID NO: 3798 - DNA, 201 bp, Bos taurus
gatactaagtctctaatagggccatttataaatgttgaagttttctttaatgcgtgttagtttattttatacataatcatttgaaaattaacggaattggttttcctctgtatctctttcttcttaatttagaatgggtcctggagggattgtcagataattgattggttgacctacatgtgcagttgagggagttttaaa

SEQ ID NO: 3799 - DNA, 201 bp, Bos taurus
ataatttcattggaattagatgaaagtattatttgaattttttctataatataaaatattttataaaacatctgattttgtaaaaaaaaaatgtaaaaatatgtatgtacttttcaatattacctatgtggggttttcgtgattcatgttataaattttactaaaatgctttgattatttttgttgcctttatctagaggt

SEQ ID NO: 3800 - DNA, 201 bp, Bos taurus
taatgaattttaatttcattttaaaataattttaatatatctaacgtacaaatatttcccagaatctggtcatgaaaggttgctctggtcaatatggttaagaaatattttaggttaattcacctatgtaaaattattcttttaatacaaattttctacagcaacaaagtgtggtactatcagaagttatatatatatatt

SEQ ID NO: 3801 - DNA, 201 bp, Bos taurus
aagagttggacacgactgagtgactgaactgaagagattttgcctacagatatacatacttgatgtaatacaaagcctaaaatttcatggtcatcatattgcatttattaaacagagtcttgaacagatggaagaaaaataaatgttgctcttgttccggtatatttaaaattattagtaaaactttcgtgagtgtggatg

SEQ ID NO: 3802 - DNA, 201 bp, Bos taurus
ttctgtattactgtgtatacgtttccctcaaactgctccttaaagaatagaatcttggttacaagtacccagattttagagcctatattacaattttatttcagtttctgttcctaattactattgctcaaatttgtttatagtataattgcaggaaatgtggtcttttttcagatgtaaatatggctttaatgataatta

SEQ ID NO: 3803 - DNA, 201 bp, Bos taurus
ctcccccagccctcctccctcctgggagctctactgatgcctcaaatgggacatcttcaccaaatcatctgactgaagccagggattactatatctacacgggtatttcttttccaaagcaaagggttgttgagtgctatataattcagtgacctgatctttctaatgttcaaatttcagttcttcttattttcttactca

SEQ ID NO: 3804 - DNA, 201 bp, Bos taurus
catttttcaactagtcttacacaagttcaggcaaggtgctaaggaggcacaagaagggtcaggagtctattcttataagaaaggcctaagaaaatgacctcggatgctgacagtaagggattttgtggtaagtttgccattatgtttatattctatttcccttcccattcccccaaagcaagggactctaagagacaaact

SEQ ID NO: 3805 - DNA, 201 bp, Bos taurus
ctatctgcactgctactaacagaactctattaatgtacctcaagatttatttataagaagatccagctttttaaattcctttttaaaatgagtgacttggggacctccctgtcagtccagtggttaaaactttcttaccagtgtagggacctaatcatggattaggtaactaaggtcctccatgccctgtggtacagcata

SEQ ID NO: 3806 - DNA, 201 bp, Bos taurus
aatgtatttttgcttttgttgattgttggttcatttattgacttgatcactcattcattagtaaccattttcagcactgtaaaactatcaagagtagacaattttactttgaaatatttaaggttgtatttttagcatctaccaacatatttgttgttgagtcactaagttgcatccgactcaaattttgagacccccatg

SEQ ID NO: 3807 - DNA, 201 bp, Bos taurus
atatataaaaacaaggtcctgatgtgcccccaggcaggcagaagtcaagaaagctgcctgcaaattgcctgtatcatcacaatgatacaacaatgccccattgggtaccttggttatcaaggaggaacagccggtcctgcacagagctcagccagccggtgcattcaaacacggtgaattcaaaaactccccatgctactg

SEQ ID NO: 3808 - DNA, 201 bp, Bos taurus
cttgactaagctggccttacaattccccttggcttcactaaactttacacaagtttcttcctgacctcccttttctcagagcatttactttaagcttgcaattgtgaattattgctctggccctttgagatcttttcccaatgtctcaccagttttaacaacccaggaatgtctttctcaaagactcaggagccattcttt

SEQ ID NO: 3809 - DNA, 201 bp, Bos taurus
gggggtaaatggggagaggcgataataaggttgcaggcatataaatacatacacatgtagcatattttaagaagtgaaggaacatgagtttggagtggtagacaagctgcatagtatttaatatcttgatagcaatctaagtttagagtttgttaccagtagacaatgatgagttcataataaccgaagattttagtagcc

SEQ ID NO: 3810 - DNA, 201 bp, Bos taurus
catctggagcacctctatatgcagtgaatggagttgtggcattttcaggccttccaggatctagacttgcaactctgatagttgctccaaattggccatcgagccaactctataaggtcaggagcctaggagatattttgctctattttgtagacagtgacaactgagaagaaattaatggccatgcattcactatgtagt

SEQ ID NO: 3811 - DNA, 201 bp, Bos taurus
caagaactgattacattaatatgtggcacaagaaatatctgaagattttctagtttcaaactacctcagagtaaatgtcaataaattaatattttgtcatttttaaggtaacttgacttttatggcagttgaaagtacaaatacagttacaaacaaaacaacaaagaaaatcaagatttctgtattattttaaatatcatc

SEQ ID NO: 3812 - DNA, 201 bp, Bos taurus
ctgaatcaaaacatcattgtggtaatatttatgtcatcgatctctgctgattgccagatgtcttattcctactgtgaaatattcatgataaaattatttcttccagaaagtttgtgtgtttatatgcctggtggaatttattaacacatgaccacaaattaatttattggcctaataaaatattacctaataaaaaaatag

SEQ ID NO: 3813 - DNA, 201 bp, Bos taurus
ttttcacaggtgtataaatatgtcactaattaccaaattgtacactcaaaatatatgtaatgtattcaattatacctcaagaaaaataaaacatttctggcgtgggcataatgttttaggaaagttggatctgagaaatggtccttgttaagagcatgtttgtatctcctcaaaattcatgtgttcaaaccccaaccccta

SEQ ID NO: 3814 - DNA, 201 bp, Bos taurus
ttaataatgacagtgcctagggcaatgtttggataagttttctagaagcctccttgtaaatgattggcattttcctacactcagtgttttcctctaacacgaatcactgtgtacacaggcatcacctggaccttgtaatgtaagtacgtgggaattaaggtttggggaactactggtaaatgatatgacactgactactgc

SEQ ID NO: 3815 - DNA, 201 bp, Bos taurus
gatgactattggtttcatgtcattgttttggatggacagctcagagactctacttgtcagggtagattttttttctgtgaaatgtgttatgtgtggttaacgtcctatttagggccaggcatcatttgctggaagttatgtagaagcttatgcttggaaatccaatttctaaaaataaatgagtaagcacagtaaagatga

SEQ ID NO: 3816 - DNA, 201 bp, Bos taurus
aggaatgtgtaaaaagtgttataccatcctccttgagtgaggcaaaagaatctactcaatgaggtaatattgaccagtgatctctggcctagtaattttagctacatagatatgtcttctgttatttcatcaataatatctttataaccaattttaaatagtgtcataataagcataaatgcaaatactcagggccaactg

SEQ ID NO: 3817 - DNA, 201 bp, Bos taurus
actctactaatttgtattctttaattccatttcaagatttctaaatacaattaaataaaattgcataattatgctggtttggctccattaaaacttcatacttctcagcctcaataagcagttctcattaataagataagcagttctcttaatcattcttcatcccattgcacattcctttcagaaaccgttaaaaacaaa

SEQ ID NO: 3818 - DNA, 201 bp, Bos taurus
tctccctttcatttaaaaagctgaaacttgtttattttaatatccttgcaatttacaagtgtttaaaagactcaatgggacatcatatatttgttgaattagttttattccccttatcaagcataagaaacaagtgtgtaccaagtgcgatctgaaaagactacattcagcttaatttcatagaaggcaacactaaactga

SEQ ID NO: 3819 - DNA, 201 bp, Bos taurus
gggtggacaacaaagaattacagaacccaaacatcaataacgtcactgaggagaaaccttatagatagagaacatttgttttgacatactgtgtgtgcatgccaagtctcttcaatcatgtctggctctttgcaatcctatggactgtaaccctccagggtcttctgtccacaggattctctaagcaagaatactggagca

SEQ ID NO: 3820 - DNA, 201 bp, Bos taurus
aggagcctggcatgtgtgtagacaacagagaattcctgtattattaacccctcattctctgacccacagatgggaggccaggttgacctaaacccaaagagagaaaaagctttcgtgggtgtctggaggcttagaagagctcggcctcatagagaaaggcctgggaaggggcagaggtatgcttgccctacgtgcccctag

SEQ ID NO: 3821 - DNA, 201 bp, Bos taurus
caaatatacgacagcataaagcagagaactatggtgaaagggcaatgttttggtgaccagggaagctgggctttgaaacctggctccagctgagtggcctgacaagtctatttaactaatgaggattttatctataaagcggaaccaaaattattattatttgttggcttagtcaactagggctatgctaggacagaatag

SEQ ID NO: 3822 - DNA, 201 bp, Bos taurus
gcgtgaacagcggcccgaggtggctgtctgctgcgctcccaccccaggaagggcacaattacgcctgcagaggaggatcaaggcttccgctggttgaaagacccccctggcacctctggcccgccccggcaccactgcaccgcacaggattcgggcactcccggcgttgccagttccgagacgcactcctggcatctgcca

SEQ ID NO: 3823 - DNA, 201 bp, Bos taurus
cagccggagttggagcgggcccggcttagaaaccagaccggatctaaggttggacccgtccgacttagaaagctgatcgggtcaagggtcggaccaagaccggttagaaaccagattggttctggccctgactggttccgacttaaaccacagcaggcccagcgtaagatagagctttggtttgaggcggaataagtatgt

SEQ ID NO: 3824 - DNA, 201 bp, Bos taurus
catcggggttcagtgcttacttcagggccaagttgagcatttccatgggatagatagatttttctcaccctcttgtgaaaaaatacctgagtgtatgagggtagcctttcttggcctctggtgaacttttctgtatagaaaagcagccagccatatttagcagttttatccagcagcatgaatcatttaactgccttggtt

SEQ ID NO: 3825 - DNA, 201 bp, Bos taurus
ggcaagaattcattgatgtaggtactctctttaggacaaacagtgtgaaaccttgccaatgaatcctgaggtaagaaacgtggaaaatgatggccagcaccgagcaaagtggatttcttgatgtcttcacagagagtagaggaagggataaagagactgaggaaagtgggcctgctgtgaggtcagaaggctagccagaag

SEQ ID NO: 3826 - DNA, 201 bp, Bos taurus
cagtcataccaaatcagatcattgtcaacccaatactctcctggaatcaattcgagtacttttttctcacatggtttgctgatctgatttagacttctaggaaagctctggacagattatgacaaaagactgctgctgctaagtcgcttcagtcgtgtctgactctgtgcaaccccatagatggcagcccactaggctcct

SEQ ID NO: 3827 - DNA, 201 bp, Bos taurus
acacacacacacacacacactcattcagtctcccaaaatatccacaagtaattgacctaatgaattaatttaaagctcaaacagtttatgtggccactggtgaagaaatttgctctgctacttcaaataaacacaactaaatgcctgccagggattgtagcagacaaacaatagcaacactgtctcctgactatagactct

SEQ ID NO: 3828 - DNA, 201 bp, Bos taurus
ttaaacatacaacacggatcatttgtaagaacttgatggaaccatcagggaacatttcttttcccagatccggaaagcagccaaactaggctggccatggctatcaaacaattacctagtggggatctagcgggcacatctttcaaagggtttctgggtttgtagctcaactgatttttacatacagaaatattggcaata

SEQ ID NO: 3829 - DNA, 201 bp, Bos taurus
gaaaacttaatggagctgacataaataagatgatcttaagcttgcctcactctaaactgctttttttgttgttgttgccttctggaaagttgctggatcattgaacattaatgtcacgccagggtgtagaagaaaaactggtaaacaacactaagaaggtgaagtaggtccagaattgggccaggcagatcttagggtcat

SEQ ID NO: 3830 - DNA, 201 bp, Bos taurus
gaatctgaatcaagcagaaataataaaatatccagcatttggccaatcctatgtatgttaaatcattcataagtaaagcatctcaaagccctggcatagagttcaaagtaatctcattttgaggccctagaaattaagattcaactctaagtaataacaataactgcaagtagctacagttatcatgtaatatttttataa

SEQ ID NO: 3831 - DNA, 201 bp, Bos taurus
caaaattcactggacatgacacatttaactgtatataaagtttttacagcaatttaaaggaaaaaaatttaagtggttcacttatactcaacatgtaaacccagaatgaaactttaaaaaaaattcatttaaataaacactcattgcaaatgacaagtgctgtaataacaacaacaaaaaaaaatgtggaaaatactcgag

SEQ ID NO: 3832 - DNA, 201 bp, Bos taurus
tgggagaatcattggccaaagcagagcgcatatgcttgggcagggtcttgccagtgaggtatagggatacggagcagtgcaggaaacactgttgagggcaagctatgccagagagccagggccaccaggttggaaaggaggtgctagatcaatttcttggtagagcagagatgaagcgcatatgagacgacgggacaagcc

SEQ ID NO: 3833 - DNA, 201 bp, Bos taurus
cccaactgtccttgtctggccccagccaggactagatcacgtctacctctgtagattctctctccagctccagctgaatcctagatttctgtaacctcagggtcatcatgcaaaaatataggccagagtgtaagtagcccctaccctaggatcaggattatttaggcatttttgttgcctggttatgatcatttcaaaaca

SEQ ID NO: 3834 - DNA, 201 bp, Bos taurus
ccctgagagcaactcacatgcagggcccagagccagtctccacctgcccacccaagtctgttcccacccggctgacaccatgatgactgctgttcacctgctcggcctcacaaagaccccaagtcacctgcactccttcagcctctcctgccctaaatatccacacatttgtgcaataccatcaccctgttgctgctgcag

SEQ ID NO: 3835 - DNA, 201 bp, Bos taurus
ctgcacggccacccccagtcctctgcccagatctgtcctctgaaacccaagattcagcacctagccccgacccgcactcgcagacacatgaatggagctggggagtgcagcaaggtggccgagaccaggtgtgctggtctctcttttctgcctgctgaagccaattgctgcactcttctctgagcctctgacgcttccgtt

SEQ ID NO: 3836 - DNA, 201 bp, Bos taurus
ctcctggtaaaactttccaccccaaagtcaatgctggtgaaatactttctctgagctgaatggtatccacctcttggttgatggccagcgtttgcaaatcaaaaggacctgcaaggtgggagcacttattgtccctgggcacagaaatacactctattaggaccacgttcatgactcaaatgctcagaggccaatgcatta

SEQ ID NO: 3837 - DNA, 201 bp, Bos taurus
aaatgctgccctggggaaatttgcccccaaactcggagcccactggacagaaattgaggacctgactctcctctgtattcctagcagccagcagagtctccagcacatagtaggtgctcagaaaaacgtttgtcaactaaatgaatgaatggttaaaggctactatctatgttgctcagttttccaacagccgccaaaaaa

SEQ ID NO: 3838 - DNA, 201 bp, Bos taurus
gcagcccatggagttgcaaagagttggacatgactgaccaactgaactgaactccactaagtgttaatttcatcagatcccaagatctccattcagatgtactttctcagtgaagcctccataattgaatctgcaaacacctttccaccctatcccacaccctccctctagcccggctccttctcaccccctacatagttt

SEQ ID NO: 3839 - DNA, 201 bp, Bos taurus
tgtatatgttattcccttctcctgatttatcacttccccccacatttctcctttgataaccataagtctgatttcaagatctgtgagggaattccctggtggtccaggggttaagaattcaccttccagtgctgagggtgggagttagattccttgatcagggaggtaagattccacaggcggcatggccagaaaaccaaa

SEQ ID NO: 3840 - DNA, 201 bp, Bos taurus
tgcagaagtaacctttctcctcacagaggcctgacattcctgttgaaatttgaccgcttgggaccctttgttgtctgagctacagccttctccagcctctgggttacccaggccctaaggagaccagctgccttcaaagaaaaaccctttgaagatgtaggcaggataaaaaagcaagagatgagacactgctgtctgcag

SEQ ID NO: 3841 - DNA, 201 bp, Bos taurus
aaggctaccactagccttgtaaagtctttgtaaaaagaaaaagccatctcttccttgagggtgagcagaggtgagctggatttcagttcctcttgccccccgttggccagatgccctggtgcagggctcacccttcacagtgacgcactctacagcccaagcacttaatcattatgctgggcttcccaaggggctggggcg

SEQ ID NO: 3842 - DNA, 201 bp, Bos taurus
aagcagggccaggaagaggctcatgaataattgtaattgggtaggaacgttttcttcttgtggcttgcctaagactagacttgaagaaaattaactgatcgcaaacagaccggtatcgctgcacactcactaagaggttttgctgtaatctttccaaccctttgcactgatgtaggtcctctgggtttgcagagctctctg

SEQ ID NO: 3843 - DNA, 201 bp, Bos taurus
tgtgcagggaaagagacatcgagggaagcacaagttcaaagtaaaagaaatgtatctgacaaagctgctgtcgaccaaggtacacttaccattctgggagcgctttacggctaccttgggggtgtatgatgtgtttgacttaatttccactgaagtgtgaaaatgttacaaatcccttgtgccttctagcaaagcaaaatg

SEQ ID NO: 3844 - DNA, 201 bp, Bos taurus
tgagttctaaacactattccgccactatcatttccaccttcccacatccatgtgttcactttgggtctcagactgaaggggcaggagcacataggggaagctcttcttacggtgaaaggagaaaagcaagagagcaaatctgaaaccacagtatgcttagatctctgcttgcaggacacatttgttaatactccattggcc

SEQ ID NO: 3845 - DNA, 201 bp, Bos taurus
agcccgtgcctcctgggtagccacaggccacttcactgtctcacctgtcaatcaaagctctcttggggacctgcttttaggtgagggcagtagaaccctcgccccaggccatctgagtacctgaaatctgaagacagaaataatttacaaatattctccttctcggacttccctggtggctcagacagtaaagaatctgcc

SEQ ID NO: 3846 - DNA, 201 bp, Bos taurus
tacaacagaggacaatagagtctgaagcttctaaagcctgtctgtaaagagggcatggcatctatctttactggcacaaggggccagttctggctgtccccgcttatcacaaccaccacatctgaacagcagcagcctactcctgggagaatcatgagtagatgccctggcctcttacctgagttgacagggggccagaca

SEQ ID NO: 3847 - DNA, 201 bp, Bos taurus
aacaaaaactggccaccatctattgagtcttactgtgtagctgacattttatagacatgactcatttattactcacaacacctcaacggtgtggaagaggaaactaaggcctaggataactataaggtccaaggtcgagtgcttagtaagcagccctaactagcccaggatctgtcctctgcgggctagccgcatgaaact

SEQ ID NO: 3848 - DNA, 201 bp, Bos taurus
aggaatcagaatttctagagtgccaaagatgttgctgtgatttcaaggaaagaactgtgaataaagcttggctcagccgtgtctgtagaaaggatgaaacgttattagtcatggatggagactggtgtggaatcaacagcccacctgttctcttggtagaaatcatctctattcctgtttaaataattttgatattgtgaa

SEQ ID NO: 3849 - DNA, 201 bp, Bos taurus
tgacagtaggaaaggggaaggatttgcaagagaaaaacctgttagcaaagtaggacagcagtcagatgaaagataacgaaggctttgttagggtggagatgcagaagtcaagagcaggacagatttttcaaagataaatttgccaagatttattgaccaaatgggtgacaaaggagtattcaacaatggattttgaatgtt

SEQ ID NO: 3850 - DNA, 201 bp, Bos taurus
gatgaggaggaagaacacataatacaagaaaatgaaaatgaggtagaagaaaagtaagaaccaagatttacgtgaaggattttattctttttttgtgaaagtgttttaacttcaagactagaaattccactggaaagggaaaatgagtgtaagtttactgtgtttaaagctaagatgtgaaattataggaagaacctgggt

SEQ ID NO: 3851 - DNA, 201 bp, Bos taurus
cttgttcttatcaagggctgggggatggccaacggctgtttaggcctctgtgacctcacctttgttgttgttgctgctgctgtgtagttactaagccgtgtcagactcttttgcaaccccctggcctaaagcccaccaggctcctttgtccgtgggatttcccaggtaagaatactggagtgggttgccatttccttctcc

SEQ ID NO: 3852 - DNA, 201 bp, Bos taurus
tggactgcaaggacatcaaacagtcaatcagaaaggaaatgaatcctgaatattcattggaagaactgatgctgaagctccaatactttggccatctggtacaaagagccaactcaccttttccacctggagaaaactctgatgctgggaaagatgagaggcaaaggagaatggggcagcagaggacaagatggttagata

SEQ ID NO: 3853 - DNA, 201 bp, Bos taurus
gaagtgtgttttatttacaattttatgttactctcagtacttgagtgcaatctcaaaatgacagaatgatctctgttcgtttctgtgtgacatgacaaaatatgatccactggagaagggaatggcaaaccacttcattattcttgccttgagaaccccatgaacagtatgaaaaggcaaaaagataggacactgaaagat

SEQ ID NO: 3854 - DNA, 201 bp, Bos taurus
agctctcctgctttcatcctggccaataagaaggaaaaacaaagaagggcgtacgcattcttccctctaaggacgatgctcaagcaggtgcaccagcctccttcactgtacatgctctcctggccagaacatagccctgtggccataacagcatcagtggcagttggaaagtcatttataagtccagcagccaagtctcca

SEQ ID NO: 3855 - DNA, 201 bp, Bos taurus
cttccatctccagagaagatttgatttccaaagagcaaattgtgatcagatcttccaggcaaccacagagtcagaatcccaagctccctctgtccatactaaaggaaaaacatctcagaaatgctacccttggatcagaagagactacagaacacactcccagtgatggtaggagatggggaaagtgggaaggggctgggc

SEQ ID NO: 3856 - DNA, 201 bp, Bos taurus
gaagggaaagagggaaaatggcagggaaagaagctggagggtgaggctgcagcctcctcagtgggctatcctcaaactgcactcccagcctcccagctgctcctcctccatgtgaaaagagcaggcagctccatgaggaagagccctggttccgtacagcccagccccagctcaggcttcactagggaggaggcgtagagg

SEQ ID NO: 3857 - DNA, 201 bp, Bos taurus
cggtctgtttccccttccgaatctcccagcccctccaaagcatgtctgcctctcatcttgagacttgagtgatgcagagagacaagagagcagggggaaggccagagtcctagccctgtctgtgtcagtggagatggaaaggaggcctgggacgggaacagcagctgggggtgcgtaagggggagggggcttaggagaggc

SEQ ID NO: 3858 - DNA, 201 bp, Bos taurus
ggccccagggtgcaaacccatattgggtcctgaaggctccatcccccagaggccattctctcctcagagctgagggacttccctggccaggctcaataaagatgttacctccactcccacacccatttacactccactcacagcaggagcctcctggcctccagggcctagttttacctcaggccagtgctggggacacca

SEQ ID NO: 3859 - DNA, 201 bp, Bos taurus
cctgagggtctcaggaagaccccacaagcctttgatggggggcagcttggcttcccccagggtcttctggacgtcagagccctctaacctacatggcctccctccttttcaggactctttttttttttttccccttctctctgactccctctcttctctccaactgagggaagtagagcaaagttggggtagtggccctaa

SEQ ID NO: 3860 - DNA, 201 bp, Bos taurus
gttttcaaacattcctagcggaccttgtgtgtatgggcgcttcactagggcccggcatccgcccagcgcctcccgcccttcccagaagccgaggccgaagcacctccactgcaggggaccgaatcacttaaccgcattcgcctttccaggactgatcgctcctcaaaaccgttttccagaagttcacctccttgtccaggc

SEQ ID NO: 3861 - DNA, 201 bp, Bos taurus
cccagggaccacacctgaaacctaaggttagacgggtcagagagacagagggcccgggaggaggctgggagactcccgccgccgtgggcagagcgcggggaagcggaaagacaacgtggaggaggccaaaaccggtgcagatgagctgaaggacaacggcgcggaggaagcgggctacgttgtctgcgaagcgaagcagag

SEQ ID NO: 3862 - DNA, 201 bp, Bos taurus
taacaaatttcatatttaacaccaaaactaaaacaaatttaaaataatgttatattgactgcatgttgaagggatataatattttgaatagattgggttaaataaaatacattattaaaggtagtttcacctagttctttttcaaatgtggctattagaagattttgggcttcccaagtggcactagtggtaaagaaccca

SEQ ID NO: 3863 - DNA, 201 bp, Bos taurus
gggctgagaattcccagggctgttgctaccaggtttgcaaccagacattaaatccggaggcatgagactataaaatgtggttggaggtatgtgcagaggggtgaatttgaagacagcaaaatatgatccaagagaacattagctaagggtctagggattttcttaaccaagggcttgggaaagggttcttccttcacttca

SEQ ID NO: 3864 - DNA, 201 bp, Bos taurus
aggccctaatgtgccagcctcaaaagcacttcatttggggaagttgttgccccactaatagcattatgtccccttctgatttttcttccttttcttgatctagctggccagacctgtgtctatggtgcccaacattcctggtatccctggcccaccagttaacagcagtggttccatttctccctctggccaccctatgcc

SEQ ID NO: 3865 - DNA, 201 bp, Bos taurus
tgctggagccccagtggaaaccgcctgctgttcaccgtgttgggggaaccgcttatttactccttgtcattcccagaacgttgtggtgagtcaggggcaacacttccggatgcacaatagctggggtagtcagagggaggaaagagccatctggaatatgctgccttgaaggaaaaagggaagtaaagaagctcggaagac

SEQ ID NO: 3866 - DNA, 201 bp, Bos taurus
gcatatactaggctgcttgctggctggccaggcacggtccagagagcagcttaccaaggcagaacccagggtctccagatcttaccaaagaccctagcccgatagagaggccacagaaccacattcccacccgacctctgggtcctgaactcacaccatcctgcagctgctggatgagggaacagtggctgccaagaaaag

SEQ ID NO: 3867 - DNA, 201 bp, Bos taurus
tccctttctcgcagatgttctccctgtcgcttatgagtctggagccccaaatagtgccagaatagttagtaccaggcctttcacgtagctctgtcgagataatctttacccgagcctttccatcaggcgcagatctgcagattccgagggccgcccgtcagctgggagggaagttttttgcactatcttgctgagtacact

SEQ ID NO: 3868 - DNA, 201 bp, Bos taurus
aacctccacagcagcttaattgcggaccagatcgcaggcctccggctgcagtgtgcactgacccagagctggagactaccgagagccagttcccggggcaaccctgtctctctgatggccctcagtccaggctgtacgtccaggacatgcgtgtgaactccggagataatgtcgatggcagtatggtgtccaggaagacat

SEQ ID NO: 3869 - DNA, 201 bp, Bos taurus
ttccaactagtgacttggcccctctgcgcacttgggtttgggcaggggaagggatagggagggattttggaggcttctgactgtaaatcttgggggcccctgactcactcgcccatctcaccccaagtctgtaaagctctcagcctcgaagtgttccaggtgtttagctgtgggaggggagttcctccctccgggtcaccc

SEQ ID NO: 3870 - DNA, 201 bp, Bos taurus
tggtcgctactggctggacaccattctgcttaagtttgtattcacgaccacccatatgaagatgtgggcccccacacggcctctgacacctatgggaacatgtctatgagctggtgagcagtgcttacaattcacaccataagcccggagactggggccaaggagcagagagcatcgtccagcctcagggggacctgttag

SEQ ID NO: 3871 - DNA, 201 bp, Bos taurus
ctccagttgcccctcaaacccatttgctcctcttggtcacccttcacccaccagcacatgcatcttgaattgaagatgcagatgcagactatttgaaaatgattgtgcaaatctcttcaaacacatctggggggcattcctgaagaaatgttgcaagggtcccatcttcgtttcccataaattcagatgcaggcaagaaaa

SEQ ID NO: 3872 - DNA, 201 bp, Bos taurus
ctcagatgactgcatgcccagctggcaaggcactttgaagatgaaacatgccgagtcccttagagcccagggactggcatcctttacacagaggagggtgagggccactattaaagcacattctagagaggcgttgacctcagctagccacacaagcccataaagcacaaattgccacaactgcatctgcatagccaagcc

SEQ ID NO: 3873 - DNA, 201 bp, Bos taurus
acactgccggtcgcagccgggcggaggctgagtcctggtaccgcagcaaggtgagtggtccagcactcccttcccagaacagggatgctaaaatctgaaaacattagcagagtggggagggatgctgaaaaagcattgacctttgtctgggtgggcaagggaagggcgggcagctctcgggatggggtgcagatgtgcaag

SEQ ID NO: 3874 - DNA, 201 bp, Bos taurus
gacccccaaagtccactccccctaccccagcctctagaatagttagaaaaatatctacaaggctgtctgtccattcctgctgtgccactgggcccagagggcacacagacgagggctccctgggcagctgcatcaggacccttccgcacattcccttccagctcctccttcagcctggcccagagctcagcctggggcccc

SEQ ID NO: 3875 - DNA, 201 bp, Bos taurus
ccctagggtgtgagcatctctcacctcagctcacccaactgctcccctggggtctagagaaagctgggacccctgagacagagctggaatttcttgttgccggaatccttcctgccaaccacaggcctattgcctcctgctcagggctctgtgaagtaagaagtcgagctgtaaaaacgccaagatttggagacttttgga

SEQ ID NO: 3876 - DNA, 201 bp, Bos taurus
ccaagccccacccaaggagggttaagcaaaccgttgctaagtccaccgtatccagctgagcaggctctgtgtgtgtgtctccctggctccccttctcctccttccctacctcccaggtatgaggacgagatctccaagcgcacggacatggagttcaccttcgtccagctgaagaaggtagcctccccagcttaccccatg

SEQ ID NO: 3877 - DNA, 201 bp, Bos taurus
agcccaccactctaaaagtgaggacgaggaaactgaggcttgggaaggaggggccacttagccagggtcacacagctgactctctgagtcccgactgcctcgtctgcctcccaggtggggcaggccaggcctccccagcagcaggtctcgggcaggagccagggtctccctgggggctggggagcattgtagggttcaggg

SEQ ID NO: 3878 - DNA, 201 bp, Bos taurus
acggccggctggggatgagcacagtctcggggctattttcggaagccagaagggaaagtgaacgactcccagagggctattctgagcacagtgggacacgcaggccagacccgcggccgcctctggaaaagcagctcccttcggaatctgtcaattagcagccggggaagcagagcccctgctcccagacatgcgctcccc

SEQ ID NO: 3879 - DNA, 201 bp, Bos taurus
ggacagaaaccaatgagccccaactggtctctctgtcctccccacatatatgcactcccttgccttctcttgacctaacaggggtctcctaggccgttttctgaaataaccagggacactgccactcctggaaccagggcagcccctgaaaaaaagagggagatgataacggcccctctgagcatcccagagaagggtcag

SEQ ID NO: 3880 - DNA, 201 bp, Bos taurus
gaatgcttctctaggttggcatggaaagaggtctcccgcattgtagacagacactttactgtctaagccatcagggaagtcccagctttccccaccaccccttattttttccgttctccataaagaattaagattgctttggtgcttgaactttctgctgtcttaggtcaagtggtttactaaggaaacattcccacttct

SEQ ID NO: 3881 - DNA, 201 bp, Bos taurus
tggtgcttcgcaggcatcccgaagagcttcaggcggtcgaagaactgaaaagggagtcagcgctcatctttcggtggttgttctggggcttgttgggcccgctcacgtcgttatatcacaggctctgaaaggtagctaataccatgtctacctgacagaagtagaaactgagtctcaaagagaacaggtcatttggccaag

SEQ ID NO: 3882 - DNA, 201 bp, Bos taurus
aatttctatcctcctgttccggttattttcccctgctgatcgttacagctggttagctctcagggaacattgtcttggcccagatttgaaaactctttgcggctggtgttcctctacctcaggggtagaggctgctggtgtttctctacctcaggggtagagggtttgaagctggccgggaggaagcaccgccagaaggca

SEQ ID NO: 3883 - DNA, 201 bp, Bos taurus
gcctggggagaatcagggagggtcaacagttagagctggaagaacttaaaatagacctctatctacaggcaccttggtcctggcccattgctcccatcttgtttgtcttggagacaggaatgatgaaggtcttaagggtacacaggctttttgtcaaatgtcctgatccctcactactcaccagggctaggccaatgggcg

SEQ ID NO: 3884 - DNA, 201 bp, Bos taurus
ctatgatatcaacttccagaactctccattccagtttttgggaaaagtccatttcttagaactaacctcagctttgtgtgtaacacaccaattcgttatggcacttagtctgaaaagcattatctggtcagacctgttatagttatgtgataccaacccgaaaataagaaaagcttaggatacattctaccccaaggactc

SEQ ID NO: 3885 - DNA, 201 bp, Bos taurus
ccttagtatacctccatggtagtgattctttactggtgtgattgtgttgcccaggggaatctggcaatgtctggagataatttggttatcacaaagcggggggcaggggtagggggcgggtagaggccaggaacactgttgaacttactaaaatgcacaggacagacagtcctccacaacaaagaataatccagtccaaaa

SEQ ID NO: 3886 - DNA, 201 bp, Bos taurus
caattttaaaaggattctctgacagtgtatacccagagtttcagaaaaatgcagttcaatactgagcagctgctcagtattgaattgaacagctgctgctgcatactacattattgagcagctgctgctacataactgtgtgctggcctaataaaaaaggcattcagagcatacccaatagtttaactagtcagtgaggca

SEQ ID NO: 3887 - DNA, 201 bp, Bos taurus
ttagtggccctgacatataagcaggcaaggaggtttggaagctggcaaagcctcagagggctgagcagagaaagtgaagagccctatttaatgggtattaatttggccattctaattctaaagtctctggctgatgagtgattatttttgtctaaaaactcagtacttcttgacagcctggccacatttctccccactgtt

SEQ ID NO: 3888 - DNA, 201 bp, Bos taurus
gaggtgtcatttgacagaggccttaaataaagagttgagcagcttaaactcagtttaatgctgaatagatatctttgtgattttgagttgtgggaatgatcgaattaaattgttctggaaattatgagctcatgctcagaaaggggtgatgaaggagtggaggcatggagacctgtttgaagcattttctggtatgagaga

SEQ ID NO: 3889 - DNA, 201 bp, Bos taurus
tggacatgaatttgagcaaactctgaaagatggtgaaggacttggaagactggcgtgctacagtccattgggtcacagggtcagacacaattgatcgactgaacaacaaccttacaagaagtgctaaaggaggttctttgagtgaaagtaaaaggacactaattaacatcataaagacattaaaaggtagtgcaaaactca

SEQ ID NO: 3890 - DNA, 201 bp, Bos taurus
tgtgctgcagtctatggggccgcagagtcttagcgactgaacaatgagtgagtgtgttagtggaatctcactttttaaaaattaggtcttggctgcactgggtcttctttgctgcctatggccgtgctctggttgtggagaacagggctacgttttgttgtggtgcgcaggctctaggtgtgtggtcttcagtagttgtgg

SEQ ID NO: 3891 - DNA, 201 bp, Bos taurus
ttagttactgtaaggattagagaaaattcatgtaaaaagccaagggcaatggccaacatagaaaattttcagtcatcatgacttattttaatacaaagaggtaaatattataacagatctaaatcttgtaataaattataacaattaatattaataaggaaaacctagttatagttccacaaaacttattaagcactaact

SEQ ID NO: 3892 - DNA, 201 bp, Bos taurus
aagtttattttctatgtctgtgagtctatttctgttttgtaaataagtatatttgtatctgttttctttttttggccttctctgactaggagtctaatccatgccctttgtagtagaagcacagaatcctaatcactggactaccaggaaattccctgtattatttttttagattccaaatataaatgatatcatatgata

SEQ ID NO: 3893 - DNA, 201 bp, Bos taurus
tcttaaaataataatagcatttattttgctgtgagtctccaattagggcagtgcttgcctttgttgctttccccatcctcggtgtctcagaactggggccatagtcatctaaaggcttactcgtaagtcaggtggtggatgctggcagtcatctgggctctcagctggggccatgatcagaatagccgcacatggcttttc

SEQ ID NO: 3894 - DNA, 201 bp, Bos taurus
gaacagtacgagaccacagttgaccgtggcctcaactgggactggctccctgtgaatgggatgcagtctgcttacatgctggctgatctgaaacctgtgtgcatggaggccccagggttgttgggggccccaacctgaggatcctcttcatccatcactctccttgactctttccctcccccaggccttaactggaagcaa

SEQ ID NO: 3895 - DNA, 201 bp, Bos taurus
cctgggagatgtggcaggactgagaccgacgtcctctcactgtcttctcttaaatccccagcctgctctcacaggcctgaggctgagtaagggcttgagcgctggaagactgggtgttctgggaaaaggagacttattctgactgctgagccagcagcacccaccccgaccccctgacccaggaggaaattgggccctgcc

SEQ ID NO: 3896 - DNA, 201 bp, Bos taurus
tctaataagtgcggtggatgattcctgcaggagagtgagcctgcagagcagagtctggaccgagagcagctggagcctaagagggcaaaagccaccaggaaatcgggtttctgtcattgactcgtgggaaagctaacaggatagcactgggggcattttctaaggcagaagcactccaaggagttctttaagagcctcatg

SEQ ID NO: 3897 - DNA, 201 bp, Bos taurus
ctgtatgcagtcagctgcctcctgcagtcatgggagagaacaggtaaggacagttgccggcgcagtcgctgtgcttggtggccagagctggctttcacacttcatccatgaatccatgaaccacacattgagaactgaccagctaggaaatgtgtaactcagccttcacctttatttagtgaagctcaaggaaggaaagac

SEQ ID NO: 3898 - DNA, 201 bp, Bos taurus
gaaggacagggctcttacaccacatacaaaaaccaactcaaaatggattaaagacctaaacataagatctaaaactcctggaagaaaacacagaggaaaagcttcatgatactgacgttggcagtgatttcttgaatacgacaccaaaagcagccaaaaaaagcaaaaattgacaaactggaccatgtgaaaattaaaaac

SEQ ID NO: 3899 - DNA, 201 bp, Bos taurus
ggcttcagagactggagtgagcggataggggggctggcacaaagtgggcgctgggaggagaaggtcaggctggtggtcgctggagcccactgactggtgcggggccgtggacttgactctggatttctgagttccagggagcaggcttctgatacccctggatctaccctagtggagggctctgggagtcctatctgcccc

SEQ ID NO: 3900 - DNA, 201 bp, Bos taurus
tagaaccaagactacgcttccccttagcttgcctgttggcgggtgtttgcgttgaaactatactgaaagcctgaccttaaaggggaggaagcagaggggacccggggccctttaaaacgaggccagctggtgcctgcccctttaagggcggggcgctcagacgacagaatctgagccccagattactccgagtttccgtca

SEQ ID NO: 3901 - DNA, 201 bp, Bos taurus
acatctataaatggaatttggcctcttttaatcaggtcatcatcttttaaagttctgtctggagcaccctttgtatgagtccttggcatcctctctgttgttgttgtggtccaggccctcatctttctcctcctggatatcagcttccaaattgtgctgctgcctccagcctcagtctctcctggtacacccttctccaca

SEQ ID NO: 3902 - DNA, 201 bp, Bos taurus
agggccccatggccagcattagaacctgaacctaagtcttctcactccagaacatgcctggagcttgagttgctctggctctcatgtaagatgcatggaccgtgttgcatatcctgggccctgggttcatgtttctgtgtcacaaggctctctgatgcccctccagggtgggaaacctcctggcttgttgagggagactga

SEQ ID NO: 3903 - DNA, 201 bp, Bos taurus
ccatcgggacccaggcagtctgggctcttcaccactgagtgaggctacctctggaaaggaaggcagttgcaagagctaagaattgagcctgggcctcccatacgagagctgagaattctaccagtccacctcccaagacactgatacagcacttggagacttgctctgcaggaggtcctagggcagtgggaggaacacagg

SEQ ID NO: 3904 - DNA, 201 bp, Bos taurus
ttctgtggggttctcaagagttcatcctcacagtctatgcccttctccattaattagttcctctggcagtgacccattccctgctaaagaggataggctaccttgaatgggatggccccaagttaatggacaagtgcatgcttgtcccaggatatgtaaaaatgtaaaaaactggccatacctgcttacacgattggtgat

SEQ ID NO: 3905 - DNA, 201 bp, Bos taurus
ttctccattggccacagtgaaaagattctcgaggcctcagtaagtagaatttggtgagaggtcactctcagatggtctcaggcccagctccagggaatctcatttagtttcctctgtgattataaatattgttgacctacctaagaggcaagagagtgagtctcagctttaaactctcagaaaagcaggtacagctcaagc

SEQ ID NO: 3906 - DNA, 201 bp, Bos taurus
ctacttaaaagattggtcaccagaagaagctctgattagagattactctctccctccctctcagaggccactggggccattcccatcatgacctgactccctgtttgcgtcagttttcacaaaaagtctaagctcctccctccatgactccacatacaggaacttttagtcttttatggccagatacatgccatagcctag

SEQ ID NO: 3907 - DNA, 201 bp, Bos taurus
gttaatccaaagagaatagaagtgtcacttttttaaaaacaacaacaaaatgctgtgaattattagagaactttaggcaattcttggttgggaattgggaagttctttcagagagaaggacacctaagaagtggaactgagtcgttggaaagtcagaaaccatataggaaagatgagagtgggggtgggggtgagacagct

SEQ ID NO: 3908 - DNA, 201 bp, Bos taurus
gccgggaggtccgcgctgggggaggggcccctgcgaggggcacagacaaaggtcctctgcgatgggtccgatgggggtcccggaggagagggctgaaaccttggggctccatctcacagtccgggccaggggctccagttctacttccacaggggagagtcattcaaattcagctttaactcccatttgctaaatgcctcc

SEQ ID NO: 3909 - DNA, 201 bp, Bos taurus
ccaatgccaccagctttgaattagccttgagcatccacccagctggtctttccatggcaagccttagggatggagaagaaaaatgaatactctgtgctcacgaggccttcagacctgaaacggaacacaccaaacagatccagagagaaaactgaggctcagaccccgtgactggaagaggcctcagagacaagtggacgc

SEQ ID NO: 3910 - DNA, 201 bp, Bos taurus
tgcaacgtatcgattaaacccgggccccctgcattgggagtgtgcgtggagtcttagccgatggactaccagggaagtccctcatgttaaccttttaaatgaaacctacattaatccttcactcccaattctgaaatcaggatgaagtgatagagtggagaaagggctgagtttgtaaagtaatttagaaatcctagaggg

SEQ ID NO: 3911 - DNA, 201 bp, Bos taurus
atgtccaggcctctcactgggcttccctctacctcccccaggctcttcacatatgtcaatgagaagctcttctctaagccgacctactccgccttcctcaacctcctcaacaactaccagcgggccacgggccgcggggagcacttcacagcccaggagctggccgagcaggacaccttcctcagagagatcatgaagacg

SEQ ID NO: 3912 - DNA, 201 bp, Bos taurus
cagagcccaatccagagaggttgagactaagaagcactaggctgctttgcatgataaaataaaaggatgtcctcaccaggtagggaatggtatgaccttggatttcttaagaatctttggaaatagtgggagtcactaggattgggggtctactatcccaggggatgaaggcttggatctttctatttggatatcacagga

SEQ ID NO: 3913 - DNA, 201 bp, Bos taurus
ctgggacagtagaagtgatttcttccaaagctggagaagccacagctggagtctgtgcctcattcttcatggcagtggttatttagaacatctctgagctatggccaccattcctatagggaggaatcaatgtgtaaaggaaaatctccatttatgacatctgtgtattttcctgtggctgttacaacaaattacgacaaa

SEQ ID NO: 3914 - DNA, 201 bp, Bos taurus
gccaggcctccacctgtgcgctgtggaggctttggggaggttacttacctacttttagtatttgtccttcctacctggaaatgcctgtggctcaggattgctgtcaggcccaagaatggtttatgtcaggagttggcatgatgccccacacattgcttggtacaagttcatgcccttccttctctctgaatgcttcctgtc

SEQ ID NO: 3915 - DNA, 201 bp, Bos taurus
aaactccgatcaccagtaaaggccaggagattccatgtaactcaaggtgtctgcatcgtcaagcccatgttttggaccccagtaccatccagaacctccctgtgggctacttaccaggcagagggagcagctacatccttcttgtgctcagatgtccgtgtctaacttagatattagatttaatgaaattccagggcagaa

SEQ ID NO: 3916 - DNA, 201 bp, Bos taurus
ctgtagagatcaaatgacaagaagcaagtgagattttgaataaaacaaaactaatgttatttgaacagatacccatgccaaatgcttggcaagtgttacccgatttgtgagataagaaggatcttcatgtgatggaagtgaaagtcactctgtttagtcgctgagttgtgtccaactctttttgaccccctggactgtagc

SEQ ID NO: 3917 - DNA, 201 bp, Bos taurus
gatatgcaggaaggcctgtcctgggaaggccccatggggtccttacaatgtctttgcctttctgccacatgaccgcctacccctgccaagtgccactgtctgaggtgcgaatgtaagtgttcatgccaaaggtgtcatattcttggggtgtgggtgtggattttatgcagaggagaggagaaaggtactttctctacaaca

SEQ ID NO: 3918 - DNA, 201 bp, Bos taurus
cacattctttactgtctgagccaccagggaaactagagttgctgaaaaattaagtcagagtcacaaagaagaaatactgatgcacatgacttaatcgtaaataacttgaaacaatggtaagttctcactgtaatttttcttatcccaaaagcattgcagagaaatagaaaatgcagataagagatgaaaattttaaaacca

SEQ ID NO: 3919 - DNA, 201 bp, Bos taurus
aggaatgagacacagccagattcagacctacctgcctggaaatttggtatatttctattgcattagtctgctttattgttacctggcccacctcttggcctggagtatggatttccaagaagatttgaaagcattttcctccaggttgctaagtcagttgcctgtctccgtcacttgggcacgctggcattctcatccatg

SEQ ID NO: 3920 - DNA, 201 bp, Bos taurus
aagtaagtgtgtctatgaatggtggcaggggacaaggttgtctcatttagagacgtcaggtcagtgtgtggagcaggggcggaatacaggacctgacctgttgccacagactagccaccacttctctatgctcatcctgttatcacaataggaaaagttgtcacgtgacttagggattgcaggtccctaagaccttagaac

SEQ ID NO: 3921 - DNA, 201 bp, Bos taurus
tactgagaaacaggcctgcggttctgcggcagtgtctcccagacgagggaagtacaagagcggggataaggatgagggagcaaggccagaggattctgccatcagctgcgttggggggtggtggttgatgatattcactcatggctcctgagtcctgtagtccttctttgcgggcctgtttgaccttcctctggttggtaa

SEQ ID NO: 3922 - DNA, 201 bp, Bos taurus
tttaaaagatcaatatgactatttgtagaaaatggatgaggagagggagggtaggcaagaaaggatgaaggtatcaattatgattgttgcaattgacaaacggagaaggcaatggcaccccactccagtactcttgcctggaaaatcccgtggacggaggagcctggtaggctgcagtccatggggtcgctaagagtcaga

SEQ ID NO: 3923 - DNA, 201 bp, Bos taurus
agcacatcattcgcatgaaatagttcttgcatcacaagcgattttcttgtattctcatttggaatgagagacgaatagtcatgagtttaaatatagttgaattagaatgtcaagaccattgctaatagtatgttctaggcacactagatgttatagttggacaaaaggaacacttcagcaggaatgtgacaataactcagt

SEQ ID NO: 3924 - DNA, 201 bp, Bos taurus
atagaactttactttaatgagtctgaaacggaaaaaataacagccctacttaatcacagtttgccagttttccattcattctactctgcttagtataagtaacagctaatggccttaatggttcctctgtctgcaatgagatattcagaaagtgtgactggctgtccctgaacacacaaccccatctgcaaagggacaggg

SEQ ID NO: 3925 - DNA, 201 bp, Bos taurus
gactatgtggaatctcataaaagctctttatctttgatttaattcgatttagttttgttaaatttttgatttggcaagaaattagtaagtattttactgataggtggattatgttcatgagactgaatttgatctttggcaaatctctatgaatgggaaattgagatatgacttgtcaccccacaaccctcacaatgtact

SEQ ID NO: 3926 - DNA, 201 bp, Bos taurus
gatcgctggatcctgtgtgagcccaagtcttttaaactgcaaaatggacaaaagggtagtatttgcttaaacaaattgctgagaatgagcccaggccagggaacagctcctggactcgtgtacctatgagaggaggggcagagaggtggaccttcacagacagcacatgtgcgcatgggacagaggccagcaagtggcacc

SEQ ID NO: 3927 - DNA, 201 bp, Bos taurus
tgtaggataaggtggagcagactaggggtgtgatgggacagcctaggttcatggagcatatgatggtgatctccagtggccttggcctgcaatgtcttgaagtgggtcttgggttccccaccagaaattgggctgggttgtggcaatgaaaacaccagatcctcgcaactagaccagtggtcagtgacataggccctgatc

SEQ ID NO: 3928 - DNA, 201 bp, Bos taurus
ctatgtctccttcctctttttaatgtgcccccgtctcccttctttttcccagctaagaatgtgaaagtgtctcaggggggaatagtcaaagaacctgactaggtaactggtagtaaccttttctaaaccaaaactaggacccttgctttgccccctcatctgggaagggagtaatagagctgatgttggttgtgtcctggc

SEQ ID NO: 3929 - DNA, 201 bp, Bos taurus
gcttttcctttttctctagtctatatgttccaagggttacccacccaccagtgggttggcagcagtcccaggacttctcaggccaaacagccacccatgtgggggatcaggctcatctataaggaagataaagcagtcgaccctaccacaacagaagggcccaagcagcccacataaggaataagggacacccctagagca

SEQ ID NO: 3930 - DNA, 201 bp, Bos taurus
tgtgattataataacaaaagtggccaaaggcatagacctagcttgcaagagtcaaaattgactcttggctgttacagttcctgagacactaatgatattttcccccatatttttctgttgttcagattgggtaggttctactgctcttgtctttaagtccactgactgtcgttctgctctttagtctgtccagtgtgtttt

SEQ ID NO: 3931 - DNA, 201 bp, Bos taurus
aaattttatgtacagtttcttttaattaatttgggtcagctttgactcttccatttatgtttgcttagtaaataacacatccccaggcataatgaagaaagaccttttgctaggtattcttttattattcatttattcttcattcatctcctattcttgactatggcaatgttatagataggcattttttcagaattaccc

SEQ ID NO: 3932 - DNA, 201 bp, Bos taurus
tgaaactattagcacattgctagctaggtacatgctatgtacttaaatcaagctcctctgtaaagattaagttccttgccagagttttgtattcattcctataacttttatatatcactgtaatggagttctgtatagagccttcatactctaggagtaacagtggaatataaatatgtaaaatcagactaagtccagata

SEQ ID NO: 3933 - DNA, 201 bp, Bos taurus
ttggagacgatagcggcttcccagtgcatcagttctgctaaatggaaactgcttttcctggaattcccatccacgtctgcttctggattagggttggccactgtgattgccttgcatgtgatttgaaaggcagatgagagatggcagccatgatgcttgtgagggtgagttgaggccctggttgccatagcagattatgct

SEQ ID NO: 3934 - DNA, 201 bp, Bos taurus
tgagggtgcaagacccagatatatcatgctttaggccagaatcctttgtatcagactgagggaagctggagctggccattttctcttcctgataaaggacatctagatatgaattagggaaccatggtaccaatatctaatgatcaatccatcaatacttgccaaacaactctacctggtgtatggccacatgggttgtac

SEQ ID NO: 3935 - DNA, 201 bp, Bos taurus
ttctaagttgtactttcctctagagtcaacagttcctctcatgtggatccttcctatcaccattaaaacctgctcaagtttctctatttgacagaaaaaacccatccctggccttcatattctcctctagttctctgagcccttcagagtcaaaccccttccttgaaagagagctcagtattttctacctccttttctcct

SEQ ID NO: 3936 - DNA, 201 bp, Bos taurus
atctttttccatcccccaactttcaatctatgcgtgtctttcagcctaaaatgagtccttcataggtagtatattgtaggttcttgtttttttttttttttaatccaatatgtaactctatgtcttttgttcagagcatttcatccaaagacatttgaagtaattcttgataaatatataattgccattttaaaccttatt

SEQ ID NO: 3937 - DNA, 201 bp, Bos taurus
tggtccccatagaaccccgaaactcatcaaatcttgttttcaagatcttttatagagcttaatctgtagcactttccttcacctcctcagaggttggttgttggggctggaagttctaactctaatcacgtgggtgactagccccatcctaaggctacccaggagtatcaccctaagtcacctcattagcataagctcaaa

SEQ ID NO: 3938 - DNA, 201 bp, Bos taurus
gaggccgacccctccctccgggccccgtcccaacccgcgcccgccgcctgggctctgcgtgtgggaatgatgtgcgcattggagggtctaagttcttcacatgcttggggggtcctcccttttttttcttagcaaccaaatcgtactaatcttactaatcagtaaatccaagtcagcggcaggaaagacaagcgatatttt

SEQ ID NO: 3939 - DNA, 201 bp, Bos taurus
catgtaaaacaaattcaagcagcatagtccctctttccaggtgatccctgccactcccctctgccacctccacttttgaggaaactgtgatctccataactattgctcagtttttttgttctcttttctgtgtctagattctttttttcggcataatgtttaagagattcattcatgtagtacatctgaaatttgtctttt

SEQ ID NO: 3940 - DNA, 201 bp, Bos taurus
ttgttgaaactatgtcgatggtgtatgtgactgaatcccatcaaggcctctagataaacctttaaaattctggcagttacctgggtggaaatctattcatttcttggctgcccagggccagtctcatatgtaagctaccttgcttatcaaacctgccaactcccaatctggaatggtctgtctctttcttgggactctctt

SEQ ID NO: 3941 - DNA, 201 bp, Bos taurus
ctgccctccatcctgttcttatccagaaacagagcccatatcttagcccaatgcccactgacatggaggagatggccatggtatcttaacaaactacagtaagtgtataagggcaagtcattccacatgactctgggaaaatgtggaggcccctccaaaggacaaaaggatttcttgaagagggctacatgatattcttct

SEQ ID NO: 3942 - DNA, 201 bp, Bos taurus
gcccatgggtaggacagaatcccaaggcctccccaaaccaaacctgccagcaaagtgtgactgatgggagctcttctaaacttctaaacattctgaagggagatatgctcatggcccaggtcgtgtctgggccagggagggctctaaggcatagtggacaggagtgtgtgtaatgatgtgggtgcaagcttcaaatgacat

SEQ ID NO: 3943 - DNA, 201 bp, Bos taurus
ttcttagaaggtaatcttcgttttaaaaaaatgtttatagcagagtttggcaatttagcagatgatatttcaaaatgagaacaaaatcttccaggggtcactctcttcaaatcaacataaagacgcagtgaattaacaaagctcaggactaaagcatgacacttatctggtcactttgggggctagaaagtgtatagttca

SEQ ID NO: 3944 - DNA, 201 bp, Bos taurus
aagaatccctattgcttcttttcttcatcattaggttactgttatcctttttctctagtctctttccatcccagttgctacctaccacacagacctactgggagttttaaatgccttaatatgtataagacacctatacaataccagttacataatgggtgctcaataaaggccattcttccttcccatcaaactttattg

SEQ ID NO: 3945 - DNA, 201 bp, Bos taurus
ggaaagttcacacagaccaaattggattggctttgctgaagagtgaaacggtatggattctgaaaagatatgaacttacctgttttgtcagatgtacttattacatgagccatctcattgctttcttaacccagcatataaatggatgtatacccccatatatatgtactgtacatcatgtttattgaacagccactatgt

SEQ ID NO: 3946 - DNA, 201 bp, Bos taurus
gaggctttcatatttttgtatatcttgtgagcagagacactgattggcctttgtttaatacgattggcctttgtttaattttgaaggatgcttttacaccagaggtggcccatggatcaatttggctcgccatctgttgttgtaaataaagttttattataactcagcacatcaatttacttacatattgtctatttctgc

SEQ ID NO: 3947 - DNA, 201 bp, Bos taurus
gggagagactccccttttggccagcagtagccctggtgatccccaggactctttcgctgccttgtagctgctgtggttgctattcgtgagggactcttcctgacccttggcctctagtcccacaagagctaatcaatcactgttgctaacaactcagccttggcttgccaccaagtctgaaattatataagattcactaaa

SEQ ID NO: 3948 - DNA, 201 bp, Bos taurus
catttctaatctcacagaaagtaaatttagttaaacactagaagtgaaagccagatttctgaatgtacagttaaaaaccacagaagtggctagtatgaacttagctcttgctaagctcaacttagctctctgactacatgactacatgtccaaagcagctctcttgcccaggaagacacaagtctgcatgtggccctctgc

SEQ ID NO: 3949 - DNA, 201 bp, Bos taurus
gaagaacttttcagacaatgctacaagactgatgcggtacaacactaatgacatatgccaactacaaacatacgatagtaatttcaacagtactcttaccctgcctttgctccaacagaaaatcacctctgacctatggctccacacacagattttaggattcctgacttctcattaattcaaaagtctagcaaattctgg

SEQ ID NO: 3950 - DNA, 201 bp, Bos taurus
aaaatctggatttctgagttctttcaaggtcagaagtaaatagattgctaaacagcacggatcagctgctaccaggtagcagctgctccaatctgaccctcagcatttgtttatattccctcacatggtcactgtaagcacatgagttactgccattaatagacatgggccttattactacagataaatatgttaactact

SEQ ID NO: 3951 - DNA, 201 bp, Bos taurus
ggaggaggctcagaggcttgtgtaagcttcctgatgggaggaactggtggtgggaaaaactgggtcttgccctggtgggcaggcccttgctcagtaaagctttagtgcagttatctgctgattgatgggtttgtgctccctctctggtagtttttggcctgaggtgacccagccttcaagtctatggtagaattaatgaca

SEQ ID NO: 3952 - DNA, 201 bp, Bos taurus
tgaatttgagccaacactgggagatagtggaggatagaggagcctggcgtgctgcagtccatggagtcacaaagagtcagacaagacttagcaactgaacgtcaacaatcagagaagactggaaagggaaaagattaatgctaataatatgatctgagaggtgtgaatagtcgtccaagggagagaaaaacaaaaaacagt

SEQ ID NO: 3953 - DNA, 201 bp, Bos taurus
aaaggtggcctagctgaaaaggatgtaagctgatctctaaaacctaccccagacacgcccagaagagctcacagatatgctacaaaaatagccacagagacttttccaactcctgtggcctaggcacatcgtgaatgcaaaccaactacaggtgcttctccaattcaggaacctgagctcttgatgcacagctgtgtcctc

SEQ ID NO: 3954 - DNA, 201 bp, Bos taurus
gctcccagaatctgccttatgtctggccaggttggagctttgcaaatggctaacatgtatcttactgacacagatctttaagtactggaggaaaagtatatggccctccaccttatcagagatgtgtctaagttcaggagctttctgatgatcaattccatagaaataggaaacaaaaatttactttaatgtcgaatgggt

SEQ ID NO: 3955 - DNA, 201 bp, Bos taurus
ggaagcatggttgaaatctctctgatagggaggcactcactgttcctgttcatgtgtttgactctctcagtgtgtaggcctggagaacagcggagaagcactagcccttttgtgcagagctgtccaaaagtgtcacactgaaaacatgagagagacaaattattggccaactttttgttctgttttgctttgctttcactt

SEQ ID NO: 3956 - DNA, 201 bp, Bos taurus
gctaccatcttcccaaatgagtattctatgaaatgaaaaaaatacatacttcacaaaattaatttaatgaaatatgccattattctatgtactagattaacaacactaacatctttgtatcattaacattttatataaattgcttgacagagacttttaaaagatgaaacattctgcctttgtatagaacattcttccaac

SEQ ID NO: 3957 - DNA, 201 bp, Bos taurus
tgtctactggcataaaatgttcagtgtttcctgaactaaaattaagataagattcaaaatcttcaagacagcatataatgtcctgttggcctctagctaaccctacagcttcattgtgttctcttttcccccttcttcactatattctagttactttggccatctccctgtttttcctaaccttaagactttatttttcct

SEQ ID NO: 3958 - DNA, 201 bp, Bos taurus
agatttactaccaattcactttgaaccaattagacatgacccaatttcctcaagccagatggcaaaagcacttccggtgaggcagatgggcctattgactctcagtcccatgaaaacatcaggcttggaagacaccctgggattcagataatgcaccaagaagacagaggaatgcctttgatattggcctgggtatcatgg

SEQ ID NO: 3959 - DNA, 201 bp, Bos taurus
ttaacaaatagtctgtacttactataagaagctagatttttatgcagtggtggacaatttgaaaaaaagttcaaagttatttggactctaacataaaaacgtcagatatgaaaggtagacataagagagtagcaagaataacagtggaaaattcagcattatgatggtaaagaacatgtagttttatcaaaagtcctctaa

SEQ ID NO: 3960 - DNA, 201 bp, Bos taurus
gattaaaccaagctcaacaaatgtcctgaaataagattgtaacaagggagatcaatataatatactagtcacaatgtgtctctaccacagctgtctaaaatatatacattattttagactgaatacatcatagcaaagtatacttgtgtgaataagcacctagtagctttctttttattggcataaattcctactgtaaag

SEQ ID NO: 3961 - DNA, 201 bp, Bos taurus
ctgcctaattgctgtgactagaaatcccaataatattttgaatgaaattggagagaggaatcatgcttgtgttatttgtgatcttagactcctttacgttcaacaagttgtctttctcttgctgcttctaagattttctctgtctttaactttcaacatttaagttatattagtaatatgcactgttttgtgcttgtttgg

SEQ ID NO: 3962 - DNA, 201 bp, Bos taurus
atgtacaatatatatacttggcaaagtcttagtatttagagttgtgctacctaatagggtagccacaagccattgtggctttggcacttgaaatgtgtcttgtcttaactgagatgtgctataaatgtaaaatgcaaaccaaatttcaaagacttagtcaaaaaaaaagaagtataatatcttcttaaaaattttatattg

SEQ ID NO: 3963 - DNA, 201 bp, Bos taurus
gttgttgctttgtaaatgaaaaaatacctactggatgaccaggtgacagttctttttggaattatgtatggcattctccattaccattctccccctctgtcgcttttattggtaagcattatattattgtttgatctgtgtagccattagacttacctctccgtagttagggtgtgccatcttgagtccaactgtagaaca

SEQ ID NO: 3964 - DNA, 201 bp, Bos taurus
catgtattgtggacagagagataaaatatttcagtattaaggtactaaggagagagagatgttttgtccatgaatgctcacaggtcatgatcctgcattatttctcaatatgggtcttactggtatttggggtagaataatgaaatcactgcagccatgaaattaaaagacgcttactccttggaaggaaagttatgacca

SEQ ID NO: 3965 - DNA, 201 bp, Bos taurus
ttcctctaatacttccttgaaacccagaccatatcagatattgtcttacacattctcatagcactatataggttctcggttataacacttaccatccttttttgttcgtgattaactctatttccctcactatattttttaaatttatagaagcagaatctttgtgtttctttatagaaaaagtctctgtttcgtctgttc

SEQ ID NO: 3966 - DNA, 201 bp, Bos taurus
cagaggagcctggccggctgcagtccatagggtcacacagagttggacacaactgaagctactaagcattcattcttagctcataggctacataaaaattggtgggacaaatgtggcccagtggttggtttgtaatttgccaacttctgttctcattcaatggacatcttcccaggattccagttgactagaaatgtgtgt

SEQ ID NO: 3967 - DNA, 201 bp, Bos taurus
taccctcagtttagcccattgcctgctgtgcttaatgtcttcttcaaaccaagtgacactgaaatccaggagaactgctgcagtgggccaagtgtaagtattgccttgactgctgccattgtgaaacaggtctcaggatggagggagttgtaattctccttttgacttggctgagaaggggagagatgggtggtgtctgag

SEQ ID NO: 3968 - DNA, 201 bp, Bos taurus
attagagttttgttttccaaatagtatctcatttatattataagttattaaaaatattcccttgttttcttctctataaatggcctagtttaaattatttgtggctaaggtattgagaagaatgtctgtcgcttcttagttgcagttgtgtgataatataccctcagagatggcctttttaaaaatgatgttaaatgtgaa

SEQ ID NO: 3969 - DNA, 201 bp, Bos taurus
aggatcataggcaaagggaagtcaggcagaggaagactatggtatagggtgtaccttcccagcagaataaaattagacatacaaggccaaaattttacaacccaaaaagagactcagagaattcaaagataaacaaaggattccaggggaataaaatatgtgaatggccttgaatgaattaggaagtccttaccctcatag

SEQ ID NO: 3970 - DNA, 201 bp, Bos taurus
ctgagccaccagggaagatatgtggtgaaggatattcaaatgcagacacaaggacaatgcctgcctcccccacaaggcctcaaacattcttaaggggggaggaatttgcagtgggttctccccacagttttcgacgatgacccatgtttcactgtcctgtgtgctgtcacaccaattgttcagaatcatgtaaatctctat

SEQ ID NO: 3971 - DNA, 201 bp, Bos taurus
gctcccttcagggctggcaggtagattcatcaattcatttaatccagaaattcctgcagtgggttcactgtgagcctgttggacctttgggcaaaggaagaaacaaaacagataaggtccctgtgctcatggtgcctattctccagaagaagacagagacaataatttactgttttaaaaaattaaatagtgttcatattc

SEQ ID NO: 3972 - DNA, 201 bp, Bos taurus
gcagccagagtcagcacctcagtctatggatggctggaatgacatcttgggttccctggactactccacccttctccagcaccacggaagaggtaagtgaggagaaaggagtgcatggagtgtgtcttgggaaggcctcagaaagcccattgcttgaaaagactggaaataatttgctggaaataatgctacttaagtggg

SEQ ID NO: 3973 - DNA, 201 bp, Bos taurus
gctagagagagttcacacatggaccagggccccagttacccagcacactctttcctgtccatcacagcagccaaggtcctaggaagagcccctgcactcaggttccagtgtggccactgcttagctgtgtcaccttgtaaacagcatttcagttctctggtcctcacttttctcatctgcaaaacatcacaggactatcct

SEQ ID NO: 3974 - DNA, 201 bp, Bos taurus
caaagttgccaatggaattaagctgttaatcagctaaccttgagatggagagactgtcttggattctttgggttggcccaactacaagagttcttataaattgaagacggaggcaagagaaagagaaccagagacagcagtgtgagaagttggcctaatatttctgattttgaagatgaaagaaaagggccatgagccaag

SEQ ID NO: 3975 - DNA, 201 bp, Bos taurus
ttgaaatactaacatcaaagatcactgatcacagatcaccaaaacaaataaaaccatgacaaagtctgaaataatctgagaattccaaaatgggataaagatataaagtgagcaactattggaaaaccaccaccaacacttgtttgatgcaggattaccacaaaccttcaatttgtaaaaacatcacagaattaagcacaa

SEQ ID NO: 3976 - DNA, 201 bp, Bos taurus
caaggttttctgcagaagtgacttgtgaaaagtcttgaagaagactagaaagaagaagcagcttgaactagggccaagggctgagaaccagtgcttgaggggtactagagaatagagtaggatgtgaggaattgagggccaaatgatggccaaaaagtcaggcagagtccagatcattcagggcctcatgtgatatgttaa

SEQ ID NO: 3977 - DNA, 201 bp, Bos taurus
accacaaggaaagtcccatatttccacatatctctgagtagggaatcaatgaatccatcaaaatcctcacaacaaaattaacgtttttaaaattatgacctatccttctctacctactctcttggtgttatttgaatgtttttaccatagtcgtgtgttactagtttacaaataataatgaaaagaaatctcaaagtttat

SEQ ID NO: 3978 - DNA, 201 bp, Bos taurus
agctagaggggttcatcaactccaagccatgtactgtcaaccccaagaagtgacctgcagggcactgccccaggaaaacctccacctaatgacctagaatactgggagtctccccagtcttccttgtacaaatagtcctgcattgatccaggaagaaagaagctaaccagttctttcaggcggaggtaacatggcccagtt

SEQ ID NO: 3979 - DNA, 201 bp, Bos taurus
aatccctagtctgaacactcacttccatttctactgctagaacagtttcaactcattttaacatccttttcgctaaccatccatcaccaaacagcacagtgcctactaggttccaggcccaatactaaagctatatgttggggtaagatgcattaaaggcctgccctcaaagcatgtgttcactagaagagaccttactgt

SEQ ID NO: 3980 - DNA, 201 bp, Bos taurus
gatggctgcaaatatggagaccttgaaggatttgccagtgagcggcaatccacatgtgagacgcctagagaaagaggagatggtagtcagcgaggaaaaaaggaaaatacagacatgggggaaaacaaggggaatggacacagatagagaactaaaatggtatgaaagccagcagacaggtaaacttcacctatctcaaaa

SEQ ID NO: 3981 - DNA, 201 bp, Bos taurus
tgatccgtattcctgaataaaaaataaccagaggtcaaatgacagagatttcagccaagtatacacatgcggtcatttttgaaaactgcagtataaatcctaagactgtaactgttagacaattgatatgaaatgtctgagaataggcttccagggaaagggtgaaaggttgcggtaggtctttaagcacagagccaagac

SEQ ID NO: 3982 - DNA, 201 bp, Bos taurus
acatacgtcatttaaatcaaccttccccaggtactatcacctgttatgttgggagaagtagaaaagttaaataacttgtcagggggttcacaacagttaaaatttcaatctagggtttcaacccaggtctcttaggctcgttgctgattctgctactctatgtacgtgctgtatgtgcttagttgctcagtagtgtcccac

SEQ ID NO: 3983 - DNA, 201 bp, Bos taurus
gtgactcatttttcccaaggacccaggggtagaagaagtttcacagaataggtaaagtgtgagctagacctttagaggagtagacactgttaaagggaatgagggaactctaagcagatcaatttataaataaatctctctgagacccctttccttgtaccaaaaacttatgctctcacagcaatagacttctggtctttg

SEQ ID NO: 3984 - DNA, 201 bp, Bos taurus
accagagggacaagacccagctccacccaccagtgggcaggcatcagcctccctgaccaggaagcttgcacaagcctcttagacctcatccaccagagggcaggcagcagaagcaagaaaaactgcaaccctttggaacagaaaccacaatcacagaaagttagacaaaatgagacagcagaagaatatgtcctatatgag

SEQ ID NO: 3985 - DNA, 201 bp, Bos taurus
atctcccaccaagtgacaccttaaatcactggcctcctaacctgtgttaccagaagatgatactactaggagagttttcccctcaaaaccaggcaacaaaggtagaggccattatggcctcttatggacttggatactttattcaaactcccctaaaggctggcatgattggacaaagagagtgttgcctgtcacttcatg

SEQ ID NO: 3986 - DNA, 201 bp, Bos taurus
cattcatttacattaagttgttttatgtgacttcagtatgttgtcttcatttttttcacttattttatatacaccttccacaaagaacatgacacactacctgttgttttgactggtggatagcacagcaccatgttgctcagccagattcctatacttactcttttggtgtctattataaattcttaatttataagtcaa

SEQ ID NO: 3987 - DNA, 201 bp, Bos taurus
caccatacccagcacaacacccacacaatactcacagatgagctcgagaacagtttattagtcatatacagtcacagtctgggttaaaggacaccactaaccaggcagggccatgcagacgtttcgctcagcaacagagagaacaaccaggtgctgtgaaggcaggttttgtagtctcaagaggttgagatgcctttggct

SEQ ID NO: 3988 - DNA, 201 bp, Bos taurus
caagataattatacagtctgaagcagaaaagttggctctgggagattttctgaccttgaagtgttcagtggcagcgatccatgtaatcttggatctgctctggcagacagctcagggcttgaacatacggtgttgtttccttggacatattgagccaaagctgcagctataggtacaaggtggcattgttaaagctatgat

SEQ ID NO: 3989 - DNA, 201 bp, Bos taurus
cttattgatttcaaagtgcttttgaaacatagaagaagaatttgcctcttccaggaattggaaaactaatagccctaaccctcgttccttgattgatgcaacctcttaacgttgaatttctagtcacagggcagagaagttggacgtaagtgtcgatatgccccctgaaacatgctaaacaaataatagtttaaatgagac

SEQ ID NO: 3990 - DNA, 201 bp, Bos taurus
acctttcttaagacagcccttggcctgtagcctgggctctttgacccttgtatgtcttccatctcttccattcctagggaccttccatgagagtccacaaagtttcacctagggccttaagttttttttaataaatgagtttgaaggaggcattcattcatttgttgattgattgacttattcatttaacagacattcact

SEQ ID NO: 3991 - DNA, 201 bp, Bos taurus
ccttgttgggtttttggggccatgttttatcatggtcctccccttgcttttctcttttatactttattagtgtttttaaaaattataaaaataggggctgaaagaaattgctgctgcaggagacctggatttagaaacaccagctttaagtacatattggatattttatcccataaaacaaaaaccttggtctgagttcat

SEQ ID NO: 3992 - DNA, 201 bp, Bos taurus
acagtgttgtatgaactaatgaataaaattatagtgtgaaatgaagttccaaggatgaataatatggacaagtatataaataaatgtcttacttgataaatgctatagtaaagtatatttacctccaggagagattttcacgctttgatttttggcatgctacttcttgataattaatgaaaagaatctaattttaaatat

SEQ ID NO: 3993 - DNA, 201 bp, Bos taurus
cttctcaataggtcccccccgagtgctctggccttaagttgcaagagaaaagaattacaaccactgcccccgcaagtcgcccctgagttactatcatagaaacagtctatgagggccaggtaaaatgtgaaggaaacaaaagtcctggtgggatttttaaaaaatccattatatataaatatatatatatataattttttt

SEQ ID NO: 3994 - DNA, 201 bp, Bos taurus
gcaagaaacagttgccagtgacatccgacgccaagtccataaaggtgtgatggcagtgtcactttatggagatacattttttaaattcaaatatgccaagcttttatttacttttaggtaatttgctataactatagggtgagttgcccaccagctgaggttagcaccatatgtatataaaacctgtcttcttaaattcag

SEQ ID NO: 3995 - DNA, 201 bp, Bos taurus
ctttctctggttgcagggagtaggggctgctctctagccgtggtgcgcgggcttctcattgtgggggcttctgttgttgcagagcataggctccagggcacgcggcctgcagtagtttggcgcctgggctctagggcacaaacacaatagttgtagtgcctgggcctcgttgctctgaggatgtaggatcttctcagacca

SEQ ID NO: 3996 - DNA, 201 bp, Bos taurus
tacctgcgtgctgcccaagctgccaaaacttgaaatttacaacccccttgactttgtgtttcaggaaatttgattttgcgatttaattttagaataacaactagtcctccacagagagtctcaaatgttcctgtttctcaaggaattacaatttctgagtttctctatgaaaatctaaatatataatcttctatttctgtt

SEQ ID NO: 3997 - DNA, 201 bp, Bos taurus
actacaattcagtaataaaaagacaacctcaattttaaaaactggggaaagtccacaaaaaagtaaatggcaataaacaaacaaaacagcattaaacatcggtagtcattcagagaaatggaaattaaaactacacctatacaccaattaaaagagataaattaaaaagcaacataaccaggacttcctggcaatccatca

SEQ ID NO: 3998 - DNA, 201 bp, Bos taurus
tggccagtgggcacccattcaagttcatctgtgtgaatcttgacacgtcctcagaatctcttgttttctaaaataacaatattttagatttccaatcttagaatggccctgctccaaacctgcaagggtattgacaaaccaagatctgcacactgggggtgctcattcctttgggaatgttgctattcccaggccttctca

SEQ ID NO: 3999 - DNA, 201 bp, Bos taurus
atttgggaggacaaactgcagttccttcagaggccaaaataaactgctcggcagaaagagtcctagtagtgcagtggttggtctctgacaactacaaaccggtagttattgcctcaggggccccgaattcttcagtccccatcagacactcaggaggtgaagacttaggtgttatctagccagaaccccagcctcggggca

SEQ ID NO: 4000 - DNA, 201 bp, Bos taurus
taccccatggactgcggcatgctagagatagagagctgaagcagtgccaagagttttgggtagaccagaacccctgagacttggatatttgctctttcacatgagattccatcatggaggggagcgccaaggatggaggtcctctgtctatatagccactgctctcagcaccatcctgcacatgttcctgccccttccagc

SEQ ID NO: 4001 - DNA, 201 bp, Bos taurus
caataatctggcctagttctagaaacataaaggaggacagtatggctggaacagagtaagcatgaagagaagtgggggaggtggtaagaagtgtaaaggatagcgcatccatgtaggccaacggagggaccttaagtgttgctctgaatgatgaaggaaagcattgtatggtttgggcagaggagtgtcatgatctgatta

SEQ ID NO: 4002 - DNA, 201 bp, Bos taurus
gcagttttacgattattataaagacggtcataggtggtttttgctttcccagcctgtttggaatctgtgtttggcgaatccagatctgagttcatttcatcgtggatcgaagggtgtaagctgttcctgacggccaattaatgagtatgccgcgctgcctaaaaaccagctgcaactcattggtcatgtccaaaagggatt

SEQ ID NO: 4003 - DNA, 201 bp, Bos taurus
attgtcgtgattattattatttgaagcaagaaatatagagaggcggtggccttgacattactttttaacaaggaaattgggttatttaaagtgtactgtgtgtgtgtgtgtgtgtgtgtgcgctcgcgtgcgcacctgtgtacgtgcatgctcagtcgtgtctgactctttgtgactccatggactgtagcccatcaggct

SEQ ID NO: 4004 - DNA, 201 bp, Bos taurus
tccactgcttctggggacagtccttgggaagtgggctagacaggaagcagagctacccctcactttcacaagttgtaatagccttgcagatcgtgtctgtggtcaatgactggccagaactggccagcctccagccggcttgtttagactacttgatgagttgacacaagcaacgactctttccagtgctattagtgtctg

SEQ ID NO: 4005 - DNA, 201 bp, Bos taurus
gactaataggtccagctttgttgacaaaccgttagaactattaccaggtgtttagtgctgtctttgagttgagcagctctaaccctagcagactcaggaaagtgttaatagctcccttcccacgcttggttggcacgccagattgggaggtgaaagattctgagcttttccattcatattaattcaattcagtaatgttca

SEQ ID NO: 4006 - DNA, 201 bp, Bos taurus
tgcttgcaggtgctaaacaagccgaggatagacccaagacctgacccagcccgaggctcttctcaccacggactcagcagcagggtcgccaaaggccaaatccaattcagtaaacacagacttctgggaagcaagtgcgcttgctttccttcggtgtcagctggaggttgcatttgccttgagcactaaaacattctgcag

SEQ ID NO: 4007 - DNA, 201 bp, Bos taurus
ctataaacaattgaggccaaattttcaggcatcagcagctaagatgcaccagtgaaaatacatatgcttacccaatggacacaggaaagcacctatttctgcctgccagaacagtcagtgtgcaggccaacaggaaccggtgctctcggcgaccagtatgtgtgcacaattactgatctcacgtgcagctccagcactttg

SEQ ID NO: 4008 - DNA, 201 bp, Bos taurus
gcttcctggtctctagtctgtaaaaggtaaatgaagggctatgtcccctctaagtgattccacacaatcccatgagattgttacagaggaggttgcctgattttccaggccaaccttgaatatgatccagtaaaagaacgaattaaaaaataaataaaagtgaagagaatggtattcacaaacatttgtcattgttctctt

SEQ ID NO: 4009 - DNA, 201 bp, Bos taurus
aaattctagaatgcttcattctcactgaaataaattataagcataggaaaatacatacaaagctcttttaaaaggtgcaaatgagagaacaaatgtattatacttaaaagatttttacatcttgaaaatgaacaatggaaaacttaagttttaaagtggtaatacaaatcagaggaccactttccccaccacttttgaaac

SEQ ID NO: 4010 - DNA, 201 bp, Bos taurus
gcaacttagcgcacacacacacacgagtcagtgtaagtgaaaacactggaatacaggcatggctctggtatgttcaaagtaggccagttgagctccagcagcatgtccctgttgaggaatattaaaaaataagagaaacatggagccaaattttggagagcattcaaacaggccaaaggccttatcctggagataaggaga

SEQ ID NO: 4011 - DNA, 201 bp, Bos taurus
gatgtagaatatcttttttggtacgttccagtcttttttttaatcaatgattgtttagcagttgtgattttggtcttctcatgagaggaagtgatctcaaagtccttctattccaccatcttgtcctgagctccatctggactgattttgaaattgaaaggttgaggaaatacagcagaaaatgatatttgcagaagatag

SEQ ID NO: 4012 - DNA, 201 bp, Bos taurus
aaatctttgcacatggccaaaggggaattccagaagtgtgacagcttcttctcagttctttccagctgggtcagaagctgctgtgatgactcaagctacgtgagggccatggaatggacacacaggcgcacttctgaattccacacaagcatcagactgtacagggtgggggtggaggtaattatgattggggaattccta

SEQ ID NO: 4013 - DNA, 201 bp, Bos taurus
ggttggccccacactgactttaaaggatatgtaacatatggaaggctctggaaatctggcagaatgaaaagtagttccttaaataaataaactaaaaatagtaattcttgataccctggcccagaagagtaacattctgaagaaggaagcttagggtggttggatcaaatagactctttcaggttactgcttcacgaaata

SEQ ID NO: 4014 - DNA, 201 bp, Bos taurus
ccatctgtcatattcatgaatatcttcagatgtcaatataaaaacttgaacaaacaaatgcctggttaacactggggtcagactgattacaaggtactgcaattaaaaaaaaaaatccacttaacctattttacaaggacacttcactgaaacaatttactgttaccactataactgtatttactaaagtaggaaagggtc

SEQ ID NO: 4015 - DNA, 201 bp, Bos taurus
ttgggtcacgggggcgaggaagttataagatggatgttgttcccatgcacacagggaggtgaagggctttcaaggcagagagaacatcaaatgtagaggacggggagaggcctgtgtggccacaggaagcaaagtttaaggaaagaaaaaaaggtgcagtgggggtgtgtggttttttttggaccagtcctgtacctcact

SEQ ID NO: 4016 - DNA, 201 bp, Bos taurus
aatcctccctgccgtggagcctggaattgggctctggaagatctcaccttctctcgtgctgctccctgacctctgcagggtatccaaggcccttttcaatcctgcttaccttccggtgtacagaaagactttataccttatttgactgcaaagaaaaaaaaccaaaacagcaccttggttcctgaaggccagatgaaagta

SEQ ID NO: 4017 - DNA, 201 bp, Bos taurus
aaagaactgggagttagatgtaggtcaaattcatgatatgtcaattaccagttttacgacctctggcaaattaccagatgtcaataggtctaagttttctcatttacaaaagagtaataattatacatacatcataggattggcatcagactcaaattttttatctactacagtgcttaatgtgtattaggcatgcaatga

SEQ ID NO: 4018 - DNA, 201 bp, Bos taurus
aatgttatgaaatttaatttaaagcctccatatgctctgcaattattagcaaattctcttgtcagttagtgtggcatttttgtttttacactggcaaacttaatttaagaacataaattttcttcaggcttatccagtcaatagaaaaactgaaaagaaatctctgttttttttttttggtttctcattttgtttcaaatt

SEQ ID NO: 4019 - DNA, 201 bp, Bos taurus
cggggtgttcaatggctacaaagctgtcagaatccttctaatgaccttgctatcagtcatcaagagccataaaatattctaatagcatgaggccacactggatgtaaagaaaatgtgatcacaatttgtgaggtctcagttgaacacacactccttgttcctcattcagacaaggaagaggtgcttggagaggcctagaat

SEQ ID NO: 4020 - DNA, 201 bp, Bos taurus
catctggtcacacatgctctggtgacatgcactggccacagttatgcttcccactgtgatacagttactactgctgactggccctactgtggctctctctgtcctccgagatgcagcttcatcctccagcaaaaccttgtctaagggcagccctctgctacaggaaggcctcccttaactcagctgctaaccagtgggtgc

SEQ ID NO: 4021 - DNA, 201 bp, Bos taurus
tctcaagataccatgtgctgaattgtattagatgatattatatttttctctaatatgtgcatatcctatttcctctattgggctataagccactttagggcaggattcatttctagctttatatgacagagtctagggtagtcttacttaataaatacattttgaatgaatggttgggtttaatttagagagacagttaag

SEQ ID NO: 4022 - DNA, 201 bp, Bos taurus
gggctacagtcatgggatagcagagagtcagacacaactttggtcttagtgtagttactatttaaaccattcatattgaagagaataaatatatcaaagactagatttgtgaattagtaggaaatagcagattcaaactgggaaaatctgagaaaatatttaataaagagactattaaaaacgggtaaatagtagtatgaa

SEQ ID NO: 4023 - DNA, 201 bp, Bos taurus
tggttgtttgttttttaagttccttgtgagcaaaactgttaaaacatggcctttgttcactcctcgccacggcctggccagcctctgctgcgtgagtggtggcatctgaacagccctgtctggcataaaccactgaagcataaacaggattttctttctgtgtgtccaatggccatctaatagccatcgtgaaacaaagga

SEQ ID NO: 4024 - DNA, 201 bp, Bos taurus
tggcgcctttgtccccgcgcccatcgcgcactctgggcagaaggtcgccggcgaaggcggatcacccgccccagatcggctgcctggcccggggccaaagctcgccgcagccactcgctgccattccgacgtgagtgaagcctccttagtaagagtgtaaataaaaatccgggctgagaaatgagttttccatgccagcga

SEQ ID NO: 4025 - DNA, 201 bp, Bos taurus
tccaggccaatactttgaacctgattcttgtggtcttcctaccaagatgagatgagtagggaaggatgaacccaaggaaagaggcattacatttcttgctgagatttagagcagagatggcctaactagcccactcacaggtgtcctcagagtgggaagggagggattctccctagcttggcagtcctagtgaagactgtc

SEQ ID NO: 4026 - DNA, 201 bp, Bos taurus
gaggagttttcattcagaaactttctgactgagaaagtaattgcccattttctgttttagcctctgtttatgcatatcctagtattccagaaaattcagaactagatcattcttgaaggctagtagactgaagtgaaactaaaaggttattatttacttttaaaaaatctcactaagatagtaaaatgacagttgctttgc

SEQ ID NO: 4027 - DNA, 201 bp, Bos taurus
atttctctgttgctggaaaaaaaagaaaactattggttaggttttggaaagtttacatagttgggaagattgtgggtggaggagggctttggaactacaaggttgcagctagcagctactagcaaattctgttttgaaaatggctgatagtgtcctcaagtttgattcagtttaaaaaagtcaagttctcagtgatactgg

SEQ ID NO: 4028 - DNA, 201 bp, Bos taurus
ttcctctattatgagtcccttaaaggaggaaggaattggggcttgctgatcttggtattgcttacaatgcccaccagaaggccttgcatgaaagactcttaagagtcccgtggacatcaagatcaaaccagtcaatcctcaaggaaatcaaccctgaatattcattggaaggattgatgctgaagctccaatactttggcc

SEQ ID NO: 4029 - DNA, 201 bp, Bos taurus
taaaaaagaaaaaaaaagtgggggggtattcaccaaagaaagatttaaaaatagtattgagtgtgctgactgaaagcataatttcaacttaagacttactgtgggtgaatctgagaaagtaagcccattatgcttaagaaatctatagaggaatgggactttacatttaaagagataaaggattgttaatagaaaattatg

SEQ ID NO: 4030 - DNA, 201 bp, Bos taurus
gcccaaagtatttagcctggccacaaaagaagggtgtcctcaatccacatgggggcatctaggaatatagctctggtgagcagaagggagtacacaattggctcccactgaacatctacataaggccacttctccaagactgggaaatgtaaccaatctactgaacacatagaaataaacacagaattgggaaaatgaggt

SEQ ID NO: 4031 - DNA, 201 bp, Bos taurus
gctccctgtagaatctgtcaaaatatgatgaactactatatattccaccaactcaagaatcacactggccctaccctattatgtacacagcatgacaaaaatgcttaacacaaggagcaaggatgtgggaaaagtgagcacacacatactggtggttagaatttacatccattacgttttttgaaaggtatgtttgcagta

SEQ ID NO: 4032 - DNA, 201 bp, Bos taurus
atcccgccaacctagggaatgaacccgcatctcctgcattggcagacggattctttcccactttaccactgagccaccagggaagccctactaaacccgatagcatgtcattttcttgtggggctatcttaactgtgcaaaacttttaacaaaaatacctttacaccagcatcttgtagttgttacccaaatgccttgtaa

SEQ ID NO: 4033 - DNA, 201 bp, Bos taurus
caggtaagattctcagaggtacagggaacatagaatattaaaggtgaaaggacaaggaaaggaattgtaggcaaggaacaggtaggtaagaaaacagcacgggccaaggcacagagaataggaatgttttataattgtcacttactctgcttttttgtttggggatttacttgttatactactaatgaagagacagtgtgg

SEQ ID NO: 4034 - DNA, 201 bp, Bos taurus
ttcacaacctcctggtcattttactgcacaccctgtggagataggggcagtttcaagaatgacaggtgaggcaatagcatctcttagagagtcagtgaagaaaaaaaatgtattaattaggaagtcatcagtggcctctgataacataatgaatagccaacacatttgttaaaattaaaacattcattaaatccctaccat

SEQ ID NO: 4035 - DNA, 201 bp, Bos taurus
ttattttcaacagttgaaatgactggtactaaagccttatgctcattgcgggagaactgattcttccccagctcttgctaaagaaaagctagctcagccaccatggagatatagttccccacgcaccctgaatggaatgtcatttcaggaaagcaggatatcacagcattctttgtttttatcaacacacaggtaatttga

SEQ ID NO: 4036 - DNA, 201 bp, Bos taurus
gattctgctaaacatcctacagcacacagcagccccccctcactttccccaacaaaaaattatctggctcaaaatgtcaatagttccaaaactgataaatcctgctccaaggccctgcctaaaaaaccctgtctataactcatcatcaatgctaacatatttttcatacacacaaacattatcatcatctgatagatgctt

SEQ ID NO: 4037 - DNA, 201 bp, Bos taurus
ccaccctctttttttgccaccaaaataactctaattgatgaaataaatccatattttatagcaagacaagaataatttaaacataaattttttctctgccggatcgggccttttccctcccccttagagtgtgttgtgcatctgcattaaccagagcttatagtccttctcaatcttgtatagtgtcaggatgatccacta

SEQ ID NO: 4038 - DNA, 201 bp, Bos taurus
aactgtgccattgatgctgacaactggagctccctaaagaaagagttcagccagcccctcaagtgctctaccaggaaccttcagtgagtgctcccaactggctcacactgcctccctctcaaacatgaatggacagccaaggaagacagggtgtatgaggaaagtctctaatatgatacaaacagcagaaaacatgaaatc

SEQ ID NO: 4039 - DNA, 201 bp, Bos taurus
ttagaatggatgcctatggtggggaggaaaaggcagggaggggagtttatgcagataaaagggaacacatacactgcaagagcggggtcttgtaaaggccggtgatgacagcctgccatgaactgaggagtttgatcacctccaaactttacactggagattgacaacaaaaggattccaaggagctcaagcgttctgagg

SEQ ID NO: 4040 - DNA, 201 bp, Bos taurus
gacacaactgagcacacacaaagaaaaaacagagggactacctgaagagagaggtgggccacgacaagggaggcaaatggccctggagagctgggtacagtttttttttttgggggggggtacagtttttaaggcaggattatttgcataatccacgggggccgttgatggacaaccatgattgacaactgcaggttatat

SEQ ID NO: 4041 - DNA, 201 bp, Bos taurus
ttgccttctgagcaataaaatcaaaatttgctatctgttcagtattcccccctgaggtcctgaattgtgaatttgggcccagccactcccagcagaggtgtggggtgggggtccctctggcagtccctatccaatgcatgtagctgcttcccatctaggtggtctgtgaaacagctgaggccaatggagccccttatactt

SEQ ID NO: 4042 - DNA, 201 bp, Bos taurus
aatatcttttggtaaagaaaaattcagtttaggatttttaaccttaaagctcttaaacttttttttttaagttggtaaaaagtttatattttttgagtaaatgtctacaaaaggtaaaaatctataattggggaattcttaagaggagataatacagattctaatctttttttattgattttatcacacttggggtactat

SEQ ID NO: 4043 - DNA, 201 bp, Bos taurus
ggcccaggacggatgagccctggaaccagccgcaggcaggtgaagttgccaagggtcacggcaggcaagatggggtctctgtcataagccgtgtacacgccggacaggaccgaggtggaaagggccctcgagctggtcagcaggccaggcaggggccaggctagggccgggcgtgagttacatcagggtaaggaatctagg

SEQ ID NO: 4044 - DNA, 201 bp, Bos taurus
ccagggcctcccccacctacctgccttctcattaggttttattcatcccattttgagacttgggactcattattgtacatgcagtggtccagatttagccaggagtctgtaccgcatcaaccagactacggcgtgttgacatatggagttcctcacccccttaggaacctgagccaaagaggagggaggtcagagctgggc

SEQ ID NO: 4045 - DNA, 201 bp, Bos taurus
agttctttgccccatggcctgtaatctctcctttccctcaaaggcctgacacagagagtttcccaagtccctgacctgcatcctcagttcttcctacgtcaccccctctcagagccaagggtctggccccaggtccttcctacaactgcccagggcacccctcctcatcatctggctgagcctcggtctcagtgatgcttc

SEQ ID NO: 4046 - DNA, 201 bp, Bos taurus
ctaagcaggcctcccacaccagccccttcaaactgtgaaggggcaccccctcacaaaatccagaggctccatgtttccaaccacataatacctccctggtgctcaggtgtccaggcccatatgtgacagggcagggcaagctctggcctgaggctgcttgtatggcctcttcctcagccacaacagccatcaccacaccaa

SEQ ID NO: 4047 - DNA, 201 bp, Bos taurus
gttattttcactaggagaggatggacatgaaacattttgtgaactgggaagccacatctgttcagtataaggtattactgctccctcacttcaggcctcatgctggaggctagggggactgttgggaggagaaaactgttgctaagaaccatctgattcctcaaccttagtggcccaagtttcttgggctctgtgggattc

SEQ ID NO: 4048 - DNA, 201 bp, Bos taurus
gtagcggtcataggccatggctgtgagcaggcagcactctgaaatgcccaggacaatgaagacatacatctgggctgcacagccccagaaggagatggcacgggggtgcgggaaggccaggtcagccagtgtcctgggcacaatgtcggtggtgtagagtagctccaccagggagaggtggcgcagaaagaagtacatggg

SEQ ID NO: 4049 - DNA, 201 bp, Bos taurus
tgtcttatttcatcagttaggagaattaatatttgcttatttcattctactgatcatatagttcatccactggtcctacttaaaggtgaagtgaagcaaaatgaaagttacttagttatgtctgactctttgtgaccccatggactatatatatagtccatggaattctctaggctagaatattggaatgggtagcctttc

SEQ ID NO: 4050 - DNA, 201 bp, Bos taurus
agcaatgaggcgcaaagtctttgaatcgatctcaaaagtccatctaaacagcgggatgtgggaggggtggtcagtgaaggattctacaggaaaacacagcaggcaggtctaatggcctgaaggcctaaaattcatgggcggggtaggcctcagaaagattttaatcaaaaacgaaccgtggactccgacccaaaagccaag

SEQ ID NO: 4051 - DNA, 201 bp, Bos taurus
gatcttcctgaacccgggatcaaacctgtgtcctctgcattgacaggtggatttttaaacaatggaacaccagggaagtccctgaaacctttttaaaggcgatttattcacactgggttttactacatgatctttttgactctgattggtaagattgcaagcctgatgaaacatgacacttggacaaggcaaagggccaat

SEQ ID NO: 4052 - DNA, 201 bp, Bos taurus
aaacctaattagtagggataatgaagaccacattggcaaagttaattgaggctaaagaaaaattgtaagttcactgtattttaggcactaaaattgcattactttggaaaatgtgttgattaaaatttataaaatgttcatacaagattatgctattctgacactgaatttttatttttttatgttttccctgaagtcaaa

SEQ ID NO: 4053 - DNA, 201 bp, Bos taurus
attgtttcaaactttgcaatatatgtaacaaactataatcacagattatgaagtggagtgaaatgcatttggagaggaatgaaatatcagtacactgttcagcatgatgatgaaaacaatattgaggcaaagatatgtcagatgaatcaatatgtatatatgtcttctgtaaagaaggtgttggatttttaaatgtttttg

SEQ ID NO: 4054 - DNA, 201 bp, Bos taurus
acccttccaatttaacctatgatatactcactggaaaaagagccatggcctatatgattgcacaattagctaatattacgcctcagatgttacatttcattaaaaaaactgcctacaaggcgtggccaaggttgatagcatgaactctgatggttcatttgttaagattattcaaggaaatgaggaggaatattctcaatt

SEQ ID NO: 4055 - DNA, 201 bp, Bos taurus
tgctgttggaatcactggaagttttcagcacgacactgttttgtgagcaaacttctgaaagtatgcttttatactttccacacccctcctccacaggcctccaaaactcagctatcctaaagggagttaagacttcctgcagcagtagacaaagcactgagtgttagccgctctgccaggttcggattacctccgacggcg

SEQ ID NO: 4056 - DNA, 201 bp, Bos taurus
tcatttcttcttctattcatctttatacccctcacctgtgtacacaacacacacacacacacacgcacacacacaccctccctgttatctggccacccttgatcagtcatcattcacagaaaaacctcctaacctttgttcattatattccctttatagagaagggccatgactctccacctggtttttccaatgtatcct

SEQ ID NO: 4057 - DNA, 201 bp, Bos taurus
agtgattaactagagttggtcctgcatatggggcccaagattaccaccagcttctgggaactggggaagacaaaagctggataagtgaggcaggaactggcatctgagagtccctggcccttgcagagtgtggtcaggaaccaataccaccagcacccctggaagctcattagaaatgcagaatcttgaatctcactttag

SEQ ID NO: 4058 - DNA, 201 bp, Bos taurus
ctgtccatcaccatctcccagagttcactcaaactcatgtccatcgagttgttgatgcaaatgcaaatcaaaaccacaacacatggtcctttgcatccatcaggatggccataatttaaaaaaaatgaaaataacaagtgttgaccaagatgtggagaaattaggaccctcatatattgctcatgaaaatataaattggtg

SEQ ID NO: 4059 - DNA, 201 bp, Bos taurus
ggacatattctaatagcctgagtttattagtaggtagtaaaatggtcctggtattgtgaagatgcaattcaggatgctgacatcctttatctgtttctcaggggagcagatctcctgcgtcagtagtcaatgaggaggtcagtacctagtcctcgtggcctgtttggggtgggagtggtgaggtacattcctatctgtctc

SEQ ID NO: 4060 - DNA, 201 bp, Bos taurus
tcaaacatgggtatccatattcttggcttcttgatgttccctaactttaaacagcttacaatctgagttaggaacacaaggaacatagctactttggaaaaggcctcgcattgcaaggtaggcataaaacaggtagcatcagagttcgtccctgattgtgggagatgtcaacaaaggttcaagtatgaaaaaaaggttaat

SEQ ID NO: 4061 - DNA, 201 bp, Bos taurus
ataatctccctattatcactttgttgagcacttcttggcctcccttcattattttgctccccattagcagttagaagtagctgctttataggagctgaacattgttgaggccctttggcagtgcttctgcatgtggggagccagtgggagcacgagcaggaacacagcccctgtgtttccaaagtcacgcggatgctctct

SEQ ID NO: 4062 - DNA, 201 bp, Bos taurus
gaactgaacagaacccaacaattatgaaatgatcagtagaaacttagaacaagaaataccttggcctttctgaaagactcaggaaagattacctcttttaaaaataacaatatttttgtgtcacatccaccatataaagagactgttaaaagccttctgtagcaaaaagtacaaaaccctcagtttggcttgctgctgctg

SEQ ID NO: 4063 - DNA, 201 bp, Bos taurus
ttctacaatgaagctgaagcactattataaagcttgtctcatctgagaagttcagagagaacccccacgtccaggaaaagctccccccacacaccagtcacgtggtcacacagcaacatattctcccccaaagtatgtccattccaccaaaccaagaaatttccagaaagcatcctagagtagagttgagttcactccttc

SEQ ID NO: 4064 - DNA, 201 bp, Bos taurus
tttcatggcactgtctttcatctttctccttctttgaggtagactgaaagatgggttccgattctccacccttcccttgccaaggcctcacaatggcctgatatatttcctgcccttcatgttgggctctactatgtggcttgctttcctcactggcagaggaagggagagcccaaagcctagacatgaatttttctgatg

SEQ ID NO: 4065 - DNA, 201 bp, Bos taurus
cacaattcatggcccaaaaacagaagtgtattttttttctgataagcatcagcagtccagcaccgagctggtagctccatattcataaaggatccagtctccatcctttaatgaggcccatacctcagaacccagataactattccacacaaatacagccatcaacatcaacattccagcaagcagaggaggaagggaagg

SEQ ID NO: 4066 - DNA, 201 bp, Bos taurus
ccaaactaaaatgcttcttatcccccaaaatactgctctactggcagagttgccatgttgcagaattcaaggaacgatggccacagagtgtccaaggtggcaagaatatacagaagaactgtacagaaaaatcttcatgaccaagataatcacgatggtgtgatcactcacctagagccagacatcctggaatgtgaagtc

SEQ ID NO: 4067 - DNA, 201 bp, Bos taurus
aaacacttttgagaaaaagtatatttcctggccagaagttattcagggtctagtgaggagaaaaccaagtcatagacaaaccatgaagatggtagaagtatgtgtcgggggcctcagagcaggcaaggttctgtgcgggagcacgtagacccttgctgctgctcccacactgccatgttctccctttgcattatctctgct

SEQ ID NO: 4068 - DNA, 201 bp, Bos taurus
aagtggggtatacacactccagggatgtgcaaggtgattcagtagagtgaaggaggacaacatcagaacttccatttatagttattttaaatcttatccactaaaaactttctacctctggcatatgttttataatatattagcatagcatttcattaaggtaaattataaacaaatgcatattagaagttgtgctaattt

SEQ ID NO: 4069 - DNA, 201 bp, Bos taurus
taaatgacataaattcattttctcatatttctggaacttagaagtctgatatcacggtgtcagcagagtaagtttcttctgaggcctctccccgtggtttatagatggctgtcttctctctgtgtctccacatacgtcttctctctgtgtgttttctgtgtcctaatttcctcttcttagaaggacattggccgtattgga

SEQ ID NO: 4070 - DNA, 201 bp, Bos taurus
aatgaaacattccatgaaattaaagaggttgtcaactccatggatgaaaagtccatgtcaaggaaccatgcttcaccccttaaaggaggccaggctagttgtggtctggtccagagagcacagacttagagtcatacaagcttgtgtctgaagttcttccactggccttggacaatttatttaacctgagccacagttccc

SEQ ID NO: 4071 - DNA, 201 bp, Bos taurus
tatgcagtgtcctcatttttgaaattttcctcattccttttcttttggagggaggtgcaaagtgtttattagggcagaagaggggccaaagaatgatggagcttgataaagtctctatgaacccactggagctctggcgcagtttaggctattagagcatcctgggcatggcagatagaaatgggcctttgggccccacct

SEQ ID NO: 4072 - DNA, 201 bp, Bos taurus
atggagaattgccccagaaccttgggtggacagatggcagacacacagacttagagggtccaccttaccagcgagagatgaactcagctgagccagccaataagagctagccctggccagaatgatcttggcttaaattcatcacttgaaggccacaggtataccagaaaggatgctcaagcctactagcctactatctct

SEQ ID NO: 4073 - DNA, 201 bp, Bos taurus
aaatctgtgaatatattacgtcccatgcaaaaggagctttcttaagaatcttgagatggggagatcatcgtggattatccaagtggcccagtatcacaacgctcgttatatgtgaaagagggaaggagagttggtgttggattgatgcaatgtaaaagacttgactggccattgctggttttcaaggtataaaggcagcca

SEQ ID NO: 4074 - DNA, 201 bp, Bos taurus
ggttggcaggggccagcatgctctatctagtacctaggctggaatcttaggagtcatctttgaatcctctcttatcagaacacactaacagtgaccttagacaaacaaatttacctctgaggcctcaattttcttatctgcaaaatgggatctctctgaggtttaaatgcaacagtacttgtaagagcttatgagcaacac

SEQ ID NO: 4075 - DNA, 201 bp, Bos taurus
ttaggtagctatttacgaagtgacaaatagcttctctgttgaaatcaggaaacaactaaaattcaaagacaaaaaatctatccacacagtcatttttaaatctgttatgaaacatccctgctttctcacagaaacacttttgaaatcaattttcttggatggcattcacttaattacaaaattaggcagcctgatcaatct

SEQ ID NO: 4076 - DNA, 201 bp, Bos taurus
taccagctttcacctcatgtggtcctaagtccattctttttatctcctcatatgctttatgcttcagtcttctaggtttttatatcttcatctgaaacctatttggaccataagtatatcagttcctgcttcctgatcagggattaagtttctcctttgtttctgtagctggggtattccatttcttattttcaagtttgg

SEQ ID NO: 4077 - DNA, 201 bp, Bos taurus
aaaggcttttaccttgttttcaataccaattaagaatgcattaaaatctatggttaagggtgaatgactcctataggagcttattttaaaaatagattcaccaggtttttagatgcctaaatcgaaagactaaaaattgtagaaaactaagaattatattgccattataactcataaaatgaattctgaacatttcactct

SEQ ID NO: 4078 - DNA, 201 bp, Bos taurus
agcctgatccagaacacctgagaagagcttggagttgacctttccatttcacccaggcagaggagttaaaccacccctttatcaattggtaactgtacctcctggcccacctggccaaaacacctggaagctgcatagctcagcaacactcaagtagagagtatggcaggcagagatgataggctgcaaagcaaagccagt

SEQ ID NO: 4079 - DNA, 201 bp, Bos taurus
gactggccaattctttcctctcaagcgccctaaatatatctcttaaaaaaaaaaaactttgaaaaaacaagttgtatctttgtttctcatccagtaagttggacgaagtctcccctaggccttgcaaagagcaggggtaaaggagttcctgagatgaacaaaagttaggctctctggttattctggaccccaagagaaagg

SEQ ID NO: 4080 - DNA, 201 bp, Bos taurus
gttccctgggacaaggatgtcaggaaacccaggtagaagggagaattttctcttataaggactaatgtcagatatggacattcttcatctatatgttctgcgtactgccaagagtgaatttgataagaataaattaaaggtatatatgtagattcggggaaaaaagcaatacttcaataagtaaacaaagggaaagttgac

SEQ ID NO: 4081 - DNA, 201 bp, Bos taurus
aaccggaaagtgagggttctctagagctaatacacggccagggcccccagtcctgggggttgggaggaagacctatcctgtccccgtacatttatcaaacaggacctctctatgggccaacggatggggccctcaaaccagtgacccaagatgggcaaaaatcatgttctcacacagtatcccgcagaccccgggtctgca

SEQ ID NO: 4082 - DNA, 201 bp, Bos taurus
atgtttgaatatggcccacatatacatcaagatacagttccaacaatgtaaatccttaaaaacaaaactgtgtgccttaaaaaaatatagtaccagaaaacagtacaagtggcctgaggtgacctctaaaaatggtatactattcactcaacccagaaaaccccacaaaatcatgcagatcaagaggttcaaatcttcgtg

SEQ ID NO: 4083 - DNA, 201 bp, Bos taurus
gatggccttagttgatggtggctgctccctcctatctgaacaactctgatattggcttctgagatgccatcttttctggaccctctttacctgactgtgccttaatggccttttgctggcctgctcttcctctacctgtcctgtgattacaggggttcctttccttctggttccttccttggcagccttctgaatctatat

SEQ ID NO: 4084 - DNA, 201 bp, Bos taurus
aaaacaatttttaaaaaaatcctaagacatcttaggcctcacagggaactctctcactcctgaaaacctacaactcattaaaaaaacatttggaaaagcacgatgtggactatcttaggccacagaccaagaacacaattccaggttcagtcctgcttggctgcaaaagaaggctaatggtaacagaacttctaaagacaa

SEQ ID NO: 4085 - DNA, 201 bp, Bos taurus
gttcaccttcctcattctcttgggccgataaacttctactccatcttcagttctcagtctaaatgtcacttcctctaaccaataccctccagtcagaattaaagttcctaattatatggccttgtgacacccgtgttttgactttggtcatacggatcgcatgtattgttctttctgtcattgtctgtctttctcaataat

SEQ ID NO: 4086 - DNA, 201 bp, Bos taurus
tctgatatctgatacagaatgacagaaagcagactcccaggaaatagtacaaggtcaggactagataggattgtaggccttgaaccactgaaagtcccttactctaaagagaatttaaagagcagtgagtctgaactcctccttctacacaggaggaaagtgaagcccagggaggggaagtgacttagggcccagagacac

SEQ ID NO: 4087 - DNA, 201 bp, Bos taurus
ttatgaccaagaacaaggccctatatttagtatgagttccagggctatcattgcaaagcaagaatggcagcctaagtaccttcccaaggctgtagcttgcaggcccttcctaactgctagtgcttcttaattaaaattgaagttactgagtgaacaatttcagtttaatctgttttatgcatattaatacccagatactct

SEQ ID NO: 4088 - DNA, 201 bp, Bos taurus
gatgtactaaggtcgaggtcaagatagcatccacacttggcctttgttcggaggttgaggaggctggtgcacctgggtaggaagctgtggtcagaaaagatggaccgcagctggcctcctgcttcaggccaagtgcctccgggccacagagccccctcctctttatctgcccacacacagggaaggcctcagccccccaac

SEQ ID NO: 4089 - DNA, 201 bp, Bos taurus
ccttctgttcccccctcagcccacggtattttgactttatccaccacttttccatggaaataaattaccagtattccttgttgctaaatccaatggattcagtcttattttagttgctgtgatccccagcaatagtgtctctctttctttttttttttttttttttgagtttttcttttgtgttttctacagaatttgcat

SEQ ID NO: 4090 - DNA, 201 bp, Bos taurus
atgtacgtgtgatacatgtgtgtcaactcagccccatgagcgtgcacagggcacactagacccagggtagcatgcaggcttgggcggccgcgggagcaaggtgcaaggtggggaagaggtgtaggtagccttggagaagagaagacctttggggtgggacacagttaactaggtggcagtagcagctggccctggtggccg

SEQ ID NO: 4091 - DNA, 201 bp, Bos taurus
aggtttggaggaaccctgccctaggaaccctgctttattggtggtgaggctggattcaggggcacagacctgattctgtcactcccagctccaccggccaagcagtgacagacctggaacccagtccccagaacttagaagttctttttcggctaatacatccctgagacacaggcctccactttgtgcgcacaaacctct

SEQ ID NO: 4092 - DNA, 201 bp, Bos taurus
cttcagcattccttgctaggactgttgcagtagtctccttgttgtcctgccttttgtgtctccccaatccaatgcacgttctctcagcacaggtctggccgggacacatttttggttacagatagtcacttctttctgttgcagtcagtggtatggagtcagctttccttgacatgaggtctgaggccacaccattactat

SEQ ID NO: 4093 - DNA, 201 bp, Bos taurus
gtagacagacactttactgtctgagccaccagggaaaatctaaaacttttcttagtccataggaatttgagaaagggccttactggctatctggttgatatttattaggctgcattttaggagctcagtggttccataatgatgagctacatcagaatccctggaatactggttaaactagagtcccaggcctcactccag

SEQ ID NO: 4094 - DNA, 201 bp, Bos taurus
ccccgccgcatcaaagtccactgcaggcaccctgagcccatttccacccagcgccaagcaccccagctgccagtctcttggcctcagggctgattctaagttcttgtgttgcagctgcaggatctttgtcagaaatcctctgtgggaagatgggccgggctgcaggttgaggtaccaggaggcccatgcagcctcagcagc

SEQ ID NO: 4095 - DNA, 201 bp, Bos taurus
tatctaagtgttgtctttcatgcttcctaataactctttccccttttttttgtttgttaccttcatagcttgttcatcaagatctggatgaaatttttccctcatgggattttgtaatgtgcacagacatttccaaggaaattctaaacagtcgccacccctccccccaaattcttagttggtagttgaaaccacgggtac

SEQ ID NO: 4096 - DNA, 201 bp, Bos taurus
ctccagccacacccattggatgctgccaataccttcactctccacagcactctcttagagcgttgagggggaccccctcatatctatgcctcttctgagcccttctagcagttacccaaccttttgagagtgtgaacacccctcttcccgagccaggaaggtgtagtgctcagcaaggggctatggatgagactgcccatg

SEQ ID NO: 4097 - DNA, 201 bp, Bos taurus
cagagcatttccttctccctgaaaagtaccctggggtctcagcacagacagtcccctcccccagcctgcagaaggctctgccttaaacagtgcaaatgcccctaagatgaccacactggtgggtactgaatgtctgactacgaggacagttctcttctagacgggaagcactgggtgagggccagttgaggatggagtggc

SEQ ID NO: 4098 - DNA, 201 bp, Bos taurus
cggcacttagagcagtgcctgcctcatagcaagcagtggaaaaactatgttgaatgtcttcctcagtcatgaagagccatttgtcctctatattttatactttgttcttgcttctagtttggtagtttttttatgtggaatgatattcataaattcactcatgattataacccagttccctgtgatcctgaactgtgttcg

SEQ ID NO: 4099 - DNA, 201 bp, Bos taurus
accctccaggtttgtttcctcaagagccgccccatcactgcttgtgggcttggaattgagtcaggctctcaatcctgggatctgagggagtgacggggccactcagcccgcatggggactctgtgcttctcctggctgctgagtaaaacaaggacttctctgctgggggggaagctccaatgtccagtctcagctctcccg

SEQ ID NO: 4100 - DNA, 201 bp, Bos taurus
tgtccaaggtctacagcatggcccagaacctccagtggagagactcttcagtcataaacaaatgaacacagctcacgtcagagctgactgtggatggaattgattgtggagttaagtttcctgctgttttgctccatcctgtgctgtgctcagtggctcagtcgtgtcttactctttgccactccatggactgtagcccac

SEQ ID NO: 4101 - DNA, 201 bp, Bos taurus
cacctgcacagaataacgattattgtgcctctctttccccacgttccccacgcctcagaccatgctgcttccttatttgctatcccataaatgcccccagccccttgcctttggggaggcagaattgagactcattcttccatttccttgcctgggtgccttgtgaataagttcctctgctgcaaaccagcatctcagctt

SEQ ID NO: 4102 - DNA, 201 bp, Bos taurus
aatcgggacacctgttgattccagctcaaagtggccatggacagcccttgtctctatgggagcctctgatcctcattcgtgagcagactgacctaaatcattgtccttaacccatggcccctgagcccactgaagctttgttattgccccataatctaacttcagcataaactattagaaccccatttccacacttctcct

SEQ ID NO: 4103 - DNA, 201 bp, Bos taurus
ggcaaactgtggcgggcagtcacccatcttaagcaggcagcctcctctggctagtgggtgccacttagtcaagcaggcccagcactattagagcctttggtttttcaagagaagtcagaaaacagacttttatgtgaaatcgcccactgattaaatgtttgtccacttttttagaaagactaacgtggccaaataaagtat

SEQ ID NO: 4104 - DNA, 201 bp, Bos taurus
ttgttggttgcaggtggattgcggctctgtggctccactccagatgtcttctgagttctaggatccaggctggggagcagctcctctcagtctcatggccgagagtaagagagcagcaaccgaaccataccatggctcttaaaacttctgttcagtgagcgaccctgtcatgtctgcccacattccatctaccaaagcagg

SEQ ID NO: 4105 - DNA, 201 bp, Bos taurus
cctgcagcatggagcaaaatgactcactccagttgctccaccagtcttaagaggaaattcctagtcccgcatattctacacagtcaatagaaacttggcagggccggcagcatgctgggaaaaggaggcagcagttccgggctcagaagaggtggcgggattttttgtttcaatcatgcaaccaagtttcattgagcaatg

SEQ ID NO: 4106 - DNA, 201 bp, Bos taurus
cccatgagaagtaaaatattggcaaagagagaaagccagagggaagggcaagcactccattttgggacttggggattggtggaattgaaaagattagagtagaccattttcttcttcctctagccccagccacacccacacgtccttctatcagatgggagttaaagcgcaaggctagtttgcctggggtaaagtaggtaa

SEQ ID NO: 4107 - DNA, 201 bp, Bos taurus
cagggtagggagtcttcctgtctgactcacattctcacctgctctgatgtgactccagtcagagctggagccctgctgcccattgacaggctggccagagtctcaggtgttctctgtgcccttgctttagatcagggaactactggcagcgccagagagagagggggaagctgggggccaggagatgccccagcctgagga

SEQ ID NO: 4108 - DNA, 201 bp, Bos taurus
ccgagggggacacaagggtccctgaggtagttttggggtcctgtccagtttcattcccatttgaagggattgttaataccaagaatatctgcctatcatgggtattaccttagatttattaaaaaagaaaacaagataatatttatatagtactctgtaccagcaccattctaaaatacatattcatacttttaggaatta

SEQ ID NO: 4109 - DNA, 201 bp, Bos taurus
aatctttgactgtttttctatttggtagttgctgtttttctcattgatttttaagagcattttattttttagggatattaaccatgtgtctgtaataagagttgcaaatattttctcattttgttcttttatttttgccatacagaaaatgtatttgcatagttgaatttatcagcccttgtttttatggcttctggattt

SEQ ID NO: 4110 - DNA, 201 bp, Bos taurus
ccctggccagggaactagatcccgaacaccacaacgaagatcaaagatcccaagtgctgcaactaagacctggatcagccaaataaataaatttttttttaaaaaaaaagaaactctagggtggggcccagccatttgctcaagaagcctccaggtgatggtgaggctgactagtttgaggaccactggctttgggctttg

SEQ ID NO: 4111 - DNA, 201 bp, Bos taurus
gaggaaacctttctccaagattgaatagcatgtgaagagacacagaaatcagagtatagagtactttttattgaggtgtctacaacttgactgtgatgctctggatgtggccaacaaaattgggatcatccaaactgagttgggcttccctggtggctcagacagtaaagaatctgcctgtaatgcaggagacctaggttt

SEQ ID NO: 4112 - DNA, 201 bp, Bos taurus
ctagctttcaacactttcttcattgtctccccaagccccagttcctatcccaaacctctcttgtcatctttctccaacaagcttcctaagaaatgtgcaggaattccaatgactatatgctgctgctgctgctaagtcacttcagtcgtgtccgactctgtgcgaccccagagacggcagcccaccaagctcccctatccc

SEQ ID NO: 4113 - DNA, 201 bp, Bos taurus
gcccaaaccagtgacggctatgtgagcacagcaggtgggctgatgtccagttacacttcctgcattagaggatctaagaggtacattctcatggccaccatatttaccaaggagaacaagaacccacagctggcatagaccaataaagtgtcatccccggggcagggaagggcccagtctgtacagggacttggccattca

SEQ ID NO: 4114 - DNA, 201 bp, Bos taurus
tgagtgaggttgaagcatggcatatttggttgaaaaggtaccaaagtattccatgtatgcaaacagagtgtgcaaagggcctttagcagaagggagtatggcgagaggagagcagccagtgtgactggaatgggagaagcaagtgaggggggccggttagaggctggagtaagcatcttccagagtaaggagtctgtgtct

SEQ ID NO: 4115 - DNA, 201 bp, Bos taurus
cccagggagtggaggtggaggagatgggggagagggtgggccagggctgagagctcagcctagtggagtctgagattggaccctgctctcttcaaggctcggacttgtgctaaggggatagaggccaatgactgatgaggcaatgactcaggaagaaagaagacaagaggggcctgggtccagcacttaggaagtcaatga

SEQ ID NO: 4116 - DNA, 201 bp, Bos taurus
gtaaaagcaactctaatcccaatatttttcaaactgcaggttacagcccattaatgagccattaaatcaacgcagtgcagagattggcaaacgataccccgcaggccaagcttggccaactgcctgtttttataaagttttattggaacacagccaaactcacttgtttacatattatttatagcttctttggcacttgtg

SEQ ID NO: 4117 - DNA, 201 bp, Bos taurus
cacccacatgccccgcatgcctcaacccaactgtagccataacacatgaataggaaatctttttgacctgcaccgtgcatttctcaaagtgtggcccctggtctacctaaatcaatatcataggggctgcttattaaaattatattcatgagccctgtgcaatcagcattactggagataaggccaggaaatctgcattta

SEQ ID NO: 4118 - DNA, 201 bp, Bos taurus
gggccttgattagttgaggacatcttctccctctgggaactagtagtgattcctaaaagaacccggggtctgctcttcactgtccaatttaggatagcatgctgggtgggagtggccttgcaaagcctccccgctgtttctgttgtgttctgaaaggctcaacgtgtcacatggtctgaatgcattctctggtcctcaaga

SEQ ID NO: 4119 - DNA, 201 bp, Bos taurus
cacccaacaggtcgtaaacagcttggtagacctcctctctgctctctgtgtgtcctcgccccggagacagcaagcctcctcccaccaaggccgagaccactctttgttctaggtcccctaaggctctgactgcttgctgttccctccttcctcgtaacaggacccttaagttttctctggggatttggcctctcagctaaa

SEQ ID NO: 4120 - DNA, 201 bp, Bos taurus
ggctgggagcctcaggctcttcttgtcaactgcagggagccttctccactgatccactcaatcctcgtttcaaccattttccaagagtgtcatgatgtgtcatgacagcatctgctgtcccacgcggcccctccttgggtcttctgatctcactactggaggattgagtgttggtgtatgaaggatccttggggctggggg

SEQ ID NO: 4121 - DNA, 201 bp, Bos taurus
ttagttcccctggggacggcaggcctgcatcagtctctcacagaccccctgtccccgctcacatgccccggggctccagagttcagcactgcccagtggcgcaagaggcctgacttcctgttagaaggggcgaatccatttttgaaaccagagatacccaggctgataagggccctattcagaaggctcccaagaaaacca

SEQ ID NO: 4122 - DNA, 201 bp, Bos taurus
gtcaacattattttgctgggcctggtgttaccaccttctccagtcactggtgagagagaagatccaatttaaaagtgggtgcccctgagacaggccattgataaatggacttgacaccttgacctcccttcttttccagtgaggttcagtaatggtgaatttgaccatgggtgggcaaccatggccaaataatatatttgg

SEQ ID NO: 4123 - DNA, 201 bp, Bos taurus
cagctttgtggagatagtccccgcccatccggccatggctgggttggccactgacatggatgtgggctgagaaatgaggctggctgtttatcagggcttgcccttggctaaactggggcccagccacctttcaatggccccagatggtagctaagtggtggagactggacctccatgaggattctgatgtaggtccccttc

SEQ ID NO: 4124 - DNA, 201 bp, Bos taurus
aaacaggtgtcaggtcatgggtgtgggacagtgcatctggtttgtgttttgctgaactggattgggatttcatggctgcaggtggccttggggggaagggaagataaatgagaagggtatcacaggagtgtgtcctggggagtaagattacaggtgaccagagtagaactgcatgagactgagccacccctgagtggacca

SEQ ID NO: 4125 - DNA, 201 bp, Bos taurus
tgtggttagtggtccaggtggctggcaccatggttttgcaacccagctgggactgattgtctacccaccgcagactggccagactggccctgggagacagcgtgcatcaccctctagcacgcattgactccatgtgtttggctcccttagcacactgcactgaccctttccagattcagtgctggggccagcagaggtggg

SEQ ID NO: 4126 - DNA, 201 bp, Bos taurus
gctctcgcctctcaggccagtgctccatctggccagcactgggagactcctgtgctttttacccttgcacagccccagacacataatggcaatcaggctatagcccatgagcaccatttttcatacaaaaaaatgaaggttcttgagcaattaaaaaaaatgacttattggaacagctgtctcagagaaaccgtggtcccc

SEQ ID NO: 4127 - DNA, 201 bp, Bos taurus
actcagagaggtgcaaggacctgcccaaggacctacgtgttcttcagcaataaagcctggtccagaacacggggtggtagacgccaagggtcacacaagacacagacagaaacctctgcaggctctgctctccttaaagaaaatagggacactccaaataaaaccaaattctaaaagcaacggtattttttatttacaaat

SEQ ID NO: 4128 - DNA, 201 bp, Bos taurus
aaaaatgaatatatgtatatgtataactgaatcactttgctgcacacctgaaacccaatattgtaaatcaaccatgctccagccaaattaaaaaaaaaaacaacactttactgagagaaagatcagtatgaaatgaccagagaagttaaaattcgttttcttccaatgatttaacatttaaatgtccttgcagttttctcc

SEQ ID NO: 4129 - DNA, 201 bp, Bos taurus
tgacgaaaaaatggacccttataaatgttaagaagcttgaccagggatgagatatgacctgcactgtttcctttataagccaaaactcaaactcttaacccaggtagcatgttgatccccacaggaaggctaatgtgatgtcgacattctgattgatgcatagtttgctcagatggaaagtgaaagaaaatctcaggggag

SEQ ID NO: 4130 - DNA, 201 bp, Bos taurus
cagcattctttggtacatgggaggccagcagccttaaaaggattcaggcttccttatgtgcccgagggcttccttttctacctctgctttgctgtggaacaagctagactggccaggtgatgggacacagtaggtactagaggagaagcaagttgcgctagccgccagactcctggtctgaagctgaccacagacatttgg

SEQ ID NO: 4131 - DNA, 201 bp, Bos taurus
gtaagcgtgtcctggaagggtggccaggacaaatcagaccaagaagtcagtatctcccaatcatagtgaaaggtgtcacaactttgcatcataaagttcctcaggccctctccttagcccacttgctaactctgggccaaagcagagggttttggaaagagctagggttggaagtcagacagacctgggtctgaacctggt

SEQ ID NO: 4132 - DNA, 201 bp, Bos taurus
aactagaggcattttttgacttctcttttgtgatcgtcattgttcgtgaagtctaggttttctgcttgaagcactgacactagctacataggcaggactctaggaaatttggccaacggctcccctacctgccgccctactggcctctcccccgccccactgaagcctttaacttctgtggcactagtctctgggctgttt

SEQ ID NO: 4133 - DNA, 201 bp, Bos taurus
tgcaggcgacagcagatcctgggccagtaacttctgtgcagtgagcatggacccatctgcacttaagccttagataaggagcctggaaagtatggctgtcgaggggccagactagacattctggcttggttggcaaagggcagacttgggcatcattcttcttaagatgcaatccccactccaagccatgattctaacctg

SEQ ID NO: 4134 - DNA, 201 bp, Bos taurus
tcatgtcagaagagctctccagcggagaagaacagagcaaatcaaagacctcatagtgtagtaaaagtagcatggactccaaggttggccagagccaagggtagaacctcaggagcatcacttatttacctgtgaccttgaacacaggatttaacctctgggcctcagtttcctcatccatttgtgggtatgcacttgtac

SEQ ID NO: 4135 - DNA, 201 bp, Bos taurus
ccccatctactttatctgcacctgaccactgaggacagttcctggaccattcactcagcaagcacaggctctgccacaggggccgtgcagagaaagataagcagaatataacccggaagccctgcgccattcctggtctaggggtgatggtgcgtcatcagcctcaatcaccaggcaatgcctcggcctccctgagtcacc

SEQ ID NO: 4136 - DNA, 201 bp, Bos taurus
ttcaagtcactaagctataaaactgatattccataatgatctctgggccattgactcctctaaagcacccccactcctctagcttcgtgggcagacatgctgctgcttcactctctgtagagttggccaagtcaccatgctgttgtctccatcagacctctggaacaatctttgtttctaaaaatgaatggccagtggaga

SEQ ID NO: 4137 - DNA, 201 bp, Bos taurus
gttacaaaacaagccctgttctagatctaagggccagagagacaaaacagacagggaacctgccctcagggagcttacattctagaggtggtactgggggagtggccaagacagatagttaaccagcaaatacataaacaagaaagtatggatagtgaaggcaagcgttatataagatggttagacatcttttgaggaggc

SEQ ID NO: 4138 - DNA, 201 bp, Bos taurus
caaaggccccagctctgagcaccggatgcctgttatcttcagatccattataggacaatacgctgctaactacagacatcagctagagggagagaaggctccttctggctcctacgaggccgagggaagaggcctgatgtgcaggtccagtgtgtggaaaggtcacatgcatcccccgctggcatgcagtattgctctaac

SEQ ID NO: 4139 - DNA, 201 bp, Bos taurus
tccatgaccacggagtctgggacgctgtgctcatccctgtagtgtggccaaatccggaaataggaggtcggtggtcttggtctctggcccccaacacctcacttctccagccttgctttgcctgtcatgcaggtcacatgtctgaccaagttcccaaaggcaggaaaggagaccttttcctccatctcaaggcaggcctac

SEQ ID NO: 4140 - DNA, 201 bp, Bos taurus
ccccctttctggataatttccctgggcccagacttcatgaggacactgagcacccatgttctgtcaaagtggggttctagcctcttcagctttgtacctctagctccacacataataaaactggcccatttcagctgctcaagtatttgactctgcaagggaatccagagagagggtggtgggttctctgatggaattaag

SEQ ID NO: 4141 - DNA, 201 bp, Bos taurus
ggccctactttgattttaacagcagaggaaactgaaaaacagaaaaatgaggtaacatgcaagtcacgcagtttgtttgtggtagaggcaggatgagaatgcaggcctttaagtcttctggccccttctcctgcctccttagagatctaaggctctgtgaccctaagggttttgactgtaacattgtaagggtatatttct

SEQ ID NO: 4142 - DNA, 201 bp, Bos taurus
tgaggcatccgcttcgaagatggtgatcttaaataaacacactggtagccccagcactcagtcaaatccagctgccttccccacagaggccccttggtttcagagctcttggttgatttaatcactgaccattcgggtcacttgctcccgtgccttcaatttcccctcttaagtttaaatttaccaataaagagggagccc

SEQ ID NO: 4143 - DNA, 201 bp, Bos taurus
aatttttataaataaataaagccattttatttttctgaaaaattggccctttggtttttataacattgtaacattgtgtcactgctactctataaatatgtgactggaaagatgaaaaggccaatcaccagatttaaatgactataagcaaagacattactcaagagaaaacccattcatttggaatcattccaatccccc

SEQ ID NO: 4144 - DNA, 201 bp, Bos taurus
acatgagcatgtgtgtctactatagtagaattccataattaaatggccatctgcttttttctttttaaagcaaaactttgataacttattgcaaataaccgagaattataaaccaaaagcaggccttataaaaccagagcatatataataacaatgaatgcacaccatgcagctactgatacagatctaacatgtgatgaa

SEQ ID NO: 4145 - DNA, 201 bp, Bos taurus
aggtctgaatattcttttttgaactgtacagtctctcaccgtagctctgagattctgatttatatctcctcatttctaactgggatcatggctctaaacatacttctggacttttgtgacaagcttctttccaatgattcaaaacagtaacctatatgcaaaaggaggacaacttctgtgccttacaagaattagtaaagt

SEQ ID NO: 4146 - DNA, 201 bp, Bos taurus
gacaggactgaagcaacatagcacacatccttattccaaactattgataaacatgatgtgtcagcctttggtcaagtacaaagttctgggtagtaagtcctatggaggcccaggctctctgggaacctcccaggtttagcaggaggccctcacagggtgagtgctgacctatgctgcccttcgacctgatctgtcctccgc

SEQ ID NO: 4147 - DNA, 201 bp, Bos taurus
cacaagtggctattgtgtaagacagaacaggaggcctccacggtggctcactggtaaagaatctgcctgccaatgcaggagacacgggtttgatccctgaccgaggaaaaccccacaggccactaagcaaccaagcctgtggattgcaactcctgagcctgtgctctagagcctggatgctgcgagtactgagtgtgtgcg

SEQ ID NO: 4148 - DNA, 201 bp, Bos taurus
aggccccagtccccaggcacaggagccagaggtctggtaggcctaccccactagcacccctgacaattagaaagaaactcaagggacttctcttgaattccgttaggaggccccagataagcccctcttggtcaaaatgcttctggtggctcacgcaggtaagctccttgtgcacaggtaaacctgccaaaaccactgctt

SEQ ID NO: 4149 - DNA, 201 bp, Bos taurus
tctccatttagtctcagggtctctctgtgtggtgagttcacatggagagtttgggtttcctcaggacatggtggcttcaggccagtcagactagtcacagggggcttaagactgccagagcacgcattctgactaataagctgggagctgcatggccttctatgatccagcctcagaagttgtgtgtgtgtgtgtgtgtgt

SEQ ID NO: 4150 - DNA, 201 bp, Bos taurus
gcctgttccagctgaaatctcaatattagttatcttgataaagaggaatttctataaccagcctccaactctgcttcctcatttaatgtccttatacaactggggaaagacagactgtaccatgaatagcatcatcactaaaacatctcctgcagcttgtctgtctggcaagggcttgtgaaatcatggatgattagtgaa

SEQ ID NO: 4151 - DNA, 201 bp, Bos taurus
tttggaggcccttaaagtagctttcctgaaaagttcaagaacttctcctatcactctccatttacatgggatccatgagcagacagacctgcccccaacatcctcaaatcccagtaaggacactagcctgccaagggtctcaagttcacacacagagacactcctgctgctcactctgcagagggagagaagaaaggctgt

SEQ ID NO: 4152 - DNA, 201 bp, Bos taurus
ctaacatcttcttaataagggtcggctttttaaaatgcaaagggtatgttctgcttctccagcagtatgtcagccctaatccaaaccagatcggccactgtacagggttcatggtcccaattaagaaccaaggctaagctctcaggagccggcaccttctggggctgctcagagtcctgggccaacctgctgcctggcaca

SEQ ID NO: 4153 - DNA, 201 bp, Bos taurus
cataagtgtgagaatcaggccacgtggctccacggagtcgtgtcctgccatgcccgtgatcaagcccggactgaggcggtggctgccagggcaatggatatgggccaaaccaagacggatgcagaagcaggagggagaggagtgatgggggtcagcgtcacttgtcatgacacctctgaccacaccattccctcctgaccc

SEQ ID NO: 4154 - DNA, 201 bp, Bos taurus
acatcttttagtaattaatagatatagaatcctgaattcaaactattttcaaatatatattgattatctataaaaattgaccatctgctggattataaagctccgcatttgaaaggactgcaatcattacaggtcgtgttctctaatgatgatgctattgagaaagaaatccacttttttaaaaagtgatttttatggtgt

SEQ ID NO: 4155 - DNA, 201 bp, Bos taurus
tgagcctaatgctcggggcagagctcccatggggttctccctgtgcctctcctcttgggctggtcccttgggcctccctctttgggaggaaaggccagatattaggcagggaggacccttgggatggcagagggagcattggagtgtcagaacacggggctcagcccagaagctgacctggccatgggggatgtcataccg

SEQ ID NO: 4156 - DNA, 201 bp, Bos taurus
accctgaggcagtgttgctggcaggcccaagagatgggatatcaaacctatcattttacagatgaggaaactgaggcctgtaagggcacatgacaagctgaggtcacagagatccgaccgctaaggagagccttcagttcaagcctgggccgacccccacagtcacgcccaccccgcactcctctggccctaaccctgcct

SEQ ID NO: 4157 - DNA, 201 bp, Bos taurus
tcagtaccaatcccgttctcctgcctcctccaccctaagtctctcccagcccacctgaccccacccctgacaaatcactggccaggagtatcctgggaaaagtcagggagaaggaaaactcagccccaaggatgaggactaggaagccaaaggccttatgggaacaaaagccatgcctgtggtcaggccaaagctggtcca

SEQ ID NO: 4158 - DNA, 201 bp, Bos taurus
ggggtggtaacatccggcagctcccatgcctggcccttgcccccactctcacccccacgcccccattccccacccccggaggcccttgttctgcctcagcatctctcagctcccaggaaccagaggctgtgtctccttgagctttctccactgcatacaccagccagggccagggctccacctagcacataggctcgtggg

SEQ ID NO: 4159 - DNA, 201 bp, Bos taurus
aacatttgtcttgctggaggtttacaggaacagcttgatcagacctatatggacagctgtaagaacaaaggattagcatatcccctctgaagtttggctggcaccaggaagttcacatcaaccagccacaccccctctccttttactataaaagaagcctgaattctaactctgaataagatggttctttgggactctagt

SEQ ID NO: 4160 - DNA, 201 bp, Bos taurus
agatttgtcctttagtttgctagggcttccataaccaagtactacaatgggtcacttaaacaacagaaacttactcctcagagttttgaaaactagaagtcttagataagttgtcaggagggtagatttcttccgagtcctctccccattggcttcttgatagctaccttctccctgggtccttacatggtcttccttcta

SEQ ID NO: 4161 - DNA, 201 bp, Bos taurus
acagaaatatctccaatgtaggaaaaaaatcacattgaaggacagtgtatatactatacctctacttctaaaatgggaaagaaaaatatatattcgcattgagttatatatgcaataaaggtctttataaggagacataaaattttagtactagcaggaggagaaggggacgacagaggatgagatggctggatggcatca

SEQ ID NO: 4162 - DNA, 201 bp, Bos taurus
ctttgcatattatcccttttaagtctaaatgcaacctccccagaaaattattatcgatattagtcatgaaagtggatctcatcttgattacagagaaattctgggttgatctgagtaagtattattgagaaagggtcctaaagcagtgatcttgtttacattctggtcatagttagacacttaaaagccttacctcacaac

SEQ ID NO: 4163 - DNA, 201 bp, Bos taurus
ctatatttccttagtatggtaattttttttcacctaaaacctacttaaggatttttattcatgcttttctttgcctcctatgtagaaatagtcagtgtttacagtaaaaaacacaaacaaccagccaactaggagactttaatgtggccattgtggactaaaagtttaagataatttttttttaaattattgtttcctagg

SEQ ID NO: 4164 - DNA, 201 bp, Bos taurus
acctatggaaaattactccaaaggacaaagaaatgactgcttgaaagaccatgtttgttcatataaaagtaaccacatatagaagtccaccagcattaatggaaggactctgtaatatattcatgcaaatgacctaaaagattatcaattttaagcacaatcagactcaagggggataaagccatcttacaataatactgg

SEQ ID NO: 4165 - DNA, 201 bp, Bos taurus
ggtaactatataaagtccctgaatactagcaaagaagtctcaagatattatggggacccaaacatctcacattagtctttatctgtctaaattctccgctcaaggtagggtagcactccttcctaaccagttgccttagcataagggacttagcaagttaataggttttgcgattctgcacatctacaatcagatctgggg

SEQ ID NO: 4166 - DNA, 201 bp, Bos taurus
attcagtccaagattttcaccccttccttaacctactcccctaggcaccccaccccccaccccaggggacttcatctggaggttccaggaatttgtaaacgctttgaaattctgtgcagaaatttgatatgatcacttttttctgggagaaagcgcccctagcttttattaaaaattttaaaggatctgtgacctccatag

SEQ ID NO: 4167 - DNA, 201 bp, Bos taurus
gtcaaaatggtggagtgttacggtgtgaagttcatgtctcctcacaactagggcacctacttgacgttggtgggggatagatatggacacctaagagaatgagaggaatgcccaagctactacatagaatgtaggggtgggggcgagcagggagtggggagagatggaggcaggaagggacaggtacccttgagagggaac

SEQ ID NO: 4168 - DNA, 201 bp, Bos taurus
ttcatggggtcacaaagagttgttggacacgactgagcgactgaactgaatttcccaaacccttcgaagaaagaacaggagggaataattcaaaattcattttataaggccagcattacctgataccaaaaccaaggcaggaccaccacaagagaagaaaattgcaggcctttatcccacaaaatcagagatgcaaaaatc

SEQ ID NO: 4169 - DNA, 201 bp, Bos taurus
tgctggtaggaaatccacgcttcgaaacaacctcatgcactgagacctccaaatgaatcctcaaggtagatgtgaggttcccccatcaatgccttctgaagctgggacttggttttcaagctgctcaaatacaagccgtctgggcagctgcccttggcccatcctggagcacccctgggtccaggggcactcccagaggag

SEQ ID NO: 4170 - DNA, 201 bp, Bos taurus
tcccagccacgtgagtttgagtcacaagcaatgttttggctgggttcaaatcccagaacatgggttcaagtcccaatctgaggtaaatggtttcacaatgacataacagatctgtaaagcaatctcaacagcctacttaacattggtccattatcaagagatggacttgctttttaaaaaagtaaacgaacaaaaagaaac

SEQ ID NO: 4171 - DNA, 201 bp, Bos taurus
ccatataaacatgctgcaaatgagagttcaccatgctcattaatactgtaatgcccagtcacagggtaccaggcagcagcttgacaaacaagatcagaaagttttaagattgccatgtcaatatgtgccattcctctagatagaaatcagatgtcaaatggacaggtgtttcctcttattcaagccataatccttattttt

SEQ ID NO: 4172 - DNA, 201 bp, Bos taurus
ctccagtattctggcctggagaattccatggactgtgtattctctgtacttgggtaactaatggcacagcctcaaaggcggttgtgaagatgaagggtgccagagaatgccaactcaaaacaggccactttggcctgaggattattttgagctaaaggtacacagcaagtgagctgaccagctctcttttcttcctaaaag

SEQ ID NO: 4173 - DNA, 201 bp, Bos taurus
ggaggaatggtaaactgaaaaagggcaaaggcgtggcctttgaggaagcagcccagatgaaagttcctgcgattgcataaggtaaccaccaggtggcgcatgggaaagcatcaaacttgggccctcggcggactacagttcagttccctcagcccggtccgcctcttagtgaccccatggactgcagcactccaggcttcc

SEQ ID NO: 4174 - DNA, 201 bp, Bos taurus
attttaaactactttgtttagaaaagagtggttagggttttgtagcacttcctttgttcatttttgcctcactaataacacctagactcatactttggccccagcagtacagaggatacaggtattgttttctttaaaaaaaaaaacaaaaaacaaaaaacagtcccatttgaaagagaaacaatggtggtattgctcttt

SEQ ID NO: 4175 - DNA, 201 bp, Bos taurus
gaactgcaggagacaatctttctagacaaggcagttgaggaggagggagcgattgaaggggggattgacttggcgtgcactgtgcccctcgggaacgttattgcgcgtggaacggctgcttttggaaggtgagtaactcgaaccattactgtggtgcaaaactgtctcacgaggctttgatttcagagtggtttcttttct

SEQ ID NO: 4176 - DNA, 201 bp, Bos taurus
gtggcaggcctgtaatgtggtccaggtactagacatctggagggaatatgatcagaaggaataggctgcttgctcgctcgctctctttttttgcatctatagtcgccatggccaaactcaggagtaggtcagagtaaaacatgtctgtggggagaaatggcccagacagtaggcacttcatcagtgcaggcttgcttgggt

SEQ ID NO: 4177 - DNA, 201 bp, Bos taurus
tacacaggctgtagccatcaagagcatgaaaggaaatactgggcttcttttctttcttttaggcttcatgttaggaagaggcatttgctttcctgaacagaactttcagaaattttttattcaggccattggttgtatttcaaatgattgtctttcctaaattatttcccaatatctatgatttccatctaattttgcttt

SEQ ID NO: 4178 - DNA, 201 bp, Bos taurus
ccagtcctgtggccactgctgagtttcctgttctctagcagcctgcaactctcaagttgtcattgtcacccttctcccacagaaaaccctctcgttcaccatccctggcccatccgttactctctctggtggtggtttagttgataagtcatgtctggctcttgtgcaaccccatggactgtagcccatcaggctcctctg

SEQ ID NO: 4179 - DNA, 201 bp, Bos taurus
acccaaggcctcaaagttactgatctctcagtgaagatgctcttctactggtagaagaagattctaccaagaagaatctactggtagagtctcttctactgaagagggccataggaagccatcaactaggctgtaatgtctttccagacattgcttgctctgctgttacctgagctcaccaagtgccacctgtgttcctgc

SEQ ID NO: 4180 - DNA, 201 bp, Bos taurus
cattgtacactactgcactgtatgttcgagtttggactctgtgctgtggcaggtcttatggctttgttgggtagacagtcgctggggctccatagctggtgttgggagtgatactgtttaccattggtctctctctccagggatgtgctgcctactatgttcccactgtggccagtcaagtccttaagttaaaggaaaata

SEQ ID NO: 4181 - DNA, 201 bp, Bos taurus
aaattagatgaagctgtggtgtgcataacagagctatgcccatggccccatagctttttagtagggatactactcaatagccaacagcattggtcacttggtgtacactctactgggcctatttccttttaggattcttataaccatgggtttctaaatccactccttgtttcatttttttcttctttgtgatgcaatgtt

SEQ ID NO: 4182 - DNA, 201 bp, Bos taurus
catacagctaaatttaccccttttcacatgtatagttagatgagtttttatccatgtgtaaaaaccatcatcacaacaaacagagcattgctataccccagagaattccctaatgcttatctgttagtggctagatatttaagtagtaaaataaattcttgacctgaaatagttgatactatacctgaaatagctgatagc

SEQ ID NO: 4183 - DNA, 201 bp, Bos taurus
tgataaagtgtgaagaattcttatatcccttcaggaaatgttgctataaactatttggatcttggatcttcattaagtgagtggactgtggaggttttgctactttcctttatttattttagattatagaacaaaattacccctttatatgtatcaaaatttagtgacaggtgaaagagaagtcattccttgagtaaggtt

SEQ ID NO: 4184 - DNA, 201 bp, Bos taurus
agtgtgaggctgggcatgtataaaggatgatgttaacaatattaggccaacacaactctgatgattgttttgaagaaggacagaaaatcacatatactaattgtttagtgtgaatcaagcattggcctggggactttacataggtcatgtctttatgctttttaatttaggtaatagggcttcccaggaggctcactggta

SEQ ID NO: 4185 - DNA, 201 bp, Bos taurus
tggtccaccatggtcagattggccccaaaaacctggcctctcctttggtggcccctgagtggacaaatcctttgtaatcatttgagtcttttgtttgtctctctgcaggcattcagccctgtgggccacatccctataatgaaaactgaataagccaattggagtaaatcattcataggggtttgaggaccagcagatacc

SEQ ID NO: 4186 - DNA, 201 bp, Bos taurus
agaacatggggtgggctgagaaggacagaagtacggggcaggaatgagaggtgtagagtttggttcacagttccattccctttattaacaatgccaagcaggatctcttcagcctgcacaatcgggaaagttcctggcaaaaaagtgcacaccctcttttatttcccagaactgtaattcccattaaattgcttctctgga

SEQ ID NO: 4187 - DNA, 201 bp, Bos taurus
aaattcagtgaagaatactccaactaaacagaagcttttaaaaattagatatattaaaactgtaattaattgatacagtgggttaaactggaaatgttcacacttatttattttatgttagcttaaaacctataaatggattttcatacacaattttttccttttgtagatctagaatcttttcttcgagtataggtacac

SEQ ID NO: 4188 - DNA, 201 bp, Bos taurus
cttattcagcctattccatttatataatcccaattcaaagaacaaggatactcataagccccactgcataaaaggcaagatggtacccattgcagatcaacgtgaaagctgaagaaataactcaaagttgtccaagtacctggggtcctgattttcctgactataacacctgaggtcaaaagattttggtttgaatgccat

SEQ ID NO: 4189 - DNA, 201 bp, Bos taurus
gtctaactactttcatggccaatacttctttttgcctgctgctttgtggtcagggtcagggaacagatcatgtcttctcattgtgtgtgtccacatagggctaccaccttcttgctggcccagcagtgaccagtttacctatgaaaactggactgtggagtcagatatttccattctagggtttgtattaataatacaagc

SEQ ID NO: 4190 - DNA, 201 bp, Bos taurus
taaaaattactatttgaatccaggccacacagtagagatacaaagtatcactcaaaaagaattctgtccttgtctacagatactgccttatccatttctgcgtggagaagtggcccagcaccagttattaatatcatcactataaaacaaattatcataaaacttagtggtataaaacaaccattgatcatgcttataaat

SEQ ID NO: 4191 - DNA, 201 bp, Bos taurus
ttcatttatgtatccagatttctccagcaccaggaagtctttctctccttttattaagtatagttcagtggttgttggtataatcacaaagttgtgcaacgatcacaacaatcaacttcagaacattttcatcaccccccaaaagaaacttcatagtcacttcctattcctcttgttcccttctccctgatgccctagaca

SEQ ID NO: 4192 - DNA, 201 bp, Bos taurus
aagaaactgataaccactcccattaaaaaggagtgtagtacatttatcattccactaacatttttaccagtcttctcatctcaagataagtgagcagggacttctccggtggcccagtggttaagactctgtgctctcaattcagggagcctggaatcgatccctgtttagggaactagatcccacatgctgcaactaaga

SEQ ID NO: 4193 - DNA, 201 bp, Bos taurus
gttccaagttcagggaactggcccacagagttaccatagatcagatctaccagcatctaactggggttttttaaggtttttgttgccaaggaaatgtttacggtcctcacacaggggcctgggattccatggtgtctatagaatctcaggctttcctcccaccactccccctaacccggtcaacaggaagactgccgccat

SEQ ID NO: 4194 - DNA, 201 bp, Bos taurus
tgagtcccccaactccttgttccacacttcagggcaggaaccacggtggaggttgggcgggcggcggagggggggggcttgagatagacacagatgggccagaagaaagggcatgcctgtcctttcttgagttacattgattcttctccccacttctgaatggctctgggccatcctgggctctgccatcgtttttttttt

SEQ ID NO: 4195 - DNA, 201 bp, Bos taurus
gaaacaccctgagagtcctacagcaaatcaaagggtttaccgaaatgcagggttaagagcaccagtctgggcagatcaggcctagatccaactccacagcttatgagcagagtgacattgttgagctatttaactctgagactcagtttcctcatgtataaaatggggccatatcagcatttatcttcagggttgttaggc

SEQ ID NO: 4196 - DNA, 201 bp, Bos taurus
agggaatgtattaaaccagagacttttaccaaaagttgtaatagtgttacacagacataggccaaacaaactgatgttcaatatagctcatcaaaagaaattgtttacctatattgcctgattcagttgataaactttatcataatgcctacataacatacactactcagagattcttgtgtgctacaaggacttaaatcc

SEQ ID NO: 4197 - DNA, 201 bp, Bos taurus
gtctttactctttttccttctttttgcagctttgactaaataagttcaatgacctatcttctaattcactcactcactttttttttttgtgggggccaaatggtctcttccttcagtatttatggtttcacttcagcagggaaagacattcaccagtcagcttggaatattggacaggcctgctggtagtgtctgttggca

SEQ ID NO: 4198 - DNA, 201 bp, Bos taurus
atatatatttaaagatccctttgggtttttctggagtaaagcaggaagttattgtctctttttgctgtacttctgcttttaatatttttttattactggagtataatttagtttataatgttgtattagtttctgctgtacaacgaagtgaagcagctatatgtgtgtgtatatatatatatatatatatatatatataca

SEQ ID NO: 4199 - DNA, 201 bp, Bos taurus
ctcccgcccacccacctccccacaattatcctttaaccaggatttacctgatgtttctgaatcctgagttgtcacaaaataaggtagagtattgttcttccagcttgtattggtaacaaaggggcctggtttatattttctaacttaatttttcatctacatatctatttaggaaacacttatattaaggaaaactgttaa

SEQ ID NO: 4200 - DNA, 201 bp, Bos taurus
tgattctggtgacctacacattgctgtgacttcagttcagactttgggctcagtggaggagtcagcacaagtcactgaagccctagaaaagattatgtggacatcacatgccttattcctggctttgcccacagctgctacttcagtgtcttgtcactccggttccaccacctctgattactcttcagtctttgatggcat

SEQ ID NO: 4201 - DNA, 201 bp, Bos taurus
atgccttttaacctcttggaattcaaatgaggaaaactatctaatcagagagactatcattaaacagaaaggttaggagagcaccagttagactaataccgagtttaatgttaaaataaaactatgcagagggtacagaaacatacaatcactttcttgtagatcttatccaagctgattagaagctaattgttagtcctg

SEQ ID NO: 4202 - DNA, 201 bp, Bos taurus
ttttacctaagggaataatatggcccagtagagtgttcaggcagaggtgcgtgggctggtttggggaagggaaagacgaagtgagaggtggtacttggcaatcgacaagatcaggagggggccgtgaaggagcaggggaaaggctgagagctgagccagggacacctgacactgtgagcctggtcactgggagaaaggcag

SEQ ID NO: 4203 - DNA, 201 bp, Bos taurus
aaacacaggaaatgtgcatcagatactgttatctaggtacttcagagaagagctaaagcagaggatttgggggagcagactgtcccaggaaggccccatatccacttaggtacaggattaggagcacagggatgcacactgagctgcagatttagagtggtcagggcaggcctcactgagaacaaagatttgatcaaagac

SEQ ID NO: 4204 - DNA, 201 bp, Bos taurus
cccctgacgattgtgactgtgtggcttactccagtaaagggacactccatttccttattctgctcctcccctccactgtcagtcagctttcccaacatcacagtcagtcctctgggccactactctagactgaatacttaactctttacaactccatggactgtagcctgccaggctcctctgtccttgggattttctagg

SEQ ID NO: 4205 - DNA, 201 bp, Bos taurus
gaccaaggttacctgaagacagggagtcattttcacagacagagctgaaatattgaaactcgttgctctatacctctccattccctgcattcccaactcaagtaaagatctatttttgtctgggaggtctaagaaaggcatcgtgttggtgacaggatgagtggctctcatggggaacccgaactccaacttctcagtgac

SEQ ID NO: 4206 - DNA, 201 bp, Bos taurus
aaaaagaatgttgtcgaagaaatatgtgcagtagatatatggttggactacctgacttcttagggtgatgagctgtctccatttcccagggattatccaagttttaacactgaaactcctcaaactgaagaatccctaaattctggggaaaccaggatagttggttgccctttttgagattctttaaatcctaagactcta

SEQ ID NO: 4207 - DNA, 201 bp, Bos taurus
ttgagatttttgctgacccaagtggggaaggaagaactttgttctctgatattgtaaacaggtaggcctagaatcttacaacaatggccatgtccccataggtgaaaaaggcaagcctgtaattaaggaggaagacagctgagatccagaaagaaaaaacaggagagattcttgatggcatttagaatcttgactccaggt

SEQ ID NO: 4208 - DNA, 201 bp, Bos taurus
aggcctacctagaagccagattataaaagtgagttgaaagaagatggtcatgtatgttcagaggggctaggaactgcacctgtctggaggtaaaagtgaacagaggaaatgggccttcttattcttgcaggctgtaagactagtagaggagaactatataagcccactggtataatctcatagcagagcagtcgcctagaa

SEQ ID NO: 4209 - DNA, 201 bp, Bos taurus
tttctttttactcctagtatctagtgctgcctgtacaattcaggcactcagtaaagcttcattgaatgaatgaattagtaagtgagaagtgtcagaggccggatgaaaaggttggcagagaatgcatggtattaaaactggtcaagaggaagatacaaaaaatatagtgatgagagtaagagaaaagatcatctactaaga

SEQ ID NO: 4210 - DNA, 201 bp, Bos taurus
ttctgatttgcctggttcacagtctatatttggtgtatctcaggatccttctatgtgtgcacatgcatctcttagccaaaatggattttactgaaaaggcgtatgggtagaacagcccttgacatactccccctttgaccttcaaggaaccttttatgtacatgtgtggttggggcgatctcctgacttggagaaaagaaa

SEQ ID NO: 4211 - DNA, 201 bp, Bos taurus
tcaggaacaatctttgggcttaaaaaggaaacagacattgcagcaactctagtaactttgatttatactgtgtggctttaggaaaagacaaagaataatgtgttgaaaattagcaaaatattgagtttttttccccaaaaagctttgcaataagagttacaagcagagttctttccatgagcacccgctcaccattcctct

SEQ ID NO: 4212 - DNA, 201 bp, Bos taurus
aatcaggtcagctactaggaagtatataaagggcagttcaagagaacggatttcagtgagatcagaacatgctatatgtaaagcattcttaattctacaggggatatatgttaggggaaattagtgttattgccactacttgaagttttctcattccatttttcactcaaatatttgccaagtgctgatttctctatttgg

SEQ ID NO: 4213 - DNA, 201 bp, Bos taurus
ggctctagttccctgaccgaggattgaactcgaggccccagcattgagggtgtggagtcttagccactgaatcacaaggcaggtccttgataaaccattcagacatttttctggccttgagcctaaccactgtcttatggaaaagacctgatactctctctgtccctgtctctgtccatcgccaaccaccctctttccctc

SEQ ID NO: 4214 - DNA, 201 bp, Bos taurus
gtgccattgccttctcccacccttgatatataaccaggtatgaaccactgtcagtctctttaaatctactgaaaagttattttaacttgtgaatggccaagttaggtcccagcagtattaaaagttctggtttatttatttgtgcaagcccaatgtatatcagatcctgtaagacttgaggcctctttatatttctgtaat

SEQ ID NO: 4215 - DNA, 201 bp, Bos taurus
ttgcttttggacctgtgaagtatgagctcctcattggccatctaagtagatatgcaaaatagttattcaagcccagatatgcaaatttgtgattcaccagaataaagatgctatttaaggccaagacatgggatgaggttgtttagggagtagcacagatggaatggagaggagggataaggccaatgccctggggaaggt

SEQ ID NO: 4216 - DNA, 201 bp, Bos taurus
acatcaagattatatcagatttactgaaataaacaggcataaaattgcttacatagaccatttccgcaccaccgccccccgccccccccacccccccaccgccaaaatcatctaatcacctagaagttgaaagtgcttaaactggaaatccatgcagtaagaggttctgtgtttgttgctgaattcttgatacttgcacct

SEQ ID NO: 4217 - DNA, 201 bp, Bos taurus
ttattgttttacatgctgggtcatgaatgtggttggttattgtactgcatatggtggagagaaacaatagatacactcatttacattaagaagaggcccagctagagctatctgtagacatccactcatattggcataaacaccctaaactgtctgggtgcaatgacagggccccagtagcaatagcctcatagagaccag

SEQ ID NO: 4218 - DNA, 201 bp, Bos taurus
aggagcagaaatgatcacagcagaaagcacaaagtgccgagtacctctggagcatgacaaatatataagcaggtccacggtgacttttctggatagaaagcgtccctaacattttaagactcagattcagggacaccacagatcatgttgaaagcaggtcaataaaatgtcaataaaaatctacaattatgcaaaaaaggt

SEQ ID NO: 4219 - DNA, 201 bp, Bos taurus
ctgaaacaagtaaatttccagaacacactgtgtaatagtaagggaagactgctaattgaagatgagatgcagacctaaaaaataatctgagagaatggaagagcaaatacccttaaatcctgacatttttgaacatttttatgtgtttgcttttttttctatttgggcttgagattactacttcaagaagcttatactggc

SEQ ID NO: 4220 - DNA, 201 bp, Bos taurus
aattggttcctttcctttagttaattaggtaaaattctactgatccaatggtaatacggtttataaaaacagaaaggaacatttgcaatgttggggaggtgggaaacaaatcgtggctaacactgttacagattcaaacagattttaagattctactcatggaactagaatttaccattttaaatgcctgtgtttctactt

SEQ ID NO: 4221 - DNA, 201 bp, Bos taurus
aacatggttcattttcaaagtgggagatagggatagcagggaagtctcattgtgtatatttaccatcaatttatttgaatgatgacgggaacagcttcatagagggaggtgttgacggtggaggaacagttagaactcttgctctgccatctgtccactagctctgtgttccaccttcatcatggacacatcacatgagct

SEQ ID NO: 4222 - DNA, 201 bp, Bos taurus
aacatctcatattttattgataactttggtaatcttataagttgattttaatgttgttttcaacctaacaactatggaaaaagcaatttctgcatgcttagagaatatgagaactggcatcaaagatactcataggagaacacttagacaatttcattttctgagaaacatagcaatcttttatatgccagctctaaggca

SEQ ID NO: 4223 - DNA, 201 bp, Bos taurus
aggtgaattatcacttgctgtatctttactttattattatccaagactgtttttacctgcccacttttcaaggatcctgcaagtcaaacaaagatcttgggttcaagtcagtgggaaggtgcctccttccttctctctctgcctaacatctcttattcatcccaatggcttagttttagaattggttttatttttttcttt

SEQ ID NO: 4224 - DNA, 201 bp, Bos taurus
accaacattttatactctgaaaactattacacataaaatttttcttgctacattttatttttcctgtctgctgagactcagacttttaactctttgctaaggaaaataaaaaggtgctgagcaaaaagacaatagcaaattaaattcattcgagaatttttactctgggcgatctgctgttaatgcattggctagcagctc

SEQ ID NO: 4225 - DNA, 201 bp, Bos taurus
aacattttcaagttaagatagtgtagtgatatggaagcctaaaaccgcactcccctaagactcacatgcaagtaggcaaaaataataacgataagcaaagctaaggagtcaccagaagaaaccaactacaggacgagattggggcaaacatttccacctttcaaacattttattttctaataacagaagccaaagaatcta

SEQ ID NO: 4226 - DNA, 201 bp, Bos taurus
aatcccatggatagaggaacctggtgggctacagtccatggagtcgcaaaagagtcagacatgactgaaggaaaatagcagcgcacactcctgcacgtaagacatcagaatccctggctcgagatcagaattcctggtcttgggcaacttggcatcatcaggggtacttcctgtggagcagtatctggatagtcatgctgt

SEQ ID NO: 4227 - DNA, 201 bp, Bos taurus
atctctgtgttatatgctacatgcttttacttacttctctgtaccttttttccccctcacttttaaaattagaataatgatacttcctttgttagtagtattattatttttaaccaccttgtttcaagttcctctgcaattctgttgtctttaacaagaaatacagttgcaaaaaaccaaaaaacagtgcaagagtgattt

SEQ ID NO: 4228 - DNA, 201 bp, Bos taurus
ctgtgcagttgtagatgtgaaaccgtttagtatgtatccagcagtgagctcggtgaataactgccccttgcagtttcgttcactcggggggcctgttgatcactaaagccagatgctgtgtgacatgtgccctaccaccgtcaccttccatcttggacggatgcaggttttgaggagcaagttttactgaattaaattata

SEQ ID NO: 4229 - DNA, 201 bp, Bos taurus
tctattttccaaagaagaaactgagtttcaaagaagaaactgactcatctaaatgtattagctggtaattgacaaaggcatcatttgaacccagacctgtgattccaaggctgggatcattgattgctccccaacaagttgatctttggtgctaatttaaaaattgcagagggacttccctggctgtccagtggttaaaac

SEQ ID NO: 4230 - DNA, 201 bp, Bos taurus
caagcatccagtgttcaagcttgtctgggggctacctgagggactggtttctgtctctcctgactccaaatgctaactgaactggtggcataatttgcaaaatgctgaaaataggccagaaactagtcacattagaactacatttccacatgcaaataccaagaagaataagagatcagaaaatgtttgaaaggtcctgga

SEQ ID NO: 4231 - DNA, 201 bp, Bos taurus
attggccctcagttccatttcacttggcgtggaagggtagctcccttcttttctgttcctggtgggaataagttgaaaaacaagacaggggccagcagttggaaaagcaaataaaatctttactgtcaataaaggttgggttggatgaatttagcatgagaacaaaaatggacacaactctatatcctccaatccaggcct

SEQ ID NO: 4232 - DNA, 201 bp, Bos taurus
tgaggcatttaaaaatctctctgtatataatatgtaactaagtggggataagtttaaattaaacttcttcactatgagttggacctaaatgattttttacgtaagacatagtagatcaatatgttatatttgttcctttgctatgtcactttgtatatcatattctaattgcatttataggtatttataacttccctccaa

SEQ ID NO: 4233 - DNA, 201 bp, Bos taurus
acgaaagcatgatcatttgtattgagattctgaatcatatgcgccagatttcagggctttcaccctggattggctggcctttgggagcaggaaaacagaagaggaaatatccatgtttgagctggcatgtactgtacaattttatccagcactgacaagtccctgctgttggaaacctgtagaagttgtgcagtttgtaac

SEQ ID NO: 4234 - DNA, 201 bp, Bos taurus
atcactttcctcagagttaaattctgcctgcccccatttttctgggaaattaggatttacatattttccactcttccctttttcctccctctgcttgatgctatcttatgcatgaaattgtacaaggggttcaccttcattttctttttctctttttaaaaatgttttattttgtactgagatatagccaattaataatat

SEQ ID NO: 4235 - DNA, 201 bp, Bos taurus
aagcatttgagagggcagctgtgctgggtagaaccagcagtgggcatgacgaccaagggcgtggattggaatctagttctccacatcctggccaagcctcttaaaattgcagagcttcagtttcctcctctgtaccatgtgaatgatgccacctacatcacaggattgttgctatcagaagggttttgcatgcaaacactt

SEQ ID NO: 4236 - DNA, 201 bp, Bos taurus
agctttttctaagacctcgaccacttcattcttctttaattgtatagaattgacacttggaggcatctaactgggatgtcagtaaccttacacaactcagcactaaatagttttcttccttataaagtctagaaatcaagaaaagctgaggatatagctaaattatttaggcaatagcacctatgaaaactcaggtaaaaa

SEQ ID NO: 4237 - DNA, 201 bp, Bos taurus
ttaatccaccctacaaaacaggaaggttatatctaattaatttcactttaaagaagggtaaattgagacccagtaaagtacagttctatagctagtgaaatgagaccaaaatcgggtctttggactcaacagttttcttcacatttctttaaattatgatggctttatgctacaaagcatcgctatgaacaaagctagtgg

SEQ ID NO: 4238 - DNA, 201 bp, Bos taurus
ctgatctgggtagatatttaccccagactcctccttccattttttgttttctttttcttttcatgtgtcattcttgtgatgaatatttgaacatcagcgtagtgcttacataactttaagtaccaagcttttcagagggaactggggcagccaagtggaacatattatggctggggaggggggaagtgctaccatgttgat

SEQ ID NO: 4239 - DNA, 201 bp, Bos taurus
gagataagagtattgctgaagaatactgcttaataaacctgtgagaccctgaagttattctgcttttattaaataattctacgggaaactggccagagctctatttttcctactagtgctaccaaaggcgagcatagttcaagctttatcttttctgtgacagcattttattaatctttgaatccttagaactgggcctcc

SEQ ID NO: 4240 - DNA, 201 bp, Bos taurus
agtgtatgaccttgaagaaggtcatacacttggtaccattgaagatgggcctcaaagtgaggcaacctaaatccagagcctatgcttcttatgatttactgtgttgcctctctatttcccctcctgggtccttgaaattatacatctaagttttctaagcatgtgcttgaagttgtggggacaaagagggaaagaggaaat

SEQ ID NO: 4241 - DNA, 201 bp, Bos taurus
aaggaatcctaattcttatgacagttgcacactatagccctttctcagagctctgcaatgaacaatcatcacagtttctttggagccaggaaatggccttattccctaacttgccagattcaatagataccttaagacaaatagatgagatcatgtcttgacacctctaaatcagatgaggcccttcagatgtctaaggag

SEQ ID NO: 4242 - DNA, 201 bp, Bos taurus
atcaaagagagcagtgaggggcgtgctcctctgctggcctgcctggtaaccaaggagtcaacctgttgttaactttccctataactggtaacctccccctctctctaagtgcaaagatggccaccgcgtcctgcccaccaactgccacacatggtggggtggctccaggaccttgtttgagacatataagagcccccatcc

SEQ ID NO: 4243 - DNA, 201 bp, Bos taurus
aatgtagtagtctgatttttccccccctagaaaagtcatcattaaatcactggtgaatctttcaaagtgtctcagaaggccacgtgaaactcaactctactactggtcaacagaggcagccaactcattactgtcattcgaaaaactggagactgggtgggtcaaggccagaatgtgctggaggccctcccagggctggac

SEQ ID NO: 4244 - DNA, 201 bp, Bos taurus
ggtactgttagtcactattctatggtgcttctctaggtctcatataaggaaggagacaagaagcttctcctgggaaaaatcattatggaactactaatgatctgggtcttgatggatgagtcccatttcactgagtaccatgttgaagtgtgtatgtgtgaaggtggacaggagagcaggattagaagaaggaccacccca

SEQ ID NO: 4245 - DNA, 201 bp, Bos taurus
aggcctggtgtgctgtgattcatggggtcgcaaagagtcggacacgactgagcgactgacctgaactgaactgagctggtaaataaacagccaaaaaaaaaaaaaaaaaacaaaacaaaacaaaaaacacccagaaaaccaacaaacagaagttaattaataatgattttatatatggagttcaacatatcattactatgg

SEQ ID NO: 4246 - DNA, 201 bp, Bos taurus
ctgtactacccaatgacccctcattattaagattgttccttctaaagcccagagttcagagaacaaactccaggctgttctctgtgaaggggtggcccatggtgagaacaagaatggacaaccgaatccatgatggctttgcatgaaggaccctgtccagtagcaataaaggccactagttaagtcaattagacaaaactc

SEQ ID NO: 4247 - DNA, 201 bp, Bos taurus
aacaactcatattggactgacctgtgccaaacaaacacttcaacaaactcagaaatcgaaccaaggtctgcaggtggattctttaccaactgacctatcagggaagccctatataattatttatggggatctatattacaaattttaaggcttgtctgagatgtagttatatattaaaaaaaaaaaaagactagctgaggg

SEQ ID NO: 4248 - DNA, 201 bp, Bos taurus
ggatatccaacctgagggaaaaacacagacagcaacagcaacctttgagacctaatttagacttccacacccactctacagggacttcaccatcagcactcggtgtctgggccctcatcatcatcatcatcatcatctcatgaaccacaataagctgtgaaaatgaatgtcaggctttcttcctatctttctaaaagtact

SEQ ID NO: 4249 - DNA, 201 bp, Bos taurus
agaagagggtggagggagtaaattatgacattgaaggaacatgatttttgtttcagatagcaagttgtaacgtgttgaaaatttagcagtttttaaaatacgtattcatgtcttgggagataaagattgtgccagcataaggcatgtcaaagcataaccaagctaagccatctgtatttcagcaaggtggagggcaagtcc

SEQ ID NO: 4250 - DNA, 201 bp, Bos taurus
ggtcgcaaagaatcggacatgactgagcaactgaattgaactgaactgaaacatgaagcccgattccaccaagatggtggaaacaatctcagttaggaccgtggcctgggttcatgaatacccccttttccagggtttttttctatgttccaggaggatttatgtggtagcaaaatactgttgggagtggaggtaagaagg

SEQ ID NO: 4251 - DNA, 201 bp, Bos taurus
ggtattaatttataagtgattttttatttgaaacttttcattcattttaatgagtcctaatgcacagattctgactataacctttgcaattgaatcagtgtttctcaacctatgttctcaagaacactggagtttggtgagaggtataatgaagttctgtaacacaaaagtttaacaataaaacatttttgggaaatggca

SEQ ID NO: 4252 - DNA, 201 bp, Bos taurus
ataccttttgcctctgtgcagaaatgtaactgagttcttaccaatggactatcaataggattgatgttcaccacttccaggccttgtctatgtaactgttaatatccattcttccattctaaaaatttcatagaatttgttcaatgaatttcaattccaagtgaccttgtgaaacgcaggccaaagttgttaagacctcag

SEQ ID NO: 4253 - DNA, 201 bp, Bos taurus
gattttgagtaagtaaataatgtattacaacggaaagtgcttgaaataggagtttaaaccaatctgaatttgaatctcagcctcagccttggttggtgtgcaatcttgggaaaactactgaaccactctgattttgatttcctcatccataaaatgggaagagtaatgctcatctcacaggataatgctaacaattatgta

SEQ ID NO: 4254 - DNA, 201 bp, Bos taurus
ttgccactgagccaccagggaagccagtccagtggggagtcagtgagcaattttaaagaggaagctcagtgtaggcctaattgagaaaatggtaactgagcaaagtcttgatggaggtgaagaagacggatatgtggttacctgggagaaaatccttctatttagacagaggaaagggctgaggaaaaggcccttccatga

SEQ ID NO: 4255 - DNA, 201 bp, Bos taurus
actgattataggtctgaatgggcaactgaaaaggagcagttacctgaacctaatttcatagcactctggctacaggacaaggtgacagtccagactgtaaggctggacttccctggtggcccagaggctaagactccaagctcccagtccaagggcccgggtttgcttcctggtgagtaactaggtcccacatgccacagc

SEQ ID NO: 4256 - DNA, 201 bp, Bos taurus
aatagtagaatcagagttggaagtaacccgcgtgtcttttcatccaaccccctcatttttctttttagcaattctggggtgtgatgtaaacagacggtagcgagtccacatgctccagactcactcattaaaaacacaaaacggcttctgccactcttgtgttcctttccagctacgatgggtcccgcttcctttcttgca

SEQ ID NO: 4257 - DNA, 201 bp, Bos taurus
tagaggggttggcgtgatgggccatcgagaggacctagaaaaatcagaaactagcctaggaggtaatctgtacacagcattgtggtttctgtatttacacgactcagccggagaattactctggcctcttgaaaaccattagtgtcaaaggagtgctttgggaggctgaaggaaaataattgtttactcagctgtttttat

SEQ ID NO: 4258 - DNA, 201 bp, Bos taurus
cccatatgtcatgtcagttacacaaaaaattttatgggttctctgctttagttttcaagataggtgtaaactgtgttttgtaaaaataccctaaatcatacagaatcatgttttatgaataattatttgaatggctaatttcatatactttgaggaggctgtcatatttttattgcaattactcttaccgtctgatagttg

SEQ ID NO: 4259 - DNA, 201 bp, Bos taurus
gttgtaaatgaaagaggaccaagggcccaggggtcgagcagccagaccaagagacagcctcatagacgaaatgacaagtgagcttcaagcatctctgcttccagtgggccctgggtgatcaggtcatgttgaagacagagacctaaacagctgatgataggggatgaaagactcaggctccttgacacaggagctcccttt

SEQ ID NO: 4260 - DNA, 201 bp, Bos taurus
tgggccatgcgaggagagaatggtttatgccccacaaactccgaactccctaaagggctccagcaaagcctttttgaagcccagataaggaaggcaccccggggtatgtgatgggcccatgtacagttttctgattggttgatggtgaggtaacagggcagttaacattatcaatccttaggcgcctgtaggtctggggtc

SEQ ID NO: 4261 - DNA, 201 bp, Bos taurus
agcataagagatatataaataaaagttaaatgcaattcctcaaataaaaaaaaatacttaaaaataatttgaaggaaatggcctcatgaagtttgttgacgtcaaggaccataagagatttcaaagaattttaatgttttttgcctggatctgctgggcccttgtccttgaaacaaatactttaaatatgcttaaggaaaa

SEQ ID NO: 4262 - DNA, 201 bp, Bos taurus
gttctgttgggcagtgctgccagcatctcgggggttgccgaaagtgaggtttatctgtcaggctagtcagctagctctgaattttccgtatagaggtggagatcaggaagctcaggcccccagctcccgtggaggtaacagtgagtgacaggagtagagtctcccatgagatagcgtcactcgcttcagggagctcctggt

SEQ ID NO: 4263 - DNA, 201 bp, Bos taurus
gagggtgggaggtagtgtaatagcacagccagtatagcctgccttgggctgaggattcctggcacaccccaagacctcatggctggccaccgtgtgtcctggatgcattctgctgccttgagaacatgtggtccggtgttgtagagagcaacagccttcaggccttcagcgtcgtgttgccatgacaacagacaactatag

SEQ ID NO: 4264 - DNA, 201 bp, Bos taurus
acgaaggcttgtcagccctcagcactctccctactcggtggcgttagtaccactccctttccatcacatccatcctgtgcgctggtgtagacagtctgacatggtgcgagaaaggccatgtcatttttaattggaaatgtaagaaaagaaagcctgcttggtggaatgtgccagaaccaaggaaccagacaccccatgaca

SEQ ID NO: 4265 - DNA, 201 bp, Bos taurus
tcccagttcccgcgagaggatacggtaggctgccgttcccagttccggagagtggatacgtgggctggctcgttccgctggagctgagaaggcagtggccgcagggcatcttgctcctggtgtggaaggactctttgccacccggttggagtgaagccaaggagaagcaggaggaggccacggagaaagcaggatacctct

SEQ ID NO: 4266 - DNA, 201 bp, Bos taurus
acctgtccccaggctatgatgctcactggggccccagtagactctggaatgttctggaacaatggaagcctctgattctggccacccaccagtggccctttgccctcacatgcaagcctggagcacccatgctgctgggtacccatctcctggctcccagtcatcttcctttggccaccaagtgtgagggcagagaccatc

SEQ ID NO: 4267 - DNA, 201 bp, Bos taurus
agcttgtaccccctgatggctgctcctatagacatcatgtgctcaaaatgtggctttggtggctaatgcaaaataaggcctaccctcaaattctttgaattttatttagtaatagatttatccactgatgtgttcattccagatgctgtgttggccttgttgtacaaaggtgtaaaaaatagagttagccccagccctaca

SEQ ID NO: 4268 - DNA, 201 bp, Bos taurus
gattttatgatgatgaggttagctttctgggttttctccggccactcatcttgactgtgcccacatttggttcaattcaaggcccttcctgctggcacacacatctctcagtcaagatgtttcccagcacgagcgttttagggaggttggcagaacatcttatgggttggcctctcctccctccttttggcccctcccaag

SEQ ID NO: 4269 - DNA, 201 bp, Bos taurus
gtgtatcagtgactgtgcattgaacccttttcggagacaatatcaaaagtataaaatagagacaatttgtgaatgtgagatttaggccaaaggtttttcagactttcctttgtactaggtcctaatgtgttcagttcagttcagttcagtcgctcagtcgtgtctgactccttgcgaccccatgaatcgcagcacgccagg

SEQ ID NO: 4270 - DNA, 201 bp, Bos taurus
ggccttggctgaagctcccaaattctagaggcttgagggctcagtcactccattccatttcctcaaagcaaagttctgatttaaatttatttttccctagtggggtggaatgggagtggggaggccggctcaagagggagaggatgtatatatatagttatgactgattcacgttgtacagcagaaaccaacagaacactg

SEQ ID NO: 4271 - DNA, 201 bp, Bos taurus
ctgaaggctcaaatgattagctggagaaatacagaaagagggaggtatggcttcatattagcacatttgaaagaggccttaagattttagatgattcagtgcgactccactgcaagaggctgccacaagggcaacttcaaacttgggctgtcttaaaagacatacagtatgcaaagcaggcagtaggctggccctcaccac

SEQ ID NO: 4272 - DNA, 201 bp, Bos taurus
acagtatgggaggtaaggattagctacaattactgttaatatcatgactatacttactatttccacccaaccgtcttcctggcctaccttttctaatcactgttcgagacgtttcttcttcacgagtgaagcacaagcagtaacttaaatattcactggcttttttttgtttcctggcagcctggccactgcctcttgttg

SEQ ID NO: 4273 - DNA, 201 bp, Bos taurus
gggcctggagcaagagaatagagtgctactttctgtatttcctcccttttttttgtttataattctcaatatcctgtcttctaaacatggctcctgtagaatggccaatttaattaaaccacacaggaggagtggggaggatttggaaagtgttgtgcagtgtgtgtccttgtcaccatggggccatgggagaatgtgggt

SEQ ID NO: 4274 - DNA, 201 bp, Bos taurus
gagatgagaggcttcttgttggccactcatgaagcagggcagccactcttgagagaaggatttatagctgtcaacatcagggtctcttgctaggggagtcgagggcctgactgcaacggagtgaaagggttcaaaagaaaacttagagtcagtgagagtagacagcactttcaaggaattttattgccaaaagggtaaaga

SEQ ID NO: 4275 - DNA, 201 bp, Bos taurus
cccacatgtggtgcagccaaaaggaaaaaacatgaggaccagcacctcacccagattgaggcagggagacgtggaggaaaggaaggtagggtggaaccagggatgtgcggaaccagggatgtggggacgggagagtcagggaaagtgttcctggagaaagtagcagaacttgaagaggcaagcagacaagggtgaggggtg

SEQ ID NO: 4276 - DNA, 201 bp, Bos taurus
gatattattatgagtgtcttttggttcatccccattgtgaaggcctccctggagcctccccttaaaatcaagtggattccactttccaagcctttattgagcacaaaccatgaggcagacgtggcccctgtccctaggaagtcactttctagcaggtgatgtggacacggcactgagtagcatacagcaatgaattcctgt

SEQ ID NO: 4277 - DNA, 201 bp, Bos taurus
gagctcacatagtaactcaagtgatggggagcaggtataaagctgtgctcagttattcgttgcttatctcctgctgtgcagcccagcttctaacaggccacggatggtactggggggttgggaaccccggactaaaggacctactggaatgatactgaatttatcttgctgagttaggggtaggtggtggcacagggtaag

SEQ ID NO: 4278 - DNA, 201 bp, Bos taurus
acacagctttgcatttagatgcaaataaaattttctatcttagatgccttattcttcttagcttgacctatgttatccattttcatctctccctggcctcgttgtgcttttatttttctccttggtgagacacaccaagaatttccaactcaacctgaatggctcagaagacaccagctcagaggcccataaaaggaccgt

SEQ ID NO: 4279 - DNA, 201 bp, Bos taurus
tttatataaaagtagaacttaaaacattgaaggcacccttagcaaagcctaagtttgtagtatgtgtgattgagataaaaacaagttaacaagttaaaggtgtagtcatcttttccccagtatcttttagaaaatgaaaaaaacttctcagaggcacttaccaaagggcagactaaatgacacactacacacccaaagtct

SEQ ID NO: 4280 - DNA, 201 bp, Bos taurus
cttgaggttgggactactatcatatcccttttacagaggactaactggtaatcaggaggattaactaaattacccagttttatgtggctattaagtggtagagttaagactgagctataatatgggaggaatattgaccagagggaaatgtcgactgaaagatttacccagatattttctcctaatgctaggattgagcaa

SEQ ID NO: 4281 - DNA, 201 bp, Bos taurus
ttctcttatcccctagatttctattccctccacatttaactctgtaaaccttaatataatgtgccctacttgtatcctttgttgtttatgtgaagtgtgtagtgttagtcactcagttgtgtccaactttaaggatggtagcccaccaggctcttctgtccatggaattctccaggcaagaatactggagtgggttgtcag

SEQ ID NO: 4282 - DNA, 201 bp, Bos taurus
catttcttcaacaattttcaactttctctcttgctttattattctctctccttcctttagttcattacccctttctggtacagcgacatactttttggtggccatggtggtttagtcactaagctgtctccaactctttgcaacccctgaactgtagcccacctggctcctctgtccatgggattgtccagacaagagtac

SEQ ID NO: 4283 - DNA, 201 bp, Bos taurus
taaaaattatatggtcattgtatcagccttctctaacaacagagtaacaatgtcaaaaaatccctttctttgactcatggcttttatgggacctaatgctatttcattacttagtgacatagattttttaaaagcctgccctaagtatatgaattagtattaaaataaagttactttgtaaaagcaaattgagagttttgg

SEQ ID NO: 4284 - DNA, 201 bp, Bos taurus
tcttgggtcattctgagaccagcattatggcttactgtgattgatagccccatcgaaccacatggactttgagaggagaaactctctaaagaaagaagagggttggggtaaagatgctgggggaaaaaatatgaagtctattataatgcccaataatatgagtttggttgaaaacattgccatagtaatataaattaatac

SEQ ID NO: 4285 - DNA, 201 bp, Bos taurus
agcagcctggatccagggtggatgcctcctaagactggtgaggacaggcttcgatacatgaagcactggtggagagggagaaagagcccacagggagcttagggaccaggtgggccagtgggggcgaggaacactgaccatggacggggtggggggggaacacggggtggggccaggtaccaccagagagagtgcagtaat

SEQ ID NO: 4286 - DNA, 201 bp, Bos taurus
aagatgtgacagggactaaggatgtggtcagactgaattagggccacatctttgcagaaaaaatgtagctggacacagtcacccaggctttctccatggggacattgagggaaggtagtcctggccataagtatagctcttctcagcttgatgagcagctgtagaatttattttcaccacttgggtagaatacaagtggag

SEQ ID NO: 4287 - DNA, 201 bp, Bos taurus
tggagtcgcacagagtaggacacgactgagcgactggacaacaacaacccatctgctaaggctggtccctccaccacagaactggactccttttcctctcgccttactcaagaatttcgtcttaaacacatttcccttatatcttcacatttccctttctactagatcaataccatcatatcccttaacaacactctcctt

SEQ ID NO: 4288 - DNA, 201 bp, Bos taurus
cccaaaatggtgattcacgcaacctcaccgtttccaggtttcaacatggcttccgtaacccgcgccaacagaggttaatctcaggacgccggccgaacgctcgcggaagtagcgtcagcggaagtgcgtcagcggaagttttttggaactcagctccccggctctacgtcccgcccccgcgctgacgccccgcccccagcg

SEQ ID NO: 4289 - DNA, 201 bp, Bos taurus
ctctacattgtctgggtcaccctggacttttgatctcttagagttgtccacgctgtgcttccagcaattccacaattacaattctggtttctctaccctgagactggctcccaaagaggtttctgctccaatatattgcctttgtgtctctccagatctgggagcgatagtttgctcggtgtatgaaaagttgctggtttt

SEQ ID NO: 4290 - DNA, 201 bp, Bos taurus
atgaatgagcaactaacacacacacacacacacacacacacacacacacacacacacacacatttggttgtaacaggtcttagttgtggccctcaagatctttgattttcatagcattcaggatctagttgcagcatgtgagatctagttccctgcacagggatccaacctgggccccctgcattgggagggcagaacctt

SEQ ID NO: 4291 - DNA, 201 bp, Bos taurus
acagaggaacctgacatagtgaaagctcagatttttcctttacagttctgtttgctaggagtctgaagagagtctccatgggccaacatcccagtggtcacagggctgtgttcttcctgcagtctctggggaggactcctttcccagccttttgtggtttctgtgtggcctcatttcttggctcaggaccctctttattct

SEQ ID NO: 4292 - DNA, 201 bp, Bos taurus
catatacttaagccctacccctcacagtgaccaagtaggagacagggcctttaggatgtaagtaagcataaacaaggtcataaggatgtggccctaatgcgatatgtgaccttatgagaagaggatgagacgcctcttcctccctctctccagatgctcatgtaactggaaagcccaggtgagcacacagtgagggagcca

SEQ ID NO: 4293 - DNA, 201 bp, Bos taurus
ctattaaaaaaaataccacttatgtttgctttatgcttcattgatcattcgtgaagacagtttgtgtatgtggataaactgtatataagtcatcaatctgaggccataagaaatgtgaacaagctagtcctgcatgtgaccagtggagtttcaaattttaaacagcacattatattcatttagttattccactttattcaa

SEQ ID NO: 4294 - DNA, 201 bp, Bos taurus
ggagcccagaggggaaaggagagaggtggccacacaggcttgatgatacaagaggagagaatgttctccttcatttgaagaggagaagtgggctccaagcatggcctgacacccaaggctggggacaggaccaagaggtagaaagcagccccttcaagtacccacctggacagagctcacccctgctccgtgatgcctccc

SEQ ID NO: 4295 - DNA, 201 bp, Bos taurus
gaaccctggttgttcctgaaacagagctgctggctgactaaggacaagaagaacagggttaacggagaagagaaggccaggaaacaacccccctcagctgagatttccagtgtctttagggtaggaaccctgaacacacagccacagttcccaggaaggccctgaggaaggggggattcccatgagatttagaaagggaca

SEQ ID NO: 4296 - DNA, 201 bp, Bos taurus
caggagaagccaagtcccagcctccggcaattagcccagggcggttcgagggtgtgggacccgcctttcttttgtgcagctcagttgggatgaaagggttgctgggagaggggccctgaggcgcacaggtgatgctccaccctcgcaccccctggagggtgacgcctccagggagctgagctgcctgccgagttgcccaat

SEQ ID NO: 4297 - DNA, 201 bp, Bos taurus
gggcccaggagatggagaagagcagtagaaacttatatgggatggagctagactgtgagtcccttgagaacaggaaccatctctgattccttcagacggttcccagcacagcacaaggcctggcacatagcaccttctcagtatgtgagtggagtgaataggattcaggagtctcgggctacaaaggttccagtgctgcgt

SEQ ID NO: 4298 - DNA, 201 bp, Bos taurus
cgggccagttctgggggccaggaactaagaacctgtgtcggaggctgttgtccactattctaggtgctgctccctttttctcagccggttggataggtggcggcctgtaaccttgttagaggtactttaggatctgtggcctgcactctgggtagaggtgatgaggaagctgagtttcagagacttcttgtgggcttccat

SEQ ID NO: 4299 - DNA, 201 bp, Bos taurus
ccacacagaacctgaccgagctggacacgaagatccaggagaaggccatgaaggtggacatggacatctgccgccgcattgacatcactgccaagctctgcgacttggctcagcagcgcaactgcgaggacatgatcaagatgttccaggtgagggttgccggcgcctcgccccagccccggcggccccacctcactggtg

SEQ ID NO: 4300 - DNA, 201 bp, Bos taurus
ttgccctctgggatgttcagaagcccaaagagccctggggacagaggtcatactggtgaaatgaaggcaggagatgaactggtatttgagggtaagggccatgtctttggacttgcttgaattacagcaggattccggcggcaagcgcttgccctgcggacaggacccctcagggccttcccagttccaccccatctggaa

SEQ ID NO: 4301 - DNA, 201 bp, Bos taurus
cggtccttggaggtcaaaggggagtgatgctaactaatgctggtctatccagaggcctttgtggtagaatccagcttgactgagatgtgtgcatacatatgggaggatcctgagatatacgaaatatggactgtgaaccaggcaaataaaaatgattagccaaaggaaacctggaagaaatacaccaaaaaagtaattcaa

SEQ ID NO: 4302 - DNA, 201 bp, Bos taurus
tgacatgtgtccttttaagaaacacagaggggagacagagagcgagaaggagagaccatgtgaagacagaggcagagactggagcgatgtggccacaagctgagaaaggtctggagcccctggaggctggaagagacaggaaactccttctctgtcttagagccattggaggagcttggccttgttgccatcttttttttt

SEQ ID NO: 4303 - DNA, 201 bp, Bos taurus
ggaggctgggagaagtggttatctgcagagagagagggtggggcaggagtcgggggtcactgagctggggttgggggtggggtgtacggatggcagaagcggggggcactgaactggagtcgggaggtcgagtgtgcaaagggcaggagtcagccagacccacggccggtggaggcatcaggcccagtccctctggggttc

SEQ ID NO: 4304 - DNA, 201 bp, Bos taurus
gccactaagcatgctattctttttagcctaacctagaagcaaaagggcttcaacacttcctgctttaaaaaaaaaaaaaaaaaaaaaggccacgttctctctctccttattttcccagcaacatttacaaagttgggaaagtctcttgatacttgagcccaagagggtcttatctgccccatattgtcagaggcccccaca

SEQ ID NO: 4305 - DNA, 201 bp, Bos taurus
gtgatttggctcctgggagctcagtgtgaaaatatatttgggtcactgaatattgccattaattggatctttttagagaatattttccttatttttggccatgctgggtcttcaccggtttgtgcaggctctctagttgccgtgagcgtgggcttctctctggttgtggtgtgcaggcttctcgctgcagaggcttctctt

SEQ ID NO: 4306 - DNA, 201 bp, Bos taurus
gctaaacaacaacaacaatccaggcaacatgtacgctgacaatcacactaggggaccaaggtgagactaagggtagtggcctggatgatgaagggagcccatgttctccttcccaccacagactgacaacctctcagtggaacaaagtttcagtcatgacctagtgtgtctccagcactgggctggccatcactgtgcttt

SEQ ID NO: 4307 - DNA, 201 bp, Bos taurus
cctcggggacattacagagccccccaaatttaaaatacaaaagcactttgaagatcaaggaaagcaacaagggaggcaggggtccagacgacaggcctagctctaagaagtctttcttctacaaggaagtattcgaatctcgtaacgcgggtgatgccaaagagggaggaaggaccttaccggcggagagaaagatgttca

SEQ ID NO: 4308 - DNA, 201 bp, Bos taurus
ggggacccaggccaaggctggagcttatagttggaggggaaggcgtggggtctcagcgaaggccctgggcagcaggcctcagcctagaaaccttccccacgctgcccgcagcctccactgtgagtgagtgctattgaaatgattctatgaggtacccttggcctagagcaagctcactcgattcatggacatttcacttct

SEQ ID NO: 4309 - DNA, 201 bp, Bos taurus
ctggtgagtgaggcagaagatggctgaaaaataccagttgtcaaaggatgttggtgggtgcctgaatacaggaaggtttcctgggaggaaaaggaggatcgagggagtatcttgagcaattgcttggcgttgatgcagaaaacataagcttaggagtctgacagggcttgaatctgagctctcgccctttacagctgtgtg

SEQ ID NO: 4310 - DNA, 201 bp, Bos taurus
gaacaagagtgtgcctgacagacagcagcaactcgggtacagtttgctcattcactctcaagatagtaaacgctcttagccaagggcatcatagtcatggacttccctgggggtccagtggtttagactccacgcttccaatgcagggggcacaggttcagtccctggtcagggaaatgctgcaggccttgaggagcgtgg

SEQ ID NO: 4311 - DNA, 201 bp, Bos taurus
ggaagcccttaagctttttaagtacctattttggccactggtgttggtgttgacttcgcagcctggctgagggtgcagtgccccaggggacggaagtccaggaagtaaagccatggggggcagtttaggtgaatggacttcactggcctgctaacccttaggtccccttttctagtttcttggcccatcacagcaccttgc

SEQ ID NO: 4312 - DNA, 201 bp, Bos taurus
gtggccagtaggaagaagctgtggctgtaaggaattagtaatgagatatgaagttgctcacctccaggtcactagttcaaaaccagatcagcagggagtcaaagttcctgaccaaggaggccacggaggtttgtttgaatggctggaaggcaagaaattcgttttctcagaagtcagtgccggccggtcagccagggccac

SEQ ID NO: 4313 - DNA, 201 bp, Bos taurus
ctttgtgatgacatctctggggattcaggactttctagtgatgtcgcccacgaataggaggagaaagacaatgcggccctcctggaattggcatggtgggcactgcacagggcttaggggtgagtctggtgtcagggcagaacagtcggagacaaagctgggcgtgcgtgttcatggttgaggcctgaagggatggcgtgg

SEQ ID NO: 4314 - DNA, 201 bp, Bos taurus
ctgaagcatcctggaggcagaaagctgtgttcagtcccgggccagagcatcaccaggcttcctccaaatgtgagacggcccagcccagcgcagggcttcctttctatttggaaatgaaagcagaagcacttctgtggctttgtcttctcttccccttgggaaccccacagatactatgggaagatttctggccaagtcaga

SEQ ID NO: 4315 - DNA, 201 bp, Bos taurus
gacggatttgagaataaagagaagcaaacactccacgggatggtggccaccccagttacgtagccaagcctctttaggcttcagagaaaaaagcaagtcctaggatgagggctgagaggagatggccagcgtcaggccctgtcgcacactttaccacagtgaccacacaagggcaggccgagaccttctagagctgttgac

SEQ ID NO: 4316 - DNA, 201 bp, Bos taurus
ggagaatgactcgcctgcccgcctccttcagctggagaaaaagccaacacacagcctagagggccggctgggcggggcggccgagaatgcagaccaggccctccagactagttctgaacacaggctccctacggctcctgggtggggagcacggttacaccgctccagccagcatcacatacacacctcacctggccccac

SEQ ID NO: 4317 - DNA, 201 bp, Bos taurus
cgcctgaggaattcagggcatcccgggcccagcattgttcacatcacacattcctcttcttgaaaagctcctggatagctctcattcctctacctcccggaagaaaccatagtagaggacgggccaccagatcccccatgtgatgggaacaaaggggggacagccacagggtacccctgcccaccagctccctggcagggg

SEQ ID NO: 4318 - DNA, 201 bp, Bos taurus
aatgcacaaaagcatctctctatggctgaatggctaactaggacattcccacactgtggaagggtttataaattttaataatgcacagcaacctggaattcgtgcaccatctccaagactcctcctgcccactaactgtaagcagatttaataagccctgagatacagacaaggaggtgtgctgattctctgacagtcccc

SEQ ID NO: 4319 - DNA, 201 bp, Bos taurus
atgataaaccctatcacagtggttacaggactaaaccagtaaaacactgaatttatcagcagcaaaggggaaagtatttatgctacatttcctcatgcttactaaactccagtcatccaatcaggtctggtttagagagaagagggaaaccagaaagtccaggagaggttaagagcaattaccagcttacaagtgagccaa

SEQ ID NO: 4320 - DNA, 201 bp, Bos taurus
tagacgttgttgtatttgagaggtgtgtacttgctcaaggagaagaaaaaagtggcctagagagacagggggagggcaggcgcagatgcaggaggggcccgcgaaccctctcctcggggacggagcacagttagatacactggtgcttctggaggtggagagtacacgccatcgcagaccgtgggccaaggcgtcagtcac

SEQ ID NO: 4321 - DNA, 201 bp, Bos taurus
agagcccaacaggtatctcaagagagtctttaaaaacaaaagtaaaaattgtgttaagtcacaatcatctaatccagaatatgtgctccttgctctctacgtgtaactcatattcctaaatatttaatcctatctcctaagtgatatttacatttccctttagttatttaagctatctctggattactctacgcatataag

SEQ ID NO: 4322 - DNA, 201 bp, Bos taurus
cctactgggcggtaggggagcggctggcctcacggggcgctcttccggcgcggaggacgcgtaatgagccgggggcagaggttctgcttccggcaagctgagctgggcccttctttgtgtacgtacggaccggaacacaagctgcctatcttcgcccggctgcctgtttcaacttccgtgtccgcctgtttctaaataact

SEQ ID NO: 4323 - DNA, 201 bp, Bos taurus
ggagcacctgcctgtgaggctttaacacctgaaaggagagttttggaaggaaagtgactctccagtcataattataaccagactggcccgctgccctccataagcaggaaagctggttctaaacatagtggggcgctgaccctcccctttgtaggtgccctcacttggggtggggggcggctgtgtgcctgggcctcgggc

SEQ ID NO: 4324 - DNA, 201 bp, Bos taurus
cagtagccacagaggtaacatggagctcatatgagctaccccaccagtgtaatcagccttttcccaaagcaggggatttctaagagcgaagcagaggtcactgcaaattagaattgctttggaggccttaactcttcattgaaaactgccaccatatttgtggtccctgggattaggaactggaggtggggtggcaagtaa

SEQ ID NO: 4325 - DNA, 201 bp, Bos taurus
actttaaggggggcttgagaagacaattcaagacaacaatagcagaatttaaatctacattgaatatcatttaaaaaaaagcagatgccacagaaagtcagtaataatgagaagtgaattcaaagaagagagaaacaatttatggatagttgagtttctaaagggaccaataattgatagcctagaagatgatttttctga

SEQ ID NO: 4326 - DNA, 201 bp, Bos taurus
gtcactttggtttaatgatgttgaggtctcttcactcacatggaaagtaagaactggttttacttactgttgatttttttcccctcctgtggatgaaataactgaaacctagaggaatgaaccagtgctactgaactgtttaaattattttcgtgttaatagtacactttgagtatctttttccacattaaaaaaatcttt

SEQ ID NO: 4327 - DNA, 201 bp, Bos taurus
gaatggccagtgaggtaagaagggaagcctagaagctacttgtgaactgatttgtgttgtgccaaaattcccattgaagcttgtgccccagtacctcagactgtgactgtaactagagataaggcctgtaaagaggtgaaagttgaaagttaagtcgctcagtcatgtccgactctttgtgaccccatggactgtagccta

SEQ ID NO: 4328 - DNA, 201 bp, Bos taurus
ttttgaaccaaggcctttcttgtagggatcctggaattttccagtattcttctctttatggttttcctgacctagatgacaagcttcgtggtatgaatatgtagtagtggccaggtctgaactctgttttgttgctgctgttttaagaactcacagaaatatagtagcgactatgagaagtaggatttaaaacattaagaa

SEQ ID NO: 4329 - DNA, 201 bp, Bos taurus
gttaatgttatcattgcagtagttttcagtgactcgttagagctttgggcagtgtttgccataagaattctcagctagtaattcatatttgtgtgtaataggccatgtttgcctttctgatagaagtccatatttacctccccagaacttccttcttagtttgtatagattatcagggctagtggttttggttgtctaacc

SEQ ID NO: 4330 - DNA, 201 bp, Bos taurus
acgtgtgtacttcttaccagctcgtctcccttctgggtggcaatgcctggagggcggatgccaggcctgtcctcacctttgctgcctgtcgggcctggccgtagcagattctgggagtgtggacgaaagtcctgggggcacagttgtgtgtgggtcctggtgtgtagctgtgtctctgcagggaaggccgggtggttcctc

SEQ ID NO: 4331 - DNA, 201 bp, Bos taurus
tgtgcctgggcatcttttatatgtttcgccccaacatctcctttgtggcccccctgcaggaaaaggtggtcttcggattattcttcctgggggccattctctgcctttctttctcatggctgttccacacagtctactgccactcagaaggggtctccaggatcttctccaagtaagtatctgcagagtccctgtttggat

SEQ ID NO: 4332 - DNA, 201 bp, Bos taurus
ggcccgaacctgacgtgacagcacctgccctgggagctacgcaccagggccaccggccttcatggtgcgggccgacgtgtcctctggctgggctggcctgcggctgatcttcctgtgcaggacgcatgtcctcctgcctgtcctgggacaggacccgggggctgtgaccagtgtctgagggagaggcggtcacccgctacc

SEQ ID NO: 4333 - DNA, 201 bp, Bos taurus
gaagtggtcacattcaagagtctttgggatttcccgaagggccggatgagagaaagcaatcaagaaccactccagatctttgggcccatcaactgagagaaggggagcctgttgaggagcaggttttgcacagaaaacaaggaattccacattggatctgttgggttttgagatgcccgagcggagactgagttggccgtg

SEQ ID NO: 4334 - DNA, 201 bp, Bos taurus
tggccatgagggacagagtgggcactcgcaccttcctggggggagctggagcctgtccccaaggcgcaggctgggtgatggcccagttcattcctggggctcctgggaaggctctgcactaacaaagcacagcgaaggttcttcaggcaagtgggggagagcctccctttgatgcttatgctggtgacaacaggcccgagg

SEQ ID NO: 4335 - DNA, 201 bp, Bos taurus
tcaaccaaggaccccttggccgcgagctatggcttctggtctgtggacactggtagctaagaccactgactcaggatgggaaaggagaatcgcagaaagacgggcctccagaagagtctatagctggaaatatctgagaagatggactgtcattcagtcagcaagcgtttaccaaccatccccgagacagaaggaaggaga

SEQ ID NO: 4336 - DNA, 201 bp, Bos taurus
aaaaatttgtttattataaagtaatacttgcttacagtaaaagattagaaaagcagaacactgaataaacagagctaggcaacctctctggtgggccagtggttaggactctacactgttactgagggggcatgggtttgatccctggttggggaacaaagatcccatctgcattgcagtgtggccaaaaaataaaataaa

SEQ ID NO: 4337 - DNA, 201 bp, Bos taurus
agtagaagactggttgctgaaagtaggggaaattgagagaggctggagaaagggcataaactcacagttataagaggaatgagatctgaggatggtgactgtagttggcaacagtattgtatgagattttctagaaagtagaatttaaatttcttcccaccccccaagaggggtgtaagtacatggggtgacagatgtgtt

SEQ ID NO: 4338 - DNA, 201 bp, Bos taurus
agcctgtcttcgttaccgggcggccagcatgttgtgggcatctccaggggctttgttttgggggagaaaaccgcaatcagtggttttctgaaagggtgacgtcgactcggaaaaggtgggcctagtgccaggcactgctgtccaagtctggaccggaagcctggaggaagagacagacgggtccttggatgccgggagtaa

SEQ ID NO: 4339 - DNA, 201 bp, Bos taurus
ccccctggctcactcatctgcacctttttccaggtccatcatgtggttagcatttctctggaaatgtcatgcctttggtcaagctgtttccatggccaggcacaggcttccgtgtagagagggtagcctcctccaggaagccctccctgactgccttctctgggtcagctggctcctggggcccccactgcccactagggg

SEQ ID NO: 4340 - DNA, 201 bp, Bos taurus
tggtgcttgatctacaaaagcccacctgtgactccttcccaggtcctggttctcagccttatctgcgcttgacacaatcacaatttgcaatgatatcagtgccgtctccccagtggcctctgagcctagtatgaccaaaccaagtttgttttgttccctcctggccaaagtagagggtctttcaatgggagaaaaggaagg

SEQ ID NO: 4341 - DNA, 201 bp, Bos taurus
tgccgtgacaagggacttgttctcctgagggcacaactgagcaccaggggtgctgggtgctcaagtacgtgtcttgggacagagcatcacagaaggatctcggccctcagggtcaggaattctggagtcatggaaatccccagtattggttttggtcctgcccctctacaggggcaggagtctggctacacatccatccaa

SEQ ID NO: 4342 - DNA, 201 bp, Bos taurus
atagtgcccagaattgttgagagagcactggactgggagtcaggaggcctgggccttatcttggttcccccagtgactcattttgcggccttgtggttccgtctgggctccaattagactggattctggtcccagctctgacacgtcccagcttggtggctttgtgccagcgcttcacccctccaggcctcactatccttg

SEQ ID NO: 4343 - DNA, 201 bp, Bos taurus
aataaaagattgttgtcagtgggcacccacaggctcagggccttgtgctgagggcagtccgggaattcctaagcagccacttccagggcccatggggcacaagcatattcacatgcagaactgatcacagtgccaggtggggcaccctgtttctacagaagtggccaggggaagggctgctggagcgcagaggatggagac

SEQ ID NO: 4344 - DNA, 201 bp, Bos taurus
tccagcgtgcagttcctagacttccctggtggtccagtggttaggccttcacgcttccattgccgggagcacgggtttgatccttggtgggaagatcctgcgtgctgctcagtgtggccaaaaaactcccaagcagtccctaagtctgtggagcaccgggctgaggactcagccttaaataaggtctgaaagtggtggtcg

SEQ ID NO: 4345 - DNA, 201 bp, Bos taurus
acagtgtcacagcagcctgcggtgggaacaccaggccatgtgtgcaagagggcagctctttggagggtctgggctgtgactggggtactagggaggctgctggatcagcagggccaggaatcccttaccaagtggctgagtttagttctgtgggtggcgggggtgtggaaatgttttctccaggtagtgataaggtcagat

SEQ ID NO: 4346 - DNA, 201 bp, Bos taurus
tctccttggtgaggagaggacaagagcccccatccacagagaattaactagaacacatataacactgagtgcagggccagatacaagaccagggatgaagaacaggtattgatgagtgtgtcccaccctctgcttggagccaggctccatgtggcgctgtgctgggcccacagcggggtctcagtaagggtgaagttcaac

SEQ ID NO: 4347 - DNA, 201 bp, Bos taurus
ttgctcagatcgtgccatcggcccgtccccaccctccacgatacaaaactagacttgaccccgcatgcctctggtaggattgtccagctggaaagttgatattcctgcctctgctttgggcctggatgcctggccctccagagctggaagactcattagaaatcaactagtgaagcccaattcacagatgggaaaacaggc

SEQ ID NO: 4348 - DNA, 201 bp, Bos taurus
gggctgggagccagagccacgggaaggcctttctgaggggatgctggagtcaagatgaaagagctctgctggtactgggaaaacagatgtgctgtgctgggtgggaaaggaggccggcggtgctgcagggccggcagggcccaccctgtgcctgcattctttcttaagttcaaaggccacttcctgcaccctgcgagtctt

SEQ ID NO: 4349 - DNA, 201 bp, Bos taurus
atttatcctgccttctatgtgaagaataaatggtaggggcaaggtctaaaggaaggaagctagttagaaattattatcaataatccagaacagatattaatagatggtttaggccagtgaggtaacaaaggagaaggttgtgagaagtaattaaatttacatttttttctccctctctgtacacatatagatacaaatagg

SEQ ID NO: 4350 - DNA, 201 bp, Bos taurus
gggtctcacagctagcagaagaggtgctgggccacaagcccgtgtactctggctgcctgatgccagcatgaatgtctcacccacagttggaccggtcaacgcgggaggtggaactgggccttgactacggaacccccaccatgaacctggccgggcagagcctgaagtttgaaaatggccagtggatagcaggtgggctgc

SEQ ID NO: 4351 - DNA, 201 bp, Bos taurus
gtagtgggtccagttggaatgagtgctggccagcattggggcataggctcaagctctttgtgttctggagcccgcctcatgccctctgcagactttatccgtggccttgagtaggggcccttgagaaagtggtctgatccctgctccatacagcctgtctgagatcttggaatcaggctcaggcttgctttctctccagaa

SEQ ID NO: 4352 - DNA, 201 bp, Bos taurus
cagatgtggcaaggtgatcggcctcttgggatgttggttaggggcgccatgtgccacaaggtgggaaaatctggcagataagagctgtgaagcacctggcgcagggctgggcccaaagcaggggtttgagaagggtcagctctctcccctttgcagcctgggactcttgggagacacccagcttcctctcccttcagctgt

SEQ ID NO: 4353 - DNA, 201 bp, Bos taurus
cagtgggcctcagttgcctcacctgtaaaacagaatgacaaaaacatctactccataggatggttgtgagattaatcaaattctttcaaaggtctcaacacgggccaaacggggtcagaattcacacccagggtgaagccaggcagtgagggcagcagctacacgcatacactcagctgccatcgtagaagcccactctgc

SEQ ID NO: 4354 - DNA, 201 bp, Bos taurus
agggactccttgtcaaagggctgggtggtggacaatggtactgaaggattccccatgctcccaacgggagccaaaccggaaaatggtggccactagaatttgacagagccaaatcagaacatgacaatcagcacagtgtctctgtccgcccgtcagtaagttcatcatttctggtttctgacaactctagaggccaaagga

SEQ ID NO: 4355 - DNA, 201 bp, Bos taurus
gaggccacagggctgactgtggcttagccggggatgctgaccacttttcttaccgcatccaggcaggtgtgggcgtggctggtctggccatggccccgccgtccttcgagctccgggtcttactctcctcccctctctttgcaggatggtcgagtactccctggacctccagaacatcaacctgtcggccatccgtaccgt

SEQ ID NO: 4356 - DNA, 201 bp, Bos taurus
cagggctacagatggactgagcagcctccttcttcatgaagggaaggacggtggtgagggccccgtggagtcccaaggccgtgaggcatcatcatctctatagcaagtcacattcctgaggaatcggaccacacaggagtgaggctccagaaacccctggccaggcatgagagccgcagaagagaggaggccagcctctaa

SEQ ID NO: 4357 - DNA, 201 bp, Bos taurus
aagaactggctagaacttgagagatcctctgagtcatttccctactgcacagcacctaactcatttcagaaaggtggcctactcttcaactgtaacattttcaaagaaagattgctttaaaaattttttttatttggctgtgatgggtcttagttgtggcactcaggatcttcgtggcatcatgcgagatctttcgttttg

SEQ ID NO: 4358 - DNA, 201 bp, Bos taurus
tgacctctctgagctattctagagaactgaacagagcaacttggagttgtcatgagaaggaaacaagttaaagggaattgtttggtgagggccctgcaaatggtgggcagcccctcaccgcccccccaccaccaacttggcagagacaggcttcctcacctcaccccactcccagacatgctgctgcaatggcctctttgc

SEQ ID NO: 4359 - DNA, 201 bp, Bos taurus
gagaccaccaaaagatagctcccaaagttgccaagtgtccctgggggttaaaatcgttccagttgaaaaagagctctttgagctcagttgaaaaggccacatgctcctccctgggctgctttcctgggcatacctcctgcaaaaccattccttttgtttgacaggacactttggcccagagagactggttgacttgccaaa

SEQ ID NO: 4360 - DNA, 201 bp, Bos taurus
taacttatgctgacagaaagcacgttagtggtggcatagggagggagagcaggagggaaggattaaaactgggacaagatgggggacttcccatcatgcaagaattctccgggcaatgcaggggactcaggtttgatccctggttggatcagtaccagctcactaaatgaaaaaaggaccatacttagtggtttgcatgtt

SEQ ID NO: 4361 - DNA, 201 bp, Bos taurus
gtgataaataagacctggtttcacgtatgttaagcgttatggctctggtgagtttcagaagctcagctgccattttggatctaagttcctgcagagcccagccttatggcacaccaaactctggtaattcaggagcaaataaaaatgagttatacatcaagcgtgcaggtggatagtccttaatttgtgccttttgttgaa

SEQ ID NO: 4362 - DNA, 201 bp, Bos taurus
acaataatcaatcactgtgaaagccccacccctaccaggaaaggccaagggggagtccagacttccagccctccacggctgtgatgaagcatcccagtcctcctgccacggggcatcgaaggaggccgaggaggaagctgccccaacccaaggagtaagtgcagaccatgtagggagaacatccccgctagcagtaaggag

SEQ ID NO: 4363 - DNA, 201 bp, Bos taurus
gcgtcaatgtgtgcaacagttataggagcacgtcgcactttctgggaaggctaagctgtttaggtaggacactgggctgtcacaggggtgggcggggccaagtcatgaaggtcctgtgtgccatactaaaagaccggagattcaagttcttttgaaaagaaccggaatctcacgcaagtgttgagaatggacgtgtagaca

SEQ ID NO: 4364 - DNA, 201 bp, Bos taurus
atctttgccaagaaagaaaagggtgttctaaataatggaagcaggcattaagatactcagacaggcctggtgggtggcctaggtcacccagagttgtgtcgtgagtctgaagagaagtaagtcagggtatgatgcagtgggcatgaccccaggaaaatcgtgcagaaaggcaggggccagggacgtaggaggtccaacacg

SEQ ID NO: 4365 - DNA, 201 bp, Bos taurus
tcgaatctcctgcatctccagcttcgaaggtggattctttatcgctgagccacctgggatccccccaaatatatgcacatatatatggcaaccacgataccattacatctaagaagatatacaattattccttaatattatcaaatggccagtctgtgttcagatttccagcagtgtcacatatgcataggtgtttccaat

SEQ ID NO: 4366 - DNA, 201 bp, Bos taurus
cccctcaccttctactcccggagctctaactctgcagtctcctcctgccagcccttcactgtttgtctcttcaagccacctcccgccactgtttactcattgaaaactcggcaccagggccccaggcaggggcaggcagtggaaagcaaaggggtcagagagctgggctcatggttgacctcggggtctgaactgctgtca

SEQ ID NO: 4367 - DNA, 201 bp, Bos taurus
ctcatatactccctgattttgtgctcacgcagacctgcaaaatgcaacctgccttttcagcacaagctcggtccttttctacacacagacacacacacacatgatctgctgtgtgtttatattctcacaacacgctctccttcctcaacttgcaaaacggccacttttcctggcttctgccagctcagagctgtggcctca

SEQ ID NO: 4368 - DNA, 201 bp, Bos taurus
tcatttagaagctgctaattgcaggccaaggtccacatctggtggctctattgccttggcatatactgacacattaaaaaaaatttttgttgttggctgcgctgggtcttcgtggctgtgctccggctgtgctctggctttctcaatttgtgctgagtgggggcactccgactcctcattgcagcggcttctcacgttgca

SEQ ID NO: 4369 - DNA, 201 bp, Bos taurus
aggctgcctttgaatgttggcgtatctgcaagaccttgggtgagttactgtcctcctccagccctcaagttcctcgtctgttaagtggggcccatatacactagggctgttcatgcacataacccttactgctgctactagtaattattattgttgccattgtctttgcttagacatttcagctctgacacctgttcagtt

SEQ ID NO: 4370 - DNA, 201 bp, Bos taurus
ggccagccaagcacatgcgtttctcccagagccgtcctgagaggggaggggaggggagggttgccctcctacacctggccccacctgtacctccttccgttagcctttgttctagctagaagggcccctgaattctccaggtaacccctgagagggaaggaaatgccttcccagagatgaacataaagccagctcaggccc

SEQ ID NO: 4371 - DNA, 201 bp, Bos taurus
ctctgcagatgtccttcggccttctccgcgtgttctccattgtgatcccctttctctatgttgggacgctcattagcaagaactttgctgctctacttgaggaacatgacatttttgttccagaggacgacgatgatgacgactaacaggtaagatttgcctctcccccacacatggaccaggagccggaagtagggtgga

SEQ ID NO: 4372 - DNA, 201 bp, Bos taurus
acagccccgcctcctgggggaaaagtctccgccctgccccgcccacacaggcctcgccctcctgtcctaaatgcctcccactttcacacccccttcagtctggagactgctcccgttctctgtgggcccgcactgctcccgaggctcccctataggcgcccgtcttggctccactttgtattttactcactgagaccctgt

SEQ ID NO: 4373 - DNA, 201 bp, Bos taurus
ggctagcccagggccaggggcaggggccagggcagatccagatgctctgcagtgaaccagctgctggcagagaggctgagctgtgctccaagggaccaggggctgtctcctgggcccccagctccttaggacagctctgagaaggggaggctctgatttaaagggtgtgcctgttttaaatctttgggagaaggtaaggga

SEQ ID NO: 4374 - DNA, 201 bp, Bos taurus
gagggaaatggcggcggggccactccctcctctgagcttcccaggtgtcattcaggctgccaaggaccagccttgaccttcaaaaagaagctcactgccacggactcgtgtccccagaggcctctccccagaacctggagaagtatctggttccaggcaggcacccagggctctcaacccacctccaacttcctctccatc

SEQ ID NO: 4375 - DNA, 201 bp, Bos taurus
ttgtcttgggacctccccttgggagaggagaattggcagatcgggctcccaagtgcggccccggggcccatcaggaggcctgtgcagaagcattgcccagaacgaggctctggacgaatgaatgaatggatgagtgaatgactgaaaagtcagaggcggaggaaagggtggggtcctggccaccaggtgcacattcactgc

SEQ ID NO: 4376 - DNA, 201 bp, Bos taurus
gctccagctgattgaaataagtcaggccagagggtgcaggtacgacccaggccacaccaagcaatggtacaggcaaaggcaggcaggtggaaaggactggatcatatttaagggcgtcactggggccctggaggtcccacagcaccctggttgactgttgtattggagcattcgagttgcaggctgctctctgctgccagc

SEQ ID NO: 4377 - DNA, 201 bp, Bos taurus
ttttctcatctgtaaatagggccagctgtgtgtctgtccggcggaagctccggggcatgagtgagcctattcataacctgcctttgcaagagtctttgcagtgtgaggcccgtactgctgttaaagcgtgaaccgaaagcgcttctgaagtgccttcctgctgagacatgcggatgtcttgtcttctctcccacagctctg

SEQ ID NO: 4378 - DNA, 201 bp, Bos taurus
ttcagacatggcccgggaacttccctgggggtccagtggttaagaatctgccttgcaacgcaggggacactggtttgattcctggtctgggaaggtagcccgtgggccgccactactgaagccagtgagtctagagcccacgctctgcagcaagagaagccaccacaatgagaagcccccacaccgcagtgaagagtagct

SEQ ID NO: 4379 - DNA, 201 bp, Bos taurus
ttgtggggactgggtaggatgtgtttgcatcataaatacttggtaccaagagtgaaacaaacatccccgagtcccgtccggcccacccctcatgttacccgggtttttttctctgcactctccccactctcccctccgccacctctcagttcaggcctcacttcccgcgtagcccctccctgtccattcttctgtgagatg

SEQ ID NO: 4380 - DNA, 201 bp, Bos taurus
agcctcaggttccctgccggcctctgttccctcacctgcaaagtgggagtcaccgcagcgcgacctgcagacgcagaggcagggctcaggcaggcgggctgggccttcatttcagcccaggcatcaaaccacggcccatcctctgggcagctccttggcagagttcagctcagcacgggttcccctgtagacagcagccgc

SEQ ID NO: 4381 - DNA, 201 bp, Bos taurus
tgccccctcaacgctcaccgacgggacccaggctcttcgccgtccttggtcccgctgctgcttcagggccttggcactgactatccctgggcccagagaggtctgcagggggctaaatcccagctgagtccttcagctgccatctctgctcaagtgttgcctccccagtgaggcccaccggcacccactactgggggttgc

SEQ ID NO: 4382 - DNA, 201 bp, Bos taurus
acccgtggcacgtcctcctcaggccccacaggtgtgaccagcatagggatggaaaccacccagcaaagatccctctgctctctgatcaatgacacccctcgcggtgtttagggaaaggccttcatacttagacacaggaggcgtgtttccaactgttcgaaaaagtgtaagatgcatctgtaggatcacttttttttttct

SEQ ID NO: 4383 - DNA, 201 bp, Bos taurus
tctggccgggaaccccctctggggactgctcactgcccctccaccgtgcgcttcacccagggcggcacagagaagatgctatggccccctcgctcagaagggagacagaggctcagagacgcgacatgctgaggtcagacgaggagtgagagtcgggacagtggggatggccctgtgtgtctgggcccaaggtacaagcgt

SEQ ID NO: 4384 - DNA, 201 bp, Bos taurus
ccacaagttttaaactttcaccaaagaggagaagccagtggccctgtgtaggcacacaccaggactcagcaagtctctgaggtctcttcatttactgaaactctgacggagggggccccgggcagcctttctgtctcagtcttttgtagttcaaggctacagctagcctatgttgaagcaattaagtatctccccctgagt

SEQ ID NO: 4385 - DNA, 201 bp, Bos taurus
tatttccattttacagaagggaaaactgaggccccagaggctgtgggacatgcccggggctgcccagctggaactggggctgacctcttgaccctcagcccatgttcttcttttggccatctttgtgggtctcatctccatcctctcaggaggcaggggtgctcttgactggaagagtgatttggggctcagagtccccag

SEQ ID NO: 4386 - DNA, 201 bp, Bos taurus
aaagtcctgtacatgttttcttagatttacactttaattcttgaagattttttatagtcgtggatttttatttgtttaattggccgcgtcaggcccccgtcgccattgtggtgcgcgggttctctagctgtggtgtgcgggctgcggtggttgcgacacaaagtctctctggttgtggcctgtggactccggagcgtgctg

SEQ ID NO: 4387 - DNA, 201 bp, Bos taurus
taaattccagatgtaaggaactggggctctccctgaccaagtcatccggccaagctggggtccgaactgcaggcctggcttgggggccacttggtccctccaggaagtgggtggaggtggtgggcaaggtgttcaactctttgagcctgtttccttctcaatccaaggaggctgaagcccccaggccggggcctgcctacc

SEQ ID NO: 4388 - DNA, 201 bp, Bos taurus
agtcaaagccaatcatgccaggagaaagcggacccaaatgtcagctccaaacaactttctctccttctgtgcccagggtcacacagggccctgcgaggaacgccgccagagagccttgggagtgaaaagagcagctgctggtctgggaacgagggaaggcttcactccagaccccggcctgcactgggaactggaggcagc

SEQ ID NO: 4389 - DNA, 201 bp, Bos taurus
tcaagaaggccacagacgtccaacagcacctgtccccaacctgtaaccgtgagcaccaacggcttgccacacctctaagccaagcgaagctggggcagcagccagggccgggcacaaggacccacatgcagaggcaggcctcagcctagcgaggcacagcggctgaaacaaggcgcggatgcgaatgcagtaggacttctg

SEQ ID NO: 4390 - DNA, 201 bp, Bos taurus
ggagtgtggctcgtttatatttttctagaatagcgcacactgagcacacgggatgctgtgtgaccctgctcgtgggccgaggctgccgggcaggctcagccggtgtggacacagcaagccaattttagagtcagacgcgccgcaggggcctgcccccggcccttgtcccactcacccaagagggcagctgcaagggccaaa

SEQ ID NO: 4391 - DNA, 201 bp, Bos taurus
ccaaaggtcaagttcagatcgcgcgcttggctcgggggctgggatgtgtgtattagattctcaagaagtgcttactgggcggaaaggaggaacgtgcagacggcctttgacaagttgtgtggccctcgcagcctccgtgtcctcagtgaagagagctgccaaccccgccttaacccgggagtgttgtgcagacaggcctgc

SEQ ID NO: 4392 - DNA, 201 bp, Bos taurus
caaggggcccacttcaggtataccagacgtcaccccaccaagctgcctcctaattctgctcccaggggctgcctccccgacctgctgaatgtcaggaccacggccggaaccagagcgtcttgtcaaaagtaattgttgaatgacctctcattattacttaaagaactatgtatttggccaaatgggagctttgaagacttt

SEQ ID NO: 4393 - DNA, 201 bp, Bos taurus
gctggcagagacactgttcccacccccgtagggggcccggaggaaatgtgtagttcaaaagtgatctcggaaaaagccttgatggtgagcctttgagctagtcttcggccactcctctggtgaccaggccacgggaaggcagaggggcgctgcacttttatgagccggggggcagagcgggaaccatccatctgtcctgca

SEQ ID NO: 4394 - DNA, 201 bp, Bos taurus
ttcctgcatccaggaaggagcctggaaggcttcgtgtggagctgacgtttcttttcctctttctgcccgagggagaggcgggcccccgggggttggctccggttccctgctgcttccccacgtagaccctcaggtttggttgtgagagacccgggaggaagtgtgtttatgagagccgagaagtcgggaggatggttctgc

SEQ ID NO: 4395 - DNA, 201 bp, Bos taurus
gtatcccgacagcctgcttagccagtggtcacggaagacaatgagaaatgatcttgcaacagcacctgaccagccacccatgctcccgtgatccaggaggaccacaagaccaagattagaccaactgcgtgtcaagccttgcccgtgagacctctgttggagacacaggggacagaatgtagccgttcccctgcaagaata

SEQ ID NO: 4396 - DNA, 201 bp, Bos taurus
tgcactctggatcctgttcttggcaaaacagggtcatctgccctgggagcagctgtctctggggacgtgatgagctcagtggctgaattactgaggcccatgggtgggagccagatcaaaccagtccaccctaaaggaaatcaaccctgaatattgactggaaggactgatgctgaagctgaagctccaatactttggcca

SEQ ID NO: 4397 - DNA, 201 bp, Bos taurus
ccagctttacttccacttaacttacaatgtacaactaaaatgtaattacagagatgagcgagaaaattgccctgcgctgttcttgttcttttacacgttacgctctgctcccagaactgagcacctttcctctttggttttatggaatctactttttattaaaagttttacttgaggggaagtcagaagccatagagcatg

SEQ ID NO: 4398 - DNA, 201 bp, Bos taurus
ttcagatgagggactgcactggagatttctggggcacttgtgtctcagttggggacacacaacaggtctactgaggaatgcccaggctgtggcctcaagctgctgagctagagaatccagtcgggttgggggctgttagattaaaaaccactgggggctcagtcagtgaagcaggcctggtgttcattaagaccctgctcg

SEQ ID NO: 4399 - DNA, 201 bp, Bos taurus
aaaaggccaggccttgccctccccatccctgcgccatgggaagctgtctccccttccccagcagtgagtcacaaaggctcatcgagccctggctgtgtgtactccctggcccgggtggagccggccctgcaggggtcgggggcagcagtggcttggtgggcagagccgagctgctgctcctgggactgacactgagatcag

SEQ ID NO: 4400 - DNA, 201 bp, Bos taurus
tctgctgaacaggacgtgagagtgttacacacacatatacacgtgtatgttcattttcctgttctttcccactacggtttatcatagggccctgggctacacagcaggaccttgttgctggggctgtgttgtttcctggcttgctattaagtctctagctgtgacatggacttactcgtccttgtctgtcagctccggtgg

SEQ ID NO: 4401 - DNA, 201 bp, Bos taurus
actgtaagcatgagagaattcaacaggattttacaaaactcaaggctctgagtggtgtttcaaaccttcctgggcatgtgaggcctctttaattcaggaactatcttttcccaaagactccgccgtccactgtccatacagcaggctgcgctgcggcccggcatcctccacgcgttccctgcgctctcccacctcccggcc

SEQ ID NO: 4402 - DNA, 201 bp, Bos taurus
agaataggaccagaagcccatgtccacttgagatcaacctgctccgggagacaaacttccttgcttatcactgttatgttttctccatcatagtttcttgagtttgtggtacagtaccagagaaacttaagtctctctttctctagagggtctgtttcctctggatcagaagacatatttccattgagagtcaccccatct

SEQ ID NO: 4403 - DNA, 201 bp, Bos taurus
gtaaactccgagagttggtgatggacagggaggcctggaatgctgtggtccatgggattgcaaagaatcagacacaactgagcaactgaactgaaatgaggtaatcaagaagctgggggccaagataggggacgggccgtgtccacagtgacgtggagagcctggtgcacaggcctgggagtttccgtggacccggaggag

SEQ ID NO: 4404 - DNA, 201 bp, Bos taurus
tgggaggggaggaaggggtggagccccacccgcgtgtccgtggcacggctcctgggcatgacgacagccctgatgactcaggtgtgggctcgggccccggggtcccctttaccttccctgctcatcaccagatcccagggcagccaggaatttacagttaacaattgggagaccatggagaagagatgggcagggccggac

SEQ ID NO: 4405 - DNA, 201 bp, Bos taurus
ctccagcctccttcccaggggctcgtgtggccgcgacttctcccaggttttaaaaaagcggtttctctgtcacccttgctggtgggtggggccggagaccgcgggtcactgggcgggcagcgcggagacgggggagccgggtccacccgctcctgcattaggtcctcaagcagacacagaggcccccatccccaccccagt

SEQ ID NO: 4406 - DNA, 201 bp, Bos taurus
caaaccggccagggtcacgcagcacctgagacccagagcctggatccaggcttgtagacccagtctcctccccagggagacagaaggccaggctgctgaggggggagggcgtgaccgcgtggacccaagtggtgcccgcaaggactgggagtggtggaggggctggtccagggggcggggcgcctggcccctgcactgcgg

SEQ ID NO: 4407 - DNA, 201 bp, Bos taurus
atcctcgtgagtgggaatttgtcacttccccgcagtccctggcacacaccaggacttcttagccgcggtagatgaattcctggccgtgaaatgacctcaacgtgaaatctgaaaaatcctttcatgtctgcgtatggaaaggtatatttaatgtgaggcttggccgcgttgtaattgttcgtcacgcggcatctctgaaag

SEQ ID NO: 4408 - DNA, 201 bp, Bos taurus
tctgcttttctccttttgttccagtccctcctccccagctgccccaccccaccccttctctttcaagcgacaattaaatttaaatccattttctctacagaaaaaaaactaatcacagtctcaggcccaggagtgacccagagtcaaggggtcacgtgggataggacagcagactctgccctttccggggggtgtgagtcc

SEQ ID NO: 4409 - DNA, 201 bp, Bos taurus
gggaagcctggcgtgccacagtccagggggtcgcaaagagctagacatgacttaggggctggacaacaaaggaaacccgaaagttcaaaaccaaggtgtcggcgggccagcatccccccggggctccagtgaggacctgctcctcgcctcccgagagctgagaagattgaatcagaacattctggaggagcagttgatgaa

SEQ ID NO: 4410 - DNA, 201 bp, Bos taurus
ttgtaaggaaggagagaggaggacccaggagaggtggggtgcacccaaggagcctctcgaatgagctggggtgatcagacagcactgtgttccccttccactcagggcctcccctgaaactcagctgctgggcagatggcattcatggtggcagtcaggccctcactgcctgcagaccaggctggggtgaaacctcagatc

SEQ ID NO: 4411 - DNA, 201 bp, Bos taurus
tcctgcaccaggtcatttttcactcagggaatttgagttctggtccgtgagctggttggtcaggtggaggtcacgtggccacctgcatgcctgacatcagtgtgggtgggtataaggagaggttgggtcagcatcttttaagtgggatggacgggcagggccagaggtcaaggctgggatgcagcatcacggtactgctgg

SEQ ID NO: 4412 - DNA, 201 bp, Bos taurus
ctggaggggatgtgggaccctgacttggccaagaggctgtcaggagcagggagccagctggcatttagggtgcaagcctgcagttgtggaggtctgctcttagagcctgggccccgtgatatgcaccccggctccccttctgggatccaccctgcttcccagctccccagacaggcccctgggtttaggcatggtcccctg

SEQ ID NO: 4413 - DNA, 201 bp, Bos taurus
tcccgtccccgtggacttggagtccagctgcgcctctactcagctgctccccatctccggatctttgctcttgttgccggcctctctgtctgcagcactttgtccactccctgcccgctgagtaccctcggaccatctcctgaggctgggtcctctccttggctctgagttcccatctccacccctccccgacctccctcc

SEQ ID NO: 4414 - DNA, 201 bp, Bos taurus
ggtccacatgcagagctgttggctgtgggccagaggccccaggtcctctccacgtggacattgctaggtccccgggagggaggggtcactcacactcagcccgggcagagtgggagaggggagaggaaggccttctgggaggagctgcttcttgagccagaccacgtcagcaggacgcatgtgatggatacagggaggaac

SEQ ID NO: 4415 - DNA, 201 bp, Bos taurus
aggatatgactaatcatactttacttaaaaatgaaaatgaataagatatgtcagaaaatatgaattacaaatcaactcaagaaacaaccatcatagaactggaaacagtaatttaaaatatctgtataaagattcctcaaggtccagtcagttttagggaagtaacttcaacctatggcggctcagagagtaaaggatcca

SEQ ID NO: 4416 - DNA, 201 bp, Bos taurus
catgttggccatggtcacagacattgtgctgcgggctttgctctgtgtccacctcgggctggaaagaggcagaaagagtgaagatgaacgtttggagacataaaggcctggctgcggtgccctgcttgctctcccatcaggaccacgtggtctcagctcaggctctgtgccccgtttgcaggcagatgtctgtctccctgc

SEQ ID NO: 4417 - DNA, 201 bp, Bos taurus
gaggggaggtctggctgtcatgggacactcagccgtgggagcaaggggagcagggtcgaccccaaaaagggaagggaattggagttggtggatggggactcggggccatcatgtgggggggatggagaggcgtttactaaagttcctcggtggttccactggtgtgggagcggctgcacgtgggaggaagatgggaggcag

SEQ ID NO: 4418 - DNA, 201 bp, Bos taurus
ccctcacctggctcctacctgtgccacacaaaggccgctggctctcccgcgcccaggctggagtgggtgcagtgacgtcgacgtgtctgagccgccctctttgagtggcagatggccctgcctggtgacggtaggtctgcctgatgtgcttggctacgggcaggtgtccttctgcacagaccccagaggagccagctcctg

SEQ ID NO: 4419 - DNA, 201 bp, Bos taurus
ggcgcattttaataaggaaaggccctcttgccggagtgtctgcgtttaatagacagtcatttacggacaggggagaagctgtcctgctagtgggtttttacggccgtgactcaggccgcccttttgtggataaatggctaagagctatttttccataaattaacaagagaggaaaacccataaaatgtgttaggaggcttc

SEQ ID NO: 4420 - DNA, 201 bp, Bos taurus
gttatgtggacacagatgtctgtctgcatcagtggtggcgactgaatggatggatggatgagtgaatgcagggtggccaggcagctgtggcctcctgccccggaacacccatgagccttcttccccggaaagctccatggaggatgtgctcttgcggtgttgggctccagagcagagaccagggctcccggccccatccct

SEQ ID NO: 4421 - DNA, 201 bp, Bos taurus
tggaccagcttagctggcggttgcatttaccagatgacactgcggagtttgaaagggattgttcttgcaagaggccgacttcagggcccagagaagctgctgggggtgagcagggggtcagggcagcccccaagagacagcaagtaggggcttgaggagggaggtggaggcggggatgaagggaggagaggggccctgact

SEQ ID NO: 4422 - DNA, 201 bp, Bos taurus
gcctccccgtcgtctgtagccccctcgtctctcgtacggagtgggtctcattcccgggcaggtgaccacacaccgctgaaacagaaggccagggcactcttaacagagctcagtttcccgagggtctccctgctccctcccttctgcatctctccccgcctctcccctctgaccccctccactcccccgcctctctctggt

SEQ ID NO: 4423 - DNA, 201 bp, Bos taurus
aaacaactctgatggggatgcagagagaatgcttaatcggccttttcacctttaatggcttcagggggtgcaaccagaggaccgttcatcatcacacgctcggagtcggaggagggccgccatttcagtgtggatgtgctcggtgtctggagcctcagagtgtaaggaggggccccagaacttgtgtgttggagcccagga

SEQ ID NO: 4424 - DNA, 201 bp, Bos taurus
gtactgaagacggcgtacagcaccccgccggagcctggccggtccagcgaggctgccaggcaggtgccgaaggcgggggcctgggcatcgccggggtccaagcagctcaggtccacctccaggtaggagtagtagaaggggtcctgtttgcacatgcgcgccagcagcgtgcggttccgggccgggtgtttgtcctgctgg

SEQ ID NO: 4425 - DNA, 201 bp, Bos taurus
gactccgtagagctggggccccagcgaccgctctgcaagtatggcgaacatcacactttcaaggaccaaggagtccacgccctgaaggaagatggacagtgaaggtttttcagtcacaaggggccaaaggcagaggggcgccaacacacacgagggtcgactcgctcctcccaccacagctgggactcaccgccggggggt

SEQ ID NO: 4426 - DNA, 201 bp, Bos taurus
tttcccccacagaagctcctgggtatcctggctgcccctttatctctttgaaagagtccctgagagctacccaagaggccatctcctgggccatggtccccagtgatgccctggataaaacggttctcagcttttaggttaggttttttttttttttttggttcagttgacggtggccacatgtaaacacaccaccctcct

SEQ ID NO: 4427 - DNA, 201 bp, Bos taurus
cacctggccccccgagcaggacactcaagggcagccctgttcccagattcaagtgcacctgtgtctgatgcctgaggccacgctcccctgctccccggacacggatctgccctccgtgttcccctaaatgagagcatcctttgcaccaaccccactggccaatcaccaagcagctgggatggggcagacaggctttccggc

SEQ ID NO: 4428 - DNA, 201 bp, Bos taurus
tgcctgccatgggacctgcccactgggcacaggccgaggctggggctggctggctgaacagtctcccggggtctcacataaggactaaggagggaaagtgagagactgtggactcctctccgagtctcaccctctgccggcccccacatcctgccacgttctgcctgattcaggccaaccagcaggcgtctggagggtcag

SEQ ID NO: 4429 - DNA, 201 bp, Bos taurus
ggaggcgggaggtgcagctgcggactcagccggacacctgcgtaccgcgcgcgagagctgatgggaaccgacagcggccctccgcgaagacgcggcccaacgagcttaaactcggatacgtcccttccaggggttgctgggctcttgtttaaataagacacagagagagagaaaaacgtttgccctgacaggccccgtaga

SEQ ID NO: 4430 - DNA, 201 bp, Bos taurus
ggaccggttcccaagcgcagagcccagcacactctggagcatggagggggaccaggccagggacacaggcggtgggtccgtggctcgtgggggcggcctccgcctcctgccctcggcatccgctctcacagatctggaaactgtggtcaaagcctggaggacggaagggtcataggccccgcgaggccgaccccaggctga

SEQ ID NO: 4431 - DNA, 201 bp, Bos taurus
ctcctcaactggtcccagctgcctcactcatgttcatccacccgcaagtgtatttactctcagccgctagctgcgtgttctggatgctgagccaggtgtcgggagagtctgcaaacctggcctgtgtcaaccgcagctctaatcactggggttctcaggagggtaagccgcaacgcctctgaaaagaggccacttgccaac

SEQ ID NO: 4432 - DNA, 201 bp, Bos taurus
caacagacaagagccacagggaagaagcagttgacaaaactccacaccaattcctacttaaaaaacagagcaaaggggaactggagagggaggcttcctcagtctgacaggctgtgttctcaaagagctcagagagacccccgctggagcagcacttcagagctgctctcagccttgagccaggccaccaagctccctgtg

SEQ ID NO: 4433 - DNA, 201 bp, Bos taurus
caacaactgacactcagaaccactctggacccagacagccatctgtattccacttacagtgagaattaaattcactacgtgagctactcagcatgttatcataagacaggctttgtggccatggcttcacccaccttccaggggcgtgagtgtccaggcccatgggaaacggccccggcaatggcgaggctgtggcgctgg

SEQ ID NO: 4434 - DNA, 201 bp, Bos taurus
actactgtttgccaggtccggggagggcctgggtcaagaccaaagacatccgacctccgtgtgagcttggtggtggagctgctgcagaagagaaaggccgagttccactccacagacaggattctcagcaggattcggagccgctcagctcagaggcagctctgaagccgcggggtggtgagctgtcttcctgaaggccaa

SEQ ID NO: 4435 - DNA, 201 bp, Bos taurus
aacaataagacgatcagaaagaaaaataactgcaattgactgaggctcatcaacatacaaaattcatgcgttcacagtgatgtcccagaagcacatcctccttggtcagaagcagaaggctgctcttcaccttgaaattgaagagaggaaggtcaagtgtttatcttcccacattcagttcaaaattgatgagataaaatt

SEQ ID NO: 4436 - DNA, 201 bp, Bos taurus
cggcagcagaagcggccgccccggcagacaggccccgctggacacggcgcttctcggacccgcatcctctccccggcagtcgggctgggcaggcctggagtgagccctatgtcaatgtgctcatcttacaccacgttgctgtgaaaagccctcctgctagagtaaggcctcctgagacgctcgcctgcccacaaaggctct

SEQ ID NO: 4437 - DNA, 201 bp, Bos taurus
gcccacagtgggaggaggacacgctgaggagggaaggcccccaaggctgtaaaggtgaagctgagttcagaccacacaggtcccagcggatgccccatctcgaaggttgtaaaggccggtgcccatcagtggtgctcactaggtctgcaggcactgggtagcatgagccacttgaagctgggaagctttgggacccatctg

SEQ ID NO: 4438 - DNA, 201 bp, Bos taurus
tgtgcacatgcgcacgtgcacgcacgcacacaggaaggtgtgtgttggctgtagctgctctgcacttgcagcctgtggcctctggagttgtgtgtgcaccgacgtgaggttcacatgccgggtccttggcacgcttgtgccccgtgtgttctgccccatctgtgtgccagctgctctgctgtggatgcccactccctcctc

SEQ ID NO: 4439 - DNA, 201 bp, Bos taurus
agctcaacttcctgctgcaggaaatcgacaactgctaccaccgggcggccgagggccgcgcgcccaagatcgagaagcagatccagtccaagggcccgggcatcacggagcgcgagcggcgcgagatcatcgagaacgcggagaaggagaagagccccgagcagaacctgttcgagaagtacctggagcgccgcggccgca

SEQ ID NO: 4440 - DNA, 201 bp, Bos taurus
acaaaaaaaaaaacctttttacttgatataaaagtaaaattcacagttaagtttttctactggtctagatattcctcctagttttcatccttccaacccaccataaatttgaggtagactttcagagagtgacagcttctttcttggattatcatattattattttgcttcagtcaaatagcagcaaaatttctcaactgg

SEQ ID NO: 4441 - DNA, 201 bp, Bos taurus
gctaaaacaagagttacaacatagaggagaccccagcagcctgcacagactttagagaggaataaaatatagggtacatttttctcaacaaattgtcacgctcatgtcacaaagaaaatgaatgaaaactacagaaaaaaaaaaaaaaaggcactttttttttcccatcttgagcatttaattaagatagtaggttgcttt

SEQ ID NO: 4442 - DNA, 201 bp, Bos taurus
gtagttctaattctccatacagttacaaaatggtcaaagagaccaggaaaaggtgaccaagaaaggaaagtttgggccacacgattcacctgtttctggccgctcccttctcagggacgttgggaccctcttggcattggcaggtcggtataaacccctgacaaggctaccctctggtgctgccatcagtcattatgaagc

SEQ ID NO: 4443 - DNA, 201 bp, Bos taurus
atctttatccaaaacttctgggtttaaaaacaaagttttctcccgctgattcagaaatgatttttacctcattatttgtttcctgacttcttaacagaaagggctctaccagtttcttcaaaagttttatttctaactttgttgtactcatctatttatagtaaaagcttaagaaactttccatgaaaattcttaaagagc

SEQ ID NO: 4444 - DNA, 201 bp, Bos taurus
cctcaaaagaaattacttcctaactgtttccctgcccccacaacacaccagaaacaaatttagaaaatttttacttctttgttgactctctatactgagacattttacactgtattcttccaaccacagctattcattttgaagtcacgttaataaaagttatggatttgttgtgagaattaatgcaaaagaagtgtgtga

SEQ ID NO: 4445 - DNA, 201 bp, Bos taurus
aaagcagtaagttaataagtctcaaaaatttatattacattttttgtaattctgtatgttttgtttgttttaattgatgaaacttcaaataatgtaagaagaaatggataggtctccttgatttttatgtagaaacatcattgttcagccatccatcaaacttgtactgagtgactggccaaccccaaggacaagtgatgt

SEQ ID NO: 4446 - DNA, 201 bp, Bos taurus
aattcagaaatgtgaatcagacactttaatctgagtacttcagagaggagataaagcaaaggatataagggatgggtctgtcccaggaaggccccatagagtcctactcagttacactatcggcatacaggaaggaaataataaataagtcagtcagttcagtcgctcagtcgcatctgactctttgcgaccccataaatc

SEQ ID NO: 4447 - DNA, 201 bp, Bos taurus
actggagagaaggtagactaatttccaaaaaccaactctgaagattctgctcaaccatgaaagtttcaaaagcaagaaagtgacgttcatcattttgggaatgggccagtcttcattatcctccactgtgtgcaaagtttctcctgattggttggtggggagataacagggcggtgctccaggaatcttgttctgagcctg

SEQ ID NO: 4448 - DNA, 201 bp, Bos taurus
tcctggatatgaagaggattgttaaaacccatgagtactactttgctttactacttcatgctactcaactttgaagatgacttccaaattggccatgttgaacctgacgacttttccagggaaaaaacgatgtggaacatttctgcactacagatatttcaaaaaatcaggccattattcatgatcattgtaatataatgc

SEQ ID NO: 4449 - DNA, 201 bp, Bos taurus
cctactctctgctgtgggcagagtcatgtgagtcccttctaggctgggaagttcagcagcgatatctgtggtgaatggtctctgttttgccttctgagtttcaaccattacactcctctgtggttctgaagctcctcctagctctgcctgtttggggatttcctagtgtgtggaaatgacacttttcttcttcatgacact

SEQ ID NO: 4450 - DNA, 201 bp, Bos taurus
tgtttcctgaatacataactccatgaagttctgggttttaactccttgtgaatgtgtctcacttacattgaactgcatctacagcatgaccctgacttacaaacaaattatatggagtacaagaaaatcattaaaagcactcaagattatgtagatccaatattctactgcctagcccttgacattctaccccttagtaaa

SEQ ID NO: 4451 - DNA, 201 bp, Bos taurus
ccttagtgggtgttgaaggagcagttttggttttattataggatcctacgggtgtctgatctattgatgaccttgtggaaagagaccacagtgccaacaacctgcatgagtgaatggatgagtctgtgagtgtgtgtatgtctgtgtgtgtatgatgcttatatacaaaaatttgaacatatggtagaatgatgcaagagt

SEQ ID NO: 4452 - DNA, 201 bp, Bos taurus
cataagttatgaatggtgaaaacatgctattaatttcatttgctagcaggatgacatacaaggaaagaagaagaaaggcactgtggaagagagatcacctaacatggattttcaggatgcaaagataaatattatgaagttgcttgtgagtagatagagataataggaagggtagcactctaaatataaataaaatcacta

SEQ ID NO: 4453 - DNA, 201 bp, Bos taurus
atttctttccagataaatctataatctctccccagttgccctattggtagctgagaacagtctcatttttctttctacagactttgactattaatcactcttccattacctcctttcactttgtctaacttcagtctctctgttattattagaatacttctgtctgtatttaaacttgctggctatcccactttcattcca

SEQ ID NO: 4454 - DNA, 201 bp, Bos taurus
gctaattatcttggagaaggcgcactgcccggtttttggccttgcatggttgaccttggaacagtcatggtgctgttgggtataatgctaacgtatcacagtgagcataccatgagactcaaggtctactggaagttgaatcttctgtcgtcttggacccagtatgttctaaccagttttcgtggtatcccattcttctga

SEQ ID NO: 4455 - DNA, 201 bp, Bos taurus
gggcccaaaggggagtcttgggaaaacagtcaaagcagagacttggagggcaataagcagagaacgctacactttttagccggttcacagctcatgcactatggccccaaacatgtcgggctcgcgggaccaagagtggtgagcgtagaaacccagccactgcacacaacccttgcagcacagagggcgggcccaggtggc

SEQ ID NO: 4456 - DNA, 201 bp, Bos taurus
tttcttgagtgtctactctgtgccagtgtcataagggtttaggatggagaaaaagagatgcatacacttgccctttgaagtacatttgtcagcaaggcaactgcaacttcataaggcaatggcatggatgttctagaatgatatacagatagaaaggcaacttctagagtgactcagagcctttgctttataaaatgtttc

SEQ ID NO: 4457 - DNA, 201 bp, Bos taurus
gtgggatgttagttccctgaccaaggattgaactcagacccttggcagtgaaagtgcaatgtcctaaccactcggagcaccaaagaattccgaaagtgactttcacactctctctcacacacacatacacacacacccaggacccataaaataaagttcaaatgtaaatgacaaaaatataatataagtttaaatgtaaat

SEQ ID NO: 4458 - DNA, 201 bp, Bos taurus
atgcctttattccttccaatgtaccagtaaaaacatatttagaaaagtattaatccagaccaacacctgaaataccaatagttcacctttctatgagtcatttgacgacagtaaaatatatactccaactgaacagaaccacccttatgtttagtactaagatttccctaactcccaagactaacatatttttattgtctc

SEQ ID NO: 4459 - DNA, 201 bp, Bos taurus
tcatctttcattttgcatcctggcctttcatatttgctttgattaatattttgattattttttgaacaaatggagtcttgaaaaaacaaggctttctttccggccttcagcagtgctctttcatccattcctgctgctgctgctgctaagtcgcttcagtcgtgtccgactctgtgggaccccatagatggcagcccacca

SEQ ID NO: 4460 - DNA, 201 bp, Bos taurus
tggtggtatcaggaggtgcagccttgagaggtgactgggtcgtgacagaggagccctcatgaatatgattagtgcccatataaaagaggccctgtagagttcatcccctctaacatctgaggaaacagcaagaagatggtcgtctgtgaaccaagcagttggccctgaccagacactgaatctgccagactcttgatcttg

SEQ ID NO: 4461 - DNA, 201 bp, Bos taurus
cgttttttgaatgttgaattttgagccagcttattcactctactctttcacacttatcaagagactctttagttcttcttggctttaagctcttagagtcgtatcatgtgtgtatctaaagttgttgatatttctcctggcaatcttgattctagcttgtggtttacccagcctggcatttcacctgaggtactctgcaaa

SEQ ID NO: 4462 - DNA, 201 bp, Bos taurus
ttcaatattaaaaacattcaagcaaaaaatgtgtagaagacataaatagaaatttttccaaagaagacatacagatggccaacagacacatgagaagatgtgcaacactgctaattgttgttgatcagtcagtcagtcatgtctgactttttgagaccccatggcctgcagcacgtcatgcttccctgtccttcactatct

SEQ ID NO: 4463 - DNA, 201 bp, Bos taurus
taacgtgttagttccaggacagccctgctccggcgcaacaacatgtaggtgccagtgttgcaatgcctcaagctaggcaactaactggccagggacacagcctcacccattagcagacaggctgccttatgattccctaagccaacagcaacctctagacatggccctgcccaccagagggctcaggactctgcttcaccc

SEQ ID NO: 4464 - DNA, 201 bp, Bos taurus
gttatcgtctgccttttagtccaccctcagcattatgtctctacttttctcttctccacactcacattccagcctctgaggctggccctgacctgagataaccaccctttcttactctctttcttccctccggcatctgtagtttaagccccagacgtcagccccagcctgggctggccacatgctgccacatctcactga

SEQ ID NO: 4465 - DNA, 201 bp, Bos taurus
atctaccaggagggttgcagcctgagatcagctccccagaggagacacacggcacctgagatggcactctcatggcgcacccaggaaaccaagtggccaggagcgggtggtgattaagactcacagcccacctgggaaggtgcgcttgccaagcacatggttgcctgagctgctcggaactgggtagggcacaaaacacag

SEQ ID NO: 4466 - DNA, 201 bp, Bos taurus
gtcagctatggggaatgtgtcaataggaaatgattgaaagagtttctgtgtgacaaagtgggccagattaaagcaaagtctcacaagttttagtggtcaatgtaggcagcaggatctagtaacattttctaaccaggtcaaagagtaaatagcattgtctgggaaattcagatcagcagagaaggtgaaacaaaaagaaca

SEQ ID NO: 4467 - DNA, 201 bp, Bos taurus
tcagttttctcacctgaaagacagcagaggcacttcctaactcaaggaggctttctatgaggtgaatggaatcacgcatctgccgcacttagtccagtgccgggctcagtagatactgccatcactctcaggggactgcgtgcttgtacagatttcagcaagtcagccgagcaagggtgaatgtcattttttagtagcatg

SEQ ID NO: 4468 - DNA, 201 bp, Bos taurus
ttctagtgtaggtgacagcaatatacagatgcataaataagaaaacactattggctggttttcattgccatgcagagaattaagaggcctgtgggaaagatagtgtggtgatgcctactctagatgtacatttatttaaatactttattatttttctggccgcaccatgtggtatgtgaaatcttctctgacaagtgatca

SEQ ID NO: 4469 - DNA, 201 bp, Bos taurus
ttgaccttactcaatttgctttgccattttaatggacaacgagtgggaacaactgagtgtcagaaagcataattcacatatttgttgaagaaattgtttacgttgctcttttagatatgaatgaaaagaaccagtttttcaaaactcatggacctgtagctttccttacattgtgaaagaaatgcacatttctaaggatct

SEQ ID NO: 4470 - DNA, 201 bp, Bos taurus
tgcttactaactctttagtatggaggcaaaaatcaacttcttctgtacaaaatgttaatttaaaataaagatcacatctgagtcctgatgtcttggtgacctctcagtaagaaggggagcatacgcaactgatgatgtaattccctactgaattggggtctccataaggcctcctcctctgcccgttgtctcttcttagat

SEQ ID NO: 4471 - DNA, 201 bp, Bos taurus
acaaaaaaatcattatgtgaaagtagaaacatgtttctgatcaacatgagaaaagcctttctggcagagagttcctattgtgggcaatgtttgagttaagctgggtgaaggtaggagctttgctggaaagggtgttcctctcccagttggaaactggcacagtggatctatgtgaaaacttctgtgtcttcttccatgtac

SEQ ID NO: 4472 - DNA, 201 bp, Bos taurus
aatatcctgatattcacaaatataatttaaagatgattaaagttacgtctaatattttgcacattccttcttttaaaagtggtgttttattattatggtggtgtttcaatcttgtgaggtttccctggtacaaaaaaattatcatcatcatacttaggattctccaagtagttggcttagaaatgatacattcatttacct

SEQ ID NO: 4473 - DNA, 201 bp, Bos taurus
ctttctcgttaaagactactgtctgagtttggaatttgtgtgtgggtgtcatgtcagtgctgtggatggcacctcagtgctggcctgaagcatgaaaagggttattcttggtaagatttgcagccactgtgctgaataaacctaataataatactgactgtggcaggcagaataatggccccacaaaaatgtcaatatatt

SEQ ID NO: 4474 - DNA, 201 bp, Bos taurus
aacctaaggctggcatctgaggcctccagttaaagacagaaggtgccatatctgaaaggagatgtgtggatactcggagaagggagctttcagttctgtatgagtccgcctcttggatctggcctgccagagtccagtggacctgtgcctcagtgagcgatcaagagaatgcttaaagggagccaagggcgtctagcaacc

SEQ ID NO: 4475 - DNA, 201 bp, Bos taurus
cattctaaataggctcctcctagaaaatcttctgtaggtacaactggaagatttccagaagcactttggaagaggaagaatctgtttccctgattctgagaagaatttgagcctcagagaagcctcagtcttgatcataataccttttgttttatatataaattcaggtatctgaatcatcacaaactccttcaaacttac

SEQ ID NO: 4476 - DNA, 201 bp, Bos taurus
ggctttaataccattccttgtttggtgacagagtatgctattcattgacaggcaatatcacagtgaacagaggctgattctcagagtttcaggccatcttctctggatactagtacaatcattattgggcaatgagaagcaatgaaagagctggcttcctttccccttcctttctcactttcacagtttattttaacctgt

SEQ ID NO: 4477 - DNA, 201 bp, Bos taurus
ttgctaatgccagaggcctcagtgaattggtatatcatttaaaataacaccatcagtgctcagaattggtgaattctgaatggcataccgattagaattactgttcatatgaggcctgtgaaaatccagtcctcactctcccactaggtaactttgtgaacttctctggtgttaagccaccctttgagacttgattttttt

SEQ ID NO: 4478 - DNA, 201 bp, Bos taurus
atgcattcctcttgaaaccgagaaggaccctgcaaggccctcctgggtccaagagcccctccatgccttccatttattgtttgcagaaaaaggcttcaaccgcataggccttccctgagttccaaggtgcagattcaagcagttactaattatgtaagtgagagaatgcagaaacaaaggaaaagcagacaagaaaaaata

SEQ ID NO: 4479 - DNA, 201 bp, Bos taurus
tctgtttggagacccctcagccttccaccatgcccatacagaaatgctctgtcatacacaccgggaccagcacgatggcccggccaagtgcctaagaaggtgggcaggaatgcacgggggcaggagaagaaatgcccgcaggcacaactcatccagcaccgagcaaggtcttggcctttttctctgaatcccctgttggct

SEQ ID NO: 4480 - DNA, 201 bp, Bos taurus
gccacacaggaccagagccaagaagagccaaatgagggttttagagtgaggctccccatcccttcacttttttccatttaagaaaagaacagaaaagaaagagcaggcaggaatatactagaggccaaaagagtaaaaaacacacttataaacaaaattgcaaaatctgaaaatatttctgaggtaagtgtaatataatgt

SEQ ID NO: 4481 - DNA, 201 bp, Bos taurus
aggctgggatgcctcaggcccagcagccgacaggagacaggctgattgaagatcctcagggcacaatttgcccactgggtggcccaggacacagctccacccactagggcagcaggcaatagacctgcaccagggctttcaagccagagactctaggacccaggcccccctgcccccccaccaaagagcagacaccagcca

SEQ ID NO: 4482 - DNA, 201 bp, Bos taurus
aaacaaaaaaagttccgaatatgataaacataagggacctaaaataaactgagataataaatgtctttctcactctcattcatcccttcaaactatgtgttctagatgctgtgttatttattcaacgcgatttggcttacatttggaattcatgagataaggctactcagaagaatacattttagctactaataatggaca

SEQ ID NO: 4483 - DNA, 201 bp, Bos taurus
tttctctacaggaataaagataacataaggggagtctctcaagaggattggagacttcagtactggccaaccacttggtaactttttaattatcttttttttcttctctgtatttagaccatttaattcatttagaatccccattgaaactctaacacctcctccaccatgaaccaattatggaaagacttcctccataca

SEQ ID NO: 4484 - DNA, 201 bp, Bos taurus
tcatatgatgaaactagttgtgaggctttaactgaagttcaacttctttccccaaaatattgtctaaacttttggccattgcttccttatttgttaggttatgcttagaacaaagaatgtttattaatgttcaaaggaaataattcctgtgcaggatatggcaatgaagtttgtggaatacagacagaaaaccaatattat

SEQ ID NO: 4485 - DNA, 201 bp, Bos taurus
actttttagcttatgagaacctgtgaggcctctggctctgggagtggtcctgtagcagttgctgtaactcggggagggaagtaagaaatggaattgatgggggcccaatatatgtgaagttactatttaaaggaatcgtatttccttcttcgtctagaaccaaactaggcaagtcaggatttatctttaggttagggaatt

SEQ ID NO: 4486 - DNA, 201 bp, Bos taurus
ataattttattttttatttttatacaattttgaaaagttactttgcatttacagttattacaatatattggctgtattccccatgttgtacaaggcaacctgagtctatcatacacccaacagttagttcttcccactccacccaattatatgcccccatcttctttgataaccactaattttgtccctatgtttgtgagt

SEQ ID NO: 4487 - DNA, 201 bp, Bos taurus
attctaaacaaaagcaacatagcacagtaaaagaaaaacaaaattttaagttaattcaactcacttatttaaatggtagcctttgagattttagaagacagaaaattttaactttgtctattatttaatgctaattcattatataacattttaacaatgagtttcatctaaaagcaaagtttcttttagtgttttctcttt

SEQ ID NO: 4488 - DNA, 201 bp, Bos taurus
attgttaagtaatctgtaaagaatcttatacaaatagatggtcagaattgtcagcctgatcagataaattgtggagtcctcagaactatctttgacatttgtccttttctcactcctcactataaacacgttaagccttatatttctatgatcctctttcctaagagatcttttaaaaggattttttatgtatatgtgaga

SEQ ID NO: 4489 - DNA, 201 bp, Bos taurus
aaaatgtgaacatactaaaatttggtattagactatagtactctttacaactttatagagatctcttaaaattctgcatgacttcagcaagttattgcttcaacaagcaccattttgtatcaagatttttcacatcattaaataaagctttatattttacttatgtggaaatgagggattaggaagattaatccctaaata

SEQ ID NO: 4490 - DNA, 201 bp, Bos taurus
attcctttttgtaataaaataatgtcttatatttcccatcctcctcctactattttttttacaccctgacacttgctcttcaccagcccataattatatatgataaaatgtgctatcaagagttcctctaactagtttggtttttcacttcactgaagggaataaagttactgaacattgatctggcttgcctaaggaaca

SEQ ID NO: 4491 - DNA, 201 bp, Bos taurus
aacacaatgacatggaaagagaagcctcaattgtttgaattttttcaaaaaaacttccttccaggctaaaatgcttcttacagatgcactaaataagtaatgtattaacattgtaaccaatgaaggggtttgttagaactgtccctagggttacatatttcttgaagaaagcaagaatatacattgcaacttaaaataata

SEQ ID NO: 4492 - DNA, 201 bp, Bos taurus
gatttccactcagcctttgtctatctaggtgcaaagaattttctacccatatatagtcatttcattttgtaagaatgaatacaattatcaccttgctagacgctaagggaattatttttttaacctagctggagtgaagtgacccaattaacaccttgcatgaatactctgaatattattaattttataaggtgttttgag

SEQ ID NO: 4493 - DNA, 201 bp, Bos taurus
ccacacaggaacaacaaaattgataaataccttgagaaataaagcacatgaaaagaattttagggaattgttggaaaatacagatattttaaaaatatatcaatgtttactatttgctactgtcagaaaacactgtaaaaactctgaaattgacaaatatacagagcattgtattaaaccctcaggttatttctgcctttt

SEQ ID NO: 4494 - DNA, 201 bp, Bos taurus
cttcaaaatgatttttttgttttttgacttgtggtcagcttatgaggcacccacttattgagttttttcacctctccaattcacttcaaatgtcacatgatcataggatggtctacattgagttcttggataatttctcatgcagttgtaagaggatcagctttgatgatcctctcagttggtcgttgtcaacttcgatgg

SEQ ID NO: 4495 - DNA, 201 bp, Bos taurus
caatcagattgtgacgtgtgctgaaaagtgggttctatagacaactagcgaagaccagctcagtggttggaccaacaagaaactcccagttcagttcagttactcagtcgtgtcctcctctttgcgaccccgtgaattgcagcacaccaggcctcccttgtccatcaccaactctgggagttcactcaaactcatgtccat

SEQ ID NO: 4496 - DNA, 201 bp, Bos taurus
atgatctagaaccactgctaatctaatttctttaagagtttgtattatttaatatatattcttgattattgaaagaatatgtggaaaagttgatgtcaatagcacctaattgttgagaacaggtagtctcgatgattgcattattgtctgtataaataaaaagaaatcaactaagcaatataatttaaaaacttctgaatg

SEQ ID NO: 4497 - DNA, 201 bp, Bos taurus
acaagagtactggagtggggtgccatcaccttctccgcacctcagagagtctggggcttttggtaactttcccaatgttgtggaatggtgttgactggccgttatctccttatctggtattgctggttggtttcagaatgcgtttacccctgtagcttttgcactcgattatttttactcctctagccaaattgctggcca

SEQ ID NO: 4498 - DNA, 201 bp, Bos taurus
attactgactttatcctgaaaaaaattcctataccttatcttaaaattgaaacttatttgaaacaaaaatctgcttttttttttgttgttgttcattaatgccttcatttaccttcacttttgtgctctttttgtatgtacagaattttaggttggtaagtgcacaggtgttgttgctacagttattgtcattttcagtac

SEQ ID NO: 4499 - DNA, 201 bp, Bos taurus
aggatggagttcaagcagctagatatttagagatctgggagagaaatattccataagaggaaaaagcaaatgccaaagacctaaaatggacatttttttttaatatgaatgagaaaaaaactgcaagggagtggctgaaaccaagaatagaagaaaataaagccagaagggtaagtatttgattctagaggcaactgattt

SEQ ID NO: 4500 - DNA, 201 bp, Bos taurus
tatactcaggacctgaaataaatatgaattaggaatactgaagattatggtaataatgcctagaacgttcttagaatagtctaatgaaatacattattgggttacaaaatagttaattgaagtcatatcattacaatagttgattcctttgatgtattgcctctgggcatgattaaagatttaacaatattggtcttatat

SEQ ID NO: 4501 - DNA, 201 bp, Bos taurus
gagtatatataagaaattgttgaacatatgtatctaatttaaaggacacacagtaagaaacattaatcagccacccacaatctttcaaaatacatatatccatactctctgtagaaaaatatagtatacatacaaaatgcatagaaaatataaactttgattttccctactcccattggcataaacaatatgagctattat

SEQ ID NO: 4502 - DNA, 201 bp, Bos taurus
taaactctggagttggtgatggacagggaggcctggcgtgctgcgatttaccgggtcggaaagagttggaaccgactgagcgactgaactgaactgaatctttcaaataaacgcaggccaggcaaatagacttaaattagtaagcaaatgttggcaactaaagccattcagatattaaaatattgtaattaccaaacagaa

SEQ ID NO: 4503 - DNA, 201 bp, Bos taurus
aaatgaaaatctctttacaaatgtaccttaaaaatagtcatttgcatctcacagaataaggccccaaattctcaacatggcctttgctctccataatctgcctctgccaacctctctcatcatatttctttatacactcattattcattgagctctaaccccacttagcatcctttgtaaactccaagaactctcaacttg

SEQ ID NO: 4504 - DNA, 201 bp, Bos taurus
tctatagcaatgaagtttattctataattacaatgtcaatgaaagaagaaaattaaatagccaatcttagagcaaaccttccaggcctttattctcctgtgttgtctctccaaatgtgtctctctggtgtagccttctaccagtggtggtgggggtttagttgctaagtcatgtccaactcttgtgacccatggactgtag

SEQ ID NO: 4505 - DNA, 201 bp, Bos taurus
cacaaaggacatcccataacttaaaatatattaagtcagtcattgtatacatacttgaattgcatttttggagcttgaaattattcagaaaaatcggtgaatctctttctctactttttaaggatctaccagcatttaacacttaatattattgactgaatggctggataaagtaaatgatgaaagcatttgctacttctc

SEQ ID NO: 4506 - DNA, 201 bp, Bos taurus
aagtctaagatgtacttctggaaaatgcataggtgaggacattgcagagcacacaaggaaatattttactggtttcatcccatgacctgttatgtttcaaatatccaagatactatgatgtttcttcataaacttgaggatatatatttcttacaatcgttattaaatatttctaggattatccttacaattctatgttct

SEQ ID NO: 4507 - DNA, 201 bp, Bos taurus
agttacttgagcccacggactttattccgattactgctatcctacctgcacctataaaagtgctgggcacttagatattattcaataatacttgttaagtgtgtgaaaatgaatcagtgagtgaatgaatgaatgcattatatactgtaaagcatttcatacgtgtacaaagaagggagttacctctaacaaactcacacg

SEQ ID NO: 4508 - DNA, 201 bp, Bos taurus
tatttccattccaacttgaagtccattatatatatctatatatacatataccacatttaaaaaatggtagactaaagttgacaatttttcccaattcaaggataatataaattttatacaagattacaagtaaatctttattgttatagttcaagagtagttagactcagtgaaatagcaaagtcaatgaaaagcatcctt

SEQ ID NO: 4509 - DNA, 201 bp, Bos taurus
catcgcaaggaaccctgggagaactgctctgatgaggtgaggggagaaaccaggctatatagaagttttgcaacaaagggcaggtagtttgaacatcaaaagatcattgtgaattaaaggaaactagatactcaaggaatttagcgcttttctatgtgtgggaagatgcaagagtctgggcttactgaaatcattcttttc

SEQ ID NO: 4510 - DNA, 201 bp, Bos taurus
gaaatagttacactggttggtaaaatgtttgctttaagttcctgttgtaaactgtatgtaaaatctgaaggagctattttgataatacttgtcatttacatttgaaaacctgtttatttctcccatgaataaagtcatacttttctgttctttctctcctgattacaaactccttcaagctgactaaactttgcacattca

SEQ ID NO: 4511 - DNA, 201 bp, Bos taurus
gcagagggaaggggttccatacctggttggggaactaagatcctgcatgccatgtggcatggtcaaaaaataaaggagtcaaatgatatctctgtttcccaggtacattctcttgttcttcctataataagagaatgcaggatttctagggcacagacaagttgctgctgctgctaagtagacaccagctaaactgaagaa

SEQ ID NO: 4512 - DNA, 201 bp, Bos taurus
ctgacattcacttaatatgatctgagttgtaacacatgtctttctcttgaggttgctgtgaaagttacataggataatatgtacagaggccctctaatagagaatgaagtattatacaattttagtgctgctgtgctgtgcttagttgctcagtcgtgtctgattctgtgtgactccatggactgtagtcggccaagctcc

SEQ ID NO: 4513 - DNA, 201 bp, Bos taurus
gccatcagcaccagacagttttcatattgtgctactccagagacttctgccagctggaaaacttgtgctcaaagctaaaggtgctactcttgggagccacgcttaaagcagaatggagatgtttgtttctcttgctcctttatgaaaggtggtctgtgatgagttcaactgttgtgcttccgtcagttgaccaaacactat

SEQ ID NO: 4514 - DNA, 201 bp, Bos taurus
cccacaaacaagattttagaccatgttcaatttcccaacttccaatgatcagatattttttcatgacatttaattcttactatcagatattattcaatgctctggcctcagttctcccaaagctcatgaagaatgtttctcctccgaggctattgctttgtcctagatcttaaactcaataagctacgtatcttgagtctt

SEQ ID NO: 4515 - DNA, 201 bp, Bos taurus
tcctctaaagcaaacagaggagaggacaggcaatgaaaaagggggtaaaagtgaaatccaaaatcctttgcctcaaaatgtaattttgttgtaaccgtgttgttacatatatgcttgtttctaagtacagatttgttttggaggcggggaaaagctcctttcttgcatgctttgcgtcccagtagatacacaatgtgcttc

SEQ ID NO: 4516 - DNA, 201 bp, Bos taurus
tataatcattcatatcgattatacttcatataaataattttgaatcatgtgtatataggacacaatgaagtgaactgagaaattaaaaatgcttctgcttctatatcctatatacattttctccaactggtgtgaccttgtttgactcttcacattaggtttgctttgagaagtcattttccaaaattcaccagtctagta

SEQ ID NO: 4517 - DNA, 201 bp, Bos taurus
caacttttcgtggactccctctaacgatgtgatggattgattaagaccaaatcctatcctctctgtgtttattggagaaatggcttttctcccagccttgtgcagaaaacccgctatctgctgttctctggggcatgtttaaaggagttcttctctatcgactgagcacccaccatgtgtcagttaatgtacatgcaaagt

SEQ ID NO: 4518 - DNA, 201 bp, Bos taurus
gacatcatctgcactgcaaataacacaacagaagtgcttttcttgagctccagtgaaggtttggacaacaaggccatggtgcgcttgaaaagtttcaccactggcctcactcattttggctgccaaagaatgctttatttcctatccaattgccaaaaagtgctatcatttgaggcttaggagattcggcttgtgggaaac

SEQ ID NO: 4519 - DNA, 201 bp, Bos taurus
catcaaagtgaatttaatgcaaaataaggtagagctacttttttccttacttaaatggaacatcacaaattggacagggtatcaaaaatgactattatacatggttgcattcagtgtctttgcctgtatctattctaaaggatttggaaatcaaatcctctacagcctgaattgcactacagcagattataataccttcgt

SEQ ID NO: 4520 - DNA, 201 bp, Bos taurus
gagacctgtacaatccagtacctttaaaagaagttctctgagtcctttctcactgtactgtgctttccttctctgcattaaaatgcctgcggtatctcagaagcaatgttgacaccatgtgaattccattatcatgctgtaatgctataataatatagataagtatagtctatgcaatgcttgattgaaactccctgtgtt

SEQ ID NO: 4521 - DNA, 201 bp, Bos taurus
taccacagctttaaaaaaagcaaactgagttctagaataggtgatacctccatacaactgagggatattatggagcaatggggagagaacttgtggtcagctgcagctctctaacttttaccttcattcagtggagcccatagtgtttgagttccctggcagtcatagagaaaggaaaatgtgatttcattagaagaatat

SEQ ID NO: 4522 - DNA, 201 bp, Bos taurus
ggcatattagaacacttaacagtctttaactgacagttgagctataaacagttaggaacatatgaaggacccaagtacgaaagggttagtgatgttccaacgacatggagcccatagactggtgtccctggaccaattgcagaatcactgaacagaatcactaaaggctttttttaaaatcacagagccttgagtctcact

SEQ ID NO: 4523 - DNA, 201 bp, Bos taurus
gagagcaatttaagtattaattctttcttttccatgtggaactgtacttcagagtaacaattagctccaactgacaagggaaagctctttttgacagaatcccaattaataaatgcaaaatgactgaatgcaaaaagattgatagaattgggaaagtcatcattttgcaacttgtaatggaaaatgtggttaaggcaagaa

SEQ ID NO: 4524 - DNA, 201 bp, Bos taurus
actacatgttagaactgacctgcttgtcttcaattttatttcctatcttttctctacataaatctttgtagagctgaaccactcattaaataaatccccatatttattttggcctgctagcaaaagtattattggatttccctaaacttctgtaactgcctcatcctctgataatttattaccacttactgtctgtagcaa

SEQ ID NO: 4525 - DNA, 201 bp, Bos taurus
gtctttccccaccctcaggctctccgggcccaggcgagctttgaatgtattaattaaataaagcaggcagcccttgaatcgctccaatgcagggcgctcccgggagcgtgaaagtcctggcctccgaatccgccaaagaaaatgtgtgaaaagagaattagtgaaattaggttagaccaataaaacgtgagggcgccagca

SEQ ID NO: 4526 - DNA, 201 bp, Bos taurus
aaatgtgcacacacacataccctacatttttttacatctgttttcaggatgggaaatatggggttctaattgagtttgtggtacaaagggaacttcatggcgaggaagctgagtcaggtggtaaaggaattaaactccacaatgagatttcaatacacagatgattgaaaaaatgctaaagagcctgctctaagggctttt

SEQ ID NO: 4527 - DNA, 201 bp, Bos taurus
aaagagcacggatgacagacaggttagaaaaaactagacttctaaaggcaccttaaagttcccctgtaaaaacatatgcactcctatacaaggatgtgggaaaaaggctctcccagaaacttttcccattacataattaacagaaacaaaagagatggggagtgtgcattttatacgggaatcttgtttctgtaacaaata

SEQ ID NO: 4528 - DNA, 201 bp, Bos taurus
ttgctccagccctgtgattggttccaatttgtttagttgtgtcctgccccccaggcactgccactggatgtcccagagagcctcccaaagaccggcctgcgctctgcctgagcctgtctggcactggttgtggcggtggggtccatgtgggcgccgctgacagtatgtgcaggtatctgtggctcccaggtgccagcaccc

SEQ ID NO: 4529 - DNA, 201 bp, Bos taurus
ttaaaagagatgtggttatgacttacacagactgtagagttagcaagtatagaaccaagtcttaaagtcaggtctaacagaaagagatcattcggaaagtttgtacattgttctgatatatttttctataaccaaagggggaaatcatgcctaaacagtgttatagttttagtatataactggcttggggccactgcgttg

SEQ ID NO: 4530 - DNA, 201 bp, Bos taurus
gttctgagcataccatccccttcagggaccctggccaattttatgtttaaaaaccatgacccttcctcacatgcgtttggttaggattgacctaaccaaaagcaatttagaacaccattggccattatggggaactgttgaaacacccaaacttacttttcttaaaaccaaatttgatgctgtagctttaaaatttcctag

SEQ ID NO: 4531 - DNA, 201 bp, Bos taurus
ctgtgtagaggcatcttttgtggtatctgccaagcccatggcctccttttctggacctgagggaacaccccatgtcatagtgcttgaggagagaaagtcagtagttacaaggatgagaaggattaagcgaagaggacttccagcctaagacatattctctctgttccaaagagcagtgatagataatctgtttgaggagat

SEQ ID NO: 4532 - DNA, 201 bp, Bos taurus
cctgattgaattgaattggaaatttttgtctgcaaaaatctttattgcttccatttggtccaagatttgtgagagggctccaggatggttaaaaaactgcttaagtggccacagagaggggtttcaggtagaagccctgacacctgctgctactgctgccgctaagtcgcttcagttgtgtccgactctgtgcaaccccat

SEQ ID NO: 4533 - DNA, 201 bp, Bos taurus
gcacttcatgaaagccaaaaagcttacagagcaatgtttttaagagaacttcatctcctgcaactagggagccaccagagctgaaaattaggcctgaaatttgataataatactggcagagttacaaaagactgaattagtaaccttagctggtcttctgtgttaaagcaaaggacctggaacggggacacttgagtagat

SEQ ID NO: 4534 - DNA, 201 bp, Bos taurus
tttacttatatataattttatataaattttaatatggtatgcacatatgttggtgtatttttttctgctttagtgcatagtagaataacattcagtgtgatgggctagttgaaaaattaaatgaagggaaattcaagatttaattgtccaagagttttgagagtttatagggatggcaacccactccaatattcttgcctg

SEQ ID NO: 4535 - DNA, 201 bp, Bos taurus
ccttccaggtaggcaaggcatgtgaccgcttttatccagtgagcattttgtgaggagaaaacggttcattattctgggccaaggctgcgaaagacacatatgtggttctccaggtttttctcttccctttcacggtgaccaacaggatcaaatctctagatggtgcaatacgaggtggtgacacctcctttgtctccgtca

SEQ ID NO: 4536 - DNA, 201 bp, Bos taurus
actttccagaggaaacaaagcagagctgtattctatatgatttgttaacatagaagcttatagggtaatatgatataatccgagggatgaattgtgtttcgttcacacctgatgccaagagatctgatggcttttggggggttttgttctagggattttagagaagaggtgtcacttaaactcttaagtgctatcagtttg

SEQ ID NO: 4537 - DNA, 201 bp, Bos taurus
actgtaaaaatatccacatgtccctgagataaaatcctaattcaaaataaaataactggagacaaaaatacataaagtgcctgatgcctgcccagcacaccccgtacttcaagaatttggaacagcctatatttcaaagtagtactggggtgagcaggagtgtagacagtatagcaaatctgaaaatagtgcatttttctg

SEQ ID NO: 4538 - DNA, 201 bp, Bos taurus
gagcattgccaaacccatagggtgaatcatatgattaaaaaaatgtatagtattaaggaaatgtatcctaaaagcagaggtgttttaaaatgcattttgacattgctaatacttttttttttccgaatagctaataattcagagctctgagcatgaaaaagcataagatttagccagatctctagaatatgggtgaaaaag

SEQ ID NO: 4539 - DNA, 201 bp, Bos taurus
ggaaactgaggggtggagggtgaggccctctgtatcctgctgtatcaggatgactagaatccctgccaaagtcctaaaattcacagccagggaaatggcacaaattctccctgttgatatttaaggccaaagagacatttaaagcagaaggaaccaggtggttcctaacatggagggactggaatttatttgttttgcaaa

SEQ ID NO: 4540 - DNA, 201 bp, Bos taurus
ctatatttgcaaatgcaggcctcatcactgaattaactggctatcatcaatgtatttaacacatctcatgcagacttctctccaaatgactgagaaatccaaggtgacttcacaatggcaatctcaaaaactgggttatttacaaggttgcctgactgagggcagcttcaaacctctaaaccccttgcaagcatcatgcct

SEQ ID NO: 4541 - DNA, 201 bp, Bos taurus
agaaataaaatatctcatatagttttttctctttccatcaacatatttctttcctatgtgttctattatctatatgctagtaattgttaaatctacatcttagtttataaatctcatgttttgttgtttatggatatttctatttttggaattcctccataaatattaaggagagacatcaaatgggagaacgagctccca

SEQ ID NO: 4542 - DNA, 201 bp, Bos taurus
taggatctggccactgcactcatagctttccaccactttatgatggtgctccaagcatcccacatttcttccttacatatcatggaccatgtcaagctcctttccgtgcctgaatctggccacatgtgcattcctttgcttgaaatgccccattatactttttcttcaaaccctcctttaccaaaaaaactccccaaagga

SEQ ID NO: 4543 - DNA, 201 bp, Bos taurus
cgctggtatccaaggaaagcaattctccttaatcaagtcgtattttcttagtgtatcctaggctctaacccagggaacttccctaaggccctggtgagaagtgcagaaagacaaggagaaattctaaaaagaggaataacaatgtgactagatgtgtattttagaaagacacctctggaagcaaggtggttaagatagcca

SEQ ID NO: 4544 - DNA, 201 bp, Bos taurus
tttaaatattctttccagaacaaaacagtaagatttcattttcttatttcatttcttagcccatccaacaaatttggtattgaaatctatgcaaaggtaccgaaggggacactgttcaagtgcctatggaaaaaacaatgatgaacaaagagagcgcttgccctcacaggctttactgtgggaggtgcattttccatcttt

SEQ ID NO: 4545 - DNA, 201 bp, Bos taurus
taaccaatgacagttgggagagcaaaaggacaaaagcattgcagctctcaagcctcccacacatgtctggccatcttctggcctagtgaggtagaaagtagctcagggagaactccatggagcccagagaactaaccatctggcaaggaacactcagggcctgagaagggtctgagaagtaactcagttggagtgagatga

SEQ ID NO: 4546 - DNA, 201 bp, Bos taurus
tctttctcttcgcatggaaatatcatctccttcatcacatctttcttccaaaagttttagtaataggggaagagaagaaaccaggccaaatttagagatacatgtccaaaacaatggaccactgcctaatacttaaaaccaaaggaagggatatgttttttttgtaagaggcctttataagatttaaaccatgactatagc

SEQ ID NO: 4547 - DNA, 201 bp, Bos taurus
gtggagagagggagccttagcaggcaccatcaagccccaggtatgtgactgaggccgctttcgaccattcagtccagcctatccaccctctgattgtaacgacatgaaggagttcagcaagaccaacagaggaactgtccagctgaaacaacaacaatttgttagtcttaaatttttaagcaaataaaatggttattgtct

SEQ ID NO: 4548 - DNA, 201 bp, Bos taurus
taatgagcccagctgggataaaaaaagcaaaccaacttttgaatgaataccactacaattctatcattttacatcttaaaaaggaccatcaatatttaacagtaattgttttttacatgtctctaatcagctctctctcctttctctaggattttagaacttcttgatgctcctcaaaccccctttcatacctctactcct

SEQ ID NO: 4549 - DNA, 201 bp, Bos taurus
tgtgtcctcaaagcctggctacatagtacctagaactgagccaaatggcgagtgagcccttagaggcgtttttggctatggtgagggccacagccctggggtgggtggtccttacttaagggaatcccaacttctagaggtattggcaattccctgaggcctatactgtgttacggggaaacatcttagcagttcttttga

SEQ ID NO: 4550 - DNA, 201 bp, Bos taurus
tgcacccaagaaagattagcttattacatgtctccaacagttgcactggacccctgaatgttcactttggaagaagctgaagttgaagctgaagttgtatgaagacctacaagaccttctagaactaacatccaaaaaggatgtcctcttcattacaggggactggaatgcaaaagtaggaagtcaagagctatctggagt

SEQ ID NO: 4551 - DNA, 201 bp, Bos taurus
gcacgcgctgtccctcacggaggacagagtgaagggtgctttcccctcataccagcctagaaaagaggttttaatgcaaccacttgaagagttttatctgtgtatcctggaactcatgtggacacagtggcctggtatctgatccccaagaaatctagaggatgagagactgtagttgactactgctttaacatcagagtg

SEQ ID NO: 4552 - DNA, 201 bp, Bos taurus
atgcctactcttttccttttttattatttcaaatgcattgttagttttgctcttcttttaggctcacccctttagccgtcttttcttagaagtgaacaattagaaagatccaataatttaaggggtgagtttctaaaatcatcttaaattaccagtggttagtgttctcccagatactgggtgattaacatgcttgcttta

SEQ ID NO: 4553 - DNA, 201 bp, Bos taurus
ctgagaagcactggtgaccacaggggtttccattgtgcggggagaggtgggctgcaccaagtgaccccagccctcacaaaactgtacactcagacatacacagaatcattcatatgctctcccccttagtgtgtgatatctgcaccctcatgtcaccataaagggcttcaggcaagattaagaagctctggattagatcag

SEQ ID NO: 4554 - DNA, 201 bp, Bos taurus
acttaattgcacagaatattagatgcatgtaaaccttaaggcatgagtcgtgttctctcactattaacaaaaagctagtcgagactttaaagaaattgtatgaagcagtccaaaaactattacacaaataatacttaactagcagttctttgattaaatgttagttaagtaacttaaaagaagtgttttgagcataatttt

SEQ ID NO: 4555 - DNA, 201 bp, Bos taurus
tgtgcggatcccacccatcgaagtctatgtactcacctcgcttcccagggtagccaatgggacagctgcggcaacacacagacagaagtcagcagtgagctatggccagaaacacttacattcttgtactagccagtcatctctcagcctctacacttcagcctcatactttgtgaagaatatggaaaatccatcagggct

SEQ ID NO: 4556 - DNA, 201 bp, Bos taurus
agcactgggggcatcttcctctgatgccagtcaggggaccagcaatatcttcctgttttccaagtgaagaatgaggccaactgtactacatatcccatcattcccatgccatgtgacttagcaacaaaagaggaaacataccctctgtctgtccagtagagtttatggccaatccagtcaacagcaagaccttctggtaaa

SEQ ID NO: 4557 - DNA, 201 bp, Bos taurus
tttaagtagaggagttaacccctcagatttaccatttataagcaagaggagaaaatgaaaagattaagtggctgctccaacaggccggataagacaagccagctgtttggactatggtggtggcagtggaagagagaagtggacatttgagataaattagaatgtaaaatggaaaggatttggcagtaggctgaaaattgg

SEQ ID NO: 4558 - DNA, 201 bp, Bos taurus
tgagcagagtgggagtggagggcccattgtcttaaaaaaaaaaaaatggtagtgctccagctagtgtatcgcagttgatcttatacacactcactgagaccctggcccatccacagacagaacgcacagcacagagtctaagatggcagcagagtcagactgccagagctcaagttctcttccacatagtaactatgtacc

SEQ ID NO: 4559 - DNA, 201 bp, Bos taurus
gttttaaatgcctcagatggtcctcactcttaaatcatactgacatttctgttaaaaataaaacagccctgaagtcacacaattactttctagaatcctaaagttcctttaagatctttcctagtaggttttaacttttttagtttccatccattgaaatattttgccaataaataacttcattattttacacatttcatc

SEQ ID NO: 4560 - DNA, 201 bp, Bos taurus
gcaccttggcctgcccgacgagtgcggccgcactgcaagcactgcaagcactgcacaggcgttgccttgccccgcctgtgacggccagacgctcacgcctgtaagctccagattcaccctctttcactgctctatgaacatgaacctgagttctttcactgtttttcctttgatggttggccctcaagttctgtgagtggg

SEQ ID NO: 4561 - DNA, 201 bp, Bos taurus
gctcactgtcccccaatagtgacttgatggagctcatatcaccctgttctgatctactgcacagggtccttgcatgtggatctacagctggggcctgggcgattctccactcaccagtgacactttttagaccctgaaaaaactttgcctctaattttagacaagagttttgagattacgtaaaatatctttatatactac

SEQ ID NO: 4562 - DNA, 201 bp, Bos taurus
acttgctttaacccctaaaatgtggtcaaaaggacactgctgtttgagaagaagcctagctaccctgctggagagagcatgtgaaaggaccacttttgttgtttagtccctaagacatgcccagctgttttgtgaccccatggactgcagcccacccagctcctctgtccataggatttcccaggcaagaattctgggtgg

SEQ ID NO: 4563 - DNA, 201 bp, Bos taurus
catgcttttaaaaataattttactttatttatttttggttgtgctaggccttcgttgctgctctgatatttttctctagtttcagtgagtgggaaggccacgctctttttttggagcacaggctcttgggcgcatggacttcagtagctgccactcccaggctctagagcacagactcaatagctgtggcacacggtctta

SEQ ID NO: 4564 - DNA, 201 bp, Bos taurus
atcactatgctctctacatatggtagaacatctctgttatttcagaaatgttatttcacttctctggagtgacccttcaatagatgctttgaccttcaaaataagctttctttccacaccttcatactagttaattatgtcctgcataccagtcccaacccagagtgccaactacctggagacctttcaggcttctgtctt

SEQ ID NO: 4565 - DNA, 201 bp, Bos taurus
cagatgaacaggcatcaatgaaagtttcattttttctaatttgggcacgtgacaagatggtagaatggatatttcctttgaataaattgattttgaaattcttttatgaaggtaagaatatgctactcttttcccatgttaagtgatagttaaaattgcgaaatacatataagtaaaagcaacctctgttataatttaaaa

SEQ ID NO: 4566 - DNA, 201 bp, Bos taurus
cttcaaaggcttttcagaagagcagctgattttcacagtctgggaagctttggcttaggatccttcaagcttccccaagagaagcatgagctgctcacgctttgtctctgtatgatctcttggtatgaagcctttgggcctggacatattggctgcgcatgtgctgcagtccagttgtgtgctcttgagaagataagtcag

SEQ ID NO: 4567 - DNA, 201 bp, Bos taurus
acattttgcattagagttgcagcttgtggactttcttctggtgggttggtggtgaggtatcagggtgatgctttgggaatctttatcatcagcttggttctagccagtctggggtctagtgcatgtgctgtcaccatcttccatgggaagggggtcttggtttctacagagcaactcaaagattcatgtcagattgctatg

SEQ ID NO: 4568 - DNA, 201 bp, Bos taurus
attgaaatataaattgtaaataacagaatttttattaagctacccctttatatatagaataacaattaaatgacatgcaataatattaaaagatatacttcagtcctttaattatatatgtttaaaagtagaaacagtacgacacttaaggcttactctttgaaggcattcttttgatggaaaaatgcagcccctaattac

SEQ ID NO: 4569 - DNA, 201 bp, Bos taurus
actgtatttttaatagactttattttttagagaagttttggatttctaattactattttaatcttttccattattcttaaaaaaatttaataccacacacctactaggaaaaatctattttatagtgctaaacaaaaaataagcaccttctatttaaaaaatgatttctccagagcctcaaaggaagatgtgtggaggaaa

SEQ ID NO: 4570 - DNA, 201 bp, Bos taurus
tgcaaatgattgcaatgtaactttatagaggaagaagaatttcttccatgagttaagacattagcaattatagtacaataacccagtgtaatcgtaaaacgttttttgcccttttagaaagacactatatgcttcacattgcctagttttatctggtaggtgtacaaaatcatctttaaataagttacatttagtccaagt

SEQ ID NO: 4571 - DNA, 201 bp, Bos taurus
tccttttttctctgtgtagagtcaaccaaggtcagagttccttgctttatcccctcacttgactaagtctccagaagcaaaattgtcctcaatgctaaatgtgtgccttattctgtacaaacttcaaaaaacttgagacttgactcttctttgtagctcagaggcctgcagaagcccaaaaggacttgacccaaaagaggc

SEQ ID NO: 4572 - DNA, 201 bp, Bos taurus
tattttcgttttgctcacattaatagtataaacgacttggtgagtgagcgtacaggacccatacttaagtcagacctgggctctggtcctagaagagtgttaagttaccttgtgatctctgtcacattaaattcctcttctatgaaagtctgagtggcaaggtgggaagtacattaacaaaaaggcaaggtcaagtccaca

SEQ ID NO: 4573 - DNA, 201 bp, Bos taurus
tggccaaagtctttgaaagtattgcatgtgcctgctaatccaagacctctcctccagttcatcacaaatgcccagccatgccatccacactgcacttctccaggtcaccagggccctccaggttgctaaacctgctgaccatttttcagtcctcatctcctgggacctagtgggggctgatgacctaacggatcactctct

SEQ ID NO: 4574 - DNA, 201 bp, Bos taurus
ctaataaaaagctaatcaggtggggagcctttcctactaggtctgggtaagtatatctggtgagaacagggggatatcctgcttaggcctttggaaccctgaaaaactgaaaggtattaaggcaagctcttgaaatcttagggctttatgatgcattgcccaagatctcaagtctgtgctccactgtattcttatgttctg

SEQ ID NO: 4575 - DNA, 201 bp, Bos taurus
ggacacgactgagcgactgaactgaacttaactgaagagtatagcctttctattcttttaggaaatagccttccattttccaaaggaaaagcaaatgattgggtgataaaatcataccttttgccttgtgtccctctgaggctcctggtatcattggcatccttttgtcttgtgctttccttctctaagagctttcgggaa

SEQ ID NO: 4576 - DNA, 201 bp, Bos taurus
gtccttcaagcgactattctagactttcccctgaaatcattaatacacaagcctgatgaactgtaactttcaactcatcctgggtgcaaatagggataacaagctcccttctgccttcctacggtgtatttcaatgcctaggcacaaccaggtggatttatttctggagaatgattgtcttcaatttaagtttcatagcct

SEQ ID NO: 4577 - DNA, 201 bp, Bos taurus
actcttcacctctgaggcagttgtattttcttttctgtcagcagcatgcaaaccctccaggtcctccaagagattatagtccttcctgaagggaaaaataaataggccagcatatagattatgctatataacgagtctcctgtgtattattatagtgttgccaccccaactctcaattatggcaatttttgctgaggggca

SEQ ID NO: 4578 - DNA, 201 bp, Bos taurus
ctaccctccccaaatgaatgtgctttttcttgttttaaaccttacagctagatttttactgctgttactaggctgcctgacaccagtcaaaggtgccacgcggcctctgctcttagatctgaatgccttagtggcgacagtgatctggtccttgtgtcccctgccactcatcacctgtacgtggtcttgtccggtaactca

SEQ ID NO: 4579 - DNA, 201 bp, Bos taurus
gtccctgaatgcagttttcagaatcattgctggtcgtttgacaactctctccattaggatgtcagctaggcaactagctggccaaaatagaaccctattcgctacaatccccgcatccagaaaaaaaacaaaacaaaacaggatttgtgcttgatttctcctactctgtcatttcacccatccaggcctatccattaagtc

SEQ ID NO: 4580 - DNA, 201 bp, Bos taurus
ggagtggagagttggaaggaaataactcactcctggcccttagtcactaatgtcaagttttcccagcagaattataggcaggatttggttagagtgggatagaaaaggaaaagaagggaagtggccctagtggtatgttttaatatagcaaagcaaaacttaattaaatggacacttgatgattccttctggtgaaccatt

SEQ ID NO: 4581 - DNA, 201 bp, Bos taurus
tggtgtgctgagtggagaggagcaactgcagaggattcactgaaagaggtcatattttttcagggaggatggtggggaggggcccaccgtaggtgttaagagatggggaagggagggtacctttgccatcttcccaaataaatcctggcgctcagaactctgtctgacctgttctctggtggccacataggctttaatgtc

SEQ ID NO: 4582 - DNA, 201 bp, Bos taurus
ctcctttggaaataatgtctatttaggtcttctgcccatttttgattttttttttaatattgagctgaatgagctattggtacattttggagattagtcctttattagttgcctcttttgcaagtattttctctcattctgagggttgtctttttgtcttatttatggtttccttttctgtgcaaaaactttatagtttaa

SEQ ID NO: 4583 - DNA, 201 bp, Bos taurus
tcattgggatgaaacgttgatttaaattttagagatggagacagaaaggtgctgagggagctgctacgctgaaatagtcaagttcaagtaatagacctttcaggaacaaatccctgagtaactgtggactgtgtgtaaggaggaagcagtgtctactcatcattaatgcgatgccttcagtacacattatctgtgaatggt

SEQ ID NO: 4584 - DNA, 201 bp, Bos taurus
ctgtccgtactgaacactaaaaaagaaaatgttgggagtggaatggagcaagttacaaaagttattggagagaatacttctcctttttcagactttctcagtgtcacttattatcctgaacttaggtgggcagcaaaatgtgttctctcccaggtggtaaatgaagttcctttctgaattctgaactgtttctgggatata

SEQ ID NO: 4585 - DNA, 201 bp, Bos taurus
gaccgaggaaagaagatagaactctgtgaagtctgaacatctgttaagagtcatgaatggcttcggggatgagctcatcagcaggtaggtcaactaactattcaacccagctatcatcagccaggttcacaactgttgccccgttgagaatccctaatgtgtcccaggggacatgagattagatagtcatccaaagaactg

SEQ ID NO: 4586 - DNA, 201 bp, Bos taurus
taagaaccacaatatcttaggatttagggctgtgatatctaaaggccatgtcataggtatggggataactgggcgtgtatcttaaagaattagccgaaatgatctaggaggagtttgagtgatagaagaacatttctggaagagggaacatgaggaaatgtagaaaggataaaaatagcctggtatctatggaaaaccaaa

SEQ ID NO: 4587 - DNA, 201 bp, Bos taurus
attctgtaaaaatgcactgatagtctaagttttcataatctgagtttgtacagctttcactcgagaagatacaggagcagagttctggcctgctgtgtttgcttctgttgtacttccttgcgtccttttctaaaaatccttctggaattagaaattgatttcttcagaaacacactcatttttctcttctcccagagacct

SEQ ID NO: 4588 - DNA, 201 bp, Bos taurus
atggcctttggactcttaattaaaagttcggagttggaagagtgtctcaagtttctttgtaccattggttgagattatatggatgctgaattttgtattatgtgcaggccctattagatataatttgaacttggatgaagattatattctataatattattaaggattacttctcattcctggatacaaatcaactgtttt

SEQ ID NO: 4589 - DNA, 201 bp, Bos taurus
ggagtatgtaatatacttctttcaatgtattagatataaactgccagtaagagtttctatctggtaatgagctaaaaaccttcattcagatggggaaaccgtcatttaaaatcaatcaactgagatgacagctcagagtcaaacaacagtgttcacttgctcattctaatttcatctcagccttttgaaatttggctcaac

SEQ ID NO: 4590 - DNA, 201 bp, Bos taurus
aaacttcctatgcttcctctcaactcaatgatttcttttcaaaatcacatgtaatttattattagccagagttaactcagagttaaccttggcctacagaaaaaggctaaactggtgtcaggcacttttcagagaagcagggaagcctactagctgtgttcctgtcacaactgccgcagaaagcagaggcctaatcttgag

SEQ ID NO: 4591 - DNA, 201 bp, Bos taurus
ctgagtaagtcagtagtaaggacgggaacagcacggtttctgccaagtgtgctacacactcagcagagcagatcctgaacacgtgcaaggcctcaaggtctgggtcagcaacagtgtttaacagtgatgtggagctccttctaggatgagtcacgagtgtgtaatttaccatggagtggcctatttatggtacacaggggg

SEQ ID NO: 4592 - DNA, 201 bp, Bos taurus
ttctggcatgctgtgaccacaaagtagctttggacacaaggagagactagtagaattgaagacttgggccatggagtacttaaagcacaccctgagcccttcctcgtatcggttgattctgccattttcattccaacaggatgggttcatgacagtctgaattaactgtaagccaacttgttgtcagtgtgatccatgcct

SEQ ID NO: 4593 - DNA, 201 bp, Bos taurus
tttcaagctcaggatgtccagaagcaagtgtaaaagcagcagtgatgtagccagtactactgtatttttcaaggtgctgtactgcatgattaaaaatatcgtctttactttttgtgctgtttcttatacattatttgtgtgaaaagtattataaacctattacagtacagtactgtatagctgattgttttagctgggtac

SEQ ID NO: 4594 - DNA, 201 bp, Bos taurus
actcttcctagctcaacagcctccttgagccccacagtgaggttatgagaacaagcccagctgcagctgagaagggccaatcagagaggaccctatagacggctctccctgtggagctatatttttcatactataatttgttaccctcaggccatactgaacacaaaagagaagaaggaatagggaagagtggcatctatg

SEQ ID NO: 4595 - DNA, 201 bp, Bos taurus
gaggtaggaaaggcataaccaggtttgagacttgtatttgggaacaaatgtcaggtacttattggcacgtgaaactgattagaaccaagtagatcaaaatcttcctaaggtgttaaggacatggcattaccaaagaaattatacagacctttgacttcttgaatcttcaaccaatccatgggtgcccaaacttacctgaac

SEQ ID NO: 4596 - DNA, 201 bp, Bos taurus
agacaaagtacttggaagaatttaggagggattttcatcttcataggttcctgatgccaaaaaatggaactttgaataatttctttagcacagcataaccatgaccctcagatatcagatttaatattctcatttcgcatttcatagcttctacaaggttccaaaggagaaaaagtacattttttcctccagattaatatt

SEQ ID NO: 4597 - DNA, 201 bp, Bos taurus
ctttgtggcacatttaaatgaaaaacgtggcaaggtctcactcttgtcttcttgcagaaataatcatgtctttgaaactcacatgagaaactgcatcttcgattgttaaactagaattagattccctgggtatacaaggaaacatgctgaattaatctcagagagcaagtatataaatctgagaattaaggcaatagcttt

SEQ ID NO: 4598 - DNA, 201 bp, Bos taurus
tgagatccaggagtttatgcttctcaggccctccctgagaagccctgtcctccttgagggctgcccctgtactcggggcaaatgtgaatttcctgcaagacctgctccaggcctcccttcataggagttggctcatctatctctaagccacaaagatgtgagagtggaaattagtgtcactgccccaggaatatatgtctt

SEQ ID NO: 4599 - DNA, 201 bp, Bos taurus
ttagtctaatgataatgacaaacatagatttatttctgattgtaacaaaatcaaattctcaggaagggctctaaaatgccttacctgctaaagagaagctattgagagagttcagtcaaggaactcaatgcttttaagattagagtctatcattgagtctttaattttttaaaacacctgagcaagtgatttttatttgtg

SEQ ID NO: 4600 - DNA, 201 bp, Bos taurus
cctaactctggcttctgaggcttcagtgtatttttttatctggcccggtgtccttcacttgacttaaccctgaggatacagctgggccaccagcccatcactcttggctgggacactgcccactgtgatgggctttcacagtgcttatctcaaagcacacctgcatcaaaacacacctctcatccaatactgtcttcatct

SEQ ID NO: 4601 - DNA, 201 bp, Bos taurus
caattaaagaaatagaatgctgagctatgaaaatgttcctcctctaaaaatacctaaaatggcatttaaacttcaactattatcctttacctgtttaatcggacttctgagagtaaggaaaatccataggacctgataaagggggaaagggactaaaaagcagtgtaatgatctcactgacaccacagctgcctggagggt

SEQ ID NO: 4602 - DNA, 201 bp, Bos taurus
aaggcagtgggttgccttaattttcaaagaagaaagaaagaaaatgtgttgcaggaacattaatatggcaactgtcttgatgtcaaggagaataaccagagtattactgtagtacaaaaagcaagtgaaaacctgaatctgagtaatagccttggaaatgaaaagcaggaacagatgtgagaaatgttgcagactcagaat

SEQ ID NO: 4603 - DNA, 201 bp, Bos taurus
ctaaaatcctcttaaggagaagtgggtgtctaagagctgagctgggtggggattagggaggaggttcagacagaactaaggtaatctcagggcttccttggtggctaagttgctaaagaatctgcctgcaatgcaggagacctgggatcgatacctgcagaagaaaatagctacccactccagtattcttacctggagaat

SEQ ID NO: 4604 - DNA, 201 bp, Bos taurus
ttatttttgttggtgtcacattactgatccaagtacttcccatttcactaaaagcaagtaaaggggaatgagttactttacactcaaagaacaaaggcagcaacaaaaaaagacccatggccccaggatagaaactgggacaaacagctggacaactacttttattccacccttcattactccctgaacaaaaatcagcaa

SEQ ID NO: 4605 - DNA, 201 bp, Bos taurus
aaagaaatagttgcagggtgagtgatcagttcattcacattcttggttgatgggaggtaacccagccagtagttcaggggtcaacatcatcagtcttatgcgttccaactggcctggggtctatgtgagggtgtttagcatccagttaacttcttccacctggtgagggttttaatctctgcaaaacaactcaaggatagg

SEQ ID NO: 4606 - DNA, 201 bp, Bos taurus
ctttaaggccctggtagagttcttggaggtaaaattcacaaaaatgtgcctgcccgccccctatagctaggctcccctaatgacttatccctatgacttttatccacagtgaagctccagcggtttgctaattacaggatttttttctaccatggcactggttcctgtggccatttctactcacatatttctgctccaaca

SEQ ID NO: 4607 - DNA, 201 bp, Bos taurus
ctttcatttttatcattttttcccaatttttaataaagctgattattatttctgatgtttggtcacttacaatgtgagcttctttccagtaggaattatggaaatgctaccaatttacttaacattacctgtttaaacagggaacatgtgacagtgacttcctggacaaattgatgaatttgtgccatttgttcatcctcc

SEQ ID NO: 4608 - DNA, 201 bp, Bos taurus
aggggccatttctccccaggtctgggagaggcatctctccctgggtctgcgaggcccccaaaagccagagcacatgtagcccaacctggcctcaggtccccagtctaactgcctgggaggctgaggaatggaagggagcaagactctgtgccttaaggagacatggcccgaccaatctggacttgtggagtatgtaggaga

SEQ ID NO: 4609 - DNA, 201 bp, Bos taurus
gttgctttggtagtatctgtgggaatgtcaacacagtgaaaaaagaaaataacctcttagtattattaaaatatttttgacagtggatccactaaaaggggtctctggcattcttagggttgggcagagcacactttgaaacctctgctttaggagatgtgctttaaagaaacactctgtgttagtgtatgatagctatta

SEQ ID NO: 4610 - DNA, 201 bp, Bos taurus
gtctagaaaggttagaacactgactcagcaagtggtacagcctagggcagagagcagttctgcttgactcctgggcagcttatgatattaactgattgtttcaatcccatctcttttgatcatttctaacattccaaagctagggaccctcaaatttcacctatgcttcacatgactttgagatgatgagaacagaaatct

SEQ ID NO: 4611 - DNA, 201 bp, Bos taurus
aggagatattcagagtaccttccctttgttgcaaaacttctatataacctggctcttccctttgctcctcagagcagttctctcactgttgcttgagttgctgtctcctgggcttgaagtcctaaaaatcccagtgaataaaacataattcttataaaaaaccctccaaattctaggtgggttatattatgaatatactta

SEQ ID NO: 4612 - DNA, 201 bp, Bos taurus
tcaaaagctcacactttcatgaatgaaatctgattctttcagccatgaaagcaacgtagaccagctgaagagctggccaagtgtttaggaaatctgattgcatggttatgagttggtggtggagcagagagatgcaggtgtgataaatgtcaattatggcctaagacccgttgccataataaaaagtataacttacctaac

SEQ ID NO: 4613 - DNA, 201 bp, Bos taurus
tgaatagattatgaaagagctctgatagtaaaactgttcatactcttggagtggaattacccaaagtgtgctcctcatcttggataagttacttgcagggatgaaatggggggagagggcagcagaaacatttagtgggtcaagaaggctgagaaacacgatgcaaaaccagtgtctcaaagtcttaaaagtgctaaaatt

SEQ ID NO: 4614 - DNA, 201 bp, Bos taurus
tagagaattattttaatatgtctgtgtttatatttcaggccctgaagaagttgaagggtgtttgtgtaaggttatccttgggtccttgtctcatagaagcgtgtacatctgctgtcctggcctacttcctcatgggtttaccatggcagtggggattcatgctggggtaattcatgatttttttgttgttgttgtatgaaa

SEQ ID NO: 4615 - DNA, 201 bp, Bos taurus
aagctaaagtccaaagttcttagctaagtttggcccatgcgcccactgttctggtcttctgctggtctcttcgcactgttttcatttcctggaacacaccgtgttctctagcatcttgaggccttcatccatgctgttccttctgaaagcatgccttcactccctctcccctaaacaccctgggcaagtggtactcacctt

SEQ ID NO: 4616 - DNA, 201 bp, Bos taurus
ttcacaaaatgtgatggtataagctttaacattatgtagaacacttttctgtttactcacagtattggtatcatgtttttcgtacctgacagttttacaaaatggatgttaatatcagaattttcatttcgtagcttagtgcttaagagcacgtgactccaagtcctggctgggccacatactgtccatagtaaacttgga

SEQ ID NO: 4617 - DNA, 201 bp, Bos taurus
gcccctgcctttcacagcacagtctgggtaacgctggctttccctcagcccctttcagggtcaggatggaggtgacactggctcagggcacctggttctcccacagctcaccttgtgccagcaaatcatcagacgtaaactctggctcatagggtttcccatttaatatgtcaaatacctgttgagaagaaaaacacgggg

SEQ ID NO: 4618 - DNA, 201 bp, Bos taurus
gtactcgacacatggcccatgggtttgttcctctcattttggcttctcagagacctttcttacaaaaggaagtcttcaaatgctttattatgccaataaaatcttccttctgaggacctgtgatgggaccttaaggctgatactgctccgaattctacaaggaattcagttcaaccttaggatcccctgtcatgggactca

SEQ ID NO: 4619 - DNA, 201 bp, Bos taurus
cttaaaaggaattttaccaaaagtgtctgctttcctccattcacctttagaggaaagaactgtgagtttactgtaacatataaaaaactctggagacacacacaaaaaagccaaaaacttctatttaaattatgccttcattaattaaaatgcttttacttcattaaactttctgtctcttgctgttaatgagatgtttac

SEQ ID NO: 4620 - DNA, 201 bp, Bos taurus
tttgaacgcatagctgactatataggaaatttagtgacaaccacatggccaaaacaaagattgaactatcataaaactaatattgtggtgccaaagtgactagaagacttgaatttaatggccatatgaggtgggaaattagaacttggattttaacaacacaaagtaggaactgagagctcttccaaagctgcatccctg

SEQ ID NO: 4621 - DNA, 201 bp, Bos taurus
tggattaagggcccaccctatgtcagtaggacctcatcttatctttatagcttctgcaaagactctttccacatcaggtcccactcacaggccctggagatagaacactgtatctttcagggggatatatccaactgaaatctctgtatttcaatttctccagactagagtgttggttatgagcacaaaaacaaccccggc

SEQ ID NO: 4622 - DNA, 201 bp, Bos taurus
gataaaagaaacatatgagatgaaatgagcatggccaagccatccacatcctgaacaaggcagctccccactgacctgtcagctgaccaatcataagcacgatcagggccaggaccagggggaggagagtgaggcacttgccttgagtgcaaaatataaggaggcaccaaaaaacccagaaataaaaataaataatatttt

SEQ ID NO: 4623 - DNA, 201 bp, Bos taurus
cctgtttcacgttaaaaaatctaaaaatgtatcatgaattaataggcaaaccgcagtgaacatataaaaccatgtattaaaatgtgaactgctttacgaatgtacacacaaactcacaatttcagacaaatattatcaatactttttagtgaagggctatgatacactatgattttcttcttacactatcatatatttttt

SEQ ID NO: 4624 - DNA, 201 bp, Bos taurus
agaaagaaaatattaataatgggaaaatatcattaatgtaaaatgagttttgtaagaaaaaataaaacatgcaacaaaaataggaagtctaagattaaataatagaaatacgtccaaacacataaaggatcacaattaaatgtgaacggcctgaatatttcagctgaggaattaagattttcagactttcacatgaactgt

SEQ ID NO: 4625 - DNA, 201 bp, Bos taurus
tttgccacaaactttcactgtcatcaccaataaccagagtagcacctctgaaatctcaatggcaagtcaatactaattactgtcttgtatttacctgcttattataaaatcctagcagctacagtaacgtgttgattgtattgattcctcttattcattgacccctcaactttttcccctatgtaattcatccagttctgt

SEQ ID NO: 4626 - DNA, 201 bp, Bos taurus
ttgtattcatatgtgtattctgcgtgtgtgtcagtgtttgttttgtataaagttgatggaactaaactgaatgactttaaactcccagtaataccttccacggctttctatttattctactttggcaccgaaccctgttgctcattattgtgtccttcttctgtgtaaaactatttttcggattccctcaggcatagctat

SEQ ID NO: 4627 - DNA, 201 bp, Bos taurus
ctttgattgcctatttgtaaagtgagtattagttaaatggggggtgatcggtgtattcttttttgactaaaggacagataatttaatataaaaattatgttaagaaatgtctttatattttaccctggctcatggtcaatattcaattcacttaaatattgttagaaaaatctttcaaaatcatttttttgttgttgctat

SEQ ID NO: 4628 - DNA, 201 bp, Bos taurus
attaagtggaaaattactacagtctgaacgtttgggtccctcactcctggcccaaatttcgtaagttgaaacctaatcctcagtgtgatgtagttggaggcggagctgttgggaggtgcgggcctcatgaatggaattagtgtctttataagagatgtcagagagctcacttgctgccactgctgtgtgaggaaacagcag

SEQ ID NO: 4629 - DNA, 201 bp, Bos taurus
aagaatttggaaattgagttttctttagtgttttctttcctcctctcctcctcctccctcccttcctttttctctctgtcatctctcttttctctcccccgttcgctctctgctccctctcctttctggctgtcttccttctcatttataggaaaggagtcactatttcctaaatttctactacatgcagggagctttatg

SEQ ID NO: 4630 - DNA, 201 bp, Bos taurus
agtctgggattaaactgaataaagataaattttattctgtaggctttgatctgttactagttcatcttttcttttattgcatagtcttttaggagtcccaatagaaaatttatgatgtttactagttctgcttcttcttggtgggtcttaaactctttgtttctctagtatttataagagtgtcattcactttgtttagct

SEQ ID NO: 4631 - DNA, 201 bp, Bos taurus
ggacagggaggcctgttgtgctgcagtccatggggtcacagagttggacacaacttagcaactgaacaacaacaaaaaataaactttgagcggcctctctaaagaaaagcaggctgaagggtagttcctgagcttcgtgataatttaaatttgtaaaggaattgttaattattacaacttattatattttgtatctgtggc

SEQ ID NO: 4632 - DNA, 201 bp, Bos taurus
gagatcacgtagagcatttcatccttactcctcctgaataatcacagaaatcatactgtgggcaaacttttccttgggaatttatgggcctttcataggcatcagtgaaaaaggcttttatttaaaatgagaaatggctgacctttagacactggcatgggacagcgatttccctttcctagctattttatgagtgtgttg

SEQ ID NO: 4633 - DNA, 201 bp, Bos taurus
ttattccaattgaaaataaaatttttctttaattgtacatttctaagtttaaaaagctgttatttctgaacagaattaaaacttaacaaagttttctatatctagtggaattatgtagaagaattatattgatctttggcctcctggaatccattcagccttccttaatggtgcccagttttcctctggggaaccactcca

SEQ ID NO: 4634 - DNA, 201 bp, Bos taurus
aaagtagacaatagagtcaaaacaaaaattaagtgtataatatgatataatatattataattgtaagtgctaagaagaaaacaaagaagtggagataagaaatgttggcaggataggtgatatgttagtgtgactgggaaaggcctttctgagaggcaagtttcaagcaaatcctgaaagatatgaaaaaactagccactt

SEQ ID NO: 4635 - DNA, 201 bp, Bos taurus
gaggcaactgtccacctgcccccatcctcccatccctcagttccttgagggccgggcctgtgttttatttacttttgcatctccagttacaagccaggccctgaaaaatgggtgtccaaccagtgcctgctgagtgaagccaccttcctgtcctctctgctctaatctatgtttcccaggacaggccctccctcctcgtga

SEQ ID NO: 4636 - DNA, 201 bp, Bos taurus
aagagtttatctccttcaccgtggatgtgtgggcgccaactcacacatctaagaagccaagtctctagtgtgacaggtttcttccttccctcccaccactatgtacagtgctcactgacttgaaacttaactgaggtgagcagtcatgcaagcaaaagaaaatacctctccatccagaagaggtcaaactccgaccccagg

SEQ ID NO: 4637 - DNA, 201 bp, Bos taurus
tatgtgggaattatgtattctcaagatgagtgtgatttctttggttagagaagatggcaaaaacttgggtatgagaatgagggaagtgatttaaaagtcattgaggacttccactttcaggaagacttttccctgttattcacactaaagtacaactgaaaattagttataaaacaaaacaaatataagttactcaacata

SEQ ID NO: 4638 - DNA, 201 bp, Bos taurus
tgttttacctgcagcaagctataaagagttagttgttacaacctaatgaggcattagacacattgataaaaatctagaatcgccattatcccaatttttacttaattgtgtccaggaagtttttgccagtgcagtgatgcatgaaacaagaaagtcttttataaatgaggtgaccaagattgtgattttatttctctctat

SEQ ID NO: 4639 - DNA, 201 bp, Bos taurus
gaaggaccaaatgcctctcagatttttggagatgctgctaagctttgtaggccttgctatgtctcccatccctcattccaggggccctgcctttggggtacaccccttttagtaaggagcaaatccatctgggtttaagccaacaatgctgacagggaaacacccccagagctctgggccaagtgaaatgtggaaccagat

SEQ ID NO: 4640 - DNA, 201 bp, Bos taurus
tttgggctgttttggaccaaaccagggctttccacaattcttgataagtcttgttcccaattgcaggctggggcttgacttctgacagggacacaaagctgctgctctactgctactgtattcaagctgtgtctcaggcatatgttgtggctgattgccaaaatgttactgttttctcaggctgactttgtttcaagtgaa

SEQ ID NO: 4641 - DNA, 201 bp, Bos taurus
ggagaaaatactgaattcttagtaaatggttcaactaatgttaaatcttacccaaaacaatcgagttggcattgtacaactcaaagacattaaacataataaactcatgattgaaaagagaaatgaccgataaaattgaaagagaatattttttcctgaggaaaaaaaatttttcatacaatctcttggttttccattttt

SEQ ID NO: 4642 - DNA, 201 bp, Bos taurus
tactcctaccagcctctgaaccaagatcctgaacaagaggaggtggaactggcaccagtgggggatggagaagatgtagttgctgatattcaagatcggatccaggccctggggcttcattcgcctgccggacccaccactagaaagtgaggacgaagatgagcagggagatacaacattgaacaaccacagctctattcc

SEQ ID NO: 4643 - DNA, 201 bp, Bos taurus
gaactgtccaacctccagagacgtccttccgccccaccaccagctttaccagacgttagcacttccagactctgctccctgctggagaggcttcagaactgtctcttccccaacttccacagggcagcctccagccttctctgagtatctctccaaggttatgcccttgaagtaggacagagaggggaagggagcattttt

SEQ ID NO: 4644 - DNA, 201 bp, Bos taurus
gcgtgtggagcacacgttctggtgggggcccgagagctcggggagaggagtgggggaggggcggcgcctccggcggagccttaagaccacgaggatggagggtgttcggggccctgggctagggttgtgagaattgtgttttcgggataggagggcgcggggccggctccgagcaggcatcgggatccgcagggagggtgg

SEQ ID NO: 4645 - DNA, 201 bp, Bos taurus
acgtgtcctgatgaattttgcctcttgcttgctgatttggtaaagaagtgtggactcaagttcatggtgccactagtttgtgattcagtctcaggatacccctgttcctgggccctggaaccacggggaactgagtcagcagtgtcagcctcattcagttttggggcttgaacatacgcttcaggataggagctcagcaga

SEQ ID NO: 4646 - DNA, 201 bp, Bos taurus
tggtttgctgggtgatttaaaaatatatatattgcaagccctgcacaaagaaataataattcttgctgaagttcaggatttctgtggaggcccacaaggggttcttggaggaaacacatgatggagcaggctttctggtagaagggttgttcaacgcattccttctaagccttgtggccttggaataagctgcagaaccaa

SEQ ID NO: 4647 - DNA, 201 bp, Bos taurus
aatagggctactgaatttattaaggcccatgaaagttgtacagatggtcaagataatgtagaataagaatgacagcagggtgcaggaattggtttgtgggctgtactctaaagctgtagctatggccactgtcccctatgtctgtactgtctcaagagtctggaccagaaaatcttcaatggttcatttatgttcagaaat

SEQ ID NO: 4648 - DNA, 201 bp, Bos taurus
catctttaaattatatatcatgaaattgtagaatcccagaggtagggaggattgtatatatcatttgatcctctctctgcttacaaatcagaaatgtaagagcccaagggttaagggattttcaaaccatacatagcttgtgagaaaaagagcaaagacttaaatctctgctatgtttagatatagatataaacaatatga

SEQ ID NO: 4649 - DNA, 201 bp, Bos taurus
ctgtaactaaatgaacttttctgcaggagtcatgaagttggccaaacagaatttgaaagtgtcctaggaaggatatcttccacactgcagtttgtggtagaacgtaccatctggccactctctcaaagcctggaatgagagcaacaaagggctgccaacctcccgtgatcaaagatgagagtttctgacaatgcctattaa

SEQ ID NO: 4650 - DNA, 201 bp, Bos taurus
tacatggttgttattgcaacagctgagatcacttacaacacagtgaatgcatatcacaatgcacccactcagtcaggggccacttttgctctgtaaatacatataagctccacctgaaaagcccttgctgctaccttatggctgtgtctcagctgggtcagtgggccaactagggcaggagagagtgaagcgtgtctgctg

SEQ ID NO: 4651 - DNA, 201 bp, Bos taurus
caaataatgaccctttgttcacttacaacatgcagaagctgtctctctaggtcactgtaggagtagccattattcttattcaccctgttccctctctgttcggatcaagagtggctggccacacgagctcctggcataggctgagggagagagagcaagggaagaggtttcagggcttaggagccggggagccctcctgca

SEQ ID NO: 4652 - DNA, 201 bp, Bos taurus
atttaacctggctgaaacaacctcccggcggcggaagaggccaagcacagcaggagcccaactcagcgagtggtagaagcagaatgtgaaggaaatccagcgcaggggaaggcccatcgtgctggaaactgggacagtgaaaaacaaactctaagttcatgcggctcggtctcagattccagaagaccgccggttaaggta

SEQ ID NO: 4653 - DNA, 201 bp, Bos taurus
aaaacaaaaataatagttaaaatgttaggtgaagtttctaagttttaccaagaaattttagtgctttctctagaagcataacacaaagtaaatcaactacttttaagtaaccttaaataatcctaaattactgcgttttgtatttacaggaagttcttaacacaaaatttgagaaattgttgagaaaaagattttaaaaat

SEQ ID NO: 4654 - DNA, 201 bp, Bos taurus
ccatctcctctgcacttggacaaatgggcaggcatcaatctggagatgtgtgttacagcccagtcttcactgtaggctttctatataaaatttaatacctaaaaggccataagccaggcaggacttactccctcactaagaaaacatatcattctgtccttgaagtaccagaggggctgtgtgatcctccagagggcaggg

SEQ ID NO: 4655 - DNA, 201 bp, Bos taurus
gtgactcaacaacaacaacttagaaaagggccatggtaagtaagcactccacccatcttagcaaatgtgattatcatggttatgatgataccttccactgccctcacccacaaaactggcctgggctctgagctctggctcccttcaactgtacctcttcccggtgagcagtgggtttgcaaaactccagtgaagtgtcca

SEQ ID NO: 4656 - DNA, 201 bp, Bos taurus
acgtttccttaatttgaataattcattatttaaatatgccagataagtaagaaatcactcaatttagtaattttaaacctttaaacctcttttcaagatacagtatacatcaaacattgccacgtaacaaaaaatttaggccccggatcaaaagaagaaagaataggttgaaaacaacaggtaaagataggttaggaaata

SEQ ID NO: 4657 - DNA, 201 bp, Bos taurus
taagatgctggcagggttcatttcttctaaggcttctctctttggcttctagatggccgtcttcacctggtcttccttctgtgtatgtctgtgtcctaacctcttcttattaagaacatcggtgatactggattaggacccattctaatgaccccattttacctcttaaagaccctatctccaaatacagtctgaaatact

SEQ ID NO: 4658 - DNA, 201 bp, Bos taurus
tatatttgtttaatctactgatcttaagagtttaagaagtatcacacaggggtcaatgaaattttgcttgtaaaggaccttcactgtgaaaaggttaggatacagtcttaatggatttcaggtggacaggctggtggagagaaatttttggcaaaggagttttcttgctgcagctgccaatatgataaaaaaaagagcaaa

SEQ ID NO: 4659 - DNA, 201 bp, Bos taurus
tcagtgtcaaccaaacaaccttctaatggaagaaggttccatctaggacctccagagctagagaggagaagtcaatgtctggcttaaaaggataggctgagtctcctgttaggggctaatgtagctggtgactttagttgaaaccactgctaatttatcatgcccgaaaatcttaaggctcttaagaattatgctaaatct

SEQ ID NO: 4660 - DNA, 201 bp, Bos taurus
ctacatcgctgtagagagttcctttagtaacctttcatcaatgtcccaaacagaatgtaccatctatgtcctatctggtatcatgtaaggtcccatgaaacgtaagtgcataatgggattctgggattgaattgctcatttatctatgtagtgtatatttgtgggaaatggaacactggcaacccacagcttgtggttaca

SEQ ID NO: 4661 - DNA, 201 bp, Bos taurus
gaattttaattttcattactgtaaacttttcaatcattctagaaatcacttgagactgctctttaaagatgttttaagagctctgtagtagggaaatgtatgtcctttctaaatgagaaagaactagctcccagaaacagtttgtctctatgagaagtgaacctataatggctgttctccaagcaattctgtgtggcatta

SEQ ID NO: 4662 - DNA, 201 bp, Bos taurus
tcaatacagcatatgccactgtcactcaggaaaagggcaccagtctgcagtaccagccatcccctctcagggtctttcactacatatactgtcaggccaacatcactgaaacccttcccaggcgtgcactggtcccagggaaccaggctgtacccatactgcagcagctgggacttgctggccccagggttgccacacagc

SEQ ID NO: 4663 - DNA, 201 bp, Bos taurus
atttcttttttcatagatgtgataaatatctatacatgatttttgtttgtttcagatatctgcctccttcaggtaaagatttgaggtcatttacagaaatccattctgtacaatataaaagaggaaaaatattaacagaaaaatatggctgtggttagctttgaggacctgttggaaattggtaaaaaatcctactcaaca

SEQ ID NO: 4664 - DNA, 201 bp, Bos taurus
aaggatatataactttattcctttatttttctcataatttcaaacatacaggaattaaatgtttgtattctcatttttcattgtatggggaatggaggatgaatattcatcttttttatttactcttgatctgaatttttttatgtcaccagagcactaattcatcccctgtatactcaacatatataatcaatggatagt

SEQ ID NO: 4665 - DNA, 201 bp, Bos taurus
atccttaaaagctagcatatgatagattcctggcaggagataacacttccaacacaaaagcagctttgaaaatctctgggttcaactgtatgagcaggcacgactactagtctacctgtctgtacactgaaaaagttgcttaacaccttgaagaccaagtgagtactgatttgtgagcatgcaggcaaagaaattagataa

SEQ ID NO: 4666 - DNA, 201 bp, Bos taurus
agttaaattttatgtgtcaagttgactagaccatggggagaccaagtatctgcttaggcattatttctggatatgtccctgagggtgcttctggacagttgctattgaatctatagactgagtagagctgtgtgccttcctcagggtgggtgggcataatccaatttgttgagggcatgaataccgcaaagaaaggtggag

SEQ ID NO: 4667 - DNA, 201 bp, Bos taurus
gagctcgtgttctaaatatttttgtggcttcagaatctgaaggaagaaacagtttctttgatgtagacactctcttctggggaaaattctggttttgcttgactagaaacacattctaaaatgaaataggtttcacatgaatgctctcattgctctactaccagaaaagtgatttttaaatactcttcacactttctgtat

SEQ ID NO: 4668 - DNA, 201 bp, Bos taurus
ggcaaaatattcctaacatatgtatataatgctctcttgtcttcggttcctaggccaggattcttatgcatatgtttcaaaatctaatcactatgcctacatcactggatgttcaacagtaacactataatgatggtgacttgtttgacttttgagcacttttaagacaaaaggcctggaatttacaagaataagtgattt

SEQ ID NO: 4669 - DNA, 201 bp, Bos taurus
aggcctttctaatcaaaggatcaacaaaagggaagcctaggaagacaaaaagttttagaaaatattcactgcactacagccagacaccaaagcaaaagccgtgggccccacctgcatccatggcagcaaaagctgaatggggagccaggagttctaaccttgccatgctgcactgaaatgctcaaactctgctacagtggt

SEQ ID NO: 4670 - DNA, 201 bp, Bos taurus
ttaccctcctgtttcaccttcatcaagaggatctttagttcctcttcatgttgccattaaagtggtatcatctgcatatctgaggttgctgattttctcccagatttagtgattccaacttgtgattcatccagcctggcagttcatatgatgtactctgaatagaagttaaataagcagggtgacaatatataactttgg

SEQ ID NO: 4671 - DNA, 201 bp, Bos taurus
tcctggcctctatagaaaaaatatagtaccagggcaacacatggtgccccagaaacaggtgtttttcacaatcataaaccctctgtaaatgaggggcacgagttgacagtgtctccaatgtggcctcccaggttgctggcaagccttgggtacccactaaagctcaaataattgaacccagtccttgtttgaagggacttc

SEQ ID NO: 4672 - DNA, 201 bp, Bos taurus
ggaggtccaaaacctagcaaaaattccaatagatcttaacgcttcagaataaacctctttgtttcagtgatttgccgcgcagaaccatggggctggcagcgtcattcccagggccctaaggaagtgaccccacctgcttcagctctttgcagggccacctcctttaaaactaaggagaggagatgtccttggtcttgagcc

SEQ ID NO: 4673 - DNA, 201 bp, Bos taurus
attttatcttttttaagtggaatgcacccatgttcactcatgtttatatcatctatgattaccttcttcacagtaacaataacagttcagtaacagttccctgtatttcagtgaatggttcacagttcacagtgaacaataacagttccctgtaacaatgcactgagttgtcaagacatacctatggcctgtgtgtatgcg

SEQ ID NO: 4674 - DNA, 201 bp, Bos taurus
gggtggttgatgcacaacaatggggttactgggaatatagaaatgatctatttgatggtactttacatggtagaataatcagtctgacaaaatcccttgacaaaatagcagcaggaattgggaggagcctttagaattcataataaaagtgggtaaatgtctaagtcaggcatggacaaggatgttgtctaactctcttga

SEQ ID NO: 4675 - DNA, 201 bp, Bos taurus
aaatccaaaaaggaaaaagaagattcacttggagacatacgtgctgttcctctgagaaactattcctttggttcttcacataggacttgacaaggttcaacatggcctctcatccatatttctctggagactcaggtgactgtttctgtgatggttgttttgaatggagacatattctaaacttatgtctagtgtattatt

SEQ ID NO: 4676 - DNA, 201 bp, Bos taurus
gccaggctcctctgtccatggcattctctaggcaagaatgttagagtgggttaccatgccctcctccaggggatcttcccaactcagggatcttaactcacgtctcatgtaattatttggtatgaaaagaaatgttatgctaataaagtctttacttcactgccgatatgtttgaacaaagactcaggaggtaaattatga

SEQ ID NO: 4677 - DNA, 201 bp, Bos taurus
ttcttggccattggacccagacagcctcccaccttgagtcaacaaaccttcagtcagtaagcacaagcataatggcaggtcctctgtggaaaggaataaatagggaaagtaagtatgcactggacttaattgtggagaacagagacctggctctatcactcagccagtcccgtccatgtggcagcctaaaactcctggtag

SEQ ID NO: 4678 - DNA, 201 bp, Bos taurus
tcttcagatagagattatcctggattatttatgtgggcagtgagagtcagtgtcttagccccagtccaaatgcaatctcatgtattcttataagggccagtaggagattgggcatgtacacagaggagaaggtcatgtgaaggtggagtaaagagaaatttgaagatgttggccttgattgaagattaaaatgatgtggcc

SEQ ID NO: 4679 - DNA, 201 bp, Bos taurus
gtgcttgtaaaaatctagtaaaatttagcacattttcctgtggaaagagttcagtaaccactaaacacaaatatttctggaatttaagattctgggctttatttcttttcctgatttgttcctttagagcttttcatcttataatttcccatcagatttgtgtgcccccatatgcttgtacatacagatatatgtttattt

SEQ ID NO: 4680 - DNA, 201 bp, Bos taurus
atcctgctatcagtttcccttcatcattgagccttgagtgtaattttctgccctgttctaatctcctcttgaagtacctgatggtggaaagaatagacttgtaccatttcagaattcaagcacagcactcctaagaccaaaacattaaagtttgttagacttaaacttttaaaaattatgtattaataatatagtttcata

SEQ ID NO: 4681 - DNA, 201 bp, Bos taurus
atcaaggtgctgagggtgggtgcttgctgaggcctcgctgccttgctggcagtgcctgctcagtgagggtgtcctcacatggcctttctccgtgctctccagtgcctgcctcttcttataaggatgcccgtcctcttggattaagtccccaccgtcatgacctcacgcaaccttagttacctcctcagaggccctgtcgcc

SEQ ID NO: 4682 - DNA, 201 bp, Bos taurus
acacgctcctcctcagctttgtgagatactgttccgcaaggcaagtctgcaggtggagcctgccagtggctcctaccagtgctgcagaaaggcatctcttaaaaatgaagacattcacaaaccagaagactcataactcaaaccaagtagtacaaaggcaacatgggcatcatgtccttagatattctagacacctggttt

SEQ ID NO: 4683 - DNA, 201 bp, Bos taurus
cccaacaggccttaaataacagtaatcaggctatgagcttactgaattatgagatctatatgatgaaaaaaaagcagtattataaaacacatggccctcagtatctttccagcatctcaaagaggcaggccgtaattcaaactgagtgctgcatccttataccagatgaatcctccaatactatccacttaatgactcaca

SEQ ID NO: 4684 - DNA, 201 bp, Bos taurus
tcctctattccagagtttccataatagctgctccttcttacccaggtgaagccttggaaaacagtgtcctgtctcaaaacggacaagaacttacattatccgtaaatcatgttaaaataaagagtattaaagttgccaaaagaaaactctcaggcctaataataatgaccttggactttcctcccaccaaccgtctaagac

SEQ ID NO: 4685 - DNA, 201 bp, Bos taurus
ttaattactattgtaattagagtctattgtaattaaagtctattgactttagagcagtaggtctcagttcaggaccagatgactaatcctgggctttaattctcacatacaaagcctgaaaacacttatacactatgaaccatgtttgagaatcgtttctttttaaagccataaatctaagtttaccatgtatgttttcag

SEQ ID NO: 4686 - DNA, 201 bp, Bos taurus
agaccagtaacaacaacaaaggagactgaatcaataatcaatctctccaacaaagaaaagtccaagaccttatggttttactggtaaattctacaaatatttaaagaacaaatgtcaatcattctcaaacccttccaaaaaactgaagaggtgggaacacttccaaactcattttatgtcaccattactcttacatcaaag

SEQ ID NO: 4687 - DNA, 201 bp, Bos taurus
gttatctgtggttgaaaaacaatcagggaaaggcccaggacatattagatacagtatcataagaaacaagatataagaagagaggtttcatatctactatgttcctaatggaataataatttagttttcctaaaacctactattcaaactccatcactcctcgatatcccaaatccccctaaagtagtatgtgagaaccat

SEQ ID NO: 4688 - DNA, 201 bp, Bos taurus
agatataatcaggtatcctgaactggatcctggaaaaggaaaagagtattagtggaaaacctgataaaatccaaatagagtctgcagttaaaagtattgtgccaatgttaatttcttagctttaacatagtatgttatggaagatactgactttaaggggaagctgggtggtatacataggaactctctgtattgatcttt

SEQ ID NO: 4689 - DNA, 201 bp, Bos taurus
atctcactttcatcttttggcacactcttacttctcagacctttccccattcttacatcttcaaatctaatgtatttttcaaggccaagattttttaagacgagctgcctccgtgaagcttttctgacccctgtagcctgcagccatctcttactttgagatcttaatgcttaatctcacttccattaatttggccacttt

SEQ ID NO: 4690 - DNA, 201 bp, Bos taurus
tttctttcctggaagatgccctctgtggttttaggaggcaatttcattgccaaacagatcaggaacatcaggcttctgcataatctagtgatgtttttagagtttcctttcccacactcatatcctcttaattttaaagcatctgtggataagaatggtttagaaacctactaatttcactttgtacatgatgaaattatt

SEQ ID NO: 4691 - DNA, 201 bp, Bos taurus
aggggacatggcaactcaggtcaaaagggcacagatgtgctaggacaaccacccctgctcccgcagcttgacgacattccagccttgaaatacacgcctattcaggctgcagttttgtgacactagcctgggaaaaaagggaagagagaagtacagtaggcagttcttttaaaaaatttttaaaaattttatcaatttctg

SEQ ID NO: 4692 - DNA, 201 bp, Bos taurus
tacctgaggcccaatgtggtgggctagggagagatgtctgggttgttagggggtccctgtgctacctagcaaggtaggaattatggatgggcaagaaggagaatgatgggccaagtctgaccagaaagttcagagctttagtgacagaaagacatcccccattcatgggaacaagggacatctaggcaggagtctgtttgg

SEQ ID NO: 4693 - DNA, 201 bp, Bos taurus
cagatgttgtgccccattctgatctaattttttggttctttgctatttttacctctgcttttttgtactattttctgaaatttcttcaacttatcccccaacacatttcatatttaattttggctctcctatttttctaatacttttttctgattgctcatcttttatagcactgtgttaattttcatggatgcaatatat

SEQ ID NO: 4694 - DNA, 201 bp, Bos taurus
ataattcagatacctgctctgccttttttgttgttcgtaattaaacaataggtgaattcagtaggctgtttattatgataatcacagaatactcagctcactataggaaaaatgaggagaaaaatatggtagccatgagggctgaactaaaaaatttgaattactaaatgaatagagaggataaaaggggagaagagaaca

SEQ ID NO: 4695 - DNA, 201 bp, Bos taurus
aatgtcatcaaggattttttctttctcaacttttcatatcaagacatttcagtcataaagaaaaaattaacactaaaatgacacagagagcctcaaccaatattcaagaattgtcagtatgctgccatattcacattctttttactttctggtttgtagaactactgaaaagtaaattgcaaaattatggcatttcactcc

SEQ ID NO: 4696 - DNA, 201 bp, Bos taurus
attttggctgatacaagtgagtttgataatgatgagaagactccacacattaacgggtgaccaggggctgaaaaactacaaatgaattgaatagttcatccatttttagtttcttaaaaatcccactgcctttcctctgacttcagctgacggttcagagctagttccatggattcagacattcatctgttcattacttcc

SEQ ID NO: 4697 - DNA, 201 bp, Bos taurus
tgcatcttgggttatcagtaggcaattaagtataatgctgtttctgatctgaacaaggacagcaggtttaaaaagaaaggttgaagaaataccaaacatatgttaaatatttgctttttaagatttttttcctttcttcatttatatgctcagaaaaataagtgaaaataaaaccagttttgcttataaataatacatcag

SEQ ID NO: 4698 - DNA, 201 bp, Bos taurus
aaagtgtagaaggggtccagagtggatgcagagaaaccattaggaggttacagtagttgtccaagcaagaaatgctgttgctttgggcctagggaagtgtccatggagatggggagaggggatgccctgagtatggtaggatagggagagagaggttaaggatagtgcataagttttctggtacaggccactgagtgaaag

SEQ ID NO: 4699 - DNA, 201 bp, Bos taurus
cagtatgtagtataacagcaaggagatgatttgatttatgtgtccttccttcaggcttacttagctgtctgtcacaactttatcaaagttcttgtgttttgtgtcagtctcagcctattgatggtgatgttgtcagttaggaatgcctgaggcactctctgggccctcacagacatttcccagaccagaggcaatgttgtg

SEQ ID NO: 4700 - DNA, 201 bp, Bos taurus
aggtggcaggataaggctggttctaccagtgggagggagaaccccaaagtggtttcagctgccactccaggaaggcattgcctgaggtgaagaagcatttgtaatgtgctgttcacctaggaatagggaacagacaggatattaacaggaaggaaataatgagcaattgccacctccctccttcagtcttgcattgtccct

SEQ ID NO: 4701 - DNA, 201 bp, Bos taurus
gttgtgggcaagtttggagctctaagagaccttatttgtttgggaggattttggaaggcttcttggagatggtggacttagaacaaggtaacaaaataagggcaagtccttgtcagaggcagaagaacagaaagagataggagggtatctcatgcaggggaaatggtaagaaccaaagaaagactttgtggggtagtgtct

SEQ ID NO: 4702 - DNA, 201 bp, Bos taurus
acgctgagaaggggatttaataggagtggggatgctttcttcattttaacaggaaaggaggcagatccaggtagaaataatgaagcaaaaaattaaggtacttgtttgttagtgtctgtctattctataaaaatttttaagttcgggcttccctggtggtccagcaattgtgactctgcacttccactgcagggggcatgg

SEQ ID NO: 4703 - DNA, 201 bp, Bos taurus
agttggagccatttcccaggagagacagagttattaataagacattgcaggctcatatactttctcctacctgtttttgattttccctctttctaatgcaatttcactgatctcttggaaatgagacatacatggaatgttcttccttgctcatgcattccaaatgtgcttcccaaactaaaatgctgtaccgtatgtaaa

SEQ ID NO: 4704 - DNA, 201 bp, Bos taurus
tggagcatctgtatagcttccagggtgttgcttgatctatcttagttctcagaggaaacgaaggcagcatacgctcaaggccagttgaccgttgcaagttatataacaacatttctattgcacctatcttcccataattcagtctgttataatcagatgtgtatatgtatacaatatttatgaacacttaaagtgctgcga

SEQ ID NO: 4705 - DNA, 201 bp, Bos taurus
atacacattattcatcagtctccccagtggagtattttttgtagagatcagtgaaaagatggtttgtgggatttacatacataagtcttaaaagatcctacgtattttaaaatcctattatacagaaaattaattaaatcaaattataaggagccatactttttccattaatgttaccaatttaaaactttaaaaataaca

SEQ ID NO: 4706 - DNA, 201 bp, Bos taurus
tgacctgcagaaatggtggcaaggttcctgcaattcaaaatagaaaagagagcattgtagacccacagagccaatcttcaaactgacatgttacaaatggatttgttaatgcatttctaaaatgcccatattcttaataatatcggttatttattattaaatcttggtaatgaataaagaagaaaaatcaaatcataggta

SEQ ID NO: 4707 - DNA, 201 bp, Bos taurus
aaaaatagaagtctgaatgatatttggtctggttccatgaagattgattgagacctcaaattgtctgggtttattaatataataaaatgtattcccagaggtttaagtagattcactccttcagtcaaacagaaactaccttttaaaaaagaaaacataatttaaaagcaatatatttatccaagtctccactgctgcata

SEQ ID NO: 4708 - DNA, 201 bp, Bos taurus
tggaatgttgtttgaaaagcatggagataaagcaaaagcaagtggtgagtttggcagggatgaataggtatcgctgttaggtcattggacactaagtctcgtttttggacacttctgggactggaggtacagtatgatgatttggaagtcattctctttcagtagaccacatcttttaattcagtcttttgccaatataaa

SEQ ID NO: 4709 - DNA, 201 bp, Bos taurus
gactgccataaatgtctttaggttgtaccatcttatcactgcaggaatagtatagaagtatgtgaaatgctcatttaaatcccatcctggcatccccatcctcctttgcctcttctttctcacaagcaggcgcacatttttaccctcatatgtaaagcatgaatacacacacacagaggaagatgctatcatttaaacatt

SEQ ID NO: 4710 - DNA, 201 bp, Bos taurus
agcattaccttctcctggaagcccagtgcactgattactccctcctgagggcttccctggcttcccatgtgttcctctgtaagaacatttatcaccttgtgttgttattatttgtttatgagcctgtctccactgtagactttgaacttcttgagtttgagagctctgtcttaaccaccactacatctcaaagtttgattt

SEQ ID NO: 4711 - DNA, 201 bp, Bos taurus
tggcttgtcagggtttcctggttagggacgcttgtgtcagtgttctggtgggtggagctggatttcttctctctagtgtgcaatgcagtatccagtagtgggtttggaggtgtcagtgggtttggtgtgacttttggctgcctgtatttttgtgctcaggtttatgttcctgcattgttggagaattagcttggtatgtct

SEQ ID NO: 4712 - DNA, 201 bp, Bos taurus
tgaagatattgtgaaaggagataatatcaaggagtttgagagaagatcccagaaattaatgatagagaaatgggaaaataagagataaggtaaacaggtggaaaacacttaatacatagcaaaataacaagttaccactgtggacaacagggacttaatcccactgcatattctggaagactgtattccgcatacctcacg

SEQ ID NO: 4713 - DNA, 201 bp, Bos taurus
attcttactcatccttcaaaaaccaaatgaattgctgattttttgtgacacttttatttgttctttcagagctttatttttagttctaaacaatatctttcatatctagaatttttgcctgttccctctagagtttcatgagggtataaaccatatcttattcagttccatatctcaacacttaggacagtatattaaaag

SEQ ID NO: 4714 - DNA, 201 bp, Bos taurus
atctttctttctcatttccaaagaacacttgtgatccgaggttaatctatccagtgtaatgtttgtttgaaatcctcaaggtcattttatatcaaggtggcagagtaaaagttgcttgtggaaatcaatccaggtggcagagtaagaggacgtgacactcacctattcctagaactacatcagaagtattggatgtatttg

SEQ ID NO: 4715 - DNA, 201 bp, Bos taurus
gtgtctgagtcaggatagtggagaacagagctgccaagctggcttgtgataaaactcacttgcatttatcataacagaaaatttgttgaggtttccttaactagctctcagctgtctaggtgctgcttttttggtggattagcttccgcaagacagggtgcttcaaaagacagaagagctagaaatagtctatggtatagc

SEQ ID NO: 4716 - DNA, 201 bp, Bos taurus
atgacatttcattcctttgccagcctatgaaggaaaagtgggaggttaaaaaaaaaaaaagggaggtcaatatgaatttactccaagtcaactgtaatctgtatcctgtcttcctaatacatctcataacaaaagcttgttgtatcagtatattccaaacgtttgtaagttatttagaacttggaacatgttttcccatag

SEQ ID NO: 4717 - DNA, 201 bp, Bos taurus
tgactctcttgaatcctctcacaggctctacgttttcttaaatgtactaatcctactgtggatttctctatccccagaaagcataagtacccatcttgctcatttacatttgtaaggttttgttctttctggatatctttgtatttgcatgctttttctttctccttctctctttttgaccattgcacttgtctttaaaaa

SEQ ID NO: 4718 - DNA, 201 bp, Bos taurus
aaaattgccatgggtctttgaaaacctgtggctctttggctctttgccttaattaggttgggtacaggaatttttgccaaacctgaggtcttgagtgtcacggacaagcatccttttgcatacttggatcttttcactgcagaggtcccgctgctccctatggatgctttgaggacctttggccctttcctcatgtgaaat

SEQ ID NO: 4719 - DNA, 201 bp, Bos taurus
tttttatacagatatataaatgaccatgaatgaccctattcagttgctccaaggactccaaatctactgggagaaacaagcaatgaatagcagttataataccatatagtaagtgcttctctggagtacacataggagatgcaaagcccattccaggaacggtatggagtggttggctggagccatctgaggcaggaaggt

SEQ ID NO: 4720 - DNA, 201 bp, Bos taurus
ttcctgtgcagaccaacccaccaatatgtatttgaaaagggagcatttctttacatgggcaaaacagaattaagcatttgaaattcttcatgtctatattcgtttcttcattagagagtgtttgcctttagcactctcatccttcaaactaagtcacagtcaagaatatatatattgatcactttggataatcttatcaga

SEQ ID NO: 4721 - DNA, 201 bp, Bos taurus
ggggcggggaacagaaaggggccaatcattctaacttcaggaacctggtagctagagataccaatgaataaatgatggtgatcataccagtacatttggcgggtggtttgatctacatcctggcctgagtgttcaaagagcagtgggcaactggccagcttaggggacagctaatccttaactcatggtccaggtgtcatc

SEQ ID NO: 4722 - DNA, 201 bp, Bos taurus
aggtgggttatagtccatgggatcacaaagagtcaaacaccactgagcgactaacacagacctaggtacttcagatatataatttagatatataatacatgaaacacaataattctgagggttaagtaatgttattatcccattttatatatagaaactgaaactcagggacataaaaatggtaaatataaatgtaaatat

SEQ ID NO: 4723 - DNA, 201 bp, Bos taurus
ggccatgtatgacaatttttgccctacttaattgacaatgtaacctaattctcagactagttcccaaaaaaagaatcctttctcttttgaatctcagaagagctcttaaaatggatgggccctctgggactcacggatgtgtttccactgccacatagtcaaagaagcctaaaatcacagggatttatatcaaatggcatt

SEQ ID NO: 4724 - DNA, 201 bp, Bos taurus
agagtgactgaactgagctgaactggaccataattctcctctcatatagtctttcaattctttgaataaactaagattattcccagctaaaggctttggtgtttcaggaccctcagtgtggagtactcactcctccaaggctgtctccttatttcttgctctttctcatcactcatttctaggctcaaatgctgttttctc

SEQ ID NO: 4725 - DNA, 201 bp, Bos taurus
ccatagcaagaactctaaccccctaaactgccaatatttatctccaaattcacttgccaggatacatcttgtcctccttctgggacattttctctgccctcttgctcatacctttctctatcatctaagtcactttgatgagtttgtagatttctcttgccctgggtattctcccactcctcaatactgttaagtgatcct

SEQ ID NO: 4726 - DNA, 201 bp, Bos taurus
atgctaatgattaaaataaatgtggcctgttatgttatctaaacagtgttctttctttggaagcccaggatggcagtcaaagcacttcctggagaccatcgtggccttgaggtaagctttcactggccttataaggccaaagatgggttgctaataaatcaggttaagtgctgggtgttggagtaagtggtttcatatata

SEQ ID NO: 4727 - DNA, 201 bp, Bos taurus
acaaaagggtgagtccagcatggtgtgggtacacatgcaacactgtgagtggggagggctgtgatctctggaggttgggtcccacttaaaaggggcggccgtactcagacctgcttcaatattccttgtttatgtgagcccagtgctgctagagtcactctttttttttttctttttccccctcaaagacatcacagcata

SEQ ID NO: 4728 - DNA, 201 bp, Bos taurus
cagggaattcatacataggtcagttaatccatgacatttcctggctacaataattggggaaacagtgggcagtggctttagatgaaccaggtagattaactgctgcagttttattccgcagttggggaagaaccaactattgatgtggataacatggggggagggtaggcagatatgaaatgtggcgctggtagtgtcatt

SEQ ID NO: 4729 - DNA, 201 bp, Bos taurus
caagagtagcataatttcaaagcaggcaggccaagtgaatatgaactgtttattcaactgtcacatgtcagggccacgtgaactgtgaaataaaaactctggtcaccttgccaggaagaaatttgagttttatgaatttttaattatgtgatattttcaggaatgcatcctttgcatgatatgcatcagatgaaaacaggg

SEQ ID NO: 4730 - DNA, 201 bp, Bos taurus
gctcatgaatacccatggatttcagcaagcactcaggagaacaggattctcatccgggaaagggcaggacagcctctcagcgggtgtggccatgtcttgaaaggaagggcgaggctgaaagctccctcccctcctcatccctcagggtctagagattctatttcatactgtccatttgatcattcctgaggccaaacatct

SEQ ID NO: 4731 - DNA, 201 bp, Bos taurus
tgtgaatatgtaaatatgatccaagtattaacttttgttgtgctaagtttgataattacatgaggcttatatataaaaatgttcttttcatttggagatgctcatgtaagaatttgcagaaaataagcattatgtctatcatttattttaaaaagtgcttcccccatcaaataacagctgaaacaaggttgcaaactgttg

SEQ ID NO: 4732 - DNA, 201 bp, Bos taurus
ggtcaggcagctagcccaagttagggagcaggagtgttggaatttaaacctagaaaatattgtcccagtaatgttaaactaatcatgaacatcacttttcaaactgcagctaacccttagattctcacattctttaacagcactatattctctgtacaatagcttcaaagcttcagcaaattagattccaagatgctgtgc

SEQ ID NO: 4733 - DNA, 201 bp, Bos taurus
cacaactactgaagcctgcacagcctagagcccatgttctgcaacaagaggagccactgcaatgacaagccagagcaccgcaactagagagtagcctccattcgctgtaagcagataaaagcccactcagcaaagaagatgcagcatagccacaagtaaaaaaccaatctttttttaaaagtgactgtaacagaaaccagc

SEQ ID NO: 4734 - DNA, 201 bp, Bos taurus
gataaataagagaataatggacataggcgaggaatcttcctaaggataataaaaagagaaatgtaccagcttgcttaacaatgtttgtctttagggtggcggcaccagaagtcgttgcttttcctctcagcctatatatattagtgacttcttacaggaagcatgtattacttttattgtggaggagaaaacactgtatct

SEQ ID NO: 4735 - DNA, 201 bp, Bos taurus
ccacattgcaggaggattctttactgtctgagccaccagggaagcctgtgttctaggtacagggaagtactatgttccagggactgctatggaagtactatgctcctgtgataggcctgcagtggagtactacagcacaataatctgtggtgaactatagataaactcaacaacagagatgaacctcaaaataattaaatc

SEQ ID NO: 4736 - DNA, 201 bp, Bos taurus
gtgtactgatagagtgatgattaataacaatacacgatatggaaaaaaacatgcctggatggtcattcaaatgtgaatgacaaagaataaaagattacaatggacttaaattccaattttttttcctgttaccagaaacatatcacatcattctaactttgaaagaacatataatcttttagaaaagaaaatgtagattta

SEQ ID NO: 4737 - DNA, 201 bp, Bos taurus
attgtttttctaagattacacagttagtaagcagtcaagccaggatgcaaattagatttatctgataccataattccacacttttccatgatgcttcaaaagggataaggaatacttaattgcactcttaggcttcaatcacactgtagatagatgacaaatatattgtccaggctccactagctggggtattaaggtgtt

SEQ ID NO: 4738 - DNA, 201 bp, Bos taurus
agtctgctgtggcaagcatgatcacatgtgttccatcttacttggagattccagtctgagcactaaaatgatgatcacaagtcaaaggactcttggggggaaaaaagaaagcagatgggtgaaactcacacactgtttttattctaataggtctaaagcaagccactttcactccacagtccctctgttctccagctgagt

SEQ ID NO: 4739 - DNA, 201 bp, Bos taurus
ttgtctcaaaccaaagtgtttgaccttctctttatttttattacttccttaccagttgccctttcaactccacgttatcctttttaaggctttgattagcattctcctaatgtgacatttccttagaaaatatttggcttggtcccaggacccccatatcactgaacacacttctgcactgctctaaccgggtagccagaa

SEQ ID NO: 4740 - DNA, 201 bp, Bos taurus
catgagtcatttgactaaagggtatagcaatcaagctgaaaacctgctacatggttaaattaggaacaagcacagcttcattttcttttcagtccttttttaagtacactgtgaagctctggtaggagtaagagatcgggttggaaatgaagtgtgatagcattgatatgaataattttcaacaacaccaaagtgaatcaa

SEQ ID NO: 4741 - DNA, 201 bp, Bos taurus
tcacagaacaccttagcacaatagcagtaaaggaaactaattttttaaaaattagaaaaatgggtattacactaccaattgtgaaagtattactgtttgctacatttaaaacttagctgtgtctaccttaatttttctttagataaaacaaggcaaaagaatcttcctaaaaagattccaaatacctatgaggtgagaaaa

SEQ ID NO: 4742 - DNA, 201 bp, Bos taurus
tagaggagagccactgggtggtgagagtcctgctgtttatttgggagcaagaacctcattctattcattaatgtcaaggactttatgctgacaagaccctccaaccacctttaggatcctacagctttcatgtgttgttttttgacttccctgtatgtttgtggcagcaccacaatttccttttacaaaacaatcccttct

SEQ ID NO: 4743 - DNA, 201 bp, Bos taurus
aacacacagttgatacgatagtgactattcacttatgcctgcatatagatgtaatttaacatactaacatgtgatttggttttacaatgggtatgaaataatgttacccagagagagaagatttagaagggtggatggatctgaaatttagggttttgtaaataggaataaggtccatggaaacaagagcttaaagtaaca

SEQ ID NO: 4744 - DNA, 201 bp, Bos taurus
atttgattcaggcataaaatctgtaatcctttcatttcaatttggacaaaccaaaccttcattctgccccaaaccctcaacttgtatatgaagaatgctgcaattattcctctcctcttttcctcttacaccacagctgtcttctttccatctccccaatcccagtcttccccaacctcagatatggggacctcggggcaa

SEQ ID NO: 4745 - DNA, 201 bp, Bos taurus
tatagagttttaaaaatagattttgccacacaatcatgcccacaaatgctgacttgcagtctgggaactatctcttcgtcaggcccagcaagatgaaagccggttctattttcatcgtgagagagctgcagggtggaggcacaaaggcgaaattcacttttcatgtccatcaggcagagcccctcaccaaccaaagcgggg

SEQ ID NO: 4746 - DNA, 201 bp, Bos taurus
gagtgccatagttcgccccttatcctcagcctctaagcatccaatgtgcaaccagttttgcttacaaccagctaaagaaacgacagcattattctgaatctactccaaactgacaggagagaaccatttgaaaggaaatcatgtattcaatagtaaaatacttgcctattaaggtcacctaaccatcctacttgattctgt

SEQ ID NO: 4747 - DNA, 201 bp, Bos taurus
gtaaaaggggttcagcctccagtttccatcaaatctcaagctaccactaaacctctctgtcttggtctctgctcaccccttcctctcaggggtcctcccccagactcataaccaacagagccacgtggctgggggtgggtgatgactgaagctgagccctgaactcaggacaagccaggtggaaggatatctggaaaacaa

SEQ ID NO: 4748 - DNA, 201 bp, Bos taurus
aagggaatcgctaatgggactggacagaatccaaaagcagatattaggataatagtgagtccctgacctaggttacggtgttaattctggagggcagactcgtggtacattttcaatagctttgtggggctgctgtcacggtcacatatgcctcaactatatatggttcctagcccccccctccccacgacatactttttt

SEQ ID NO: 4749 - DNA, 201 bp, Bos taurus
aaacatgcatctgctttcccaggtttagccacttgaagaaaatggccttggctaggccaaaactgaaaatgcatggagtcttacggtatcaggccctgaacatcttacagaattacatccaagactgcattagctgctgaacattctaaagtacacctgaggtatgagatacatcaatgaatcaagtcttttttcactgac

SEQ ID NO: 4750 - DNA, 201 bp, Bos taurus
agtgttccttatgtaatcagtaggatgactaacacagcgattaaaaacctgacttggctaaagattttcttatgagattaagctttagaggcccaagatcgccggaataagtccacctcttttaacaaccaccacaactgcaaaataatcggctagcaaatatcaacagtggatgatccatcattcctggttttcaggaat

SEQ ID NO: 4751 - DNA, 201 bp, Bos taurus
gaagtgctaaagttaccaagtttctctcctttcttagttgaatactatctacaacaaacttaattttattttttaaatattttcagtaaaattttgaatatgttcaaataacaacactaaggcagagtggggtcaacttgaagttgctcacaggccttgcttcaattttaagcaatttagattaacaaaggctatttccca

SEQ ID NO: 4752 - DNA, 201 bp, Bos taurus
gacagcagagctgaagggcccagccctgcttctccatgcggcctcaggaggcctatctggaaccaacctatctacaaatggggttgtgaaattacccaggcagggtctgctgcaaacatgaatggagtaacatggggggcgcaggacgctggagctgctgttgaccttgaccccgaatgtctggctggcctggcccattga

SEQ ID NO: 4753 - DNA, 201 bp, Bos taurus
tagtcaatagtagttgggaaaccctggtcgaagaccagcttcctctgtatagttgaaactggctgctggcagctcccaggcccacatccaacagctttggcaatccaagagggactgacacttgctcctgctgatccaaatgtcagtattcccagggaagctccctgattggcccagctctgtacagaggctcaccctaga

SEQ ID NO: 4754 - DNA, 201 bp, Bos taurus
tactcaagtcatgatcagaagactaagaaaagttactgaaaataccacaacgcttgagctaataatgagggcctctggttattcgctgtgggaacaaaattgtccttaactctgtggttctggaatgttgatcttaagctgtgggagttttatttttcctttgagaacagacacatggcatgcccatttccataaaagaaa

SEQ ID NO: 4755 - DNA, 201 bp, Bos taurus
gcatatttcatgataattagaaataaaaacactggctagaatatgaaaatattaaaattttttcaaaaggttatttcctgggggccataatttcatctgttccagtgctgattattgagagcttgtcttaaatcatctgtgatccaaaacctcagattttgtttcccaggcctctgtccgtttatctatccttccatccat

SEQ ID NO: 4756 - DNA, 201 bp, Bos taurus
ccagtttaatgctctgtggaactaaccacatgagaacaagcaaaggctgtttattctgagctttcctgagaagggaggcagtcttgcctttgggtagagactggagagcaggccgaagggctgggaatgcttcagagggaagaagaaggaaggctgcaagcctaacgctgactagaggcagtgggccccgggaggctgaag

SEQ ID NO: 4757 - DNA, 201 bp, Bos taurus
gaggcccatttcaggttgtagggcagctcacctaatgtctcaagaaagcaccatagtctcacaacaataattctttcaaaagagaatatagacggagggagtagagaaaatcagaaactggcccttcattccaactaattcttagtgggaggcactttgggtttgaatagtatcctttagtaggttgaatcttgactcaaa

SEQ ID NO: 4758 - DNA, 201 bp, Bos taurus
gtcaaaaggtttacctactccttatgttgtcttctaaaggtgttatgtttcaggtcttgtatttaagtctttagtccatttgaatttgtttttgtgtatggtgtaagaaggtggtctaatttcattctttgtgtgtggctgtctagttttcccggcatcatttattaaagaaactttttcctcattgtatattcttgtctc

SEQ ID NO: 4759 - DNA, 201 bp, Bos taurus
catgtctgtggatccaagaagtgtgctccttcttggcccagatgccttctctgtgcctttgagagcccccgttgtattattatttacacctcttcttgcccttgcttcttaccctcaacaaacctagttctccctggagagtaagtgagcttcaactaagcctgggaaaggggatcgatgcagccgtgtgctcccagaccc

SEQ ID NO: 4760 - DNA, 201 bp, Bos taurus
ccctgatgcaagaggactgctgtccttgtaagaggaggagattagggcacagacacacacagaaggaagactataaagagataccgttagaagacctgccgcctacatgccatggagaggcctcagaagaaaccaccctgctgacatcttgatcttggatttccagtctccctacagcaagaaaataagctctgttgttta

SEQ ID NO: 4761 - DNA, 201 bp, Bos taurus
aacctggcctggctgggctgatttctaggtgacctgacagccgtctgttgattactctgcactggacaccaacaaatcacctgagggaagaagcttcaacagtccacttgtaaagctcaggggccatgggtctgcttagcagacccaggtagctgggcctgaggcagaggggaggggacggagaagggagggtagcttcag

SEQ ID NO: 4762 - DNA, 201 bp, Bos taurus
tggcataccagtcattaggaggcaaactggggattgctaagtgagagaatgatttccaaatgcattgaagtttttgggtccacaaattctgcctaagctaggaacagctcatcatttcctcaaagcatattacagagtaggtcctcctaagtgggtccactagcctgccctagacttcccagatggttcagcgggtaaaaa

SEQ ID NO: 4763 - DNA, 201 bp, Bos taurus
aagaaaaagaaacaggagcattagaacaagacagagcatctgtaaggtggcacaatctggagcccccatgtgaggcatcctgaggtctgggcagtgaatacccctcacccaatttgcggagatggcaatggaaccagcctggggtcaagtggttgatttttctacatccacagctcaggaaagttttaatgtatctttgca

SEQ ID NO: 4764 - DNA, 201 bp, Bos taurus
ggtgatggacagcgaggcctggtgtgccgtgattcatggcgtcgcagagttggacacgactgagcgactgaactgaactgaactgaagaaatgcactccctggttaggtacccaagtgttcggccaaaactcagagcgttttatatcaccaaaatgcagaaaaagaataaacaccaaagggaaaatgagcagtttcttatt

SEQ ID NO: 4765 - DNA, 201 bp, Bos taurus
tcagggtcactctcaggaggctccctggaagccgttatgccggtgagcgcgggcatcagacaacagtaacctaagcctgttctatacccctgccacctccgctgggatcatgaacaacttaattggcctttctgagtctcagcttgttcatctgtaacatgcacacagcacagcactatctataaacaaagcaacacatgg

SEQ ID NO: 4766 - DNA, 201 bp, Bos taurus
tcattctttattcaaaacaaaatatctgcattcttgggagagttgatcacaacacagatgtgaccttttcattcttcacttcgaaagtaaggcctgagtataggactaaggaggattctgaacctgactctggaaaatgttatttctaagaacagaggtggtcaaatttctgtaaagagtcagtagtaaattcttttttgg

SEQ ID NO: 4767 - DNA, 201 bp, Bos taurus
cttccaggctcattcagtgttggcagaattcaggtccttgtggttatagtaccaaggaccttgatctcctgatgtcttttggccctttgttattctctccacagcatgatggtttgctccttctaggtcaatcttttttacatgttgtgtctttttgaccttttttttttttttaatgggcctttttaatgtgatgaggtt

SEQ ID NO: 4768 - DNA, 201 bp, Bos taurus
ttgttcatgtacaaataaggtgaaagactttgaattgttaggtagccctagggcaggtggttcttacaggcttcctttaagtcttatgatggcctactcatgtttaccttcccaaaagaggaatttacggttgaaattttagttagttcatagagtgggaaagctgatagagaaaaattaagaacctgtagtcgacccata

SEQ ID NO: 4769 - DNA, 201 bp, Bos taurus
aaggagagaattgggtatttaaaaagaactctatcctatatgattatggtaacaagaaacacaattttatgagtgcttactgtgtgccaaaactttatgctgtgtacatcattgcaaatggtttgctcataaattttaatcctcactgtacatagatacattctcatttacagatgagatgtgtacgcagagaagttaaat

SEQ ID NO: 4770 - DNA, 201 bp, Bos taurus
tcaggaaatcatggtcatatcaaaggggcatgggtctagtgtcggaggctagaggaaacctccttagaaaaaggaacgtggaaggtgagatcttaaggccaacgagcagctcaccagatgcaggcaggaggtgggggagaggaagcacagcacagtgtctggaggagagaataaaacagagaggatatgacctcaggccag

SEQ ID NO: 4771 - DNA, 201 bp, Bos taurus
gagaccttgagacacaaagtttcaggtggcatgtgttttaaaaactgttggtatccttggctaggtaccgttcacagaaagttcaagttctcagtggtgcagagatgcatttgagaccagattctcaatggcctcctaatctattcttgtacactgaacttggatgttccagtttaatttcaatttaatttcaattcatca

SEQ ID NO: 4772 - DNA, 201 bp, Bos taurus
gttaagggttatatttgattatatacagtaatatctgccactatttgtatattcaataagcatttgtggagtcaatgaatggtgcatttattcaaaagatctgtgtatacttatgaagattctgatcatgtgcagtgtggtattctgattcatagagggatctaagattattggtatcttcataagaagagaaaaactatt

SEQ ID NO: 4773 - DNA, 201 bp, Bos taurus
ttaatgattggattacaatgttaagtatatttttagttggaaaataattttaaaataatcactttgcaaagttgtacatttaaactggaaaaatttgatattgttttctaatgatactgcattttctcttcctactgatcaaaatgccaaaagcacattaaaactgttctatggaaaccaatgggtatgtgtattgtttct

SEQ ID NO: 4774 - DNA, 201 bp, Bos taurus
aaaatcaatcatttgtttcaaagactatcattggacaaaacactgggacaaaatgccaaactgtgaggtggaaacagagatcagagtttgatgaaaacaatgacattccttagagactcacttccagtaagctaacaggattgtccattctttccacacattcttgagtacttactgtgtatatgtttctgattttgctat

SEQ ID NO: 4775 - DNA, 201 bp, Bos taurus
taaaacagctgctaaatgccatcgacatgtgctgccacaagctgcacaagagctgcagtcctggaaggtcaaggaccccggcccacgtggatttacccatgtggtattgtgttttacataacaccaacccattgctggctctttcaagattcctggccagtgtgccaatatattgatatgtaagggtcctaatatataaca

SEQ ID NO: 4776 - DNA, 201 bp, Bos taurus
caagtatgacttctgtctaaattaaggagttttaaggccacctgggttttgcgttttctgtgctgaggagtgaaatgcaaccctagggccctctacgcacgaagaggatgctctccaagcatctcaagaggcaatgtatcctgtgctcaccgtgcagtggacactcccagtaggaagagggctctggccgctggtctggac

SEQ ID NO: 4777 - DNA, 201 bp, Bos taurus
aaacaattaaaatgatacaatgtacccacaaaatcatcccatttggcctccattggagaagaaagtgctttagattaaagaatagaccatcccatcaccacgttccatcacatcacatcacagttaaaatatggagaacaacagagtaagaacatatcactgaacacttgcatcacatcatgcttgacatgattcgacatt

SEQ ID NO: 4778 - DNA, 201 bp, Bos taurus
tattgtgtcttgataataatataatgaaacacattaatcaaaccaggatctcttgcattgcaggtagattcttttccaatgttaaataatttggccagggctaaattccttttctttatgtaggctggtcaaactctttaagttacatatcatctccccttggaaccagatggcctctaatacatagtgactgagatctgg

SEQ ID NO: 4779 - DNA, 201 bp, Bos taurus
acattcctcttctgctgtatttttagtctgccattcaatcctggcttggcctgttaactgtgttgtgtcacttttgttatacctagaactgcatccctgtatgttaccaaactagcattggccacaagaaaaatatacgcatagtttataagacaaaagtgaatcagtaaccactgcttctgaaggtatttttgcagtcag

SEQ ID NO: 4780 - DNA, 201 bp, Bos taurus
gcatgcagacacttccctctggcggatactgacattctggagtaaggcaaaggggaaaatgtaaagatggtacctgccacaaaaggaaaaatgaaagctaaaaaataaggctttgccagggaaatgtgtctagagttaaataaataaataaataattttaaaaacttaaagtaaaaaatatggtgcccaccagactctgtt

SEQ ID NO: 4781 - DNA, 201 bp, Bos taurus
ggttattcattatctaaagaaagaatatatatacctaaaaataaattcaatgattagcagttatgggttaatatactttgaagcactgattgaaaaaatattgcaaattttatcacaaaaagaatagctagtattgctgagctttgaaatgaggagttgtccatctttattgatgtgtgagttacctatgctacgaaattt

SEQ ID NO: 4782 - DNA, 201 bp, Bos taurus
acttgtaggattagtagtcctgaaatcctataatacaaacattagaatagtcatataaagatagtaattatatggaaatttcttatttcaggcctttttagctcctttctttcttatccttccagacactgcagagattcaaatctattctgtaaagcatctcctttccataagtttagtaaactattcttgattttcctt

SEQ ID NO: 4783 - DNA, 201 bp, Bos taurus
ggaatctcagaaatgactcttcaaaacaatagaatcttaaagcaagtattgggaagtcaggctctgctacagattaaaaactggaattgacatgctgtgtttccatatcaactctttaatatcatttaatgatcagtttaattcctactgtttggttaagtttggcatcattcctgcttttgctaatatttcctttggtgc

SEQ ID NO: 4784 - DNA, 201 bp, Bos taurus
ataaggtgataatattacttaatttctgattggttacacttttgattgtgaaagagatactaaccagccaaccctccagaaaacagtttgagcaaatcaggctctatagttatccaaaacatgtactgcatctttataactttcccatgggtgctggaaaattatatattttctatagttgttgtgcaaagtgtcctatat

SEQ ID NO: 4785 - DNA, 201 bp, Bos taurus
agagtaatggagtggcgtggcattgccttccccggtgtacccaactatatatccttaaaaatatgtgacacaagtaaagactcaaatatttgttgaatatatgcaaacaaagaaaatcttcacacctacttggagagtaatagtgaagattagcagaaatcaagggtgagaaataaagtaacatactgcatggtaattggg

SEQ ID NO: 4786 - DNA, 201 bp, Bos taurus
cccaacttttacttatattacttgccacccacagccaacataatctctcatacttttgaactgtgatttctgaattattgtaactctccaaattaattctgtaagataaccatcagaaccacaaattcctacagatgggttacaaaattgtttctgccaatagcgtggagggattttccaggtggtgctggtggtaaagaa

SEQ ID NO: 4787 - DNA, 201 bp, Bos taurus
ttcccctttctgccttacctaactatatttaatgaatggagctggcatatctttgtcattacatagggaatagagtttgtgccaaaacctatggcttagagtttaaaagttaaattgcatgaatatttatgaatacactgttcaatatacaatttctaaaatatttgaatgattgagatttagtgttcaaattgatagagt

SEQ ID NO: 4788 - DNA, 201 bp, Bos taurus
caagaggacatttacagaataacaatattcagagtgacctacatggacaagggtattaaaatcacatttttcttagatgaagtgattttttttttaaattatggaccaactgaacctatctaatataaaatcctttaatatataaactgtgatcacaacagcatccacatagcagagagaggatgggggtgtgggcgggga

SEQ ID NO: 4789 - DNA, 201 bp, Bos taurus
tccttatttcttattgcattgaaatatataacagcagaagggaaaattcaagccctggtacactaaaaccattaaagtagctggcaaaattataatctaggtaacttaccttccatcctacgttgctataattttatcagttgaaaatgatatccacttcattggagaagattgtttaacaagcttttaatcatcattgta

SEQ ID NO: 4790 - DNA, 201 bp, Bos taurus
acgtaaagtaacaaatgcaaaactttttaaatggtagtaatataactggccagcaagcagaggccaccacatggggacacacatcttattctggatggcacattttgaggccagcaactctgagaatgcttattttctactgcttcagaggatgtttgctagaaaccttttttttttctttgtaacagttggtaaaataaa

SEQ ID NO: 4791 - DNA, 201 bp, Bos taurus
attgttgggtccttccatctggagagccatttccccaggtctgcttggaaaattcataccaaaagcagtaacaggaaatgtgcagagggttttctgtgtgtccagcacagtgtaagtaagcttaataatccctattttcttaattcattccacacaaaggaacacagttcaaaattgttaatattcatatttaaatgataa

SEQ ID NO: 4792 - DNA, 201 bp, Bos taurus
tattgcaaacagtggtcattcactaggtctctgttaggagaagactgagctaaagcagaaatgtaaattattttaaaggcttgatttactcctttgaaaatgttatccacccccacccttccctgagaagcacatagttttggttacatgaaaacatccactcataaaaaaaagtgtgtttctcccaacttggccatagga

SEQ ID NO: 4793 - DNA, 201 bp, Bos taurus
acctgcctccttataatatccctattttaaggagagtttattaggaaacttaatacctcctgccaccttaattctcctctgtcctgtcatctaacaggctcacagattctggggactaagatgtagatgttttgggagggaagcatctttctgcctaccatagtaaggttgtgggcgcaggatggcatttgcagcatcaca

SEQ ID NO: 4794 - DNA, 201 bp, Bos taurus
gaattaggatacttcctgaacctctatgtagaagtggcatggaaaccaggaagtggatattgagggaatgcttttgcagactcaaaaggaataaaacacaacgttcatagaatttaggacattgatgagcctgtgaatgagtaaagaaaatatttctgaaaaccgaagaaaaggcaattattgctatacagtgggagaaat

SEQ ID NO: 4795 - DNA, 201 bp, Bos taurus
agaagaggatgaggaagagaggaaaaagtaaaggaggaaagaaaggccaacagctaccaaaacaataacaaaatttaatttgattaataaaaagactatttctaaggggagctaaaagaaaaagagctggaaagagctggcagagttagaaaaagtgtccacaaccatttactttagaatttcaaacaaatcttcattagt

SEQ ID NO: 4796 - DNA, 201 bp, Bos taurus
tgattgttagcacatggaaattagccgaggatataagatggaattttattatttttgtagaaatgagaaccccctccaacataattaaacactaccaatgacaataaaacctgataagcaaataaagcaactagtgcctccaaactcctttcaaaaataatgtttttgtgaaatatggtcacctcaaggacaggcatcctc

SEQ ID NO: 4797 - DNA, 201 bp, Bos taurus
tattacaccggcgggcccaaggcagagtcttctcttagccaatgacccggaccagtttttgtgaaaccttatataccctaagtatccatgcctaaatccacttccccaaattccctgaaactagtcagaaaaaggaaaagaaagatacaaagttaaaccgtaattcatatgccttaagcctaggtagttaacactggacaa

SEQ ID NO: 4798 - DNA, 201 bp, Bos taurus
agaagtaggttggccacagagaacaaacaatttttgacaatgaagctactgggatttaaacagacaggtgaaattagagatattttgactatgtaagaacttattacaggacttctctggtgggccagtggctaagactcacactccaaatgcgaggggccggggtttgaccccttgccaaggaactagatcctacacagt

SEQ ID NO: 4799 - DNA, 201 bp, Bos taurus
caagtctgattttttaatattagtgatggttctgatctccagtgtcctgagcttgcttggagtggggcttagttttcaggccagaaattgaggctggattcagaagtggttgaaagcaccagatcctagccagtataccagtgatcagtgacagggccctggcccctttgctttgcagaaaagaatttccagaaaaacaga

SEQ ID NO: 4800 - DNA, 201 bp, Bos taurus
catggcccatccagcgaagcacagccatggttcctgaccttggacatggagtatctctccacagctgctctagcgaagtgcaggagcctctcctgaccttggacattgggtatctcctcaaggccgctagagagtgaaaaaattggcttaatgctcaacattcagaaaacaaagattatggcatctggtcccatcacttca

SEQ ID NO: 4801 - DNA, 201 bp, Bos taurus
caactaagaaatgtgcatcagactctgaatctgtgactcagttatcttaatcattaaccacttggttctgtactgggcccttcagggttccgctggattccattatgtttgacaggtaaagacatgctattttcagaacaaggaaaaataagtatagggccattgaatcctagaatgacccttgaggcccaggtaaacaat

SEQ ID NO: 4802 - DNA, 201 bp, Bos taurus
ctgaaatttatttatcaaaggtcctatggaatatgtaaagaaatgctcaatttgtggaaaacaattgtaatgcttgctaagaatgcccaaatattcagttgcaaatataaagataagtgactagagattgtagaatcaaccacaagtaagaagtttagtttcagaatgctgtagaagctccaacaattaaatagagggtgt

SEQ ID NO: 4803 - DNA, 201 bp, Bos taurus
gctcctgtggcctgtggcagtcaagagtacacagcagccagcagcctccttagcatcctcttggatgacgttcagtgagtttcagcccatgaatagcttttcctggccacgtagaggatgcatttccagcaaatgtggccaaccagcaccatgctggcttttgtggcacctagtgagtcaaacttgtgctctcgccaacac

SEQ ID NO: 4804 - DNA, 201 bp, Bos taurus
cacagaatccctctttgaatgtatgtttggcaggccccatgaattcacgtttgagattatgccctctactgggttttagtgaatcctctcataatcacaagcatattcaatacttaaaagggcctctttcttccctagaaattttgagacttaaagccataaggatccagaaggacttgtccctatggaaagggttatttc

SEQ ID NO: 4805 - DNA, 201 bp, Bos taurus
aatccatgtacaatgtaactttttaatattgatataaggcctacctaaaattttatacaacttgcatcgtggatttttcaggcaaagaggagactttagcagtgaccaggcctgatgaggaataaagtggatttggaaagacagagtcaagccaagacaagatgcaggcctcctgcatctcccttttctgagcaggcaaaa

SEQ ID NO: 4806 - DNA, 201 bp, Bos taurus
aatgctttaacagcatcatcttttaggatttagttggaattctatcacctccactagctttgttcatagtaatgcttcctaagcaccacctgatatcacacgctaggatgcctggctctatttgaataaccacatcatcatggttatctgggtcattaagacctcttttgtactgatatgttgagagtaaacaatatgatg

SEQ ID NO: 4807 - DNA, 201 bp, Bos taurus
ggggtgaggtggttaagtgtcacagaggactgagtctgactgaactcagggatagggaatgactaaaacagcaacagaaagcagcatgaatagaacaaaaggaatctcttaggtctttcatattctgcttatgtagtgtaaaaggtaataggaagtctcttcatccacatcctaacacaaggtctcagtatttcagaaatg

SEQ ID NO: 4808 - DNA, 201 bp, Bos taurus
acagtcaaaggcttttgcatagtcaataaattccaaccaaacaaattaaaacagttaaataaaagaaaatgacaagtaggccaaattataaattagatatagaaataaagtgaaagtcagtcatgtctgactctttgcaaccccatggactatacagtccaaggaactctccaggccagaaaattgaagtggatagccatt

SEQ ID NO: 4809 - DNA, 201 bp, Bos taurus
acaactcttccaaatgagtccaagcatttagtttcagccaagtcgtttcataataatacagttgtaaatgttttgtcatcaccttacattatttagtaagataaacttgagagagatatctttgaatacctattatctaagaatgcatgtcactaattgatttatttctgcttagatgcattcccaacagttactcttctt

SEQ ID NO: 4810 - DNA, 201 bp, Bos taurus
caatgctcttgccaagtttgttaatgtcacccatgttgctgagttcaatggtcaactctaagatcttcaagtctttatcagtagtgtctgactcagcagattgattgctcctctaccctagaacacattcttcagcttggtcccaaggactatactttccttgtttccacttccatcattggtccttctcagtatccttcc

SEQ ID NO: 4811 - DNA, 201 bp, Bos taurus
aacgaatttccatctgtttagctctggctggcattgtatctacctgtatctcttttttactctaatcagatataattgctatcaggggaaaaactttgttgtctttccaatgagtcatattttctgggttaacccttcacaaggagcaattctaagtcacacagctggcagcctaagtgatcagtagttagacattcagtt

SEQ ID NO: 4812 - DNA, 201 bp, Bos taurus
aggccgagtctgctccctagttgttggagtaggtgcccccagctctgtttcttggctgtgattctgatctatagtgtgaggtagaggggactgtagcactaccactggccagaagtcattgcattttactcctttggagctgttcacctacaaatatgttccatggctccccttctgtctgtagagtgggctcacaaagta

SEQ ID NO: 4813 - DNA, 201 bp, Bos taurus
caggtttgggcaatgattgtgcaatgttagccaaatatttgcataaactctgttggatccattttattatttatgcttttttaattttcctttttacctataacccaaagatcattttgcattcttaaaatcctgtatagtgttagatactggatggaatattctcttcccacaaatattgtgatcatccgccctctatca

SEQ ID NO: 4814 - DNA, 201 bp, Bos taurus
actaaaaactaaatgtttaagatactggccctaaaatacctatgttcatttatttacttatccattcaactaagcattttatacacagacgtttttgtgcgtgtgaaaattaccataaattaaaatgctgaatataaagattcaaaagaacacattttccaataaaggttcaaagacaaagctacaaatcaataaccagaa

SEQ ID NO: 4815 - DNA, 201 bp, Bos taurus
aaattgccaactgacctccatttttggtgctcagggtcctttcttaagatcatgtcgttgttgacagaattcattccttgctgctataaaactgaggccccgtttttttctttttggctcttattcggagactgatctgatcctgtttgttgctccccacagcagcttgccaggaggccccctccttagcccctcacactt

SEQ ID NO: 4816 - DNA, 201 bp, Bos taurus
aggaacatattactcttttgattcttctttacagtactttgaatcattatcttgtgtgcatttttcctaaattactaccttatgttaagcaaagacttatgcattatgctactttgtttttctagtacttcccacaggatcctaaacctttcagatgatcagtaattttggtgactattggtaagttaagaatagcaacat

SEQ ID NO: 4817 - DNA, 201 bp, Bos taurus
aatgtaaatgcaagatttttctcatgtattgataacaatgctccttcacctctgttagggaactcaggcatttattggccaaattttccagataaaaacacagcttttcatcttatggatctcagtagtattgtctctcccttttcatgttaatgtaacagaattaccccagatgccaggtccatgggccacttacatcag

SEQ ID NO: 4818 - DNA, 201 bp, Bos taurus
agtgaaaaatgaatgtcttgaggaaatatgataagttagagatgaggtagaggaataagagatgaagaaattatagatgtagtcaatttctctttgatcttagccgtcagtgggagggagctggaagagaacatgctagccagtgaatcttcttttccattcttttctaaatgtggaagcaaccatccacatttgaatttt

SEQ ID NO: 4819 - DNA, 201 bp, Bos taurus
tacatggcaaactcactgtcagtaaagcaggtgaatatgaagctcctaaaaaaaagaaaataaaaactttggaaccatagtacaatttatcacagtcccaagacttaatcctatgaaagaaaatttgaagtcagaacaagagaaaaatatggggaaaaactagcatgtctatcttaaatttggaaaatatttggggaaata

SEQ ID NO: 4820 - DNA, 201 bp, Bos taurus
tataaaaatgcataccaaggacaagagtcaaaaaataagacaaaatattgtcattaaattggaaggaacaaagagtttaaaagttgatcattaaacagattacccttagagagtctcagtaaaataagcactcagggatccatgttagaaaaatagatttaatagagtggaagaaatagaagctgtgttataatattatat

SEQ ID NO: 4821 - DNA, 201 bp, Bos taurus
aatcatttgtataataacataatgtggtcttaatgatgctgcttgagttcaacccactgtatgtcagtgtgtgctctgaatcacatttcaacatgtcatttcatgcatcagggctaacaggaggctcgaggaaacaaaatatcaggaattttcatgagtccatctaaatccaaatggctggataataaattatgaattttt

SEQ ID NO: 4822 - DNA, 201 bp, Bos taurus
accttattctccaacaaagatgacaccagcaaacaggcttacatcaatcgtatagccactaattcagtaaaattattgtacctttctttcagtgtttcctacaaaaaccccagagaaatactcattcatcccagatgacttggtttattttctttcccctaaactactattaaatgtagtgtctttgttggccatggcctg

SEQ ID NO: 4823 - DNA, 201 bp, Bos taurus
actaatatgtgatttaagtagagacaacagaaaattcctttaccttcatatacttccataaaagtaaagtatatttctttattaccttaaatgaatgtaaatgttggatgcttctaaaatctattctttcttgtgatgtctatattttaaactcttgagataaagtgagcaaattgggaaaattaaatcccctaaacactt

SEQ ID NO: 4824 - DNA, 201 bp, Bos taurus
ccttcaggcctcttgtttttctttcttccaaaactaatctgagttttctgtatttattctttctaccatcttgcatccccattgagcctttaaccacttactgttgcttcaggcctaattcccactctgttgggaccatcttcctcaagaatatgctttctagatgcttttcaatttttatgtaataggatccccttgcag

SEQ ID NO: 4825 - DNA, 201 bp, Bos taurus
cttgaagctaacagagtagacaaagagttgatatgctgcagtggcgttggggaaggggtagtagtcaatactgcgcctagtaaatatcaggcccattacactcctcacagacatcccttggacatcagtattataattctgttttatagattgtctcatcatggccgaaatgcatagtgtattcgagttagtattacatgg

SEQ ID NO: 4826 - DNA, 201 bp, Bos taurus
agaccacaaaaggacacctgtttttaggatgaaagctgaaaccagaaagcagagtatcaccttattcaacctcaactgagagcacatacatcaaggaattcaaattcagagggttacaaataaattttatttagaaggcaagtttgcaagtggagaatctgaataatgaggactcatggatgttaagatgttagtgggtgc

SEQ ID NO: 4827 - DNA, 201 bp, Bos taurus
ttctctctcctccccccagggacagtaatgtctagtcatttcctacctgggaagaaaagaaccttcaggcaagcttctcacctgtcacttaggtggacgacttgtttgaatcactgtttctactttgatgtgaggtggtagaaggagaaaatccctcctggatcaagaacaagaaggggaaataaattccagaaacaacca

SEQ ID NO: 4828 - DNA, 201 bp, Bos taurus
aacagaagtttcccattagcaaacattcaaaggaaggcccacaaacagcagtaggtacccaaacccagtgcaggggaactggccctccactgcattttcatcagactcgatcacattccacactcccatgtcctgtcaaggggtggagctgacacaccctcacaaaggcactgccctctttccacaggggcctgatctcca

SEQ ID NO: 4829 - DNA, 201 bp, Bos taurus
cactctctattagaggttttgttcccccattaaaccacctacatgcaaatctctgtcttggagtgtatttcccaggagcctaaacccagctatgtgccattggcctgatggcagaaagaaacattggtcctctgtctccactttcagaccgtgatgtagtgagacaagcaaatggtgagcctgctggtagatatcgttaaa

SEQ ID NO: 4830 - DNA, 201 bp, Bos taurus
cagaagagcctggtgtactgaagtctatgacgtccccaagagtcagacatgacttagtgactgaacaacaacagatgaagataagaatgaggccacatttatgttacaagaaagaactacttacactaactccatgaactggacttcaccaaaaccagctgtagctggcctggcagagataatgctatgctgtgtggagcc

SEQ ID NO: 4831 - DNA, 201 bp, Bos taurus
catggtacctcagtgactgttcattattattttcaaatgaccaaaatgctggtcccttggcaatagtcttaaacccctacacatgtggaactcaagcctggtaatttcctgcatatgtttttgcttctaaaaagaggtagggtgagaattagattaaattgtgactgtgagtcatggaagaatactaagggaaatttctac

SEQ ID NO: 4832 - DNA, 201 bp, Bos taurus
cttatagtctttaatgcctgaatcagcatacatttattgagatgccactatatgttgtgaccaaaagtccatgttgtgagtgtgggtttattagagatatctcaaccagaatttctagaggcatttcaaatttcctgtttccaaaacagaactcagtaccttacctgcaacacctgtgtaagacaccatcctctcacttag

SEQ ID NO: 4833 - DNA, 201 bp, Bos taurus
cagttttactccaattggtcacaaaaggccaaagtcatacaaaataagaacagtgttctgaagaagttcaaaataatctaggacaggagagaagtaaatatggcacagaagaaatagaagtggccatgagttgataattactgaagttgagtgatagatacaagagagcttttatacatttctactttcttctattttagg

SEQ ID NO: 4834 - DNA, 201 bp, Bos taurus
ggtgatgcctcggaacctttcagtagctgtgaatatgatacttacaaaaacccggaaagagattcattcaacattgtgggtgactggccttccctcgattcgttagctcagagagagcacagatcaagaataccaaaggctggcttaaatgaacccagcctagaatttggaaccaacagcagtatgaatgaaatatcctta

SEQ ID NO: 4835 - DNA, 201 bp, Bos taurus
tttacgtactaccaactaatttacaactttcaagacagtggtgggtcaacactctgtgggccaaacacatcatgtctgagttggatgtggtttgtcggccgtttgcaacctctaggtaaataatttgctgtttccacagtacttggctgagaaggagatttgaaccagggctgtctggactccaggcccatattcattcag

SEQ ID NO: 4836 - DNA, 201 bp, Bos taurus
aggagttaaaaaaaaaacctgctaggaatgttttctatttcaataaaattttcatacatgcaatatgaatttggggccattttcttcaaaaaactaaactactgtcattctaattatcatattctcttcagatcaagaaacgcaaccttttgttcctccttctatccttgaagaaacagggaatggccataagaaaatgac

SEQ ID NO: 4837 - DNA, 201 bp, Bos taurus
cctgatctgggaagatcccacatgctgcagagcaactaagcccgtgcgccacaaccattgagtccatgtgccccaacgactgaagcccttgctctggggtgcctgtgctccacaagagaagccaccgcagtgagaagccggcacaccaaaactgcagactagcccctgctcaccaaagctagggaaaagcccacgcagcaa

SEQ ID NO: 4838 - DNA, 201 bp, Bos taurus
aaatagttcagaaaaatctcttatttttctctcctcccctcttccacccactttaaacatgaaaatttccactctggcctcttttctgaccagaactgtggaaaagtgaggaacacaaaggacagcaaattccgctatagtcagggatatttctcctgatttgaaatgataatggagcgatgggggcccttacgcaatctg

SEQ ID NO: 4839 - DNA, 201 bp, Bos taurus
gccacatgtctccagttggttgagctcctcattcttgaagttctgtcagacagtcacctctgtgatgccctttcatctaccacactccaccatccagcgtaagggcctctttcccctgaggtccttggccctttatacagacttctcttacaatgtgcagcaacatggcggtaactacgtttaggtgtatctgcctttgcc

SEQ ID NO: 4840 - DNA, 201 bp, Bos taurus
cctgtcctgggtacaccagtggtcttccaagtgtgggccccagaccagcagaatcagcatctcctgggaagctgttagaagtacagactttcatcaggctgcaccacaggcctgcgggatcagaagccctgccgtggggccggccctgtgtgctgtaacatgcccgcaggctactgacgcgcactgaggtgcacgatgatt

SEQ ID NO: 4841 - DNA, 201 bp, Bos taurus
cttctcagcctctttgaatgctttgtggttcctctgtctcactttggttcccatcacgtcagccttgaaggtggagtggcctgtcagcaccacatccttctgagtggagccacagaatcaactttatctgctcaacttcagactctgctgtgtgaatccagcctcagggacttaaggttgagaggatgcagggccgtctct

SEQ ID NO: 4842 - DNA, 201 bp, Bos taurus
ctctgttgggacttgatgactcttacatccttttactacaacaaagatttaacatggcatatggttctctacttggcccggagagctaggtaagaggaaggaaaacttttctggctagatcaggaaaagagtagtggttggaatagatatggagatgagagcaggcagcatcattgtcacaatgacatttaaatagtctgg

SEQ ID NO: 4843 - DNA, 201 bp, Bos taurus
gattatctaggctagccttttctcattctgaagagtgatgaagaattggcttccagaaagcgcaaaaaatgaaacagttttacttcttagacacaaattcgtattgatgataataattaagtaaatactcatgcatgttgtattttttttaattaagcaaacctttcattttcttattataaagatatggaaatacaacaa

SEQ ID NO: 4844 - DNA, 201 bp, Bos taurus
gagaaatggatactcttcaaaaattgcactgacattgactaactaaactcctaccaggaatttgatcaacaagagactgaagccatagcaggctgggaaatgtacccaacaattctgtccttgatgcctcctaattatacagtgaagaaacagaaggatgtcacaagagcatgcacttcaataaacatttgcttgaaatgg

SEQ ID NO: 4845 - DNA, 201 bp, Bos taurus
ccctgctactgacttcaagagaagcaagcatgatgtgctatagaaagtggtcaattctgcctgggaactgggggacgggtctgttagggaagtgccacccgactagggtactgaaggatgagtaggagctcctcgagtggggaaaagggagggtatgtccttcgactggagggacagcagaaattaagggaagaccagaag

SEQ ID NO: 4846 - DNA, 201 bp, Bos taurus
tttgatagccataaaataatactaattgtgcttgcctacatactgggttgctagatgtgaacccctgatattaagatatgtttgtcaatatctttttcctcaagaaatcaagatatctaggaatatcagtccttagaatgttctttgcttgaataaatttatttcttaatcctgaaaacataaaagcctagtctatagtat

SEQ ID NO: 4847 - DNA, 201 bp, Bos taurus
tccagtgccatgaatctctaggtgtctgacatgggccagggtagcctggggaggcaagctggtgaaatggatgaagcacatgctccaggattagaggcacgccagcccaggccttcgtgtgtgtgtgtttgcaaggcttagaattgcctcgataatgatcacaagcacgtcctgatgtttgcaacctgtgagcagatgcca

SEQ ID NO: 4848 - DNA, 201 bp, Bos taurus
ctgagagagcagctggagacccctgagtctgaaatctgacagaaatctggcagaaatgcctgagatgtgtaccacaagtcacggggcctggctctaacatacttctgcagatagccttggagactctctgagacaacgatctatcagagattcctctggccacatggagtttagattatgaaagtattagggaaatactag

SEQ ID NO: 4849 - DNA, 201 bp, Bos taurus
agcttccctttctgttagatgtgtttgtgtggctgtcttctggtcagtgaagtgtgagctggcacggtgtatacctgatgcagtccaggccctttgaaatctcctgttctccatccaccagtttaaaacaggggaatccaggggcttggatagaaagaccctgggcctctgctgtatgcatctgtcatcctaaactggact

SEQ ID NO: 4850 - DNA, 201 bp, Bos taurus
ttccttatatcatttcaatttcttggttcagcatcacatctcctccactttaatcctcctgcctcccttttacaataaccttagtgattacacgggattatccagataatataggatacactttcatccccaaatccttaacatttgcacatttctttttacaatataacgtaacactcacaggttaaggagattagaatg

SEQ ID NO: 4851 - DNA, 201 bp, Bos taurus
actgcaggaatggtttccagaaatcccccctgctacctctgtgtcagttcaccagtcttcaaaacaggaggtgcaggatcagaggctgtattacataggaatgagtctaagacatctgaggcaggaagtatggaggtaaagaagaaccaacatttaaaaggagcatcaaacttaaaatattgaaatctagttttaaaaaaa

SEQ ID NO: 4852 - DNA, 201 bp, Bos taurus
tagcaaaaacaaaccaaaaaaagcttattgcattgtaattccgactactgttttaatattggagatttactcttttcccagaattaactctccctcaatattgacacatgacttaagagtattctcaatgaaaacggtgccatacagtctgtagtttggcttaacttataacacctttgccctttatttcataagacatca

SEQ ID NO: 4853 - DNA, 201 bp, Bos taurus
gtacttcactcttctccatttcatgccaattacctccccaggtagatttactaataaagaaactggagatgcaaccaaatactaactccagcacaaaccattgggacttcccaaagtgccttttatcctgaccccactaccagtctcggctgtgtgaagcgggttcactttcaagcccatttaaatcaatttgtaaaactg

SEQ ID NO: 4854 - DNA, 201 bp, Bos taurus
taaggttgcacttgggttctcaccaaataccatcatcagtagaatcgaaaaatgctgattctgcacaatatcctttatatcaatgtttgcacgaatcttcctaacaagttttagttgaacctgtttttctaagtaaatctcacacagagtccaatatacagaacagacgaaaatagagctgacttgttaaaagaaaaagga

SEQ ID NO: 4855 - DNA, 201 bp, Bos taurus
caaaaactaatgagaggatgaggttgaaggcaagctttcctagtactgccatcttctagaatagaattcttagccatttaataattataaatttaaatctgccattctaggtttttgtgaaaatatattagtcaaagtatgaaggtaaactctgtcttatttaataatttgctaattagatacacaactttaaatattcat

SEQ ID NO: 4856 - DNA, 201 bp, Bos taurus
tcttcctgccagaaatgctttaggtaaaacttgcctgaaacaatgaaaaatgtattagacagtgtaagaagccttttttggtcttatggtgtataatgagatattatgtgattatctggggcatttttaaacatgcttgcctgaacaacaggacactagtaatacaacagaatcttatgtattctgatggtttggggtcag

SEQ ID NO: 4857 - DNA, 201 bp, Bos taurus
aaatgttttgttaacatcggtatactcaacatattctctttaagaaatgacaatcccacacaataaaattagaacaaagagcctatttttattaagcacagattacttggaacatattattgatgaaattccatggaggtaatatgaaaaaaatatcaatttctaccattttctacataatgaagtacagcagagttagcc

SEQ ID NO: 4858 - DNA, 201 bp, Bos taurus
ggcaagaaaaagcagctaaggctgtggtccccgccccggaaggcgaaggctgcaaactcaacctcacctgcctggctgctgggcccatccctccgcaaactataatgaatgcaaatgaggatgactatcgcgcaattctaacaagtgtctgaaggcccccagggaggcaccctcccggaggctcagttccgaagaggaaaa

SEQ ID NO: 4859 - DNA, 201 bp, Bos taurus
agaaataagtgtaagaataaaagacttggtattgttactgactcagctctcttcagtacctctctatgtgttgaaagtgaaacttctaaatttgtagtaggttgtttctcaccatgagtgttaggctagtcttcctgagcagagatgcgtgttccagaggcaagtgatgaaatgattcaaaaccctgtggtaagtgcggtg

SEQ ID NO: 4860 - DNA, 201 bp, Bos taurus
gagtcagatgtgacttagtgactgaacaaggattcaaatagactgggtggcctactgggaagacagatggatgatctatttattggggtttctttgatctagcaaaccctattatttgaatggccatccatgatactctctcaacgttatagagaaacaaatattagcattagccatcaaaagacttctttatcctgagat

SEQ ID NO: 4861 - DNA, 201 bp, Bos taurus
agaaactctgttttggcatggtgcctatcttcatgtcatgtcatgcacacagcttggtttagtcctcagagattatccagtgtttgaattttgatgaagttagggatgatgggctgaattttgtaacttttaccttaaaatgtattttattcatccatatcttatatctgccagcaaagcccttttgtgtaatccttggtg

SEQ ID NO: 4862 - DNA, 201 bp, Bos taurus
tgtacctggtggcttccagggtctgtttatgggatggagattgggcctgagcttctgtggtgggaactccttggacttgttagtccaagtctgaactgctggactaacggagaatgtcaggccccagggaatattaatcagagtgaggtatcccagaagtccacatctcaataccaagacctggctctgcccagcttactg

SEQ ID NO: 4863 - DNA, 201 bp, Bos taurus
ctggaccaggcactgctgagagtagggatgcaagaaatagaggaagtgctcagaggtactagggatgaccttgtcacctggattctatctaggccccctgcgtggtatgtcctgccagtgcttatctggccataaacaaataccatgccattgaaaccctgaaatagtgagtctactgaggctctcacattttcatcacgt

SEQ ID NO: 4864 - DNA, 201 bp, Bos taurus
ccagagaggtggccactgtggcccatctcataacaggacctacaagaacctcacttggagtgaccaaggagcatggaaccagagtgaagggagcctatgaagggaggcagtgccaggccatactcattgaggtcccacaggcactggcagcccctctttggaaactgctctgcttctttgcactctgggcctatgatggga

SEQ ID NO: 4865 - DNA, 201 bp, Bos taurus
aagaatattacttttgagttcctcttaaaacaatggaaagccataagtggtgccacagaatgccttactctcaaatgtgtgtgcagtgctctaacttctgactcttaaatacacaaaagaattctgaaaacttctgaccttaaggttcagaaatggattattttgaattacactttggttttcttgtgtcttaagtcatgt

SEQ ID NO: 4866 - DNA, 201 bp, Bos taurus
aaatcaaatgcaaccacaagtatgccttgcataagggacccttagcaataagttgctggttttaggtcattatacacttttcgaagggaagtgggagagagctaaatggccagtcagagaagaggcattgacctgtctagggagctccttgacaagtacaggcacttagggaggttccctttgaggaaaccataaaaaagt

SEQ ID NO: 4867 - DNA, 201 bp, Bos taurus
tttatcgactaatttattcattcttttaacatgcaattattgaatatccaatgtttgacagtgacaccaggattgaagccattaacctaaccttgaatttaaaaaaaaagaaaagaaagatacatatgatcgtagaatgatactgttttaggtcttatcaataatctacagatactattttatgcagccaagtttgaaaaa

SEQ ID NO: 4868 - DNA, 201 bp, Bos taurus
caacatgtgctaagtgtttggactgaagtacagagaaggctgatagttaggaaagaaaaaaaaaacaaaacatatatgagttttaccaggatactattaatgatagaaattgtgacaaaaattaaaaatacataaaagtatttggcagatatttattataatacatggaacacagggcctagatcagtctaagggaaaata

SEQ ID NO: 4869 - DNA, 201 bp, Bos taurus
tctctgataaagcaggtaactgtagacattttgactgatgttgtgactgtcttctgagttattgctttctttttacttaaccattgtgatttccccgaacgacattctttaaaacaacggaggtataaactactccttaaaattagtggttaatattttataaggtatagcatttagttgcttgttttatttttctgtaga

SEQ ID NO: 4870 - DNA, 201 bp, Bos taurus
cctaagatattccaatctaaaatggcctaccaccaaagcagctgcactccgttaaatttacatggtttacatgggaaggaaaggaaagaaaaggagtaagtaagcaaaaaggaaaagatggaaggaagacaagaaagaaggaagggaaggagggagagagggagggaaggaaaaagggagggaaagaagggaggaaaacca

SEQ ID NO: 4871 - DNA, 201 bp, Bos taurus
ctgaattgaactgaactggacctctcctccttgtcatcctagatccagcttttctttgtcagtgacttatcagtcacttgctctggcccaaagtctctgcgtgtttttatcctccagctcatctgttccatcctaagtgtccagagttctatttcttcagggtacctactctctgcacagaaagagacatggtctctcagt

SEQ ID NO: 4872 - DNA, 201 bp, Bos taurus
taagtaagtcctctcttaccttgtatacttctattgtacctttccagactttagtcacaccctttcagaataaagacactcagttttcacaaatgaaaataatcttggaaagagctagaaggtggggcataaaattgtttcctttttcagaccccaccccctcaaaaaacaaccccaacaaaaagagaaacagtatgatct

SEQ ID NO: 4873 - DNA, 201 bp, Bos taurus
tttttcagctttaagaataaactgagagtgggaactcactatgaatataggtgagttgttttttttttttagttcccaataacaaaggtacatgcatatacttgcatcacttacctgtaggtttgctagcttaattcagttttgagtcaaagcatcagacagaggtgactcatttaggtgtgtgatcccttcaaaaaaaag

SEQ ID NO: 4874 - DNA, 201 bp, Bos taurus
atattaatttgggggcctttttctccccaaggagaaaggaacaagggaaaaatttattctgagggggtcccttttataaatgcacatttagggttcaaaactgtgaggccttttgtttgttatggattaagcttccattattttttaaaaatgtctgtcgttggataagctggtaggagcacttgtgtgtcgtcaattatt

SEQ ID NO: 4875 - DNA, 201 bp, Bos taurus
aaatgtttttattcatgcaaaaagtttactgtgctttgaaatacatctctgtgaccttattggtatggctggacagagaaaaactgaaaaatacttaggtatggggtgcaatttaatttccttaaaaaactgcatctctccactctatagcaagtcctcctttagcaaagtttaacctcaacttcattgtcacaaagacag

SEQ ID NO: 4876 - DNA, 201 bp, Bos taurus
acaaccttgcctttgttcccccccatgaatataattaaaagagacaggcttgcaaagacctactgatgggtcacactgggccctgccaaagtatgggatcgggatatgaagcaaatcccattaattatagcaatcaatgattcctccagagagtaaggcttacaattagaggttttcaaaaactttcgaggccactggaga

SEQ ID NO: 4877 - DNA, 201 bp, Bos taurus
aaatgagtctgtcaaggaaacatttttccgaaaactgtgtctgttaacagtgcttgcatacttacttctacaatttagaatctattgttttttctctacttggtttttattttatggtaatgtaggctttttccagttaaaataataaatacctttgttatactcaaaacattctttatacattaaattggtacaaataac

SEQ ID NO: 4878 - DNA, 201 bp, Bos taurus
ctgggcctagaggcccaaataattgaataagtcttcataattaggaatgaaaccaagtacaaaattatttgagactttgtatttttgtgggtacccatccgcattctctggcctcttggatgcaatggtatatgttaatgattctgagattttacttttttttttttaactttacaatattgtattggttttgccatatat

SEQ ID NO: 4879 - DNA, 201 bp, Bos taurus
gtaacaacaccacacagaggagagcagagttgtcccagccatctgagttgaggccatcctagacaatcagcaaccagctggccctcccaaacatatcaggaaaagcaggcaatatggcagagttgcctacctgacccacagctgatcacagacatgcgcaagctcagtcaggatcagctgagcctggcccagaagagccgc

SEQ ID NO: 4880 - DNA, 201 bp, Bos taurus
cacctggaaccaggccatgttcctcaggagacaaggaggtgcctcgctatctcctcttcatcactccccaggcaccacccctggcccaagcctactacctccccttttcccatctagagtatttcctgcgatttgggggttgcttcctagccacatggtgctcctggccctcagaagccaccacttcatttcagttttctc

SEQ ID NO: 4881 - DNA, 201 bp, Bos taurus
gaactactataccttatatgtaataatttgatgactactaagaatgaaaccaatgaccagaaggagttatcttttaactacatataaggcctcacatgcaatcatatacatttcatgtttttactatcatgaaaggttgtgcatttttcaagttaaataggccacatttttaatttgtcattgaaccacaaatcaacctca

SEQ ID NO: 4882 - DNA, 201 bp, Bos taurus
tccagtggaacaatacatcagggtggcctgccaagcaggtgcaaagttttggaagacattgcaataaaggtatctctggataaatgggcaagtcaataaacgtatgccctagggccaatttgcatttattattattttaattatttatttaaagtttatttttggctgcactgggtcttcattgctgtacccgggctctcc

SEQ ID NO: 4883 - DNA, 201 bp, Bos taurus
ttcaattatacatatgtatttacattttttaaaaatattcttttccagatggttatcatagggtgttgaatatagttccctgtgctatacagtaggacactgttgtttatccatctaaatatactattttgcatctgctaacagcagcctcccgctccactcctcccccaacctcctccctcttggcaaccccagtctgtt

SEQ ID NO: 4884 - DNA, 201 bp, Bos taurus
acaattgtttgaaaaagaataacaattattttatgtccttttttgcctgccagtgacttttgacactgattgtttaatatttgccaaaaagaaaagaggaaaggggttacagattaatgtcctgaatatttggtccttatctattaggaatataccaataaaaagaaatacaatacacactatgaagttgtcagggcttcc

SEQ ID NO: 4885 - DNA, 201 bp, Bos taurus
catgcagatactgactgggttggcactaatggggcccacctgtctgcaaagcactccccatcaattgtcatgaccttcttgaagcaaccttcaaggaaagataaaaatacttggcctaacaccctaacaagcagcactggctccaaagacccctgcctgccagttgaagttagcagagtatttgttgaagtttaacttcta

SEQ ID NO: 4886 - DNA, 201 bp, Bos taurus
cagctcaggaagagggaagggagctaacagggtcttcatgaaacctgagagccacacttcctggccacgcctcaggtcaggcccactcatcctctcgcaggaggtctggaagggtcaagagggagatctgataccctggggggcttccagatcactgcaatgtcacccttttgtcagaacagctaccctcagacttccctg

SEQ ID NO: 4887 - DNA, 201 bp, Bos taurus
gtccccaggtcgctactgcaggcccaggctctgctgagctgcaaagctgtatcacaggcacctaaactctaaaacacaagttattttcttctccatttcttcttctgagtcagagagaatgtaaacacctgccatcgaatcatccccgactggacgaggggccctggataatgccctcatttacttccacatcccatcaac

SEQ ID NO: 4888 - DNA, 201 bp, Bos taurus
atcctcaaagcaagtgctctacaatggatatgcttctgggacaccaggccaaaggggtctcatttttatcatctctgagcattttcataactttatcaatcttcaccaaaagcagggtttacattcagttacccaaaccctataatgaaaagtcattcacacaaacacacacacgagaaatgtggatcaaaggagacaaat

SEQ ID NO: 4889 - DNA, 201 bp, Bos taurus
aggaaaatatttaaaagaatgtattcatattttctagaaatcaatttctttgcacttgcctaggatggctcttggctggcctgcaaggaaatatggaaacggaaactgtttgcactgaatgcttggcttccaatgacttactatgctttgggagttagtagaggaaaatagcaaattcttggccaggtactaagaataaaa

SEQ ID NO: 4890 - DNA, 201 bp, Bos taurus
caaagagttggacacgactgagcaacttttactttctttcacttttcatgaccagtgaaggcaagctgccactcaaatgtcacaattttaacaccaagactttgccaaaagagcagtaagaaaggtaccaagtcagacccaaggtctggggaaattttcattgacttctaccttcaaaacccaagttcgttgactctaaga

SEQ ID NO: 4891 - DNA, 201 bp, Bos taurus
tggaagggtggcctgttctaatcaagttggcatcttcaggcttgcagttgacagacatgagcggcgagcttcgagctgcccgcacctccgtttctgccccgtcagcagggccatttgtcagtggagctcacgtggtgggttgctggtagagtgaggcaactgcagcggtccccatgtgcccgcaggctcgctgtcttcctg

SEQ ID NO: 4892 - DNA, 201 bp, Bos taurus
aggccggaagcttggagaagttggtctggggcccaggctagggagaggggtgggatggaggatgcagctctgtgatttctcgggaaagcgtggagaaagaggggggaggaggctggcctccccgggaaattaacaaaacctacactttgcaaagtctcccccatccccctcctccgaattcttccctgccgcgcgcccgcc

SEQ ID NO: 4893 - DNA, 201 bp, Bos taurus
cagaaagaaatggctttgaaatagtatataatctgtgttctatttagataatataaagtttaattttattgacaatattttatttttgatgctagtaaaaattagtaatggtgattttcaagttccctacaagagtacgaaagggccttgcagatttaagtaacatgatttatgtatgatgcttcgtcaagtgtctgggat

SEQ ID NO: 4894 - DNA, 201 bp, Bos taurus
cgcagcgcgctcgggttgcgcgctgtagcgcgggggcgacggcggcgcgggctggcgggcaggcaggcggtctatggagtaatgacaaacacatttggccccgagtgaagaagtcgtcgtcgcctcgcattccagcaactgggatttgaggaatttcgaactgcgctccaaggggccctcattgtgcgcggtggtctccac

SEQ ID NO: 4895 - DNA, 201 bp, Bos taurus
gagttaggaccaggccctctatttctttcctgcacccctcctccccaacccctttgtgtctagaagagcactgaacacgcagtaggtgatgttttgaaacattgattgatggggagttgggggtgttcacttgggccatctgcaggtgggctggggaggaggggatggcgtcccatggcttgcatctatgtgtctggtagg

SEQ ID NO: 4896 - DNA, 201 bp, Bos taurus
ttctcaggccttctggctcagactgaattataccaccagctttcctgggtctccagcttgcaaatggcagactgtgggatttctcagcctccataattgcgaaggccaattcctcataataaatcattctttctctttctgtctgtctcaatattatatatatttatatgtatgtgtatgtgtgtgtgctcagtcacttgg

SEQ ID NO: 4897 - DNA, 201 bp, Bos taurus
ggagtctatcaggggctaagagcgtgaatttacaatgccctatggcccagaagacacgtttcatgtatcttagcaacaactctatgaaatacacgaagtcaagttttatgtacccattttacaagtacaaagagagcataacaggtgcttagcagcagggctagaattggtgaataggcttcacaattctgtctccagcag

SEQ ID NO: 4898 - DNA, 201 bp, Bos taurus
gcctgtttggttaaaaggatgtaattagttgttggtcacatccttatgaaaccatcacgtgaagtaaagataaaggcagcttcactatgctagggtttctacctagctttgttcaggattatcatcatctcaaagtagacattctctctttttcactctatattaattaatttacttgggggacgcatagttgaattcctg

SEQ ID NO: 4899 - DNA, 201 bp, Bos taurus
tagaaactctttttaaaaggacatattcaaagagaagcatgtaaaaggaaagcagtcctaaggggggggaaagcatttattcaagttggttttgaaagcagttatagtaattaaagtcctaacaatgtaaaacacaaattgaacaccattcagagcgccatctagatatttatttttggggcaccgaatggtttaaatgta

SEQ ID NO: 4900 - DNA, 201 bp, Bos taurus
ggtatcattgtaaagatctttttagatttggttagcatttacagtcaggagactttgagtaaagcagattactgtcagtaatattggtgggccttatccaattagttgaggaccttaggagcaaagattgaagtttccaaagaagaagcaactttgccttagactgcaagatagaaaccttgcttaagtttcccacctgtt

SEQ ID NO: 4901 - DNA, 201 bp, Bos taurus
gaattattaattatggggacaaaagcatcagttacacaaatcccacagacctggggttgcaggcaatctattttacattaaaataatatgctgacccaaattcccttggggtatctgcaattaagccaagttttctgccactttatagcaaggaacatttttcctccaatattcaataacataaccctcatttccattgag

SEQ ID NO: 4902 - DNA, 201 bp, Bos taurus
ttccttctgccttgaggagttttggtgagtcagatatgagctcatctgtctaatatataagcacatagaagacaatcttctcatgggccctgaaagcattacattgaaggcaacccaactgcctctggatggtccagagtgactgccctacctaggactgtgagctgcctggccacacaatgtcttttcttagtcttcctg

SEQ ID NO: 4903 - DNA, 201 bp, Bos taurus
aggccacctgacccatgaaaggaaacaaaacaaaggttcatggtcattgtctaccgaaatgtcgtgttttggtccaaccagaccttggaaacacagattgggatatgagatgccaagcattgggccaccttaggaaggggcagaggaaaaaatatttcccttacccatcagatagtgctggataaaaaaaataaggcagga

SEQ ID NO: 4904 - DNA, 201 bp, Bos taurus
cttccccattttgctgggactggcccagtctcattgtttgagtggtttgggctgagatcatgagaattattctggctggagctaactgctttattgtaaacttcaggccgtgtgaaaagataggaaaaagaagtgcctggttacacattcacttactatgtgaatttagatgttttacctagaacctcagtttttcataga

SEQ ID NO: 4905 - DNA, 201 bp, Bos taurus
agtttctgagttcttttattttccacggagtgttctcaaattctaagtaagattattcttcgggggctatgagagggagaagggaatgataaattaggcctccttcaaatctcaatatattgctgtatggcttttgtgattggtttctttcagttagcatacatactttttttaaaggcccatccatattggagcatgtag

SEQ ID NO: 4906 - DNA, 201 bp, Bos taurus
gatgctttgaagaccagggaaggccaggtgatgtccaggcaacttgcagagtcagaaagattttaagttgattcaaatagagaataggtaaagagacctcgaaaaaacccgtggtgggccctcgtaccataccaggtattgcagcaaaccaacattgtctttcaagtaaaattaactctgttaattgcaatttatgttgct

SEQ ID NO: 4907 - DNA, 201 bp, Bos taurus
ttttagtaacacagatctccttccttctcattatgtgctctagtttccgtatgttcaccctccttaacttcatgtattatggcttttgccctcacacttccacagaaagtgctcttcattgtttctacctcttcataaaactcacatgttttcattcccatagcatgaaacttaccttcctaccttattgactatttctct

SEQ ID NO: 4908 - DNA, 201 bp, Bos taurus
ccaattttttaatgatacatttctacttgacattgtgatagaaactgtcttctttgatcacttaatcaaatgctaatcacataaaatgcacttttcaaaaaacccccatgaactcagaatctctgaaaatgttacttgatattaagttaaatcactgagtatacctagataagaacagcagggttaagaaaaaacaatgaa

SEQ ID NO: 4909 - DNA, 201 bp, Bos taurus
ctcttttgctctttcatccctggctagctcctactgtcccatcaggcctctgatttgatgacttcctccaagtagtcccactggccctcataacaccttaccataaccccactacagcccttagcatacagtgttgtaataacccattttcctccatttggccactagactaagcttctcacctgtgtaccctggaggaag

SEQ ID NO: 4910 - DNA, 201 bp, Bos taurus
agcgagaagttgagagtgagggttgggaggtgggcaggactcaccgaggagctgcaaaccaaaataagaaatctagggagcagaaggagaaaagagagtgcgctggagccaagacctcaggccaagtggaactggaggaaatgtcatcattggtaaaggaggacttggagaagaaactgtttaagccactctcacagaatc

SEQ ID NO: 4911 - DNA, 201 bp, Bos taurus
cagttatatagaatatgtttcagaaatatagagcagaaacctgaaagagaagcctcagtttacttctagatttctccttaatgttacctgcatacagccaactctttcctggtgagttatctttactcacaacattttaaacaccaaatgagactttgtttttgttttttttttctcctcctaacatccaaatacatggta

SEQ ID NO: 4912 - DNA, 201 bp, Bos taurus
aatatatagaaaataattgtttccttagtgactcaggatcctgataagaacattagttatgttctattctttaatatactgatgtcccaggtttattagtatttgtaaggccttcatttaaatgatttcagattgctgtgcttttgctttatttatttgattaaaacatgtgttttcttctttcattttgaggaccacttc

SEQ ID NO: 4913 - DNA, 201 bp, Bos taurus
agggcagggctgggggagggagagtgggcctttggacagacgtccaccaccctccccaaacccaggtgctgacatctgaaataaactttccgttccaccaatctggcctgtttgttggcttttgagtggggagcatctggacaccaccaccatttggtaacatgggagaaatccccaggaagaatctgtcaggagaagaga

SEQ ID NO: 4914 - DNA, 201 bp, Bos taurus
ccagtggaagagatacagcagttaacaataattgactgtctgcctctttgaatttacagtctgtctgaaaacaaacagtaaacaggtaattacaaaggtggtccagattaaatgtatataaacttaaactgaattgattgatacaaagataaatatgatttagccccctttctgaaggagcttataccttaagtgttgaaa

SEQ ID NO: 4915 - DNA, 201 bp, Bos taurus
gtccccagactttctttgttttcttggtaataactttggtcagtatgatggagtctatctccagtgataaagttcactgaagtggggagtgaaaagtcaaatcatttcaaatggtgtctaaaaaacatacttgaaagacttttatatagtatgaaagactttggaaactgtaaatagccaagctaatattggatattatgg

SEQ ID NO: 4916 - DNA, 201 bp, Bos taurus
taccaactaactgttagtgaatgaagcaatttacaagcaaattggaaccctgtaatttgaatacaacatgacaagcggcataatatagaaatgcatactaaaaggtgaaaatttcctctcacatgtgcactgtacaaaatagtcctggctaatatttgactactagttttagtaaaaacactggcctgggcattcttgaat

SEQ ID NO: 4917 - DNA, 201 bp, Bos taurus
cttatattagtgtcactggatcagaatgacaacacacttgtatgtttttcattgaatgagtgatactgttgtcactgtataaatctgtatctctgttttataccaaacaataatgattgcctgaatgattttgcattgattactgttatcttttgctatattttaaagttgatttttactagttgccattgtaatatagca

SEQ ID NO: 4918 - DNA, 201 bp, Bos taurus
tctcatccaatatattactttagttatattggaacaaaatgctcacctttaattcatcttgatttgggggaaataactgaaaatttaagactattttaagtacctgattataaatttttctaagtttaataggtcctgatccccagccccatcataccgcaacaactaatcaaggaccagaggctcctttttcagatccta

SEQ ID NO: 4919 - DNA, 201 bp, Bos taurus
ttaatgctaaccctaagtctacaggaagttcagggatctgtttcaggccaattaacttcacagcattcatctcatcatgggacctgggacttgacttgccaattcattgtccacagctatagggccactcaatcgactagaaatacttgaaggtaaacacttctgactggtgtaatgttttatgtacagtgtttacagaca

SEQ ID NO: 4920 - DNA, 201 bp, Bos taurus
tttatgattgagagttttgttaatgtcatttgtttctgttgaggtttgctgtggtctctaggataaaatttgagttcttcatgctgtttaggcctctttacctttccatgggccttttccctcaatctgaaatgattgtgctgcctgtcccatgcctcctcaaaaacgggtaatagggagaaggtgttttttacttttttt

SEQ ID NO: 4921 - DNA, 201 bp, Bos taurus
caaaacatagttttgaaagctctaaatatatttcttgcttccttccctctaaagcctaggtctaaaaggaagcatgtctcttggccaggggtcttagtctcttctgtggctaacgtggacacagtgagtaaagtggggctgcgtttgtgtgtactgctggctctgtttctgatgcttccttgtctgtcctcaccaacacaa

SEQ ID NO: 4922 - DNA, 201 bp, Bos taurus
agaaagggctggcctcagtcaataccatggcgggtctaagggagccacgccgctgtaatgcacatggtcgtccctcagtatccattgggggttggtaccaggagtcctgtggatatcaaaatccacagatgttcaagtcccttacatggaatgatacactacagtgaatacaggcagctcttggaatctgagaatgcaaaa

SEQ ID NO: 4923 - DNA, 201 bp, Bos taurus
ctgtgtggtggggaggtgtcctggacctacagtgggaaggtgggaggtgaatgaagtaaatattcagtgaactataaggcagaccttcccaggcagggatcaagtgaatctgtgggcctgaaccacagatgatccatacacaacaggaacagttggacagctggtagtagctaccagaaatcaagtgtttctgctgggctc

SEQ ID NO: 4924 - DNA, 201 bp, Bos taurus
cagcctctctgggtttggcagtctccctctatccagagccagtacagttggcaactcacttatttgtcacctttggagatgaagttgttctcagatgtgatgtatccatctaaaggaaataggtatttcagttttaaaacattaaaacatagccatctggacaggagcccatctggacaccctgcactggctgatagcttt

SEQ ID NO: 4925 - DNA, 201 bp, Bos taurus
gaaacaggaatttttaacatttttgtgctgacagtttttttttaacacatgattatttggttaacctgaagctcagattctaggcgctgtattttaaatagacaaaaaggctgctaaatgagcaaaacctttaagctccaatctttttgatgaggcaaggtaagccagagcttacatttgaggccaaatctattctctttg

SEQ ID NO: 4926 - DNA, 201 bp, Bos taurus
ggcaaattgttgcatcctgtagacatactgctatttttcacacatttctatttattcaggttatttccaaaacctagaagctgtttctctttcttccccctctctctctctttttttttcactttaccccaatctcttaatgtatagaatataatataggttctaaaagtgtggtccatgtatcagcagcattaatatcac

SEQ ID NO: 4927 - DNA, 201 bp, Bos taurus
atgctaatttcatattagctcaagttgaaatagttgtaaggcagtagaaactgatgttagctaacaataaaaatgggatttatgataaatatgtgggagagttttccttatggagggaaaaaatgtagaaatttaagttttgatgaatatatggtctgaaatctgagtcctggtaccagatcatcagtagtcagagtctag

SEQ ID NO: 4928 - DNA, 201 bp, Bos taurus
ttaacatgtgtatgcttcatttaggaccctaaatgcaatgaacatatttccttatgcagatgtagcaggttataaagcctcaactgctgttcctacaaacgttgttaggagtggggattttctatcacctgcaaacaaggcatccatccgtgaaagctacagggtgtttgagggaaagtaacatcctgtttggatcaagtc

SEQ ID NO: 4929 - DNA, 201 bp, Bos taurus
aaatggtgctcataagcattcctaatgtatgagtgcaaaaatggtgcctgctagcacttctgtccttggggggtatcccaacaggccactgtccctccaacggatacttatgattagcaaatgaatttctttcacataaaatctgagtgcttttcatatggctgtttctgcactgaataatgtatctggatggcctttaag

SEQ ID NO: 4930 - DNA, 201 bp, Bos taurus
ccaaaccacagccatgaagcaattttcctcaaattttaaactcaatagtcatttttctgattttagtgtcaatttttaagagatacatcgcaagaaaagtatattaagccatagataggaagcaaatccaaatcatgaaaaactttacaaggaaaattatctggcttttcaacaaataccacgacaaaaattgcaagggga

SEQ ID NO: 4931 - DNA, 201 bp, Bos taurus
tgcattgcaggcagattttttactaactgagctatgaaggaaattgtgaccaaacaaattaatcccacatatttcagacatgctttttaattaatttgacttgtttttattgatattttgtggtaggttttggacaagtaaaatataaacaaagctgtcccaagccaaatagattttttttttggcatttatgcaatatgc

SEQ ID NO: 4932 - DNA, 201 bp, Bos taurus
accccttttgtcaaaaagggcctctactattttctacaaagagtctttgtgaaaactgcaaagcaagcagcacttttagacatattaatacaagacagccctctcaacaggctggcccagatcaaaagaaagcaaagggtttgacaagcatgggaagtactaggttttacctctttattctcgtcttggctagatgccttt

SEQ ID NO: 4933 - DNA, 201 bp, Bos taurus
tctgatataaaaaccacagaaaatgcattattctttgataaaaaaaaaagctacagaataatattctttgtcaaagcgtatgtaaaaatcccaaacaaaattttggcaaaccaaactcaaggatgcataaaagaaaaattctcagtgaccaaattaggccaatcccaggaatgtaagaacattcaaatatcaacaaatgta

SEQ ID NO: 4934 - DNA, 201 bp, Bos taurus
gaccagttgaaatcactccccaggcttgatttggcctgaagccagatggttgatactgttaatagagaaaacatctgtttacactaatgtgttagtttttcgtgcttggaggccatcaatatgagctgctatgtgcacaggtattatgaaaggaatgaataatcttttttcatttgaaagtcaacagtagatagaggactc

SEQ ID NO: 4935 - DNA, 201 bp, Bos taurus
atggcttattttgcataaattgacaagctaaatctaaaatttataaggaaatgtaagaaacccagaaaaaccccaaaaattgagacaaaaaaataaggttagagatttctattttctgatttcaaaacttactggaaagctatagtaaacaataccttgtgaagttagcatatgcatatacataaataaaataaaactgac

SEQ ID NO: 4936 - DNA, 201 bp, Bos taurus
agaacaaatcactgatgacagctagacagtgattcagaaattgcatacatctctcaacccgcactctggtttgtctaatctcgctttgctcttggttccacatttgtgattctttacagtaacttcacacttcccttaaaacttcactttgcttgctctggtttgctgctaatagactctagcattttggacactagtttt

SEQ ID NO: 4937 - DNA, 201 bp, Bos taurus
ttccagtattcttctctgtctcccatggacagaggagcctggtgggctatagtccatggggtcgcaaagagtcaaacacgacagagcgattaagcatgcacacatgcacgcatgcacacttacaaaatgcttgtaaatcccttttaaaatggcataaggaataattaaattattgttaaatcaacataatatttaccaata

SEQ ID NO: 4938 - DNA, 201 bp, Bos taurus
aggatacaaagtagttatagcacctaaaagtttctccttactgcccatttttagtcattttctgcctgtgtctctaatctatagcaaccactattatgttcttcattcctacatttttaggttttttagaataccatataaatgaatcatacaataagcagccttttgaaactgacttctttcacacatcataatgccttt

SEQ ID NO: 4939 - DNA, 201 bp, Bos taurus
ggatacagaatggtggaaggccatacatatgaaagcagagatgtttagaaaacaaaggttgctgttatcagtttcttaggtaaaaagataattctgttaacagctctcttcctgatacaggcccctttttccaatggaaattaaggctattgggggggtatagagaattgttcctcaatctgttgcgtttttgattacctt

SEQ ID NO: 4940 - DNA, 201 bp, Bos taurus
tttatatcatcagcagcagcaacaacaacattgttatcattattttctttgttactataacactagtcacattagcagtttgtactaaaatatttaataactctgtccagatactgactatatatgatagatggactgcttctaaattgctgcagtccaggcgttctctgttctggtctgtgtgtcaaaatatagtgaaaa

SEQ ID NO: 4941 - DNA, 201 bp, Bos taurus
aagtggttgggccaagaattttccgattatatggcatttaagcacagaataaaaggcaaaaagagagtaagtaagtaaacatttttggaaggacattcaaagcagagggccactataagttaaaaaaacagtgaggtggaggtaatttgcacacacacacatattccttcattttgccagaaaatggaaaagattcaaaat

SEQ ID NO: 4942 - DNA, 201 bp, Bos taurus
aaaagatttaatgcgtggaacatgctgaaatctaaaaggccttatctcatgcttagctaattattttgacaggggtctaactgatgtgcacttttccatgaaaatgagtttgtggcaaacaggatgactgccatctccataaaaattccataactaattcttatctccacagagagattaagcagtgaaagttagcaatta

SEQ ID NO: 4943 - DNA, 201 bp, Bos taurus
agaaacgaatgtctaatgtatccttttaagaaatatacttcttttacctaaagaagttggcaatgatattgcatggcctcatctgtccatccacagggctggttatatgactctggttggctaaccaggccctttattccaagttacagcattgttatatagatactgtcatatgacaaactctttccactcaagttgacc

SEQ ID NO: 4944 - DNA, 201 bp, Bos taurus
tcccagtggggtcctcctgaagaagcagtaagttttatggatcttccacagcccctctagctaccctttgcatatgttatcagcgatagattagagaaacgtgctttttctcatcctcatcctctttctcatccttagttttggttttctgcaactcctctacttttactgtctgaaatcctattgaaaccaaagtagtct

SEQ ID NO: 4945 - DNA, 201 bp, Bos taurus
gagaggatccatgaacaaagagataaaagaggacacagcttattggggaaaaaccaaacaatctagtaggtagagaccgtgacaaatagtatgatttattgatgaaggtaaacaagttattcattctgaagatgggtctctttgagtaaaggatttggatgctctctgaggctttggtgtttgcactttggaagcaggtgg

SEQ ID NO: 4946 - DNA, 201 bp, Bos taurus
gcagagtcagttgggcctgtgttttgtgcctttcccagatcccagcagctcaggcgaccaggtgcttggtgagctcactctctccaggtgggacgatgtgccttatcacctcccccatctcagccgcttggttttcagcaggagtgccctctcaggtgtgccgtgtagggagagattcccccccccccccccgcctttttg

SEQ ID NO: 4947 - DNA, 201 bp, Bos taurus
tggccaaatgaccttattcaagaaccctgagtggctgagctgtgattcttctattggtatttttatccacgttacccttatctaccttcattactgctgtcatcatatgatgtgcaagaccaacttgctaaagtggtaaggacatttactagagagtcctttcttaatcaggccctattcaaaactgaccactttttaaat

SEQ ID NO: 4948 - DNA, 201 bp, Bos taurus
cattggcccatattagtttgctagggctgctgtaagaaagcagtataacctgggtaaaaaataaataaatttactacttgcagttttggaggctaaaattctgagaacaagttatcagcaggtcaatactccctctgaaggtgttagtaaaggatccgttccagacctttctcaagcttctggtagttcctcagcttgtgg

SEQ ID NO: 4949 - DNA, 201 bp, Bos taurus
gcgttaggtgagagcctccatcacgaaggccttctagcgcccgaccaacttcagggtccagccgttagcctctgtaccacagagccctgtccaatggccacgcccaacccagagaagctctgccctgtcacgcagccctcctcatggtcttgccgaaaggatgggtcctgctgcccctgacagtggtggggtgacccacca

SEQ ID NO: 4950 - DNA, 201 bp, Bos taurus
ccaatacattagcttatttaatctatccaaataaataaataaatgactattctcctttatctacttttttgtgtttttttttttttttgaatatttgtttatttgggggctgtggtaagttgttgctacacacaggctttctctagttgtggcaagtggaggctaccttcctgtggtgcacgggcctcttattctggtggc

SEQ ID NO: 4951 - DNA, 201 bp, Bos taurus
ttatgatcctacacacacacagacacacacacattcctatacacacacaactgcagctagaatttgtatgtgtgtttctgttgaagagtacatacaaaaaacacctttcatcatttatattggatttaaatatatctgaaggggtaaaacagggttttttttttgcattaaaagcttttattcatcttaccccctaccaaa

SEQ ID NO: 4952 - DNA, 201 bp, Bos taurus
tgcagggcctggtttggatggaacccctgcagagcaccctggagcctgagtggtgtagaccaggaaagcacatgttgtgagctggagaaaacccagtgtggtctatactctgtgagcactccccacacataccagggatatttgttttcattgttctccctccccacaaaacaactgaacaagtgagcctaaataagtgac

SEQ ID NO: 4953 - DNA, 201 bp, Bos taurus
tctgcaaagtccctttttccatataaagtaacatttatagattctgaggattaggatttatatatttataacaattagattctctacacgtttcagtttacaaagttctggctttcaagagaaatacctctgactaataaggcacaaggattcttaatggagaaaaatatacttttgaaacagtcataattttataaaggt

SEQ ID NO: 4954 - DNA, 201 bp, Bos taurus
aaatactgtcctttgaatttctctgaaactccaggttgtgcatccaaaaccaaataattcattatactaaataaattttattgtctatgatatatgaactcaggtgtatttatgagtctgtgtttaaaacacatttcagcatgtatttttcaaaacattatacttagagattataatttatcttaaaatcagggcaagata

SEQ ID NO: 4955 - DNA, 201 bp, Bos taurus
actttacccttaaagaagcatagaattttttcttgaaaaaagtcatgatattgcagctctttagccagatactatgacccataatatagggtttaactggcgacaaaccggtgtacgaagatatacatgaatacgggattgcttgcttttattcatgtcaggcaagtaagaagagacagactcagtttatacaacatacac

SEQ ID NO: 4956 - DNA, 201 bp, Bos taurus
ctcacactggcagactaccatatccagttctcacgaactttatgaagtgaggcaggagaaacccacatgttgtctgttttggagtcaatgaggctgctagaaaaattggtccatcaggaaatactttctaagaagagatctgttggcaaaggttttcttttatattaagacaaaacgtaactctttgtagcttaaaaacat

SEQ ID NO: 4957 - DNA, 201 bp, Bos taurus
ttaaacatttttgttattgtgtataagacaaacttcatatttgtcaattataccaatagactttataaaattcataaagtcagtcttcagaactctccaattctaattaatttaaatcacattctgctttaaaaacattaaaaaatctagtttatagttattctgagcccctcatagaaaaattggtattagtctatttag

SEQ ID NO: 4958 - DNA, 201 bp, Bos taurus
caagcttattattcaaaataaacttacaaatgtttagattcctaaactaatagcatattatggcactcaaagccagagctcatggtttttaaatattattccacaggatatccaggagttctatttttccaaaatatgcatttgacatatataataattcagatatgtttgacagataacaatgttaattattaaaaaaaa

SEQ ID NO: 4959 - DNA, 201 bp, Bos taurus
gtccttcctctcacatagaatatagccccgttcaagttctgatttcattttactggccctgtgacactctcccttagatcacattctaacttaaaatatttctccccattcatcacaggacatgatttttgtaaaatcttttattttattccttccaaaaaaattattttatttgcctctcatttgcctcttgcccctgcc

SEQ ID NO: 4960 - DNA, 201 bp, Bos taurus
tttatagttgggccatttaaaaatatccaaacagactatcaaggaagttatctaaagtctatgaacacataataatgctgtgtgtgaaacataggcacttcaatgggcctttgagcttgttttacttcttcaggacttgtatccagtaaaatgagggatttggagatgatcttcaagttctcttctcttcctttgtccttt

SEQ ID NO: 4961 - DNA, 201 bp, Bos taurus
tcccccttcagctctgacaaaatggtctctaaatggttccagcagcttacagttcactggttttctgggtgccagtgaacttcttgactttataatacgcatggagcttgtagtgtctcctgctgttgctaatgtttcaccatccccagtttgatctcatagctcttccattaccagtgtgacaaactccttctatttcag

SEQ ID NO: 4962 - DNA, 201 bp, Bos taurus
agaataaacagtgatgaacaatacaataacgggaatgaaaaatgcactagaagaaatctttagcagaataacaggcagaagagtggaaaagtgagaatggcgagaaagtgagaaagacagaattgtagaaatcactgctatagaacagaataaagaaaaaaaaaaaagagagagataaaatgaaagtgaaaattgctcagt

SEQ ID NO: 4963 - DNA, 201 bp, Bos taurus
ctcttcaaatctcatattgaatttttcagtttagctgttatattaatcagttccatgatttctgttttgtactctttaatattttttcttctttaaaattctcacttaatttgtgtgttcctcttctaaccttgtgaacatctttgtgaccattaattttaagttgtgttgtttaattcacatagtctctcttacattaga

SEQ ID NO: 4964 - DNA, 201 bp, Bos taurus
actaaactaaaccaggcttgctacttgttatctctcaattagcatacaaaaccactataatgatgctacagcaataattctgcatttcagcaggccaagtttcaaaggcacaacatttagattttggacttgaatatttaagtacttaaggaatctccccttatctgcatctgtagcttaatataaaaacttatagcttat

SEQ ID NO: 4965 - DNA, 201 bp, Bos taurus
ggctggcatgctgcgattcatggggtcgcaaagactcggacacgactgaacaactgaactgaactgaaaattatttgggagagtttcataatctgcgaaaatttcacttccatcatatgtagagtaagcatgataaatttaatagaatctaactcattgggttagatgtgtattaagagataattcagtgttataactagc

SEQ ID NO: 4966 - DNA, 201 bp, Bos taurus
tggcctccctccttgctgtttacctggggccaaactatggtggaggtaatgaagataattgtgacctccctcaaaagatcccatgctgttgctgcaatgtcgcttcagtcctgtccgaccctttgcggccctatagatgccagcccaccaggctcccctgtccctgggattctccaggcaagaacactggagtgggttgcc

SEQ ID NO: 4967 - DNA, 201 bp, Bos taurus
catgtgaaggtatttaaaacaagtcttaattcactccacacaagattctttcaaatttttcccttctgaaacaccatttcgaggcccaaaaaccttcagtcttttcctatgtggaaaagtttccactccctctcactagttctgttcttgccctctgaacatgttacagtttgtctacatctcctctttaggccccttgga

SEQ ID NO: 4968 - DNA, 201 bp, Bos taurus
tggcccaatgggtcccaaaagaaaactctctgaactttttcatctcctccattattcaagtcagtaggcagaggacaatagccaaaaccatgaagccacatatctaggaccttggccaggtgcataaaagtgagcatacggtgtgcaattaatcatggagagtttttccagagttctatacagtactactacaactaccaa

SEQ ID NO: 4969 - DNA, 201 bp, Bos taurus
ttaaaataaataaacttaaattttaaaaaaactaaaaaaaaaaaaaaagatttcagtcctaaggaaaaaaagaaattcttatctagatgataagaattgaagatccagtctggtggaggccctgccgtctagatattgctgctggctgcagcaagagtagaaagtgcatggagcgccacactgctttcccaggctttggac

SEQ ID NO: 4970 - DNA, 201 bp, Bos taurus
ctccccagcttacaataccagcaaggaaccaagtgcctttataatcttcaccaaccagaggtccaccagagtcaccctagagagaaaaggatatatataacgactacaatttaagtatgaatattgcttatttttttctcctgtagtaaagacagaagaaacagaaggaaaatagctaaatatttcaatattaaaatgatt

SEQ ID NO: 4971 - DNA, 201 bp, Bos taurus
caaagtaatgcttatttgaactctgatgtgtagcactgatttaaaacagagctgtttctaggatgcagagggcatacagaactctcattcagttcagtccttcagttgtgtctgactctttgtgaccccatgaatcgcagaacgccaggcctccctgtcgatcaccacctcccggagttcactcagattcatgtccatcaa

SEQ ID NO: 4972 - DNA, 201 bp, Bos taurus
tttatacatatgtggagctgggtgctggtagttgttaggagagcaaatcttttgacttcatagggtgtctacccctaccagagggccacgactgtccccagtttttggcatcactttggagatttcaataggaagttcactctaaagctgaagctccagtactttggccacctgatgtgaagagctgattcattggaaagg

SEQ ID NO: 4973 - DNA, 201 bp, Bos taurus
tctaggttcatataccattaaagattaactcttgtatcatacgttacacgttcactaatagattttaattctaagtcaattttactctgtaattatttacatatgtgacaaatattgcattctaaatgatcatcttcttgttttccactgtatagcattagatttctatcactttcataatatttgtgcatttttaataac

SEQ ID NO: 4974 - DNA, 201 bp, Bos taurus
atattgttttaaatatcacaactttgaagtataatttgaaattgggaggtgtaatgcttttgcttttgttagtgtggatattttagcaatattaattcttgtgatctgtgaaaacaggatattttcccattcatttgtgttttcttctgtttccttcaacaaagttttgcagttgtaatatgccaatgtttcacttcattg

SEQ ID NO: 4975 - DNA, 201 bp, Bos taurus
gtgaccagaagcgggcccaggactgtgatgaggtaggtgctagactggtcgtggagcccaagcagagcccagtgccaagagggctatgcgtctctgtggaaggagcagggtggaaggggccagagatggccctggacctgggggtgatgccctcccctccattcctggctgagccagccacccaggctgaagcggaaaaca

SEQ ID NO: 4976 - DNA, 201 bp, Bos taurus
agaaatcttcacctgaaatttcctttgacttcttaaagtgaatttgaaattgaatgtatcattgtcatctcaaaaattttttttcaatcaattctttcctagttcagtaaagtctactgctctccaagaagccctgtctggttccatgtcttctatcaacacttagcttttatgaaagcatctttatcactcaaatgatca

SEQ ID NO: 4977 - DNA, 201 bp, Bos taurus
aaaataagactcttgtttatttctttgacttccattaacctttgcaggatccatgtgagtgtcaatgttggcttgaacagtgttgttttcctggcaaccacgtcacctagtatgtcattattacctcatgtcagaatgttctcactatctgggaaatttcactgggtaaatgctttgaactaaacacatctgtaatagctg

SEQ ID NO: 4978 - DNA, 201 bp, Bos taurus
tctctggaggttaattatatgacctagaaataatatagtatccttcgcattgataaaagccaatgttagaccacattaacctgaacaaaacaattcactcccaagcccattacagaattaaaataatgaaatattgtaccaaaggatatgatgtaccaaaagatattaaggatatgccttaatcatagaaaaatgaatatt

SEQ ID NO: 4979 - DNA, 201 bp, Bos taurus
tttcattaaattatcgtgtttaagtgtttagtcaatttatttgttaaatttctgaccatgtgctctcctttttcccacaggttttcaggaaggcatccaaaatgacagtgtctttggcttttctcttatgtcttctcaggaggacttctagttttcctaagaatggctctgtgtgccctacaggttcatcatattacttgt

SEQ ID NO: 4980 - DNA, 201 bp, Bos taurus
tttccaggcaagagtactggagtggggtgccattgccttctccggtttccatcttacttgtctttattcctgttacagtggcccagccaaagatcaaatcctctatttgtgctctagatacaaaacaccctgccttcccagcacctttactcctttatttcttcaccaagtcacagctaaagtcttcaaaaggccaagtta

SEQ ID NO: 4981 - DNA, 201 bp, Bos taurus
aagtcactatttatatcccataaacttttataatctaatccttagaaaataaaaagcacttcacaacaaaggccaattagtttctacaactgtgaagttattgaggtgtaatttccgctatagatgaagacactaaaatttaatcactcatctctgatcaccctctgagctctgagttttataaagactgcagttttcttt

SEQ ID NO: 4982 - DNA, 201 bp, Bos taurus
ggcctcttatctattacagctacattaagaactttgctcaagcaactcctggaatataggtttcatgagttgggactttggatattttaattactgttgaatttccagggcctagaactgggtctgggtacatagtaggagcttagtaaatatttactgcataagtggcaaagttgatgaagatccatgtcaagaatcctt

SEQ ID NO: 4983 - DNA, 201 bp, Bos taurus
gtcaatctctcccatggccttatttctctttcctcagaaaagagtatacattgtctatcaatactttccctacctcacaatgtgtaattgtctatttctcgcaacttttcccacctcagtggtgcagttaaaatgataaactatttcaaacattcagaaaactacattgaaataaaaaactttcaaatatttgggaattta

SEQ ID NO: 4984 - DNA, 201 bp, Bos taurus
gttcttgacatgttaggaggagtcagtgaagcaggagtaggggggtttctgttctttgaggtttgcagacgcaggagagcgctgctgcccagctggtgggtttgacggcaggggccacgtttgctaccacacaggctcatcttagcatgcagggctgagtttccatcgcacatcaattgctctttaaaaacagtcatttct

SEQ ID NO: 4985 - DNA, 201 bp, Bos taurus
ggcaattatacagtttacagtaaagaagtgagatttaggaatggaacgctggggtgtgtttaagacggtgtttgtccggactactgaggaacacccaaacttgttctcaatccaacactcctgagaagatcaggatgagaaatgtgtacatagataatcaaaggtcaggtaactcttacagactgagacttcggctgcaaa

SEQ ID NO: 4986 - DNA, 201 bp, Bos taurus
actaaagaatttgacttacaaggtatgaaaggcttgggttatgtataaaggactttcagattatcaggcaggttagaagaatgaaatgatggacaaagagtatgatacacatttgctaccttggatggtttggttattggcttcctaaaacacagatgatcacctacttaaaacccctttgctttaactcaaattatttgt

SEQ ID NO: 4987 - DNA, 201 bp, Bos taurus
agctggcacgtatacttgtctcttggtcaatgtccggtgctatttttattcttttcaggtattcttattgttctgctaggccatttgccaccatcactcaggttggtggagagaagaaattggtagccgctgcttctgaccacctactgggtcctctgtgtgtttggccaccctagcttggctagcctgaacctttcctag

SEQ ID NO: 4988 - DNA, 201 bp, Bos taurus
gatcaagatgtaggatatatatattagaatatataaaacatcctttcctgcctctgcatgctaataagcctaataccaagctcttagcttcaggttggggaaaaaaaaaaaaaaaatcagagggtttgtctctaagataacaaatttcctgaggaaaacttcaaaacttctatttaaaaagatctccttatctgacattaa

SEQ ID NO: 4989 - DNA, 201 bp, Bos taurus
gcagttttctacatcatgtccaaagttgtttccatggatgtcttctcaccccgcttgagtgctgacatcccatcctggcctgccttcctgtgtggacacttatctcactctgatcttactgtttattgctctgggctcccgtggctctcctgtgctgaggtggacacccaccacgctaggccacacctgtttgtctgggac

SEQ ID NO: 4990 - DNA, 201 bp, Bos taurus
ggcacagagcacagtcttgattgcagggtactcttaaaacccaaccatcttgcttttctcaactcccatgagaaattccaataccctgataagtcccttctttaagcttattcaagcaatatttatttgcaattaaaagcatcttaactaacatacttttagaccaatctttcctctgttgctgtcattatttatctgaaa

SEQ ID NO: 4991 - DNA, 201 bp, Bos taurus
caattcaagattcttgacttttgcaatggaaaaatttttttttctgtttttcagtctttgcattgattccgtttgatttcataatggagtggagtaaaaacagattttacccaccactgttaactgaatcctttgctgcattttaaaggtattaaaaaaaagtcaaattgattgtgatacctgatttgctttcccttgaga

SEQ ID NO: 4992 - DNA, 201 bp, Bos taurus
tatttcctaattttttgtataaataatttccctctgttatgtctttttaagatattactgctctaccaaatcaattcttaagcaaattcttcatttatcacggatatgatttattactttgctggtttcatttattccctaattttttatataaataatgtcccacttttatgtctttttaagatataactactctactaa

SEQ ID NO: 4993 - DNA, 201 bp, Bos taurus
tacattgtccattatttcctgagttcttggtgacattgtcctgcagatccagtggtgaacttcatagctggcagtgaggcaaacatagggcaagtctctagatttataggatgaatcatgtgcatttaatttttcctcaataacttcctaatggaattacaggaagaaggtagtaattgggaaaatatcaataagaaatga

SEQ ID NO: 4994 - DNA, 201 bp, Bos taurus
atgggtgaaaaagagaaatacagcctgttaaactgattatctctgtagtcaccaggttttcattaaggcttgggcatagtattaagatctattgtttaaagaaatgcaatctttcaaaatttctccacatagtccaatacatttctcttgcatattttgttttcaactctattactccatttcttttattttaatttattt

SEQ ID NO: 4995 - DNA, 201 bp, Bos taurus
agctttgctacctttctcaaccaggcgtcatctttccctgtgccagagggctgcatggagaaaatactccttaactgctttcatctgtgcttataatgagtgatatttttgaaacgaatctctaaatgacctcttcttttcctcactaccgatttgatatgggttgtttttcaatcctcgctgtgagcttagtcaggcaac

SEQ ID NO: 4996 - DNA, 201 bp, Bos taurus
attgttccagtttagcatataaagataactatgtatgtaggggaattataggctcatactacccaggagaaatttgagtaattttacaaagtgaaggaaaatatgatctctttattaataaacatgattgaattgctcaactgctgatttttccatgtgtaattggcaaagtgcaaaaaggagaacctcccatcttattaa

SEQ ID NO: 4997 - DNA, 201 bp, Bos taurus
gaacttatcatacctatgcttttttttttaattcagaaaatttaaatgcatctttctcatttttccaactctaatttttcttgaggttcagtccaagtaaccattttttaaggctttaaggaactcttttctcagcaaactcagactattttgcacataggaaaagaagtgaaattcaaaacactgggtttcatctttcct

SEQ ID NO: 4998 - DNA, 201 bp, Bos taurus
cactggaagggaatacaatcctgaggttgtatttcacttcccaaggtgccccctacattaggcataaacttcagaaactggaaatagacccagataacacaacctacatcttacttaattgaggttgcttaccaggtattcaataaccaagatgtagagggaaaaaaggtagaagataaaaaggctcagcagcaagcccac

SEQ ID NO: 4999 - DNA, 201 bp, Bos taurus
gtcattttaagatttattaaagaagttgagtaatctccaagcaaaccaatatgttatttgttgcacaagaatagtgactaagttttctctttgcttcaacagcaaagaaaacctgaaaataagctctgaatgtctatgctaataacttagcaatatgactttgtatcttcaatatcatcaaggtaagctttacagcagttt

SEQ ID NO: 5000 - DNA, 201 bp, Bos taurus
atcccattgctgattttaaacacatgaataattgagacctactcccctagaatggtagtgggatctcacatgtatttcttgggttcacatttacctggtcacttcacaatggcaaataatactgctttttcccatttatactctcttctgcaaggccagatattttcaagtcccactgaacatcaaatttagaagtaaata

SEQ ID NO: 5001 - DNA, 201 bp, Bos taurus
atgaagaagcaatagtaccagggtggtaagcggccttgaacaaatctctctacagatggccttgtgtcacagggtggttgagtcattgggaagattttcacgtttgaacttttctagcacccttttagtttactcccctacactgcatgcaaaagattatgaatgggaatcagtggtgattggggcttggatttggatagg

SEQ ID NO: 5002 - DNA, 201 bp, Bos taurus
agggcatgcaagtgcacaggtggagttgctggctgatgatgggcacagtgatgctgaccagagacagaagatagggcttgattcaggccccagaacagctcggggaccctagctgttgacatggtctctcatggctctacagtctctcccaaggcaggcacatggcagtggaatctggtgataggtgtcaggccagtggtg

SEQ ID NO: 5003 - DNA, 201 bp, Bos taurus
tgagaattcccttgtttcccatctggtagagattttttgtttggcatttggggcagaggatatttaggatctacaggccacacattccttgtacctgtgcctttaaaacaccttaaattgtttcactttacttcagttcagtcatgtccaactctttgcaactgcacgaattacagcacaccaggcctccctgtccatcag

SEQ ID NO: 5004 - DNA, 201 bp, Bos taurus
caaaaaatcaaaatacgaaaagccaaagcggtattgtaacagattcattaaagactttaaaaatggtccacatcaaaacaatctaaagagaaataaaacatattcttcacctatgagcatcttgcctttctaatgaacctatctttagagtttaagacaggagccaaatctcaaatttcaggtcattaaaatgcacagtgc

SEQ ID NO: 5005 - DNA, 201 bp, Bos taurus
actgctgctcttctcctggaaaatatgaacacaaagaccccatctgaaatctagagcacccctctaaactggagcaggtgtgttaaaaatatcaccacaatactgagtcttagtatgggatgacagtctcaggagctggaatttggggtgggaactgacttctttgaaacaatgatttctggattctcattttgagctctc

SEQ ID NO: 5006 - DNA, 201 bp, Bos taurus
tcctcctcgcaagttaacacatctccacagaaggtagaaacgaatgttctcttttttccccctacagccacgaaatgcacgtttctctgaaggagacacagtggggaagaaaaagtcctgttttcccagacttggcagctggcaggaagaaaaagaaattcttcaaccctccaggctgccttgccgcagttccgtgtttcc

SEQ ID NO: 5007 - DNA, 201 bp, Bos taurus
acaaagacactggagaagcctgcagtgtaccttcaggtttgtttcctgacagcagagggtgccacaatgtttctggtgataggaatgttttgtgctgaatgatttttcttctacctggtacttaaaataagagctttctcaggatactgacattgaggccttttattatctattatataatagtgacacaaaccaacatca

SEQ ID NO: 5008 - DNA, 201 bp, Bos taurus
atgaacatgaaattaaagaacatgaaattaatgaacatgaaattaatttagcaattcagctgaccctcagagagattatcccagtgggcccaaggaatcacatgtgcccttaaaagcggaagaatgtcagagaggtgaggcagatgagttaagagtgagtcaaaggagtaagaaagtttcaaccacagttgctggctttga

SEQ ID NO: 5009 - DNA, 201 bp, Bos taurus
caatgtgcttcagtcagtttcttgcaagaaaactttaaaaaacctctcacttaggtctcatgagatactgaatgatcatgggattttgggatcacttcagttgagttaccaagtgaacggaagggccataaaatcttcagactaaaaaagtaaggttatcttcagtattttatggctcatgcagctatgaatgcattctat

SEQ ID NO: 5010 - DNA, 201 bp, Bos taurus
cagaaaaaatggtcttaaagtcatcactcggtttcctttgccacattaattcaatgaagcaataatgacagagaatcagaaacgcgctgatgtgtatcaatagaagattaaataattatggtacagacaaaaaaatatcaacagctaacaaagatacattagatgaaaaaaaaaggcctagctttgaatcagctacttcca

SEQ ID NO: 5011 - DNA, 201 bp, Bos taurus
accttcagctagaccccaaaggacatacttttcaaaattgaacctaattccatttttgtttactcagacatcagtcagtgatttgatagaatgcccttgtttatacaatgtcagtatgtttggtgcctacaaatggtattcccataataaattttattttcagtttacctggataacatgaagatatactgtggacacaat

SEQ ID NO: 5012 - DNA, 201 bp, Bos taurus
atcagttacccatcgggaaacccagtggccatggatagagatatgtgtaagacctccacactgtaaacaatattgatatccctcttcaccttgttgttcccggcccttacaccttatcagctcccattcctactgaaagcaagcttttcactgtgagtgatttttgttatcctttgttgttcagtcgctgctgtgtctgac

SEQ ID NO: 5013 - DNA, 201 bp, Bos taurus
tctcacactgtacggactatacctgcccattctttatgaactgtacatccaaagtcaagttgcgtaagaaacttccaaaaacataatccagattccggccgtggtaaatgtggcctttggagtcctgagccacaatactggtgcagaatctgggaaaagggaaaagtttaacatgagtgaacaacaaaaacaagaaaaagg

SEQ ID NO: 5014 - DNA, 201 bp, Bos taurus
tttttctctttttcaagagtgcatctcgtagcgccagctggaagataaaggaaaaatgatgtaaacatgatctagagaagaagaccactggaccagtgttcaaagtgaacctgtaaatatcctcagaaagtttcacagtccccaaaagaaaataaatggaatattaagtaaaagattatgaagaataaacctaaatataaa

SEQ ID NO: 5015 - DNA, 201 bp, Bos taurus
ttgcctggagaattccatggacagaggagcctggaaggctacagtccatggggttgcgatgagttggacacgaccgagcgaccaacactttgctactgtcggcatcttgatttctttgcctgtggactttcttttgcctcctcctttggttaatgactctaagagcaactctcaacccatgactgagtgaagatctcagct

SEQ ID NO: 5016 - DNA, 201 bp, Bos taurus
tctaaaggctgatccatccattattaaagagacttggcctctgagcatcagattactgcttttcttgtaaaacagcttagtggcaacaaaatccatttcatctgtagacactgggttattttttttctttttaactgagcctttctattttgttttgtttcttgcttaaagatgagctgtaaataagtccatggaactttt

SEQ ID NO: 5017 - DNA, 201 bp, Bos taurus
tgaagctataagctgagatgttcaagggtgaaggacattacaaggccatcagattttgctttacctgctttaccggagcccaaacctggtcattggaagagatccctgcactgaatggcctggatcaactgacacttttgggtaacagcgctttggtcactgtagatgaaaataaaggagtatcattttttaaaaaagaaa

SEQ ID NO: 5018 - DNA, 201 bp, Bos taurus
aaatgtctaaacacagacagctttgggaggaaggcacaacacttgcctaatctaccaaagccaaacgcctggctcttgagcgagttccttcatcaggtccatctggtccagccatactagaccccgtgtccacccccgtgtcccaccattttcctccttgctgtagattcctttcgatttatcaattcaccctaatgaagc

SEQ ID NO: 5019 - DNA, 201 bp, Bos taurus
attcagtgtttcctttctccatgtggcctctacagaggttgatgttagtttaagaagaaggatagggctttagaagctgatgcaacctcacagtcacttactccactggccaatgagagatttgataaaggagaaacaactatgaaggcagaaattctgccccaaatgatgaacctatgttttctaggatgattccaaact

SEQ ID NO: 5020 - DNA, 201 bp, Bos taurus
ccatgcagacccacagcctcatccacgagccagccattgggactgcaggtttagaaaagaatgtcagttctggtcctcaaaagacctcagaagacatcagaacagagacgctagccaaggaaattatccaccaagacaaatctctggcagacattttggacccagactccagaatgaagacaactatggacctgatggaag

SEQ ID NO: 5021 - DNA, 201 bp, Bos taurus
caactctctggatttctatgtctgcatctctgtgtgttgtgggcattacaattacatcattttgtgtaaatcactcagtacagtgctagatagctaattattaccaagtgtagatttattgtgaagctagtgacatgtagttttgggctcctcattgcccatactctttctgagatctcaggaggggccatagcagagtgt

SEQ ID NO: 5022 - DNA, 201 bp, Bos taurus
gagtttctgactttgaaggaagctataaatatctaaaatggaaaagtaaagtaccaggtagataaaagatcccgctcttaccctgacaatgactgaaatataacaaagaaattaaaagaaaacgtgccaagtacttaaccttaagacaaaagatttcacagtcaagaagctaaaaatacggctaaaaagtcatcataattt

SEQ ID NO: 5023 - DNA, 201 bp, Bos taurus
tttatattatgatatatttagtgaatgtaaaagttcacatagtaaaagaatcttacactgtcacactcctttttatttcaagggtggtaagcaattcgtgggagaaaggtagaaattttcacagttattgaagtcataaattttttattatttggggacataaatgtttaatgcttgaggaactctttggcccgtatgtca

SEQ ID NO: 5024 - DNA, 201 bp, Bos taurus
agattttgcacagcaaaggaaaccataaacaaaccaaaagacaacctacaaactgggagaaaacatttgcaaacaatgtaaccaacaagaacttaattttcagaatatacagacagttcatatagtttaatatccaaaaagggggggctgggtggcagaagacctaaatagacatttctgcaaagaagacatataaatgac

SEQ ID NO: 5025 - DNA, 201 bp, Bos taurus
aacttgccccaactcacacagctagaaagtgataatactgggattcaaatctaagaagttttgttccagagcaccactgcttaagcaaaattgctctattgtttctctttaatgagaatgtcattaagtcttaaatattcagaggcttggagttcccatttcagagggtgcatttttgtggtttttacaagtctcaagcta

SEQ ID NO: 5026 - DNA, 201 bp, Bos taurus
ttgagactaagtttggatggggtgccaagccccttacactcatctcaaccaaaacatttctgctttgtctgcttatatattgcagttccacaaaagacttgtttataaaattctaaaggtgggaaaaatactagattagaatgaggtccattacagctctcaatttgataagcttctcacttaatttatttggagatgata

SEQ ID NO: 5027 - DNA, 201 bp, Bos taurus
tttaaatggcaattcaattcttagcttgaaaaaaaacattttttttgcctcatctgcataagtagatgcattgtaggatacattaaaagtctatcagcactcaacaaagctttctgttaaacacacaaaacaaaaatcatttctgttgtagtgaagatgattggtttcttttagccactactttcccaggcatcctttggt

SEQ ID NO: 5028 - DNA, 201 bp, Bos taurus
ttcaggctttaaagtggctttaaaaattatggcatttcaagataccttaaatctaaaggaaatttaaaattttggcctgatctcctttctttggctatggtttgttatttatgtagtgcctgactcttatacctagacccttggctgtaggagctggggcctcctgctgttaaatgttctaatactgtacattagtatgga

SEQ ID NO: 5029 - DNA, 201 bp, Bos taurus
tgggccccatgctggaataaagtgattcgaagagactggagacaagtgcagattcctgcactggacatagaaattgggaggggtcagagtggcagctctcgtcagagttcctgaggacaaatgttaagtcagtgatagaaagtgaatcgtgaacttccagatgttcaagctggtttagaaaaggcaatggaaccagagatc

SEQ ID NO: 5030 - DNA, 201 bp, Bos taurus
ccttaaaaaatgtggctttgttcttttgcacggcagcccaacagaatgctatttgctgtattaagagttgtctgttggctctcactgcatattttggtatgtcttggaaaagactctcattccccaaatgctgtttctacagagatctcatccttgatcattcactctttgaattgcatggatgaccatcttcccaccttt

SEQ ID NO: 5031 - DNA, 201 bp, Bos taurus
tgagacatttcttttacccttaacagctacagataggtctaattaccagtcatttaagctaattgttacagaatgaaactgagccttcaggatacacacagaggagccgccaaactctagttgcaggtgttccaaaaatgtctagccaaacatctggaaaattcagtaagatgataggattgttattgcttgtcaatatat

SEQ ID NO: 5032 - DNA, 201 bp, Bos taurus
tgtcatattttttatagattcatccagtaataaaagtaacctagtacagagaaaacagttgtcattttaattccagtgattcaggtgtttaaaattaatccctaatagagagtaatgcattaatctagctgatcatatgtaattggattaaaataaccacaggcatgactggaagtttccatgaaaaattaaggttatttg

SEQ ID NO: 5033 - DNA, 201 bp, Bos taurus
agcatagactttagcagagactaagctctcagtatagctattgttgtgttactgtcatcatgcgagatgagagacaaatcaagcattaaaagatacctatattttatagatacaaagatagatattactgttagtttatgcagatgcttgcaaggattagcatttgaaatgaagttcttggaaacccccgttttgcatcat

SEQ ID NO: 5034 - DNA, 201 bp, Bos taurus
ttctgagtaacatggagagccgttgcagggtgttgagcagaggcctaatggcctttttaaaggcatcgcctggtggctgtgtggaagtagactcttgaggagagagagagagagcaggtgggaggccatggtgggaggccaggtgtgggatctagatccccgcagggtggtggcaatgtcatgaggagaagtgattggatt

SEQ ID NO: 5035 - DNA, 201 bp, Bos taurus
aggtgggtgattagaatgggccagagctgctttataaccagatccatcatggaagaagcacagctttgaaggcaaacacggacatcactgcatctgagcacggctctgagagatgctgaaggatggccgggccccagaagctggctcattcctcatcttgtctgtagagatctgcctcctcgaactcatggaaggtcaccc

SEQ ID NO: 5036 - DNA, 201 bp, Bos taurus
catggaaacttggaggaaagtggcagaaaatgagttctcatttagattttgcaatatctcagactagggttttgaagaaacataatgagagcaggtgagggagactatggagaatatcctactagattcaaccccatgaaattgctaattttataagtcaaaacagtccaggagcagtggtttacacctctcaacctaata

SEQ ID NO: 5037 - DNA, 201 bp, Bos taurus
gtccaactttggctttttgacctgaggagtcaaattctctattttgttgtcattgagagttagtggccccatcattaaccccattgcctaggccccaaaactagaactatccttgatccctcacttcctctcacacttcaaagctaccattttttttttttccccagagaagctcagctctcttcttaattaaggctcttt

SEQ ID NO: 5038 - DNA, 201 bp, Bos taurus
cctcctctactctggtgtgcagcaggcagagccctttcctcctctctgcttagcttattttaggttgtggtacttcatatcagcattgagagaaggtacacgtgtattcttatcactggttctgaggagtttgggtacatttgttttaatatgtgtagactgtgcagtaaacattttctttttttttaagcaaaattactt

SEQ ID NO: 5039 - DNA, 201 bp, Bos taurus
gagattaccatgtggccacagctgacccaaaggtggatcagtggcccatgagatgtaacacaaatgtccatgcaagtgtcatggtaattagctttcttcagtcagtttctttcttgggaatttggcctggagatgtgggaagagtgcttccagcccagtatttgaaacagaagtaggaagatgcccagagatcatcagagg

SEQ ID NO: 5040 - DNA, 201 bp, Bos taurus
catgacatgttctgccctctccctcttccaagactttcttttttctgtttctcagtattgcacttgttctttaggattcagttcagatacctttctgtgcatgtgtgtgtgtgtgtgtgtgagaaagagaaacttccctggctttctcagacagtttcctactttttactcctacttcacatgcctatactataattttta

SEQ ID NO: 5041 - DNA, 201 bp, Bos taurus
ccttggagaatacaaccattctggttaccatggtaattgtatatgggacccctattctattttctatgactggtcatttatttggattgttatgtttttaaattttttcaatgtattcagtacatactgtgtccttttaaaaatttcatatttggaaatatttttgaacttatacaaaagttgcaagaaaagcacaagctc

SEQ ID NO: 5042 - DNA, 201 bp, Bos taurus
gctccaatggcagacattgggatgcagatcaacttgtccatgttctgttagaactgcagggagccctactgaactggcctccccaggctcacttggaaggtggtggaaagctactgcctatcaaactctggatgaaaagctgtggaagagagcctgaaatgggccataaatttggagctgaggtgataatattggtgattg

SEQ ID NO: 5043 - DNA, 201 bp, Bos taurus
ccactgaagagtattcgttgtagtggccaggtagacaagatgacttgtgctatagtggtgggtcggcttctttccccagctgttctactgtttgtataataggcccatgggagttttgcctcctgttcctgaaactttgagctatgcttctttgtaaatcttaatcaccatgatatcagaggtagaggttgtgcaagggct

SEQ ID NO: 5044 - DNA, 201 bp, Bos taurus
actctctctcaaatagacagatagatattgcttctatggcctttatgtttgtgttccaccaaaaaattcatatgttgaaatcctaatgcccaatgtgctgatattaggaggcagggcctatgggaccttatattgctgttgttcagttgctcattcgtgtctgactctttgcaactccatggactgccgcatgccaggctt

SEQ ID NO: 5045 - DNA, 201 bp, Bos taurus
tacttttctttttcaaggatgctaattatcttctcttttgaagttatagcctaataaccagttaattttgttctaaaatttcaggaatgtgttgttcttggaatagtcttgggtttgtgcaaagcacaggtggataaagtgtagacctcatgctgctgctgcttctgttactgcactttaaacagaaatactaaatacagc

SEQ ID NO: 5046 - DNA, 201 bp, Bos taurus
agcagcagcagcagcagcagggattcatatgaatgaaacacatgatatacactcttttgtgtttgcattattgcattttgcttgtttttgagattcatccatgttgttgtgtatattattagttcattcttttgtattgcttagcaatgttccattatgttatatatatacaccacaatttgtttatccactcacctatta

SEQ ID NO: 5047 - DNA, 201 bp, Bos taurus
aatttgctaagttttggcccaattagcactgaatatattgtgtgctgccagtacatatttattaaataaaaacaatgaacaacacatgtcaaagtgcttcagaaaattataaagtaataagtacacattattaatgtcttcaggtgatttgcctggttatcattaaacacgctgaaaaaatcattgtctgatgtcatattg

SEQ ID NO: 5048 - DNA, 201 bp, Bos taurus
caatagttggatataaattgattctatttccttgcatgttccttagatgaaaggaactttcactccctgtcttcatgtatttatgatttaattgattatctttttatctttgaaattaaaatccttggttataaagacatggctgtagtggagagccctgacaaaagaggtatacattggagggtaggagtgggagaagag

SEQ ID NO: 5049 - DNA, 201 bp, Bos taurus
tgttttcctgagctgtctagtctgaagtttatcaatattcttggtcttcttagagaaccagttatttgtttcattgattttcttattaattttgtattgtttatgcctttgatgtctgccctttatgattttgtttctcctgcgtactttgggtttattttgtgtgtgtgtgggtttcttcttaagatgagagtgtaggtc

SEQ ID NO: 5050 - DNA, 201 bp, Bos taurus
tcactctgacaaaaatcactgtctgaagtataaatatagatatgaagcgaaacttgatgtagccaaaaatttggcataatttcttacccagaataaaaaataaaatttgaaggagtatttgaaaaatcctcaacttattgtaaaatcaatttagcccatttgtctgaagttattgttattgctaagtaagaatagactgca

SEQ ID NO: 5051 - DNA, 201 bp, Bos taurus
aaaaaataagcaaaatttttaggttctatatgataaatacttaaattgcaaaataatggctaccattctccactttgtcgtgtatccatgtccctttgcagtgatactttgcatctgctcccatcaagagaagtcactctgcctgcctctgaaactgagctgctttgtgacctgctttgggcaacatgtggtgatggtggt

SEQ ID NO: 5052 - DNA, 201 bp, Bos taurus
cttactcacttttacaagttcatttcgatattccaaaacaataaacaaaatctatgtgattttaaaaggaacaaatggcccatgtaaaacttagaaaagtatgctttaaattcttctattcaatctcagtattctgaagtaggcttgcaatgataacagatttctaaatggttcaatttagtgaaataattgaatttttta

SEQ ID NO: 5053 - DNA, 201 bp, Bos taurus
cttaaaattcttcctaagatgaacatctcataattccatctttaaagagctgtaaaatattaagaaccatacaactcaactctcctttttctttccttcaagtactctctttgagatattttatgcctgaaattaaagaggttgagatatatgaaaggtggagacagtggtaaacaggatgtgtttcctttgtacaacaca

SEQ ID NO: 5054 - DNA, 201 bp, Bos taurus
ctttattttgggtgccagacatcagggggaagggcaaactcctatccaaagaccgaatcctcctccctaacaagtagacaatgggttttataggcagagaaagggggttacatgggaaaacagcatagtcagctctgatagtcatcttgaaattggtcattggctttatcagcatcaccttgactgttttaaatagttaat

SEQ ID NO: 5055 - DNA, 201 bp, Bos taurus
cattcacagacacggcagcttggatttttctgatttctagcccttacagccaatctgttcccccagggagagaccctggcattctgccatgagatgaaaaatacccatatagctgtagccaagtcttaggccttggcctcccctcaccaccaaagcagagatggaaaacagagatttcaaatgaaagtgattgagccattg

SEQ ID NO: 5056 - DNA, 201 bp, Bos taurus
tacttttaatgttaaatagaaatctgcagtaatttgcaataaggtcagaggagtagttttttaaaaaactaaaggctgaaagagggcatacagcaatactgtatcatcaccacttaaaattaacagaggctatagattactccttcattatggtaagttttgtggttttgtttttctctacagcagacaaagatgattctc

SEQ ID NO: 5057 - DNA, 201 bp, Bos taurus
ctttttcttagaaagaaacaccaaaagccatattgttttcaatcaaaaacaaaaagagaattaatggcttgacctcaatttcacacctgcattaacaatttaaaaagaacaatttggcaatcttctataagtagaagagcctatcactggcctgattcaattatagttaaaccaaggccaagtcaataaaaataaaagcat

SEQ ID NO: 5058 - DNA, 201 bp, Bos taurus
tcaggcccgctgggctgtggtcacctgaaaccagggatgcagagatgggacccaaaacaaatacccagaatgctcttcctcagagaccactggactagccacctcctggcagtcaaggccagcctcagctccaccatctcgggagattcccaccatcaggaaaaacagcccctccctctcctctcccctccccctcacttg

SEQ ID NO: 5059 - DNA, 201 bp, Bos taurus
acaggacaaaaaaaggtagagagtaacttaaaattgactgtagaaaactctttaactcccaaaattcatagcaatcatcatcacctggccacagctaaagctcctgtggtttggtttagttgctcggttgtgtctgaatctttgtgaccccacagtctatggcccaccaggctcctctgttcatgggatttcccaggtaag

SEQ ID NO: 5060 - DNA, 201 bp, Bos taurus
caatcctcagaaagcctcgatcccatctttagttagagccactttcagacctgccctggaccatcgtctttcctacactgggacacactgacattcactacagacagttattgtcaacactaccgacaatctctactgtcttcattacatgactgctggcaacttatttagcacttgaatcacttttataggcaccaaatg

SEQ ID NO: 5061 - DNA, 201 bp, Bos taurus
cctaaaaccagaagagaaaaatctgcccacagatgaataaatgtacaacgctaagactcagtgtctaagagaggacttccctgttgtcctaggattatagttctaggcagcatgctatgttctttgagcaccagaggaaacattcataatgacttggacccattgcttttcaatttgcacaagaacaaaagtataaatttt

SEQ ID NO: 5062 - DNA, 201 bp, Bos taurus
accaaaggaaatggaagcaggtgttgaaagactgctgaaagtgaaccaacctggattaatatcctacaaatctctgttcctaactgatcaatcccaatagccaatcatgctcaggtctcaattttcacctctatgtatcaaaagtgagcagtgctccatgaccaaccccaaggaccatgtggaatagaagaaccatctcta

SEQ ID NO: 5063 - DNA, 201 bp, Bos taurus
aatatttgtagtatattgtattcatgatatgatatgaaggatttgttttgaaagggtgcatattttaaattttctacctctgggattatcttttctacatgttttgagattcctcattctcatatatatccagtttaacatttgaacatgtctgttgcctatataaccatttggatatagagtgttcaaaaatcactagat

SEQ ID NO: 5064 - DNA, 201 bp, Bos taurus
gctgctggctttttgcaacttgctggctctagggcacgtgagcttcagcagttgtggcacaagggctcattagttgttgcttgtttggccatagagcatggaggcatcagaagttgctcccctgcacatggaatcttcccaaaccagaagtcaaacctatgtcccctgcattggcaggcagattcttaccaccgggccagc

SEQ ID NO: 5065 - DNA, 201 bp, Bos taurus
ctccctcacttcttctctcacaagatatccattagataacattcacttatttggaatgtttctaagtcacaagtttggatattgaagctacaacatccactattgtctgctcttttggggggagggtgcggggggagggagcagaggtgggaagggcaatgaagcccaggtggggagagaatcaagattctgggaatggaa

SEQ ID NO: 5066 - DNA, 201 bp, Bos taurus
tagtactcaatgtgccatcagaagcagttccacttaataacctgtactgaacataaggtttaaataccattgtttaaaaaaaaaaaatcaaatactatactacgacaatggccttgaactacattaagcagtttgaatctaactaaacaaaaatatcataagctacaatcattctcaaaactattaagaatactatgaaaa

SEQ ID NO: 5067 - DNA, 201 bp, Bos taurus
attacctttactgagttgatgaggaaatggaggctctgagactttaagtaaattgtgaaattcaaacccttctctggctcactccacaggccctgtttcttcctttgctctcagctaaaaagcctgctccttcagagcactgactgcattgtggcattgtccttggtttgttgtgatctccttgagagctggaaccctctc

SEQ ID NO: 5068 - DNA, 201 bp, Bos taurus
aaaatgacctaagaaaatagtgacaaacaggaaactgttctcaaacgtgctgagttcaagcttattttgaaaagcgctagggtggagttttgtcatggctgtaccctagataagataagaaaactcttattttttgattgatggttttcagccaaaggctatctccacagaacttggaacttccatcatatacacacacac

SEQ ID NO: 5069 - DNA, 201 bp, Bos taurus
caaaacggcggctgggagaaggaaggtgtatgcatccccatagcatcgagtggagtggtggcaggcctacagcgggctcctgtctggcccagtgggccctgcctgggctctggatgcagggtcttgtcctacttagcccaggacatcggcatctgctcacactgaatcctcctggcctccagcggcatttttgcattgacc

SEQ ID NO: 5070 - DNA, 201 bp, Bos taurus
ttggagcaatgtttctcaacagaagagcaagttacatttgggcaggacagctctctactgtgcagggctgtccaatgcatcaagagatgtttaatgtacccggcccttactctgtctacatcttagcattttgtatcttatcttgccttgatctcaatgccagtgggacgtgaacatgtgagtgattagtttgctaaccat

SEQ ID NO: 5071 - DNA, 201 bp, Bos taurus
tctgttactgaaatgggaaacactccttgactttatcccaaacagcggcatctttgtgctagccaatgagtttaactctgtattaggccaatctacagcaatgggattgtgggggcaagtggaggagggctgggtgagaatccagggtactgatctgtgtgtagtcacatagcaccagctcaggggcccataagaaatctg

SEQ ID NO: 5072 - DNA, 201 bp, Bos taurus
atatatggataatggcccttttaattcccattttccttatgatatcatcacgtactgtttgtcaaaatgttcttggaggaaaacaccagagctcagagatcaggccaattattgtggagactcttttgaaagaatattatgcttccctctgctcaagggtacatggcacatcgtaggacccagaggaatctacactaggtt

SEQ ID NO: 5073 - DNA, 201 bp, Bos taurus
gatcatcaagtggtgataagtgctttggaaacaaatgaattgaatgcccagaacctgtttgctgctcctctgcagattgggcaggtgagggccggacaagtgtccaacgagggggcaaagctggtaatttgttgttgctgctgcatgccctctgggtgagaagaaaatctgtccctgaatgcttagtgagttggcttggcc

SEQ ID NO: 5074 - DNA, 201 bp, Bos taurus
cctctgtaagggaaggtggaagtgggagacagcagtcagcaattaagagtcccaacctttttcttttttttaaatcttagaatcggccttataataatttcaaaaaaatcaagtgtctactttgaattaaggcctatgtggagaggaaaaaaaaaaaaaaaactgccccaagatgctgctcagggatgaagattttttaat

SEQ ID NO: 5075 - DNA, 201 bp, Bos taurus
actaaagctgggtgactttccctcatgttcctatggaagtacatatttccttattcttatcattagtggtctgtttctctcctgggacactggagcttgcgtttcattcatgttgtgtctccagcacccaggacagcgcctgatactgtattcaagaaatacatgttgaatgaaagaaagtagaaaagaggacacttctct

SEQ ID NO: 5076 - DNA, 201 bp, Bos taurus
ctcttgtggatgttggccatacttattcaattaccctggatatttacacagaaacttcatggtggacatagtagcttggtattatctccattccaactgcgttcccttgggccttcctaaaatgcagagtctggaaaactaaaaaaaaatattagaaacaaaccactgcattttccagattatcttgtagctgggctcctg

SEQ ID NO: 5077 - DNA, 201 bp, Bos taurus
tctgatgcagtgacttccttctagttctgtcaaatttaaagtacgcctaccatttttactttgcctatcattatcatcatgccaaaccaaaacgaaacatcattactgttgttaattgaaataacatacttcctaagtctgacagctattataaacctaaatgagcaaaaacattcgagaccttatggtgatcgatataaa

SEQ ID NO: 5078 - DNA, 201 bp, Bos taurus
cttggtactattttacagggccacttgagacaatttagcctgctagtgctctagtttcctgtatggtgttgtatcaaagaaaacaggcaacctcaccttccgagagatgtgccgaagggagtggcatagatttaaactccaaactcatagacaagttttatgattcctattctagtctgacacagccagaaatgatcctct

SEQ ID NO: 5079 - DNA, 201 bp, Bos taurus
tgggagctacaagatagcagggcccccaaaatgataagaataattaaattattattgacctccatgcccagacaatataaattattctggttcttaagaagggaggtttctaggcctgaaaagaaccctttagcatctttcagattgcatacaatcttttgttatggattatatggtttatttagagggcttcccttgtgg

SEQ ID NO: 5080 - DNA, 201 bp, Bos taurus
gaatcatgaacagaaagtatgtatgttgttcacttcatacattctgttcaggagaatcatgagcagaaagtgaatgtatgttgttcacttcatacattcaggggacaaaacaaatctgtcttccagtttcacgttgcctccattcacatggaataattgaggtacaatagagttgtatttgactcaaacacactttttttc

SEQ ID NO: 5081 - DNA, 201 bp, Bos taurus
cgtgaatttaaggtttcacaatgtacaatagcatatgaaagactgtgagaatctctggagttaaaaaaaaaaaaaactcttaatcacatttcccaactatgttgactctggaacatttaaaacaaacaaaattctattgctttctcacagaatacaatgtttcatgtaacagctttgaaaagtttcacaaaaagtataaat

SEQ ID NO: 5082 - DNA, 201 bp, Bos taurus
ttcttcaggggatcttcctgacctaggaattgaacccaggtctcctgtactgcaggaagattctttactgtctgagcccccagggaaaagccccagggaaggtagctaaggtatccacttagtgatattgccccctcgcttaccacatggatgggaaaccctaaaccctgctttggcgttcatcacgtggtgtcagaggga

SEQ ID NO: 5083 - DNA, 201 bp, Bos taurus
ttgtgtctttctgatagtaagtcttttcccttagcaacttcctcatattgtcaaactcatgctgaattctcaatgtacaaaaattagtcatggagagatcgtctagagattgaacttaaagccccgttcctttctacgaagagtcttggaccagttgatctaaatcagcgagaggtacttctctggagactcagtaaccca

SEQ ID NO: 5084 - DNA, 201 bp, Bos taurus
tcctaaattccaacaggaaaaaaaaatgtctaagaaaatgcatatcaaccagcccgagaccagacccttaaacaagtcaggcgaaggaaaaatgagtacacctactataatcagaaataagactcctaactttatggaccacttgaaggaaaatgatgttcatggccagaagtcatgataaatgttgaaagagatactttc

SEQ ID NO: 5085 - DNA, 201 bp, Bos taurus
gaagggaggatattattatggaatgattcatgaaactttcccaaaattaaaggatatgtattcccaggtccagggtactcagcataatgttcaaaaataagtccactccaaggcatgttatcatgaaattttagaacaggagggtcaatggtaggattttaaatgtttctataaaaaagaatcaaaacaaaaacaaaaaaa

SEQ ID NO: 5086 - DNA, 201 bp, Bos taurus
ttcttttagttagcattaggaaggataagagaatacaaatgcttttactcaattatctttatgtggaaatcttttatctactgtagataaatttagacatgcattaagagtagatctataaaaactggtaactcttgtttaaaaaaattagcacagaatcagttttaatatatattcaagtatctataaggaatatgacat

SEQ ID NO: 5087 - DNA, 201 bp, Bos taurus
aattccctggatccaccggggctggaccctggcaaattacagtattccatctttggccaacctggctcttatctcattttgatataatcctagtatagttcggtgacttttttgggatcacactagaatatctaatgcatatcttatgaatttcttgatctgaatctgtccctttccataaggatctctagtttcttttta

SEQ ID NO: 5088 - DNA, 201 bp, Bos taurus
gatatttctgatacattcagttcctctctaggctaaagaaacgtctttaattatgaagttcacgtttctacagagaaatttagctcttttattcccatcacttctggcattatcaggacctctgtctgctgcttttattgatacatgcattcttagttctgataaatatatttgtaattcctcttgctgctcattctattg

SEQ ID NO: 5089 - DNA, 201 bp, Bos taurus
ttccagaaataaaaagaatttaatataattggctttactcaagaccactctaatccataacctaatttttgcttaaatgggaattagcctcttgactgatatggtggggctccttacccaagtaagtgctctttttcctgtgtgcactagattgtacttcctagcttcttttgtgattggaagtaatcatatgaagagtta

SEQ ID NO: 5090 - DNA, 201 bp, Bos taurus
gtcagagtactgtgtaagtgactgactaagaaggattgatgtggcaaatatttgtaatcctcacttttgataggtatagagagtggacccatgaatttcccgtgatgcctttcatgtgatgtggttcttagagtgatgttctctgtatagggccctcggtttagctattgcctgcagtcatgacacctgtcagcagacact

SEQ ID NO: 5091 - DNA, 201 bp, Bos taurus
cttttcaaacctttccaagattttccttgggaagctacagtaaaatgttaaaaaaaaaaaaaaagattgtacttctctcctgaccaattcttcttggagaccctgatttcttagctgcctgtatttaatcatcagtataactactagctctttatttgtgaccttggtagtttactgttttaattaatgaagttttatgtg

SEQ ID NO: 5092 - DNA, 201 bp, Bos taurus
aatacttgatacctacatctattcctcagtggtacattgggtttccaggtccctctaatggtggaactttccttctacttccttgccaccctcaccatttgcatctattttaaaattccttggctttgtttcagttttccttgtcaagtaaagttcctttaactatgcaagttccaactctttgctgattttttgtagaag

SEQ ID NO: 5093 - DNA, 201 bp, Bos taurus
attctctatcacattcatgacactgtatattcactatatctttcctctctctcctttgagtctctattctctctgccatttctttttcttttgcaaggaaaatccgtatcttttctccagaaaagtactggctgtgtagaatccatgtattgaataaacttgtcctgtttgcctgtctgttttttttctagatgagttctt

SEQ ID NO: 5094 - DNA, 201 bp, Bos taurus
agaaccaagcagaaaaccaaaccatcttatttgctcttttacccattgcaaatactggcccatgcttccagatgctttctttatacacttaaactttaatacaagtttcttttcatctgttgttgttgttattcagttgctcagtcatgttcgactcttttgaccccatggactgcagcattccagtcttccctgtccttc

SEQ ID NO: 5095 - DNA, 201 bp, Bos taurus
atcagggagagtcttgattcattttcgtcataccataaaaccaattggatacatcgtcaaaaactctatgaataacaccttagactaacacaatgttacatgtcaagtatatctccataaaaataaactaaacaaatatgttttcagttacaaaattaatcaacatggatattaaaatgaattaatatggccctggtgaag

SEQ ID NO: 5096 - DNA, 201 bp, Bos taurus
tcgagaaagcccagaccactcccaatgggagcttacaggccagaaggacctcttccctgaaggggtctggtaccaaaatgggcacccacagcgtgcagaacggaaccgtgcgcatgggcatcttgaactctgataccctggggaaccccgggaatggccgcagcatgagctggctgcccaatggctacgtgaccctgaggg

SEQ ID NO: 5097 - DNA, 201 bp, Bos taurus
tgctcaggtgcacacacacagcaagagaaccagaagcatctgtggtcataaaatataacttatgtggtcagaagggacaagagggccatgcctagagaaacagatgggtcagagaaaggctggatcaagaacggtttcagttcagttcagttcagctgctcagttgtgtctgactctttgcgaccccatgaattgcagcac

SEQ ID NO: 5098 - DNA, 201 bp, Bos taurus
acatttgcataaacaataaatttcattcttttacaacatgttgtgggtgaataaatgacactgtaaatcccaaattaaacctgcagcaaattatagaagtgatttttatcattcttaagactgtctttccattagaaagggacataataattttattatactacatactctgtgaaagaccataaacttttaatagactta

SEQ ID NO: 5099 - DNA, 201 bp, Bos taurus
aatatcgtcctggatgcagatgcaatcatgggagatttgtaaggcaaaagcaaggatggtaatcttctatcacctctcagttggcaggcctggtctcaagaagacctgaaattttcttctgaagcagtgaaaattcatgccatgcaccagattcctgggtgaggggagcatttgaagcagaggcattactggtctccaggg

SEQ ID NO: 5100 - DNA, 201 bp, Bos taurus
agatttcttgaccaagtggacaccctaaagacaaattgagccaagaggtttatacctgagggaatcatctgagaaaacatcatgattatacaacgaagccgtaacaaactcactcctgactgtatagcctacacatcattgaaccctaatgggaatgttaaataaggatattaaatgactgtactaaaaaaagcttcatgt

SEQ ID NO: 5101 - DNA, 201 bp, Bos taurus
gaactgaactgaactcaaccagttgcaaatattccccacactgtagtgaataggagctttcgaaagcaaagtgataccaggcctgtcctctgacaaaatcctctcaatggtcttccacttctcctagaataaagcctgaattccctactatgacctacaagggcccacgggatcagctttgcccgtctccagccccatgct

SEQ ID NO: 5102 - DNA, 201 bp, Bos taurus
gatccctggtcagggaactagatcctataggccacaactaagagttcgcatgctgcaactaaagatcctgcatgtcgaaactaaaagatccttcatgttaaaaagaagactgacgatctgcctgcctcactaagacctggtatggccaaatatataaatcttaaaatcatttttttaaaaagatctcaatagcttttaaat

SEQ ID NO: 5103 - DNA, 201 bp, Bos taurus
gaaatgtttttaggcactcttcgggcagagggacctgcagagtaattgctgactcagtcactggaggtgaaaacagtttacttctgtcaactaaaagagaaagtacgtaacagacccagggaaaggagaaatacttttgcttcacagactacagaactgtgaacacagaaagagctagattctgggcaaagcaaaaatagg

SEQ ID NO: 5104 - DNA, 201 bp, Bos taurus
ttaatacagaatgacatctactgctttatttcatactgcagtataaatttaacccccaatttttagattcagtagatttggatagattcgtaagaaaggtcaggaagagaagacaaacatcactttctccttcagtattcaacttttagtattgaggttgtttgggtttttccataagatcataggggaaaacccaaaaga

SEQ ID NO: 5105 - DNA, 201 bp, Bos taurus
caggatgccggtgctgcctcatttgctacctgatatcacatttacgtgcaacagagaggagttgggtaatggcaaattcaagctttgggtagtgtgacttttcttggatagattaaaagtacatactgttaagcctaaggaaacaaatatttttctatttcctgaaggtttttccttatctggaggtcgtgacagccttca

SEQ ID NO: 5106 - DNA, 201 bp, Bos taurus
atgggtatactattttgcaatgggtttaaattattcaatggtttttagcttgaaaccaataaactctggaacgttgacactcaaaactgtgaaaaaatacatttgctctcccactgaaaaaaaaaaacaaacacataaaattatctagctagccagatggacatggaatatactataagatcagatcaatagacttggccc

SEQ ID NO: 5107 - DNA, 201 bp, Bos taurus
gattacatgatatactttatgctcatcacagatgtggctggagaattggtattgagctggtagcatcagcagaacagaaagtgagatgtattttatatatgtcaataaaggaatgacctgtttttatcctacagacagtgcaaattggaagtcaaataccctttgtattccaaaataggacctcaaacatcttgtaatttt

SEQ ID NO: 5108 - DNA, 201 bp, Bos taurus
ggtgagaagcgtgttctttggtgttgacttcacatttggggctaacgcaggattatgaatctaagcacgttatggaattttagggctattgttacacctcgctaaggaccttttggatgtatttttagcggccactggtatcacccaggcttttgtgcttctgtcagttctgggtagagacttgagagtgttaggtcagcc

SEQ ID NO: 5109 - DNA, 201 bp, Bos taurus
ctatttttgaatcactaaaagcctgtgcattaaatggatggcaaagtagttttgccagagccatctttcttggtccctctgccccaagttgcttatccgctaccctccagaggtattgtaaagataaacagaggagactgaaagtctcaggcactaagtctatctggaggatatatgctgtttactggattgctgagtaca

SEQ ID NO: 5110 - DNA, 201 bp, Bos taurus
cattgtttaaaaagaaaaaaatcaacaccttattctcattcaggatcaccaggagaactttataaaacacagatggctgggcctgacccttccccactcccaagagtttgattcagtgggtttgggtaggtctaaagttctgaatttctaaaaagttcctaagtaaatgctgatgctgttggtcaagaggccaccacgtgc

SEQ ID NO: 5111 - DNA, 201 bp, Bos taurus
cctagtggctaagactctgtgctcccaacgaaggtggtctgggttccatcgctggtcagggaactagattccgcatgctacaactaagagttaacatgccacaattaaagatcctacaggccgaaactaagatccaatgcagccaaacatgtaaataaatatttaaattgactactcttctgagggaatccatttgcaact

SEQ ID NO: 5112 - DNA, 201 bp, Bos taurus
gttccccattgcttgtattaccacctgaactgttccccacctcagtcactcccattaccaccaggcctgaattatccatccctgcccccttaccctgatcggtgtaaaaattgtcttccacgaaaccagttccttgtgccaaaaagcttggggactgctgtgttagaccattagcttatttttttttttttttaatggatt

SEQ ID NO: 5113 - DNA, 201 bp, Bos taurus
ccaacaaaagtcaggccctagaagtgttttttcaaagttggtggtttttcaagcttttattgctaggactcccttttaccctagtgaaagctgtggccaaactcctaaagtccatccatgaacctcccctcccccaagggattccatgaagttaagaacctttgattcaggttaagggccagggaacacattcatcagtcc

SEQ ID NO: 5114 - DNA, 201 bp, Bos taurus
cagacatttagcaggcacctggtcacacttacttcaaaatcaaggcttctgtttagggtttgaaaaacagctattgggtctcactgaaggaaaatctatatgcttgagctgtcaagtaagaggggggaaaggtaagaaaattaaggatacggacagctttctttactctaccagcagacatagcacaaagactcttttatc

SEQ ID NO: 5115 - DNA, 201 bp, Bos taurus
gcccactgagagcccaaatcctctttgataactcctgctggccatgctaccactgctctccaaatctttattacctgagtgatcctgcaccgaatccttacattttggcctaattttcccatttatgaaatggactaaattatatgactcctatctgtaactgtgtgaatagcgtcctagaaaatatatgcttaaatctta

SEQ ID NO: 5116 - DNA, 201 bp, Bos taurus
ctttcttggtgaggtcttcctgacgtccctatctattcccctattccatttccccagtccttccgttgagaacattgagagcattttctaggcccaatatataagcactctcttgcctgggaggtcacatcagtaaaccgaatcttgggtagctttcttgtccctgtaaatgttccagaaagtctgtggagcagtgaaatc

SEQ ID NO: 5117 - DNA, 201 bp, Bos taurus
gcccagggcctgatcaggacatcagtagggaatgtttttggccaaatggtcgaatcctctgcaaccttgattgcataaaaccccggagtccttcaaggagccttgtcctcctgctccgtctttgcacagaacgagaaaccaagaggctgaagaaggtatcaaggttggaaagggcccaggttcccatgagccaggacatcc

SEQ ID NO: 5118 - DNA, 201 bp, Bos taurus
gcaggaatgcccacagtggtgccaaaattcatcggcctgcaggccctgtcagttcccatcaggaccaatgctaagcatggccctactgtgtgcggctgccttcccagggtggacccaggctggtgacaccggcaccatgtctctatctgtggtccacgtgcgggagcttcagcactgagctctgtgcatgaggccaagctg

SEQ ID NO: 5119 - DNA, 201 bp, Bos taurus
ttcaagtgttctgcctagtgggtgctggtgagccaaaaccaggctcaacccagcggtgtgggtctcatgagcaaagagcagggctctgggccaaagagggaagtgagggtggcttgccgtgaggtggggaaaatgcaggtttgaggtcagagttgagcaagaatcctgctctgcctggtgactgctaggtggccatggaca

SEQ ID NO: 5120 - DNA, 201 bp, Bos taurus
ctgggcctccagctgcacaggtgggaaatgggagcaggtacccactccacacaaaccaccccccaaacctcccacaagccccttcccatctatctccatgcaggtgacctgtccaggaaggcctgccttggcccaggcatggcatcccagctctttccaccccacctctgaccccagccctcaccctccaccaagctcagg

SEQ ID NO: 5121 - DNA, 201 bp, Bos taurus
catggatgcaaaaattctgctttaggcataaatgatcagagatgaagttggcctttaattttctttgcctgcaatctttgtccagttttattaagaggattgttctcttgtaaaatgagctggccgctttctctctttttttcccctagaacagttagtataatatatctgctccttgaagtcttagtaaaactcacatgt

SEQ ID NO: 5122 - DNA, 201 bp, Bos taurus
gggatcgccggcctggaagttcacttcttgcatcccttactttaatcgcgtgcagtttcccacctgcttaggatgttttcgtctgcgcgttcatttttcacgccagcggtttcctttcctgggggcctcgggagccctggagtggtgtgtctcgcgcgcctcactagccccagttcagggctccggggacagataatgaag

SEQ ID NO: 5123 - DNA, 201 bp, Bos taurus
attcaattattaatagtcatctattgaactatgataggcatcacctattagaaagccctgaaatcaatttagggggctgtgcccagtagttttaaaatataaaatagaagacaaagtgtcagagtgcacctctgaagtagggtgactattacttggcatgagtttggttttaattctgtttgtatgcgctgggtcacacag

SEQ ID NO: 5124 - DNA, 201 bp, Bos taurus
tctctctgaatgcagcgtttatcagttctgaggaatgccagctgctgcctcccaccgggggtggtggatgtcagtcacgtcggtcagagatggaaaagagataggccgtggatcgtccctcgtgttgagcagccagtgtttagcaagcacttgctgtgacttgtctctctggtggctcagaggttaaagcgtctgcctgca

SEQ ID NO: 5125 - DNA, 201 bp, Bos taurus
cagtaacaaaagaaccctgaaaggtcagttctaggtcacccgtgcgctggggcaggtccactggagctctcttccaacagtgatccagggatccagccctccccatctgctcaggccacaagctctacacttgacttgtgaggtctgtgcagcaggaagagagagaagaggaaacacatgggctcttacgtgcctttgcac

SEQ ID NO: 5126 - DNA, 201 bp, Bos taurus
atcatcatgcagcgatgagcaagcatctttaatcataagtttctatctatgttttaaaacacttccacaggatagattctagaagtgcgatcactgggccaatgggtaagagggtttttaagagctttgacactgttcagtcgtttccagaaaaatggtaccaagtcgccttctacatgaacgctaccactgccggtttct

SEQ ID NO: 5127 - DNA, 201 bp, Bos taurus
cacagctcaggccccaccctggaactgatgggtcagcaactctggggcagggcctctgggatccacagggcctccaggtgatgctgatctgaatttaggagtctggacagaaagtttccccaggcctgaggatgggtctacaagcttaattcgggctgatgtaaattgcctggccatcagtccgacagccttttcccaagg

SEQ ID NO: 5128 - DNA, 201 bp, Bos taurus
ggtacggaagagcatagcaggaccaggagttgagacaggagggtcccaaggaggacaagttgtcagaaccatggcgtgaaccaaagtctggaagccaagggggagcaggactttgagcaggagaggctcaagtcagggtttcggggatatcactctaatcaaatgggaaagagagatggtgtagggaggtggcaagttaga

SEQ ID NO: 5129 - DNA, 201 bp, Bos taurus
ctcatcctctttagaatgtcctgtggacgctctctcaggatgctggggatgaaacccaagtcactgcagagcagggaggcagcgaagacaccaaacttcccagaaaggccaagttgttttgcaagtcttagattttacagagccattcggagcacccatctgttcttgagggggcccagtctgtgaatctcaggcccacgc

SEQ ID NO: 5130 - DNA, 201 bp, Bos taurus
cgtaaaatatccttttgttgggtgctctgtaatcttggcctgtgggactttatcagtgtgaagaatcctgtgtgtctccacttcagccataagaatgttacaggctcagcaatatcaggcccaggaatttcaggaatatcactggcctgtgggtgttaggatatcaggcgtatcataaccagagtttcactggctcaggaa

SEQ ID NO: 5131 - DNA, 201 bp, Bos taurus
cacagaggtctacgactctgccaccaactggtcgtgcaagctttaacagaatacttcgcctcttgcagtctcaatgtcctccacagaaacatcaaggaaggtgtgggccttaatgagttagcacaggtttcctaaagcattcagcacagattagtgctctgtggatgttgagaaccttccctcaacatattgaacctaact

SEQ ID NO: 5132 - DNA, 201 bp, Bos taurus
tcacctcaaatgtccccagtgccaagatggagaatccctgatttcaattaaaagagcaattttctttccagatgggaatggcctctcctggcagtggttggtctggaagcttctggatattcccagcatcctctgggagaaccatttctccttaggggagagcagctgtctagcagaaggcctcacggttcccagaggaag

SEQ ID NO: 5133 - DNA, 201 bp, Bos taurus
ccttaagggagcctcggctaagagggcctttctgagttgtttgctccctgggcacttggtatcctgctcctctccctggagtggaagtgtctgttggaacagggcctttgtccttccatcaagtcagggacctgccacagagcttgctgtgcggcgaatgctggggaaagaataggtggagaattccaggggcagggatgg

SEQ ID NO: 5134 - DNA, 201 bp, Bos taurus
aagttaaatagacggcctaaagtcacagagctagaaagcagtagacccaggattcacatcacaaagtctagactaatagctttcacaccacagctgcctctgcagggctcaggctccagcctggccttttaccaggagccctgcattaaactgtcaggggcttgcaccattgtgaacattctgatactctctgagcaccca

SEQ ID NO: 5135 - DNA, 201 bp, Bos taurus
tttcaaacatctgcagcattgatcttccctatcctattgggcaggactacatcataagtccatgctaaactgttcacctgctaggaggctgaaaaggccatgattgtcttagactagagggcagcacttcttctttaggcttcgagggctacatggtttctgtagcagctattcaactctggccgcagcgtgaaagcagct

SEQ ID NO: 5136 - DNA, 201 bp, Bos taurus
actagcttttcagcctccatgctcccctcaaggactcttaccctgggatgtgctacctgccaatgatgtctgcagaggcttccaattaaaaataaaaagaatcagctgtctcgttttggaacgttcagcttggtaatgggatgcataataaaattttcccctggacagctatgaggtgacctctgcagcctgacggagtag

SEQ ID NO: 5137 - DNA, 201 bp, Bos taurus
gtgtgcatgctgtaccaccaggacctagaacacaagctaccacaaagaacacactgggtaaacaattgtttggatacttgagtgggtgaaggcccagcatccaggactgcctgtcctgtgattcctcttcttctatttctcaaggttggtccacagtctacagagttcctctgagcaaggcagctactcgggacacaccct

SEQ ID NO: 5138 - DNA, 201 bp, Bos taurus
aggagtgggggatttgaggcgtggagatgaagggaccacaagttcacatgaaggtgaaggcggaggttggagtgatgttgctgcaggccaaggtacaccaagagccatcggaaggcactgccaggagacgaggaaggagcctcccctagagccttcagagagaaagaaccccagccctgctgacatcttggacttctggcc

SEQ ID NO: 5139 - DNA, 201 bp, Bos taurus
ttgtaccttttatggtccacacagaccctattaaaacagaagatcaagaattatgttccaagagctctttattaggctggcagcaaggccccaggctgtagggaagagttggttattttgtgaggtgtcacatctgagcattactttagcaaataaccctgactgcctggggccggatcctggtcagccacgggcagctgc

SEQ ID NO: 5140 - DNA, 201 bp, Bos taurus
tagttggctgtgcggccgtagacattttattttcaagttttcaaggttattggttcatcaggagcaaaggaaaaatgtggcggggttttcatgggtcctgatgagagaggggccagcgaatggtctgggaggtggactggaaatgaacttgttgcgaagccctcaaccccacacacttccctcccctacaacatcaggctg

SEQ ID NO: 5141 - DNA, 201 bp, Bos taurus
gcattagggttcaagagggagagacaaccgaggcccctaagttgtttaggtcaaccttttcaaattgatcagtgcgactttctgttgggacttgcttttgttccgcccttggctcccatctcaacaagtttggcttccagatcactttgagaatctactatatctcagaactttctcactagaaaatgcacaccagtaaaa

SEQ ID NO: 5142 - DNA, 201 bp, Bos taurus
tctgacccaggcatggaagggttaagtaggagcttaacagacaaggaaagttcaggggagagggacagagtcttcaaaggcctgggatttgacctgcattgtgtgcagcgtgactcgttctggatggagtggaacatggactgtacagtcagcctttggacatggccaagggggtagacggggggcggggtgggggcagga

SEQ ID NO: 5143 - DNA, 201 bp, Bos taurus
cagttccctgtcttgttttgaccttttattgtttacctctcattggccagacctgggtctccagggggaccccaagctgccaggatactggggcactgagtgtctcatctttgcaacctctagtgggggatggactagcaagatgggggagctgctgggggagctgtcagtggtggctgccaaagtcctgggaaaagcagt

SEQ ID NO: 5144 - DNA, 201 bp, Bos taurus
cttttactgaaagctgccccacgcaacaccctgttatcctcagggccttgtgcaatgggatacagaagcgccctcttgtgtagcacctgagaactacaagcgcagcacagccatcactggacaaacctctgttttgcaaaggataagcattcctaaggccctttcttttgttgccaaccactaaaatctcagactccacgc

SEQ ID NO: 5145 - DNA, 201 bp, Bos taurus
cttccaaatccacttggcttttatgagcatgtgcgcacaggcaagtggctcccatccggggcagagcatcttggtctgtgaagagggaacacgaggcagctggcccgcgggcgctgccgtgaggagcagcgactgacctcatgggtccagggcctgcaccgtgccccacgagctcctctccccggtctcaatccctggaat

SEQ ID NO: 5146 - DNA, 201 bp, Bos taurus
ccccaccaggtaactaacaggtcttctcacaggccagcaagaggggcactcagaactctcgacggctattagttaggaggcttgtgcgtgtgcaggcctgattttgctttttaacaacatcctgccatcttctcctcaagctacagagtaaaaaaattgatggttctccccttctcgggcacaggctggggcctcacctgt

SEQ ID NO: 5147 - DNA, 201 bp, Bos taurus
tgggaaaatgctacgaacgattggcataagggccttagacttaagaaaggacgaggttgtgctcttgtcatttcagatgacagacaccaccacggggtaccgggaaggcccgtcaaagaaaggaaagaagaggacatgggccgacatcaaccatcccggagagccgccggtgacgggggcaacaagactgccgatcagcaa

SEQ ID NO: 5148 - DNA, 201 bp, Bos taurus
tctgggcagctttacccgggtgagggctgctgggcatttgccccagatgtggggcctttctgcttctttccctacacctaggcatcgttggccagatataccgtccaccagagaggcagagggcacaggctcagggcacaaaaaggcagccagctcagtgttgagaaaacaaaacgcccaagcagacctttgtctgaatgt

SEQ ID NO: 5149 - DNA, 201 bp, Bos taurus
tgcctggggcggacctgccggcagtgtggtgcagagaggtggactcgtccctggcaccagctcccgggcggcaggggagcagaggcccctgtaggatggtcccccttttgcaggacaagcctcctctgctcactcttgcaggttggaagccctggcagcagtaggtgagactcctctgtatctggaagttgacttggcttc

SEQ ID NO: 5150 - DNA, 201 bp, Bos taurus
tccccctaaatgtcccactaattcagaccaggcctgagctgctgaactctatctagggagcctcaaggagtcacggatgcaatgcatcaaatgaggagcacgtttgcactgcttggccccgaacagacaaatggaattctagactctctggggtggaaaagatcttaaaaggcatgctatccagccagccccatctacacc

SEQ ID NO: 5151 - DNA, 201 bp, Bos taurus
ggcacatgggaggggcccaagaaaatgtggaaaacttctgtgatcaatgcccatggacggggcagcttctttgctggcccccagctcccctcaccatcaccgctgcctccttggctcagggagtttattacaggtaatttctctacatcaaattcatcaacactccctcaggcctagaggccatgttcaaacccctctgtg

SEQ ID NO: 5152 - DNA, 201 bp, Bos taurus
cagccctggtcccctggcctctcctgacgagcgcatcctcccatggacatctccaaagtgggaaaccctgtaagaagccctgctgggctaccccagctctgactgcaccccgaggtgggggtgaagagcctgaggtcacccacctgcccaccttctcagacgtccctcggcatgggccctggatggcctgtccatgcacgg

SEQ ID NO: 5153 - DNA, 201 bp, Bos taurus
ctgccgtggacttggggctccatcacaggcccttctcccggctggcagctctgccccctctatcctgagtgctctcctcttcctccaaaacatgaggctcgagattcctccccaggaggcctgcccgctctccccagctggcggggagcccccttcactgggatcctgtgtgcccctcagggacgaaccatcatcagacct

SEQ ID NO: 5154 - DNA, 201 bp, Bos taurus
tgtcctcgaataagtgtcatcttagaggaaaagagacagaaacacccactcagaggctgagaactttgagcagcattgtgttcttgctgaggcctcagtttgcggggagttggagcagccaaggcatgagagtgctgcccagaggtggtccgtgcaggctgccttctgcttcctcaaaaagggttctttcctctgattttc

SEQ ID NO: 5155 - DNA, 201 bp, Bos taurus
gggagggccgagcaccggcccatgggtgggccgcctgagtgagcttctcggcgtcgcaggagctgagtcggagcgttctgacagagatggaaaaccagccaaggcactatcggccactggtctgcgagaagagcaagccggtgccgctgaaactgtttaccccccggctcgtcaaagtgtgagtgccgagggcccagcacc

SEQ ID NO: 5156 - DNA, 201 bp, Bos taurus
ccagcgagcccacgagtccaggattctccccgtcagcactcaagactcacttccaacctactggtggcgcaactgccttgcctccaatcatggaaggtgtctgggggcggggcccctggagcctggacctgccgccccgcgtctcgcttacaccagcacacgccatccaccccggccccaccccgggtgtgcatgggaata

SEQ ID NO: 5157 - DNA, 201 bp, Bos taurus
aagggatgggccgccctgcctccgtgggggaccgcgggcaggtgggcacaaggcggggctcctcccctcgcagcacaaccgggaggggaggggcagcctcgctcaggtcagctctggcctcaggagccaggaccctgcctccttcctattccctctcaggctccccagaccccctggctgtgcccatacagagggcacgag

SEQ ID NO: 5158 - DNA, 201 bp, Bos taurus
aaaaacctgtttgtatcagcattattcatgatggccaaggtagaaacaacccagacgtccaccacctgatggatggattaacaaaacgtggtccatcctcgtggtggaatacgattcggccttaaaaaggaatgaagtgctgacacatgctgctacacagagtcagcttgcacacgtgctaagtgaaagaagccagacatg

SEQ ID NO: 5159 - DNA, 201 bp, Bos taurus
tcctgtcccaagacagcagccgccctgctgaccgcgcggacgccaggccccctctggtttctcacagaaacgtctctgtgactgagcgactgtgaacccgggtggtgcggggtggacggggccacacacggcgtcccccgggccaggccgccccccacaagtgctcgactggggcctgggcccgggcctctgctagttctt

SEQ ID NO: 5160 - DNA, 201 bp, Bos taurus
ggtgctgctctcagccctggggtggaattctcaaggctgcctcccctcaggaagccacatctcctctctggatagcatttgctggccctttgcagtttgggggcaatccgggtctatcaaggaaacaaagcgcaacaagatgtccgcgttcctgagccatcccgtgtctgtggcctctgcttggaggaggccatgagcgtg

SEQ ID NO: 5161 - DNA, 201 bp, Bos taurus
ccccgctacggcccgccacgtaagccctgggactgggaccccgcttctcagcatcccccactcccgtcagctctgcaaggatgctgacgcccaccaggcccgtcgggaacctgcaggggctcgttcacgtgaaacacagccactcaccgttccggtgggggtctaggtgctgctttgcagaacacgtctcccccttgatgt

SEQ ID NO: 5162 - DNA, 201 bp, Bos taurus
agttagtacatgcagatcagtaaactttaaagataaatttagccttaagaaattaattgcacctattctacttacttttggtaagtcatttaccccatcttatgagtgtcaagatgccaaagccacatgtaaacgctcaccgacgtgctgggcgcacgattaggtcccgcttgttgggctccacgaggacagcaagccgcc

SEQ ID NO: 5163 - DNA, 201 bp, Bos taurus
gctccacctccacctccaggctcacttggaacaagtcggggtacttctcctggatgtcgcaagcatccagatcatacctgcagttggaggccaggcgcaggttaggaaggaccacgggcacgtcggggtcaccccaacgtccaccaggatgcaggcacggggcagggccgtgttctcggcgggcaccacaccggcacctca

SEQ ID NO: 5164 - DNA, 201 bp, Bos taurus
ggggggcggggcttctccacgtccagtcgggctgcctggcctggcctgcaggcgctgctgcactccctggtggcaaggccacagctctggggtcctctgccggataaaacacatctttctgaaaacgggttgtgaccccagttatgggactcttcctgcccctgctgtgcttccgcggctgcacctggatcctcttctggg

SEQ ID NO: 5165 - DNA, 201 bp, Bos taurus
ggccaggtcaacaaagcgtcgcaggtgcacctgaagcagaaacggacggatgccgcagtgctcgtgatccagcatgcaaagcgccccagaacttgtgtacaagcctcggggtttcggccgtgagaggaggaggctcgtgacacctcccgtcaagggaactgccgactggggggggctccaagggggtggactggggctgcg

SEQ ID NO: 5166 - DNA, 201 bp, Bos taurus
cctgggggcagttagctgggcctcacaggaccagccccaccagctgggggaccgcctggacctgggccccagggggccgatgagcctaggagcccctcccgagaatcagagccattcaccacccgccctttgatgcagcccccagcactggcctgtcaccccacttcctcatgccaagtcccgacagtcgcgggatgcaga

SEQ ID NO: 5167 - DNA, 201 bp, Bos taurus
tgcattgggagctcagtcttaaccactggaccaccggggaagtccccaagattcttccctttcttaaaaaaatactgtttcatggatgcgtttatttcctcgctgctcaggccctgctctagttgcactgagcaggcggtgcgcaggcttctcattgcggggctcctcctgttgctgagcacgggcgccggccgggtcttg

SEQ ID NO: 5168 - DNA, 201 bp, Bos taurus
tgcaacaccagaagccaggagagaacgtgaaatagactccagcctcagagcccctggaagggaccaattctgcagataccttgattttggactcctggcctctagaactcttttaagccccccagtttggtgactgcagccacaggagattgccacagctcctcacaaggccttccctctggaaatcaacccctccccatc

SEQ ID NO: 5169 - DNA, 201 bp, Bos taurus
ctgactcttgtccaattgctcccacacctaggtccctttccactctcccctcacctctctgagccctgaagctggtcctcctgagctgcaccaatgagacgcctgggttttcaggcttccacttgggtttgaccaatgagaggcgcctatgcaggctggagggccagcagaaagaacagccagaatatttcttcccagctc

SEQ ID NO: 5170 - DNA, 201 bp, Bos taurus
gagtgaaaaaacagtgcttttctgcacagatggcgcctggatccctgaggcatgtctgcaaagtcagggctcctgggatccctttgagatgcactgattcggcctccccctctgttttgcacacagcataggccccccaaacaaggagaagccttacaaacactcggcaaagtccacagcctgcactctatctgcctcttt

SEQ ID NO: 5171 - DNA, 201 bp, Bos taurus
aactgacccttttagagcaagaccacctgttctgtttgtcctgattcctgttcacttcagctctgtgggcaaagacctcgctgaaaggacaagtctatcctagtgagaccttgatgttagacatacttctcaggttctttttagcagcccagcatccagacagaattttcacttgggaaagtgaaagcgttagtcactcag

SEQ ID NO: 5172 - DNA, 201 bp, Bos taurus
acacaggataatcacaagtggttttctctgctctggcggccagcctgtgctcttaaccaaggaatggcttgcaggagaggagatgaaagagatggcattcctcctgctgggcccagtgaaccgggtcaagaacaaacgccaaccttcttttcagacaacatagacccagccagctctgctgaggtcaggaggccaggactt

SEQ ID NO: 5173 - DNA, 201 bp, Bos taurus
agaagccagataatgggttttatttcacaggcaagagatctactggtctgacattacaatggattccctttcccaataaaactcaaagacaccaaaaaaacacaaaaaacaaaaaacccaaataacagaaaaactacctcattggacaaaattaccattctccttattttttttttttaaatgcattttagataatataga

SEQ ID NO: 5174 - DNA, 201 bp, Bos taurus
cttttgctccatccaggactgccatggaattcctttcctaaggaggggacatttcagtaagtcaacgggaggtacaacaatgacaaagattataggctaccgtgctggccaggggagtaatagagatccccttgctgtgagttaaagatttaagagtctggagtctaggggagttaacctctcatggtggcagaattgtaa

SEQ ID NO: 5175 - DNA, 201 bp, Bos taurus
tgaagaagtctgagaacagccacaaattttcctttgcttaatgcagccttgaaaatatttcaagtattctgttttacaggcatgcattcactctgcttagggaaaatattacttcaagcacatcttagcatgccaagaacgcttctagtgtctggcacttagtaggaactgaatggatgtttgaagtttgacttgagttga

SEQ ID NO: 5176 - DNA, 201 bp, Bos taurus
ggtctctttcacctccctcaaggtataaagagggccatgtcaagagaggtgcacggcttgactgggattctgagagtaaaggggttcctatcctagtcatccatttgggccattaatcccaccattttggagatgatccccaagatttgctcactttgtaggttgaaaagtattttgtaaaggtaatggatttgatgatta

SEQ ID NO: 5177 - DNA, 201 bp, Bos taurus
tgggaagattccacatgctgcaggccgactaaacccacgcactatgactacggaagcttgtgcatgctctagagcccgtgtgatgcaacttctgggcccacgtgttgcaactgttgaagctgaagtgccctggagtctgtgctgcccaggaagagaagccattatgatgagaagctcacacagggaaattagagagtggcc

SEQ ID NO: 5178 - DNA, 201 bp, Bos taurus
tactctcaagacccttgcctggcttgcagggccttcactttagtgcccaatcctgtttttgcatgacaaagctcacatatcgctttgccttgttccttctctttgcattctgtctgggacaagctctcatttttgcctccaagcaagtgtatgctagtgaggacaaagttcatgcacaaaggcaaaagaataaaaattctg

SEQ ID NO: 5179 - DNA, 201 bp, Bos taurus
ggattaaaaaaaaagttcccaaatcatgtataatatccgtgataaatcactttcaactgagacataaaaggaatgtagagttcgaagaaaagaagaaagcgggttttgcgttgttttgttgttgtttaaagaggtatccacaaggccctggcttcagcacgggcttcagaaggctttcatgttctctagtacagccctggg

SEQ ID NO: 5180 - DNA, 201 bp, Bos taurus
ccaaccaccataaaacaatgacacccgacaccaacaatagcagttttttttgccaatattaataaaaacacatcatgtcttaggctccatgatttacatgcattttattattttatgcaacaactcaatgatgtgattgactaaacaagctgttttagagaaatgggattcctttctcaagatcatacaactaacggatga

SEQ ID NO: 5181 - DNA, 201 bp, Bos taurus
atcctgctttcgacttcagttctgtttaatacagtggctggcccaagagcaatacataaatgtgggaacaaacaacagataaggaagctgaggcccagtcgtatatgagaagtgtggcttccagccccatgtgctttcacttgagaaagtatttgggtcatccttaatgctgggggatgaccatacttcctcccaaacgag

SEQ ID NO: 5182 - DNA, 201 bp, Bos taurus
ttgactcggcaggatctgaggattctaatagtatcttcaggggctggattccctctccttttctcagctagaattttctctgggcaaacttcattctctgatatgtgttctccatttgggaaaacatggcaaatggtagctctggggttaagttatttttatatttcctgtagaaaagagcagaccacatttctaataatt

SEQ ID NO: 5183 - DNA, 201 bp, Bos taurus
gagcccttctgcagcttctgctggaatctgtacagccaggaagcgtggctgggagcagagtaaggtcaaggcaagcttgactttcaagactgtgtgtgtgtgcatgtgtgcccagttatatccaactctttgccacgttatggactgtagccctccaggctcctctgtccatgggatctcccaggtaagaagacgagtggg

SEQ ID NO: 5184 - DNA, 201 bp, Bos taurus
ctgttgataccctctcttccaatttctcagagatgagcaaagaatgggtctattctccatgaagagctttacagtcaggatatgtcactggccagagtcttctgttaataagaaaattgatttgataaattgaattcattaaacatgtgtgtgattcaagatattactaaagtatcacattataatttacatttaaaaata

SEQ ID NO: 5185 - DNA, 201 bp, Bos taurus
atgatacttgataggttaacatagaaattgcttaattaaatgcaatcctaggccaggcaggaaaatataaatacacttatatggccgggtgtgtagacaagagtggaggggtcatgaccttgtggagatgagtgaacacccagttgagtgttaacatgcagaaatagaggcccaattttctgcaaatttttaagagtctag

SEQ ID NO: 5186 - DNA, 201 bp, Bos taurus
gatccattaatcagcatgaaatatgttagaaataagttttcattggtgaaatgagtagtgttcaaaatataaaactgcctagaaaagcgttaaagtcttcgcatcagtgagggatagaactccagcaatttcatggccaatcatcttcatagtgtctatatctagatttgcctttattttattgggctccgaaatcactac

SEQ ID NO: 5187 - DNA, 201 bp, Bos taurus
gttatttatgaagtcttactggtataataatattatatagcctttttcaagtttgaaaacttttttactgcatgagggataaaagaattattttctctctctctctgtttttactcactccaagggcaagtcatatttgcattcaagttgaatttttttctcatctctaagttcactgaggatgtggcccataaatcctag

SEQ ID NO: 5188 - DNA, 201 bp, Bos taurus
atatattttcatgaattttgataaaatttggccagttaatattttcttcatatgtttcatcaaaacaaataatcaaaacaaacaaaaatctgacctcgttgtcaaagcagcatccctgtactctttcttgaggaggatggcaacaacgatggtaaaactagtaacagcaagagaaaaaattttgcccatgcccacaactca

SEQ ID NO: 5189 - DNA, 201 bp, Bos taurus
tatctcttcttgctattctttggaagtctgcattcagatgttactgaatatatataaggcaagtgaattactgtatgcagtaaatatcaaaaagcaaagcaaaactaacttatctaaggcttccctggtggcccagtagtaaagaatttacttgccaatgtaggagaaatgagtttgatccattatctgggaagatcccac

SEQ ID NO: 5190 - DNA, 201 bp, Bos taurus
tgctgcgtgtactgtggtaatatattcttagggctcagggactggtatttccaaatccttcctctatagctcaaccactaaggcctctactcagttctcatggcctcagtgctggggccccatgtccagaatcatccagttgtcatatcagcccaatctggatctactatgcttcactgtagttagctcaccaccacccct

SEQ ID NO: 5191 - DNA, 201 bp, Bos taurus
cattttgagatggcttgttatgagcattattgtggcaagactaattgagtcttttctaaattaattagaatatctactctattctctctccactccttgttccaaccatccttcctttttcaattcacaaagagcagagtatttggggctaaaactatgtgcagctatataaaatttagtagaatgacagtacctaagaaa

SEQ ID NO: 5192 - DNA, 201 bp, Bos taurus
atatctctcacattcagtcagaagatagaagtggttaaatttagtgaagaaggcattttgaaagcaaagataggccaaaagctaggcctcttgcactaaacaattaaccaatttttgaacacaaatgtaaagttcttcagttcagtttagttcattcactcagtcatgtccaactctttgtgaccccacagactgcagcac

SEQ ID NO: 5193 - DNA, 201 bp, Bos taurus
tccaaagtacataaattatttactgaacaattagttggataatagccatttgattaatctgaagatagatgcaataaatgttacaagttctaaatccttttgcatccaagtctgactactacaactcttctaatctggggaaataatatatcttgtgcccatactcctttacaccttggctcaccacaaatcatcccacaa

SEQ ID NO: 5194 - DNA, 201 bp, Bos taurus
gctggcattatggacacaattcccccaaaggtgctgacccacatatattttaaaatcttttgaagaagatatgtgtataaaatgtaacttcagtattttgcaatgaatagacttatgtacaaattgctttgggaatgaagagagcttgattaaatctgttttggtagggaaagatattcccatgctggtaatttcatttaa

SEQ ID NO: 5195 - DNA, 201 bp, Bos taurus
aacatagtacaaagaatgaggtaatacccacatcaactgagaatcagtgcctgattgttaattagatcaaattgttaaaacttccaaaggcccctcacactagtttaagcatttccagtgaaagtaagagttgctcagttgtgtccagctctttgtgacctcatggactgtacagtccatggaattctctaggccagaata

SEQ ID NO: 5196 - DNA, 201 bp, Bos taurus
aggttgaacgtggcccataagataaagacaaaagtcaaaaaggacaccaaagtgtctgaccttaaaaactggaagaatggagttacctttgactgaaatggagtgatagtagatgggccaattttggtgaaaatacaagtagatcagttttatacatgttagtttcagatgccaacaagcctacacacctgtccttgtcca

SEQ ID NO: 5197 - DNA, 201 bp, Bos taurus
actcctggccttcacttcctgtctgatcttctttccccaacctcagatagttccttaatctacatgtgctaaaaaaaaaaaaaaaaaaaatctacatgtgctggcctgctgaatgctcagagataactaactacattcagatgttcagagatgtttctctcagtatttcagaatttgaactctagccttctgtgtttccaa

SEQ ID NO: 5198 - DNA, 201 bp, Bos taurus
tagcctaggtacccaactaacacaatcagtttttacacaaacaatacacaaaagcaaacacaaaaaataaagaaaacattttaaatcttgcagtacagtacgctgagaagagtagtagtgcagtacaacagctagaatcctggggctggcactgagtgaacaggcaggaagagttactgactggacgagggaaaggcaacg

SEQ ID NO: 5199 - DNA, 201 bp, Bos taurus
aaacactggccccgggtacagcgggggtggtatttcctctctcccgcaggctttggttttccaacaggacattaacatttatgtcatgttaacgcgcacccaggcatggcgtgtggcctgccgccacggccacggacaaacgcaaactccagcgccgcctcggcatgaccgccaggctcgcagtgtaaatggagacgcgcg

SEQ ID NO: 5200 - DNA, 201 bp, Bos taurus
ctgattgacccgtagaaaagagtcacaaacccatgtaaaccatgaaggacacatagactaatgggtagagaaataaaagcaatcacaaattatcaacatgtttgttcaaaatcttactatttctttcaccaatgaaacactgttaaacagtataccatggacatttccccaaaccttccatatttaaaacctacatcattt

SEQ ID NO: 5201 - DNA, 201 bp, Bos taurus
agatggggctccccttgtggctagtgaacttgacctcctcatgtatttctccctggtcctgtctgccctgggctcctgcacaaccctactaaagccagcagttacatgcagtccacaccaggggatatccctcacgatcctggctctggaggccacagaagcttgtgtttctgggtcacaaaggactgaaacaatcagaga

SEQ ID NO: 5202 - DNA, 201 bp, Bos taurus
gcctctagggcaggtggagacaaatggggaatcatttctcctctagggcatcatttctcctctagggcaggtgcaggatcaagtttccttagacagcatgcagcttatgcaggagtatgcccacactcatcaccttgactgactgtcacagaagagaaaacctcaattatgacagcaaagctgtccagacttgagcctcca

SEQ ID NO: 5203 - DNA, 201 bp, Bos taurus
ctgtgtgtcttcaacacgaagggcagtgtcttcacctggatccttgggaataagggaaaaggaggaggaaaaggaagtgatggggagaagaagactacagcagttatgaatgaataaagaattattcattctttctaataatgcaaagaatttttcagtctgtcagaggaagtgcaatctactgctgttaaaactttaaaa

SEQ ID NO: 5204 - DNA, 201 bp, Bos taurus
cagaggagtggtgggtgcattttgggaaacattttctgcatgaggacccaagagacatttgtctaccaagtagtctggccattaaccagcctgtgaagggtctattaaattctgatccttgatgttcttagtgtgacaaatgtacttgtcccccaggacctggatgcttgggcctaggagctcaaagggatacatttgctg

SEQ ID NO: 5205 - DNA, 201 bp, Bos taurus
tactcatagtcatagatttggggggataaataaaatggccaaggggacatagtccgcttcccaagtgtcccagagccagttcaagataggacaccaattcgaagaagcagaaagagaggaggccaggaggaaggaaagtgagaatctgtgcaaattccgaggactttggattcttaccaccaaaatcctgggggttcaaag

SEQ ID NO: 5206 - DNA, 201 bp, Bos taurus
tttccatttcctctgaatcctgcgagcgttttctcaggatgtccagcactgtggcaatcaccagcatgggctatggccagaaaacttctctatttttaaacgacacacacacattattatgccccatcacattgtttcagtgatcaactttaaagggccctggcttacctcctcctggaataataaagcagtcacaggagg

SEQ ID NO: 5207 - DNA, 201 bp, Bos taurus
gtatatgacaacttctcttttttagtcctatttgtttcctggcatccgggcatccatgttcagaatctccactgcagctacttacaggatcgttgatgcagtgaacagaacagcctcccaagatacagtcccaaatgtaataaatagcctaaaaactatgtatcaaatatataataatcagagctactaatcaaactaaat

SEQ ID NO: 5208 - DNA, 201 bp, Bos taurus
tttcagtctaagtgtgatgagaaggcactagaggattctaagcagaaaagtcatataacatgatttgccgtttgggagctgaattgtaggagaacaaagcaaggagcaggaagaacagttaggaagctagtgccatagttcacatgaaagatggtcaggtccacttgtaacaagcctgtagtaagtggagataaactaaaa

SEQ ID NO: 5209 - DNA, 201 bp, Bos taurus
taaaattttgagaactgctattatggatgatctcagtccagtagggtaggtaaaaaacattattgaacttttcaacatagtcagataaattacacaatattaatgccggcctactatgtctccttgttaattacttttaatggattatcaggttcactcctcatgggagccctataaattgggtagaattatctcatttta

SEQ ID NO: 5210 - DNA, 201 bp, Bos taurus
gcgtggcgcatcggagctacaggcgcaccgcagcgcggcggccttgctgggggaataggcttaaacgcagagttctggtcccaggcctgacttcactgctgcgctcgctgtcccttcctcgagcgcaggtcttcgaccgcccctgtgtccccagtgccctcggagtcgagggtccgaggacaggccgatccagcggaggcc

SEQ ID NO: 5211 - DNA, 201 bp, Bos taurus
gcccacaacatatggccgagtttaaaaaagaattctagagaatgtaactcaggcaccgaaactgaatcacaagtctcagcacttcgcccacgaatgacagcacaaggtatcttcctagaggccaagggtgggaaagcgattacttctgctggggattaagagagaaggtaagaaattgggcctttgaaagatgtctctgct

SEQ ID NO: 5212 - DNA, 201 bp, Bos taurus
cactacaacgagaatgtgcatgagccattttgaaaaggaaatgaaagctcataggtgatgaacaacttgcccaaattcatgttgctgtaaaaagatagaagtgggaggcagattgcatccaaagctgggcaactgacatgttttttccctgcaccatcctaagcagaccgaaggtgttgtagccacgcgttctggcaaaca

SEQ ID NO: 5213 - DNA, 201 bp, Bos taurus
tgctaattatttttatgacgccaggtcagcagtaaaggtggccttcctgctctgtttttcctccacagctgcataacaggacagaccgttttttcattttgtcaaatgagttgaggaaggcccagctctccaggccagggaggccctgaacatttgcccagttcttcttgttcctttctctttgcattttcttgtcccagg

SEQ ID NO: 5214 - DNA, 201 bp, Bos taurus
taatgaggttggtgcagacaaggtccatttaaaacctacatcccaggccagaaagtacaaataaattaaaaaggagcagtgttttgttgtatacatgtttacatggataacttttttgttttttggccatgccacagggcatgtggcatcctacttccctgaccagaggtagaacctgagcccctacagcagaagtgcaga

SEQ ID NO: 5215 - DNA, 201 bp, Bos taurus
ggatgtccacactggcccttgttcacttttccagaggagggtatgccagtttgaatccactccgttaggactcttggtacacacaaatgaatgtgacattccccctggccatttccctcgcagagtcctgtgtattggttgcattggagcctctagagggagctcaaggcctgtttccatctcccacagctacagccttag

SEQ ID NO: 5216 - DNA, 201 bp, Bos taurus
aaggcagaaaagggaggggacctaacgtgtattcagtagcttcagtgagccgaaattgctctaggtgctttgccgtggttttctattttcacaataacactagaaggttggtatgactcgttccatttcaaaatgatgaaacagactcaagtgggtttggtcagggctccagggtcgctcagcagataagtaatttgtgct

SEQ ID NO: 5217 - DNA, 201 bp, Bos taurus
cctactcatcctcaaggttcacagaattctcaattatcacacctaccccactggttagtataaaatactcaggaaggatgtgattctgaagacctcaaacggtccaaatacaacttaattcaagactattcttaaccaaggatggcaaatgttaagaagtcagtgaatattcttttttgaatactggtgttaccagctagt

SEQ ID NO: 5218 - DNA, 201 bp, Bos taurus
aggagcttgataaaaggatttgttggtggggatttttcttagcatcctggtgacttcaggggtagatgtgtatattgagctcacatcagaacaactgcagaaaaaaaagaagaaaaggaagccagacaaggaaagtgagatggggtgaatatccctgctggagacaatgactaatttaagcagggaaggagaaaaactttt

SEQ ID NO: 5219 - DNA, 201 bp, Bos taurus
tttgaaccatcacctatgagaaaattacaacacttactgctctatatctaaattttctcttgagagttttcagggtgcatagatcctgcaacagagttgtgttctaggctttaccatttccttctgaactctgagcactgaattcattttttcccccatgtggttgcttgctttcaatttaaggaagatctttctccccta

SEQ ID NO: 5220 - DNA, 201 bp, Bos taurus
gaccctccctttacaatggctgatgtgcttaatgtgttaatttactgatatttgcaaattatttcttgagacagtatcagaaatatcctgcttctaaaatattattaacataacccaatctatagcaggtaataaataatttagactgaaattggctggagcaaacatttgtcctttcccactttctgttggcttaaaagg

SEQ ID NO: 5221 - DNA, 201 bp, Bos taurus
acacaaagcccaagatcatgtgtgtggtgtgttataagcttttaatacactgttcatgcagtacagtcaaactaaacccagaaaaaatataagtcctctgctattttaatggctccatattgttatctgacaacatgaacaaatagatgtaccaaaggatgtgattgatgaagtcagtttgactttcaaataaacctcatt

SEQ ID NO: 5222 - DNA, 201 bp, Bos taurus
tcagaaccaaccttcttccagcagactagtactgctatagcaattggtagacttgctactcaactgacattatcataaaaaaaattaagaaacaataagcgaacaaaatactgtctatttagtgaggttttctaatttaatggaaggataaaatgaaatacttgaaaaaaaagaagtctgcatggctggttcatggaagag

SEQ ID NO: 5223 - DNA, 201 bp, Bos taurus
tgaccagttttggctaatgtgatattcccagaaataatgtgtgccacctctgggttgaggttttaacatgcccttcataccttacacttggtcacttcctattggatcatatgtactaaagatggggaattcaaagaaggaaagagtctggattcccctgccactgtgctccagaaaactacttgagacagaagcactgtc

SEQ ID NO: 5224 - DNA, 201 bp, Bos taurus
acccccacgtccgaggtcaggggcagcggccgagagtgtcaggctgtgactgtggaggaacagctgaaaggagctaccccaagttcaaaatcaggggtggcggccgggagaagctacccaccgcctgagaccaggagcggctgccgggaggagctaacccacgcccaagtcagagtggcggccaggaggagcaaccccatg

SEQ ID NO: 5225 - DNA, 201 bp, Bos taurus
tcaaggcaagcttttccacccttggaaatcatataaatatgttatgatcttaatttttaagtatgatctataatttactttggaaaagagaataaaagatgatgaagtgataattgctttggataaaatataaatgccacggatttttccaaggtcaagattttcccaattgtttgtttttctgcaacttatttcagtcct

SEQ ID NO: 5226 - DNA, 201 bp, Bos taurus
acaaagtttttgcagtatttttctgcatgtgaaaactgggcaaaaactgcacatgaaaactaccattcttccacaagattctctttcaacaggcagcctagaatgttcaatctagtctcctttatcctgagaagaaaactgactttgttgacgaactagtccattttcttctttttaatcttgtagcaaccttaatcaggg

SEQ ID NO: 5227 - DNA, 201 bp, Bos taurus
cctatgtctataatatctgttgaagcataaacatccatggagaatatatggtactattctcgaccccaagagtgccatatgctgtgagcactcactaatagacaggaacaatcagatacttaacagaaacgagtagatatgaaaacacgtcatcacaacctccaaatatgctcgttcatgtacacacacgaacagtcacaa

SEQ ID NO: 5228 - DNA, 201 bp, Bos taurus
ccaaaattcttctaaataaataaatagaggtgtttttttattttctccattagagtttacagaccttttgaactcgatccacaggcccaagactaacaatgctttggctactgggacccagaaggagcaaacaatgcagagggcacgttggaaagagcagtggcctttggcagagggacgcacatccacacagccagccca

SEQ ID NO: 5229 - DNA, 201 bp, Bos taurus
ccatttgaaagtgactttaaaagtaaatttaaatgaaaagaaaataaaaactaatacatgctgtaacatggatgaactttgagaacataacagaagtgaaggaagctaatcacaaagaaacatattgtataattgtatttataagaagtacccagaatcagttctgaatattcactgcaaggactgatgctgaagctccaa

SEQ ID NO: 5230 - DNA, 201 bp, Bos taurus
atcatcaacttgatggacatgagtttgagcaagccccaggagttggtgatggacagggaagcctggcatgctgcagtccatggagttgcaaagcaatggacagacttagtgactgaacgatcacaaatttatgtaaccacttggaaaaacactgtgactccttgagccccatggatcttccatggtggataatgaatggtt

SEQ ID NO: 5231 - DNA, 201 bp, Bos taurus
tcaacttcacacagtctctgtcttccctcttaaggttcacagtatgatagcatccagtcccgagccctgtgtctggtagcacttcacagctgctcgaaaaagggtaaaagcacgtatgcacacctcaagcttgcttcataactctgaacacattctcacaacataaccttccaaaggttttacccgtatgtggtttcatct

SEQ ID NO: 5232 - DNA, 201 bp, Bos taurus
ttccgtgacattcaaggccagggtcgttgggaggctctgcttgccctgctcgctgtgccgtgtgctgcttggtcccggcatgcaacttcaggctgttagcactctaatgtgctcccgtggaatggcctgattacccaggcctttgatgtggaaatgtcatcctgacagtgagtggattccaggaactcttccagcagagat

SEQ ID NO: 5233 - DNA, 201 bp, Bos taurus
ctctgcccagctggcattgctctgtggctgtcgggcttagccattcacatcagcttcccgatacgaagtgtccactgtgctctctttagtctctggggcagaattaaactcgctgttccctggcccttctcattcatagattgtgttgctttcaccttccaggaagtgttcatgggtgtcatctcagtgacaggcagagac

SEQ ID NO: 5234 - DNA, 201 bp, Bos taurus
aaacaggctttacaaccatagtggaactgcaatagcttatgatttcatttgtctccaaatacttatgtttaacttttaaagtaatattatgtctgggatatagggggcaaataagggaacacataatggtatatcaaagaggactggcctcgggtgtgtaactgctgaagccaatgatacataggcttcactgtattatta

SEQ ID NO: 5235 - DNA, 201 bp, Bos taurus
aaccaggtcttaacatcattttttctctctcccagtcttggttgaagtagtatgccttttagaaatgggcctaaacctgtataacatggtggtgaggagacctacagctttttgcttcaacatccatgaccttggattttttaaagatcactatagctgggaatagtactgctctgtcttgtaatgcttaatgtcatattt

SEQ ID NO: 5236 - DNA, 201 bp, Bos taurus
agatccacatgcacacggtggggagggccctgagttagaccaaatacggactcggagaccaacaaagcaagattgactggccagaggaagccaggaagaattgcccccatataaatgatttaaatttccccaaagccttgactctctctaagcctggccctgtgtgtctatccacatgtacttttctgctcctaataaaca

SEQ ID NO: 5237 - DNA, 201 bp, Bos taurus
caggtccagttggaccctgaacttcatcagcacaccgcagggccttgggttcacccatgtgctctctgtgattatcaggtttccttcacgcctgtctttctttctgggcttctgaggccgggaccagtggccagagagtctcaggtgaaccctactgaatgtggaaagtggaacaaggatccaagctgctgctatggttac

SEQ ID NO: 5238 - DNA, 201 bp, Bos taurus
gcctcactgatattccccgattcctgggctcatcaggaggaatgagccactcgacttgatattccccgattcctgggcttatcaggaggaacgagccactcgatttggccagcctgagtcaagaaggcagaagacccttggaatgactgcttggctagtgccctgcagggacaaagcaggctcagagggaataagaaactg

SEQ ID NO: 5239 - DNA, 201 bp, Bos taurus
cagtttcgatcttaaacaaatagcctctcattaaaaagtctcgtgattttccaggcatgctagctcgatttcttttctagaagcttggggcctccaaacccggaaactgacatcatatcctaagaccaacaacaaaaattcactttgaaaacagccaccttcctgaaaatgactgggattcagttttcaccacagtaactg

SEQ ID NO: 5240 - DNA, 201 bp, Bos taurus
gtagactgcccagcacagtgagtgacaccggggagagaggatcgattcatgtcatcatttccctccacgaccttatttacggccgggcgcactgccaacacgcatccgcgtgatttgaaggagacagtgctggctctgtctgataaagggggaacacgcaggtgctggatataatacagcgccctgactctaggggacgtt

SEQ ID NO: 5241 - DNA, 201 bp, Bos taurus
ctctccctttgtcccagtgagaagcatgctgaaatttaatgaagacaatgagtctcagacaggctaaataatttaacccgtgtcttgtacctgggagctgtaggggctgtggtttgagccctggtctctgacacaaaatcacattcaatccccagctctccttgtggccacatgaatgtcggtcccatgaatgaccaccga

SEQ ID NO: 5242 - DNA, 201 bp, Bos taurus
ccctaaggcagtgggccagctttttggtacctcatgggagtcagtctggctgactatgatctggctgtgacctgcctcttgagaggaagggctattttttcgggctgaggaaagttctatgaaggacagggcacagatgtgacagatcagtggggagtcagtggacaggagcatggttcacagaggttttctgaaagctgg

SEQ ID NO: 5243 - DNA, 201 bp, Bos taurus
aatgagttaagttcacggacacaaaatgttgaataagtgttaagtgttatttttgcaaacatttcaacttcctgatgggtggtctggaaattttctttcctcttcgtctagaccagggtttctgaaagcctagccatgtggctaccagagtcagagccagagccatccacaactggctttgagcacagtatttagaaacaa

SEQ ID NO: 5244 - DNA, 201 bp, Bos taurus
taatggcacttagggcaaaaattacatactgattcagagcggttttagagtaaaagctttgggaagtctgagtgctttaagtggagattctgcatactggagtgatccaaaggccccgtgccacgtttctttcatttcctcaatgcattcaactctgcttctttttagatttcatggtaaagttctaggtagtgactttga

SEQ ID NO: 5245 - DNA, 201 bp, Bos taurus
tcctcaaagggcttaaaattcagggagtaagagggctacagtcagctgaggaatgaaaaaggaaggtttaaacaaaacagattttgtaaaattttgcaaacggagtgcaaataaggtaggaaacatgaacacaccaaacaataagatcaagtcaaggaaatagtgccaaaggacaggaggggattgggctcatttccgggg

SEQ ID NO: 5246 - DNA, 201 bp, Bos taurus
ttgtcaaaaaaaagagttaaaactgaatgataccacacacgtcgctcgagagcactggaaataggaattctcatatgctgagatcacttctcagggtctgaaagccccgacgcatgaagtggacagatgtctgcatccccgcccgctcagcacataccgccctcctggacataccgccctcctggacagacttgcccttca

SEQ ID NO: 5247 - DNA, 201 bp, Bos taurus
aatgctccttccctaatcttattaccgagcgtctcttctcatcctccagaacctctgaaaacattgcttttccctgacgtctactgcctaatgtcttctctgcctgcattcctttaatttcagacttgatactggattaaacattcaaagcaaatggaatgtggcctgtggctaaaggtacaagggggaaaactatgtcac

SEQ ID NO: 5248 - DNA, 201 bp, Bos taurus
cactggtgagctacaatctatgtggtctcaaagagtcagatctgactgagcaactaagcacggcagagcacagcacaactgagattatgtataaaagtttctatctttttcacatatatatgaccatttttgtatatcattaatattaatgtattttcttattcactaatcttacaatattctagtttatgaggttatcat

SEQ ID NO: 5249 - DNA, 201 bp, Bos taurus
tcttcacccccttgcagctccagggacacccctggttccctgaaagcttgatcacaacccatccctcattctctgttcctcacgcttctgtgagcctctctagatggcctttcctctgacatgcctggcaaaagctaacagcatcactccaccccccgggtttcaattttcttctgagtgtctggtagataggggttccct

SEQ ID NO: 5250 - DNA, 201 bp, Bos taurus
aaccattgctcaccattgtatagatttctagaaaatttatatgcaaacacaggtccttatgtatataaaagatttcagaaaaaaaagctttattttaaaacgtaagagtccttacaattcttcagatttaataatcgatggttacaagaacactgggtttttgctctatgatttaccccatgttgctctcaagaagggatt

SEQ ID NO: 5251 - DNA, 201 bp, Bos taurus
tggaggcctcacaaggccaggtctgcactcacttctagggacctcatctcaccccagatttcagtgagcaaggatctttaagcaggcctttcccactctcccactctctcagctgagatgtccctcaggcagtttccaaaagtgtcacacagagagttatcacctggcccagtgatgccactcctaggtatatatccaaga

SEQ ID NO: 5252 - DNA, 201 bp, Bos taurus
tcctaggagctgcagcatgctggcataagtctttttgaaggaggtcaccattgttgccattatccctaccatagtttggcctcaggacaaactacaaggacggaacagagcctaattcatcaacagaaaattggattaatgatttactaagcttggccccacccatcaaagcaagacccagactcccccacagccagcccc

SEQ ID NO: 5253 - DNA, 201 bp, Bos taurus
gaacctattaatagcatcgttagtttcaaggaggcagcttacatggaatttggatcttaatgtacagaaatagatactcatctactttccctgcaatgcaacaactttaatggaataatcttttcaaaatgaaaactctgccttaatgaaagccccctttttcactgaaataagaaagtgagacaacaaaagtaagtctct

SEQ ID NO: 5254 - DNA, 201 bp, Bos taurus
tgtgagacacagacgtcctggagagcgagcaccaggaagggacagaaggaagtaacgagaggagattcaaagagagcaacagggtcaggagaagagtgccggggaaaatcagattccctcggcctcccctccagttcaccctctacagaggccgcatgcacatttccctatcatccaattattaagattataacactgacc

SEQ ID NO: 5255 - DNA, 201 bp, Bos taurus
gagccttttattcaaagctccctcaactaccagatgcccacccccacatctgcgctgatctgccagaccctccatcaggacccactgcaaggtgggaggatggcggagggtcttcacttcctctggttaagcctcccccttatgcaaccattgcacactcccctgtactttattccggctccttgatgctttagtctgcag

SEQ ID NO: 5256 - DNA, 201 bp, Bos taurus
gcagtggaaagggtcaataagcagataggaaccggagtgtagtaattagggaagcttcggcactggaatacggagagacagaacaggaggttgaaagggacctggtgagtcagttttttctgttgatgcccacaagtgacagcatgatagctacctggtacctgtgttggtgtggggcccctcgagagcctgggaagtcac

SEQ ID NO: 5257 - DNA, 201 bp, Bos taurus
taaggaggatggtcagctccaggtcacacaggccttaggggcagagctggggtctggctgagggttaggatggggacccagagcatggtcaggaccagggcgtctgaacctctgtggccgtgagggtcccgcgtgaggaagatacacaggtccagcggtgcatcttcctcacgtctcaggtccctgtgagcgagtgctcct

SEQ ID NO: 5258 - DNA, 201 bp, Bos taurus
cctggcgtgctgcgattcatggggccgcaaagagtcggacacgactgagcgactgatctgatctgatctgatctgggcaggtgacttcacttcactgagctgtttcctctctgtgactgaggaaggcctaattcctgcctccaactagaggcaggaaaaaatggtaatgcagtgtggatgttgccaagcacactgcttgca

SEQ ID NO: 5259 - DNA, 201 bp, Bos taurus
gggtggtcagtgcggcaggggccgtgtgtccgcggagacgggcggtgtcccaggagcgcgccctccactgtgtccagggcttctctcgtccatcacctcccggcacagatgtgtgccttacggccacaccagccatcagctccaccttttcacaaagtatcgtgagcttcacaagggcacccacctgccaaagcagggttg

SEQ ID NO: 5260 - DNA, 201 bp, Bos taurus
ttctggtagcatacgcttctccttttcaaaagtctcacagagcagaggtctgcgcatgctgccgggcgctgtgccgctggccttcggagggagcgttttgcagcgtggtgtctgtgctcagcgcgccgagtcactcgctcagtgctggcagcactcaggcccggttgtatcgggtcaggtatcccgcatctagaaccccca

SEQ ID NO: 5261 - DNA, 201 bp, Bos taurus
ctgagggccctgtacggggcaccagccttgcgaaggcctccggctcgcagaaggaggcgtctctggactgagaggccgtttgggtttttgcaccaacgtgcgcggtgagcccacagctgctaggaacacacagcgggcttggctttcctctgtgctacttgtttcaggaggcaaaggcttacctctacaaggcaaaggcca

SEQ ID NO: 5262 - DNA, 201 bp, Bos taurus
tccatgctctgagcctccctttcctctctgctcggtggcccgccaggctcggaatgggacctcacccacaccttcttctcgcccaggtgtctgttcttacgttcagggcagcccccctggtggcccccagggttgggacttaaagccactgtccgcaagtcccgaaagctaagccccaggcatggctgcaggaataggtcg

SEQ ID NO: 5263 - DNA, 201 bp, Bos taurus
cactgctgtggagtgaattttggcagccactggcctctcaagaccctgtgtcctcaatggggctcgttgttctctgcacaggaagggaagactatggtaacgcttgggaagggcccagcacccagccacgtgcatagtaggtgctcagttaacgcctgttccttcctacgcacacagcccactgcctgcacagagctcatc

SEQ ID NO: 5264 - DNA, 201 bp, Bos taurus
cccaaggccgaaaccacagaaccacggccgagcttcactggagggaggaaatccgtgcccaggaaggctggcagctggagttctgagagcatcacagctccgcggccccaacagacgggcgcgaggtttccagagtgaaataaacgctgccgtcacccagtggagctgagaatgtcaatatcatttgacatcatgctcatg

SEQ ID NO: 5265 - DNA, 201 bp, Bos taurus
ctctctggtcctttcagagcagggtcgccaagcctggtcccgggctcctaactcctggggctgcccaggagaaggctgggctggaggcccatgtgagtggttgcagccaggatgttggagttttgttatgaaataaagagctcgtccagatgggacagaacaggaacccgagacggtttcgtggaggttgcagggagaagg

SEQ ID NO: 5266 - DNA, 201 bp, Bos taurus
ccgcggagccctcctgccgcccagggctcccgggactcgggtgatgaggaggctccctgccctccggactgcccgggcggctcaccttgccctcctttgcataggccagcaccttgtcctcctcctgggggtggaagatgagcgtctccacggagaaggggacgagctgcttttggaaggtggcaccctcgtccgcgctga

SEQ ID NO: 5267 - DNA, 201 bp, Bos taurus
atgggaagagtttccagcattttgcacgaggcccactgcaatctcaggggtcttcacgagtggaaggagcagaagggaacagaaaagcacacagaatcacagaagaatggccaaggagctgctgtacgactggctgaagatggaggaggggctgcaagccaagcacctcgggtgcctgtagacgctgggccccaacagctt

SEQ ID NO: 5268 - DNA, 201 bp, Bos taurus
tggggcaagaatcttggcaggagctgaagggccgctttctgctccgtgaagacgcatgtccatgccagcatcggtctggacggagctgtgtccactttctagggggcgaaggaccagggccgggctttacccagtggggtcccaggttccgggggcggccgctgcccactctgagcgctcacaggccgttctgcccacagg

SEQ ID NO: 5269 - DNA, 201 bp, Bos taurus
cctctgatttggaactttttttcctcttaactgtgaagaaaaaagataatgacaaaaaggcatgtttcaatggtagactttaatggggaaaaaaaaaaacatcacaataaagcatgcattgtggccaactttctttccccaaattttcactcatcgagtacctgctttgtgtctgtgattctagagtctagagaacacagc

SEQ ID NO: 5270 - DNA, 201 bp, Bos taurus
ttgagcgcccgctgtgtttagtgtcacagtcctgccctcctttggcgtgctacggatgatgtcctgggatgcaggcgggcctgccctgctgtgtgcaaactgctttgttcagtaatgactgtaaactaaactggtgtcgatggactcacgacagggggccacttgcattttctcaatgcaacttgagaatagaaggtggat

SEQ ID NO: 5271 - DNA, 201 bp, Bos taurus
ttctcaggcgagacagaagaggctctgaggggcaggggtggggagggtgaatcaagggacatgcagggcatgaccagggcctggatcctgtcaccggatacgagggacagctgtccccaggctaccggcttctgccctcaatgttccggaagcatctgtggagacgagccccggaagccaactctggggccatgaccagcc

SEQ ID NO: 5272 - DNA, 201 bp, Bos taurus
atctgcccccctcccagccgagagcgagacccctttgttcaatctcaaaccccggtgtagccccagcagctgcaccccgactagggaagaacaggctccctggggcctgtgcaggagaattattgtcctctgcaaacgcctcctgcagcgactcagccctgagggacagctggctcccggacacccttggctctggggttt

SEQ ID NO: 5273 - DNA, 201 bp, Bos taurus
tagcctcaactacagtttacaatcccagaagaggaaacaagccacagctattgtcaaagccatggaaagtgcctgaaacagtagacaaaatgccacagatgcagtcaggaccccagaggtaacaactacctccaggctgtgagcagacacaggttactgcccatatcttgcctggagtctaaccagcttcactcttcctag

SEQ ID NO: 5274 - DNA, 201 bp, Bos taurus
aaaaaaaaaaaaaaatcccacggcagtggagttgcccctgtggagatgttcctgcaatttcacatggacagacagtagactgaacttggccatggaagataaaggcactgtgcctgtggtgggtggctcttctagccccatgagtgcaaggactggaacacgagtcccaggtgatacctggcattgggttttgcaatgtac

SEQ ID NO: 5275 - DNA, 201 bp, Bos taurus
agagtggtgactgttgtgacattcctctgatagagtatgcaggaggagaaacaggagccaggggcaatcaggggttgagggaagggtgggagatatgtacgtttcgtttggccctatgggatttggggtgcctgaggaccctgaggtgtagtgtttggaaggagcttgggagttggtccagatctggcaagaagtgcttgg

SEQ ID NO: 5276 - DNA, 201 bp, Bos taurus
agcaagtaaccctgcccaggccttctccatctagaagtcagaccccaggcagactgagaagtcagttgcaatctgctgtgggaagagcggaagagggcagacagaggccctagcaggagagaagacttataaccagggagaaacccagtgtcttctgaggaggtattcttggtgtacctgtggagctaccctatgggaagg

SEQ ID NO: 5277 - DNA, 201 bp, Bos taurus
acattccactgcctcaacgaacatgacatgaagccacatatgggtcaagaggagctccaggaacgcttgggtgcacagccccccaccccccagtagaactcacctttatggaggatgccctccattgtccttcagggtagcccacccagaagcacaccctctccactagatggagaaggaaagcagagggttctggacccc

SEQ ID NO: 5278 - DNA, 201 bp, Bos taurus
gttggaaaggaagccctactgaggaagacttgcagaaaagcaggtgcttgccctggacttgggaagatgaaggttggccagaaacacagaagcgggagggaagtcatttcaggcagagagacctgaaggtgtgcaggagctggagtctgctgctcccagggggcttgataatgcttgagagtgagccagaggccctacaga

SEQ ID NO: 5279 - DNA, 201 bp, Bos taurus
tgcagtctagcaaaatgaccgggttgtgtgatgctgcggttaatcctgatgctgtcactcctcgtaagcattctgtccgccagcttgtgacatccatcagttttatgagcatgaacaggccttctgaaaatttatccacaaggtgactgactgccttgagtggcaggaccgagccttgaggcagacctagcagtcacagtg

SEQ ID NO: 5280 - DNA, 201 bp, Bos taurus
ttgtcctccccaacgtgagggggccgcatccaatcagttggaggccggaatagaacaaaaaaatagagaaattgctggctctctacttccgaccctgggacacaattctcctgcatttggcctgaaattcataccactggctctcctgactctccagcttgcgcacagcagatcttgggactctcagccaccacagttact

SEQ ID NO: 5281 - DNA, 201 bp, Bos taurus
taagggttccaaataatatggtcgaaaaagataaatttggttttctaaaaactcagtgacaaaaaagaagattaaagcagcagaacctttgattgggtttctgtctttgtcggtctttttatttttcagaagtgcctttaatgtttggcttcgtcgggttttttttaaatacttacatgtgttagtcattcagtcgtgtcc

SEQ ID NO: 5282 - DNA, 201 bp, Bos taurus
caaccccaatctcagaggcactagccatgcacacagggcccagggtctcagacctctctgtaccccaagactccctcaagtcggcctgcctgcctcaagcatactccacatgaaaagccggctctgcctggaccagccaccttcatctctgtccctcatgaacttctcctgcattgggagccacactgctgaggcctgccc

SEQ ID NO: 5283 - DNA, 201 bp, Bos taurus
aggtcaccttgaagtccttgaaggtcagtgtcccagtggccatggagcacatgctggattttttttattgttttttggactattaaaagacttataccctccccctggccccagagtccaacttcccatgtgtcttgttatgtcttaagccaactcccttctctggcctgcactgtttccctgctgttactgatgtgaact

SEQ ID NO: 5284 - DNA, 201 bp, Bos taurus
gggctcctagcttagaagaggatcctcccatgttgagtagactgcaactggtaaagagcattcctagaaatgaattcgagcatcccagagacattcacggcgaggcttttgccagaagtgtgttggagtgtcctccaaattcccttcttacccaatgggactttgagcatcctctactttcccaactggagagtctctgat

SEQ ID NO: 5285 - DNA, 201 bp, Bos taurus
acccgtgaaatggccacctctgtgccagccaggccgagctcaatccattgcaatcatggagatggctggtatctggtgcgagggtggggcctagctttagcgtgtgctgcctgcaccgctcaggagccttctccctgtgtccatgctcaggtccttgttcagtgatggtcaggaggcccactgggaggcatctgtgggggc

SEQ ID NO: 5286 - DNA, 201 bp, Bos taurus
ctcttttgtctgacacagatccctgtcagtgtatgtgttgggggggatgctcaagaaactgcaagaactacacccctaaaggccacctggctggcatgttctgtttaattagcattcccctgacatattgcttaccaaggctgctcccagccagaactctgcctgtgcgtctgacggggccattgcacccgctgtttgcca

SEQ ID NO: 5287 - DNA, 201 bp, Bos taurus
agatgtgtgcagtgggcctgggggttaggctggttagtcacctcggcttcacatccatccacccatccatccatccatatgtcaggctttctcttccaccaggtgtcactgtctctgatggttggccatcaatgtgacaaggcagcaatgatgtgatggtgagcaaggggatggggaggggcctggaggaagcacagagag

SEQ ID NO: 5288 - DNA, 201 bp, Bos taurus
actatgtccctaatttagggattatccaagggtgagagtcaagctgaagcccagaggaactgggtaactcaggaatttagatcaacctctgccttccagaaaggggtcccgtgttctgaaagctgggtttagtgcaatatccagaatcatgggctgtgtatgaggtcaagtcaccagtcctcaagagcaaactgggtggta

SEQ ID NO: 5289 - DNA, 201 bp, Bos taurus
gaagccactcttgggatggctcagaagcaacacctaggctcctgtaaatcaatctggactgaaagggaaagaagtgaaagtgacagggaagaaggctgaaaaggaagatgccttacaatcctattggggaggcggtggccaggggacaatggtctctgttttccttcaatcactacgtgcctgacacggcacatggaaatt

SEQ ID NO: 5290 - DNA, 201 bp, Bos taurus
tatattgcaatataattacaaccataacactaattaacacctcttaattaacactacttattaatatcacataatcagcattgcttatttgtagaaggaacaattaagatctaatctcttagcaactttaggtttataatacagaactggtgaccataatcattatactgtgcaatagatctctaggacttatttatctac

SEQ ID NO: 5291 - DNA, 201 bp, Bos taurus
tccactccacaggggctgccttgctcagctcacaatgcagggtggctgtggccccttctgtggcttttttgttcctcaggtgttttgtgaaactggtgggcaggactggtcacaaagatagacaggccatcacatggggtgaacacacagagaagacacgaggtgaagagaggagcgggaacacaacacccaagaggacac

SEQ ID NO: 5292 - DNA, 201 bp, Bos taurus
ccactggtcccccaaggagttccccagggattcattaagtatggcctgattctggagggtatccctcctgaatgctttacatttactcctgtcaggtgttccaggagtatccttggcctaaagcttcatttttagcctaacttcttattctggggtcccaaatatgataaattcacattccgatccatttattttcgcacc

SEQ ID NO: 5293 - DNA, 201 bp, Bos taurus
catcttggcactgccaggctcctccccctgaggccaagaccctcccctcttgcaagcctaccagggagcctgcggctgacccatgtcacccctacagcccttcgcttttccagaacttggccactcttgagtcctggtgggacttgggccattttccagatgagcccagggtgagaagtggttcgcagccacacagaagaa

SEQ ID NO: 5294 - DNA, 201 bp, Bos taurus
gcagagttcttcaaggggccagaaacaaccacatcaaggccctaccatgtctcccaactgccccaagtctcaatgaagcagagttcaatggtaagacaactaacacctgagaacctaggagggccctggccgagaccaagagccaatgcctcctaacaagctgagagctcagcataccctgcaggcaggaccgggtgagtg

SEQ ID NO: 5295 - DNA, 201 bp, Bos taurus
gcgactccttcagggcctggggtccaggggtctccgagtagggccggttctgctttgcacagaccccacccttaccctaagggtacatgcagctatgcccttctccatgaggcacggcagggcctgctgaggtgtgtgtgcaactaccccaggctgtccccagaggagcctcagcctgcagcgtgagtactggtgtctgct

SEQ ID NO: 5296 - DNA, 201 bp, Bos taurus
gggtgggcccggcacctgtcgggggttttgtgggtccttactgagagaagtagagggatggcttgcaagatgccattttgaaaatgtaaagaccctgaagtgggcctgagctggcaggggtcccaaatgggttatgcggatgcaaatatgggctgatttgtgtgaaggcatagtgtaaaggctgtgtcctgggatgtaggt

SEQ ID NO: 5297 - DNA, 201 bp, Bos taurus
tcttaccttttcgggagatggatccccatcctgtagcccagcaagaaaggttccaaagagtcaagtctgggggtgcaatacagatgggaagcacagagtcggaaaaaacaatgcgggttttcagctgcaccagagcgatgtcacctccaacaggatgatacaattcatatgtggggtgtatgatcaccctattcacctcaa

SEQ ID NO: 5298 - DNA, 201 bp, Bos taurus
gcactcaaagagaagatgagccaggcttaggaaaggagggtgggcagcagcctcgctttcttcagtggaaacctggcccaaaggcttcctttggctgtgagaaagctctgcatggctgcagcgaggaactggagaggagctgacagcactcggggaggacggggtctgagggacgagggtgtgagtgtcctgctgccccct

SEQ ID NO: 5299 - DNA, 201 bp, Bos taurus
gctcggtgtgcctttcctgccactctccagagggtctactcacctggtaggatccacttggttccagccgtcacgcttaccacctaggccgcctgagggtggcaggagagctcaccagctgacctgcttgtccccttcccttggcactgcttctaggagcatctcaacagctgtccccctcgcggcctccccatgtccaga

SEQ ID NO: 5300 - DNA, 201 bp, Bos taurus
tcttcccacctgcaccatttccagcccttgaagcccaggagactctcctcctcccccagttcccagcctggccacctaggccctcaatctgtctacactacacattacaacaaaagtctctggaaagttcttctggactctggttcttaacaaacattggtccactgttactagatcgccaccttctggccacacatttta

SEQ ID NO: 5301 - DNA, 201 bp, Bos taurus
ccaaaggagaactggatctcagtagtgctgggtgccacaaatcacacaaaagagtaaatttgaattagtagctagcatgttgaggaccttggcaagaacaatttctgttaatcagagtgaacagaagccacattattctaggttagatggaagatgtgaacttcaggaagttaaaaaggggaaaaaagtttgtatttcagt

SEQ ID NO: 5302 - DNA, 201 bp, Bos taurus
aaggccagcagacagcagagatggcagactggcctaagaaccatctcatctccctcgggaatcagggtgcttttatacacaagacagagagtgggaaggcgctttctgaggccgggaccagtggcagaacagggccgttaattggttggggctgacagttgctgacttgggcggaggggcccacagggggctgacaaatgg

SEQ ID NO: 5303 - DNA, 201 bp, Bos taurus
tgatggcacccttgccaaggggcgaggtaaccgcatctataaagtgctcacgacagacactgtgcctggcgtcctgtgcgcagcagggcgtccaggccgcgtgacaagctcttaaggggacacccctaccgccctgtctcaagaagaaacagcctggggagctgaagtgactgtgcacggctggccagacacacagccaga

SEQ ID NO: 5304 - DNA, 201 bp, Bos taurus
tactgggcgcaccttgcaggacccctctggcctcctccacggcccaccccactgccatgctctgtcaccagccgcctcacacagacctaggtcccagtcattgcagctctgtccccaaggccccagtgacatgactgctggaagtgggggctccgcggtcccccgtggtccaggactccttccagtgttcatcaagttttg

SEQ ID NO: 5305 - DNA, 201 bp, Bos taurus
gagagggggagtggagggcagaggaagggagaggggatattttttggagggaacccttttcttctaacttgggagcaatgcagtggaggcctagctcagatttctcactcactattcccctgcaacccagggtgtagctatcagagacaagtgccatctgtccccacatgaataagtgaaaaaggctgagcccaactcatc

SEQ ID NO: 5306 - DNA, 201 bp, Bos taurus
tgggcccatcaaatgtcttctcatgtagagcctttgtgtggtcagcgtctattcagcagacactcaggctggactccactgacagctctcttctccggccagatgtgtctgtcagggatcagtttctgtctgtgccagttctctcttttctgacctaagggttggagaaagagcatcacacccctctggggccttgagtgg

SEQ ID NO: 5307 - DNA, 201 bp, Bos taurus
ccacacgtgaggcagcgtgagctagacacggaacactgaagggcgtctggagggactgccatgcaggagtgatgcggcagagatggcggaggtgcaaggcgagtgtcagtgcagatgggccgcggagccgggcagggctcagtcccagagggctcaggctcattgagagcctttggagggtctgcacagggagtcagggtc

SEQ ID NO: 5308 - DNA, 201 bp, Bos taurus
ctttccaccactttctatcaggacttccggggccggtgtctgtggctgtttatccagctaaaccgaaggtgatggggacaggcaccgctgacttgcactttgtgctcctgtggccagtctcagggttggtgctttcccgagtcttcctgtggctcccagagccctggctcaaacagccctccttccgttgaggcccacagg

SEQ ID NO: 5309 - DNA, 201 bp, Bos taurus
tcacggggcctccaaggacacaagactgatccaaggtctcatggctggagcctggagtgggtacggatcatcccacccacgggctgagtccccagtgagcaaagacaggcctagggggctggggcagaggttctcatcagcccatggagctggcagggccctccccatccggaggggaggtggaacccggatgacactcct

SEQ ID NO: 5310 - DNA, 201 bp, Bos taurus
aaaatgagccactgggaagagctgggaggatgggaagggtttggaagcccagtctctcctgccctgtgggcccttggccatggccatcacagtctttgggcttgatttctgcatctatgtcatggagatcatcacactgaacttgggaggttcaaataccccggaggtggggagggtctggtcaggtgttggggagtgcgg

SEQ ID NO: 5311 - DNA, 201 bp, Bos taurus
ttttctatggtagggcccctcccagggtggggcaggttgggggagggctctattcgggacatggacactcatgagacttcccatactggacatcagccctgagacaatggcgatcaaggggcctgtgggccaggaaagggggcacctgaccctgtgtcaggacacaaggagacatcctagaggaggggtaccccttgtgtg

SEQ ID NO: 5312 - DNA, 201 bp, Bos taurus
ctggctctggctctgcacagagtaaagttctgtatgtgcataaagccaagactttgtctcaaaccagaatgtgctctggccaacaaccttccccgcggcacctcgtgccaggacagctctccctcctccgctccaagcaggcggcaggagtgcgagggggtgtgcagactttaaccactgcagcttcactaggccacttca

SEQ ID NO: 5313 - DNA, 201 bp, Bos taurus
ccggggtgcaggctcaggcggccacagacccctcacctgaagcatcatgcccaagagcaccaggtacgcttgacctggcacctctgtgccccaaccccacgccaagggtaccccggggcctctgaccacagctccctcagaacccagggagggtggggggtggttgctcccgttttgtcacaactagggtgggggcaaggg

SEQ ID NO: 5314 - DNA, 201 bp, Bos taurus
caaaaaaaaaaaagaaaacatttggggcctgggtctgtccgactggggtcagatcccagctctcccgcctctaatgctctgtgaccttcgctccctgagccgctccataaacccaggaggaggccatcggtcacctaggtgttgtcagggcgccaggtttggggtgtgcacctcagggaaccaggggcctctgccaacccc

SEQ ID NO: 5315 - DNA, 201 bp, Bos taurus
tccatgcctccaggacctgtgagttcacgttgccctggagaaacaacctgagtttgtacattagcaatattatctccaaagatcattttggtacattaatactgttatcgacatcagcagttgtaatcatctgactggttgattagtgttcagttagcacaggattgaggtcacacgggacaagaaagggaataaagtttg

SEQ ID NO: 5316 - DNA, 201 bp, Bos taurus
acccctccagcaggttatgcctccccggccagcaggtctgtgggaggtccccaagtgcccacatccctgtcaagtgtggtgaggtggccttgcttcctccctgttgccatggagagactccacaaggttccccagaactctctggaagggcgaagccttttccacaacccttagaagtctcgattcctggagagggaggcc

SEQ ID NO: 5317 - DNA, 201 bp, Bos taurus
tgcgcgcgcaggctgcagggattcctgtctggacgttgaccttggtcctgactactgctgggcgtctgacctaagttccacaataatagtacttaagacgctacgcactgttctgggcacatgacgtgctttaagaaatttgacagcaactttgtgttgctgcagtgataattatatcaccatatcacctcctatgttcct

SEQ ID NO: 5318 - DNA, 201 bp, Bos taurus
cttgatctagctccaacaccaggcagtgctgtgtgggtgtctccggaaggaacgcagagtgggctgcagagcctggaaagtgcccttatcatgtgggacacagccattacgttagccatctcccaatggaaaatggaggctctgagatgcccggtgggtcacacagcatttcaggggagagggttggagttggagtctgtt

SEQ ID NO: 5319 - DNA, 201 bp, Bos taurus
atctgattttctgctttactacagcttacttgttttcactttgagggttgttttcatgcgtggtatttttcatttctgtctgtttcttttctgaattttgctttgttctgtgcagatgggcccactttcacatggccggcatattttcctgcccagtttgggatgcacttcgagctcattttaagctccgggcctatctga

SEQ ID NO: 5320 - DNA, 201 bp, Bos taurus
aagtcagccatgtgggaatgctacgctgacttctccctcccaagttgccccagatgcctattctggacctgatgggtcttaaagggacatttggggctaggttttgaagtgtgaacaggagtttgccagactaaaatttcatgggtttattgagtcatccgcatgtatcaaaaaaaacattttttttctgtgcttaactgg

SEQ ID NO: 5321 - DNA, 201 bp, Bos taurus
agtctcccctctgcgggcgtcttgtcgaactaaagaaccctcaacagactacttacgtgaagaatggcgtttcatggtgccctgtggagaaaggggtggcgtcaggtccagcggcatttggccagtgctcccgccccacgcagggcatctccccacgcctcaccccggggccaggcgcctcacccctgggccgggaggaag

SEQ ID NO: 5322 - DNA, 201 bp, Bos taurus
cccctgccccgcccgcctcaccctgcacctgtgtcctcccacttcccctgggccaagttccccagaaccggtggtttctgtaggggctgccccagggtgcgggtggagaaaaaagacctagctggccttggagggtggatgaagggcagacatctggcagcacatgagagcaactgttagtgtggggagggcagggaaatg

SEQ ID NO: 5323 - DNA, 201 bp, Bos taurus
ggaggcatgtttagagaattcacatagaaaagaagcgtagcgcagagtgaatttcttacccacccttattcccagaggccacggttaattgtatctcctttcggagagattcgaagtcaatgacaaatcttccttactacggacaatactatagaaaaaagattcaagggcacatttctttggccaattgtgcaggcttat

SEQ ID NO: 5324 - DNA, 201 bp, Bos taurus
cactacctctgccccctcaccccctcctctcatgccccctgctgccctcacaataagaccaactgcctggccctcttttggaggccccagcccccctgactttctgccttcttgtcctcctcaatcccctgctgatctgagcaaaccaagctctggctccaggggatagagcaacaacctcttcaggccctggggtgggtg

SEQ ID NO: 5325 - DNA, 201 bp, Bos taurus
gtaggcagcgttgctccctctgggggctccgagggagactgccccaggctgctcccctggctgcttctagtcgctgccagcagtctgtggcttgcggccatgtcaccccacctctgcccccgctgtcaagtggctttctctgtatgtctctacatcctcttcttgcaaggacaccagtcatattggatttagggcccacgc

SEQ ID NO: 5326 - DNA, 201 bp, Bos taurus
atcttcccggaccaggggctgaacctgtgtcccccgcactggcaggcagactctcaacccctggaccaccagaaaaggcccagtaccttttttttgtcagcgtgtggctgacacagtttttgagtgtcgtgccctgaacccattttcccaaaagccctgtggccggcgtatgtacagagtgcggtcaccctggtgacgtca

SEQ ID NO: 5327 - DNA, 201 bp, Bos taurus
agagtgaggcaggactgtgccagcgcaggatttgatcctgtcgttattttcactttttgactgtgctgtgggatcttagatccctgaccagtatcgaacccgggccccctgcattggaagctcggagtcttaaccagtggactgccagcaaagttcccatcctgtctttattttaaatgttgctatttggggcttcgctgg

SEQ ID NO: 5328 - DNA, 201 bp, Bos taurus
cttacagagactgtgaggctagcatcatgcctggtgtgattaattgctattttcatttatttatttttatttggttgtgccaggccttagtcccagcacaggaaatcactgagcctcattgcggcatgcaggattttcagtgggagcacctgaactcttgcttgcggcacgtggaatccagtttcctgacgagggatcgaa

SEQ ID NO: 5329 - DNA, 201 bp, Bos taurus
tggaaatcccatgtctaccacttcctgacatttttaaaaggctttttttcttgcaacagaatggtggtgatcttaatgaatgtagctttatgttgttgaagaagaaagcacgacaacctctgcataattcaggaaactgatattttccaagggaccaatgctaccatgttcataggaggtccattcggacaaacccaaaat

SEQ ID NO: 5330 - DNA, 201 bp, Bos taurus
ctcatttgtatgtggtgtgactcagttgttccttccccatctgttgttagtttttcaaataaccattttatcttggaaagagttaggtttatagaaatgttgcaaagataatacagagaattcccttatgctattcattgacagcacaagggttaggggagttgaccgtcctcgaagttgaagatccaagtgtaactttac

SEQ ID NO: 5331 - DNA, 201 bp, Bos taurus
ggccctaggtgagttggtggcgtcttttcttggtgaagtccatttatttgatctgacctttctgtcacttgcaaccaagagagccagctgagcacagtgtctggtctctggcctcctctctcctgccctgctccagcctctctcagctgcttgtcagctcctgacctgctgttgcacccccacctggatagtctgccctcc

SEQ ID NO: 5332 - DNA, 201 bp, Bos taurus
gtgggtgcttaaactttgaccatttcatggcatttcggggggaaacttccccttcactgatgaaaggtggttatcactaagggatttttcttatgagccacttcttcttgaatctgatttctgccgcaaaggcttactaaactcttttcggcaatgacttcgggaacctctttgacgtatctgcactcagtcctggacttt

SEQ ID NO: 5333 - DNA, 201 bp, Bos taurus
ttcgatagtctgtgccaggctaaatgctgccagctgcctagacgctcggcttgaggctctaaacacaggttcttttttattcctgttttaaggtctatccgactatttctgtgcaaaaacagatttaaaatctcgatggctcagaagccgctggcagctgccaaggccgccctgttctctcaactcccctcaaggggaatc

SEQ ID NO: 5334 - DNA, 201 bp, Bos taurus
aggaaaatgggccccacggtggcaagtgtgtgaacaatagttttgggggctgaatgcatctctgagcttggagcacaggtcaggtctgagaagaccactgtgggcctctttccatcagagccaggctgcccacggagatgggcagggctggggagcagcttggagccctgggacaagttagctagcgccctttgctaactg

SEQ ID NO: 5335 - DNA, 201 bp, Bos taurus
caaccaccacaacatatgtttacatataatgaatttaaatataataatgcattatatatttacatataaatatcatgtgtagttacatgattataggcagctataaaaaccgggacattgacactgacactaataattaactaaagaccttatttggaatccaccaattttaatattcacgcaactgctgtgaaatgcact

SEQ ID NO: 5336 - DNA, 201 bp, Bos taurus
ataaatgaaatgggcccaccagagaggtggatgtcacaggaagagcagcccccaatcctgcaccagccagaagccttcattgctctgggtctgcagatgagtgagactgagggctggcctggcagggggcctgggatactacggatgcccactgcgtcactctgccctctggtttgaaatattttcttctcattgttcgag

SEQ ID NO: 5337 - DNA, 201 bp, Bos taurus
aaaatcaggaagctcagaactatgaagcctctggtctccagggcacacagcctggcaggagctcaagtcctatttccaagcaacccagggcctggggtgaaacatgacttttgggaacagaatagaatccagcctggctgtggattaccttcatcagattcagagggtaaagggcccagttagaagaggacatctagaggc

SEQ ID NO: 5338 - DNA, 201 bp, Bos taurus
tgtacccaggacatcacgcttccagatggccgggtcatccccaaaggtgctcacaatgactacaggatgaggctcctggtcagaaagggggcccatcaggcaggttgaacctaattctgactggtcctcctctcccacaggtgttatctgcctcatcagcattttcgggacccaccacaacccatatgtgtggccagaccc

SEQ ID NO: 5339 - DNA, 201 bp, Bos taurus
gtaggactcagactgagcccgggacctacctgtccgtccctccccacctcccgctgctcataacacggagcacctccagggccccatctgacacaccatttcttcattctgacctctctccatgctctgaacgctaaaactcggactcaacaggcctctcaggctcctttctccaaaaaaatagaccatgaaaactcactt

SEQ ID NO: 5340 - DNA, 201 bp, Bos taurus
gttgcgcggaaagtgccagcaaagcgctggccatcttcttcctgagtatcctcgtggtactaatctccttcctccttatccttctctcctacgccttcatcgtggccgccctcctgaggatcccctcggccgctggccggagcaaagccttctccacctgcgctgcccacctcaccgtggtcatcgtgcattttggctgcg

SEQ ID NO: 5341 - DNA, 201 bp, Bos taurus
acacaccacctcctattaacaaacatatttctaacttttactctcttcttctgtattgttcattttaatcttttgtggttaaatgtatttctaaaagttgcgttacctttagacatcatgtagaagtcattttttaaccatttgattaaatgttacccttgtctttcatgaacatatttgaatccatctatctttagttaa

SEQ ID NO: 5342 - DNA, 201 bp, Bos taurus
gatgtaagtggagttggaatgttgccaaaccaaggaagttttaattcatcacattgtctgaaggggccattcaggcttatataattttcccctaaggcccatgtgtccattcttctgtctctctctgtctctctcagactttttaaagtatttctttaaatacagggtagaaagtggccataccaagaaggaaccccatgt

SEQ ID NO: 5343 - DNA, 201 bp, Bos taurus
tgtcatggcacacagcctggtggggctcctctgggccccgggacacggaccggaagcgcaggaatagcgggatgttgtccttccggaagccctgcaagggcgttcctgcgggtggccacaggggggcggcggccccaggccagccccgagaggcttgggccacaccaggggcatctctgcagggccttgagggagaggcag

SEQ ID NO: 5344 - DNA, 201 bp, Bos taurus
aaattgtccaacttcaggtccctgtgagagggggtggaagaatgtaaagagggatgagtggggaagtgggttctgcctgaagcctgagggccccccagtgggcaaagcgggtatgtgcatgtatgcacgagcccacaggcgtgaacctgcacacgcacacacacctgtagacaatcttgtgttcgtggagaaactgcagcc

SEQ ID NO: 5345 - DNA, 201 bp, Bos taurus
aagagagcaggcagaagacgcgaaaggggaccagggcgcaggtccagcctcgttccaggaatcacagtctccgtccaggccatgtctgctacatgccaaacgcatgcatgtgccaggggagtcctacactgtcctcccagggctgatggggtagaggcagggacccaggccctccccagcccccaaggtctgaccttatgt

SEQ ID NO: 5346 - DNA, 201 bp, Bos taurus
agaagcccgaggtattatattgtcctcccagcccttcaccccacccgtacctccccctgtgggtcatgggagaaggtcacaaacccaactgaaaccagtcacctctgattgggacctgaacccacatggccggggctcaaacctggccaaaatccacagtctttcagttgagatcacacagctggttttgggacctaatgg

SEQ ID NO: 5347 - DNA, 201 bp, Bos taurus
aattcctgaattagggaattctgggtctttctcagatccactgttatcaatctgggcacccaaatggtggcaattcctgctgagctttgacccgactgctcccatcttcccagcagctgggaatcctccaaaatcttagaagcccagctgagcccccttctctggctgtgcccaccctgaacccccaaaatctcgcagctg

SEQ ID NO: 5348 - DNA, 201 bp, Bos taurus
ccaattggaaggcagaaggaaaggagggggacggggaaactgcaggcttctggttcagacagcagggtggacctagagaaacgaagagggtggggccagggagcaccttccgctctcatcatcaccccccacacgtagagtctcatctcccctcgcccgagtcagggcacatcttgtccccactcagtctcagggtgggcc

SEQ ID NO: 5349 - DNA, 201 bp, Bos taurus
tctggcctggaaaatcctgtcgacagaggagcctggcatagtcggacacaacttagcaactaaacaataaattgcatcacagaggtatttggtttttgttccactggttgctggccctacaagatgaggatggagatgttggtggggatgagagtagggatgctgttgagaggaaagtagtgatagttcagggtttggctt

SEQ ID NO: 5350 - DNA, 201 bp, Bos taurus
ggaggtgccccaggagctgccccttggcctccccaccacccacacccacctggacaacggcctgctcccgcatgggccgcaggttgcgaccgcggagatcggtcaccacgaagggcagggagatcttgtcatcctcgaactctaagggggcaggacaaggtggtagggatggcggtgggaggcctggaggctctcaaggcc

SEQ ID NO: 5351 - DNA, 201 bp, Bos taurus
gcctccactctggatgcccagcccgacgccacctctctctctcctgtcagcaagttgcaccgcctggagtacctggacctgtcccacaaccagctggctgcggtgcccgctggcctgcctcgcaccctggctgtgctgcatttgggccgcaatcgcatccgctgggtggaggcagcccggctgggcggcctgcggggcctg

SEQ ID NO: 5352 - DNA, 201 bp, Bos taurus
agttgatccctatgaccttggacaggtgtcttcgcctctctgggcctcagtgtcctcatctgtacaatggggataaaaaagtatgatctggccaagctgacgccagggttccacgagtgctcagtccaggaaagccataactgtctttcttatcccaggttcgaggccttctcctcccggactggagctgctactgcaaca

SEQ ID NO: 5353 - DNA, 201 bp, Bos taurus
acagacaaacaaacccaaccctccagggattcccatggctttgagaatcaactcgagtccctttccatggcctgcggggcccctgcttgcctccccaagccctctctctctgttccagtcacactggcttcctgccttaggaggctcagtgggtgcaggcccactgcctcaggtgctcttctaccagcagtccgtcctttg

SEQ ID NO: 5354 - DNA, 201 bp, Bos taurus
gcccaagttgtcagggacccagtggcaagcaacatagatcaagatccttgtatgcataacactgacatcctacaggggacaccaaaaggccacgaggaagccctcattggaggatgtgatgaggagtgcctacatccgaccgcagcctgaataatgagagggagccgacccgtcacagacgaggggaagagcattctagga

SEQ ID NO: 5355 - DNA, 201 bp, Bos taurus
agagaagccaccactgtgatgagaagcctgcacaccacaactagagtagcctccactcgctgcagccagagaaagcccgcccacagcaacaaaggcccagcgcagacaaagcataaaaaaagatgaggaaactgaggctcagagaggttactcaagctacagagggtcgcacagctagtaaaatggccttggtgagactca

SEQ ID NO: 5356 - DNA, 201 bp, Bos taurus
gccgtttgccagtgagcccaggcttgagggcccttgggaggctggggggagggtaggagatcctcgcagaggaagcaaaagggcaaagaatgtcagagccaagggccaggggtagtatcaaccttgtcataataacaacaaaaataaataataggtgacaagaatcatgcactcactgcatgccaggctctgtgccaagcg

SEQ ID NO: 5357 - DNA, 201 bp, Bos taurus
gccgcagatatgaggatgactgctatcaggaaacaaaacagaaacaagtgttgatgaggacatggagaaactggagctcctgtgcattgttgacaggaacgtgaagagtatagccactgtggaaaactctacggaggtttctcaaaaacttaaaaatggaattaccacacaacctagcaattccagccaaaagaactgaaa

SEQ ID NO: 5358 - DNA, 201 bp, Bos taurus
ttaaccgctgtgttggtcaaccctggaaccacccccacgaaatcactgatctatgccaatgtggctgaaaatgccagccaatgcttatacccgcctctggggtggaaacctacaggccagcctttgatttgtatcattatgaaggggcatcaggggccccaggacccaacccaaatgagggggcagggggagctcagggag

SEQ ID NO: 5359 - DNA, 201 bp, Bos taurus
agcagttacaagaatgcagactggagtagggctgcccagttcacctcccagctctgccatgggttagctgtgtaaccttgactgagttacctgatctttccaggcctctgtttacgcgtatgtgaaatggccccttttcacacatagttatggggtgacttgatagaacagagcctagtgtagaataagctctctaaactt

SEQ ID NO: 5360 - DNA, 201 bp, Bos taurus
ccagcccatcctgtccctccccacagcggaatggcgctgactatgccgtctacatcaacactgcccaggagtttgatggctctgactcaggcgcccggccggatgaagctgtctcatggggcaagatccggatggatgcacagcctgtcaaggtgagggtcggccagccagctggagcacagggtctcctaggctgcagct

SEQ ID NO: 5361 - DNA, 201 bp, Bos taurus
tgaaaaaggagggtttttaaaaagtggatgggcattgcttcaaacatatgaggcctttcctcaagcaacttcacttatattgacattttttattttcttacaaccagcagtgccagataatcagacaggtttctgaccataggtaatatttatgggctccttcctccagaaaaacaaacagacaaacatatgaggcctgct

SEQ ID NO: 5362 - DNA, 201 bp, Bos taurus
accaaagtgtagaagcccagctgggtgacaccatgggtcagttggctcagctcccagtaaagctgctctatgtccagcctgtggcccatggggtcagggtggtaggtgcagacgacatacacgctggtggctgcactatccttctcaggtctagggagagggaggtgggaactcaaaagagaagtcttgaaacctctgggt

SEQ ID NO: 5363 - DNA, 201 bp, Bos taurus
aagtaaaaaaaaaaaaaaaaagcagtggacaggaggacaagctttcaagggtcactgcagtaacaggacaatgaccttgacccttcccaggcccaaacagacatgaggcaacttgatactgtgtgtctggagagttaagtcagaaatcaggggtcactgagtgatgggatgtcaggaccttcacagagccctgtggtctgc

SEQ ID NO: 5364 - DNA, 201 bp, Bos taurus
catgtttccagagacacacagaatttttttttcaatcggtatcaaatactttcagaaaaagattggcagttgagtttacattttgctgtatttgtttgtcatggccaggtaaaacttctttaatatccttctgttcctgaatatatatgaaggcttgatttttcatcaaatcccacctcttatgaacagtcaaaaaatgta

SEQ ID NO: 5365 - DNA, 201 bp, Bos taurus
tacagccactgactttcaacacattttgaaatgaatccaaggtggggaacttgaatgaggtgctttatgttctggaagaactgcagaacaggccttcagagagtttctttcaggaaagattttatgagctcagattcttgtatcttctcataatgaaaaaaagtactgaagtcattaatggtgacatctgttttggccatt

SEQ ID NO: 5366 - DNA, 201 bp, Bos taurus
ataataatctgcctgccaatgcaggagacatgggttcgatccctagcccaggaagatcccatatgctgcggagcaactgggcctctgcaccacaacaactgaagcccgtgcacctagagcctgttttccacaagagaagccagcacaataagaggcctgtgcatcataagagaaagcagcccctgctcaccccagctaccg

SEQ ID NO: 5367 - DNA, 201 bp, Bos taurus
aaaatattatcatgtcaaaatgtaatcagtacaaaaagttaaaaatgtgtcatttcacataaatcttcaaaatccaacgtgcaatttgacactgacaacacgtctgaataaggagctaccatatttcgagggctcaaatgctacatgtgaccagtggctactctatcagacagcccagttcttaatggtttatctatatta

SEQ ID NO: 5368 - DNA, 201 bp, Bos taurus
tccaccacggcctcctcatcgctccagtaaagcaggttgatgtctgcgtggtaactggctggggtagacttgtgtgtgttctccggcctgggagtgcaagggtctttgttagttcgtttgtcgcaagttgaaaatgaattaaatggcatattcctggggatgtgctcataggatcagtgggtaaagactaggccccatgcc

SEQ ID NO: 5369 - DNA, 201 bp, Bos taurus
ttacagtgaccctacatggaggtactgttagaatcagcccactttggagatggagatactgaggcttagagggcaaacccacctgtccaaggcctcatagcccatcagtggtggagtctgcaactccagactgggaggtggtaggaactggaggaagccacccgaatggtgtggaggtgctccatttatatatcacagttc

SEQ ID NO: 5370 - DNA, 201 bp, Bos taurus
cgtctgtccagctgggccctgtggggcctggtaggggtgggaattggggacgttctgcaggggagttcatagatcacatcagtgaagggcgtgtatagagcacagtgtaggccatgagctcagtgcttcctaaatgtgggtctggccactggttagcaacaccccacaggcttctgagtctgttggctgccctgggtgctg

SEQ ID NO: 5371 - DNA, 201 bp, Bos taurus
gcaaccagcctggccacatacatggcaaccctgccaccagagaagggaagagaaatctcgggatccttggggcttcctgaccctgtgccccagacacagagcgggacatgacacagcagggcctgaggtgtgaaggttgcagctggagggcttgaggggaatttaattctcacactgagggcaatgggtggctctggtagt

SEQ ID NO: 5372 - DNA, 201 bp, Bos taurus
gcccagagcccattttacagatgggaaaggggaggctggggtcactgggcttgggtcccaagctcctggcgagacctggatgccctgccttatccgtcaacagcggcagcctaaaaggcaaggccgtggtggtgaacctctctgggctcacagggggtcccctggggaaaggcgtggttgtcactcaggtaagatgagggg

SEQ ID NO: 5373 - DNA, 201 bp, Bos taurus
cctgaaaacacagtgacaactgaagcctggaggccagggagagactcagggtgtcagtcacatgggtctccctccaccctttgctcagactcacaggagctgtgtaatggccaggatcttccgaagaggcataacagcagcactaaggtctaccccacctgggaaaccccttcctgccacacctcaatctactgttgcagg

SEQ ID NO: 5374 - DNA, 201 bp, Bos taurus
gggggaatcaggcctgtctgcgccaccccctgccctgtgtggggacacctctgacctccttcccaaccccaccagctgcccaggaggcccgcaacaagttcgaagaggctgagcggtccctgaaggacatggaagaatccatcaggtatgggggtgcccatgtggtcgcagcaaggccacttctccactgccccatggccg

SEQ ID NO: 5375 - DNA, 201 bp, Bos taurus
atgtggtaatagacacatttgtctcgaagccacagggagaaggggccctcaacgaagattgggcgggctgggtcatggcgggccagggcactctgctgctcaggactctggatccctggtgtggagacacacacacatggggtgggggtgggggtagttctggctcaggggctgtgccccagggcccagagagccctccca

SEQ ID NO: 5376 - DNA, 201 bp, Bos taurus
ggccactgttctaaatacagtagctcgagtccctttggctgtcaaagttctttacaccttagctccctactttgaaatccagctcatcatccttcaagatctagttcagaggccacctcctccaggaaggctcctctgatttcctttcctccatatacttatttagatctttccctcctcctgtgttccttatactggagt

SEQ ID NO: 5377 - DNA, 201 bp, Bos taurus
cgctagttgggcctgacaccagagagttgtaagaacttaaaagcaagtctcagatacccatgacctctgacatttctgggcatcccagcagaagcatctgacatctggcaagtgtggtctcaggcctggggaggaagcagaaggattggccagggccatcccccaactagagacagccgacccgccatcatgcctccgtca

SEQ ID NO: 5378 - DNA, 201 bp, Bos taurus
cagcccgtggactgctgggtgaggcccccagggggcaagtggggcggcttggggtatatacacagggctgcggtgtggggattcaaggcttccagaaggacgtgggggccacagcagggtaaagggtactggctcagagttctctccacagcttaataggtcaggcactgcttccctacagcctggcttaggggggacggg

SEQ ID NO: 5379 - DNA, 201 bp, Bos taurus
tacattgcaggtggattcttcacgcactgagccacctgggaagccccttttctctatcacatcttgagagcctgtcggaaatgcagacactcgggcccacaccagactaaccatcagagtctgcattttagcgaggtccccaggggattcctgcatgcacactggggtggccaccccctccctccactccccagagtttcc

SEQ ID NO: 5380 - DNA, 201 bp, Bos taurus
cgcaggtgccccagaaatcaaggggatgctggtgcctcagaggaggggaggcaagatggggtcagaatcagggaaagaggttgaagtacctgggctccgggggcccgtcccagcgctccgcgttggccccaactggggagtaacctccgggagagcggttccccggataccccccgttctctctgccaggggccctcgccc

SEQ ID NO: 5381 - DNA, 201 bp, Bos taurus
gcaactggaggggcatcctgagcggcccctgccccatgacccctatccaggctgacccagtctgtggatcccgacttcccaaacctctggaacccatttctctcccggccccaacaccccagacattctccagccacctctgagccgctgcccaagtcctcgttggcggctgtgctttcaggataaaacctgaactcttcc

SEQ ID NO: 5382 - DNA, 201 bp, Bos taurus
aatgacagttatcagagcagaagagcccagggccctggactaccggctaagtgagtgtaaggaacacccccaagttggctcccatgtcccacagggtcccatcgatagtccccaggatgggcccagggtgggggccaaggaggggtgtgggggactcaggcataccaggcaggggcagcaatgacaagttctactgccaga

SEQ ID NO: 5383 - DNA, 201 bp, Bos taurus
cctcgccgggcctctggctacaacagcaccgggccttggtggtgttgaaagctttgggtactgagcactttccggcctcgaaatgggtaaagcagaaactttgccgtgtgtctgtgggggtgattccccagtgaaactgctagaagggccagccacccccagttcttgtgaatggggtggtcctgaccctaccagcagcca

SEQ ID NO: 5384 - DNA, 201 bp, Bos taurus
gcgttgcccacctgtctccttgtggaaggcctggtgagtgaagtgaagctgcctcctccatctgtatatagtcccaactcctcacctacacacatcctcatgtccaacgtggccacaaagccgtcatagcagaggcagcggtgaccccctggcatgttggtgcactggcccccatcacagatgtccggattctgctcacat

SEQ ID NO: 5385 - DNA, 201 bp, Bos taurus
tggtagaaccgcaagacttgcctgacctatagctaaactgaggatggaggtcttttaaatataatttttaataagcagctgtaccttttggggaagagaggaccctttaagcagagttattggtagagaggattgaagttggattcgtgctgtctctagaatgttaagtagacaaagtcctaatttctaaacctggctttt

SEQ ID NO: 5386 - DNA, 201 bp, Bos taurus
gcccctggcccgattatttggcgagatgatagggctaccctagggggctgtggggagaaatgaaccccaaagaggctcaggtagagccgcagcagtctgctgccaaggaggcctcggttgctgtggtaacgcggcctcctccaattcacttccgtagtaaagtagcgcatgcgcaaatagcccgacaggccgcgaatgtgg

SEQ ID NO: 5387 - DNA, 201 bp, Bos taurus
ctggcctcgggacacttggcccatggggctgccctacgtggagatgggtgatgaccacaagagctgctgaggtccagcagggcttcttgatcacccgacatctatgcacccacccaggacagcggcctgaattgggagaccaagagacacagttctgccctccggctccctctccccttcatcctggtcctccgtgccccc

SEQ ID NO: 5388 - DNA, 201 bp, Bos taurus
gaaggaaccaaccgagccaaccagccttgactgtggggagacttccagcatccaggaccccgaggaaagattcttgtttaagtcccgggcctgcggaactgtcttctgtggcggtcccaggaaacgagcacagggcatccgagcagaagggtttgaccacgagagaattataggtaggccttggacaatggaagatgtgtc

SEQ ID NO: 5389 - DNA, 201 bp, Bos taurus
tttttatcacatgccctgctccatgcattctcagtttgcttccgcctcctctcgcagttgcatcccagtgcctaaaacagctcctggccaggcacacagcggtgtattcagtcagtaaagacttattgcccaaccctcaatattcactgaaaggacttatgctaaagctgaagctccagtacttaggccacctgatgcgaa

SEQ ID NO: 5390 - DNA, 201 bp, Bos taurus
agggagcttccagaggccacaagcagagagcacatttattctagtgcagatagaggccctgccccgtaagtgtccccctgctgctctgggccccgccatctttctgtccaatgttcccagtcacgtgaggcatgtggtgcgtcagttcacctcagcattcagggtggacgtcctgtgtatccgtgggcaggccagctccag

SEQ ID NO: 5391 - DNA, 201 bp, Bos taurus
ctggggaccagtgccaggcaaggagcctgggttcttctggagggtggaggagactacagcagggcgggcgacacagggtggtgtggccctgtttccatttcgaaaagctccctcgggctgctgtgatgtaacccaagggctctgtaacttcagcactgttgacatcagggccgttctgggcactgtgaggggtggagcagc

SEQ ID NO: 5392 - DNA, 201 bp, Bos taurus
gccaggtgaaaggccaaggttctacaggctgcagcctggttctcatggagctggtagagcaggtgaggcgagcggctggggtggctgctaccagccccaccgctcagaggccccaccgggcccaaggggacagtctggactctcagacaggtgagttgcagcgctaggattctaggtgctttctgtttgggatggggggcg

SEQ ID NO: 5393 - DNA, 201 bp, Bos taurus
gcgggaccgagatgctgctccacgccccatactgctgggggatgaaccccccacggagaacgatcaggccctgacgtgcagtgccaaaggggaggccctgcactaaatgatttatcgcccctttatgtgaaccaggagggaagctcagcccccaccgcacaacggtgacctcactgaatcccaccaagtacacgtggtggg

SEQ ID NO: 5394 - DNA, 201 bp, Bos taurus
caaagccacactgattgtaaatggggagattgcaatgccatagtcggatttccgagggaggaaatgaagaccagcccaggaagggtgtatatgggtcaggcgtgtaggccttctctggcccaacagcaggatttgaacactgacttagcatgccctttcttccaccagccgccccaaagggcgggcctggtgtgagtcagc

SEQ ID NO: 5395 - DNA, 201 bp, Bos taurus
ccatttggggcactgcaaccaggctggtgaggagcagagggtgtggggggatcccgtgttgctggaagggtcctgattgtgatgctggccgagattaaaccgggtgtggggaggtggaatttcagatgggagcagtggaagtgttgggggactcccaaaaccctgtcaggatggatgaaggccaggtttacaggggatgga

SEQ ID NO: 5396 - DNA, 201 bp, Bos taurus
accacatccatctccccccacatttagccttcagagaatgacggtttgattgtgcagagctaagaataaccccaactgtaaagtaccctggaactgcagggaggtgagaggcagagcctgtaggaaggaggcggggaaaagggcaggtctcatccacacatgccccccaccccggtgccaaagctctccactctgtagctt

SEQ ID NO: 5397 - DNA, 201 bp, Bos taurus
aaccccagggtgctctgagccagctgtgaccacagagctggcagccatgctccaggacagggcagaactaggagaaacgaggagccttggatccctgaaatgactgcatggaacagggctgcccgggagtccagctcaggactgttaagtgcctgagaaatcaacatgtgcctgaggtctctaaatccagcgagtctcctt

SEQ ID NO: 5398 - DNA, 201 bp, Bos taurus
gggctttggcgtgctgcctgcggagctggtcaaactcagcctggagagcgtcatagagctccagaggaatgacctcggccggaccatctgcctccatctcatccttctcgaagtgctccaggatctggtggggacaggggaaccgagcaagagtggaagtggccgtggtgggcgtgggggggcacagggcagccacaccac

SEQ ID NO: 5399 - DNA, 201 bp, Bos taurus
tgggtcgcctctggctgtggtctggcctctttcctgcagacgtgagtgagcacccactcgccaggagcctgggaagtggtttgttttccagcctgctgctttggtgtcccgaggccctggcctggcaatggctcagagcagcttgcctctcccctgtgctgtccccaggatggcggctccctggaccaggtgttgaaagaa

SEQ ID NO: 5400 - DNA, 201 bp, Bos taurus
tggttccacccttattagctgtgtgaccttggggaaattaattctctgagcctcactttgctcctgcgtaaaataggccacacaaaacccggggtgtggggaagattacatgaacgaataaatttaaaaggtggtgataagccttcaacagcatcaaaggcagatgcaaggggcatgcagtggcggcctttggtcagcagg

SEQ ID NO: 5401 - DNA, 201 bp, Bos taurus
cctggtgtgccagtggttaagattccatgcttccaatgcaggggaacaagttccatccctggtctgggaactaaaatgctacacagcatggccaaaaaaaaccccaaaaaacaacaaaagaagccctgaccaccttgaacctctgggaagggaggggcggggggactctggcaagatggccccagaagctcagaggagcac

SEQ ID NO: 5402 - DNA, 201 bp, Bos taurus
accacagatccaccggaccggtctcggccaccagagattgcgatgccaaagcctcggcgggggtcctgagaggggatgagaaacagaacgcgattctgcttttcactgggacaaaggccatcctacggggaccggcccactgtttttgttggcgcccatgcagggagagggaggccccaccttgctgatcgtggcagtgta

SEQ ID NO: 5403 - DNA, 201 bp, Bos taurus
agcctccatggggcagggacgtggctgcagtgttgctgggctccttgctcaggttgtcatctggggctgggctgtggcctcaagtggactctactgcatcgggtcccttccagacccctggcgtcatcagccaggctccgtccttgctggccaggacttccattccttccagacactgcggtctcctgtgtgattatcaca

SEQ ID NO: 5404 - DNA, 201 bp, Bos taurus
gctctgctctgagctccttacacggcccgtgggccagggcctgggcctcccggggcagccatcattcctggcacagaggagaaaccgcctcggggagaccagatccaatgtccccatgcgggcctctaactaccaggccctttgggcaactcagcaaggggacacgtggtgtttggtgcccacctgggaggacagggggca

SEQ ID NO: 5405 - DNA, 201 bp, Bos taurus
tgtcgtcccagggtggggactgtgacggcttctcgactttcgacgtccccatcttcactgaagagttcttggaccaaaacaaaggtgagcgctgaccagcagttcttgaagcaagcgttgaaccaagagggcatcgaggcgggaggcagtgggtgccttcctctcttgccctcgcagcccagactgctgagatgtggggct

SEQ ID NO: 5406 - DNA, 201 bp, Bos taurus
ggctctgtgggccacagcctatacccactgcggccccctcgacccctggaacctatgacctctgtcccagacttgtgtaacctgctaggtgaccctgggcgagtgattgggcccctaagcagagctgctggataaaactcaggaagttcagttacacctgaatcctagataagccttttagtgtaagtatatcccatgcaa

SEQ ID NO: 5407 - DNA, 201 bp, Bos taurus
gtgaggggctctaagacctcctcctgagaaagaaccagcatagggtgcacaagcggcaaacaggatgagacaagacaagacctatggtttccagactcctgtcccacaggcaagagttgggcaggcgtgctgggcagagtgcccggcacgggaagtaacccaagagcttgtgccaggcgtgtctgagctgtccccatttca

SEQ ID NO: 5408 - DNA, 201 bp, Bos taurus
ccacaatccacaggatggccccacggagaacagtctggccctcaatgtccacagtgctaaagtacgtcctacctcagactagtggtttttcacccgtgctgtccagaaggggtgaagggtgtgaacccccaagaaatcacatgcaaggtttggtgtgggtgtccatatttgtgggtgaggaaagggtattttggagtttgg

SEQ ID NO: 5409 - DNA, 201 bp, Bos taurus
tcagcaccttcacccaagagggtggagtgacgggggcccccagaaatagcctctgagtcatttggaagcaaacccatggaggcatcagggccagaaggcccgactgatgtcatgatctggaggccagaagtccaagaccaaggggtcagtggtctgggtccttctgaggccatgagagtgagtctgtcccgtgtccctcct

SEQ ID NO: 5410 - DNA, 201 bp, Bos taurus
ggccaggaggcagctagagctgggcagccatccgttgagcctggtcggcacctggacagcatgcagtcactgcgtccagagcactgacagcagggcttttcataactgggagctggcccggatccaagtgcccgggtcagacagctcggggaggcgagggaggtcagagcacccgaggacagcaccctgctgccccacctc

SEQ ID NO: 5411 - DNA, 201 bp, Bos taurus
gtgtctctgacttggggagtggttcgtgtttcttgcttgaaaagaaaagtaggtatagaggctgtgtcttgggctgtagaaggcttcaccaggccttgtcgataacaaatttgtgaacaagaaagaggaataaaagtaagtgaccagcctgtaacacaatgcagccaaggaggaggcctaagctgattgctctctctgagc

SEQ ID NO: 5412 - DNA, 201 bp, Bos taurus
cactgccagcaggtgtcacaaactccatgtgttctgctggcagtgagagaggtgactggtgacttctggctctgctcactaggggctccttgtcctgaccgactttaccccttaggtgtttgctcctagaacaaagcctgcttggtcttgatctggttgggcctctgagtatcacttgtgagtgagacgctgacttctaag

SEQ ID NO: 5413 - DNA, 201 bp, Bos taurus
acaaagccgtgggagtgtcatgtggctgttcttgctggtgtttcagcctgccttctcgctgtggccagggcgtgatgtgctcatcagtaacggagcagatagactctagggcacggatgaagctagcacacagccaagttgggaggaggaggcagaactctggactgcttctctggacctgtgtcctcaggatttccaggg

SEQ ID NO: 5414 - DNA, 201 bp, Bos taurus
tggtccctctgcctgaaaagttcctccccaacgtggtcagagagtttctatcctcattccgttcagtctgaccaagccccatcttagacacctcatcatattggcctttcaaaacttccttgaacatctgcatcctcattcccgccccctgctctgctttcttcctagcacacaccgccactgtaacatgacattcttatt

SEQ ID NO: 5415 - DNA, 201 bp, Bos taurus
catggccaccccccaaaaaagaaattgagactttttttttctactccagaatggctctgctgttttggagtcccttcatgctagctgtgtgaagggtttcgtgatacatgttataggccaggcctgtaagtggcatccattacttctgtccacattctcttgtcagagctatcatggcccccatctcatttcaagggaggc

SEQ ID NO: 5416 - DNA, 201 bp, Bos taurus
aggacccactccccctgccccctgccaccagaggccgagaggcaggcaagtgacagccggagctgaaaggcaagggattgttgcaatcttgacctgagaccggcatcctccaccaaactgtgagcaggctcccagttgctaaccatgtcttcctgggatcctaaacagttgacatctgccaggagggtcggagcctgagac

SEQ ID NO: 5417 - DNA, 201 bp, Bos taurus
cccttgctgccttcctcaggcctgggcgaagtgcagacccctgagcccagctagccatgtgcgtgtcttgccagcattacttcacttagcagttaacaggggggcctggtagcacttgggggcttccgtttttgaaccaaattaagcccccagtgcttgtcacagaaaagcccccactggccaccctagggcatcctcctt

SEQ ID NO: 5418 - DNA, 201 bp, Bos taurus
taaatttatttattttagcttagtgatatatcttgcgtaaagggctattcacctcaaaaaaatcctcaaaaaattcctttataagtcatatggagttaagcaaacatctcaacgccttgtgccatgtatttcattaatttattcagcaagcatttttcaatattcattctgtttaaaataagaacttaagtaattcaccta

SEQ ID NO: 5419 - DNA, 201 bp, Bos taurus
aggctcctccatccatgggattttccaggcaagagtactggactggggtgccattgccttctccgagtttacatctctaaatcagtccaaaaaagagttatgggcaagactcaaaccctatatacttcccaaggcatgtggcatctttctgctctaattagatactatatcatgtatgaattaatggtttattgtgtcttg

SEQ ID NO: 5420 - DNA, 201 bp, Bos taurus
tttgatatctgcatatcaattcaaaggaaggatattttataaagtttcaaatgctctctttcttcaaataagtttgccactactcaattcctgaagattttgcagaatatgaatcagagacagattatttctaggacattgaatgcctcatgatagaattcttaacctaactctaatttcttagaagctcaaaaataaatg

SEQ ID NO: 5421 - DNA, 201 bp, Bos taurus
ctaggagtttttgaaacttgccacaggtagacaaatactttaggactgagccaagtctgggagcagggttcttctcgcaatatgaatatctgtttcatctatctggcccatgtcagtttacagagcacctccttagctccatgaccttgattattatatcattcagcttatagactccctgccccaccgccaccacttttt

SEQ ID NO: 5422 - DNA, 201 bp, Bos taurus
ttatgcttggagagttttttgtctctgaatctgtatccccaaagcagaaatccccaactcactccctttcagccatgtatgtgatgcaggctctgccatacagatacagccttataagacctggaaatagacaatgtgcagaagcagtcaaaaccttctaataggctggcagagaagaccagtcttcaccagtcttcagtg

SEQ ID NO: 5423 - DNA, 201 bp, Bos taurus
aagaaaagtctcagaatacaagtgagtgggaaatataaaggtgcgagtaaagagtgctcctccatagatggataagaaaacacaaaacagactatagataaataataaaatagagcaagataagacatatataaggacagaaaatgcccccggcaatctaatgatgaaattaatcactgtacaaatgagcaagaataaaaa

SEQ ID NO: 5424 - DNA, 201 bp, Bos taurus
catggcctttccaaaaccacctgtatactgtcatgggggagaagggtccccgtttgcaatactggggttgaaaacgtgacgccaattagtccccattagaccgtgctgctgatggggtccttgggcctcaccatgaaccaagactcccaggtgattctcattctacgactggtccgtctcacctatcaacaaggcctcggt

SEQ ID NO: 5425 - DNA, 201 bp, Bos taurus
aggaaaaaagaaaagaaaaagggcctcatcttctgagtcctcctccccgaagaaggaattgcccagggataatctgaaaatgcaactatgaaaagtcagagtggcccagctatggggctgctgaccagagatgggcttcagctttccacatgaaaaacaagggaacattgttaacttacctttccagtgagcacttagtgt

SEQ ID NO: 5426 - DNA, 201 bp, Bos taurus
ctattcctcaacttagtcaccatcgctgtaattatagagatgtgcaacctcacaatcttttctcacgtgactcacccctaacgaattcacttggtggccctctgtgatctttaagcttggtgttccacctgtctgaagtgcctttcctggcatccttaaacctgataacaataacctctccattaggtcttatttaggtgt

SEQ ID NO: 5427 - DNA, 201 bp, Bos taurus
tccaggggatcttcacaactcaggggttgaaccccggtctcctgcattgcaggcagattctttaccagctgagccacaagggaagtccacggtggcagtacttactgggaatttcaccttagaaaaggacccacctctccttctacacaaatacacacagagtcaaatcagacctgcagatagtcactctacaatcacatg

SEQ ID NO: 5428 - DNA, 201 bp, Bos taurus
tttgtaattgatttacttcttccctccaagcattatttagtagtgtattggcctttattcagtcattagacatttctttttagggtaaagttataactaaatcaagtttatttatagtttgcgattaccaacgacacattcaaagacataggaaacagatttttacatccttggtttgccctgtaaaactatttctatacc

SEQ ID NO: 5429 - DNA, 201 bp, Bos taurus
aatgatattagagaagaatcagcaactgcagaatatgatttttttcaaatataaatgaaacattgaccaatataggccttaggccatgaaataagcctcaattgaaatcatacccagaacaactgacccctggaaaacaggcatgtgagctgcgtgggccacttgtatgtggatttttttcaaggctaaatacttcactac

SEQ ID NO: 5430 - DNA, 201 bp, Bos taurus
agagttccttggactggaaggagataaaaccagtcaatcctaaaggaaatcagtcctgaatgttctttggaaggactgatgctgaagctgaagttccaacgctttggccagctgacatgacgtatcaactcattagaaaaaaccctgatgctgaaaaagattgaaggcaggagaaggggatgacagaggatgagaaggtta

SEQ ID NO: 5431 - DNA, 201 bp, Bos taurus
atcaccaaatgggctcaatgaacaaaggggccatgatggcagggatggagtttagacttggtctcagtgatatggccatccactcactgaggccaatctggctatgaccaccactgagttcctcatctgctagcaacagaggtcaattctgagcccttactatggcatcctagtagtagattgattacaatgggccacttc

SEQ ID NO: 5432 - DNA, 201 bp, Bos taurus
tcagacatgacttagggactgagcatgcaatacaaattactgtaaataggcatccttgcatgtgctgccatcttgtggccaaatagaaatgtgtttctaaatgactctgctactacttttcaagaaaaagaaatgcaaaaggcaaaacggttgtctggggaggccttacaaacagttatgaaaagaagaaaagcgaaaggc

SEQ ID NO: 5433 - DNA, 201 bp, Bos taurus
ttgggcctccatgctgcaactactgaagcccgagtgccctaggattcgagctctgcaacaagagaagcttgtttatagctgtggaaatatacctgggtcaatgaggggcctgtgaggataagtgggataattgatgcttgtgtaatgcataaaaattattggagaaaaaaattgttcatatgcatttattcttttcctctc

SEQ ID NO: 5434 - DNA, 201 bp, Bos taurus
gcccccgcaggggtggacacggctagtgcctcggaactagcatggcccttgggttgtgcatgagactccgtctgtgtggccactgcttcctcgtttgccacccgccttgttcctctcatagcacagctgcctgtttcatccttctgttaccatttcgaaaccataaagagaaatccacaatttcagagttcttaaaggcca

SEQ ID NO: 5435 - DNA, 201 bp, Bos taurus
atttctcactggatggtttagaagtatctaaatctgattttttactatactccacacttagtaccacatcctttacaccaggagatttctcttgcgatgatagtaattcttctgtagacataaaaatattcaaaatgttttctaaatctttcaatcaaagagggcatcacgatgtaacatcaatttaatgacaattttaag

SEQ ID NO: 5436 - DNA, 201 bp, Bos taurus
tgatatcctgctacttacatttactagagcatgcctatacatatttttttttctttccataagtactaaatggctccattttcacccatttctgtttggtggcagagaaacaagacaagggaaccatggggctgtattctgaacccacagctcatagacacactatagtataaaaatggaagtgttctgaaatgcactgca

SEQ ID NO: 5437 - DNA, 201 bp, Bos taurus
cgagcaaaaactgttgtctgtgcagcttgtctagccaacttggagacagcctccctgggccttcccagcattgtggtcaaaccggccgagtggccacctcgcacaggagagtcctgatgctcaaaaggaccctattttcctccctgcttaaacttgccaacattcattgatccaaaagactcattgttctggggcccctgg

SEQ ID NO: 5438 - DNA, 201 bp, Bos taurus
caggcctgggatgaaacccagtgttaatttacatcctattcttaattgtcaattaaaaactggatttagaaatttctcatttgctgatgattaatgtgtccagaggtgcaggctcataaatggagctcagaaatgtaaaaggataaacttagaaacaaatatgtgaacttcttagaaatcatcctcttggagtaaagaggt

SEQ ID NO: 5439 - DNA, 201 bp, Bos taurus
taattccagctacctttacaacccctctgttttaatttctacctcctcagctcagtgagactgatgtttttcacctgggcttcacaaccgtgtgccacattcaaggaaggtcccatagacataaaacaaggttgaatgtgtgcttatctcatgacgtctggacttttcaggactctagtcctgcactgcctattatccaat

SEQ ID NO: 5440 - DNA, 201 bp, Bos taurus
tccgtgcctggcagctagccagcagggggtcagtgccaccttcaaggcagctgtacaacctgtgcttgaacagtcagtcttctctcctccaaagagaaggcgacattccagatcctgtcctctggccccgagtctgcactcttctctcatggtatttcatttcttcctgacctagtccccagctggtctccatacatacca

SEQ ID NO: 5441 - DNA, 201 bp, Bos taurus
gaactcgctttctccaagttccttttcttgtatatttccagttatgggaccataagctaaatccccacgaaatgttctaagggccttgccacttacttgctagctcacatcattggtgtcaagaggcagtggaatcttcaaaagctccacctttcattaggtcaccttgaaggtctctgattcctggaccaggtgtgtgtt

SEQ ID NO: 5442 - DNA, 201 bp, Bos taurus
tactcaaagtgaaattgaaaacttgactcaaggtcctaaggtgccggtgtcagatctcaagtcaactctaccatcacccggccgtggttcagcacaccaggtcccaccgtgcagttcacagacaacttcctacacagtgtctccttcacacgacagggccacacaacagattgggttgtcaccacttcacagatgcagaaa

SEQ ID NO: 5443 - DNA, 201 bp, Bos taurus
ttgacaaagtgcctatcggtatgaaatttgatctaatgataaacaagattatcatacacatgcctgagtcctgaattcagagacaggtaacatgagttgggtgtaaggttccacactcatgtctaataaggaataaaaactatttcaaacaaagacctgtatatggaaaggtccactaaatggaagataggtaacctgagt

SEQ ID NO: 5444 - DNA, 201 bp, Bos taurus
tttgtgacctatatgtttattcccatttcttccttaataatggtcagtggcctttgactagcattagatgcttctcagtcaacaatacgctcccatgaacgaaagtcaatggatactttttaggccttatcaaaccagcactgcactaacattcctttgtaaatctccttgttccatgactcaagtctgggcctaattctc

SEQ ID NO: 5445 - DNA, 201 bp, Bos taurus
ggaaattatttaatcagttctagtagctccctttccagtttatttacttatcaatttttttaagaattataatcatgcatcacatcagaagggtatgatttgtgagctagctgttagctatcactttatacagatcatccactaggctggactaaactttgcatcttgaagatttcaagcaatttccaaatgtctgactta

SEQ ID NO: 5446 - DNA, 201 bp, Bos taurus
cttcattcccgatcctcactccctttctcctcggggcgcaaatgagcgccacaggctggttgtgggccgacgtccccacgttctacatgttcgggaaaatttgcccttcgaggagaacccagcgacgcccagtggggaattccgtaggtttagaaaacaaggagaggagcacgggaggcgggaaagagacaaccgcacgcc

SEQ ID NO: 5447 - DNA, 201 bp, Bos taurus
gtacttgtcagagtacggggccacagtgcaggactcactaccattcagcacatgctggaaggtcagctgtgaaatcccttgttctctaaatctgtaccagcgttagtcctggcccttgcgttccttcctccagctggcttcaaatcaatgccccttttgccctctgagacgacacacatctcgttcctaaattacctggct

SEQ ID NO: 5448 - DNA, 201 bp, Bos taurus
ttatatattatgaatgacaggagaactaataaaaataaaacaatacctttttttctttgttctgttattttgttctatgattttaggtaactatattcaccctaggaaatcttttttatacttttacaatctgagatgtataataaaccatttatatctttccatgtttcagaaccctgaagcctgtatttgaaaactgaa

SEQ ID NO: 5449 - DNA, 201 bp, Bos taurus
gcttgcctaacttgggagttggaggtggcaggtgggatgtttagccttgttctctctctcattcatgggacctcatattcagacttctgatattaactctaaattaggtaatacttgcaagcacagtgacacagtgagaaatgctaagaatgtactcattgtacaattttaaatgtttggcccattaacagtccatgctgt

SEQ ID NO: 5450 - DNA, 201 bp, Bos taurus
aatgttaaatgcaaatataaggggtttctttgataatcactgtgtaaaaacaagacttactggaacttttgcccaaatggaccagtgggattttgcatacatttttaggacaaaatttcgcatagagttctcttttccttcctctagctgactaccaactttgtcttaagaaagatcatccttatgggacattttatcaca

SEQ ID NO: 5451 - DNA, 201 bp, Bos taurus
ctagggagcttcatagaaatgctattcctggctctgaagtctcagaacctcagcaattccatccacaaatggtcacctactacaactcttgtttatttcacttatgttttccttttcaaagggactacaggcttaaattcatttataaacacttaatcagcttctttgcaggggaaaatcctcttttaaatatacctgatg

SEQ ID NO: 5452 - DNA, 201 bp, Bos taurus
tcttgatgcatgatgatgtcacagagccctcatggaagtctgaaacccgaaacatcagacttctttgtgtgaaaaagaaatatatttggtttaatcacatttaattttttgtaagtggccaaagctatttgaaatttatatttcctcagacaacaaactagagcctgcaactgtttgtttggaaactctttttgctcaatt

SEQ ID NO: 5453 - DNA, 201 bp, Bos taurus
aagtaggaagtaacaatagaattgtaaagacacctgagaaattcagagccatagcagtaggactatggctgctgtgtcttcagttggcctccggtccactagccactttggaatcatcctatctgatgaacatgatgccaccgatgagataacaatgtgatgctcttcagagtatcctttagagaagtcccacactgggca

SEQ ID NO: 5454 - DNA, 201 bp, Bos taurus
aagatcccctcgaggaggaaacaacaaaccactccagtattcctgcttgggaaatccctcagacagaggaccctggtgggccacatggagtcacaaagagccagacatgaattagcaattaaacgatacattggatcggggtacttgttgcagatggggagcaaagctgcatcatcattaagagtgtggtctctacagtat

SEQ ID NO: 5455 - DNA, 201 bp, Bos taurus
ctttacagaaatttctcagtaactgtcttactatcttaaaagtaaatacagcaattactgtatcatttttataaaagagaaaagtgagcaacaggccaggtagctgttaagtgatgtgtccccaaatagaacatagctctagaaagaaagtgacttatgttattcacacttctatctccagcaccaagggccatgtctaac

SEQ ID NO: 5456 - DNA, 201 bp, Bos taurus
gtgaatgtggcccgtaaatttggcatgcttagtctttataggctgggtaattatatatgctaatgagtaggaggattattccaactatttttgggaaaggacggaggcttccaggatatgggccaccacccactccttggtcttttaacaatgccctggaactgtcatggcacctctgggtgtgtcatttcacttgctgat

SEQ ID NO: 5457 - DNA, 201 bp, Bos taurus
ttacagattatcaattctgctgagcaacagagagacatatttgggagtcgcataaacaaatacattcaactgtgctgtggattaacctaaagtgacacatgtatttaaaaatctgcctactacttgtcctcattgattaaatgcccttaagaaagtaagtctgatgaaataaaagccattaagatgcagcacacctccccc

SEQ ID NO: 5458 - DNA, 201 bp, Bos taurus
tctacctacagtactgcctatcttttgtagtgtggcttctgataaataggcccccagaagagacaatttggggagctggaaagtactttatttttctttaaaacctgacatagcattgtccaggccttgcaggtgggaggaacatcggaagcagaaaggcaggaggagacctaacggtaatagtgactgacaaatcaaaag

SEQ ID NO: 5459 - DNA, 201 bp, Bos taurus
caaaagttcatcattggcctccattaccgcagcagtcaccaaccaggctgaacaggggaaaggttgaaccacagtgctttaatatttatttggccatgtcgggacttagttgtggcgtgtgggatctagttccctgacaaggggtcaagcccattaagaaccctgcattgagagcatggagtctttgccagtgggccacca

SEQ ID NO: 5460 - DNA, 201 bp, Bos taurus
caaataggatgcctaaagttgtattgagctcacagctaactataaacgcaccccttgacatggccctgcccaccaaagggacaagatccaaatccacctgcagagggcaggaaccagtcccttctaccagaaaacctgcacaaaccccaaaaccaactttgcacaccaggcagcagacaccaggagcaagaactacaaccc

SEQ ID NO: 5461 - DNA, 201 bp, Bos taurus
atatatgacatcagcaaaaaaaaaaaaaaaaaggagaattagatgtcttcttatttactgtttccttttcagcatcccatacacagatatatgtctaatagccagcagcctgtctaaaaaaacctgattacttggccagactattcttgcctgacccagtgaacacctcagtaaaatgttgctcagttgaggtctcaaacc

SEQ ID NO: 5462 - DNA, 201 bp, Bos taurus
attgcaaaattagaaatgatggtcccttcaagtttaaccatttatgacagggaatgttttcaagattacccacttgtattttaaagacaatcactttcctattctctgtaaaatgcaaaaatgcttttttaaaaaattaagataaaattaccatttctacatctcattgacgaaaagagagcaagacagcgtgttctaatt

SEQ ID NO: 5463 - DNA, 201 bp, Bos taurus
cagctaggtctggccccggatcttgtgaggtccctgctttttcctgtgttcctggtgtgcatcctccaagaggggagttcctgttttccctcgtctgtggctttcctgtgagcagactttgctggccttcaaagccagcttctcgcaagaccagccctccacactgcggagcctgatgtggggctcagaactttcactcct

SEQ ID NO: 5464 - DNA, 201 bp, Bos taurus
aaaaagcctatgaacttatttgttctccttgaaacaattcttgcccttttccatccatcaatatactgtgcccaagtatgtgaacactcagaacatcaggagcaccacctttgctcttacatacggtttgaagaagtatttagataatactcctgagtgacagactatcaaaataaagaagagagaggcctactgaagttt

SEQ ID NO: 5465 - DNA, 201 bp, Bos taurus
gtgtgtctgatatcagtgtaatgttgggatcctgttatcataggtttgtgagatatacatacagaaattcataaagagatcaattgtacaaatgaaccaacgtaatatgattctataaaaaggagcagttcaagctaccattgggtgacggagttttcctcaaagagggggctttgtacaaggggcagaggaaaatgaagc

SEQ ID NO: 5466 - DNA, 201 bp, Bos taurus
ctgctgggcccacagaaacaggtctgtgacacggagaagtaaaataaattgccaggtcatcacaccttgcccatatcagacctcctttcaattcaataaacgatgtgtcgttggaggtgggccattagcatcacaagggaggctgtttcaggagctctttttctctctcttccgaacactggggctgtggctgagtgccac

SEQ ID NO: 5467 - DNA, 201 bp, Bos taurus
aaatttgaggtttataggaaccctcttactcatatgtaggaacatcaaaagaaaatgctgtcgtagtttaagactcaaataatcccttgacatgcaatccgttttccctgtatctcacacagggcgtacaccatcaggtcgccggcgagtggtcccaattctgcggggactgaatggcatctattgtcgtcttggaggaag

SEQ ID NO: 5468 - DNA, 201 bp, Bos taurus
agcagggggtgggcagggccttgagcgggaatggggacaaatactggattcaaagctgaaagaaatgtggtagcagagaaagctgagagaattggagaactaggccgtgaagaaacagtctgctggaatgaggaccatggtgggggtctttcctgctgcatgtagaaagaaagggcccaagatggggaagatttgtgggca

SEQ ID NO: 5469 - DNA, 201 bp, Bos taurus
taattaaaagattgcaaattctcaaataatacatacaacagtggtgtccaaaaacatcatcatgaagggagaaatgtcttttgttctttcagtggcccagcatccacttacccattgtcagataattaccccatcaattttcctaaactgagatccctcctctctccccctgcctcagctgattctcaggccacacactat

SEQ ID NO: 5470 - DNA, 201 bp, Bos taurus
gggaaagtagtgaccaggtcagggttgcagagtttgactatggatagggctctttgttcatctctcctaaaaaggaaaacaggctggggctttagttctattcagaaagaggcctactatagggctgaatagaggcatagtatagggctgaaaggtgattgtagccatgaaattaaaagatgcttactccttggaaggaaa

SEQ ID NO: 5471 - DNA, 201 bp, Bos taurus
gtcgctcagtcgtgtccaactcttagtgaccctatggactgcagcctaccaggctcctccgtccatgggattttccaggcaggagtactggagtggggtgcaaattacattttccctgggtagctactaaaaattcaattcacttaaaagaaaattcctgatgatatatgaacaactgtatctgtaaagcagaaaaactag

SEQ ID NO: 5472 - DNA, 201 bp, Bos taurus
accattgccagtaagggataaacatgtatgtgatacaatgtattattattattacaccataacattacaattttcctttagttttgaaatattttccaaaaagttagagggaaatacaaacaaaaagaaaaaaattgcaaaaaggtgtatttttacaaatcagagagagaagaattaaaacagctgccttgccatctgttc

SEQ ID NO: 5473 - DNA, 201 bp, Bos taurus
tagtgagtagtcttgaatcactgttaacctaaatatatttttacttaagtttttatagttaatttttaatggcagatcaatactttaaataatattaaggataataaatgccttcttatcttgttcgtgatccccaaaaggcaatgcactatagtcagtatccctgaaaacagtacaatttgtagtctacctggcaattct

SEQ ID NO: 5474 - DNA, 201 bp, Bos taurus
catcattctaccaaaggagtctgtgacatgaaatatgtaagtttttgttttacaactcagttgatttatataaaaatgatctaggtaaactagagacaatattattttctcataacagttaggtgatctcattaagtcctctggcatggtggtaattacaaacacattctgatgactcttattacaaagccagaccatttg

SEQ ID NO: 5475 - DNA, 201 bp, Bos taurus
gaagctctatgaaagaccgcctcatttgagcctttcttctttcacataatactgcttgttttattcctgctttctcttactttggccttaacacccttcagggctgagcttgtctatttcttccttcagagctatctggcacttaaatgtggttagatgccttctcaatggcctgtgtatacttctgcatatacaaatggc

SEQ ID NO: 5476 - DNA, 201 bp, Bos taurus
aagtctcacttccttctttggcctgaaagaaactttgccagtgtatgggatgattgctcgcaaaatttttttgaagaactctatcaaattcagagatgaaatagaaaatgtcctaaaaaagatgactgctgaaaggggaggcagtgtcagagttaagtcattttggaatttgtgccaatgaggctgagttgcttgctaacc

SEQ ID NO: 5477 - DNA, 201 bp, Bos taurus
ctcctatgctctgaaatacactttgttcttttaatagaatttgcttcacttgatataatttaaccttacaaaatcttttaaattgagcatagattttaaagtaattttctgaagtaactgctcccatgaaaaaatgtggcagggaaaggaacaaagtctgttgtgaagatttgtggcacgtttctttcatagagtgaatta

SEQ ID NO: 5478 - DNA, 201 bp, Bos taurus
agatgatctgggatagggaaatgctggtctctagatccttgcttttcaaatcagaaagaggacatgcttttgctccttcccccaaaaaaggcacataggctattgctgtgaatgcatttacctagaatgcacgggagaccaggactaaggctattgctcgctttaacagaattttctaaaaccaaagccagagagagtctt

SEQ ID NO: 5479 - DNA, 201 bp, Bos taurus
ttaataaatgacatgcagaacttgcatttcagaatttaaatttcaaaagcaagagttggctgattacaaaaactgcactgccacttacgacactttaattgcaagtttccaggcaaatattatgacactctatgttaattactttccatgttttacaagtttatatatatttagaggcatgactaagttccagtgaatgtt

SEQ ID NO: 5480 - DNA, 201 bp, Bos taurus
atgctaaagctctgggaaattaaaaatagcaaatattcttttattactagcctcaaaaattcctactgaaagcatttggatctgctttcttcacagatatttggtaatcatattatatatgtagattgagattgaatgaaatacatttccaaacagtttaatactgaaacattaagcacaaaatattgcatatgtattgta

SEQ ID NO: 5481 - DNA, 201 bp, Bos taurus
gtttactatttttaaataaaaatactattattagactggtattgaaataatttggaatactattagattaaatctaaagaatacaaaatatatataaccaatgaggatcagagaagctttcttcatggtttactactatgcatcagaactgtgatgaataattatgattatatatacatatacactcatttttattcatag

SEQ ID NO: 5482 - DNA, 201 bp, Bos taurus
tctattattacaaaagaatgtgtaattctcacttccatagtacactgttcaatccaaaagtaaaaagtgctatagcctatatgctatgttatacaacacaaacaataaatcaacaaatattgaacaatattttctatttaaactggtcccttcattaggtggcaaaggaagtggggagatgagggacaggagttgatcttt

SEQ ID NO: 5483 - DNA, 201 bp, Bos taurus
ttcaagtgttttctttttctaaatggaagaaaatatttcttattaataagataataaccatctggctataaggaaggatttagccaaaaatctgaaacaacggggaacagagaacagaccaacaaaggcttgtattttatgagaaagtcttagaaacagtattttttaagaagaaatttttttttctaaattactcaggaa

SEQ ID NO: 5484 - DNA, 201 bp, Bos taurus
cccagcccagggattgaacttgcatcttctgcattggcaagtggattctttaccactgaatcaccagggaagctccagtaatcagcatattttcagtcaaacaataaatgttagtgagtttttaaaattctgtaagtcactttagtttcagaatttgaatcaaacaaatgccatcaagtttacctccaagatggctaagtt

SEQ ID NO: 5485 - DNA, 201 bp, Bos taurus
ccaggggatcttcctgacccagggatcgaacccacatctcttgcactggcaggcagattctttaccactagccccaactgagaagtcccatttatattatacttcatagttatttatactatttttttgagcatgtcagtgctttcaaatgtgtgaatttatttaattctcactctaatcctgtaagtatgataattcatt

SEQ ID NO: 5486 - DNA, 201 bp, Bos taurus
attatcattaaaggaaaacatatgctaagaccacaggaaaaacgatcacttgtcataaaattttaaaacagagaaagcaaaatgttaagttctagctagacacttcagcacattgaagactctgaacttgacatatgttttaaaataaatgacctaaatgtacacactgctatatttaaaatagataaccaacaaagacct

SEQ ID NO: 5487 - DNA, 201 bp, Bos taurus
gttccttcaagaagaacttggaatcgacgaagaccttccaccaggcagtgagcagcgagaaagttcgctgtacgaacctcaactgctcagtgattgtagaaatgaggcacaagggctccgagccttgcgtggacgtgctgttcggagacgggcattgttgattatgcgcagcgcgcacctcaccgcccacaccgcccagga

SEQ ID NO: 5488 - DNA, 201 bp, Bos taurus
cttgactgctaccaacaagtatttaaagtgccttaaatataaaaggcatgtgcaaggactattaaaagatggaaaaattaagaaaatgccacatcagagaaagagaagcctactcaaagcatgggctaatggtggttaccctggctgaggacagtgtgaggtttacccttaagcttcctgatagtcaaagaaaaagtgcaa

SEQ ID NO: 5489 - DNA, 201 bp, Bos taurus
ccttgcctgtttgagtttgaagaaaagcaaggccaaagtgagtaaaggtaagtgaacaggagacatagcaggttatgtgggaaaagagccagttgaggtctggggcatgtaaggccttgtagttcactgaagggcctttggttttgattctgtgtgagatgggaagccattagatgatttgatgattagatgatttgaaca

SEQ ID NO: 5490 - DNA, 201 bp, Bos taurus
ctttattaaatgtttccatcagtccatgcttgctaggtgctccaagggagttaatgggagtcagcagtggcctctctgaattctgtggaaaagacaagatgcgtatgcttcctctgttacagtgttcagtgtttgcaaatgaatagttgtgcattgttatgcaaataccaaggtaatagaatgtgtgtaaattacaataag

SEQ ID NO: 5491 - DNA, 201 bp, Bos taurus
gtgtttgctgattggtgcttattgaagttaagttcctgtacttccacaaagactgggagataggcatactgtctccttgatgattatgtttcaaagggatagctttcaggcccttgagaaagacattcttgggttgtaataagggcaagaagcttttagaaagatttattcaaagggacagagaaataatttatgatagaa

SEQ ID NO: 5492 - DNA, 201 bp, Bos taurus
aggatagaaaggaccctctcctgccctatccagtggagaatcattttcctcagatttgaaaaaaattaaggatactgcctaaaatatcctctatctactccgtatcagtggatgaaatttttaatctctataataatgtacacaactaaggctaaaatatgttttcaatgtgatttatttttcttccttttgcatcccttt

SEQ ID NO: 5493 - DNA, 201 bp, Bos taurus
caaattaaaacctgtgcataatttgaaaattcaaaagctaaaacaattatagtaaaaaccttcactcccccttgaatctctgttccactccccaaaatatcttcacccttgggccatttcttatagcatttggtatttgcttcccatatttctaagacagaggaaaatattacacaactcctgatttctcggttttttttt

SEQ ID NO: 5494 - DNA, 201 bp, Bos taurus
tgaatggtctgctcaggaatcactggatgagtgttttttcttataatccatttggagatgaatttatcagtggtaactaaaagtattctgtggaaagtacctcaatttttgttttttttaaataagtggagattattccctaaattggtgaaggcagtatgagtcaaagtgtcttttctaagacagatattttttagaatt

SEQ ID NO: 5495 - DNA, 201 bp, Bos taurus
aaagctacccagtccagtattttggcctgttgaattccatggagtgtataatccatgggtttgcaaacagtcagacacgtctgagtgacttttactttcacaggtgtgaaaattactgtcttattcccagtgttcattttctaagtttttgttaagtaaaaaatgttagtaatctagtgtcttcaagtttcctattttcaa

SEQ ID NO: 5496 - DNA, 201 bp, Bos taurus
caagcaaaattcatcaatgaatgctaaagcaaggaaaaattttgatgatcaagatatgtccatggactttcaatatctccccatggactgcttattagttacaagaagaaaaaactaattatacagtgagaaaatcaaataacacttggagcaggtggatcacaattaacacaactaacaagagacagatggttatatgtg

SEQ ID NO: 5497 - DNA, 201 bp, Bos taurus
ctgactgaaaaataaagctacaatggatccagactttgcaagacatcctaaagtagccaataacattactaagtgagaggaacaagaagtggctggagaataaagcatggagtgctgtggcactgaccccattagggtcaaaacaccctcctcagctccagaaccatcttcccattttttaatatgagcaatcattttttt

SEQ ID NO: 5498 - DNA, 201 bp, Bos taurus
gggaagagaaccagttcagaccagaaactcagagtttcctccagagcccagggaccaccccctgcccctaatccagtggtatcggccactgagcctaggaaagccctaactcacatctggctgtctctaaccttgaaagtcaaagtgaaaatttggtggtgtccaactctttgcaaccctgtggccaatacagtctatgga

SEQ ID NO: 5499 - DNA, 201 bp, Bos taurus
ggatttaggagttctgtgctataaatatataaagattggcccttcagggtaaagaaagtcttgatttacagtgtttactgactttgtggtataaatattcgtaccatggccagttcaagataataatctgaggtcactgaacaaaagtcttaggaatacaatattatataatattttcactgcagaattacaaaagatgga

SEQ ID NO: 5500 - DNA, 201 bp, Bos taurus
aattggtgatggacagggaggcctggtgtactgcgattcatggggtcgcagagtcagacacgactgagtgactgatccgatctgatctgatctgattaaacgtgaggccaatgttctgcatccatctaaaggttttatttttttgttatttttttatttttctcattctttttttcagttttttttttttaactttacaat

SEQ ID NO: 5501 - DNA, 201 bp, Bos taurus
ctctttcttctcacgtgacatattattggctggcttagcaaaagaacttgtgttacatctgccattgtcgtttgcaatcccaaccaattgtgaactaaccatgagatgctcgtaaatacttcacaatactgacgaacacaggagtctcagggctggctaagataagttttaaatatcaaccgaatcaatcatgtgaagact

SEQ ID NO: 5502 - DNA, 201 bp, Bos taurus
tcatgtaatgacacccccaaaaaacaacagctacatcttgaagcatcataccatctcatcagcttattaatactcaaaaattacatcattatcatagctataggcaagaatatttttggcagtaattaaagagtcatgattccatccctggatattatcccaaatcagctcttctgtttttcttctcagggactcccttgc

SEQ ID NO: 5503 - DNA, 201 bp, Bos taurus
ttttttgatgccaaactaaatgactctttttatttccttccacttattagtcaaggtttccaggcctctcctttggccttcgcagaatctgttacttttttaacagttttcttttaaactacaaggcacggcgtggagtgcaccctccgtacagtagactattgtttgcgacactcggcccggcagccccatcgctcaacc

SEQ ID NO: 5504 - DNA, 201 bp, Bos taurus
cgatggtcaggtgggtgtgaggcaaaccgcatcctcactggatttcccctgttcccgcccacgatcattggacctgtcattggtggatcatgatttgaagtgccatgaaccccttctgtcatcctggcccgggttcagttctgaagtcctgggcagttgggtggatgccaccaaacccccataaccacattcccagtgaaa

SEQ ID NO: 5505 - DNA, 201 bp, Bos taurus
gaataattccttagtataagtgtgccccacctgtttcatgggacatgcttacactaaaacattattacttacctgaagctgaaattaaccaagagttctgaatattgatttgcgaccttggcaattctattgaagaggctgctgataatttgttcagtaagtatataagatttaatctctagtctacatctgccctttaac

SEQ ID NO: 5506 - DNA, 201 bp, Bos taurus
atacttagcaggaaaaagaactgtttctaaagacctgaaaagtatttcagcagcaccaagtacatataaatattagtaattcagagaatattaataataagtcaattattcattaaaataggttccctcatgctatctatgatgcaagactagattagcctagttggagatacatacttgaaagtaatatgactacatggc

SEQ ID NO: 5507 - DNA, 201 bp, Bos taurus
agtctattactctattgtcccaaccattaactgctcaagcctgctcttttgtgactcagggatgactgagagatttctgtttctctacaaacaagaggccagggacaaacagaagcctttgtactttggggagtcctgcagggttctgctcagttccaccatacatgtacaatatttgctcaggttgacttctggaaggat

SEQ ID NO: 5508 - DNA, 201 bp, Bos taurus
ttggcagagtccccaccagctcaaggattatagatgaaggtatggatttggtctttaccctgagagcaatgggggtgaggggccatctggaagtggatatagtgtaagcaactctgtagtcagcttgagtggggaggtaaggtagagttagaaaggttagttgcagtgggccctggtgtgactgtgttgctgctgctgctg

SEQ ID NO: 5509 - DNA, 201 bp, Bos taurus
ggggttctgcagttgaggcccactctgtctggcagagacagtatccaggctcaataaggtcactcaacctggattcaaacccagatctcccattcatgtctggggcctttcccctgccacaccactcagtttgctatggtcacctacagtgcttggcctggagcccggctgagaatgagccccttgtggatctttgacttt

SEQ ID NO: 5510 - DNA, 201 bp, Bos taurus
ttcagcctctgctcaaacacttccttattagaggccttccctgacgatccctgacatttgtcctctgcacccctctcctcccctatacagtactttgtctttatcatctaccaaggcctgatagatttatttttgtatgtgctaattgcttatctaccccacttgaaagccctccaggagggcggggactttgctttgtcc

SEQ ID NO: 5511 - DNA, 201 bp, Bos taurus
gagaagatgggccagagggcagaaacccgagaaggcctgaggcaggcaggggcagagtcccaaaaggagtggacagagagctctgcctaagtctggcagagcccaggtggccgagtcccaacaattttcatgagcccctaatcttccagcttctggttcgaaggcggtgaggggaaatgcctcccacccctggcccagtat

SEQ ID NO: 5512 - DNA, 201 bp, Bos taurus
acaatcatacagttagcaagttttggagcacgctcaggtctgtcagactctagcccacttattacagttaaccattgccagaacctgttttgttttttaaaatacccagtcctggccagcaacttgtctttaatcttagtgggctttttaccagagtctattcttgtcattagcaattttaccagagcttcttacacagtg

SEQ ID NO: 5513 - DNA, 201 bp, Bos taurus
agtcaatcatatcccaccccactcccaaagccattgagatatatccctgatgaatgggcagcctcagatccatgaatccttcagccagcccaggtctgagcgctcaatttctcataactctgtgttaaggatgcaaagtgacacctgagacagctggataaaggatgaaataaggggcctgataagtgggatggatggctg

SEQ ID NO: 5514 - DNA, 201 bp, Bos taurus
atctcccccgtccccgtcctcgtctgtcaccacccgggtccacattattcccgcccgactctgcaagggggctgtggcgggtttggcctccagcagtcgtgtttattcttctcatctggccgcatctggcctccgtgctgagtcattcgctccatctgcctacctcactgtgggacacagtcggctcttcctggctctccc

SEQ ID NO: 5515 - DNA, 201 bp, Bos taurus
agcagtgtccagactgagctaggcgggaggctggggatgacctgagccaaacgtggacaccccctagttctagcaggccagggtagtgcatggatgggcctacagggggctgtggtgagctgtgccatgcttgaagagtgttgccagtggtggctcctggacacgaaggccttgtgtggccctggcttccgatcaatgggg

SEQ ID NO: 5516 - DNA, 201 bp, Bos taurus
gtagtaagggaaagagtgggacttgaatccagacctctctgactacagagatgtttccaaataaatgtgaagccttgtaaaaaacactgaaaagaacccaaagctgatgaagaaactccatcatcaagaacttggggtgagaaagcttacatctgagtccttgccctgccacttcctagcaatgtgaaagtgttagtcact

SEQ ID NO: 5517 - DNA, 201 bp, Bos taurus
aatttaaattaagaatctaggcctcagcttataccattaagacaaaccatctcttatgttttatttgtttcttttgcgttgaaagaggaaacacaactaacacccaaacatttaaggcctgaaggcaatcattaaaacaattctgacaaagccattcttactcccttttcaatgttttgtagtcatcatttttcctacagt

SEQ ID NO: 5518 - DNA, 201 bp, Bos taurus
ggagaaactaagtaatcagtctaggctaacagtataactgatgtgtgagaagggacataccaaactccaaggtactctagccatcctctcccacctaaagagggaggaaaaaattagaaacacttgtgaagttcacagactgaaatagtgagaactaattagggaacttccctggtggctcagatagtaaggaatctgcct

SEQ ID NO: 5519 - DNA, 201 bp, Bos taurus
gcctcaggtcactttagccttgagaagtctcccacaggaggtaacgctccacactaaccaatgtgtgtccagcggtggctggtatgtagggtttaggaaatgttgcctgaggtcaggggccctgtgctatggcttctcccctgcttcagccatcctgggccccaaggccttgacttcacatgcatcctctctagcccatca

SEQ ID NO: 5520 - DNA, 201 bp, Bos taurus
aagacagacagatggccaaaaagcacatgaaaagatgctcagcatcgctcattatcagagacatacaaatcagaactacaatgagggcccggtgggcagcatagcctctgagcagtagagggggcttggggctgagtcctcgctaatgccagtgtggagatggcaccatgggcaaggggcagaggggcaagttggccacca

SEQ ID NO: 5521 - DNA, 201 bp, Bos taurus
gggaggcaggtatctgagccagttctccatatccaccttatgcccaaagcttccgacatctgtctgcccctcccgtcccatcaccctaacctcggcctagcggttccgttcccctcctcaagttgtctcccccgtcccaggggaagcgcgatgaggcacatctgacctcagcagtccccagctccggaacccctaccgtgg

SEQ ID NO: 5522 - DNA, 201 bp, Bos taurus
ctgacactgtgggtttgtttttggccataccatgtggcttctgggatattagtttcctgaccagggattgaatccgggcccctgacagtggacgtgacagtggaccatgctcaaaggtccttctgattgagatcgcaccactgcacagagctgccttagccatgtcttgaggttaggagagcaaatgtgccttgtgggcca

SEQ ID NO: 5523 - DNA, 201 bp, Bos taurus
gaattctgtgaatcagtcaggttttgctagagtatgctgtggtaacaaacagcccctgaatatctttggtttctgacaacaaaggtttatttctagctttcttttcatgtgctgcatgagttggctgcagctcctgcctgagacatgctaatctcctagcagagggaaaaagaaccatggcaaaatcatgtgatggtttgt

SEQ ID NO: 5524 - DNA, 201 bp, Bos taurus
tccgtcctcttattttgcagtctccgcccccacccctactctctcctgagaataagaaggtccaccttgaacccttggacaccagtacattacaatcctggcacagtttccttaatgagctgtgaacccctgccctatattaaacatccttaggacagcttcctatctaggtccagacatgaatttgaaacaactgcatgg

SEQ ID NO: 5525 - DNA, 201 bp, Bos taurus
ctttctagcacctcccgcagaagctcctgtgctttgcccgcttgtgagcatagcttcagatgaactgaccaggagaaacgacagaaaggccaggagcagcgggagacatacagagagacttttacacaggaaggagtgaaaacaattggtgtgaaaggaaatgtggaaaaaggccaggaagacagagggagcggggaagaa

SEQ ID NO: 5526 - DNA, 201 bp, Bos taurus
gaatccccttcatgaaactcatatcttcatgaaaaatcattatgaaaactatgtagcaacacagaaaaatgtttatgatacaataaataatgtttacatctgtgtaaaaatgtagccatggaatggcagcaactaccaaaacatctacccacttgggtatatggataatggtgatttactttttaaaaagttttttccaca

SEQ ID NO: 5527 - DNA, 201 bp, Bos taurus
gttagatggatggggtagtgtgaaggctaaaggcagcattaaaatctttgaacccaagtcaactttccagacctatatccttccccaccttattctacaggtgttcagattcaaaattattcctataaaaatgtcacatgcatttgaagtctcaagacttttcacagtcagagaactgagggagctatttgctgagaatta

SEQ ID NO: 5528 - DNA, 201 bp, Bos taurus
gaacaatagagaaagaccccagagaggctggcccgttaagagcctgatgcactgagcaaaagacaaggccccaggaggaggggattttaagtgcctcatgcaccaaacagcagagaaggaccccagccagagaaggacgctttaagtccctgaatgggccgagcaacagagaaggatcagccaaagaggccctctgatttc

SEQ ID NO: 5529 - DNA, 201 bp, Bos taurus
tctttggtctcctttcccaggggagactgtactttggcacttggaaaggtttaggcaaatgtgagaatgtgggactgtcattgtggccaaggatatacatataatctcatcaggctaagctgtgttgagtgacagcaatgtcaataggctgttatcctgggctgttcctattgtacatatcaagggtctcttcccacttct

SEQ ID NO: 5530 - DNA, 201 bp, Bos taurus
aaaaaaaaaaaaaaaacctttctgaacttgattctttcaagaattcttccaagtgaggtccaaaattattctttatctaggaaaaattaaagataggcctgaagtgtgagtttctaccaggaaacagtgtgctttcaaattgtcagggcagtgctgaaaggataaaggggccaattttaaaggggcttccactgacaagca

SEQ ID NO: 5531 - DNA, 201 bp, Bos taurus
tgcactgccaggcagattcttaaccactaggccacccagggaaacccaggaacattcttttacaagggtgcagagccagcatgactaagcacagtcaacagggcccaaggttaaaatgaaagaactaggtctaatatggagtcagatttgttctttcctattacatatagagtctggagactctcagagtcgaaagaaacc

SEQ ID NO: 5532 - DNA, 201 bp, Bos taurus
taggtggcagtgaaattttagaatatatattgccaagctttcttgaggaagattttgatattctgctgactttcatgttcacttcaagagggtgtctactcagggtagacaccttgagacaccaagttaggcattgagttattttgagtaaagtatccaagatgtgaccattgaagaccatggctttgctcttaattggca

SEQ ID NO: 5533 - DNA, 201 bp, Bos taurus
cttgatttcttttttctttgtacttgcagggatgtgagaatgtcagtggttgtgaagaagtatgttacactgtcattaatcataggccctatcggagaccttccctgaactccaacgatgatggttatgagaacatcgcaaagagagtgagaccattaagagaaaggccagaaacagaatatgcccttctcaggagacctt

SEQ ID NO: 5534 - DNA, 201 bp, Bos taurus
ctgagttttggtacttatatatttgtttttagcatatttattaatcaaaatttgtacattgtgacattgactgaactcgtgaaactaatttaaacaaatataggagaaatacacaatattcatcagatacatcacatcaacattgactaaaatgaatgaatgaatgtgtctgtagctccctcaacataaaagtccccaaat

SEQ ID NO: 5535 - DNA, 201 bp, Bos taurus
ataatatttgatttcctttgtttgccaggtcaatctaccatactttattattgttggacagttttcactttgctcatgggagtatatgtgtatgtgagtacgtcattaatttaattattatttgcctggttttgtaactgccatttgtccggggttcatctttggtttctcattcttggatatttgttttaatctcactta

SEQ ID NO: 5536 - DNA, 201 bp, Bos taurus
agccaagagcaatccttctgcacctgctaaagtcaagaaaaagaagctctgtatcccacatgcaatgaaggagatagacttgtttccaaatagaaaatcataggccattttgggtacaatgttggaaatgtaggtcaggtccacgagggagagctgactgagtagaaaatacatgggtttctgaagatgggtgtcgagaaa

SEQ ID NO: 5537 - DNA, 201 bp, Bos taurus
caaaattttatcttctgctggtgaacggagattcctgggccgaagataagtgtagacaaaaggtgcatagtaaaatgtcactacagttaaatgtgttgaacaggtggtgaaggccttttttcttccatcttttgaacgcatacggtagacagcaaaaagaactcggccataggaagcagtgatgccaaggaaaggaaggag

SEQ ID NO: 5538 - DNA, 201 bp, Bos taurus
gggtcgccgaaaagcttttgctacctgttcttcccacctcatggtggtgggaatgtattatggagctgccatgttcatatatatgcggcctgtgtctgacagatcccctacccaggacaagatggtatcagccttctacaccatcctcactcccatgctgaatcccctcatctacagcctccgaaacaaggaagtggccag

SEQ ID NO: 5539 - DNA, 201 bp, Bos taurus
gagcaatttatattctgagggaaattcaaaatttttcattaagcttaccacagaattttttaaatttgtattgctatctctccataataattcaactttacacatcacaaaggaggaaacagagggaattttctcattatatttcacaggaatgaatagaagcatcttagtttttaaagggaaagattctggcactattat

SEQ ID NO: 5540 - DNA, 201 bp, Bos taurus
ctgaccttcacgagagagagaatgggcccggcccagctggcagatggggcactcactgccctcagcacagagctcacacagcacggcctgttggcacggaggcactgctcggttctgctcctgacacttaaggcatttcaacgactgcatgtggaatacggcctgcggaggaagggatactacagtcagtggcctgggccc

SEQ ID NO: 5541 - DNA, 201 bp, Bos taurus
catatttttcaaagagtatgattgttcatactctttacttgtaatgatatttctactggggtgctgatcttttgcttatttattcattatattctttatgcaatagttatctgaactcactgtcattaatctgaacccatttatcattgatttttattatttatctccagtatctgttttgatatttatttctgtgttgct

SEQ ID NO: 5542 - DNA, 201 bp, Bos taurus
ggtaatgtgagtgatgggaagtggccataaatacagatgaagctttgctctctcaccttctgctctgcagcccagtccctaacaggcaaggaccagtaccggtctatggcccggggtttggggagacccctgcactgaaaagaatttaaatgttccataagaagctgacatatcaggccgtgactaattcaacacacagag

SEQ ID NO: 5543 - DNA, 201 bp, Bos taurus
tttgtcccattaagattgctaattactgagacctgttcacaggcaagcattaggcttaaaacaaaatggcttaggccaaattaggttctcttatgtcaaacttgctggcatattaggttctcaatatgccagaaaatttggaaacctcagcagtggccacaggactggaaaaggtcaattttcattccaattccaaagaag

SEQ ID NO: 5544 - DNA, 201 bp, Bos taurus
gccaggactgggtgacttggcagaggaagaggtgtgggtcttaaaatgatgggtatgccaaagacaataaggcagaagccctaataattttgaaacaacaacagcaatcactgttgcttcctctgtggcaagctatttccatatgatttccttgtattcactcaactagccagttttccccagctagggccaggcacttgt

SEQ ID NO: 5545 - DNA, 201 bp, Bos taurus
tggggcatagtaaaacgtgaccacagtaagatgggaggagcagcagccagggcctcgttcctgccttcaggggagttcatttgcaggacctggaggaagacgagagtataggaagtcagaatgaggcttgtggggagaagaaccacaacgatgctggtcactactactcctttctcataggcagatatgtcctcacaagac

SEQ ID NO: 5546 - DNA, 201 bp, Bos taurus
cctgcagccgctggtgatgggtgacacgcatgcttcctgcctgactggaaagggcactggtgtgagcagagagaaagtcgggcctcagcagacagcatgtggagtctggttcccgggagcagccaagacccagaaggtgctggcttattaaaatagcagcctgcttcttcccacagacgtctgggaacgagcagcccatcc

SEQ ID NO: 5547 - DNA, 201 bp, Bos taurus
tcccagggcctttcatcctgtttccaagtctgtaagctcctctgagttctgacctgagtctctcctgctgctcaatgttcccaaattgtgtgccaccagaaggcctgattttgcagggaaaagagaagtgggtccctttcctggccctcagcagagttcagacaaagccaggtcctgtggatgctggcctgtatctgtgac

SEQ ID NO: 5548 - DNA, 201 bp, Bos taurus
gaacaccaccagactccacagatgtggccccgcgctcagagagactgagttggaggggaggtagacagtgagctgagcaggggcgtaagaaatccagccacaagctgggggccagggaggcttcaacaaaggcaccggtcaggctggagatggggaggcaaacatgccagggtgggaacctactggggtgtttgaggcagc

SEQ ID NO: 5549 - DNA, 201 bp, Bos taurus
ctctatctctccaccatgctctaagcacttcaactgcctcccatacttgtgtttttatttttatttggcggcggagggactggaggggcacacggtggccgcgttaccgccgtgtctgctcccggaggattaactcctttctcctcccattgcagaagccctaatgcactcctgttaaactggcaggaatctcagaagtga

SEQ ID NO: 5550 - DNA, 201 bp, Bos taurus
ttggccttcccttgaccctgatgtgtgggcggagcctggccccacagtgctcctaggcttccttccaccccctgccagcctaagtggctcctaacccctcggtgcatcacctataaggcctgcacacaggcacaaagaataagaaattcactccccagctcctaattccttccctgcctgggggtctggctgtgtcaggct

SEQ ID NO: 5551 - DNA, 201 bp, Bos taurus
aatccttccggctctgagttgcttccaacaggaccaccatcacctgcttggggttggctgtgacccacctgccccccacccctcgaccccggcctttcctcttccttctgatgatgattccagtgacatttccagcctggatccctctcccagaccagatgcatctgtctatctactgcctcaccatttcaccttggggac

SEQ ID NO: 5552 - DNA, 201 bp, Bos taurus
agacaagagaaattactatttccagatataaggaccctggaaagttggagaaaaaggagaaacaaaggaagaaaccccagacaagtaaacagaggaaggtgtcagaaaacaggatgatgtctaatcatgaatcgcaaacgagagacttcagatccaagtcttgtaactattattttaaaatcaaccaccctatccctccaa

SEQ ID NO: 5553 - DNA, 201 bp, Bos taurus
atgtggattcagtaataatagaatagtaaccatcgtgtattgacatctgctatatgtcagatactagacttgacctttatatatctggttaatgtctagactgttgattattccctggggctaggaagaactggaaatttaagtgatctcctgctttgggcaattaaaaaaattgtggtaaaattacttaacacaaaactt

SEQ ID NO: 5554 - DNA, 201 bp, Bos taurus
ccgcgaggccaacacctgacaaatgtgaggtaccacagggaccctgctaaaacactctgggcatcacagcatctggaattccttgagtggcagtgcagccgagctcggactctgaggccagactccggggttcaagtcctgaccctcaatcccagctctgagatgcagcaagttgctccagcgctcgatgcttctgggctt

SEQ ID NO: 5555 - DNA, 201 bp, Bos taurus
cagaaagtgaacaaggcaaggcccctgctctcttagctgcacacaagctggtgagaacaacagagagacaaatggaggcaacagagcatagatgtgagacgagttccaggcctgacgcagcacgaaggagaaactgcctaactcctccccctgtgttaggaaagattcacaaggcaaggatgccaggcctgaaggctgagg

SEQ ID NO: 5556 - DNA, 201 bp, Bos taurus
gccctaacttacagatgaaggtggttctacaggaggaaaggctacagcgtgctcaattgtcacagggcagcaagtggccaggctcaagtcttggaaatcctaccaccatgctctgctgtgtgtgctaagtcacttcagtcatgtctgactctttgcagccccatgcactgtggcctgtggcccaccaggctcctctgccca

SEQ ID NO: 5557 - DNA, 201 bp, Bos taurus
tctcatatattcagcatcaagccatttttctttcctctcaaaatccgtctactactggccagctgagcctactactaccaattcgaggcccaaagcaaacggagtcccagtatcttaagtttggaaaatgtgtcactcctcagcccgggcacagagccaggccagcaatgggtactggtcaccccagagcctgagagagtc

SEQ ID NO: 5558 - DNA, 201 bp, Bos taurus
tgatcctggaaggagaattaagatcgcttacgcagcacagttgcaaaaagaaaaaaaaaaaattcagtcatgtggaggctgtgggtacggcccctcttcaaccctcagttccccaccagatttcttagcttaaggtctctactctgaatctcaacattgtcatctccaagaggcagaatgtgcaaaccaagttatccccat

SEQ ID NO: 5559 - DNA, 201 bp, Bos taurus
ggaaggagtgaggagggaggtttctaaggtccaaagtcacaggcaaagccagtgctccaggaagttaaaagggtggccttactgcagggctccatagatatgctgatgaacatgcaggtgacatattcccttacaccctctatgcaagagagcagagtttgctgatttttttcacaaagctacttgagggcccaaagttct

SEQ ID NO: 5560 - DNA, 201 bp, Bos taurus
cgaactcggccacttcaaagcgctcggttagaggggcagaggaaggggcctgccttggagacccacagagggaagcctccagaggatgcgctccttcccacggagccgggaactcacttgtggccctgtcgtgccaccgctatgcagggggccggacggcttcctcgcccagcccctggggtgggggtcctccgtgcccct

SEQ ID NO: 5561 - DNA, 201 bp, Bos taurus
agagcaagaggttggggccatcaccccacagcacagcagttcccagatggtgggatttcacagccctgtaaaatgtccaaagaaatttggggtgggacagggaatagaaagtggccaagtttttcttttgataaataaaaatattttaaaaatcaattcttaccatcattttagtaaagaaaggctgttttcacaccaata

SEQ ID NO: 5562 - DNA, 201 bp, Bos taurus
tttaggcctatcagcccggcaacaggaataacctgacactaccttacaggcaagtgtgggtggtgagcatttgtggctatagttcaaattacttggaaacatttcctgagaaattcaaccacctaagaagccctgatacctaatgccctagtcactggttcaagtcagctgtggctcaaaaccagtgtgcatccttcccca

SEQ ID NO: 5563 - DNA, 201 bp, Bos taurus
caaaaagcaatactataagagaaatactaataaaatgaagaatcactcttcatcaaagacactaagagagttaaaaggcaagctatagaatagcagaaattattgcaagagataagattaacaaagggcttttatctaaaatatatacagactcattagaattaatgataaaagacaaccaaataaaaaaatgtgcaattc

SEQ ID NO: 5564 - DNA, 201 bp, Bos taurus
ctttgttgtgtagacaatccgccctgtctgaggatttgtgctgttattatgagtttgtttattattggatttatttctcctataagcaaatgtgttcacagcattccatcagggaatctccttaattgtcacataaatgtcatcttatgtaaattgaatatttatctttccacagaaggggtggaggggaaagaaaggata

SEQ ID NO: 5565 - DNA, 201 bp, Bos taurus
tcctaaatattctaaagcaatctcctttccccacaaccctctcatatatttaatattaaatatgcaaaacttcagagcatactagccagataagacacattaaaatgaaacatttgcccaacaaggatgccaaacattagggtttgttttattgcatgacgtttgcatgagaaataataattgaaactgtaaggcatcatg

SEQ ID NO: 5566 - DNA, 201 bp, Bos taurus
tgtaagtcagatgctacttcttaggtcacatagcggttgtgtgtgaataaatttgggaagtttggaagatggtcaagttggtgatgaaaatgaggccctgccttcagtgtggataatgtttacctgaaattgtttatgaagaaagaaactgccccacaaattagtatttcccacaaaggcttcagggaaagatctcagtgg

SEQ ID NO: 5567 - DNA, 201 bp, Bos taurus
cagaggaaagacctctggctgcaagtcagaagctgaagctcctgacctggttctgttactgcttcctgtgtgactctggccaagtctttgtccctttcccgcctgtcacaggaaggactgacactaggaaagcagtgtgtgtaaagctcggggctgtgctcagtgtgagttagctggggtcacactggccactactgcagg

SEQ ID NO: 5568 - DNA, 201 bp, Bos taurus
tggatgaggccccccctgccatgcctggcaagacagatggtgaggaagatcctagggtgaagcctgttccgcttttcacagctcctcttccagctctcccacccccactttcccaaaggccctgacaggcctggagctgggaggacttgtggactcgagcctggaggatggtggggggttgggcatccttagattcagggt

SEQ ID NO: 5569 - DNA, 201 bp, Bos taurus
ccaggccctcattaaaagagagacagagagagaaagagacagagaaacccacagtagtgccctaagcccatccctgtggtaagaagatcgtttgaaattatggtttctcgggaaagtggaggtggcctgtttcctcttcctgcccagagtactggtgcaggctctcccctagagaaggcacagtggccgttggtgggggta

SEQ ID NO: 5570 - DNA, 201 bp, Bos taurus
aagtaatcaagggttgtacatgggagggtttatgggtcaaacaaggaatctgtatccatcacttcaacccactcagggtattctactggccagaatccagccacgtgactgcgcccacctgcaagggtggctaggaagtatagctcagtgcttgccacaggcctcatttgtatgtgtatgtgtatgggtatgtgttggttt

SEQ ID NO: 5571 - DNA, 201 bp, Bos taurus
gactgaataccatccatccatagggctacagtgtgcatttgggtcaggagctaggcagaggttatgggaggtactcagagggccttaaagagccaagtgaccagaggctgaatcagccagggagtcccagagcctttactgacctctcaccagcccctggccaccagtgtcagcagtgagcgccagcagggcaagcagtga

SEQ ID NO: 5572 - DNA, 201 bp, Bos taurus
tactgggcctcttcttggtgcactgaaaataccaggattctgagctgaaaaactaggaaagaccagggaccatggtgaaaagcccaaagcaaaggatactgtgacaggagagggcctgtctgccagcctttccctttgtgcatcaccacatgtacagaaagaaatgcatcttttgtcataattttaatttctgtatgtaaa

SEQ ID NO: 5573 - DNA, 201 bp, Bos taurus
tgtgccaccatatcagaattaactgggagctgataaaacctgcaaattcccagaccttatgccggaattagtaaatcggaatctctgaagcttggacctgcgtaactgcattttcccagactacttagatgatccttgtataaacccaaatctgagaactgctgtccaagatgttgaccagagtctgaacggctagaggag

SEQ ID NO: 5574 - DNA, 201 bp, Bos taurus
ctgtgaactcacacgctgtgttagttgtggttgttatcaaagagcagccagctgtggaatctcagaggggcttgaggtcctgcttggcccctgatcagccgtgtgaccttctacttgacttctctgagcctcggtttgcccatctgtgagtgggggcaactttccacacctcccacacaggaccattgtggggcttagcta

SEQ ID NO: 5575 - DNA, 201 bp, Bos taurus
atggatgtgagagagctgcccaacggtgaggccctgtcccaccccttcccagtggcgtgaccctcagtcagcaaggtctctgaccccttccatgcatttccgcattcacggcccggggatgataactcttacttcatagcgttgtggtgagaattcaaagagcacactcaataagtgtcatttcctctcttttacctgatg

SEQ ID NO: 5576 - DNA, 201 bp, Bos taurus
ttaacacttacagataaaggccaaagccatcaagttcccgagcctggtgttttttgctgagctccactctcaattctctaagagcctcatttttcacttgacctttctccagagggcctaggaaagaaacagagtttctgatctaagggtagactgctgctttttatttcatagactcagatactccctttggtgtcaacc

SEQ ID NO: 5577 - DNA, 201 bp, Bos taurus
aacctaaagtaaagagttttcagcagtaatcagagcctgcaagagaagcatatttgcccagtggagctgaatcacattaggggccaatggagcctgacacaacagagccatgacttccagttgctgaggagccttgaatttaaattccttcccagctccagtgactgcccttggaggtcctgagaggcccaaacctctata

SEQ ID NO: 5578 - DNA, 201 bp, Bos taurus
gcgatcctgaatcctccaccctcctcacagaccgtgggctgagctcgggggagaccagcctcaccgtgtcggtgtggggtttgctcctgccccttggccaccgctaagaggggtgtctcccctcacatcccgaggcttcttgcttctcagccagggtagccacgaccctcagtgtcacctccctgggtgacacctcaggcc

SEQ ID NO: 5579 - DNA, 201 bp, Bos taurus
cagaatattttttttttcagccttcttgggcactgcactttttagggtttttttgttgtgtggtgaggcacattggtgtatacaaagttaatagagctggctaagcaacaggaaataatagctgttatcttccattatcttacaatggagtgtaatatgcaaaaatactgaatcctatgttgtacacctgaagctcatata

SEQ ID NO: 5580 - DNA, 201 bp, Bos taurus
caccagaggcctggaatttaagaaaggcattgatctccatccctaacactgcttctaatggtaactgttcttatgcaaactcttcacaccacgtatcagttcagcaaggcccagtcacttcactcagtactctacacagaccccccacgaagagcacctcccactctgcgcgtccccctctgctctcctggagtctcgagg

SEQ ID NO: 5581 - DNA, 201 bp, Bos taurus
agaaaaataaagtaccgtttcttcttcagtatacacaatcaagtgagatttcaagtaatagaatcataaaattttagctctgcatcacatctcagagctatggcctaaaaaggccatgtgacttagtagggccggattaagaacctggatttcttgactgctcagtgtcttttctggcaggcactgtacccttacacagtc

SEQ ID NO: 5582 - DNA, 201 bp, Bos taurus
tgaacttgggctctgatgccttgtggttggttgaggccgaaggaaaagtgacagggaatgagagagagagagagagtgtgtgtgtgtgtgcgcgcgcgtgcgcctaagttggggtgagagcagggcctagaattgcgggcagctctcctccagcagtcttacgtcctgctgtggggccgcggaggtgggggcctgactgtg

SEQ ID NO: 5583 - DNA, 201 bp, Bos taurus
ctgataagatcgcagaggcctacaatgtgctcagtgacccatgaaagcacaaaatcttcaactgctgaggggtggaaggcttgtagggcggtggccccagtggcaggagcagaagcagtactaatggtacctccttcagctacacattccacggagaccctcatgccatgtttgctgagttcttcggtggccaaaatccct

SEQ ID NO: 5584 - DNA, 201 bp, Bos taurus
aaaagttacaataaaatgaacaaccctaataaaatcatggccatttctaccaatacaaaaatgaaatggattcctaaaatgcttacttacgatacataccagattattcctggcccctcttttaaataatttgatttgatacttctataatacctatttcttggcctcaattttcctaatagcctaattgttccctttatt

SEQ ID NO: 5585 - DNA, 201 bp, Bos taurus
agacattgtgaaagtttccctttgcattacagtgggaatccaaaacgccatatggatccctgtcttagtagtgtgaaaaagtcaacatctctccttctaatccacattccttaggctatgacctatggaaaagcacactttcattctagaggagatcactttcacagaagcaatttcaagacctgaccaaatgtacaagag

SEQ ID NO: 5586 - DNA, 201 bp, Bos taurus
aagaatacagtggaagaaactgcgaactactgcagttttacaagcgatgaaaacaaaaacattttctctttcaatgctgacctctcacagtaatgaaattgagtatgaaaccactcctcacttctctaggagtgattctagctcttcttgcaaagagctgagctgctctttttcccggtcttccttctgtttcagttcatc

SEQ ID NO: 5587 - DNA, 201 bp, Bos taurus
cgggagaaataacaagtcaagaacctctggattttgaagaatacacaatttatccaatggaaattcaagctcaggatggtgcaggcctcatggccagagctaaggtgctggtcaaagttctggacataaatgataatgccccagaggtaaccatcacctctgtcactacttcagtcccagaaaactttcctcctggggcca

SEQ ID NO: 5588 - DNA, 201 bp, Bos taurus
cttccaagctgcactaaattcaggcctctataccactggattctgggtttcttttccgaatacacagggcttcacgcagacgtcctgtcatccagaaatataacaggagataggccagtgtctaaagatcagcaggacaagaatggcggctcggcagaggggaggggactacagagcattcatcctgctctccattctcct

SEQ ID NO: 5589 - DNA, 201 bp, Bos taurus
gagggaaaaaatgcacctaatgcattacgctcctggcctgtaccactcaggtgaccggtgatggttatttacaaggctggcttattcatggccactgaagctaggagaggcaggatggagacaggatctaacaaacgagttatttatatctacaccccccggacctcagaaggaaaattcccatacttaggcattcctaga

SEQ ID NO: 5590 - DNA, 201 bp, Bos taurus
caacaaagatttgcattttggagtttacaaccatggtgagctacacacgagtcccaatacagcaaggagaagagaactttttcaaagaggggaaaagaacgctgggagggctgtagtaaacaatgctatggaggaattgagagtttaaagtatagtgggttttcattggctgagttgtgacagtctctcgttggctaagct

SEQ ID NO: 5591 - DNA, 201 bp, Bos taurus
acgtaacatttgcaaatatcttttgctgtttagtaggttgcctgttcaatttgttaatagttttctttgtcattaaaaagctttttattttgttgtagtcccatttgtttgtttttgttacccttgcttaaagagatggatccaaaacagtattgctaagactgatgccaaaaagctttactgcctatgttttcttctagg

SEQ ID NO: 5592 - DNA, 201 bp, Bos taurus
gattgtctgtttgaccgcaaaagaatatatgcttttaaagcagggaattatgggttggaccatccgtcttcttcatggccttatccctagcgcttaaagcagtcccttgtgcgtgataggcagtggaaggtgctaaggcagcttctccagggcctgccttttgggacagtgctcacctcaaggtggcaggtgaaccactga

SEQ ID NO: 5593 - DNA, 201 bp, Bos taurus
acgcgcccctcaccaatgcccaactgcacctgtctcggaagaagagcagcgactccaaacccccatcctgcagcgagaggcccttgacgctcttccacacagtgcagtcgacagagaaacgtgagtcactgcatagggtgccctggggacaccttggcctcatccctgctgcccagagaactcacctctgcctttgtgtgt

SEQ ID NO: 5594 - DNA, 201 bp, Bos taurus
ggtcctggctgccactgtcatgttcaacctgtcccaagggtgctggggctatacagcagacaggcaaaagcaggctcagaaccaaggcctgtttccatagtaacaggtcaataccacccagggtcaattgtgagtgcctgcagccttgtgcaccatattaagtagcatcaatggatctctgaagttcaatattttaaatta

SEQ ID NO: 5595 - DNA, 201 bp, Bos taurus
cctggagcctctactcagcatttgcaattcatccttcagtttctgccttgaatcctaattagtgctatagtttatcagctccttgagggcagcagctgtgctttattataactggcttcctaaacgtgttaatcacctcaggtctcttcttgtactgacagccctttaatgactttaaagtgaacttaaaataaattcaag

SEQ ID NO: 5596 - DNA, 201 bp, Bos taurus
cacattcctgaagttcccttggtgtgctcacctctcctgctgcttctgcaggccctggtccacatacagcacagtcacatggccttttgacagcttttatgataggcaggtcagtctcccaccttgagacattgcacttgtgaacccttccttctgccttttgcctttctgggtcaggctttaatactttttccttggaaa

SEQ ID NO: 5597 - DNA, 201 bp, Bos taurus
tttatgactataaagtcattcttagcattcccctataattatttagtatctgtggaatctgtagtgatatgttctgatattgatagtttgtgctttcctgcttttttctttgtcaatatgaacagaagtctatcaattttgttgattttttgaaagaagctgcttttggtttattgattttttttctgttttctattttcc

SEQ ID NO: 5598 - DNA, 201 bp, Bos taurus
tggtcaagtctgaattttttctgaattcaagaaagtacttctgtaaaatatgttaatcagaataaattatttccaaggcccttccagtcttgaattctatatgtgttcatccatccatccatccattcattcagtcactctttcattcatcacttcaaagcagctgagcacctgctctcagctaggccctgaaggtgcaga

SEQ ID NO: 5599 - DNA, 201 bp, Bos taurus
caacctgaacgccgtgtcatcgtcgaggctccgaagcatgaaatggggttttgcgctgaagtctgagagacacggtgcattgagcttggtttggctatttccccccctgctgtttgtttttaaagatgaaataaggacaggcatgaaaaaggtctcctaggtcctctgtacgatatgacagccagcagtacaggcaggaat

SEQ ID NO: 5600 - DNA, 201 bp, Bos taurus
ccttgctgtccaagggaccctcaagaatcctctccaacaccacagttcaagagacctggtaggccaaggtaaacattgagtgtgaatctctctttctaaaggtggaggaactcaagctcagagaggcagaatgccaggatggtaaatagcagcctgggctctgactgctgctctgacctgtacatcacactcacacttctg

SEQ ID NO: 5601 - DNA, 201 bp, Bos taurus
ctattttctttggaatcattgatggatataaaaagtttaatttgctattaactgctttcatattctgtttagttcttatagtatggtaaatgatacaggtgcagtatcagtattgtaacattgtgtggtgaaaactacaaaagtcattctgtggatatattttacaaggcagaccagaaactatatttcagattcttgtgt

SEQ ID NO: 5602 - DNA, 201 bp, Bos taurus
aggttcaaaagggagaggatatacgtacacctatggctaattcatgttgatgtatggagatatcaatattgtaaagcaatcaattaaaaatataattttaaaaactgattaaggttttagattagatattttaattaacacttcaggtgttgaacaaaatgctgatttatatttagacacaaccagtttcaaaatatcagc

SEQ ID NO: 5603 - DNA, 201 bp, Bos taurus
aacggggtaccttcacaaaaccccatttctaccaatactgctagttcactcagggttaggctagcacataaaactgtgaaccagggccatatttcatggaataatcaggcattaacaccaagcataattcacattcctcctcacagagccaccctccaacaaaccactcttacattgttagagcgccatctagaggccatc

SEQ ID NO: 5604 - DNA, 201 bp, Bos taurus
agaatagcaaggagagacacgaaggccttcttcagtgaacaggacttaaaaatagaggaaaacaacagaagggacagtctacagatctcttcaggaaaattggaaatattgaggacacatttggcccaaagatgggcacactaaaggacacaaatggtagagacctagtagatgcagaagagatcaagaatacatggaaga

SEQ ID NO: 5605 - DNA, 201 bp, Bos taurus
tgatgacacatctaatgtcaaatatgattagacttaatttgagcagtctttttctcaccctctctggaggagaccatttttaaaatcattgtacaggccatacaaaacacatctctgaaaaggagacactgaggaccacctgtttgctacttctgcttcccagcctctacctttattcttccaggaccagggaggtggaca

SEQ ID NO: 5606 - DNA, 201 bp, Bos taurus
actcatttgcaaaaatctgctctcacaattatttaatttcaaggaaaagcagtcctctggggcatgagaagaagtgggatggaaggaacaatgaggcctgtgcataattccatagctgccaatgtcctacagacctcagtttggctctgactttcacaggaaagatttattctaaagatgaaccaattggcctcatccatt

SEQ ID NO: 5607 - DNA, 201 bp, Bos taurus
aaaataactagatccctggcaatatctcatttttattacatggttagaattttagaaaataagagaaatctccaataagaggggaaaagtatgtggatagcagagtgatgaagagtaagtacatccaaaaaacatgggttgcttggaagaaagaatttatatcatagctatgatgggtagactaagctttgaagcaagatg

SEQ ID NO: 5608 - DNA, 201 bp, Bos taurus
gagaagtgcaaagttggagagggctataatctatgagcactggtagaatacatttcttctacatcttgttaaaaccccccgtgccaaactccttgagaactgtcttaagcattcagagccaaaagattcgtcattgtaataactgttttgggatcatggggaccataccctagatccactgaggttacaaatatagcacct

SEQ ID NO: 5609 - DNA, 201 bp, Bos taurus
cacccaagaatcaggtatggggtttaactcctttatttgccccagcatcctcttgtgaattctatgagccatgatgcctagaacaagcagaaacacacagcactttccaggcctctggcccatccttagctgccctgacaccatcaccaggcaatcagcaggatgtcctgatgaaggacggacatcagcttctccagaatt

SEQ ID NO: 5610 - DNA, 201 bp, Bos taurus
tggaaagacactccagcaccacacctacaggaaaagctctctcggggaatgggaaaaatgaatgagggcagaagggcccccagaatgggtgaggtggctcttccctttgtccttcaggctcccacacacctccagcccttccttcaggattccctgtgccctcctggaagaagacaaggccaccagcagcttcaggatcag

SEQ ID NO: 5611 - DNA, 201 bp, Bos taurus
atacaattgtcacaggttctgaataaacatacacacttgtacatacatactcagtaatggattcacaactgctcaaacacacattcttcaaataatagttgtacccacaaagcacagtcctaaaaaggcacatatatgtagttatcatcattaaaggtagataactgaagactggttgaatgtatttactttggatggcat

SEQ ID NO: 5612 - DNA, 201 bp, Bos taurus
tcctgtactgataggtgaatgatagattctctgagctcctcagggcctctccccgctcttgcaccctggctctttctccaggtcctccccatcgctctcccatccaaaagctaaggccagctgcagttgagacccgcagcaatgaaacccttcttcattctgattagctggtgcctatgacatactggcggagaaggcaat

SEQ ID NO: 5613 - DNA, 201 bp, Bos taurus
tctgagacttttcaacatcaaatggctttattttacaaggtggaaaaacaccataaatgactacaaatgctgattctgggcttattgctcattctaagcgcagcatggctagtttatgcttaacttgatctacagaaactgaagatatcttctgacttatttcccacccttttctaaagtagattgctgggtggtccgtga

SEQ ID NO: 5614 - DNA, 201 bp, Bos taurus
gtggcccagtctcctccctcatcagtacatggagggattcagaaggtaatctggggttcacagggaattaaaggtccttttggcctatcctctagatcattgtttctcaatttgttgtctttggtcttctacatcagagccagccagtttggtttgtaggccagcagcatctgatctcctaggagcttattagacatgtaa

SEQ ID NO: 5615 - DNA, 201 bp, Bos taurus
ccttccctgctccacagcctttgctggggcctctgggaaagctcttcttctactctccctgaattgtttgcatgtctgtcttcccacctaaactgaagcacgtagcatcatgagggcccagcacagtgatcggcacacactaactgtgcaactggattaattcacattgcagttttaaatatctccacgggtggctttgga

SEQ ID NO: 5616 - DNA, 201 bp, Bos taurus
acaataaacttggtggccttcatatcagtgttacccaatagaactttgtgtgacgatgggcatgttctgtatctgtgctatccagtgtgggagctgccagccacatctggctgttgagcacttgaaatgttagagcaactgagggactgaattttaaatttcatgtgatttaaattatagaaataatcatgtgcgactaat

SEQ ID NO: 5617 - DNA, 201 bp, Bos taurus
agatcccctctttctatgactataaaacaaatcaattacgtgattgttttttctactatagattaaggacattacattcatcagtgacacactacattttcaagtatattaattttatcacttcctaggtaagaggagaaacttgttcttcacaagcctttgctgacctcattcatgcaaacagcatttattgaatgttct

SEQ ID NO: 5618 - DNA, 201 bp, Bos taurus
ctccttttcctcaagtttccaagacgtagagaactagaacgctgttcaaaaccttacaactcagtgtattccagccttcacagtctacagtctttaaacaagcccagaagtagcttcctggtatcctccaccataccatgcttcctgcttcctctctacctgaggctgcatggtacagataaccagtagcagattcatcat

SEQ ID NO: 5619 - DNA, 201 bp, Bos taurus
ataaccccggaagcttgagtgtgtcaacctgccctagctctaatggtaaacttgcagtggatcacaggtagtgacccacagtgcccctggcttgcaaacagtcaatgaacattgatgatgttgataaggcacactctttttctggtattgagttccaagggttatttccactctgtcattactgaagcagatgaattaatt

SEQ ID NO: 5620 - DNA, 201 bp, Bos taurus
actcaatgcagcccactcttatagcccagccaggttccaggtgtgccagccaccaagcttgggctccgcggggttctcccagtactgggagaatcaggccgactacctaaccaggactgtgatcttgagttaggacgtaacctctcagcaccccagttttattagctcacagtggtagtattaataccaggctcacctcac

SEQ ID NO: 5621 - DNA, 201 bp, Bos taurus
tcttttgttaattgtcggaatctcagctcagattcttcagctgccaaactcttgaggttataaaaaaaagccaaaaaataattatgttacgttcacttcctgtgtccatgtaaattgtttaaagagaaataaaagtttgcatgattttggattctatgtaattttattcttaattttaaaggatgttacaggcacaaacac

SEQ ID NO: 5622 - DNA, 201 bp, Bos taurus
caagaataacagcacagccctacacacattaggtccttagtactgtacatacagtgagctctgccttctatgcggctttctgtcaaaattctgaccatttctcatgactcagattaagtattttctatttcttaaagattttccccatttattccatagatgtaatagctctaatatctattatttctcaattataccatt

SEQ ID NO: 5623 - DNA, 201 bp, Bos taurus
aaatagataagacatgggagccataaggaatgagctttattaaaaagaccgtgcctattgctaccacgccaaggtgttttacaaaggcggtacgtgacactggacttcatttattctgtgaatgtccttatgcaagattctttggctcttcacacagtgaggattcagaccttaaagagttttagctaaaggccagatcca

SEQ ID NO: 5624 - DNA, 201 bp, Bos taurus
tggctggggggaaaaagttattttaatggttttctttccctcttcagggcagaagagccttcttaggtctgaatccttagagactaggccagtttgagaccaccatgatcaagttcaattcagagtagtgggttatcttaggtttggaaagacagctgtgcaagaaatgatgaataaactgtcttgagcatttccacaggc

SEQ ID NO: 5625 - DNA, 201 bp, Bos taurus
ttttaatagcttttatagcaaaattagttcttagagtaggcagggcaatttttaaaaaacaaaaacaggcaatgttacttccttttgtaaaactttctgacagctcccctctgccttagaataaatctagtttcttgatttgggccataaagtgctacataatctggcttgttctcaccttgtactactccccacctcaca

SEQ ID NO: 5626 - DNA, 201 bp, Bos taurus
ctgaccacatcagaatccagaagtttccagtttcttaatatcaacttgatggtgaaatttgcattatgaagtgcaaaatccaatcctcttggcattttcacttgatctttgtttcttggttatacaacttcctttgtctaattttacctgttatttatttttaagcttttcaccccctctcactcagctttcagtagagac

SEQ ID NO: 5627 - DNA, 201 bp, Bos taurus
ctccaggagttggtgatggatggggtggcctggcgtgctgcgattcatggggtcacaaagagtcagacacgactgagcgactgaactgaactgaactgactgaaaaaataaaagggccacctcattccatttccaaccctgctttacttagaaggttgaacctactggatggtagcttcttcaccccctttttctcttccc

SEQ ID NO: 5628 - DNA, 201 bp, Bos taurus
gatgttttaaaaattttgcacctaatcatcacttcttccacaaagcttccaagatgttctgcaaatctaatttagagatcttcactgtttcattgtatctgggcatattttacactgatgcttagcccactgtttaaaatcttccatttgtctttcttctatgctagacagtaaactacttgaaggaaataactgtgtctc

SEQ ID NO: 5629 - DNA, 201 bp, Bos taurus
tatgtccacttgatgccaacccatatatccacaccttcagatatatttctttgaaggaccctggccttggtttcttcattgggccagactgtgagatttagattcagttcagttcagtcgctcagtcgtgtccaactctttgtgaccccatgaaccacagcatgccaggccttccttgtccatcaccaactcccggagtcc

SEQ ID NO: 5630 - DNA, 201 bp, Bos taurus
agaagtccaaggtcatggtgccatctgggtagatttctggtgaagcctctcatccaggcctgtatatggcagccttcccactctgtcctcacatggcctcttccctgtgcacagacagacagagacagagattgctggtatcacttcctcttcctagaaggtcatcagtcctattggattagggcccacctttatgacctc

SEQ ID NO: 5631 - DNA, 201 bp, Bos taurus
gtgaacagtcacaggccctgtctccatgcagggcccacagtcgggatgggcggggaggtctctttggggtaggctgagtttcagtctcctccctccactccccactccaggaggccctcaccccttctcttcctgtccagtgttacaaaagctccaaggaccggcagccgcacctgaggctagcgctggatgtctgcagtg

SEQ ID NO: 5632 - DNA, 201 bp, Bos taurus
tctgtgctccgaaggcaggggggccctggttcaatccctggtcaggaaactggatcccacaagctgcaactaagagttcgcatgctacaactaaagatccgcaggcctcaacgaagactgaagatcctcagtgctgcaactaggatctggtgcagccaagtacataaataaacaaatatttaaaaagagagagagagagag

SEQ ID NO: 5633 - DNA, 201 bp, Bos taurus
attaactttagcatctggtttccttcttcttcatgcatcttgatggcctgtctcctggttctggatgagtgccaactcttgtcacttcctcctttctactgcctctttcttgaataagtaattggccaaagtcaggagccaaccagaactgggaggaatcatggtacaaatgttgccaggcagaaatgttcacaaaagggt

SEQ ID NO: 5634 - DNA, 201 bp, Bos taurus
ttcaggaagccttccttgatcctcccccttcctcctccagggggattaagtgcccctcagttccctcagataccctccctgctgtcacactcgcctgttttcttggccgccttgggttccctgtgatgctggtacatcgtaaaagactgaactgtagaatatcagaggtggaaaagtccccagacgtcatctggcccaggc

SEQ ID NO: 5635 - DNA, 201 bp, Bos taurus
acactagcctttctgctcctttgggaaagggagtggccacagtcccttctctctgcctggagatccagagggaagaggcctgtggggctgccaggttattagtggattagggcttcctttaaaagcttcctcccattattgccaaaggattataagcatcttcagacaattgcatccatccttccacaattatacctgcct

SEQ ID NO: 5636 - DNA, 201 bp, Bos taurus
ctttatgcccctgcaggagtcttgcttctggcccaatcactaacttcccctggattccttctgcacttttctgctgggtcactaatcaagataaaagagagccctgggttgagggtcagggcctctgagttctagtcctgggatactgagacccctagatgggttatgggacttgctcaaagtcacatggtgagttagcaa

SEQ ID NO: 5637 - DNA, 201 bp, Bos taurus
atgatgatgaatgttccaatgcatgagccatcaccattcctctgcttgcatcacattccctaatgtcccattggccaaagcaagttacaaggccataacaggattcaaagggcagagatacagattttacttcttgatgggaggagctgcaacatgacattgtcaagaggaatttgaggccatttttgcaatctattacaa

SEQ ID NO: 5638 - DNA, 201 bp, Bos taurus
cccctccctgccggaactgcgagtggtagtagctgatggccgtgtactcgttgagacagggagccggcaggtgctcccggggactggggggccgcgggggaatcagatcttccaggttctggttgctgtaacggggtgggagaggtgctcgcttgttttccagctccagtgggaaggggaaacccccgtagaggccactgg

SEQ ID NO: 5639 - DNA, 201 bp, Bos taurus
ctcagatttgaacctgagctgcctattctgaatgctaaggttaaacccatcagactgtagtaataatagtagtagcgttactgactcaggttaattgaccgccttctatatgtcaggcacttttctaagcaagcccttaatatttaattcttaatccctacaatagcacaaagggacagagaggttaattaattttccctg

SEQ ID NO: 5640 - DNA, 201 bp, Bos taurus
ctaccaacatgagagcccaggcccaagccacttattatattagcttcctacaaggaaaatgttctcatccccattttacagatgatggaacaaaggctcctaggcataatgacgtgtccaaggccacacagctgtaaaatgtcagtgctaagattggaacccaggtttatcttgatttcaatgcctctgcccctctcaaca

SEQ ID NO: 5641 - DNA, 201 bp, Bos taurus
gcctgcagggaggtcgtgcagagtagaagagaagatataggtgacatggtctaacctggtggttcaaggggctcagtacatcaacagctctctcttcaacattcaatgttcggggctgcgcttaggcccaggacccatcgaaagctgggctactgactttaggcaagtaaaatggaaccaatttacaaatttccatttata

SEQ ID NO: 5642 - DNA, 201 bp, Bos taurus
gccagggtcaaatatcactttctagatgaagtttcctctatgccggtgaacttgtgcatctcttcttctgtgagcctctccacagtagctatgagacaacggaggaaaccagggggcttcaggaaactatgggaggggccctgtgctttacatagtaagtcacatgcatgcatgctaagttgttttggttgtgtctgactc

SEQ ID NO: 5643 - DNA, 201 bp, Bos taurus
ctggggaaagagtgtagtttcaacaactgggacagcaagtgcaaagaccgtgaggcagggcagacctcagctatttcaggaatacaaaggaggccattatagctctagtagagtgactaggatgtgctgggagacatggctagttgttgttgttcagtcccccagtcatgtgcaactctttgcaaccccacggactgcagc

SEQ ID NO: 5644 - DNA, 201 bp, Bos taurus
cacagagttgtatgttgtcttccctcctccacttctctcaagcctagaggtagaaaaatctcctttcttgcttccccgcttggagacaaaagcaaaacaacgcctgcatgtggctttggatgaaaggaacaggagagaaagcgtgaatgaaaggcttgtctgagatcgttagaagttgaagggtcagagactcataacagg

SEQ ID NO: 5645 - DNA, 201 bp, Bos taurus
ctcacagcgctggagggcacttgaagctcttagaggttccgggctgctcccccagcctctaaccttccacctctccctctagcccttcctaccatctcagtggcttttctggcctctctaattaccaggaatacagaggaaaccacagcttctgtttagaccagaaggaagaaaagaaaaaaaggagttagatacccgtca

SEQ ID NO: 5646 - DNA, 201 bp, Bos taurus
gtgggtaatgaagggccattgagataatgaatgagaaaaacgctgtggtgtatgagagccggctgtaattatttgatacctggggactcactggctctccggacccatgggccctgcatcctccagtgaggagggctgaccatggccttgagcatccccggatattggtaatttggggggcctggaacccagttcctttgg

SEQ ID NO: 5647 - DNA, 201 bp, Bos taurus
tgagagaacgaatgtgaaagctgttgaaaatgacaagtggcatctgaaataagaactaccatccgttgtgtgtgtcctttgtgtctgaccctgtgctcagtgcttccatgcctcatctgccagtcctcacacagtcccaggtggatgctcttggtcccctgctctacgaaggaggaggctgacgtaggctaccttgtgcgt

SEQ ID NO: 5648 - DNA, 201 bp, Bos taurus
gcactgtgcatagaagcccctctccccagcatctcagggcattgttcccttccaatgtgctttctgaatgaatttcctggctggcctgatggtgttttcagttgtgggaggctgaacagggagttggttcaggagagacagctggagtttagggctgcgaggccttcatccattcagtcctgtgaacaccatctgtgcctg

SEQ ID NO: 5649 - DNA, 201 bp, Bos taurus
gatagagataggaagggtctggaggactttctaaatgaggggcaagggcagagatgagagattgtttttatcctggagaagacaagcgtcagggtgatcagtttaatccctcaagggctgccttggggaagagggagatgcttgcttctgtgggacaccagagtcacggggttgggagtgggggaggagacggaatcagtg

SEQ ID NO: 5650 - DNA, 201 bp, Bos taurus
cagtgcctgtgtgtgtctcctgacttgggtaccaagatatctaagatagagtgggaggtgatggattttgcatgagaaccagcttggggtaaggccacagcgtttaaatctcactgaataacagaccctttttttaaacaaatgaactcttgattggaaagtcaaaatacacaacaggtaaagggattctgttctgaatga

SEQ ID NO: 5651 - DNA, 201 bp, Bos taurus
atttcccacctgccacacatcctctttgccccaggcttaagtttagaacttgggtggtatgtttgatggaggtttgaggacatagttagtcccaaaaatacagtccatttgttattattagtctgtgagacctgactgtgtttcttctccaccacccactgctttgagggtcttactttccattgggacccatttctgtta

SEQ ID NO: 5652 - DNA, 201 bp, Bos taurus
ataactattttgctatctgtccccacgaccctcactagtctgaaagcttcattttttaaaaaaagagctgtggctctttttgcttgattgttgtatcattcagaagtgaatttggctgcaagtagcaggattttaatagttgtggcttaagcctgcaggggcttgtttcccttacaaaatataaaatgtggagataggtgg

SEQ ID NO: 5653 - DNA, 201 bp, Bos taurus
accagtttctgatatttacttacttacaagcacccccctgtccaggcctgagactttgttcacgggccaagcaggtatgtcagactccatcttctgtgaggtctggctctccccagagagtactgggccctttacactaacctgtgtcctcaggttgctcttcgggaattcttcaatatgtcagcatcccagatggggttg

SEQ ID NO: 5654 - DNA, 201 bp, Bos taurus
gaggaaacttgggaaagaaggaatccatgttttgcttatagctaagaatattaaaggtactgagatgcaaatccaggccctctgattcagcaacctttccatcactctccaacatagtgtatgatgtccttaatgagcagcattaaagtggcctaaaagcagaacatgatgccccatgaatgccctttggctggctttcag

SEQ ID NO: 5655 - DNA, 201 bp, Bos taurus
tcatttaattaaaaacttttatggataacctcctgaataccaattaccgtattttgaacaagagtgattcaatccttcacctgatggcctttagagtctaatggagtttctcatcctcatttcaacttttacttcttatggtgttacggaacacaggtttgtgtgcccgacacacagtgaggccaaacaaacctccatgtt

SEQ ID NO: 5656 - DNA, 201 bp, Bos taurus
tttatggagatggatgctgtggtttgtaaaagttaaagttactcagagtctcaatcagtgcacagcagtgagataggcctctgtttagtccagtgtcagaggctttaagcctaacctcttccaaagttcagtgtccttctaacctgaccctgccctccatggtaagggccctgaaggaagcaaacttggcattctctttag

SEQ ID NO: 5657 - DNA, 201 bp, Bos taurus
tcccatggacagaggagtctggtgggctacagtccatggggtcacaaagagtcagacacgactgagtgacttagcgtgcacgataaggccaaatgataggatatgagattattttattgtcaggtatgctacataggaaatttggaaaactcagcagtggccacaggactgcaaaaggtcagttttcattccaatcccaaa

SEQ ID NO: 5658 - DNA, 201 bp, Bos taurus
gcagcctcatttttcctgttcagtgaactcaatctctatggctggttaattctgtcacttgagagtgtgattcaaatgaaggcaggctgaatgccaggccgtcctgcagtcatagtccacagctctctttcctgcccatcacgtctatagacccttggttataagagaaattgagacatgctttatttgtccaattgcctc

SEQ ID NO: 5659 - DNA, 201 bp, Bos taurus
ccagaggtcttcaactaattatcagtcttctaaagtacagagaggaatcttaactaaacaatttcttataagtactaaccctcaccatctggcctagacgatatcaacccttttctgctacagcatacacaacacgtggtgttccaatgagtgacggtttcccatgggcacaatcgcaccttgatatggcctcagaaacct

SEQ ID NO: 5660 - DNA, 201 bp, Bos taurus
cagtaacacattagtagtacaggacttttacatcaatggatagatcatccagacagaaaatcaataaggaaacagtggccttcaaaaacatatgcaacccgatagacttaatagatatatatacaatacaccccaaatcagtagaacatacattcttttcaagtgcacatagaattttctccaggatagagcacatgctag

SEQ ID NO: 5661 - DNA, 201 bp, Bos taurus
tatgacactaatatttgtacagtagccagtagatagcttttaaagtctgtctttctctccaatctttaaatgcagcatgggaagaaattagtttcccccccctccttgtccctaacatttctctttcctctggggatttctgtgcatttttcatatgtccattaattttcttattaatttaacatttgtttaggtgactat

SEQ ID NO: 5662 - DNA, 201 bp, Bos taurus
aagttcctcaattataaattatcaacagttgtcacaactcacaggtccttgtgaagtttacatacgatttcttatgtaaaaaaattagcatgttttctagcgtagattttactaatatcatcatcaataaattgggcttaaatctgtctccccactgcgacaaaactctacatttcgtacggttgttttatccattacgtt

SEQ ID NO: 5663 - DNA, 201 bp, Bos taurus
actgggtgaaactggagcattgtgtggatctgaagcagagatgtgtcacttacataacccaccatgcgctcttggattcgagttactttccttagaccccgctatgcccctacaagactgatgggaaaaacactgtagttgacacatttagaaatggaggcttagaagattggcaagtttacaaggctcataatagccagg

SEQ ID NO: 5664 - DNA, 201 bp, Bos taurus
ttatgtacctacttattattcatttgacttctctgctcattcatttgttcctgatgtcatgcattcactgtcacacacacacattccttcactcaatgcagatgaaaattcaagagttaatgacatcatttgtagaagttatcctaccattgggttgctcatagattggaggggatgactacacagacatacacgcagggt

SEQ ID NO: 5665 - DNA, 201 bp, Bos taurus
gcaatttgcctgtcactgtgctgctttactcatgtcactgcttatctctgagcctcagacgctctcatctccaaagaggtgaaacagtcctgaatgaagcgattttctaaggtctttcctggtatctcccaagactaagagatcattacggagtgatacctgtccccagcccacgatgactacttcatgacttttactgga

SEQ ID NO: 5666 - DNA, 201 bp, Bos taurus
ggggtaggatggctgggcatagaaaccataacctcccacacaagtattccctgcatcgcatcctgtgctgagtcaccccagttgttaaaggggaagaaccgtgtagcttgaggttaatggaatcctagatgaaaggaacatttctggtctttaatgtaaacagtttgggcttaattctgttgctgtcatctcctttttaaa

SEQ ID NO: 5667 - DNA, 201 bp, Bos taurus
tcccaaccataaaattatagtttgggctgcagagcagaatactttatacctttggtcatagaaagagatgtttaaaaaaatttaccagctataataccccgttccttggtcatggtgcttggtccaggatgggtccatgatataagccagaccaaacttttgagaattctccaaattaagtatacagagagggtcatcttt

SEQ ID NO: 5668 - DNA, 201 bp, Bos taurus
atctcttccagctcacactgactcctggacatgcccagagtgaagtggagagtcacatttgcatttaaatctcctgttgcatttcatttagtctttctggtgcagcacataaacataattcaattcagtaagtgaaattcctgcctgtgagtccatcaaacatgttgctctgattgcccattttttagtctgataaaatac

SEQ ID NO: 5669 - DNA, 201 bp, Bos taurus
ggattaatcaatcaaatgttttagttgaggaccattaggatatcaactttgccttaggcacagtggtaggcattatggctggtgtgaaaaaggaagaaactagagtacagatttcggactttgcaaaaatcaagatacacaaggaaaaaaaaatagataataaagcaaaatgttcatctgaataatttccaaatgcaggat

SEQ ID NO: 5670 - DNA, 201 bp, Bos taurus
ggtggtggccacatgtccacagctctctcccagttctcctttctctccattggcaacctttatgatagccatggggctccctgactcaaaaacagaagagcaactctcatcctaagagggccttgagttgctggtctggaaaaatcccttctccctctatgggattctacttctcatctctgcaataaaaggaatcattct

SEQ ID NO: 5671 - DNA, 201 bp, Bos taurus
caagtctgtgcgaccccaagactgagggactaacacacacatacacacacataggtagggctagttaagtgtgtctggataaaccacaatctgagcaaggcaggtttttgttttgttttgttttttggttttggattaaggcagctaaaactaagactagtctcaaatctgaataaagcaggcaaatgcctagatggtggg

SEQ ID NO: 5672 - DNA, 201 bp, Bos taurus
agcccactttggcctcctttgcatggcaaagcaataaatcttttctatttcatccaaaaccctgtctctaagaattaaatcactctagggtacagaggcccgatttggcttcattaggaagttactgaatctttctgagtctcagtttcctcatctaccaagagcacataatgatagtacccacctcaaagggttgtcaga

SEQ ID NO: 5673 - DNA, 201 bp, Bos taurus
ccgcttcttcctaacagttgggaacactgctttgcctcctgctcagctgtatgaagaaggaagactcaagtgtcctaagtgacaataaatcagccttctaggggcctccttaccagagaagagccactctctgggaaagtttgtccctaagcagaagggaagttaatcaggaagaattccatctgaggggtagttttgcca

SEQ ID NO: 5674 - DNA, 201 bp, Bos taurus
tcatgagggaagaaagcacattcacaacatatcctacatccttcatgctagctagtttcacatgtaagactatgctggtcttcaaattcacagactgacaaacttaagaacaggcagaaggcatgattcctaaagctgtgactgggagatttcaggtcaagatgctagaataatagagtcctagatggaaaagaactcagc

SEQ ID NO: 5675 - DNA, 201 bp, Bos taurus
tggggttgaaactcgccgggccccatggctccagcctgctggagacaggagcttggctttgaggacaggcctttggtgatatttctgctgtctgaccccatgggtacaagtggaatgtgtcgcccagctcgtcaccgggaactttctggatggctttattattcagagcatatggtgctttggctccagtcatcggagaca

SEQ ID NO: 5676 - DNA, 201 bp, Bos taurus
gagcctcttttctgttgtagtgagtgcttctgggctgcaggggatttctgaatagcagaggcactttttctgggtctttgttgtggatggttctcgtggacagactggttttggcttatgatctcttggtggagctgtattttggatgagggcctgaatggtggaggcagggttaccctggaaccctcacagaatgtgcct

SEQ ID NO: 5677 - DNA, 201 bp, Bos taurus
agaactttggctgcatcataagctgaagtggcccctaaatagctaagatacaaaagaaaaatcaaacataaaaagactgcctactcctgctccccagagggtcgaatcatttctttctgtccactctgacttgcatggcttcctatggtcctagctgtgtctctgtctgaggctgtccctgagaaggctgaggctagcatg

SEQ ID NO: 5678 - DNA, 201 bp, Bos taurus
ttcacagatttgagtaatctatgtggattattgcaaccaagtacagactccttttgaggatgctgcctggaggcagacaaaccaagtaaaaatggagtgaaaatacctacagatatagttattcactttgcttgacttctctgatagtgtcacatcccatgccagtctccctacctcaggagtttcatactgtctggtcca

SEQ ID NO: 5679 - DNA, 201 bp, Bos taurus
gaaggtttagtgaatgcttgattctctttccatcttattatgtgcattcaatattaagacagtgttttgtctcctaatttaggagttagatctcaactcaccttgtgatctgagaagtggactgattgaacccttgtctgcaaaagagaaaactaagattggtgacatcttaggtgagtggtctgtgcacctcacaaagtt

SEQ ID NO: 5680 - DNA, 201 bp, Bos taurus
caagcctgagcttagggtctctgtggtactgaaacaccaaggtagctacagacagtcggctataggagatcgtgcagggttttatattctcaatactcacaagtagactgaaatctgggcctcgtatttacatttttctcatctttgaaaggtattccggcaagcttgaatttcaaggggcatgcttagaaatattacatg

SEQ ID NO: 5681 - DNA, 201 bp, Bos taurus
accaaatgaggccagtggtactaggaacaagaagggaatgtcagcatcagtctcataagggctttagtacaaggataggcaggtggtctttctcctgtgacgtcaagaagctcttatttattcattcatatgacagacacacatttgtgtaaaatattatgcaagtatttacacataaatatttatgtgtaaatacttatg

SEQ ID NO: 5682 - DNA, 201 bp, Bos taurus
tgggtgccttatctattactatgggttgttatttccttccaaaaaagaaggaaatttatcctaactcattttcaccatgtgcttgttacacttccctttgcctcactatattcaaatatcttttcactgtgttcaagccccttcctcccttaccccatagtaatgtctcccagaaggaaacgaccatggaatctcattcct

SEQ ID NO: 5683 - DNA, 201 bp, Bos taurus
tgtctatcttttgtggacacaaagaccagatcccacagaggtgcatccacgtgagagttgtttagattcttcatagcagctcatatggccctgtgcagaggcttccattatgctcaagatcctatgctgtggttattactgtgtgttctggtctttctctggtcactctggatggccttcagtgtggcttcatctctttta

SEQ ID NO: 5684 - DNA, 201 bp, Bos taurus
taattaagttcccaagtgtggtgaagtatgcttatagtagatttattctgctacagatagtaactataaactctggacaaaatgtaaaacacaactgcttgaagaatctaataaacaaaagcaggagaatccagagagtgatagaaatttgggaaatgggactgctgctgctgctgctgctaagtcgcttcagttgtgtcc

SEQ ID NO: 5685 - DNA, 201 bp, Bos taurus
gagaagaaaggaagaaggaagatggaaaaaggggcccagcatatccaggagggataaacatgtggagcataaacaaggtgttgaagaaatgaatgaaaaagttgggccttgaataaatatcatgtgtgcatacataggtaataatgattatttcatgaaagcattaccctgaaatgctttaattcctaaagactttatatg

SEQ ID NO: 5686 - DNA, 201 bp, Bos taurus
ataactaaaaatgtaagttgtcaaaatagtccagttcaaagatagagactagcctggatttaaaaactaaaatccagctatgtgttgcctacaggaaaaccactttaaagataaatgcaccaaaggacagtccaaaagaaaaaaataagctaaacttcatcatagataagaactctgctttttgaaatccacagttaagaa

SEQ ID NO: 5687 - DNA, 201 bp, Bos taurus
cctccttcccaaggaagagaataaagcatgatgctgtcccaaacctactgttgcttgtcagagaaaaatcatcattgttaatgctacccgttaggaggacgtacgactcagcacaaaaatcacaaaccatgtagactgcttgtttaatgcactatcagtgtgaatgctggaggaaattcagggggaaagtatgaaaaaaaa

SEQ ID NO: 5688 - DNA, 201 bp, Bos taurus
tatctgatggagggaatcttgttttagcacagaagtgatgttgagagtataggaatttacctttacctggactagagaagttctccttcgttgaatccttgtttctggtttgagttacttataaatgtatgtatctttcatagttgaaaatgaaagtacatctaccattgtgccatttcagtaaatgtacgttaattacct

SEQ ID NO: 5689 - DNA, 201 bp, Bos taurus
aagtaatttttttttttttttttttttaccactgagccaccagggaagccacccattaaggctggctgaaagaaaaattgccatagatttgctggcctctattttttcagatggcaatggtttaatagattttactcacatcacattttgagcctggatggaacaatgttaaggccaaaagtttatattcaacaaaactta

SEQ ID NO: 5690 - DNA, 201 bp, Bos taurus
aagtcttgcctgtacattgaggatgttgcagttctccccttttctctctgttcattttctataagggtgtggttattgcttttggagctcttttagaaggctcagaagcttgtttcccagaagcaccaagcaaaactcaccagctgtctcactggcctgaatggtgtcacatgcccatctctgcgccagtagtggtggcca

SEQ ID NO: 5691 - DNA, 201 bp, Bos taurus
acttgcagctttttgcctctcagactctcttgtgatttgaaatgtgttattcataagtgtgctgagttccaagtatttgaaagaacagatgtggatctaggggaataataagtccttgctaatatcgctctaaaaggcagtgaatttgtacatattcgtgtttatacattttgctgcatgaaggtgagggcctgcatttgg

SEQ ID NO: 5692 - DNA, 201 bp, Bos taurus
tcctgaaaagtcgccacttgaggacatgaaggaggtaaagaaattagctatgagaacatttgctggaaaaaatttccaacctgaggtacaatggccctgaggcagtgaccaagaacagggacagcagtagagatgagatcagacaggtaatggggtccagacccatggaggattttgcaggcccttgtaaaggctttggca

SEQ ID NO: 5693 - DNA, 201 bp, Bos taurus
ctgaaaaacaaaataacttaattgtcttgtgttctctgttggctgtcatctcttcagtacatgcacttgcatctcacacaccgttaataggttcagagaagactcagcttacacacaggccagtgttcttgactccttgggagtatgtctcgtggtcttgcccaagtccttgaaaacacagtccaggcgtttgtgttccca

SEQ ID NO: 5694 - DNA, 201 bp, Bos taurus
atggttcttgtagatgaaggcgagttttcagaacatccactggtcatggccatcctcacaaggtcttcaggggggagagtggccctgaagtggaagcaagtttggtgtgtttagcaaacagcaaggtaactgatgtggctaagacagagtgaccaaagacagcactgtccagcaaggagggtacagaggcagcaggtggcc

SEQ ID NO: 5695 - DNA, 201 bp, Bos taurus
aggacagttgggttggaaaaagatattagggggcctaagtttaagcaagcacactttgatttccgtaacagttttggttgggatggcccccattccaccacgtcaatccaaggcatgctatttctctaatgatgatcaaagtctttcctgatatgtaatgttaattcactatctttgaattaattcactcttttttttcta

SEQ ID NO: 5696 - DNA, 201 bp, Bos taurus
atcttcccacatcaaacccatgtctcccacattggcagatggattctttaccactgagccaccagggaagcccagatatagcttttactttctgctacacatacctgtctggcaggtagaaagaatctcataatttagtatatttgtttcttttttaaatccagcataatctgactatgtaacaatacaacagtcacttac

SEQ ID NO: 5697 - DNA, 201 bp, Bos taurus
gtctattcttgcctcttttgtcattgattaattaaccaaaagtatatgattctgaattctccatcctcttccattgatctgtgtgtctattgagccagtatcataatattttgattaccatagctttgtaatatagtctgaagttggggagtgtgatttctccacctctgttctctttctgaatatttttttggccttctg

SEQ ID NO: 5698 - DNA, 201 bp, Bos taurus
gaaggaaatggcggcccactctagtgttcttgcctggagagtcccagggatgtcggacgctggtgggctgccatctatggggtcacatagagtcggacacgactgaagtgacttttgaagaacaaaactccaagccaaaacttgtacttgctaatctttgcaagatcaactttctaacacatataagaatactatcaaacc

SEQ ID NO: 5699 - DNA, 201 bp, Bos taurus
atgcaccttggatgaggaacctaggcaacttccaaactcactgtcagctgaaggctttctgcgggccgcacccccaccaggtggggccatgggtccttcactgaaggaatgcccacctcatgtggatatttcaaatggaaaaccatctttcaaaacataccctccagtctcattttatagattctgtggccaatatagaaa

SEQ ID NO: 5700 - DNA, 201 bp, Bos taurus
aactgatggaagcagaataggaagggggagaaaactggggtgacagccctgagaaacagaaatgtggatggagcagagctcactgcctgcttcaaggccattgggctttgtcttgcattttaaggtttttgccctaatgagctactctattttaaacaagtcaacaaacctctttggggccttactcagttcctcactgca

SEQ ID NO: 5701 - DNA, 201 bp, Bos taurus
aggactcaataaataactactttaagaagctatttcctccaggaggccagtgacctaacagaactgaccacaacatggcagtcccatgtcctcactactcaggagcacaagattattttggcctaaaatgccaggcttggtgtggctgctaggagcatgcatttcatttgggctcttgcacttcctagctgggaccccagg

SEQ ID NO: 5702 - DNA, 201 bp, Bos taurus
tgttggcaatctctccacgtgtgaattccattaaaggctggctcacagctattttgggccacgcattagcacttggactttgattaaatgagagaaggccagacacctcgggatgatgagaaagaaatgagaaatgtcctctccctgccctcacagttccaggagtccttgtccactgctcctgggaggcctgagaatcta

SEQ ID NO: 5703 - DNA, 201 bp, Bos taurus
aggtggtgaagttgggttcatgcgcactctttaaaccacaatgctgtactgccctaaaaacacttccttttggtaaaagcattaggtagttatcaggccctaggcaaaatgtatgttcatccaaatgttaaaacctaaaatatttgaaatatgtttaaataaattgtaatacaatgtttttgaagaatgcttaatgatctg

SEQ ID NO: 5704 - DNA, 201 bp, Bos taurus
aatggccctccatcattaggaggtttttgttttctcataccccagtgagctagagcagagcttctcagactttaatatgcatgcctatcacctgtgtgatatgattcattaggtctaggtaaggcccgagaatctgcatttctagcaagctctcagatgatgccattcctgttactgtggtccacacagtagcatggcaag

SEQ ID NO: 5705 - DNA, 201 bp, Bos taurus
ttgcccatgattttcctgccatttggtatattatctgcatagccacatataatgctatttaaaaatagaaatatggaaagatactctttttcttatattattggataaatgtagtcacttctatgtggccttaaaggccctgcctattttgacttaattccaaactttctagggtcatcttctgctagattctggcttcag

SEQ ID NO: 5706 - DNA, 201 bp, Bos taurus
tcaccccaaacattgtttatccagaacactaagaccaacatttatgttcttagaatttataagtctttccttcccgatagcccttgtggttgtcattttgataacaggccattctgatttcaagaaaacctcattttctgttctgaattgtggtgccttcttctgcagtagtttgctaagcaagcatatgggctgtttgct

SEQ ID NO: 5707 - DNA, 201 bp, Bos taurus
ctatgtacctgggccgctcttggaccatgtcaccctctcaacacgtgtgagagggaggttattcttatctccataacacagaaggaagtggaggcttggagaggaggccatggatctaaagcctcattgctggcaagggacagagctaggagccaaatgcaagtctaccttaatccaatccctgtggttgcaaacactggc

SEQ ID NO: 5708 - DNA, 201 bp, Bos taurus
ttcagaaaccttgataaagccatgccaggcacattgcgggcacgacgtacatgttaccgattccttgggcctcaccgcagacatgcgaatgccggccaagcgcgatgcctcggtactgatgctcacggatcactcaggaagacagctggcaaactgaaacgggacagggacacctctggccttcaaaacagagacggccag

SEQ ID NO: 5709 - DNA, 201 bp, Bos taurus
actgcttaaagagaaaacctcactggcctaaactctctcataaataaccagccaaagaaaatctcagtatttatgaatgaaggcaaaaaataggagggagcgcaattaccatgagctacaacgtgccaggattcaccctctctggaccacacaggagtctatgaaataaatttgcctttgtcagctctcttacttgaaata

SEQ ID NO: 5710 - DNA, 201 bp, Bos taurus
ttttattacatattttatgttcaagatggaaatgaagatataatagtgagataattttatacagaggtaccatgaattttctgtgactaggggcaaatcagttttgtgttttgtgctttagttttctaaactatcattactaattatattaatagcaaatttttattgggtaatgactacagtacaaggggctgtatcaaa

SEQ ID NO: 5711 - DNA, 201 bp, Bos taurus
attctaaacattaagaagaatcagcttcattgtgtgaattaaaggcataccttgtagatactgtgcattcagttccagactatcacaataaagtggatactacaacaaagtgaatcacatgaattttggggtttcttggtgcatataaaagttatgttacactacactgtagcctcagagtgcaatagccttatgtctaaa

SEQ ID NO: 5712 - DNA, 201 bp, Bos taurus
gtggccttatcgtttgtaaatgatgtgccaagcataagagctggcattgttttgtggaggcagggagaggggactgcctagaattcttcactttgtggtctgcttagggggcctggaatgcaaaagtaggaagtcaagaaacacctggagtaacaggcaaatttggccttggaatatggaatgaagcagggcaaagactaa

SEQ ID NO: 5713 - DNA, 201 bp, Bos taurus
ttattacctgagggccatgtgaacacatttggctggggcgccgtgacacacagttgacacagtcacctcataaaatgttcatagctgattaaggggcatacgctccttcagaggcctgggtgtcccgaagagagaaagaacagctgtttcctatgctctcattaagggcttaaagccttcttcacattaaagagcttccat

SEQ ID NO: 5714 - DNA, 201 bp, Bos taurus
cattgctaccggcgagggtattaagtttctcagtgtgggttttcttttgttggtcattcatagttgtgaatccagctacaatttatttctttttatgctaacaatggacagcaaagggataaaactgtgtaaaagaactctttaattcctaatctcttttttcctactgctacaacttttttgtctttttcttttaaacgg

SEQ ID NO: 5715 - DNA, 201 bp, Bos taurus
attccaggtagaggaaccagtgaatgcaaaggacctgagtcaggtgtgagcacaacatgttcagggaacagaaactacactagtatggctggtggaataaagggaagagtggaatgagaaaaggctgggaaggcaggcaggagcctgttcaaatacaaacttgtaggctgtggaatggagtgaattttattttaagtgcag

SEQ ID NO: 5716 - DNA, 201 bp, Bos taurus
gtgttcagggctttgatgaccagccctataccccacatcagcccctgccacagctcgaccttccaaccaggaaggagactatcagagatgttgaaggcagaggccatcttgctgctgttcatccctctgcccatgagccaggagggttctgcagccagcagactgggaatcaagacacactcaggaaaaggtctaagcctc

SEQ ID NO: 5717 - DNA, 201 bp, Bos taurus
catgaagaagctggatgagaaccagaccttgaattacaaataggatttgaagaataatgaaactaatgagtggcaagtggctgaagaggaggcagagtccttcctaccacccagtgtagtgacaaggccgtgcttaaaactttctttgggcaaaagcgcagccttttttaaaatgaggagagagacctgtacttgtttctg

SEQ ID NO: 5718 - DNA, 201 bp, Bos taurus
acccactctgtcctaacctcctggcagaaccccatccctgaataaatccaatttccttccaccctaagcagcacactgtggccagaaaagaaggcttaacagggctgtcagttcttactttaacttctgggctgcagatcttagattccactgatcatcctactaaggccaacacctccatctgtgcatttcttctttcct

SEQ ID NO: 5719 - DNA, 201 bp, Bos taurus
gaaatgttatgcaaattttaagaaactagaaattcagcacagatgagggataagggagaattgtttggaaaaagtggtatgttgaaagcaaaagcgaaagtcactcagttgtgtctaactctttgcaaccccatggactatatagtccatggaattctctagaccagaatacaggagagggtagccttttccttctccagg

SEQ ID NO: 5720 - DNA, 201 bp, Bos taurus
tggttgagtcaggccaattgaccagtggctgagcagttgctgatagctgattgaacagacaggaaaaatggtctatgccatctgctcagcaagcagccttcattgtggccaaaagccaagcgtaaattaaaaagaagaaaaatcaatttaattatgcatgtgactaagctgtgtttcatgatgagagaactaaaaagaaat

SEQ ID NO: 5721 - DNA, 201 bp, Bos taurus
gcccatctccactgtctgaaccagctactcaggcctgagattgatcgccctgcgtgaaaatagtggatacaattagcactgacctcacaatgggatgagatgaaatacagaagagcttggccagactgggcattatttttaatatctgtgggccaccttatgtgtactgaaccttcttaaaccaacagctcctttaagagt

SEQ ID NO: 5722 - DNA, 201 bp, Bos taurus
ttatgatgcattggtgatgcgctgagatggtaaacatgcagtgtaatgatgggcgggggaatgtagcaggaagtgaggagaagcatcttaggcacttttcgttatcaaatcttttggttttaacatgcatgtgttagcttttgtgctagtgtgtgccactagaggagaacgataaagggcaaaaatgagccaaggtcataa

SEQ ID NO: 5723 - DNA, 201 bp, Bos taurus
acgttcaggccgagtggtggtaccaggtttgctacaagtggaaagaagggaacctgattgattactgcccagataaggggcgggtgaaatctggcagtcaatggagagtgtcggagatgggccagatggcagatggtcctgtctggggtgtgcagaagctgcttgaggctctgagagtccagcctgactgagcagcagcag

SEQ ID NO: 5724 - DNA, 201 bp, Bos taurus
tctctttaaaagttccaagtttccaaaagtgtcaaattgacattgtatcatacttaaaggttaagttggatgcatacaatatgaaaccaacttacaaatactgggagaaacttgcctctaaaaggccatcagatttttcactaagaataaaaaaatctaaaaatggaaaataagagatcaaatcttagggacagatggacc

SEQ ID NO: 5725 - DNA, 201 bp, Bos taurus
gcagggatttctgggccttgagacatttgcatttggtatcttgactgctgacctgccagcagctgctaaaccatgatatgctctctctgaaactcaatggacaggcagcaaataagtcaacctggccttcccagtttttgtgtcataattcgtattttattccttgtgtagacagaaaatagccagagcacctgctcttag

SEQ ID NO: 5726 - DNA, 201 bp, Bos taurus
aggtccccagcctctgaactctctgagccatatccctgggggcttatggcagtagagtctagggtcctttgcccctcttctaagtgagcccaggagatgactcagtggccctatcctcaggctggatggagtgtggaggaggaggcaccagcctggtctcgcccctccacctgcggcccaccagctgttcctttccatctg

SEQ ID NO: 5727 - DNA, 201 bp, Bos taurus
gcagcagcagcagcagcctttgttgctttcaaacttttcagagttgtgcctttcccacagctaccaggacccaaagaatcaccctgaaatggaagggccaacgattactgaggaatctgattctccagctccctctgctccccacacaggggaagcttcctggggactcactgcactgcaggccagagcagggcagagctg

SEQ ID NO: 5728 - DNA, 201 bp, Bos taurus
tacagccttgaagtactcctttcccaaattaagcaactttaacaattaaatgagataatgtgcaccaaacattcaacaatatctggcatgtggcacctgagaaatgcctactcccttaatttagagggcagtgggagccttgaaaaattacacagaaactagcaattgccggaaggagcattccaacaacaatcttcacca

SEQ ID NO: 5729 - DNA, 201 bp, Bos taurus
agcaagactgtcttcccaaggtcacacagtgagagaggggcagcactgggatgagagctcagaacttgcccaggcttaagttccttcttcttggccatgtttagctggacagagggcttcaacaagcatagttttcatgggaagaaaaagaagaaccagagaattctaaggggcttttctggtctgaggtttcaggaaagt

SEQ ID NO: 5730 - DNA, 201 bp, Bos taurus
cttaacgagattgcctatcacaatcactgggagcacttctgaaagaaaacttttccctgtaccacctcagaactaatacatcatcattctccagaagtaggacaagagaagcgaaaatacagttgtccaggtgattctgatacacatccaagtacacagacagatttagaggaatgaacacatccccaggccagttcctag

SEQ ID NO: 5731 - DNA, 201 bp, Bos taurus
gtactcaacctggggccctgtgagtatgcagaagggaccttacagacaggattgagtgaagaaccctgagatggtgaagaggagcctgggttatccgggtgggcctgatgatggtgttacaagtgtccttataacaaggaggcacagggggatatgcccacagacaaggagaaggagatgtaaagtaaggcgctttgaaaa

SEQ ID NO: 5732 - DNA, 201 bp, Bos taurus
agagggggacgcctttgtctggtttctcgccttttccctgctgagctcatgggagtgaaatctgtctctttccagttccacaattctgcatccttcaccccactccagaaaaggaaaggaggggaaacaagtagggctcaacattttaaagtgtgctctgtgcttgcttaggtggaaggaactagtttcagctgatgtcac

SEQ ID NO: 5733 - DNA, 201 bp, Bos taurus
tgcagaaaacaaaatagagaccaaaaaacagaagaatatagagaaatatgttccaaaataaaggaacaagataaaactccaaaaacagatcttaatgaatgaaatggaaatgtgtgatttacctgataaagagttcaagataacagtcataaagatgctcactgaggtcaagaagcaagaacaaagtgagaatatcagcaa

SEQ ID NO: 5734 - DNA, 201 bp, Bos taurus
aagaagagtaataaataaaaataaataattaaaaaagagcaataaataagtaatgtaataaaacttacatttctcccttattttgcacagggacagactcaataggaaaactctgcatttttgaaaattttacttcgctcatctgtttgctttttatgatttttagaatcactgtcttttttaattggagtatgattgctt

SEQ ID NO: 5735 - DNA, 201 bp, Bos taurus
cctacaattctgcagtaaatcaatcaacaacgagtctgaaaaacaggcaaaaaacttaaatagacatttctccaaaaatgaaatacaaatggccaattagcatataagaaaattctaaacatcactaatcattaaagaatgctaatcaaaattacagtgaatataacctcatatctattagaatggccataaaagaaagag

SEQ ID NO: 5736 - DNA, 201 bp, Bos taurus
caagtttgatcaaaagtaaatatgaaacataaagaaacagcaagtattattccataacaaaatattatagaagaaaagaaacactgatttacatagtagactaatttgaaaacaaatcaatactttaatgccgttagaccttttctttaaaaaaaaaaaaaaaaagaagctcgtttcactcagtttaaagattttgctttt

SEQ ID NO: 5737 - DNA, 201 bp, Bos taurus
ttgaaatggaaatggtgttctgggttgtaaaattaaaagataccccttctagggtggttatatggcatgtgttcttttggccaggaatcaaaagtagtcactggatacaaaatctcattctcaataaccataaaaactgaaaagcactgaatttaacaagaattatgtaaggcctataggaataaattcaataagaagttt

SEQ ID NO: 5738 - DNA, 201 bp, Bos taurus
tacaggtggaatggtcctcactgaagtctacccggagactgtcagaaggactcctgaaaaaccaaagctatattaaaaatatactgggtaggaaaggaagaaaagtgattggatcaagacctgtgcccttgtgaggggtctcaggggtaaaaatagatattacacaggaggacaccctgcctgggtagtgagcagttagag

SEQ ID NO: 5739 - DNA, 201 bp, Bos taurus
tgttgtctagagacgagaacatgcacagcccagactaaacccatccattctgcttccctggcaagcactcctactctggatcccttcctgatgcaatccataggcactctcctcatttctctccgcatgaaaaacactattctaagcccatcctactcctccacgagtttctcctatagcttccgagtctaaacagtttct

SEQ ID NO: 5740 - DNA, 201 bp, Bos taurus
attcacctgacaccgataggttcaggccaccacaaatttacttgtagaaatatcatccagctcgtgttttgcttctaaagtttcaaaaaggatgcattgttgttataagacatttgcattacaagaacagcacagtgaactctttgccattttcccaaattacctaggagtatacaatagatgtatttttccgtcaaagtt

SEQ ID NO: 5741 - DNA, 201 bp, Bos taurus
atggaaaatggattttaaataaacagagttgtgaagcacaatatatggacatctgtgcatctagttcactcatattttcttctttctttcctttcagcttatatataggcagctagaagctttgttgcaagtttcctgcacattactcattagcagtcttgcataaccaattaacactttttctttcatcctctttgatga

SEQ ID NO: 5742 - DNA, 201 bp, Bos taurus
gttccatttatgtcctaaaatttaactctgtaagtcctaattcaaaaaaggattgtttttcaataagtacatataaaaatttccattggcctgaactctaccttttggctctataaaaatgatactgtctttgaaatgctttagattaaaacacccatcccttccttccagggttatccaggggccttttggctctatcat

SEQ ID NO: 5743 - DNA, 201 bp, Bos taurus
ataagccttatctaattcttcgagcctgtaccagaatcactgtgctgaaatcccattcctggaatgatcaatagttttctggccaattccaatcagttgtcaggctgtttgggagaatttggaggattcgttaaggctcagctggaaagagaaacttgatgctgagcattgtgtgctgcaggctctgactggagaatggct

SEQ ID NO: 5744 - DNA, 201 bp, Bos taurus
gatagagcctgtggagtattacagactatcctcagacaagctgcatcagattcaacttataaaaatgatgatgatggaacaaacttctctgtactggatctgactcaaaccaactaggtgaaactccaggcctaatgatcagctatcttatttcatagatagaaaattgctgtggatgttgtgttaaataagtgaattaaa

SEQ ID NO: 5745 - DNA, 201 bp, Bos taurus
aattgtatcacaaaagttgtgtgtgtgtgttccacatttcactctgcacgctaagataattacatattcctaaaactagcatattttatgattcccaatatagctgctaatacatatccatcactttcttatccatatgtagcaggaaaagagaatattactcctgaattctcagcaaaaccctgaatttcactcctatta

SEQ ID NO: 5746 - DNA, 201 bp, Bos taurus
acttaaatgtaagatacaaaccaataaaactccaaaaagaacatatagaagaaaaattccttgcaattggtcttgggcaatgattttttatggatatgaaactaaaaacatgaacaaagaaagcaaaatcaccaagtgggattacatcaaatgaaacagcttctgcacagcaaaagaaacaacaaaatgaaaaggcaatct

SEQ ID NO: 5747 - DNA, 201 bp, Bos taurus
accctgatgctaagaaagattgaaggcaggaggagaaggggataacagaggatgagatagttggatggcatcactaactcagtggacgtgtgtttgagcaagctcttggagatggtgaaagacaggcctggcatgttggggtctcaggccacggggtcgcaaagggtcagacacaactgagcaactgaacaacaataaatc

SEQ ID NO: 5748 - DNA, 201 bp, Bos taurus
gtcaattaaaatgtatgttatatctaaatgtgaaacatatcagctaggtttaaactgtgcttcgtttaacattcaataaattgaaattaggctatgaacagatatcttagtaacttcatgcattaaagcagtctcttaattttggacatccattcattctaaaatatatacaaaagtatacaatgaagtattcatacttta

SEQ ID NO: 5749 - DNA, 201 bp, Bos taurus
cagagatgagtcttggtcttggctccctgcaagagctatacagaaccacctgatacacagtccctgagtgcttccacaggaactaaggcccccagtcaggcggagcaaaaccggctgggaccagaggctgataactgagatagctgaaacaccacctggttacctcatcaccagcaaatcagaggaaggtcacacaccctg

SEQ ID NO: 5750 - DNA, 201 bp, Bos taurus
ccttagtattgacccacataaaataccttataattccttagtcagtgatttcaaggactatgtggtgaacactcatatacactttatacagatttcaccagttgttaacgttttgccatatgttttacacgtacactgttttttttcctgaactcatagagaattagttgaatttcaccccaaagtacttcaccatgtatc

SEQ ID NO: 5751 - DNA, 201 bp, Bos taurus
tttcggtgaagttaatattattcttccataaatagtatgcttgattacgagaagatcacaaatctacaaaggagaaaactaaccgcccttagtcatttcccaaggtccttagtctaaacattgtgatattttgtcaaaagattgagtcacataaaataaaaacgtatgtagaccaagcagttgactaccagtttgcatcct

SEQ ID NO: 5752 - DNA, 201 bp, Bos taurus
taatgtgaaattctgttgtaaagggtatagtataaaataaacattaagagccagagactgtttttatctgttccccttcttctaccacctgtctatggaactaaaataaaaattttttttcaaacaggtaagaacactttacctgtgtttacccatttccatatctattttctgtagcccatggagaacatttcatgagaa

SEQ ID NO: 5753 - DNA, 201 bp, Bos taurus
caaaatcacatgatcatcttaaaagattcagaaaaagcatttgataaaattcaacctccattcacaataaaaactttcaaagtgagtatggagggaacacgtcaacctaataaaggccacaaactacaactaacgtactctgtggtgaaaagaagaaagcttttccttttaaatcaacaataagacaaggatgcccgctat

SEQ ID NO: 5754 - DNA, 201 bp, Bos taurus
aataggacttttgctcctgctgttctttacattctgtttttattgaggccagtctctttaagagtcagcaacttgtgaacactatcctagctgtagctggtcactgaagattctcagcctcacttttctctgtttagccaggttttgctcatactttaacatttactttacatcccaccttctccctgacaaccccagact

SEQ ID NO: 5755 - DNA, 201 bp, Bos taurus
acactggagtgggttgccatttccttctcctagtggttgccaaaggccagagcctgtcagacctacgaacgaggggctataagaccctgtgaccacagacggacatccaagtcctctccagggcccctatgtgctctgaggggtcaccagtataatgccagggttggtgtgagaaggaccacaaagctttctgaagtgtgt

SEQ ID NO: 5756 - DNA, 201 bp, Bos taurus
gtagaagtcagtaaagtaacattgtgaacagacaagtgagaaaagatcttatactcattattagttctaagaaaaatttctacttgttcagagtatggccgtagctcattcctcacatgtaaaagatgagatcagagagaagcaaacatggacagaagacttaaacagacatttctccaaagaagacacatagggccaaca

SEQ ID NO: 5757 - DNA, 201 bp, Bos taurus
tgttaggtatatagtatatatatatgctatttccttacaaccaaatgatgttacactgagacaagttaaaggaataatttgtattgtgattgagagagacctatattgtatccttaccttgatatagctagagcacagctaagcacattttattccaaaagaacctccgttaacaatgactgagacccctgtcctgtctga

SEQ ID NO: 5758 - DNA, 201 bp, Bos taurus
tgacctatgttttctacatcgtacgtgtagcattctctcaggaggtagaaggtaataggagccgtgtttctccagaaaataagacagaagcagaatggtatctaattaaaatgtttacaacatttcccatgagatataagccactgacattttccagactgcaagccaagaaatgcttaggattatacagatgtactttgc

SEQ ID NO: 5759 - DNA, 201 bp, Bos taurus
atctgtgaatacagatccattaacctcaataaaaacaaatggaacctcttgtgaactaaaatcagttcagatcatggatttgctttctctaatactcacaacatttagatggtcctgataaaaatgtcaggtcataaagaggtctactaatgtagtaatattcaaggtgattttcagtctttttccattgttattgtccta

SEQ ID NO: 5760 - DNA, 201 bp, Bos taurus
gtggagaaggagatctagcctcaggcacacgatagctttccagtatgactctgcctcctaagtactgtgataaaggtagagatttctttatgccttttatcagtttctgatgagcaccttaatttcccatgtggcttcagaactgagccggtttcaattagggaaaactgaccatgctttaggaactttgctagatttcaa

SEQ ID NO: 5761 - DNA, 201 bp, Bos taurus
gatttttctagcctctaaatattcttctgatcttatgcaacagaacataaacaaactatagccctgaggacagaacaaccaatggctggttccagtggaacttgacaagtgttttgtgtctgccgtggcttgacgatacagtttttagtcacagactgaaaatgattgtagctaacactgtcctccttcaagtgaaaacag

SEQ ID NO: 5762 - DNA, 201 bp, Bos taurus
aatgtgagcaagtacagaaaactccgcatcctaacatcctgctcatattgtttgaaattgagcctatctcatgagatgataaggaatggagaaacttgtgtcattggacacaggtcgacttgctctcttgtgtctcggtttctctacagtcctacccattttctaccttctcgataaagttaaatgagttcatatacatgt

SEQ ID NO: 5763 - DNA, 201 bp, Bos taurus
agtatatttacttctaaacataaaagatcaattctagtgcaatggtaattatttcttacataaagcacattttatgtaacaaaggttaaatatcaacatacggaaattaaaggtggtgcaactagttttagttcagtttgcctgaaataaccattgtttgttcttattatatatgtacaaaaatgtttaaaaaaagagtaa

SEQ ID NO: 5764 - DNA, 201 bp, Bos taurus
ttcttggtataaatattctattactgataacaagtggttggcaagattcctggagattttacaatcgtaaggtgggcagaaaggataaggaaaaaatctggcaggattactcctcaggaaatttccagtgcaaagtacaggcagctgtggaggagaatgctcccaaagaatgcataaaggggaggacaactagtgtgatcc

SEQ ID NO: 5765 - DNA, 201 bp, Bos taurus
tattgggcctgcgtttaggcatagaaagcaaatgatgttggtccaggatttgttattattattgctattattttctctctggtatgaagtcaaccagcgtggtggcctgggaactctttcagcattctctctgcaaaatcagagtgtgacaaggtgtcagaattgacagatcggtggtggagactgagcagacctgaatta

SEQ ID NO: 5766 - DNA, 201 bp, Bos taurus
gaggggtctgtgatgaattgaagaacatttgacccaacctcgatcgttgctattgtataagaataagggtacaagtatgccattatttttttttaaagaggaaccagacatcctgatttttgtgtgaacccttatttcttaaatgttgacagctaacttatatattaagtaactatataagagtaaactaaaacatatctc

SEQ ID NO: 5767 - DNA, 201 bp, Bos taurus
ctttcttttgttgcatagctcatagtttttgctttcctatataaactcaggacccaccttgaagtctctctgtgtgaacataggtgagagtgcatggccaagataaatgcaaaggagcaacatttaaatgatacatcctactcagagcacaatgtttttctctccagggccttgatttggcagcaaagaaaggaagattta

SEQ ID NO: 5768 - DNA, 201 bp, Bos taurus
catctttatttgaatgagtttcctgccctgtattttcagctgaattagagaaaaattatttgttcatgacaagcaatgacttttgagcaggtgtattaagcattagatttcaccaaagccagattttaacataatttttgcaaagcgttaagcaaaagcttttagaaaaactagctaagaatactcaaattagtattttat

SEQ ID NO: 5769 - DNA, 201 bp, Bos taurus
caccactcagtcacctggaaagccccagctgttctttcctgtctcgctttgctcagagtggatactcagctcttttaagtacaacatacaggtctctgccattcttgcttgctggcttgcaaacataggaccaaccatagtttttctccaaccacggtgacggctccatgtaccttcacagtcacactggcttccttttct

SEQ ID NO: 5770 - DNA, 201 bp, Bos taurus
tgaactgaactgaacaactatttggttatcccttatttgattttatgggagaaataataatgacatacagtgttatttcgaggggaacttcccaaatgtttattgacaagtccttctctctggctgactacttacctatatacattccacagtaattatcatatggatagccattgttattcctaaagaagtacaaaagtc

SEQ ID NO: 5771 - DNA, 201 bp, Bos taurus
ctgatgtcaactaacagtttatttctgagatcaaagatgttgagccaatttcatattttcatagtaaacagttaaatggccctctgcaatttgtctcacatagttttcagagtctagaaactgtattgtggggtctaaaattatactgaatgctttgaaatccaagtactggtggccaatggctatgtaaatatggcgagt

SEQ ID NO: 5772 - DNA, 201 bp, Bos taurus
tctatgatatcagaggctatgtagtgcaatggtaaaggctgctgctctctatagttaaattgctgggttcataatccagccagattgcttcttagcacatcttgggccaatgacttcgcctctctgaaccctgtcttctcatctgtgaaatgaggataataacagaattaacctcataggatggctgtaaggatcaaatga

SEQ ID NO: 5773 - DNA, 201 bp, Bos taurus
ttttgtacctaatactaaaaagagatgataatgaaacttttgaaagaaggccatatggacttactaagtaccttagctatattattctgaataactttgaaactccttaagagaagcatttttttaaaagattttttgatgtggatcattctctaagtctttattaaatttgttatggtattgctgttttgtgttttggct

SEQ ID NO: 5774 - DNA, 201 bp, Bos taurus
agcatatgtaaaacttctgaagtaagatcagtacttggttggtcctgatggcaagacttacattttaaccaaaagcgtgatgtaggccaacactcctcaatgtgtggtctgggaccagaaatatcatcacctgtgaacttgagagaaatgcaaatcatcaggccccacgtaggacctactaaatcagaaactttggagctg

SEQ ID NO: 5775 - DNA, 201 bp, Bos taurus
aggttaagagactccagtgctgacaaggtgataatgaggatttatggagagagggaggtaagggtgggtggaccctcccaggctcccacatgtggtggctccaggccctctgcagacagagtacctcaacggaagtgaaggttaccttctggattgcagaagcaaccaagcctggctacattgtgattaaatgcacacaca

SEQ ID NO: 5776 - DNA, 201 bp, Bos taurus
ttaaatttctctagatctctttccctgggaagatagattccttctttcttattcctattcatctgctaattggttggtctctgccctttaccttggataacgccttctctagtagcatacatttggagggtttgatttctagaaaaaaatctcagtgtctctggaaatctgctcctgaaatgttcacagtctgtcaagtag

SEQ ID NO: 5777 - DNA, 201 bp, Bos taurus
ggagacactgtccgcttattcctcctgttcacttattagagctcagctgcagtttacctctatagcctccttgagccccacttttgaaaatgattcctgtaatgcaagccttttattctgtgcttcagttttccttactaatgctcgtcatgatttgtagtcacgaatctgtgatgtgtctactttttaatgtcttttcat

SEQ ID NO: 5778 - DNA, 201 bp, Bos taurus
agcatgagaggagggggcagctcagtaagaggagctggtgacttgcattagcatttgatatctttcttttctgagcgggtatctttgttttttaccctgagtctcttagaccatccaataaggatatcagtccccaccccttttatgaagaaggaaattcagggataaaattgggatccagaactggcttgatcaattgct

SEQ ID NO: 5779 - DNA, 201 bp, Bos taurus
gggaaccatcaagctttttgtaaccactccaatattattcttgtaactactttgattaacattattatttcctacagagggcaacaataacaacagctaccgtttactaatacctgacatttagtatagcacttagcacaaagttagcattcagtgaaggttaaataatagtgaaacaatacatagcctgcctttcaaaat

SEQ ID NO: 5780 - DNA, 201 bp, Bos taurus
gtttcaatgttattcatcctaaattgtttgaacttctctgatgacctgggagcttctgtgggcacggggactctgcctttttgactcttccccgtggcccgtcaaggttctttggggactagagttgggctctgccgaggggtgcattctaccaggtcagtcattctggcatctgcactgggctgtgtagcctgaaacctg

SEQ ID NO: 5781 - DNA, 201 bp, Bos taurus
ccccaccgtgacagccacagaatctgcggcgacgagtgtgcgcgcgtggtgtaaagtggcgtgcagagtcccacgcctgtttattggctcctccccaccgtttgtgttgaaaggatgttgtggccaaagctgaggttttaacactggttagtgcaggggatgctgccctagaagggagcgtgctaatagtcggaaacgatg

SEQ ID NO: 5782 - DNA, 201 bp, Bos taurus
aactaagtaaaatcagtttcgtggcatggcattcaaggctttctgttacccaccccacactactgctagggcatcatcttagcacaccaggcctttcctaagcacacccacttcttcccaattcagtgcttaggctcttacatgtacctcatcttgtgaagtccttttcctattcactagtgaaaatctatacctcattta

SEQ ID NO: 5783 - DNA, 201 bp, Bos taurus
tacatgtcatattgaaaaaacttactatgaggatgaatcaaaagatgaagtgacaaatggttgtccactgctctgctagcttagggaagacaagatggaaaagcagggtaataagttagagatcttagcatcacattttgcaaagctaggacaaaagatgtcgcagatttaagatccaggtgatgacaaagcctgattaag

SEQ ID NO: 5784 - DNA, 201 bp, Bos taurus
ttggccactgccatcatgtcaccacaactgggcgacccagagttggagagaagggaaaatgaccagcacactgcaaagagacacagagggagaaaaaagcggtggcctctgggaactaggcagcgagagaggtgggggagtcactgagtgcatgactggctggggtggcgtctggggcgtaaggtgggggagacatgggac

SEQ ID NO: 5785 - DNA, 201 bp, Bos taurus
aactgcaagtggaagtagtcattaagacaagctcaatcaccaccaaaatagaccacttttcaacttaaatgtgtttcattattggacactataataaacctgccctgagtaacaataagatcacttgcatttagcaggcagttcactttctgagaaactccttacctttccctctagtctgttaatgctacaatacctgat

SEQ ID NO: 5786 - DNA, 201 bp, Bos taurus
gtggacacagaatcttgaaaagatgtgaatagtgcttggtctatgccggacttattctaaatcatgaattggggaaaacacacttaaagagctcagaccatagctgtgagtgagatgtgtatttctcagacaatatcactggggtttgaaaggcatgggatgcccctgtggaaataacttggagaaatgtgctagagattt

SEQ ID NO: 5787 - DNA, 201 bp, Bos taurus
ggtttttcctaaacagcacatcatccaaaaggaacttagttttgtatatcgctagcattgtacctttgctgacatttaagtataaagtctccatagtaagtccacctatcaagcaaaaataaggaacatacctttttagggatggactctgtggaagatgaaagaatacagtgtctttattctgtcctcctgcttggctga

SEQ ID NO: 5788 - DNA, 201 bp, Bos taurus
tgcttgatgaagcatttcatcaagtaggccacagagctatttgccttctgcgtatgcatgggaggcaggcagtgaatctggttgagaggaagccacgtagcccagggcctgattttctctacaggccaagtctcaaagtccatcttcaggctcctgagggggtgtttccaagctcgagatgtcagctctgctttctcagga

SEQ ID NO: 5789 - DNA, 201 bp, Bos taurus
cacctttgggaagatgtgcaattgggttatgtactgaccttgaaacaacttacctttgtgttattcctgtatgtactatgtgggggaagaaaggactgaacattaaagagtgtgtgagtcactgataacagtagagactagccaagtcagtgttcatgggttggtgaaaatgctacttatttcgcaatatgaacctttctg

SEQ ID NO: 5790 - DNA, 201 bp, Bos taurus
ttttgtaggatcattttggtgtgattatgcaaaaaatatctcagattagagatctacacaaaaaccacagttttcattgctatagctttataagacaattcaatatgtgccaggtcaaaggcccactgattattcttttttcctccctccaaattttattgatgactctttgttgtttattgttcatttggtcaagaactg

SEQ ID NO: 5791 - DNA, 201 bp, Bos taurus
taatataaaaatatcctgtattacaaactataatgaatagggtttgctttttagtgtacacatatcgagacacagctaaactttttaaacatgtcaataaattaaaagcacatactgaaaaacaggaattccatttgtttgcctaggaatcatctcaagatatctttattcctccttttcctttaggtttacatcttggtt

SEQ ID NO: 5792 - DNA, 201 bp, Bos taurus
atggccccacccatcaaaacaaaatccagtcctccttcccccccactcaccaccaccagtcagtctatcctataaggaagcttccataaggtctcttatatttctccagacaaatgaaaacaatcattgaaaactaagcaaactgatcacatggaccatagccttgtctaactcaatgaaactatgagccatgacgtgtag

SEQ ID NO: 5793 - DNA, 201 bp, Bos taurus
ttataataatttgcaggcccagtgcaaaatgaaaacgcagagcccctttgttcagaattattaagaatttgaagatagtgacaacagaacatgaaagcagggatgaagcccctctaagcttgtggccttgtgtgactgacagcatagtcatacacccatgaaggtggcattgtctgtggttctttaacaacctcactcatt

SEQ ID NO: 5794 - DNA, 201 bp, Bos taurus
agagtcaagctaaatttatgaataactggccattacaattgcacccaaatgctatttaaaacaaatcagattctttcttgcatgttgggacttggcatgagtatgtcttgggagttttatggccacatgatgtatacaaaatgaggtgttgagtttctatcattttgcatgaaatgtctttccagattcacgtttcccaca

SEQ ID NO: 5795 - DNA, 201 bp, Bos taurus
acactgcggccacattctacttctgcttctgtgattcacggggtcgaggcaggtgtggtgcctcagcccagcccacagacttctgagcggcccaccatcctttctcctctggaaataagccctgaaacacaggcagctttgatcagaggggaggattccacagtagcggcccccaaacagcaagtaccgacgaggatgctt

SEQ ID NO: 5796 - DNA, 201 bp, Bos taurus
attcaaagctgcaaggtttcttaccatattttaacacttcctatagatggcacttgaatcattgttcttatttttcctgactgcacaaagaacctcccttcgtgcagatattgtgctctatattctttagttccagcgccatttaggaaatacttcatagctcccagacagcgagatataactttcagtagccaaggacta

SEQ ID NO: 5797 - DNA, 201 bp, Bos taurus
aagagtccaaaagaaaaataaaaaaacactaagggaaacacttatccccagaaagatactgcagttattgttgtctggggcaagatccttttctgccccccacaaaatagtgtgtgctgacaattaagctaagagtagattccttttcagcctttgaaagcaagagttggtcaccagcagtaagaaaactagtataatgac

SEQ ID NO: 5798 - DNA, 201 bp, Bos taurus
ggatttacgaaagataaattatgaaagataattcacatatagaaagacaattcacacataaacatcttccccctgtccttctataacctagaaatgaaaggtaaggttactgatacctagagagtaaggatatgagaggaaagtactgaatatagtttttgaattatatgtaaaattatgtaggtgtttgactcttggaaa

SEQ ID NO: 5799 - DNA, 201 bp, Bos taurus
tcacaggtgtgttatggagattgatattatgttgtgctaacaactgcttagtcattgctaaggaaatgatacattggagagattgttttaatttgggatcagaagaatttgactttattctctccgtcaaagatttcatttttaaagtctcattctgctcctttttcaattttgtaaactttatttaggcaattatttttt

SEQ ID NO: 5800 - DNA, 201 bp, Bos taurus
cctctgctactggtaaccaggtagagcccaattctctagaatgtttccatataaaattatttcagtaaggctttatttgtcttaatcagatatgtggccagcaagataagacagccattccaagatacttataaagccaaaaccagggaatatggaagaaggcttgagggaggggtaatcaagaggatgatacaactcaaa

SEQ ID NO: 5801 - DNA, 201 bp, Bos taurus
aagcccgagggaaaggagtagggcccagctgggcttggagtcaagaactgacaccagcaacacgtacccaaccttgttatctggttagaggacaatagctagtgctcaggcaggaagaagaccctgacccaggtttgctgtgttaccagacaggtgtgatggaggtcaacaaaagagtgacacctgactgctttggatttt

SEQ ID NO: 5802 - DNA, 201 bp, Bos taurus
ttctctgtgttcatgcattcctggggacttttcctctttaaggactccagacctattgaattaaggctccaccctcatgacttcctttagccttaattgctttccagaggccctgtatccaaatattgtcacactgtggggtttgagatttaggtatggattttggtggagaacagtacaatccataacatgaactttcca

SEQ ID NO: 5803 - DNA, 201 bp, Bos taurus
ttttcccattgttttccttataacaggtcaccagttaaaaaataactacttgttagttattttctgtcttctctcttacgagaatatcttggccaaaatacaaagaacttgcctctttgaaatgctacagcctttttacagatagtaggcacttaaatcctcagggccactaaagctgttggtataaagatggtgcttaat

SEQ ID NO: 5804 - DNA, 201 bp, Bos taurus
tgaaacgttgctataaggagcctcacacagcaagatgcctttccttacacagtaagagactcaccttttgtgaaataccctcctgcacaggcttctaacattgtgatcgttttttttttcaaccttgcagaaagccgctcaatatctacagattctatgaagcagaagtcatgctgatttctgaaaggttcaaaaagttgg

SEQ ID NO: 5805 - DNA, 201 bp, Bos taurus
ccttccccacattttttttttttttgatttggtaaaaaaatatatcagtggtatatatcacactgggcagtaggtttaacagactgattataagtcatcatatttattcaccactttttaaccataaggattaatgtgttataatgatgccaggagtgtttgggtctacaaatcacttgatatgagtagatttcatagtaa

SEQ ID NO: 5806 - DNA, 201 bp, Bos taurus
gaacgtagattggggggcctaaaaaacatgtgtgttttatcttgataaagtaaaagaaattttagggatgtttaactgtttgtactttatcaacagtggaattttacttgaaaaatactttgaggcacttgtacaactgtttattacactcaaaatagaaattacataaatggccaagcactaaaataatgaaagtcaaat

SEQ ID NO: 5807 - DNA, 201 bp, Bos taurus
ccggattgaattcttctcctccgggggccaagaatcccagtgtatttgcgtgattcaacaacctttcatcagcagactatcattttcttcaggacctaccggggccctacaggaagaaaacctgggactcggccctgcacatcagtgggtacttcttagccaggaccagtttcatagaccagtagacaggcatcatctgca

SEQ ID NO: 5808 - DNA, 201 bp, Bos taurus
ttcatagaaatatatctctaaatatacagtaagctgtccaagatttcagattttacttcttctctttgaatggccacatcaaattctgtctaaattgtttttttttttttttaagacaaacccctaggtttcaattttcagtgttctatattcagattaatcatgaaattgtgtgatattataagaaacaaataagataaa

SEQ ID NO: 5809 - DNA, 201 bp, Bos taurus
tcccctaaatagcaatcacattatacaattttaaataaattgtggtttaactaagtttttgcctagctaagaatttagtttagaaaatatcttgctctagtcatggccaaaaatcttgataatatcaattgcatattatctcaagacacttgaaatttttaagatcgatggcttctgttcataaatgtccaaattatttgc

SEQ ID NO: 5810 - DNA, 201 bp, Bos taurus
aaaaagaggccatcagaatttttatagattgcattcactttatagattgtcttgggtagtgttgttgttgttccgttgcccagttgtctcccactacaacgtgccaggccttcctgtccctcaccatcttcctgagtttgcccaagttcatgtccaaggtattggtaatgccttccagtcatctcatcctctgttgccctc

SEQ ID NO: 5811 - DNA, 201 bp, Bos taurus
taatttgttttttccctgagtacaagactgacattagcataaatctctttccttctttttctatataaatgcagagaaaaggttaacccaatgatcttagtttttttttcaatataaaatatcagtaaaaaaaaatggaggtctgtactacatctcaaaaataatagatatttgcatctatgtgaaaggaacaagaattac

SEQ ID NO: 5812 - DNA, 201 bp, Bos taurus
tctgtgagtagaaaccaggacgtgaagccacacttgccttgggaatggattgtttctggtccagcttgggactgaggactgcgtgtgaaaaggagatctccgggtcttctgtctttcagaggattgatgagaagggtagtttataaactcacccggaactttgagtccatgtgaaagtctagacaggtttcattcatgttg

SEQ ID NO: 5813 - DNA, 201 bp, Bos taurus
gaatatcattgataaatggcaattgctgaaagtgcactcttacattggtacagttaaaatgaaaacccaacaacccctaacagctttcacaagtgcctcaattgtatacagatcatgcctcatgctgtgacaatcaggcataacgcactataaatgtgaaaggaataagcctggaaatttaccccagactgatctgtgatt

SEQ ID NO: 5814 - DNA, 201 bp, Bos taurus
ataatatattttcatttataggcatttgaaacagactttgaaaatttgtagctcttggactaggaaggttttgaaattgaggaaagagcatccagcaaagcatgtctttaatgttacatccattgttcctgtctccctgtgttggcttacctgttcagactgtagatttggatcagagaagccacagtgaagatgacagga

SEQ ID NO: 5815 - DNA, 201 bp, Bos taurus
gaccacctaatagctctagtactgaattgtcctgcaagggaaaaggtaagagacagggaggttctgagagggctttggccagaagaaacagatgtgggggatctatagtagacacagtgattatggatgaaatcattcacttcttacagcttgtggtcgtgtatccactcctatatggtcactggcctcaatgttcagggc

SEQ ID NO: 5816 - DNA, 201 bp, Bos taurus
ttgaaggaatcaaaatgaaactaatacgaagattagaaaatagctttaaaaatttgggtaaacatggagatgttacttatgaaataaagtattaaaaatattgatatcctcatgaaaatgaaactatctggtagcaaaggaatgggtttttggacaaaaccatatagaagagtattgtcaagtttcaagcttttgttttgg

SEQ ID NO: 5817 - DNA, 201 bp, Bos taurus
acatctgtatgctcacaaaagccctcactggccctctctggccacagctttcatgaccacagaaggcacgtttcctttgtcttacccttctctattcctcctcagcttctgtttccctggccatccacatcagagaactctgttgggattccctcaccgtgcggcaggagcctatctgactctattcaagataattttaat

SEQ ID NO: 5818 - DNA, 201 bp, Bos taurus
gattagagtgaggaggccaaaaagaaggcctaaggccaagtccccatcatctcaggcttctcagtcccctcagctttcttcctcaattggccctttcctcaccctcagcatttgtgttttctgactctatcttgttttttgttttgggtgagccagggtgggggtggcccagcacagcacctggtacataataaggtgctc

SEQ ID NO: 5819 - DNA, 201 bp, Bos taurus
tatcctagagtccagtgtgaaaactccctgctctggtcaggctgactaacttgctgcttcaattgcttcttcccattaatttcctaaaggtacagttcctgggtggtttttatcaccagaaagaattatctctttagcaaatgactaaaagattgcaagtacagggtatttttgtttttattcccaaatgttcagccattt

SEQ ID NO: 5820 - DNA, 201 bp, Bos taurus
gagcatggtgggctatagtccatggagttgcaaagatatggacacaactcagtgactaacactttaactctttagagggattcagcaatccatactgtcactacaataacagggtggcatccatcatactctcatgcaagggttcccaacctctggggtctaatgcctgatgatctgagatagagctgatgtaataataat

SEQ ID NO: 5821 - DNA, 201 bp, Bos taurus
cagcacgggtcttgagatgtcattattcccacgttatgataaggcactcacttatgctgctttacaggagaaagaaccaaagtttaaaaagccagagccactgatttatattacactactgtaacactcttaaatagaatcttattttaaaagacaggacctggaagagaaaaagctttaccggcttaatccacgatcatg

SEQ ID NO: 5822 - DNA, 201 bp, Bos taurus
ttaaaaactatacataaaaataagcaattcaagactgctatttcaaagggttgtattacttatcaaaaagattaaaagtattaaggttatttaaaaaggaaaaacagccatagcctttgaagtgccttatctgtgacattaactgatggcagtctataatcatatatttatactatggagcttattgaactttcttcttca

SEQ ID NO: 5823 - DNA, 201 bp, Bos taurus
ttattgagatcagatgtctaaattcaaggcgctgacagtgacatttcttctggagggtttagaggaggagtcctcttacctttctggcttccagaggccgcgcgttctccttcgcttgcaatcccttccttgccttgctcccaactcttgctttccttctcacatctcagactactgacacttgagcttcctgctgctctc

SEQ ID NO: 5824 - DNA, 201 bp, Bos taurus
caagattactcccgggcctgcggccaccgactcgctcgcacttcaagctcccccctccccagacaatgtaagggcctggccgtaccgagacagccttctctgagccacaacaccaccaccccgcccccttaagatgggcgtcactcgaactccagccccggagcgctggcctagatggctccgaagataagtcccggaggt

SEQ ID NO: 5825 - DNA, 201 bp, Bos taurus
gataagaaggaaaatctttgtcacttttaattagaagtcttcttaaatattttgttcatgtacagtctgattttgcaggcttagttaataaatcctgctcgtgtgttgaatttgctaatttttttcccaaaaaagtgaataaactaatttgtaatatgataggtcaggaaactatctttagtgatatggcaaaatatgact

SEQ ID NO: 5826 - DNA, 201 bp, Bos taurus
aaaactgtaagaggttactgaaaggaaacaaataataaaacaggtttaagtacctataaaactcaggcttaaggagtaggaaactgctgctgaaggaaaggtaatattttattgtgaaatgttcatttatttccattcaacccaatttattaaacacctattattttaagtcattaaaataaatgatcagcatttacagaa

SEQ ID NO: 5827 - DNA, 201 bp, Bos taurus
gtgttctcaggggaacaaaccacttgtagttgaaagaataacaggggtgcatctctatacagaacaatgaggaaaggcctcagaaagaaggaacagctacgtcaccagcaaagaaacaagaatagagaggaaagcaggcacaaatgccctgaggccggtaatatatgccgctaatgatgaaccactgacaaggtctgtagg

SEQ ID NO: 5828 - DNA, 201 bp, Bos taurus
gtcagctggatgcattttgaatgctttttaaatactctttaatttgttgttctttttaatgacctgattgagaattttcagggtctgctaaaggagcattttatctgtttcttcacactatctcttttcttctcatttccttctctcctctgttttctgcctcctcttctattacataaataggtaggcccatgccatatg

SEQ ID NO: 5829 - DNA, 201 bp, Bos taurus
taaaaggataaaaatgagtgaataagcaaataaataaagctactattaatatcagtttcagattctttgctgaaagctgactttgtgaggactaaggcctcattttttatagttgaataatactccactgtgtgtatatggatatggatatacatatatatttatatcacaacttctttggccatcaatgaaggacactta

SEQ ID NO: 5830 - DNA, 201 bp, Bos taurus
gcacttaagttccctgaattaacttatcttgcttttccttatttcattttccatctttactaacggctttattatcaattatccctataaaattctaagcaatatattccttgtatcatgaattttctgacacttacactttctacactcctctcaacgcaatcctctgagtctttcagtcttctttcctgatcactaaat

SEQ ID NO: 5831 - DNA, 201 bp, Bos taurus
tttggctcacaaaatgaaattctggattcgacagtggggcctccttctcacgcatttgtccagttacatcactcaccaacaaatgcttaatgagctactacatcatgccaggccctttgcgagcttgggtttaaactgtctgtttttccattatgaaatgctaagatgataaacaaacactccaatttattgacaacttta

SEQ ID NO: 5832 - DNA, 201 bp, Bos taurus
tcctgaacagaacagagttgtggaaataaaattctctttactgaaatatttcataggcattttccaaatgctaaccagggccttgctcctcaagcagagacgccgtctcctgtttataactgatgatatacaaccgagcatatgcacgcagggccagaaagggagaaagcacagtttgttctaggttagttccaaataact

SEQ ID NO: 5833 - DNA, 201 bp, Bos taurus
ccctggggccaactctgggagagaaggtttctgtgttagtcccagaactgtggagggtgttgaaatgctttctaattgcccagttaaagctttgtttatatagcatttttcaagattcatgaaacatgttgaggtgtcagatattcaagaactctgttatacaaatcattgaaagaaaaccttcccggatagggaggtggg

SEQ ID NO: 5834 - DNA, 201 bp, Bos taurus
tgtttctctgactggtttaaggaactggctcccagcccccgggagagaagctgaaggaagagccatggtaccttgggcagaagcaaggctgatgggcccccgggaaagaagtgtgccacacacctctgaggacagagttatcctgtcctttgctgagctgttgttgttcagttgctcagtcgtgtccgactctttgcgacc

SEQ ID NO: 5835 - DNA, 201 bp, Bos taurus
aatagataaagaatagtgttagatgttccttgctgttgtttttcaatatcacatattcagtcgtattttcagtgtttcttaatcttatatataatgttacgggaataatctaatctaataaagagttgatgtcttgcaatggattatggctagtggtgatattaagggtgttctccattcattctgatgacttgaatcata

SEQ ID NO: 5836 - DNA, 201 bp, Bos taurus
ggtgcctcaattcttcctagaaaataaaaattcaaataatcacacacatcaatgtaaaattaaatctgtcaggaagattgcaagtgggaatgatgtgagggtatgtaataagaagatctgatgtagggaaagttgctgcgagaagtgatgcttaaaccgacatttaacgacatgtaaaaactggcagtgaacattagctag

SEQ ID NO: 5837 - DNA, 201 bp, Bos taurus
attgcacagagttggaaatgattgagcgacctagcgtgcatgcacccaaccactgcagatccatgatttccacctcaagtgatcctcatgatgtctggagagcctttcttcaattggctctcttgtctatggattatacctactttgaagcttttcttctttcaaacattttagtcaaccacatcaatacttacactcaga

SEQ ID NO: 5838 - DNA, 201 bp, Bos taurus
cctgtagagttctcagcaactatatctgagtgactctgaatactcttaaaggcttttcttgatttttctagagtgagattcatgccactgttttctatttcttcctgtctttcttgttgcttcacctctgggattgaatctagtatagaatttttatatagcattagtatttaaattcttgaatgttcttagttcacaaga

SEQ ID NO: 5839 - DNA, 201 bp, Bos taurus
aaaacccaatctggtaaatatcttgacagtgagactaactctgtgattgaaacttgcctctaccctagaatacaattgtttcttaagaacttatgactaccgaagatttattcattttagaagattttgtcctggctctccatcatactgtgctatccctaaaattctaggttgttcctctagctgcatacagatagggct

SEQ ID NO: 5840 - DNA, 201 bp, Bos taurus
caccctggcagctctctactgccctcaactgccaccagtagacaaccatcacgtcactcagtgggacccgatttacactgggcccttgccttcttctaaagacagcttttgcacttgcttagatctaaaagtccattatacaacttcttatttagatgaagtagtgggaaaaacaaacagaattcacagatcatttgctct

SEQ ID NO: 5841 - DNA, 201 bp, Bos taurus
agggaaactcgggagaggctaattgttgaatctgattttaaatgacgatggaaagatgctacatattgccctagaagagaaaggttgggtgagtaggaatgtttataacttggcgacaggggagatacaagcacaatgttgttaagtgtagctttagaacatgttggaattggctgtggtctgggggggactatggagagc

SEQ ID NO: 5842 - DNA, 201 bp, Bos taurus
gcagatgctgcatgtagaactgttcagaccttttagatctcaataccacatgcaatgttcatttattcttgttattcttgcttaaatctgtcttcctccttctttggcacggttcactcctgagcgtgtggtttatgtgattgtgcagtggtatgtgtgtctgttttccagcagttaattctatttctggaaactcaatcc

SEQ ID NO: 5843 - DNA, 201 bp, Bos taurus
tcttagctccatgtactcagggacccagggatatctattttaaccctttgttttttagttctgtcttacactgaaaattttattataaacatctttctacataagtatgctgctgctactgctaagtcatgtcagtcgtgtccgactgtgcaaccccatacacggcagcccaccaggctcctctgtccctgagattctcca

SEQ ID NO: 5844 - DNA, 201 bp, Bos taurus
caaggcattaaggaggtctgaagggggtgtacagagggacttccacactccccagaggccaattacacttggaatcctcctgatcggccctgatcagggagcagggctaccccctcacagcctattgtgctagctcggagccacctgatcagcctggtcctacccagtatttaaattagggcatcgccaatcctggaccca

SEQ ID NO: 5845 - DNA, 201 bp, Bos taurus
gtttagacccatttgtgttacaacattcttgatacttttccaaacagcctcaatcttagaagagaggttacttcaacatcatcagttcattcggccctgcgttcaaatgctaaagccatttttgttcctaatcagaggaaggaagaggcagagaaaggagatgtgaaaggctttggccaactatagagtttgatgcaacag

SEQ ID NO: 5846 - DNA, 201 bp, Bos taurus
attctctttgctgtgtttcctatttttgtctaggataccactattgtctgttcatccccaggctcaatgccttagcaatttttaatcccttctctaaattgttagatgtaatgaaataactgggtccttgcccccatctccctttccataatgtatcaaaggttgatttgtccttccattgagtcccttcttctctgttcc

SEQ ID NO: 5847 - DNA, 201 bp, Bos taurus
agaagggaattgcatgtgtctgacacggcctgaaaccaattatttgatattttcttcagaatgatgcccaactctgttgggaatgagcaatcatggaatattttacctcctgatttaattttttcctgcacaaattagttgtagactgagctggctacacacagatgcttgtgacatagctctgtcttatcaagatgatac

SEQ ID NO: 5848 - DNA, 201 bp, Bos taurus
tgctgcatggctgctcactgaatgcctgaagggcccgattcagagcttcctcagctgaggagaggagttgttgtaacagattacaactgctaagttccacgatgttcttcactgtcagcaaagggcaggagatctgagagaggaagagcaataaaggatgaatgctgtcaccttcctccttgcagaaaagagggagtcaaa

SEQ ID NO: 5849 - DNA, 201 bp, Bos taurus
ctgacacaacagaagggcccacgcagcccatataggcagtacccccaacacatatagatctggtgagagaggggaatgtgcaaccagactacatctcctacgtaaggccacttctccaggatcaggaaatataaatgacctatttaatacatagagacaagtcagaggataaaccagagaagcaatgaaaatgatgacaga

SEQ ID NO: 5850 - DNA, 201 bp, Bos taurus
gtcagcaggcctggttctgttcaccaggcctggttttgatgccaaggacttttcctttacttactagctcatgaaatgttgagagctgctagtatattcccggagttagacgaactagtggccaaggttgcagccatgatatggaatttagggtaaggacttcacacaggattgagctttttaataataaagagaaatgta

SEQ ID NO: 5851 - DNA, 201 bp, Bos taurus
gtggaggggtgaccttaggaccaaggtcaacaaagtcctaggcacaagtccaaactatgacatgcaggtgtcccaagtcagactcatcatctggcctcccccctccttctaatcgatattccttaagtttgttcaaaatttcagttcagttcagtcgcttagtcatgtccgactctttgcaaccctatgaaccgcagtacg

SEQ ID NO: 5852 - DNA, 201 bp, Bos taurus
ttagaccatttttagactggtcttaatggaatttaatatgctttgaattaaacaatgatcgattgtggcaggactgctgactagtaacttttgttaaaaatttttttaaagatccaatgctttgtttagcttcaatatacctattttcatatcctcttccaggatttaaatcaattcatgactctctcaactccctccaac

SEQ ID NO: 5853 - DNA, 201 bp, Bos taurus
aagacaaactataaatggacagatttttctaaaacaaatctgagagggttttttgtttggttttattttttttcttctctctctctcaggttgagcaacagaaaccaaaacacagttgaaaatttagaactgtattttttcatcttcaaaatgtagtaataataaataatgaaaggtcaggaaaggaatcagaacatttta

SEQ ID NO: 5854 - DNA, 201 bp, Bos taurus
cgagaggaagaagctggttgtggggcagcataatgttttactaggagggaaagacaaactttagcatcggaataaaatggtcaaggtggttttaaaccatcgagtccaagactctgaaccctggcttttaagaggctgcagttttaacaattcattcctctgccttcagttattctggaaggaaaacgacttcagatgtga

SEQ ID NO: 5855 - DNA, 201 bp, Bos taurus
agctgcaccaggtgaggtctcagagggatcacacaaagttctgctttcactggctctcctttaccccttcagcccgctgcccctcgtcagtgctgcacagatggccagacaagtcacctggggacaggaactacaaatagatccatgtttaaatatcacttatgcttaaagggaccaggccagaattctcttccacaaatt

SEQ ID NO: 5856 - DNA, 201 bp, Bos taurus
ttccagaaaagttcttcaacacctgcccacatatccacccaacaggtttgattggcatgttgagttcctacttcacagcaagcttgcaggcctgggcacttcccatccttctctaccattagtgaggggtgagggtagccttcccactcagggaagcaagcgaggacagaacccgcagttccgaattctttgttactgcac

SEQ ID NO: 5857 - DNA, 201 bp, Bos taurus
gctctgggccttccttcgaagcatttaaagtgcctggcactagtgggagctcaacagatgttaattcctttctccacttttatctgaacaactgtgtgtgtccgggtgtcctcctggcctctgcgcctgctttatgagatcagttaatcggtgcatgtctccttggcatgggctcggctctttgtcgggatgccctgcggg

SEQ ID NO: 5858 - DNA, 201 bp, Bos taurus
gaagaaatgggggtgagggaaaatatgttcttttgcctaaatttttttacacatgtatctccggtagaggaattcaaagtaaatgcatatttttaggctctgaacatgcacttgaaaatacatcatgcatttatgaaattgactgttttactaagaaccagttagaatacttctgcttttctgggaattttgaatattttt

SEQ ID NO: 5859 - DNA, 201 bp, Bos taurus
atggggtgtatgcgtgttttcagccaaaaagcctacccaagcactcatcagatacaggaagcaagcatgctcctaaggaaaaagccgtttccaaatcaagtgagcagccaccatcagagaaatcaacaaaaccaaaggtaaataaagcagacagatgaaagaaagaaagaaagaaagtgaagtctctcaatcgtatccaac

SEQ ID NO: 5860 - DNA, 201 bp, Bos taurus
tttttgttaatattttatttgaagctgtcattaaaactaggtataaagctttatttacaacaatacacttgggaatcagagagtaaacttagtgattttgtggggaacataatgttacatgtattgaaggcatcataagacttctagaaatcgggccaagaaccccatctttttaggaaggacctattttctaggaagaaa

SEQ ID NO: 5861 - DNA, 201 bp, Bos taurus
tggcttgtggccaatcttctgcctctgtcttcatgtttccttttcttatttgtgtgttgtatctccttctgcctctttcttataaggatgcttgtgactgaatgtgggcccactcagaggatccaggatcatctacccatctgttcagttcagttcagctcaattcagttgctcagtcgtgtctgactctttgcgacccca

SEQ ID NO: 5862 - DNA, 201 bp, Bos taurus
ggcctcacacagtactttccaactatcttccaactgttggtgactgtgtttctgtgcctgagagtttttctgcgctaagggaaaaactgttctatgtctaaagctggccagaagttcaggggaattaatacctctggatgcagccattatgtactactaatggagttagtgtacttcagctgcctcactctaatgctctaa

SEQ ID NO: 5863 - DNA, 201 bp, Bos taurus
ctttgtttaatgaatgctgtattgttaaagacccaatttcagaagatgaattcaaagactaagtgattttctcccctcatacgtatacaaggtaaagaatttaatctacagttaatcaatgaaaagtatcgtgagagatggaagagtggagacaagaaatgtacagtaagtcaattagaaagtttaaaactgaaaggactc

SEQ ID NO: 5864 - DNA, 201 bp, Bos taurus
acaaaatagaagttgccagggattaggccaatagagagtaagctggtaaggaaggaaatcaccttttgagaggcaatttttaagtgaaacctaagtaggtactgtctggggaggccttacaaatagctgtgaaaagaagagaagcaaaaagcaaaggagaaaaggaaagatataaacatctgaatgcagggttccaaagaa

SEQ ID NO: 5865 - DNA, 201 bp, Bos taurus
gcatggcgatcttgtaggtcttggacaaagattttctggttaactctgccatatctgattctgtgggcttaatcatcatccttttccctcttttcactttgtccctggttcctcagacattttcatgctgagagtggcctctcacatcaggcttatgaatcataaacctctcaaattaaaagtggaaaagacccagtgatt

SEQ ID NO: 5866 - DNA, 201 bp, Bos taurus
cctcaaatttacttctaggatagtgtgctgaaatgctggctgatttggtagctgttctaataatttctgctccccacaccctgcacccaccaggattttgtccatcttaatgctaaaactggcctcctcttctattcgtgtgcattaattatgggaatctaagttgctgcaccttttttttttcctttgcaatctaagcca

SEQ ID NO: 5867 - DNA, 201 bp, Bos taurus
cattttgattggtggccaaacctttgtggttctaatctaagggataaagaggtgagcaaaggctaaaaggaatttaggaggcattaatgtactttgggtaaggaaagtgaacgcaatgtagaatggggagagaaatgagccactaagtttagagtattagttattcagtctgtgtaaataaaaagcagactctaaggcagt

SEQ ID NO: 5868 - DNA, 201 bp, Bos taurus
ctataggagagagaggtgagtttatttccctgtatggggtctccaaagaattcaggagagggatgtttcagccgcaggatgtgcagaggaatgttggggtactcacactcctcttgacatccctcctgtaggcgttctcttctctccaggatgaggccggtaacctttcagtctctagttcagtcctgtactatttttaac

SEQ ID NO: 5869 - DNA, 201 bp, Bos taurus
tcctagtttttgactgagggccagaaagctaagtggagtccaccataaaacagggagttcctgagcagtccagctgttaggcctcagagctttcactgccatggcataggttcaatccctggtcggggaactaagataccacaagccttcttgtgtggccaaaacacaaacaaaacataacgtaccaacagtacaggggat

SEQ ID NO: 5870 - DNA, 201 bp, Bos taurus
ggataaagctcaaggaaatgaaatctgggtaaaccaacatataatctacacaaaccttccattagttaacctcaaagacagagctcaagagaaattacatgtgtagtctacattttatgcaacttcaaaggttctcattttattaacccactcactctgaaattaacaaacgaatcattcacactcgtttttcacagcttt

SEQ ID NO: 5871 - DNA, 201 bp, Bos taurus
gtatttctggtctttacccacaaatctatctgtggagcaaatcatcattataggtaaccttaagataaaaagtgtctaaatttcattctaaataacaaattcacatagctgagaactcatgctttgaaatctttcaatagttatcttcagaaagcttaacttcagttatacaacaaactttgccctaacttgaaactgagg

SEQ ID NO: 5872 - DNA, 201 bp, Bos taurus
gtcattaacttctgtaaacattggtttgttttcctatatagctttgccataccatagggctgttgtgaggattaaataagatgcttatacaaagtcacacggtatcactgatgcaatggacatgaacttgggcaaactttggaagatggtgagataaagagaggcctggcagtccatggggtcgtgaagacttacttggac

SEQ ID NO: 5873 - DNA, 201 bp, Bos taurus
agccttcattaggggccccttgttattacatgcttttagataaactacaagttgttagttcatctacagatctttatgcattgtgattacagcttcagtattgcatacgtgttcctgctgagtttttagatgtctttccacgtggaaactccagtagagatgtttctgtatagcagatgcttttaagcatcatgggggttg

SEQ ID NO: 5874 - DNA, 201 bp, Bos taurus
tctcttctttcacgctcatcaagagttcttacttcctcttcactttctgccactagggtggtatcatctgcatatctgaggttgttaaggttatttctgccagcggtattgattccagcttgtgattcatccagcctggcatttcacatgatgtactctgcatagaatttaaataagcagggtgacaatatacagctttgg

SEQ ID NO: 5875 - DNA, 201 bp, Bos taurus
actttattcgctttctttcctatcccggttcattttaggatcaaagaggtatcaaagacaaagggggcctgaagtcaagcaggacacggtggggccttcctaggcacaaaagtacctctgtggctgctcaaaagcaccctttcttatttgtggacaaaaaggcttaacctcctaggcctttcccaagtcccaaagagcaga

SEQ ID NO: 5876 - DNA, 201 bp, Bos taurus
cacgaggcacatcggtggactacatgagaatgcacatgttctcagcagcgggagcagtcctctgaccccctcgggtcagccaggtgggtctggttgtgacgctgctatgaggtttgaggggcagttgggcattcagtggtctgctggcatccatgatcttaaaaatatattatcatttaaaataattcaaaaattgtgaaa

SEQ ID NO: 5877 - DNA, 201 bp, Bos taurus
tatagtgtctccagcaaattccaagttgggttctagctctatcaaagaatggcaagatctgttcacaaaggtttacatatttaatggccttggtggatccagtttcttttatgaggtgcccatcctgtttctcacctttaagacataaactgcattccctcctctgacctgctaatatcaaccaccaaagactatattgca

SEQ ID NO: 5878 - DNA, 201 bp, Bos taurus
tctttaccatcagtgccccctggggagccctgaaacattagtgagtgacctgcaacaaacacgtaagttcaagagatctaattcaacctagtgactataggcacaatactgcattacccacttcaaagttgcgaaaatacaagatcttaattattctcaccacaaaaaagaagagataattatgtgctctggttgaggtgt

SEQ ID NO: 5879 - DNA, 201 bp, Bos taurus
ctgaatgttgctgctttactcctttatcaaagatcagttgaatacactgggtgggtccttcatctgctccattgagctgtttgtctgttcttttaccagtatcacatcgtcttgattactaaagcttcgtagtgagccttgaagtctggtagcttcacttctccaactttgttcttcttcgatattgtgttggctattctg

SEQ ID NO: 5880 - DNA, 201 bp, Bos taurus
tggatccacatttagaagggcctgctttacaaagtacgggctgataatgttttccaatcaacaaagcccttgaaactgttcagcttgttagacatctgctgttgaagagtgtatccagctctgaaaacaagatgcaaggaaatgcagtcctcattttctccagcagttagttgctcaaaggactatagccatttcaagagg

SEQ ID NO: 5881 - DNA, 201 bp, Bos taurus
tgaaaccatatccacaatggccatctggctctattctggatatccgaaccaccgttactccattttgttcttttctttaatagttaaaacagatatacaacgtatttttgacaggccataaaacaggctattctggttaacataaattcaagtaaaattaggtagaatctagaataacttcctcatgcctcagtatatgaa

SEQ ID NO: 5882 - DNA, 201 bp, Bos taurus
atgcaggttggccataactttccttccaaggagtaagcatctttttatttcatggctgccgtcaccatctgtagtgatcttaaaggtggaataaatgagtggacctgttttaaaatcagtgaaggcctttggatcatgtttgcttagggtcataaagtttgcaaataggtaaagagctgggggaataagcagctagactac

SEQ ID NO: 5883 - DNA, 201 bp, Bos taurus
accagggccacacccactgccaccaccaccaacctctctgactttttctattattgtttcatattctaaagcaagtacatgtgctttattaaaatataatcgaggccagaagaggactatgcttgttttcttggtatgtgtatccccataaattcacattaagaactctccaaaggcaactgctactgttacgtgaaaaat

SEQ ID NO: 5884 - DNA, 201 bp, Bos taurus
tatacatagagcatagtccctgccttctgtctgttcaccggaaaggactagcgggcagatgcgtaaacaaaaaagtacaacagagttaggccggagccatggacatgcatacaagtcttggtccatgctcggagagggaaggtctccgaatggacttgatggaggaagtggtgttggagggtcggcgtgccgggcggcggg

SEQ ID NO: 5885 - DNA, 201 bp, Bos taurus
aactgtctacctacaaggaggccaggaatactggttgcacttccttctctgatctgcagtaggagagcatttggacacacacatctttagctcatttctcatgccttacaggcctctctataatgcatctttcctacatcaaagtggaattttccaccctttcctgcctggtttcctgatttaacaaagtttgtaaaaata

SEQ ID NO: 5886 - DNA, 201 bp, Bos taurus
tttgcttcttggccaagaaaggcaatatttcccggctctaaccatgaaaacactgcttatacttttaatcagatgcatctactacgagggagagccccacgagttttggcaagctgaataaaggccccatgtgtttggagcccacggtactgcacacacttgaaacaccatctgtaggcagcttcttctgctccagcttgt

SEQ ID NO: 5887 - DNA, 201 bp, Bos taurus
taacaatagaggctgcccatgtggatgtggaaatagactggagtggaagttgcttcctgacatggtggttactcatcaaactgtatatctaaggtgtgcattaaaaataaagtacactcaaaaataaagcaaagcaaaaaaacatataatgatacataagggctaaaagtttttgagaggtgctacattaggaagctggtt

SEQ ID NO: 5888 - DNA, 201 bp, Bos taurus
gaggaacaagaactaatcagtactttttcctggttccctccctggatgtcttacaaccccatctgtgtatgtctcctttactcttcttgggtgaggtcttcggttgttaaattctcccccatctcatacacaatctgttagcatatcctattgcttctaccttcaaaatatatcaaggtttcaaccatttgttattttagc

SEQ ID NO: 5889 - DNA, 201 bp, Bos taurus
gcacttgttccccagttttaaggccttgcttgtaaacactgttcagtgagcgttaggtgacttgacttgataccactcacccggagatggcagggtcagaagctccttggggccaggcacttagctgtgtgtgactggctggggtgagctggacacagtcagccctgaagaaagcacagccagtcctggttgtcagttgct

SEQ ID NO: 5890 - DNA, 201 bp, Bos taurus
agtaaaccctgggagttggtgatggacggggaggcctggcgtgctgcagtccatggggttgcaaagagtcagacacaactgagcgactgtactgaactgattgttctttctctaggcctggtacagttagagccatctcattgttcagagaggtcacctgtctggagtggtctacctgaatgcctgctctaagctgctaaa

SEQ ID NO: 5891 - DNA, 201 bp, Bos taurus
cacaccctgagcacgttgtctgagtttcgtctggactgggttgatggttttttactcatactatgattttgccctttggtaagctgagttcgttaactgagtctattttgcctccttcactataaactctaactagttgcctcagggtgtctgtgttgtgcaagtaattcaagggctggaggttgtgcgtttttatttttt

SEQ ID NO: 5892 - DNA, 201 bp, Bos taurus
gatgaggggacacagtgccctcagaagctcgagcccccccaaagggttacagcaaagcatttttaaaaagccagatgaaggagggggcccacagggtatgtgatcagaccgtgcacagttctctgattggctgatgatgagggaagaggatggtgtcacaagagataactacatcagtccttagactccaggaggcctggg

SEQ ID NO: 5893 - DNA, 201 bp, Bos taurus
aatatgtgactgtttccaatataaagctataccaggagcattttgacaactcagctgaagactttccttcagtcatgttggcctttgagggcaggaggagaaggggacgacagaggatgagatggttggatgccatcactgactcaatagacatgggtttgggtggactccgggagttggtgatggacagggaggcctcgc

SEQ ID NO: 5894 - DNA, 201 bp, Bos taurus
acattgataaagggatttaaaccaaagggccatccacaaagcagggtcagataagaaaccccacaggtagaaagaaagagtgtgttaaggataaggtccctgagactgagcttaggggcctgacagatagagagagtgggatgtaaggggatgtgaaatcaaatgtgcctattcagcggctgatcagaaaatgacagatgg

SEQ ID NO: 5895 - DNA, 201 bp, Bos taurus
ctgctgctcggggccgctcaagctctgctgtcactgtgtttccccaaatgttggagtccggtcggaacgccgttctgcgtgggtgtgcacagggtaacggtgccaaagctcggcctccgtattttatgatgaagttgaaggagcagtagagctaaagaaaaatgacacataacgtttattgtatgccgagtactgagaaaa

SEQ ID NO: 5896 - DNA, 201 bp, Bos taurus
aaacacttcctgctggaaaagccgcttcatctgacataggtgtttatcttctgtgtactctgagagaacaaaactggatgtagttttgcttccaacaggcgtcatgacagaaattttcaaaactgtgtgtcctttgttttatatacagctttcacaatgtttcagtctttctgcctattcctcttcttgataattgtatcc

SEQ ID NO: 5897 - DNA, 201 bp, Bos taurus
catcagcaaatgttcatgatggaacagtgtgaagtcaggaggctttgcccacgttggaggaggaggacatggcctggcgttttccatcgctgggcctctcgggggttccagtgctccagagggtcctccaggagggggagacctggtctaccttccctggagacaaggacactgggccgggccctccctagggcagtggct

SEQ ID NO: 5898 - DNA, 201 bp, Bos taurus
ctttctcattgtgacgtctcctctcattgcagactgcaggccctaggacacctgggctcaggagtcgtggttcatgggctgaagtagttgtagcccacaggcttagttgccccttgacatgtttaatcttccagacgggggattgaacctgtgtctcctatatttacaggcagactattaaccagtggaccatcagggaag

SEQ ID NO: 5899 - DNA, 201 bp, Bos taurus
acacacaaagtgacccgggtccctagcccttcctagagaggatgagcgcttatgtacagaagcatgttccagacaggccattggcataatcaaatgcacagaggtgagaaatggcaccttgtgggggctgtaactaaaagcacaagacagagaatgaaggcaaaggatgagagctggagagatacccaagggccagtcact

SEQ ID NO: 5900 - DNA, 201 bp, Bos taurus
atgattgctggagagaaagacatagtgaagtgggtaggtcctacaggaaaagggcagacttaataactgtgattccagggggcacagctcttctgccgaaactataatttccctagatgatgacattagaagtttattcagctgagaaagtgatggccttgggaaacttctctaaagagataccttgagttttattctcct

SEQ ID NO: 5901 - DNA, 201 bp, Bos taurus
ggtagatggtcagcaagctttgatttttctttctcttgggatactgaaaggatttaaaattctaatatactaatccaatttcaaaattagacctggaaatataagcttgtggaaaggcactttaaaatctgtcttggaacacataaaggtctgttcaaaggttgatgtattcaaaatgttctgagggtttttattcatcct

SEQ ID NO: 5902 - DNA, 201 bp, Bos taurus
gttataaaccctgctaagctagcctaaattattttacaacattagttgctaaggaataaaatgtgtgaagctcacatttgtgtatctattaatgactattcttctggacaagtgcccaattttgtctaaaacaaaaaaagtaatctaggttcttttaagacaatttacattttctaattttttaagaacttcaaccaagac

SEQ ID NO: 5903 - DNA, 201 bp, Bos taurus
cttttggattcaacaagattattattttcttttgttttaaatggggtgagtcaagaaagagctccatctgctttcccatcaacacaattttcaatgtagagttcagccatgccttgtaacaatagtattttattggtatcagtttcctgctaaaatataagtgtttggacattgtagacataccggtggagttatcccagt

SEQ ID NO: 5904 - DNA, 201 bp, Bos taurus
tttcctcagcaagtataagatacatataggggttataactggatagctaatactgaagttgattgctttcttttgcttatgctttattttagaatagtctcactctccaacaaacagggaaatactatgcaagagattaataaagaaatatatattagaaccattgtatgtatctagaggaagtgttaaaaaccaaacaaa

SEQ ID NO: 5905 - DNA, 201 bp, Bos taurus
aacagacagccacagtaagagttgtcaaattctataggacgaaatgttctataattcagggtttagcattctatgagtctctacagtcatatatctttatgttggcatgtctagcgcctaatcatatgactcaaatgcaatgtatttcaggcatacactttccattacagtgtaaaattatactgacaatttacttttaat

SEQ ID NO: 5906 - DNA, 201 bp, Bos taurus
tcaacttcacctgtaataaatattataaatcagtagcaaggctttctcgttactacagtctacatgccattgatacatacatgtcaaaaatgttaagaaacgtgttacctaacattgcaaaacgacaaaccctattctccaataactttatcctaggcaacacactcaactttaaggcctactaatgttgtcattaacagg

SEQ ID NO: 5907 - DNA, 201 bp, Bos taurus
gagagagagataactactccgaaaaaccctggaaaagagcaggctcccttaagacagtaactttccatatacgtgcctataactcttttcttggataaggactgcagctcactaatctgactgctgccccttctcgcctcattaaaggtgatttgttcctgtaaaaaaaaaaaaaaaaaaatggatatggaacaactactg

SEQ ID NO: 5908 - DNA, 201 bp, Bos taurus
aagctaaatggcacagccagaggagccatgacagctccaaggccctgacaaaagaccaaggaggaggtggtgggccaattcccggaaacctccaccctttcccaggaataactgcaataatccctccactcattagcatatgaaactacccagactacaaaaactaccttgccacattttgtgtctgcactagccctctgc

SEQ ID NO: 5909 - DNA, 201 bp, Bos taurus
ttgatattttcatttaaatgtaataatccctgttatcactctctatttttatatcatcctagaaaataacatctttggaatcaggctcatgggctaattggatttttgaatacatatcagcttgatttgtttttttatgtatcacctaaaattaccttgtatatctagtgctgtattcatgtcacccattttaagaacaat

SEQ ID NO: 5910 - DNA, 201 bp, Bos taurus
atatcaggtacattgctaaaatagactgagaatatgagtgcctaggctttcatcttgaagaaatttaatgacaagttggaaaatgaatgccaagcaaagacaaataagcagtcagaaagaaagaagtccaggtgtttctgttcgaggcacctctcttagatggaatacttcagaaggagaagtgatcaacatgttgaaaag

SEQ ID NO: 5911 - DNA, 201 bp, Bos taurus
caaagagatatttctaccagtctatgcaattaatcagatatggttgaaaagtattttcagtagttaacaaaggttgctctatactgtattagtattatgagaataggattagaagaattcatatccacttgcactccacattaataatgccttcaactgactgaaactagccccaaaaatctgcaattaagtgtcattagt

SEQ ID NO: 5912 - DNA, 201 bp, Bos taurus
acagtgaaagcctgagaagacttagatgcctaaaatgttcagaatgggattttggaatatatagtataaaatgtatagctaaaattttagttgaaaatattaaaaggaagaaaacagaacaaatcctcccaaactatgaagaatattattcaagtgatcaaatatttcttgaaattacaatacaatttctgcaattacata

SEQ ID NO: 5913 - DNA, 201 bp, Bos taurus
agggcctacatctaatgacatgggtgtttgcgagagacacacagggaaggctttctactagcaaggagagaagtttatacggaggtaggtgagaggggactgacgtggccgtaagcgaaggaagccaagggctgctgagagttactaaaagctggaagagggacgaggagataactccccagagcttctagattcagactt

SEQ ID NO: 5914 - DNA, 201 bp, Bos taurus
ctattcaaaaaagagaaatcccaggttaaccttaccacggcaatatcaggagatagaagagccccgacctcatgagtgagggacatgtgagactcagaagcgttccacaatttgttgaatgcttgttgtcaacctcctgaaactcttttaatagttttgaaccaaaggtccacattttcattgtgcattgggttccataaa

SEQ ID NO: 5915 - DNA, 201 bp, Bos taurus
tataccatatggacagaggctttataatagtctctactgagggtttattttgtgaagactcctttccttcaggtagaagagaagtgttcaaattaatcccgtcagtccagggcccaaacaattgttagagctagttgtaatttctagaatcacttcaactgaactgttagaattagaaagtatcttaaaaggcatgtgatt

SEQ ID NO: 5916 - DNA, 201 bp, Bos taurus
gcaaacttgagtaatttgtattcatggggtgatcttcagagctctttgatcataccaagcaaaacatggtatgaactttagtaagtgaactctggttattcgtgtgaaaattaaggatgctatcttttatgtaactattgtaattttcataattttcttcagctatattaagtctattattgtttttagtgcaatagcttt

SEQ ID NO: 5917 - DNA, 201 bp, Bos taurus
tggtcacattcatgtgggggctttaaaagcaatcctgatgcccaggctgtcattgttccgttgctgagctgtgtcctgctctttgtttcctcatggatcgcagtatgccaggatcccctacccttcaccatctcccagagttttctcagattccagttgtccgttgagtctgtgaggccatccaaccatctcatcctctgt

SEQ ID NO: 5918 - DNA, 201 bp, Bos taurus
tgacccagggattcaacctgcagctcctgcagctcctgcattgcaggcagattcttaccccgagccagcaaggaagcctcctatgttgctatagattcggtgtatccatgggaggtggtgagtttaggattcatctacattgctgtcttaagctggaactttttgtttccaggaagatggaagaaatgcctaacaaaaata

SEQ ID NO: 5919 - DNA, 201 bp, Bos taurus
aggtggggaccacgcctcaccttagttttgggatcactgctgtagggagtccctatagggctccatcccagaacagcttccaaagactctcttggcccagcgagcagagcctcgtgattcaaagctccagggacactttgcacgtggttttgtggggagcagaaggactcatgagtgggaggcgaggacaccacctggagg

SEQ ID NO: 5920 - DNA, 201 bp, Bos taurus
ctgctgtacaagcagtaaagaaatatttatattattccttacctactgctgtataagcagaaaaattaatatttgtattaaagcttgatgataacctattggaatcattaccatctaactctgaaatatggcctgacttttccaaaaaactggggtggggtgtccaagatctacatggcgtggagctaatctctattagtt

SEQ ID NO: 5921 - DNA, 201 bp, Bos taurus
aaaatcagtaggatgggctccctccctatccgcaaggtgtttgatgagagcccaggaaaagtgctgatgaagcctccttagacaccatgtctggcacacatttgtggaaatacaagtataatgattttcattacgctattagtagactgaattttagttatgaggaaaaattcttgctattttattttaaaatgcttcaaa

SEQ ID NO: 5922 - DNA, 201 bp, Bos taurus
gctggttgctggggtggtggtcctggccagtagggcacaagaaaaggtaacagggacgggaggagtgaaaaatgcgttcaataaactcatccgacagactgtgtagggtctactctgtaaggccctggagataacacatttcacccagagtcccgtagcaggaataaaaggttcaagaaagcgatgacatagttaatccct

SEQ ID NO: 5923 - DNA, 201 bp, Bos taurus
tgaacatgtatttttctggagatctcagcagagtactgctcagagcatggccaatgagatgttccaggcaacttgcagataatctctaaccagctgaccccaaactggagggtaacccaggccttattttgctgtcccccatagaatcccagggacagaaaaacctggcaagatacagtccatagggttgcaaagagtcag

SEQ ID NO: 5924 - DNA, 201 bp, Bos taurus
ttccagtcagatttggaaatacagtcaacttctgaatcacaattaatatcttagtaaaacagataaaacttccatgacatatacagtaattctttgataaacggagcacaatcttactagctaatttgcaccttcccaccctgatgtcctctgcctctcctcggccacatcatccatttacacctcacatgcacaccttgt

SEQ ID NO: 5925 - DNA, 201 bp, Bos taurus
gcctctggaggctggccggccactcacgtcctggtgagcaggagacacgtgctggagaggccgtcaccacgtggtgagcggcacagactcactgctgccacggtcccgatggaccagaccggcagcgggtcacacggggctggaataaaggcagtctcgttaccggtctgggctcagggctcgatgtgcccaggaattctg

SEQ ID NO: 5926 - DNA, 201 bp, Bos taurus
tactgactgaaaatctgactacaatacagaacccctttctcgattatttcctaatttctttcaggtccgggctcagtcatttcagacgagtaggttgtttcgtgcacttgtttgttagattttacaacactggatgcacaaaagtaggtcgagggagaattccagaaaattatctcactagactcagatttatggaatctt

SEQ ID NO: 5927 - DNA, 201 bp, Bos taurus
gtgctgcctcttggtgacggagagtatgtggggaggacatgaggactctccccttcgagacgcactgtaaaaggcaggattctacttgcacctaaaagacgcttcctccttggaaggaaagttatgaccaacctagacagcatattcaaaagcagagacattactttgccaacaaaggttcatctagtcaaggctatggtt

SEQ ID NO: 5928 - DNA, 201 bp, Bos taurus
aatggaaaaggcaatggcctagaaaaagaacaagctttcagaaacactcaacaccttggaaactccattccttagctacagttcagtacagcaacacggggttttatgtgggccaagaccagtcatcaagggaggacagtctctcctctgtctagttcccacatataatccaaactgactataaccttagactatatgcta

SEQ ID NO: 5929 - DNA, 201 bp, Bos taurus
gccgacgagaaaagcccattactcatcctggaaagatcgctgacatgagaaaatgtgggtccagtgttgctagatctgcaactttcccaaaagaaggcccaaattcagatttttatgtgaacgacccaattttttaaagttggcaacttactcaattttttaaatattgtatgggccaaacaaaacagctttgtggactgg

SEQ ID NO: 5930 - DNA, 201 bp, Bos taurus
aaaataagcagaaagccatctgcagttaaattattcatcttaaactgtacacattacttagaaacactataacaggatctcactcagaagtaatgtgtatgaatcattacgaaaaataattgaataaagacacacataatattaagcaaacacagacggtcaattttatacttatttctaataaaagcattcgaccataga

SEQ ID NO: 5931 - DNA, 201 bp, Bos taurus
atttcccaaaaactttctaaaatctattcataatatattactagtttcttgggtaactccgaaatctatactagttcataactctacaaagtacaagatgctaaaaataggccaaataaatataacacatatatatcaaatatgctgaccctaagccttaggatagaaaccattttcaaaatcataaaactttaagacatc

SEQ ID NO: 5932 - DNA, 201 bp, Bos taurus
tacattttatattttaaatacattaaataacagtataaccctggaatttgacattcctgaaattttatacagagatttctgatattttctcacttgttccccaccactttcttgtgtataacatgttcctttgtaagttttcagtggagacgtgaaagtttgaaggaaactgttacaaaagagtaaaggattaaaaaataa

SEQ ID NO: 5933 - DNA, 201 bp, Bos taurus
ttgtggcccaatgtgtaacaagccaaaatgctgagatgctaggattttcagcagagggttaattcacaaggcagacaggcaaggaaacagaaaatcaagtattagaaccaccaccccgaaggccagagtcttgggtatttatgggataaagaataaagcagcatgcggtctgaggcctgaggagtgtggggagcgcgggga

SEQ ID NO: 5934 - DNA, 201 bp, Bos taurus
ttgtacactttgtgttgaaattcatgggaaagcttgtcctctgtaaatgactctcagatatgaatgtgtctgaattcacctccaggccttacacatgccttcacttgtccaccggattggtggtgaggaataggaaatgaggagggaatggtttaaggcccgaatggtcgtatttgaaaggtacctcagattatcaccatt

SEQ ID NO: 5935 - DNA, 201 bp, Bos taurus
cagcatctgtgacaagacagctgtgagagagtgagcctggaatgcagacgtccgcgttgaacagctgagacaagcagtgtgatgcagagagagcgtctgattggaaccaggacaccttcaccctggctggctgctgcgacaccctgcaccacagcgacctcacagggaaggacaggagaggctctgagagggaggcttccg

SEQ ID NO: 5936 - DNA, 201 bp, Bos taurus
tgggaggactgagttcagtgtgggatattcacagcctgaggtgtcctgaacttcttgttgagatgagtagccacagtttaggatgtccttctgaagctggcgatgaagacttggaagtggccagtgtaattaaagaggaagagaaaaaaaaaatgaagaaagtagggtaatttgaaagatagaagaacaaaggagtagaca

SEQ ID NO: 5937 - DNA, 201 bp, Bos taurus
aaataagatatcaatgcatgaaaaaaagatcaattctactttattgctaaaaaaataggatttgtcaatttacagataggcctttgtgcctgttgaagatggaagcactgctttacatcctgtttgtccagcaggaatgcaaacagtcatgaaggtgaaatatccagagtgtttacatggccctttcatagaaagtcgcct

SEQ ID NO: 5938 - DNA, 201 bp, Bos taurus
cctacataaagaatgctattttggtctcagtataatttctgtttatagtacctcacgcctctctgcatttgtttccctcttactcatgagaatatacgtgtacatcatatgtcagagtagaggacgtggcgaccagggtaatttctctcttattcccagaggcacatgaaactagacagcctgagttagagaaattgactt

SEQ ID NO: 5939 - DNA, 201 bp, Bos taurus
aaagggggttttatataacatacatgtattatttatttataaaattaattgcattatggtcagagaaaatggtctgcaggatactgattcttcgaaatgtgttaatctgtgctttgcagtctatagtacacgttcactttttgtgtgtttttgtattccacagcatgcagtgttcattaaaccatgtttaaatgagttgct

SEQ ID NO: 5940 - DNA, 201 bp, Bos taurus
ccatcttgttcaaatataatactattttaattactctaactttataccaagtcttgagacatttacattttgatataaattttgcaatccatttcatcatgatttttaaattctgggattttaagtgaaatcatattgaacctatagctcaacttggaggaaactgacattttaacaatagtgagttcctattatataaag

SEQ ID NO: 5941 - DNA, 201 bp, Bos taurus
agataaggatactgcaagattaaattcagtggctcaagattatcaagaaggatccaggctctttccattgtcactctgccattcacagtgaagtggattcgtcctgtcataagctaggaggtggggttttgccagtggctcaacggtaaagaactcgcctgccgacagagtaaacataaaagacgtgagctcaatccctgg

SEQ ID NO: 5942 - DNA, 201 bp, Bos taurus
gacgaaggaggagcgcttctccatctggagccttctccagccccgaccacagcgcgccccaccccacacacctggcgccggggccctggctccagccttcgtgacccacacagcgctgtgcagaccatctggacctctgcctgagggcagcgtgggtaacgagggccccgctgaggagctgcagacgccatgaggaaccgc

SEQ ID NO: 5943 - DNA, 201 bp, Bos taurus
tgagttaggtctgtcagttaaacacacttacacaagatttagaaaacacaagggaagttgaggtaagactcttgacttaggactgtatttctcttacaattaggttaatggaaacattcttctagagcaatgctccatagctcagtactcacctcccagcctcctggaagacaagaggcggtttacggcagctgtgagggc

SEQ ID NO: 5944 - DNA, 201 bp, Bos taurus
agctgaaacgttattagccttagcatttcctttgactgtcacccagcatattacatattcattttccctctgggctctgagatattgaaggggtttacatggcatttgcttctgctactgagaccggtgttgaagtaagaagcgcattgaactgttggaacctggaacagtttctgtgtttgccggtatcttgaccagctt

SEQ ID NO: 5945 - DNA, 201 bp, Bos taurus
gtactgaactcagcaatactcagcacagggactgtgcggccagtcacaggtctgtgactgcacgtggcaggaggcgccctcctctgtccgttctgtgttgcttcctaaagcagccggccatcgcgtggtgactgcacatgcgtgtgttctgtgcacccgtttatctccactgcctccccacatcttatctgaactcttgtt

SEQ ID NO: 5946 - DNA, 201 bp, Bos taurus
taatataagatatctaataaaagatcaatcttaccatgtctgtggtcctctagagcagttcttaaatctgattttgtgagcaagatatagtaaatgtttccgtgggtagagtggaggagtaagggcttgttttgtcttctgtcatgagtgaattgctccttcttcagtccatttccgttgggttggccaaaaagttttttc

SEQ ID NO: 5947 - DNA, 201 bp, Bos taurus
aaaactctgggtctaaacaaacacacaaccaacatgtgtcgcaagtttagatgatggaactttaagatactgagctctgcttcaggtggcacaggccgaaataaaaccacagaagatgattctcaaacagcgaccgaaagtccagggtttaattgcacgggtgggaattgggtcaacatgactgctggacgcctggtgaga

SEQ ID NO: 5948 - DNA, 201 bp, Bos taurus
agcacccacagctccctgaccccccagctggcccccaagcccaggggaaaagcggaggaaggaggagtctgcaaacaggcacttagcaggcgtgcgccggacgccagccccaggcccgcggaggggaccgcgcctgtcgtggggggtgggcatcactagaggatccggccctcactccactccacccagttactgctcaag

SEQ ID NO: 5949 - DNA, 201 bp, Bos taurus
gccttggactggcaaccagggtgagagcaacggccttctccactcgtcagaggctggaggtccctgggctagagcgcccccattatgaacgctgcttgtccgagacggggccaccatatggtagagaaacaggccatttttatggagccatacgctttttgtgaacacaacagcagtctgtacaggagccccgatgaacat

SEQ ID NO: 5950 - DNA, 201 bp, Bos taurus
gttgggaggccacactttggctcaaaaatgaatacgatgtctgttgtctgggtggaaggatgagtttgcaaattgagggttgtgcatataccagctgtgttcttactaggtgtgtggccatggacaaattactaaattgattttctcatctgtaaatgagtataatattaatatctactttgcaaagttgaaatgagaatt

SEQ ID NO: 5951 - DNA, 201 bp, Bos taurus
agagcagaggttttgaagactggcaatgctcaccttcgggaggattcagcagttatttgcatggtaacagtcttaaagaactggccacagttctgcccagcgctgttactgcaacacacaccatgggcattcattgcctctgacaggagttagagcccgtggaatatcttcaagacactgctgtcacggtgatgcacagca

SEQ ID NO: 5952 - DNA, 201 bp, Bos taurus
tcatcatggagagattgggaagtgattatattaatgatgttactgaataacacagtacccctaaacaagcagcttaaagcaacaaacacccatcatttccgtttttctaggtcagggatttgggcctggcctttggctcagggtctctcaacgggccgctgatcaagacgctggcagagtctgcagaaagttcctgcaggg

SEQ ID NO: 5953 - DNA, 201 bp, Bos taurus
agttcctcggagctgtggtcttgtccagctttctatttgtcactgggacctccacctgacagctgtcacattcagcttcttaagccactccgtcagggtcatctgtgatgggtggttaatgtcatatgacaaagcagagtccatgagagggcggtctggagcccagtccctttaccagccctgaagtcagcctgccaagca

SEQ ID NO: 5954 - DNA, 201 bp, Bos taurus
ccgcgcacaaaaccgaagacccggggcaaccaaacgtaaataagtaaataaatgaataaatgtttgaaatgctaaaaaaaaaaagagagtatctcaactccgtgagcattttccagatgtcactcttatcccactttggccatgttgatatttttccttaatggcctttccttctatgggctagatgatttgcatttttat

SEQ ID NO: 5955 - DNA, 201 bp, Bos taurus
caatttcataatgatgataaaccactgtcaatttacaacatcaacatacatcaagtgaactgattaaatctacacgctcattttatataatagaaatacagtcactgcaataaaacactgtcatgggattaatgtcttctactctgaaaatgtaagtcttgcctttggcttggtattttatgaagcagcaggagaccatta

SEQ ID NO: 5956 - DNA, 201 bp, Bos taurus
tctggcatgggaggagaaggagcttctagaaaatctggctttgaaggccagcagggtttaaccacaggaattccacaggattggaggaaacagaaactccgcacttggagggcacacaaaggtctcataagcatctagatgcagggaaaaaagcagtgacctcctaatagtctgggatagacctagcagctaacaatggag

SEQ ID NO: 5957 - DNA, 201 bp, Bos taurus
atagaagtttattttctcatggtgttgaaggctgagatgtctgagatcaaggtgccatctgactgtgtatacggtgagggccttcttcctggctttgggacggcttgctttctcactgtgtccgacccagcggagagtgagctctctggtgtctttcttataaggacactggttctgtcacatcagggccgcagcagcatg

SEQ ID NO: 5958 - DNA, 201 bp, Bos taurus
gtcgtattacgtataacccagtacctaattgtcagatctcccatcaactctttatgtatcagaggcttgattaaaaactgtgtttaatttttttcccaccactctcaagatataatgtatatacagctcttttaagtttaaagtgtataacacaatatattacatatatcatgaaataattaccagaatatgtttagttag

SEQ ID NO: 5959 - DNA, 201 bp, Bos taurus
aagttgtgctttgactcaccaatacttgtgtctccttgtctatgctttccatgcatagtgccccaccgaaggaaaaaaaggccacaatgcgaccccagttcaccccgtcctggaggagttcatacatcatctgttcaaagctctgatatgctgtccccggggtgatgtggagctgggatgtctggtcgctgaatgcctgtt

SEQ ID NO: 5960 - DNA, 201 bp, Bos taurus
ggaaacactgtgtaagacttctagaaagtctccttaaaaaaatagaatgtgatggcctgtggtccagctgctatcttgggccataatgcaagatgaaaacgaagacctgagtagcaagaatgtaggagccagagttcttgatgtccaaagtgaaagtgaaactcactcagtcatgtttgactctttgtgatcccaaggaat

SEQ ID NO: 5961 - DNA, 201 bp, Bos taurus
gaccaccacgggttaacatttgcagacctggatagtggctgaaacattctttgctcttctcttgtttgcacttcctattggccccacagacacccagctctgtgggtctgtgtctggctggaaatgactcacaattggggctctcaacagcatacagccaaggacagccacctcctgcccaagttcaggggtagtatcacc

SEQ ID NO: 5962 - DNA, 201 bp, Bos taurus
aaatattctgaacaaaacgtttttaatattgaaaggtaaaactattggcagaatctaaagaaagttcatgaggagtcagcaagcctgcattcggtgggggtgatggctatgagtctgataccctgtgtcaatgattagctgagattacttctccttttccctttaaaacctttcatggccaagcagaatcttcagagttag

SEQ ID NO: 5963 - DNA, 201 bp, Bos taurus
attcctctgtaactcactttccaaaatatctttcaaatctaagcattttctccacttccatggcccccaggtcatccacaatatccttctggctgacctcacagctcccctgggcccacccctgcactcttcacgtcatagccaacagacacgtctcgaggatgaactcaatcaggccatgtccccagttacattttctca

SEQ ID NO: 5964 - DNA, 201 bp, Bos taurus
tgggggtgataagggcaggtgcattgtggcctggagtgtgtgaactctatttgggaggtggttggggtgtgggcttgaggcactggacaagaaagggacagtagcagctcctaataagggcctcagaactggccaaattaatgtgttacaaactatactacactcaccacggccacagctgctgtggcgggctgcacagtc

SEQ ID NO: 5965 - DNA, 201 bp, Bos taurus
tcctgtggaagtggacagagtgcatgagagcctctcgactatgtctgagacgtcttcccacgactccttctatgactcgctctcggacctgctggaagatagcgagaatgcggccttcttccccgggctgtcggccttcctcagccaggaggagatccacaagagcctggatctggcccgcagggccatcgccagctccga

SEQ ID NO: 5966 - DNA, 201 bp, Bos taurus
gacctggaggccacccgtagccttccagtttggggtccagctgcccacatgcccccctacttctctgggagcatagccccactctccaccagctgcctcccgaatgcccccggggcctcattggtccctgactccactggtctccctcaagttctcaactgtcacacatgtgtttctcttctccttttgatggttttctgg

SEQ ID NO: 5967 - DNA, 201 bp, Bos taurus
tgagttgtgttgtaatccagacatgagccaaaccttcctgctgccaagaggatcacactttaggggcttctggtgccaggcctgtagaggccaacaaccccggaggcatctgacaacccccttgcgttttctttcatgatcacctttgcttctgttctgcacacatgcatgctgctgctttctggcctcgtgggtgtaaaa

SEQ ID NO: 5968 - DNA, 201 bp, Bos taurus
ctcctttgacattccaccttgcttgtgtccagctgcgtggccttttccccgtacctcgaacatgcgggtcagcttcccacctcaaggcctctgtacaagctgttccctcagcctccccagagaatctcagggctcacccctcaccatcgttaactctgcttaaatgtcactttctccacaaggccacctctgaccactcca

SEQ ID NO: 5969 - DNA, 201 bp, Bos taurus
aatgacgggtacatgggatcaactgtcccccaggatcttgcccttccatttgttcccaaatcctcagcagacagcttctcctgaagtcacgtctggccctcccgccccagggatgaggcactgcagcagatatccaccccacagcacagagtcaccgcctcccaacctgctggccagttccggccaacacgccctccccta

SEQ ID NO: 5970 - DNA, 201 bp, Bos taurus
tttatctgaaattcaaatttaactggatagcctgtatttctctctctggctaaatctggccttccttgtcacctaggtgggtctcccttagtccttccccttatctatggattctgtgtgccatgctgtcttcaacttggaggctctgacccttgccctcctgacccctttctgaggcccctagctctgtggcctggtgta

SEQ ID NO: 5971 - DNA, 201 bp, Bos taurus
aagggagcctgacctgctgcagtccatgggatcacgaacagctggacatgacttagcaactgaacaactgaggtgatatttttctgagtcgtctacccaatgccccatgtactgtcaggtttttccactccagaaggtggggacgcaaacgcttcctggccatctctttgctccagagattgttctacctgttccattcca

SEQ ID NO: 5972 - DNA, 201 bp, Bos taurus
tctccatgtctcacttattacagaaccccctccaggctctcagcccctctacgtggggcgtcctcagtgtctggccacacgggggcctgggtggaccagacggcacctgggcacactcatacgcactttctgtcacagagaaggaagcgtccagggccagttcgtccacaggaagcacaagctggcctcctgtctcccatt

SEQ ID NO: 5973 - DNA, 201 bp, Bos taurus
aggcctactctggccttgtgctgggtgtgcggcgtgaactaagcgttagctggagggtgctcggagtgaaatggcagcagcctgctgcacgtgcgggtcttagtctagaaggcctagctcgagggggagctctgagaagggagatcacagtcatttctaggaagagtaaaataaaacactgagccctgagccatgcagcac

SEQ ID NO: 5974 - DNA, 201 bp, Bos taurus
aatctaaaaaattgagccaataaaaatttaaaattgaatttaaaaattttaattgtatacaacaaaataaaaggataaaatcatggataacctacaataacaagtaattcaagaatgattttcatcaggtttagggaatgagtgagaggtccacaacgtaagtataaactttttctcagcatttcccgttttccacactat

SEQ ID NO: 5975 - DNA, 201 bp, Bos taurus
acggcgaaggccaccaggcacaccaccatgtagtacacacccatgtcacccgacgtgaagaccacccgcagcgtcaccgtgttgttcacagaaccgtgcacgttggaggccatgcacgtgtatctccctcggtctgagaaggacaccttggtgatgttcaggaggccgtcatgcatctgccactttcctgtgggagaagga

SEQ ID NO: 5976 - DNA, 201 bp, Bos taurus
tgcagaagtgatgtaagcagcacagaggcctccccttagataagacgcattcttgataggtccctattcctcaggtgcggtgggaaatctcaacttcctgtggaatggagagggccggacacggtatgtcgtagatgctaacattgaaaactgacagccttgggacttccctggccgtccagtggtgaagactctgccttc

SEQ ID NO: 5977 - DNA, 201 bp, Bos taurus
ccaatggaaagtgatgttctctgctggcataaccggatctgacgcctgcatcagacataacagcttgcgctcatgcttttccatagcagttttgctcttccgtctgtggccttacaaccagagcactggctttgcacccgtgttcttctcttgaccctgtgaaatctattagctcagcttgtcctttgtggcttcagtgga

SEQ ID NO: 5978 - DNA, 201 bp, Bos taurus
gctcaataaatctttaatccaattttctattaatgggtggggctgtgttccctcactgttgtttgacctgggaccaaactatggtggaggtaatgaagactgtggcctccctcaaaaggttccctgcaagcactgccatactccttggccccgacactgcagcaggccaccacaaacccacacctctgctgaagactcctg

SEQ ID NO: 5979 - DNA, 201 bp, Bos taurus
ggaatggtttttaagcctctcacttcagtgtatgccgtgtggagcttcacctcttttggcatttctcatatggtacagacacttgaggaatgctgcatatgagaaactcatggacaggagtgagaagagtctagcctgaggggcagaaaatggagaaagtaaatttcaagaacagctctagtaccagtcacagccaggtta

SEQ ID NO: 5980 - DNA, 201 bp, Bos taurus
gtattttcttccacttagtaatctctgcagaatttttgaagtattgatacgtatcaaaacagaatcaatttcctcaaggttcaatatttgattagtttcattaggtaatgatacattatcattaaaagatcctgttaatatcaatgtgttttattcagtccaatccagtgttctatgcagcacttcaaataaaaagcaata

SEQ ID NO: 5981 - DNA, 201 bp, Bos taurus
gccttctacagagaaggagggaaatatccaactatagccctttgcagtcacttggtctcccctgagaggagaggggactgaggaacacatgtgaagttcacagcccaggcacacaggctgaccaaccataggatgtagagggttcccctctacccacactcaccaccatgttacccaaaggaatatttacatcagctcctt

SEQ ID NO: 5982 - DNA, 201 bp, Bos taurus
ctaaggtcttgagataattcactgatgtgatgatgggtgagtatctcccagagaccttggcacttgtggatgctggatctggtgctgtgacagcaatgatcgggggaaacactgattgctgtttaggaaacatggttccccaagaactgatagaaagtagaacattgttctcagggtgacaacaaagatataaataaatgg

SEQ ID NO: 5983 - DNA, 201 bp, Bos taurus
ctgaatgtgctgcctaaaattaatgaaagtctttgtcacagcattgtggcaagaaagataaaaatctaacacatgaagttagtcaaaggttatctttagtgagtggcaggaaagtattaaaaaagtattatttctgtgagaacgccagcctttctttaatactgtgttcatatcagcaatttctgccctcggctgggtggc

SEQ ID NO: 5984 - DNA, 201 bp, Bos taurus
aatgaaaactctttgccttcaaattctcctgctctcttcttctgcattaattgatggaccccgccgctgccatcctgcatggccatgctccctgtggttcggtatcgattttctggaagagatgtattcaggaaactgctcctgaatctaattcttccattcagctttcctttctattagtttaaacagacaacaccgtct

SEQ ID NO: 5985 - DNA, 201 bp, Bos taurus
ttttcaccattagcttgtttttaatctggatacatgtgtttcttcaggacactggggtggctaggctttctcccaggtctgtaggagaacacaggccagtagatgaagggtttctccttcgaataacaggagctccactcttcacagtcattcagagaattcttgttgttgttcatcattgcttatattatgagatttcta

SEQ ID NO: 5986 - DNA, 201 bp, Bos taurus
ttgccttcttcatatattgttgctgttagaaagtctgccttcaacccaagtattgttctttgatgggttgttagactttctctctgaattacagagatccgcacagatatatctaggtatgaatacaggtttttctattcttcttgaattttatattcctgatctaaaaattatatttttatcagtttttgaacacctcat

SEQ ID NO: 5987 - DNA, 201 bp, Bos taurus
ttattcaattttacaccttactttgtggctaccttaaagatcaatacttttcaaattgcatataaaaaataatatttaaaaaaaaattagatcatttgaattgtaaaaattccttcttttcccagagtttatgagatccaaatattagtaccttttgtgtctatggcaggctcccctggtggctcagctataaaaaaaaat

SEQ ID NO: 5988 - DNA, 201 bp, Bos taurus
tttaagagttttattatggtacgtctttaagtgcattcctgctgatttcaaaagtgatgaaaattgcctaattttcacttggctcgcttaatttccatgtcattcatttactcagtcaaaaatcctaatttttcttcttccatcttccttataccccacaatgtaacagtcatagtcctagggaaatggacaaggagaggt

SEQ ID NO: 5989 - DNA, 201 bp, Bos taurus
agagaaatgtaagataaaggtgcacctactggaggctgagaacctcagctggcgtatctgtgaggttcccagaactctgatcatcagcccattgtccttccgacaaaagaagtatgagtcattttttgaaaacccggcacatccaggaagggacttaaacacattcgtgtcaccatctcagcccataaacaagtgagacag

SEQ ID NO: 5990 - DNA, 201 bp, Bos taurus
cttccttcctgcatgaagaattcttggcttccatttcatcgtccggaacaatcacttagccaggcctcccctgaagaggtccaggggtctcaaactccacgccccccacaggacacaactgctggtgacacgggtcattcctgccacagctctcttatttacctgcacaggagaagtgtctctctcaatctaggctggtgg

SEQ ID NO: 5991 - DNA, 201 bp, Bos taurus
aatcaaagtcctgtccagcaccatttgcaacacactgactgactggggtccctccgtgggagaactccatccagtgtgaaaaaccctggggccaaggagatgcatcattagcagggaaaatatctatcgttgagggcactcacggagatgcagcccattcaaatgaagataaacagggccaaacaaaagaattacaggaga

SEQ ID NO: 5992 - DNA, 201 bp, Bos taurus
ggaaatggccctgagctgggctgggtgtggggctctgtgaccgggatctgagggcagtggctttgggagggaggggctgcccaaggctgagctgtgatgggggctatagaagtcccaggcccaccccagagagcccggatcgcaggtgttctcctggggagagggaggctgaatctgggacctccgcctggacagtcactc

SEQ ID NO: 5993 - DNA, 201 bp, Bos taurus
ccctatggtggccaagttatcttacctagaaatagatttaaagaacagaaacaggtttctgacaataacaatttattttagatttatttagataacatacatgaaaatacctaatgcaatccagaagggctttaggaaaaaaccaacttacagctgtattgaactaaaaaaaaaaaaaaggtaaagtaagagctttaaaaa

SEQ ID NO: 5994 - DNA, 201 bp, Bos taurus
atggggccgatgcttcacaaacctgcccgtgtcctgaggagtatgtggaagttacacttactctccgtggacagatggagtcaggttctgctcatcccgtatgtcctgtcggccctctgtcctgcccctcagcatcctctcgtctccctgaaggaattcttgtgccctgagtgaaagcgtatctcctgtataaggtctgtg

SEQ ID NO: 5995 - DNA, 201 bp, Bos taurus
gtccccatgctctacagagcccccaccccattttgttcctgttccagctctgctgctggtcacaacgaaaaccttttccttctgggccagtgattctagattaggaactatttgtctccagggatacacctgaaaatgtcaggagactgttttagttgttacagttttttggtggggggaaagttacttgcatctagaggg

SEQ ID NO: 5996 - DNA, 201 bp, Bos taurus
actttggatccctccctcgtgaagaagcagaaatttattagcacctcagttgactcttactgtgtttggacttggcttacttctcttctgcaaaccatactatccatagtctgtccatggaccagtactggtccagtgcctattacgatctaggcttcacagcaggaggtgagtggtgggcaaatgaaagaagtttcatct

SEQ ID NO: 5997 - DNA, 201 bp, Bos taurus
ccaaagtcattcctatttttgtaatctccatttaaactcaagcctgtgctgggatattccacttaatggggatctatttttaatcttatatgaacttggcagtaactctcgtggactactcttgcaccatgtactggaacatgatgctaagcttagactgtgtattaatccagttgcttcctcatagatcttgtgccagca

SEQ ID NO: 5998 - DNA, 201 bp, Bos taurus
gcccttgtgctccctttcctcaggctggctgcaaagagcaccagcacacatggattgagtccagtgtggacctgcatctcaaccccatcaccacctttttattttttggccgaaccacgtggcatgtgggatcttagttccccaccagggattgaaactgtgtccgctacagtggaagcatggagtcttatccactggacc

SEQ ID NO: 5999 - DNA, 201 bp, Bos taurus
ggggtgggaaggaggtggagattggggggataggaaaagtctgcaacattcattctaaatcacggtttttatgaaacactcgggtcagttatattccccccgccccaaggaaatatcataaaataaccccaacattttctaagttaaatgctttcaattcaattctcctttaactatacatactacaaagcatttttagga

SEQ ID NO: 6000 - DNA, 201 bp, Bos taurus
gaaactgatgaataacttctttattataaaattcagcccccttcaatggaacccaaattttacttaaagttcatttgaacttgtatcatagtcattagaactttcttttcttcctgttgtttctccagtcatatagacagacttcaagactgaaactcagcacctagataggttgaaggtatgttatagcgaacctgaaca

SEQ ID NO: 6001 - DNA, 201 bp, Bos taurus
ctgacccatcaccacctctcagcccgatgagccattcaagatgggtacctctgaaaagagttcaggctttttataagcaagtcagtctgtcttttgaaagtcttccttttctttcatttttgctatgaacgtacgaaagctggcttctgctctgtaaggaggaaaaccagagcccatgggaagcgacaatgatctcaacgt

SEQ ID NO: 6002 - DNA, 201 bp, Bos taurus
tattactgttaaccaaaaaaggaaaattttgtcactatatgtgttaatgtttgggaaacaaaatcatgtaatagtcactggagatatatttgctgttcttttgttgttaaaatatttcctcactaaaatgattaaaaatgtgagcttctgatgaaaaaataaatgatgcagtttgcaaagggacaccaaattaacatctca

SEQ ID NO: 6003 - DNA, 201 bp, Bos taurus
gcaaacttactttttttttttaatgaaaaaatattgaagggaaaagtgcacctgacattcaggaatatatagaggataccagaccaatagggaagacaaattggggagaaatagctaaaatgaatacaataagtgtgtgtgagctatgaacaaaagagattaaataagcttcagaaatacaaagagttaaacaatgtctca

SEQ ID NO: 6004 - DNA, 201 bp, Bos taurus
gcctcactgcctccacttcagggtttggaggctgtttggtggcctctttccctaaaatataactctctccctgttctcagatttgatttcttaagatgaacatttgaggggaaaaaaaggcaattttactcccagtgtgaaaacacattaattttcaaaaaataggagctgcaattcactatttgcaggcaagccaggaga

SEQ ID NO: 6005 - DNA, 201 bp, Bos taurus
ccagcctgaacaagaaaccaaagttcatgggaaaatgctgaaggagagcaacaagtctgtgttccagagattgggatccagtatgacaaagagagaggatgagtgtctggacagaatgggagagcaggccagagaggaaagaaactgtttcaggtatggttcctctggactccatcacccacacatctaataacaatagca

SEQ ID NO: 6006 - DNA, 201 bp, Bos taurus
atgcttcacaccagctttcaaccctatgtttcatcctgaactcataaggaactgcttacagtttgttgaaccaactatgcactttccctctccttggaacgtcttctgccaaattcttgaaaatctgttaaagttgggctcaagagtcttctttgttacaaagtctctcctttaaacagtttccattataacttccttatc

SEQ ID NO: 6007 - DNA, 201 bp, Bos taurus
gctttcacctttttcttggacttgaaatattataatttgtaagtagatgtcacattaggaaaactaaccagattaccctgaacagtttatataactatatctataataactccagagatgtcatttttgtcttgaagcaacacagaaaatgaaatgctagtttatttttgagaacctctaaagaaggagatgtctacattt

SEQ ID NO: 6008 - DNA, 201 bp, Bos taurus
gattgtgcctaaaaaggttgagtatgttattattttcatacactaaaatatgaaaactactaaactagactaaagaagaaaactaaggcaagatctataatgtgaacgtctgtccattcaaactggtcttcttttacgacagacatagaattcctagtaatgaattggagatgaatggaagactttgaaaaattgtcctgc

SEQ ID NO: 6009 - DNA, 201 bp, Bos taurus
gaaattattaaaatttgatggtttggaaatgaagcaatgaatgaaaatgtttttagggaaaaatccaaagtggagaaatgtttttacactcattgattcataggaattctgtggtctgggatgtcagaaatctaggagattcttacaactgacagtcattaattgaaatcactgtgaaattttactcacttataaacctat

SEQ ID NO: 6010 - DNA, 201 bp, Bos taurus
gactataaagtcttgactgttaccttcatttgttgacttacttttaattggctactctggcacctggcagctcacctctccagctcagcagagctcctgataacattaggctccaacttttttgtaatccttcccaaatctgttatttaagtattagagaatatctgggaaaagcaaaactttgaaaaagaattaatcctg

SEQ ID NO: 6011 - DNA, 201 bp, Bos taurus
gtcatatttcttgctctcatcagagcctcctgcctaagagtgtgactctagaactcgcctgtctctcgacctgcaggccagtccaggatctaaggccgtaatggtaatgggatgacttagcttcttggaagccccgtctctgaagcacagtcctcgtctgactggaaaaaccacagaaagtcccaggagacctgtgccacc

SEQ ID NO: 6012 - DNA, 201 bp, Bos taurus
acggtccttggactctttaatcaatagaaattggtaagaggccagaccaggaattcaggcaaggctttactgggacacgagagaaaacaagtagtagattaccttgctcactctctgaaggggggccaagcttgtcccttaaaaggggtgagcctagggtcagatcagtgggtggtgggtggaaggggaggagtggcttag

SEQ ID NO: 6013 - DNA, 201 bp, Bos taurus
ctgtccctggagtgtgggagatgcttagtaagggcagctaatgtgatgatgactaccacatggggccaagcacccaatgtgcagtcctgggaactgtgtaggtgcttggggcccagaacaaactctctggatgatgtgtgtgtgtctgcacacctggcttccctgcttgcagcccatggagccagggctgggcaagcatga

SEQ ID NO: 6014 - DNA, 201 bp, Bos taurus
tgaagattaagtgttgcgtatcaacatacccagttcgtgtctgccccccaccaccccgcccccgttcccaattcatatgttgaagccctaggccccagtgtgacagtgttggaaggcagggcctttggagatgattagatgttgtgatcatgggaatagagctttttggtgggattattgtccttacagaggaacagagac

SEQ ID NO: 6015 - DNA, 201 bp, Bos taurus
taggaggagatctctcactggacaccaaacctatgacatcttgatctcagacttcccagcctccagaactaagagaaattgacgtgtgtttctaagtcccccagcttatgttactttgttatagaagccaaatctaagacagagtcctttcctaaattccttatctgcatcccgtttcagtctccagatcaaggctaacac

SEQ ID NO: 6016 - DNA, 201 bp, Bos taurus
tgaggcccagactggacataaggaggaaagacttggggaggggagcctctgctttcagtcgaccttgaaccgatttcccgacctcctccatcttgctaacaaagcagcgactgtgtatcaaacaagtcagctctatatctggagagcaagcctccaaaaggacaggtgatgctgtgactgtctcatgggagatggaggagg

SEQ ID NO: 6017 - DNA, 201 bp, Bos taurus
ttctttttagttgagttgttgtaaaagtgattgtcatttgcatttcttttagggtgtctgttccatttcagaagctagcttaggggtgggtggccagtacgtattttgatcccagtacaactcctttttctgaaatagaagctgccaccctgaatgttctctgcagtgtggaacgggttacactgaggactaagctcagaa

SEQ ID NO: 6018 - DNA, 201 bp, Bos taurus
tcggtggccaatccatgatctcacatgggaaacacaccgccgtgctggcctctgtgttcctgtctgagtcagcatgcatgtgggatgaccgctcggccacggtcgggttcccctctgccttatcccttcttggagccctaagtgatgtctcttgggataatggaaccgccagcttcagttaggccacttagtgatcacttt

SEQ ID NO: 6019 - DNA, 201 bp, Bos taurus
tgaaaggatgcagttcgcattaaaagatttctgctgcaattttaaatggatagtcctggatcctcagctcatgaaacgtgatgaaagccaagtcatgttctcctcaaagacaagtacactcactctgcacaccttagcacacaccttttccctactgaggagtggcacccatgcaaaagcttggaagaatgtttcatatca

SEQ ID NO: 6020 - DNA, 201 bp, Bos taurus
gactatgatatgcccacgaggatatgaccacacgggatggtgcaaaagaaatcttcatttgtaggaaggaccaaagtcaggaaaggagtagaattacggagaggagacttggaccatacttaagacacatgttttaaggactagctggtgtgtgcgcccatgcatatgtgacaacatgcctcagaacaaaacacaggtgcc

SEQ ID NO: 6021 - DNA, 201 bp, Bos taurus
cagggcctgggtgtaggggtgaggggacaggagagaagactggttcccacggtgcctccaaaacaaaagtgcaagtaattttttttctgtaggaaaagatcaaagtacacacatggcccctacctactcacaggaatacagtacaggtggagagcacattctcccagcatgcccacgaggacactaaaaggtcctcttctc

SEQ ID NO: 6022 - DNA, 201 bp, Bos taurus
atgagatttgaggtcctatgggagggagacagacagtggagtggccctctaaagagggtaggagctgggggtaggagagagtcactttcacaggccacatcggcattccagacagccccaaatttgtcattcagtgcccatgtgatactgtccaccatgcattcacacaccacaaacacacagccacatagggggcaccca

SEQ ID NO: 6023 - DNA, 201 bp, Bos taurus
gcttgtcctgcagtttgagggccagtggcaggcgtgaattttctaaggcagacttcagcaggcagaaactgatatgtcccttctttcaaatgggatgacaatgaaaattcatctcttggccttccaggaaacacatatgttaatccagggtcaatagattgactacttttgactgaaattcaaacagcctttgtgattttt

SEQ ID NO: 6024 - DNA, 201 bp, Bos taurus
ccatgccatcgttcacacacaccaccattattatggtcctcgttgtgaaaagcatcattatggtcctcatcgtgatggccgctcataggtttctcaaggagtcagtatcagatgctttaagatggatttagaaatgtatcaaaggaaaaattggtaacactcttctttcccctgccagagaccgcccaggcccagaactct

SEQ ID NO: 6025 - DNA, 201 bp, Bos taurus
tgtgaaaaacagaatctcaaatgttcttgatttttatgaagatttaaatgaaactacaaaaaacataaaacaaaagcttgttgatatattattcaactgccacctagaccttgcttatgtatctgcctattgggagcagtccaaatgtaaattttgacaggttcagtcaatacatttgttttaaaccacagacaatgaaaa

SEQ ID NO: 6026 - DNA, 201 bp, Bos taurus
aaaagcaggtgaaaggaatgtggtggcccagggtgaagaatggaagaagaataattttgactgaatgaatgaattcctgttggtgtgttggtagtgggccgagaaatcagtgtgtgtgctcatatggaggcagtgagcatacgtgagttttctttcaagaaatgccatatagaaagccatggtaaagaatggtcttctgga

SEQ ID NO: 6027 - DNA, 201 bp, Bos taurus
gtttgtcatatcttttcctgcatttctctaataattagcaaattgagcatcctcagagtttggtatggggggttctctaaccccacatggaccaagggatagctgtactctttcattaaatatgtaggaagagtcagatcttgattttaaaaggttaatggacttttttctcattattatgtaattattaaaagaaagctt

SEQ ID NO: 6028 - DNA, 201 bp, Bos taurus
aagactgtagagaatacataaaaacataagaaaacaaaggtatcggtaatcttcccacacagcaatgaacttcatgtatgtaactgtgtgattaatagccgtcacagtgtacatattgctttgtagcctcccccttttcacatcacattgtacagagttttcatgtgaattcaaggtctatattatgtacagggtgctttg

SEQ ID NO: 6029 - DNA, 201 bp, Bos taurus
gcagctggtattgcgcaagcgcatttgtgttaacgttcacggccggcaggtgggtcactgacgctcattgaagaggtgactttgagtctgacgtaagggcggggcagtggaaggatcgctctggcctctgaccccacagtctctgtggccctctgagcttttctcctccaggcgactgtggctgtcccgtgcccatgcttg

SEQ ID NO: 6030 - DNA, 201 bp, Bos taurus
catgtaataacttagtgacttgccccaaagttgccatagttaaatgtaaagaagttgaaaacaaatctctgaatttcctatccatagttgctatcttggtcagacacatggcctctgatactagatatgaaaaagatattctctttacctagtgcactcaattcaccagcaacataacaagacggaaatgaggtgcaaatt

SEQ ID NO: 6031 - DNA, 201 bp, Bos taurus
gccaaagatacactatatgaacatagaatggtggactctccctccattgtgcatctctatactgttttcttattctgtctacaaatatttattaattttatttttatcttttccctttaaacacaacaaactttactggttgctttatgaacactgtaattaagttaaacaaaacataagtgcaaaaagaagttaatttca

SEQ ID NO: 6032 - DNA, 201 bp, Bos taurus
tactgggccgcatagaaggtggactgggccaccatggcccggccggtgctgacgttgtacagtaagttctgggtgtccgacttccgagacaggctgatgatgacgtggttgtggccgtccgtccgccagtgcgggagggacaacagctgcttctccaggtcggcgggccgcagcacggcgggctcctgcatctcccctact

SEQ ID NO: 6033 - DNA, 201 bp, Bos taurus
ctggactacgagggacaggccctccccacttttctttgtctttctcctttgtcttctctctcacagtttctgctgtgtgaaaaatggttgcatccagagcagatatattttctttccctgcacggcctccataaatcttgtgtctgtgcatgactccttctcagtgctgggtttttgattccacgcccccaggtagaatac

SEQ ID NO: 6034 - DNA, 201 bp, Bos taurus
ctggagaattccatgggcagagaagcctggtggcctaaagtccacagggctgcaaaaagttggacacgactgagcaactacagggaatgatttatgaaaaaatgtaaagggataaattattatgaagttagaaaagatgaagcagtcttttcccttccttcctgagaagtcctgtattaacatggcccatactggtttgcc

SEQ ID NO: 6035 - DNA, 201 bp, Bos taurus
agcccagaaaggcaggagatgatcactttcagggcttctcaggttgctctgctttctctgttactctgcaaatctatgaaattatcttctgggcctggtacccagtgttacctagcactctagtttttccaggactcaggaggacatagttgggggctttaaactcattgatggacatgggggaaaaaaaaaaaggaagga

SEQ ID NO: 6036 - DNA, 201 bp, Bos taurus
atgatcttagatttcctggagccctctgccccccacaggctcactggactttgtcaatgtctgctgaatctgtgtcatggctgtggggtgggcttggccctcctctgtctcggcaggagtggaaggaggagctgaagaacctgacaactctcctgcacaggacggaggggccgggtggagaagaggaggatgcgtgggaca

SEQ ID NO: 6037 - DNA, 201 bp, Bos taurus
tgccagtgaagctctatacatgacaaccattggttccagcccttaccagggggcaaaggttcagtgggtctgaggacagtcatctttgctcagacccaatgaacttccttcagtggcccagtctctactgcttcctgtgcagaggccagagcgggggtgctttgagcctggaggcctcagagatggttccagttcaattcc

SEQ ID NO: 6038 - DNA, 201 bp, Bos taurus
gctaaggggacttcttccagcctaccaacccacacaagcagatcgatgccaggtatattccaacagcacaaggatgggccaagtcagcacagttcttcttttctgaggtccaagaggttaaagcaagggaaggagggtgatgcagctgcccggggtttgtcactgatgagtacaaagtaggagaactccctagaggcccca

SEQ ID NO: 6039 - DNA, 201 bp, Bos taurus
tctccaacaatactcaactgcttgaaacacctgaatttcaaatccctgcaaggcagcagctgggcctggtttactcactctgagaggccctggttcccataatagcatctccagttcagggaggcatcagtctcagtgatcaaagtgggggctcccatggtggtccacctggcaatgtgggggacataggttccatccctg

SEQ ID NO: 6040 - DNA, 201 bp, Bos taurus
ggcttggccagtaaaaaggccacaggggtcagagatgaggtgagtcttctgaggatctcctgttagtgaagcctttggtcactgggatccagccttctactggccatctgctgctgctcaagcattcccaggaggaatcagatctccaaccccctcagtgtgattatgttaacaaaccagacttggttcccttcacccact

SEQ ID NO: 6041 - DNA, 201 bp, Bos taurus
gttattttcattttaatgtgtacaggatctgtagtgatgtcctctatttcatgttgatgaattgggacctctctgtaatttttctcagagtacatgcagagtacaacatgagaaatactgggctggatgaagcacaagctggaatcaagattgccaggagaaatatcaataacctcaaacattcagatgacaccacactta

SEQ ID NO: 6042 - DNA, 201 bp, Bos taurus
aacaacaactccaccagacagtggagtattatttgaagggttaagcatttcggcaagacctagagatggtgaaattcctccatttatgagacagatttcagtaagaaggccaactactacagatgagagatctttgcggaaaattcaagaacaggatatcattaattttaggcgaactctctatcgtgctggtgctcgagt

SEQ ID NO: 6043 - DNA, 201 bp, Bos taurus
tccgcctccgcgctggacgctcgcctcggcagatttctcgcgcttcacggctgtatttaggaagagcggagccgagctcagcggagcccagcagagcgcaggcgaagcagggggtcgcggggagcggagccgcaggcatgacggcagagcagcggcggaatttgcacgccttccgcgactatgtcaggaagatcctggacc

SEQ ID NO: 6044 - DNA, 201 bp, Bos taurus
atcccagagccagtggccatatcccccagcacacggactggcccagagtgaggccatcacaaatggaaatgaattggagggacctgagtctgagtcgctagatccaatcacccctgtggcaatggccacctcggttcttgagccaattttttttgtttgaattatgcttctaacactgtaaccaagagtcctgtctaatat

SEQ ID NO: 6045 - DNA, 201 bp, Bos taurus
cttggaccccaaggccctgcatcatctggctcttacctacctttccagactcaccttggaatgtcctacctctggcatcttttctgctcatctagcaagcgggctttttcgcatctcagggcctttgcacttgttctctctgtccgggatctcttcctctaggtctatgcatggctgtctcctttgtgttcttccttagct

SEQ ID NO: 6046 - DNA, 201 bp, Bos taurus
cgtcttttttttggtccttgaactaggacattagaaggacagtatctaacagttcctttgcccattcaattaaagacagaggaattagacaaaggaattagagaccaaaacaccaacccattactaataggtgtttggaaaatacgacttagttgtatgagaaccgtgatctttttaatgccgcatcccagaagtagatag

SEQ ID NO: 6047 - DNA, 201 bp, Bos taurus
agttttcaacgtttagctatgctgtaacatgtatcagtgtgtcttccttttttgttgctaattaatattttttataagaacaaatgcattttgtttatccgttaatcaattgagggtcatttattttctccccattcactatctattatgaatagtcattctgtggacatttgcatgaagctttttgtgtcactatttttc

SEQ ID NO: 6048 - DNA, 201 bp, Bos taurus
ttgctgtggctgagtttaagattttgtgtgtgtgtgtttggttttcagtactttagctatcattattcattatgtgtttaatttttatcttaattcttctctggggctctctgaatttactagatctataattcgttttcttccagttatattcaaaattcccagtcatctcctcaaatttttttctgcttcatttggtat

SEQ ID NO: 6049 - DNA, 201 bp, Bos taurus
tccaaagatcatagtgtcagtgccaacatgaatatccatgcactcaggtaaataggaaatgtgcagtttttttttttttccttctaggtcagaatgtcctatgtaattgatggtgaattgaaataggttgctgattttcaaaacagcttagatacaagcttcccgtttattatggtaatgagattgagacgttgtgaaact

SEQ ID NO: 6050 - DNA, 201 bp, Bos taurus
ttgagtatagaatatcattataaactgattagaacaaaagttgcttagagaactttgagtattctaacaaaaatcaagtgaatgaaataatgggcgaatcagtatgggaaaatgcaaatggcatgtgagaaaaagatattttgaaacagtaatgagattcattttgcctactaagttaatgaatatatagattatactatt

SEQ ID NO: 6051 - DNA, 201 bp, Bos taurus
atataatacctggaaattctagagtttcctgtctactagtcagaggacaaaatcaggacatggagggaagagccaagagaagctgagctataacctccacattccatatcatgattccatgttgcacctagacttcctcttacatgaaataaaagtaagactgttcacactaaagttttcatttcaggagattttaaattc

SEQ ID NO: 6052 - DNA, 201 bp, Bos taurus
agtgggtagcctttctcttctccaggggatgttcccaacccagggattgaacccagccctcctccattgcaggtggattctttaccagctgagccacaagggaagaccttagatctaattattacctgattatcgtgttatgcctagcttaagacacagcagtggtaaggaacagagaatttggagctcaacagactttgg

SEQ ID NO: 6053 - DNA, 201 bp, Bos taurus
atcttatatatcatgcttcttgggggaaaagtgtcagtgaaaagagattctataatgatggtgtctgggattggcacgtaggcttaccgactagtgaggcataaaatgtagtaaatgataagaaatgtgtcccatgatcgtcatcatcatcatcacgcagattcatggctgaaccctcaggcgtaaccataggacaggtta

SEQ ID NO: 6054 - DNA, 201 bp, Bos taurus
aaaatacctgtatagccattgtaatatcaccccattgttatttacagttaattcgaaaagacgagtcaacgtatcctagtctctatgcatagagtaagatgtcattttaaggctggcatattattttcgttcacttgatgaatgtttactgtcatggctaaataagagatgagctacactctgctagttttggcagtgtct

SEQ ID NO: 6055 - DNA, 201 bp, Bos taurus
gctttgaaaattgctttgagttaatacagttgaccaaattattttgttgggctggacaaagagatgaatcagagtaaatgacagttcaggctagagcatgtttatattcataggactgatggatttgcatcttggaggtgtggtctctgtgagatttagaaatttgaatttttacaaagagttcttaaagcagaggagatt

SEQ ID NO: 6056 - DNA, 201 bp, Bos taurus
gataaatgcagagatgtaatttagaaacttatcagaagtcagctaaagatgaatctgcctttgaaagtaatggcagacaggcccattataaattttagaatagaaaaatgaaatgatgcaaaaagacttagtttttggaaaattaagttttactaaaacatatcatttaatatggtctaactggccttagaaattcaattt

SEQ ID NO: 6057 - DNA, 201 bp, Bos taurus
tgcatgcagtaaagactctccaggggattttagaaagacagaacatgatttgtatttactagtttaaaattttaacctggaaattgtttccttactatacgttataggaatgatcttagaaatgcaactagtctgaaacactaaatctttaaaacatcaccaggattatgggagacgatggagaggacaaacatcagaatc

SEQ ID NO: 6058 - DNA, 201 bp, Bos taurus
tatcaaaaattaaagttatattaaataagaagagtgatgaagattgcacacatatggaacattaaaatacattttttttaatatttgaagaaaaagggtggatctttaaaggaaatttctcaatttattcaattcaaggaagaatattttttccaaaatagatgtatttatttgaaagtaaaagagaaatagatgttataa

SEQ ID NO: 6059 - DNA, 201 bp, Bos taurus
ttatttacttatttggctttgctggatcttggttgtggcatgtgggatctggtttgctgaccaggcatcgaatgttgctcctttgcactggcagcatggactcttagccactggactaccagggaagtgaagtccctcttaactgattttattcattccctcacttgtcaaataagttttgaactcctattatgttttaag

SEQ ID NO: 6060 - DNA, 201 bp, Bos taurus
tgccttctccgaccactagtgctacttccccataatttctggccttacctgcagcttcagtgacagccagatatggcctgaagtataaggaagattttaacaggtcagaacactgtctccttagagatcagctttatgtctgtcttctgctctgtggtggccttgagtcatcctctctgatttctgggattccagattcat

SEQ ID NO: 6061 - DNA, 201 bp, Bos taurus
atattccaacatttttgtttttaaggaatcaaacgaaatttgaagagcattttacctgaagttaatattcatgtatctggtacagagaattttgttttccgcatggaaaaattcacgcctcagtttgtatattctttaagtgttagccttatgagagaggtggtcattgaaatccatccctgaaggtcttataaacaaact

SEQ ID NO: 6062 - DNA, 201 bp, Bos taurus
ctaggataagttagtttgccgacattctggagacactagagcataagcaggatgctggagagaatgttccattctattggttggtcaagtagacaatgccattccatcccctctgagacatggaggctgcagagacccgttccctggaggatggccaggcccacaagccctgaagctagaggtgtactttcctgttctatt

SEQ ID NO: 6063 - DNA, 201 bp, Bos taurus
tcaactcttccaccatcttggacctagctggttctaaccagtttgtcatgtcctatggccatgtcagtcttttacaggttgtgccctgtccccttccctcttgtttaaaaagcatatgcagtccagcaaaagactccaggggccaagtgtagctaggaaagagcaggggctgccagtccaaagagcaacgaggacagatga

SEQ ID NO: 6064 - DNA, 201 bp, Bos taurus
taaaaacaaatttctcccattaaagagatggagaaactgatttgcaaaataagccgctggcctggactacacgtgtggccacatgtctgtaagtgcacacatgtgtgcctgcacatatgaacatttgagtggatacatacgcttgccacccacaagagaaactgccttcattctgttagagctgcgagttacccagtctgt

SEQ ID NO: 6065 - DNA, 201 bp, Bos taurus
cattttatgaaacgaagtaagctgactcagagagactagacacagctaacgtcagtctttcagacttcaaagcccattctcttgattactatgaaccttgtctctctgtacttcatctttcagataattctggcttctctctgttgcctagaagagcttggaagtgagattcatgagtagccacacccaaattcctcagat

SEQ ID NO: 6066 - DNA, 201 bp, Bos taurus
ttctggggcaaaggggctgccccaagctgttcacctggccctagggtgatgagagaaaaggaattttagccctaagtgtgagcagccatagaggaggtggtttggggagtgggccctggattggttagtttgtattgactggtgagtaaacagctcaaggatgagttggttactatctctagaaattggtgagtcctgatc

SEQ ID NO: 6067 - DNA, 201 bp, Bos taurus
tttattaaaatgaaaattcagtttgtttcatgtttatttaccctatcaacataatactttgtgtccactgaaagaatgagattgctaagaaactataaacatcctcaattacaggccaactgaggaagaaaagtctctgtatgttttcatcagacacacgatagaggtctaattatgtgatgacaagctgtgtcctgtgct

SEQ ID NO: 6068 - DNA, 201 bp, Bos taurus
caccctcctgttcctagggctccatggatattacccatgaaatgattcaactaccaaacacagaagaagcatttgtcatgagaggagtggatagtgggagcatttttttttaatagtaaatcattagattcagcaactactaaaccatggaaattaaagacaactcatccaaaaggcaagcctcgtttcacacttccagga

SEQ ID NO: 6069 - DNA, 201 bp, Bos taurus
caagccagcccaagctgccagaggccatataatcacttagaagacaaagagaggactttataaatgagtggtttggaggattttcagatctctcctctgagcccttctgctggtgggaaatggccgatgctaagctagttcatcaagtcaacccgaaaccttccatagccactctggtggcaaagaccccaaatattctcc

SEQ ID NO: 6070 - DNA, 201 bp, Bos taurus
aggctttttatcctccagttatacgaagaggcaatcatatatcatgttatttagatggtccatctttcccacatgatatttttctggccttcattcttggcctcctagtgaactcaaggtcagaataaaaatgatagctgtcatgacttggtaaaacttgttatcagcagaaaaataggaactttaaaaggtagtgctgta

SEQ ID NO: 6071 - DNA, 201 bp, Bos taurus
gtgtctggagttaagcagcctacctgaaacgtgctcttcaggccgcaggatgaaactgggttttggactgcacctggctgcagacctctcgccactgaagggtgctttcttccacttaatggggccccatagtggtgaatagattcccggggtacgaggaatccctttcccatttgactttcagatctctgctttgagggt

SEQ ID NO: 6072 - DNA, 201 bp, Bos taurus
atttgtgtcttgcccctagatgtgggcctgttctgtgatgagattctttgaggaccagtcaaatataatcatttctcatcttgaaagctccaatattaagggtggccctgaaaaattcatcaggggaataaagttttacttgtcacttctgcttccctgcaggcttttgggtaaataatggtgaatgtataggagctctga

SEQ ID NO: 6073 - DNA, 201 bp, Bos taurus
ctcctcccctggcatgcgaaggcttgcatggattcagtttttgagccttcctctctcctgccggcctcagcccatcacccaggtgggcgcacggcctccctctctccctcgacctgaatcttgagtggagatatctcatgatgcaaacagcctgcggctcatttgtcctgatagcggagccctgaggacatggcccgtttg

SEQ ID NO: 6074 - DNA, 201 bp, Bos taurus
ttgtttttattcattttattatcctcagtgggtcttttcaacctgaaaattctatgttttagttttaagaaagtctcatgctacttctttatctccattttctgtgatctttctttcaaggcctttaattactctgatattggcattcctgcatagacattcttatgtttacccataatctattaccttttttgtctccta

SEQ ID NO: 6075 - DNA, 201 bp, Bos taurus
attcccaacaagtttataagaatagtcttttgtttacttgggataatatggtgcactatattaatatttaagttccttgaatgctgtgaactcctcaaacatatctgaatgaatgactgaacctttgtaaattaagggacacttgtacgaataaagtgattttatggttttaactaaggtcaggtctaagtaggtcttgaa

SEQ ID NO: 6076 - DNA, 201 bp, Bos taurus
gacatcccaagaaggctatatgttattgataaggtatcagctatgagaaaaggagtacattcagctcttatatcagctcctatattagccttgactcctatttacttattcattcaatgcacaatcattgagcccctgttcttggctagacactaaatcttaatttattttcacttaataacatgtgaagttcaagagtag

SEQ ID NO: 6077 - DNA, 201 bp, Bos taurus
aaattaatggactattacacatatgacgcaggtaactaagtagaaaattttgaagaaaattatataagaaaaatattcatggactgggataatcaacaatgtaaagatgccagtctcttcaaattgatgcaaaaacttaatgtaattcctatcaaaacacccataagttttctgtagacagacatgctaattctgaaacat

SEQ ID NO: 6078 - DNA, 201 bp, Bos taurus
tgtagtgtttgtcatatgtttatttgtatttaactccttaataaactacttagttgacaattcaatgtatagattttgtttcttcctcaaccaagtttatcgttcttcatatcaagttgtctactaatgaatatcagttttaagaaccaaaggtacgtctgttctgtgttaattatcaacttcaatgcatatgaataaata

SEQ ID NO: 6079 - DNA, 201 bp, Bos taurus
ctgagagctacttctctgcctttatccataaaagaaataagcatacaatctattctttgaagagagtctctcaacataaatatccaaaaatttcagggccgttttattatttatgggatcgacgtattacaaaatatttctggtgtaaaattcaacttatgttgactttaccttgggaacattttattttgttttagtacg

SEQ ID NO: 6080 - DNA, 201 bp, Bos taurus
ggtagggatcgtagtctctagttttggggccaaattttgattttcccagtgttgggtagtgtagagggatataagagctataagcattctcttagatgctatggcccatttactttaagtgactgggcctgaggatgtatagagaatagagcaaaaatgcagagcaagccagtgagcctgggccttaaatgctgcataggc

SEQ ID NO: 6081 - DNA, 201 bp, Bos taurus
taaatgaagaaagggttcaaaaatggaaaaaaaaaaaaaacatataaataatccattaacaaagccagagaaagcagcttttaaaggagtatggccaatgtctcagtctaattttgcagcagttaagatagcagtaagatagaagcagttaagattgaagagctttagagccacttgggctgtaagcatcatggcctgaat

SEQ ID NO: 6082 - DNA, 201 bp, Bos taurus
gaaagtagcatcagtcaatcccaaagtgatatcccagagcatcacacaattagaaccttgagttccagggttgcccttgggggccatactgccagtcagttggtactggggctgcacagaagagacacagtttcccaggtagcagttcccatctggcccagggcagttctccaaataagtgggcagctgtgaattcttgcc

SEQ ID NO: 6083 - DNA, 201 bp, Bos taurus
tagtcttcccaagatcctgctacagaacgtattccatccctggcttaggaaaagaagcctggtaaatgtataccattcatttttcaacaaaatatgtattatgtatctactagctaccaggtacttataggcaccgtgatagaaaagggaataacagaaaaattcacattctcatggtgcttccattataaaggacagacc

SEQ ID NO: 6084 - DNA, 201 bp, Bos taurus
aagacttttttcactaactgtaatcgatatggcttcctaaagagaataataagacacttaggtcacactatgtgcaaagttactcgtctactctctgaagaggttctggttttcatttagaaaataattggatgaccataaaagcaatatatcatcaagaaaaattctaccagtaaccaggtggttaattaacagcaaatc

SEQ ID NO: 6085 - DNA, 201 bp, Bos taurus
aaataaaagcccagcaagaggtaagtggaagggggcctgcagatacatacatgtagagcaggcagttgcctgagtcttccacctcggtggaataattcagggagaatctgggaaggccatggttgagtgaggacacgaaactcagcttaggttccaaaggtcgcatttggaaagggggttggagtggagtcggaggccagg

SEQ ID NO: 6086 - DNA, 201 bp, Bos taurus
gatggcaagtaagacagtcgtggtttctgccaccaagaagcttacattctgctagcataaacaaacaataaacagggtaaataaattagataattaactagatagtaaactaacaagtgctgtgaagaaaggcaaatgttatagagtattatcaggctacctgatttaggtttagggaatagacaagggatatcaaaatgt

SEQ ID NO: 6087 - DNA, 201 bp, Bos taurus
tgattattagctatttttactgctttcgtttatagaacatctataattctattttctgtttccttcttaaatggatgttcatagatcctggattcttttatgtttatctgtgtttatattgccttttttagacaagcaacaattcagtggcatgtcataatggctttgaatgatttctttggtactaagcaacctcttttg

SEQ ID NO: 6088 - DNA, 201 bp, Bos taurus
cttctcaattcttagaacctataacattcctgtatacatcaagcatctctgagaccagactctgctgtgcagcatttcccaaacttgacagtgacttttttcccccagaaacatttaaccagattattgttctgccaaaaatcggttacagaattagcatagcaattttcctggtccacgtaggttgatttctcagccgtg

SEQ ID NO: 6089 - DNA, 201 bp, Bos taurus
actaagtgttttgctaatggcttacctttcttgaaattattgctaaacatgaacttaagcttgaaaaagttgtgaataaattcccagttcaaaactttcttaattttacctatatatcagcttcctaatataaactatactgattctttcttatactactaacaaatcttttgtgacatacagaaagatggcaccaataga

SEQ ID NO: 6090 - DNA, 201 bp, Bos taurus
gctgcgattcatggggtcgcaaagagtcggacacgactgagcgactgatctgatctgaacattaaattatatgcataatgataagctggaattctagtaaagaaaataccaggccttgtagcctcttactctatctgctttttaatctgatattatctgaatccttcagctatacagccactcactcaaaagcactctcat

SEQ ID NO: 6091 - DNA, 201 bp, Bos taurus
agaccaaagttagagaagatacagaatatattctcttgcctcattcagtatgacatgccaacagataaatgtatgcaatattagttctacggttggcataagcatcagttcagttattttatggtgaaattctcctgtaactcttagattcattttaatccattttttgaggtgtaagacactgtgagccataaaggcttc

SEQ ID NO: 6092 - DNA, 201 bp, Bos taurus
gcacacgtagtaggcaaaaggttgatgaagatcccagctctgaggaagatatgaattgaaagttacttctaatcacttcaaaatctagaaccatttagatatgattcaatcatattagatttcaaagatgagattaaaaattgtatttgagatcacaggtttccaaaaaacatagaaagacaccaaagaacaataatccca

SEQ ID NO: 6093 - DNA, 201 bp, Bos taurus
tttgtcctacagcacattcatttcacttctaattgataagtctccttgttggtcagagttcaattcttcctagagcccagaataacttctctacctgatgcagtctttggtcactatttatgctctctgttgtcaaagtcacaatgtacttgcttccatttaccacatttgttctctcttctcttcagtttccatgctgag

SEQ ID NO: 6094 - DNA, 201 bp, Bos taurus
gtccatgtctgtttccttgctacagccagagggtttcttagttgtaacagagacaggagatggccatcaaagcctataacatttattatccggccttttagaagaaaaaatattatctataatctgataactcagatataatcacagttacatctttacataatgatttctctctttaggcccttacggaaggaaaacaca

SEQ ID NO: 6095 - DNA, 201 bp, Bos taurus
cggcctgggatttccccgtataacggacgaaacgtcggggtcatccggtcgtggaggcaaaaaaaaaaggtactgccggactgaggcgtttctagcgtcagtggggagcgcgcagggtgcggcgaaccgagagccccaggctcgcggagagcagagcaccctgggttcggccgcgtctcccaggtgcctgcatggccctgg

SEQ ID NO: 6096 - DNA, 201 bp, Bos taurus
tgaacaaagaatgaagacaagttggagacagtgaaaatatataactcttcaagaggtcatatttcaatgaaagtcaaagcattaagacaatcagtaaacagaattgtggtcaagaagtatttttttttaatgggagaaagaatagcatatttgtgcactgaggtgcaatgatccagtaatgagagatggtttgatttttag

SEQ ID NO: 6097 - DNA, 201 bp, Bos taurus
aagcctgacctcagtggcccattatcctcaaataccagctggatcttgatgtttttttctgcttcaaaaccctcactgacctcccatctgaaatccttacatagtctacacggccctgcctccctcttccccctcctcacctctccagcatggccctctttcccatcacacttaagccaggcttcctggatgtcaagtatt

SEQ ID NO: 6098 - DNA, 201 bp, Bos taurus
aagaaaactagctgaaacccagttttatctccaaacgaatagatgcaaagatataatgtctgaaatatccctttgcttaagaaaactagctgaaacccagatttatttccaaacgaatagatgcaaagatataatgtctgaaaaaactggttcctcaggatgtttaatggtatcacagagcttatcgctgtggaagaggag

SEQ ID NO: 6099 - DNA, 201 bp, Bos taurus
agtgttattaattgcataataaaaaagcaggtagtaaatctccccaggctttaattgctctgtgtgaacttatctgtaggcaataaaggctgattctcacggctgagatctgggagccaaggcagctgaagagattggtgtagctacactgaccccgacctcctctctcctccaggtggaaatggcaccacaggtagctca

SEQ ID NO: 6100 - DNA, 201 bp, Bos taurus
aatacaattattctggaattagagtctcctcacccatgttccccaagaagaaccaggattctggtggggatattggcccagtctgtggaggaaaataggtgtccaggatgaaaatggtggaaagaaagggcgatgtctgtaatagtcctgacttgatggttccctaaaacacaactacagggcctgaaggaatatgttcca

SEQ ID NO: 6101 - DNA, 201 bp, Bos taurus
tttatgacatggttaggacatgtttgctaagtaaatgtttgttcactaaaagaccgtgtttctcaggaggaggtggccttgacagtctcctattgcacactctgatttcccttctcactgaggcttactacctcatcacgtgcttacatgtcccttgctcacttacaaagagagaagttgcttaacctcattaatgatcaa

SEQ ID NO: 6102 - DNA, 201 bp, Bos taurus
ttaaggtcaagcctgaatttcagcctctaactgaggccaaaatgagtaaaggcaaccaggtgaaaagacctgtagatctccagtatcaactcactatttgtgtacttggttttcaggcccattctcctagtcagtctttgttttccaagtactgtaagactggagaccactgcctttcagaagcatcagcctagctcttta

SEQ ID NO: 6103 - DNA, 201 bp, Bos taurus
gacagcagacttgcggtttcgtttctggtagtcgctgcttggttatctttacttcacttggccaacacagaacattgagcttcttggtgctagtctgatatatccacctgttgagtagtcctacacgtcatcctgttgatttaatctggcgagaactggcaccaggaattgttacttttattgtttttatttttgcctaat

SEQ ID NO: 6104 - DNA, 201 bp, Bos taurus
atgtcgtatatcacttttcacattctattagtaagagctgttcatacaaccactctactacaaaggaagccaggaaatattgtgaagcacagaacggggaggagcagattttggtggaaatctgggaatctttgccacattctgcatggtattctccagctagtttgtaaattcgctgaagtcagggccttccatgctgtt

SEQ ID NO: 6105 - DNA, 201 bp, Bos taurus
tgtctgatactgatttgtgttgtataagttgaccttatcttattttaaactctttgccaatcttttagaaaaattgtctttggcattttttgatcccagcgaggtggaatagcctctcatatatttactagctgctcttttctttggaggattgccaactagtgtgctttccccatttctctcattaatcatcaagaccac

SEQ ID NO: 6106 - DNA, 201 bp, Bos taurus
ggaacctacaaccttaggactaaacacatagggtaaaaggacttaagttgtcacaaaagtatggtattggatgagttagttaaatgtcaatagatgcagggcaggatggtgacaaaaagtgttacccatttactcctgatttctgtgtatttccccgtcaattgggaagaatatgacctttggaactgtataaagcctggt

SEQ ID NO: 6107 - DNA, 201 bp, Bos taurus
attattagtagtagtagtatatagtattccatagtatagtattcccttgtatgaatatattcagtttgggtctgtcatgaaaatttatgttcttctggtgagcatatgtacacatttcttttaaccagcttttaagagtctttcaagataacctgcttgtatttcctttatgtgtctgaggtttcatgggctcaaaacaca

SEQ ID NO: 6108 - DNA, 201 bp, Bos taurus
acagctaactgctaccctgtttttttcctgcaggtagagaccacagcccacatcagaaacggaaaatgcagatacttgctttcctacctttcttgatggaggtggtcatttaccaagtggtgaccattgaatatacagaggagtttgttggggaatttctgtgaaatacgtttctctctgataaagatggagagacatatg

SEQ ID NO: 6109 - DNA, 201 bp, Bos taurus
agtctgaaagagaaagccagaaataactgaaaggagtctacatttccaaactcaacagtctgccatcaagaatctaaagactttttttttttttttttttaatgatgcccaggggccctggaaatggcagtcagaacataattcggaactaagtaaagctctcaccagcaaatgttacaaaggagagagaactaaagatta

SEQ ID NO: 6110 - DNA, 201 bp, Bos taurus
acagttttaatagttactgtgactctggccacgtaagacacaaccggttaaatcagtttcatgagttccattgacttaactggggttgaaaactacatactaagccagccaatggccaagtcacattgaaaaacgtgttcctcatcacacttgccccacatattttctcatagtggccatatagctagaatgcaccagtat

SEQ ID NO: 6111 - DNA, 201 bp, Bos taurus
attgaatgcgtgctgtgggtttgccattatgtgagatgcaggtggtaccctgtggtgtggcagataggcagatattaccaagaactcctgctccctcttccagtgttgacgtgttccctaggaagcggctgcctagttaggagttatacttcccagagccccttgtatcttagatggtgtcatgtgactagttcttataat

SEQ ID NO: 6112 - DNA, 201 bp, Bos taurus
aggtttgaaaaaatttcaaaattacattttaattatgtgtacatagttaccagtcatttataagtgtgttatttggtggtccttgcttttggatatgggacaaggcagtgaacttctcattctttacccttttctttggacagaaggtagtaatcatgtactcaagctcttgcaaaagtcccacgtttgactttatactca

SEQ ID NO: 6113 - DNA, 201 bp, Bos taurus
atcaaccagaaaaactaagaagttttaatttctccatttctcaaataaattcaagtcactattctggagcataaatgattttagaaagcttttaacaaacatatttttagaagtgcatatggcttgaggtttgattaatagaataaatatttgtaggttttccaagttaataagaaatattttctttcttgttagcctctc

SEQ ID NO: 6114 - DNA, 201 bp, Bos taurus
ccaaaagtggaactgagaaggtcaatgttggaaggagaaatctgtgtccatgccctttttaagaaaggaagaaattaggggccaaaaagcactagttcttggttgcagatccgttgagactgaagatcttttccttgacttatcaatcaagatggcggacaagaattcagaggtacgttaaagtcaggtgatgaccttgct

SEQ ID NO: 6115 - DNA, 201 bp, Bos taurus
taaaatgacttaggccaaaaatggcttctcttatgtcaagaaagtcatgtctgattttctttctctggggacccactaccctacctgttaacaaaactagtcatctgtgggcctctagaatttgtaggcacagggcttcccatgggcatgctaggtgggaattaggctgagaaccaccaccttaattgttaaatgggcatg

SEQ ID NO: 6116 - DNA, 201 bp, Bos taurus
cacagagggttctcagtgcctccacggactctccccaaactgaagacagggggtccacagcttcccctgagagaggcagctgagtgagggcgtggaaaggtccgcagtgcagaccgccctgcctcacggtgtgtttcgttactaaagttggtaagcttctgttaccacagcattgccccattttcttctctcttgctccca

SEQ ID NO: 6117 - DNA, 201 bp, Bos taurus
gttccatttccttccttactacttctcttcctttctgtgtttacacctccttttggaaaatgcctctttccctaaacacacttgaaaaactcattttctcggtgagttaggggaaattttattgggctggccaaaaagttcccttgggtttttctctaagacgttttgggaaaacccaagcaaactctttgaccaacccaa

SEQ ID NO: 6118 - DNA, 201 bp, Bos taurus
cttttctaggtatacatgtatgagaagatacaaggatctgggttcattaaaattatttcttaggaatgcatcttaactatctagggccaggatccaaagcacagaatacttcctgtttttctgtatcttgaattccccacgggacacactgtccttggtggttggctacagtggccaatggcttgatccttgtagaactcg

SEQ ID NO: 6119 - DNA, 201 bp, Bos taurus
aggaaaggtagtctgtccagcaccagctctacagaagtactggtgctgaggccatttttgaggccaaaaatgaggccatttttatccttaccatcttcatctttcaagatctccaccctctcttgagagcagggatgggggaagttgggagggccgtgggttaattgacaaagttgctacctgtaagggtggtctgaatgg

SEQ ID NO: 6120 - DNA, 201 bp, Bos taurus
tacagcagctgaatcatgacactgtctttgtgtcaacatcctggtcaatcacccgagctgagcatacctgccaatcatgctgatggcttatttagtaaacatttatggagtgctgtgtgcaaggcactgggttggaaagttgactcaaagcagcggttcattccaaagaatcgcttgaattgtgtcatctacaaatcataa

SEQ ID NO: 6121 - DNA, 201 bp, Bos taurus
gaaggcagagcagacagtaatggggtcctcaaagaggtagggacacaacaccaggcacagagatagaaagtggcggccagcaacagagtgcagtgggatcattagtagctccctgtggtggtggcagtggtggtgatgatggtggtagactggccttgaaggaaggggaacattttgaaaaagtggaggtggcaggaaaga

SEQ ID NO: 6122 - DNA, 201 bp, Bos taurus
aacagatctgggcaagtcacatggtctccaagggcctgagctggctcatccataaagtgagtaccgttcccttatctcatcatgctactggagaacaggatataaagaaagtacagggcctagccctgggcttcccagatggtgccaatggtaaaaacccgcctgccaatgcaggagacataagggatgtgagttcagatc

SEQ ID NO: 6123 - DNA, 201 bp, Bos taurus
ttagctgcctgtcacttatgtgagttacacatccggagtttattttcatgagttcttagccctaatgagcagaaggcaagagttcagacttgcatattctcccgcctcttctccccgcacagccaaacagctcagaaaaaggcagctgagcttgacgcactgattatacagaagatgtaaatggtctgagagaggtttcca

SEQ ID NO: 6124 - DNA, 201 bp, Bos taurus
aagtaggacacgaccgagctactgaacaacaacaaatcaaagagcagtcacaacatcctacaagaaaagtggactgatttttaatgggccaaaaaaattcctgagccagactaaaggttagcggctggactgggctggaagaaggctgagtatgatcaattctggccatccttttcaaactctagacttgtgggtttggga

SEQ ID NO: 6125 - DNA, 201 bp, Bos taurus
acaattctagtattcattcattctaaatctcttaaagcaaacagtgtggtagttattctcatagagggctgtagtcagaatcgaggcctctgaatctaaaccagaattgtagacgaaaagtggctctctttagacaaatatttggagcccagataaaaagttcacagttcttcaggaagcctctagagggcgataaagtgc

SEQ ID NO: 6126 - DNA, 201 bp, Bos taurus
tgaggactggtgtgacccagttgtggttatattaagagaagagactgatgaaaggaagagaggaagcaatcagaaagaaggtccatttgactcgcttaacaggagacagcaatgtagcacttttacaagagagagtttgttgtaaacagagctgctaagtcgcttcagtcgtgtccgactctgtgcgaccccgtagacggc

SEQ ID NO: 6127 - DNA, 201 bp, Bos taurus
tcattataaaactcactgccagtaccactggcagcttctcactcttccagggagtacttgaaagtttatttgtggaaggggactaaagctggccaatttcgcgcaaaagcccatccatgcaggcagtggctaagctggagagagatttggcagtcagcaggggtggtacctgctctaggccctttgcctctgctgtgcctg

SEQ ID NO: 6128 - DNA, 201 bp, Bos taurus
gatgatctaccatctgatgatctcaaagtcaactgattagtaccccaacaggagtgatatcacactatactcacaggaggagacaccaggggactggaattctagggccaccttagaatcctgcctccacagttggattatgaggttatatgagcctggagctcagacattgttcagggctattacagtcatgggattaga

SEQ ID NO: 6129 - DNA, 201 bp, Bos taurus
tctctgagccacttgttaaaatcatcagtgaatgtggtgggtggtgagtgatagaaagggaacatggagagaggcagcagacatgggagccccaagtctcattgtgggagggttggttacaagagcacagaagaggaaacaggaggacgctgacctttcttctctcaagaagcagttctcagcagtgcctctcacccaggg

SEQ ID NO: 6130 - DNA, 201 bp, Bos taurus
gtgtacaggagtgcagtgaggcccgatgccagcatggagcctttctccgactcttcatggtacctcaccacaagcatcactctgcccaccaccctggaccagcccagagcactgccagaagcagcctctgcggagcctcgtctgcgcggagcaggctgaggtgaggatgttcacagcccgcccaccttctggaggctggac

SEQ ID NO: 6131 - DNA, 201 bp, Bos taurus
ccatatagttactcaaaaggcaacataaataagcaaactggaccttgcaggatttgggacaaacaggaaatggttcacctcattctccttggaagcaccacgccactaacattattaactctcataccaaaaccataccttccaacactttcatgacactaaattatttactaattggttttgtcaccttttaagtaagct

SEQ ID NO: 6132 - DNA, 201 bp, Bos taurus
agctcaaagccataaatgacagtctgtatatcaccccattcaaaatgggagaatttacaagcaaagagaaataacacaataatttaaaatgaattcttacaaaataagagttttttaaatggtgataaaaaagaaaaaaaagttataaacatatatgaaaaagaacaggggtttttgagagaagacaaaattttaaaaaag

SEQ ID NO: 6133 - DNA, 201 bp, Bos taurus
gtcaacttttataacaatatattcatgtaaattttacataatttaaaaagtgatataattttaaaatattctgttcttccagaggaactctaggatacactctcaaatattaagaacaataaagtctggggcaagggcttcaggcagaagggcaaagaactttttttttacacacctttgaatttttgtaaaatgtatcac

SEQ ID NO: 6134 - DNA, 201 bp, Bos taurus
gggaaatcaaagtatgagtaaaaagcaaaagcttataagcgaaatctaaatactgcagtgtttcataggttggtacatccacataaactatttcccaggatatgtctgttttcatggagcccattccaaggggataaaagtatctacgtgactagagatcaagctttgtgatccacaagcgaactccaatttgaagtgggt

SEQ ID NO: 6135 - DNA, 201 bp, Bos taurus
gaagaaataggaaatataaacaaaccaattaacagtaatggaattcagtcagtaatcaaaaaacttccaacaaataaagtccaggcccagacagattaatcggtaaattttacaaagtatttaaacaattaacacccatgcttctcaaactattcgaaaaaactgctgctgggccgtcgcagccaccgtgctccaatgtcg

SEQ ID NO: 6136 - DNA, 201 bp, Bos taurus
tttggatctgcacgtttatacgatcatgacttttacctgagttttaaaagatatggaaattactaatcagtctggctggccaagtgtggttttttggtttgtttgttttttttttttttggtcacctgttgctctgtattcctcagcaattattactaatgttacacagactgccagactgccaagggcctgtggaagaaa

SEQ ID NO: 6137 - DNA, 201 bp, Bos taurus
gcgagatttcagcacagcccctccgcccgaagcggcttctctgcagcgaggcagcgggcaattaactcgccgggtgctgagcgctctgtcggctttcgggaaagtgatttgttagagatggggctggaccactcccttccttttagtttgcccccaccctttgctgctgttgttgccccctcttgggaatctgatacaccg

SEQ ID NO: 6138 - DNA, 201 bp, Bos taurus
tccattaaaaaaaacctcaaaaacagctattcattttctttttctaattacttggcagaaatttagaattgaaagagacaaacaagtaacaaccaaacttcgcttgaacaaaagggattcttgggtcctggagaccagagaaatgagcaggaatgctcagggtgagtttgggtggattgcagaatggattgcagaacctgg

SEQ ID NO: 6139 - DNA, 201 bp, Bos taurus
aagataaaagaagcgaagtaggaaaactaaaaaatattggttatttagatataatggatgtcagcatttagagaacttccacaagcatatgtttgtagacatgtatttaacagtttgaaaagtagactatactccgtatagccatagcatagttttgtgaatgaatttggctacttagaggctccagtgtattttgaacag

SEQ ID NO: 6140 - DNA, 201 bp, Bos taurus
tctgttcagaggtgaggcacagcattctctctggctgccttactcaggacattattctttacgtgggacaaggagaaagtgacttatttttccatggtgtgatttttctgtgaaagtggattagaacagcaagcagtaagactaccaaaatacatcttatataatcatttcaccatagcactgaatatactccaccagtaa

SEQ ID NO: 6141 - DNA, 201 bp, Bos taurus
tcaaataggctatgcaattgatgattatgaaaaaaaaggaacacaaagacaaaagtttgtttgcatgagttttaaattatgaggcccaaaacactgattgaaataaaataaaaattcacatacttattaatgttttcttttaagactttctgcagaaaagaaattgccagacttcacagtgggaaagtgtaccttgggtat

SEQ ID NO: 6142 - DNA, 201 bp, Bos taurus
agtggagacttacacgtctgaagccaggttctgaagcgacacccagagggtgcggcagatgacggcaggacagggcagcagtcttcatgacttctgggggaaggggaggttactagttattgagagaattacttcaggttggctcatcagttaccagggagatcagcagaggggcaggcccctcaccactcctttaataag

SEQ ID NO: 6143 - DNA, 201 bp, Bos taurus
cccttgcaggcacaggccttcattcagggggccttgaaaaagctggtttgttgtattgtatggcaggtcgatgaatcaagaagcagagagggcctgtcccgtttcttgtcttgtgtgacatgatgtgaagagagtctgccagcaatgtttcaaagagctgcattatcagacaacataaaggccctccgtccagcctttctg

SEQ ID NO: 6144 - DNA, 201 bp, Bos taurus
gtggggcactatcagggagcagatgctgagtaagggccggtggctggggctgaacaagggagacccaacaaagcagcagacactgcaccgtcagcatgcagggcttcctgtccaagctggccggcttctctcttccctttctccctcacacagtgaaaaggaaatttattaggcaaattcctccatggcagagagagtgtg

SEQ ID NO: 6145 - DNA, 201 bp, Bos taurus
tttccctgctgactggggcctgaggtttccaataatcacaggcaatggcagaagtcaaaatagacagtgcatgggggaaggaagagaatgaagcaggagggtttatgaggtgggagggcctagggtggcgtggaaagaggatgaaggctgctaaaggtaaggacacggaagagcagggtatgggccatagtggctctaggt

SEQ ID NO: 6146 - DNA, 201 bp, Bos taurus
aatggggcttacaagaatcttctttaatgactcacctagaaggcccaacattttgccttttctcccttcctttagatgtctcctggcatacggatgtgatggctgccatcttgggccacaaggtgaccttgagaacgctaggatgctgaaacagaaagatagacactgaattcctctatggcctaccactgggcttccttg

SEQ ID NO: 6147 - DNA, 201 bp, Bos taurus
cccatcaagaaaagggaccagcaagtagaaggcctcagaaatggaactgcacctgccgcatccaagttaaaccaaaaggccagtactgctattacgtatctattgctatattctcagtgaatgaggtggagagctctgggagaaggaagctggagagtcaagaccagactgtgaagagcccatggccaacacaagtcagct

SEQ ID NO: 6148 - DNA, 201 bp, Bos taurus
tacaaaagttaatttttaacatatctccatgaaatagaaaaattttaatctcacttcactctattaattatagaaaaagagactgagactgaataacacacaggctgctaaaataaagatgaaagttcacttctaaaaacaaccacagcttcagcaacagttagtaaattcaaacaaagtactaggaacaagcagtcagat

SEQ ID NO: 6149 - DNA, 201 bp, Bos taurus
ggtagttatagattacttctgttccctagcttactgcattggatagaattctcagaacaatttgaataaaagaggtggtagtagtcaggtatggatgtgagagttggactgtgaagaaagttgagcgccaaagaattgatgcttttgaattgtggtgttgaagactcttgagagtcccttagacagcaaggagatccaacc

SEQ ID NO: 6150 - DNA, 201 bp, Bos taurus
gggtcattggtttcccatgctgctaaagggtgaaatgatgacttctgtaaatattgggctaattttgctcatttccatcaggtcactgtcctcgatccctgtgccttggtcctcgtgcatgtattagtcattgaggtttttattgcaaagtattattggactttcaatgcaaattcagcagtgccctttctatctgctgag

SEQ ID NO: 6151 - DNA, 201 bp, Bos taurus
atttctatatgcttccttataaatatgttttgtccttgtatttcaatttttagtaggctcattactattgatattaaccagtatcttacaattaaaaatcaatctctgttttaaaagtcaaatggagatataaataatttcccatgtgctaactttccttcatagtctgataaagaaatattgaaactgtatcattttttc

SEQ ID NO: 6152 - DNA, 201 bp, Bos taurus
gagcctgggagcccacgattgggacgtcagcagttctggctccgctggaggcctttctgcaggtggcccctcgtcgcaatgccctcgtgtggtctcgcctatgggcttcaacatgcatgtgtctctctgtgtttctcagtttcctcctaataagggtacttgtcggattggattagtgcccaccctaagcgtcgcatttaa

SEQ ID NO: 6153 - DNA, 201 bp, Bos taurus
tttcaattcttttagtttttgcaccattttattttaaggttttgttgttagatgagactggacttgtaattgctatatcttcctaactgtaaatataaccgtatcaattactattttattataaattgaataacaactatcaaaaggcacagaaggtcagactggataaaaaaagcaagatccaactatttgctgcctaca

SEQ ID NO: 6154 - DNA, 201 bp, Bos taurus
aagttatttctcgtcatgtgaagttgtccttgggaatgtatctgcttgtctttcagctgggatttagtgttctgctagtctgtggcctccctgctcacccacgctgcccagtaggaagttggaataatgcagagcaagctggttggttccattccagagtcttctgttagtgagctttcctgatcgggcccattttggctc

SEQ ID NO: 6155 - DNA, 201 bp, Bos taurus
actaaatgacagaatccaaaagaatgcctttaattatagtcttaaaatcttggccatgtgtcagatgagcattgattttctaccaccattaggtcaaaaactatatcccttagtgacagatgatgtgtgtaatatttattacaaaactggatattcccagggatcccaactgagacagagccttatcattcagtatttccc

SEQ ID NO: 6156 - DNA, 201 bp, Bos taurus
tgatgtacagttgatttacaatgttgtgttagtttctgctgtacaggaaaatgattcgggtatatatatgcgtgcacccttttttatatgcttttccgttatagtttctcataagatattgaatatagttctctctgctatgcagtaggaccttgtttattcattctctatataatattggtatctgctaaccccaatctc

SEQ ID NO: 6157 - DNA, 201 bp, Bos taurus
ttcagttgatgaaagagtggattttctagtttgaagttgaggaaagtttgacttgcgacacttgaggagtctgttagtccgtgtgctgtgacagagaaaatgatcagttgaagtgttcaaagcaaagttttccagcctttcttccttccatccttgtgtcagaggaataattttagaaatctcagagaactagtggttatg

SEQ ID NO: 6158 - DNA, 201 bp, Bos taurus
atgaaacttccttctcattggctagaacctggggacacggcagtcgctgagagttccatttccagtcctgggcagagctaggccagccaggaatccgtttgactctggctcctgaccagtggaggtccctgaagggtcaggaggcattcctggaggtctggcctcaccactgtttgccagaaaaaaggatcctgtttttga

SEQ ID NO: 6159 - DNA, 201 bp, Bos taurus
ctgtgtgaaattatagagattcagagccactggctctttctttattggccattggaaagatgctctttttttgtgtgtgtggcccctgaaagacttggcaagaaccttacaagaaaagtggacaatacttggtgtgtacagtgaattcagcatttctttctcaaaattcatgaggccccatagactaataaaaaccagata

SEQ ID NO: 6160 - DNA, 201 bp, Bos taurus
cctaattaagttcttaatggcagaaacacctcagaatgttccatggtttcatttggcactgaggcactcagactctttttcaaacattaggtcaagatattgggttggacaccaggaaaataaacttccttatgaaggccccaaggcataaaaacacagagaaaaggcgttccccgtggaactctgatataaggatttcct

SEQ ID NO: 6161 - DNA, 201 bp, Bos taurus
aatcttaaatttctattcacatatatttagcaaattctcttacttcgtggcttaattgcaaggtatttacccttggagcagtccagtgtacccataaaaacaggagttgatcattatggaaattggccatggaaatacgccgaaggtgttttaaggacatgtttttagtgtctcctctaggaaacctgtatttccacttcc

SEQ ID NO: 6162 - DNA, 201 bp, Bos taurus
gcaagtcatttaacttttctgaacctcaatttcagaatcattaaaatgataatatatatgcttagcattgttgttataaagatcagataagatttacagaggaacattcttttaagtattgtaaagtatcacataagtatttggcctgttgttatatgtttaatgagtattcattaaataaatactggacacacaggaaac

SEQ ID NO: 6163 - DNA, 201 bp, Bos taurus
atggtctagccagaaaataccgacatacaagggtacttgtggtggatcccttgaatggaagaatgaagcaaaaagggaggaggttcagaatcgggagaggtgagaggcaagatgagaaggagcaacgcatcttgatgaatgaattagaagctggttctaattctgcttgtgggaaccgtaacctagaatgaaatgttggtg

SEQ ID NO: 6164 - DNA, 201 bp, Bos taurus
ccactgaaatttacaaacgattcattgaaggcagggacaaagagaagtgctcaattccagtgaaagaaccccatccatgagagtttatctcaactgctcacgcttaaattccagatgtgggaagctactgaatttttctgtcaatatatataatttttgaaatatggcctatgggtggatattaaatacttgaaccaactg

SEQ ID NO: 6165 - DNA, 201 bp, Bos taurus
aacctggaactctatgcattcttgagaggaaacaggtggggtgggatgatgacttaatcaagcggagcccaaagccaccaggtggaggaggctcacagttctctgaagtgaatctgtgccactggccttgaagagagggctggtgtcatacttttaagggaaaagatatgtttttctctttgtgcaaatacttggctcaaa

SEQ ID NO: 6166 - DNA, 201 bp, Bos taurus
tctacagtcagctaattgtgcatacacagccatcccatggtaaaatccatcctgagagacccactatcaaagccctaaaaattatttttgaaacaagacactttaggccaatttgggtttcagattaggctgaactttctcagcctccgaggatggcatgattttccattgttccttgggggtctcatctgaaatcgaatt

SEQ ID NO: 6167 - DNA, 201 bp, Bos taurus
ttggatggcatatcactgcactcccttcctgctttataaatgaatggaaagaacagggtgccccacagagtacctgccaacttgagctaataagctctccacagttacataccttcccactttagaattcctccttatgatttgctccttgattctgatatggaaggatctttgtacataggcaaaagcatttgcactgga

SEQ ID NO: 6168 - DNA, 201 bp, Bos taurus
agtctattcagggctccttcctgcctcatgaggggcctcacacagcagcagatattctagcctattctcacaagctctgtctattgctttccttcgtggacattcccttaggcctagtgccaggtacatcccatcctcctgagagaaggacctgaaaaagaggccagcacaggcctgccacagggaatcctggggaagaaa

SEQ ID NO: 6169 - DNA, 201 bp, Bos taurus
attgtttctaacttttccatggatacaaatattgtattcttagctattatattaaactcctgtgtcttagactttttattacagtctccatagggccataccttatgataggaattcaataaatagttgatgatttagtacatggttatttatttaatggatagtcatctcttaaaacaatgttctgattaaaattggcct

SEQ ID NO: 6170 - DNA, 201 bp, Bos taurus
agcaccttgctcaaacatttctgcattattggccatggtacacagcacactctgcttctccacattgtaattcggagctgcagctcatcagagcacaagacttatttttggccgcagcacaacccagatgtgcagcccttggaagaaatcaccccaccagtgtcatctggctatcacctcccttgcctggattctccagtg

SEQ ID NO: 6171 - DNA, 201 bp, Bos taurus
attttaaaaatggaaggcctaagcccagtgtttaccaagagctcagtaaataacccgttctctgtttattgcttcctcttctgtggagatttaatgttctcaggccgtggctctcagtttcctctcatgaccccattacattcttaaacatttctgaggacctcaaagagcttttatttctgtggttttatccatcaatat

SEQ ID NO: 6172 - DNA, 201 bp, Bos taurus
cagagtcttgaattgtctttaaaatcccttcaaaatgtaagtctagtctctatgttactataagggtctaattaatcaactagaacaaaggaaataatagttttgtacccaaggcagtgaatgatatggtggattatgctttcatgaggctatttttctgagcctgaatttgaaaatcaaaataccaactgcatagcaata

SEQ ID NO: 6173 - DNA, 201 bp, Bos taurus
tgtccaggtggttttagccatcttatgatcctacttttccccctgaagtgtctgggtttttcaagttgttaaagcttttcttatcccattgctccttgctgtgaacaactaaggtactcaggccccattttagaagtgaaaaaacataatttcacaataattcccaatgaaaagaagtaggaatcaaatctagtttttttc

SEQ ID NO: 6174 - DNA, 201 bp, Bos taurus
atatattatgtgaaggagtgctttttatttcatttctgttttttaatttaactgagtcaactttaggcattagattttattttggccacacactatagaggcttctttgaaattagccttatctgcctggttttacttagagactctgcttcagaatctaaactatgaagactcaggcctttgccagaaaccaatatagac

SEQ ID NO: 6175 - DNA, 201 bp, Bos taurus
catgatggtggatgaggccttctgtaagtcattttggtagaaagtattgcatgcaaggatgtcaaatctgtgtctagagtatgtgtctattctagtgagagcaaaacattgcatcttccgtaaggaaagtcaagctgtgtgatcagtgtgccaccagctggttgactgatcatcccagtgagtggggccaatgagggactc

SEQ ID NO: 6176 - DNA, 201 bp, Bos taurus
ttttcaatcatcctgagaaagaattatttggtcacattgttagtgttgggtaagtcattctttgtaaaaaaaattacacctaaaatgtatattggctcaagcaaaagagaagtgtatttcttgctcagttacaataaaaggtaaattctaaaaggcaggcaggcaggcaggcagggatgctgttccacgcagttcagcaac

SEQ ID NO: 6177 - DNA, 201 bp, Bos taurus
gaatttgatgttgtctgttcaatactgcccagtgtaatttttgctttgagaatactcaaataatctggcttaaaattttttattataaaatatgtgcataataacacatgcccagagtgaaaatcacttggataaacttttgcataaataattatacttgtattgccatacttataaggaaaaacaaaagaaaaagcatgg

SEQ ID NO: 6178 - DNA, 201 bp, Bos taurus
gattaacaactgttggaatctgccctttggaactcagagaaagtcatagatgctggagacttgcctcctaaaaatgggggacaagaaaaaggccaccattcctgggactccacaggacctaactcagtttgactctttagatcagatcagatcagatcagtcactcagtcgtgtccgactctttgtgaccccatgaatcgc

SEQ ID NO: 6179 - DNA, 201 bp, Bos taurus
tcttcaaactatggagtatgggtgtcccagacgcctcaggacctgagtacaggagataggggtaaaggggatgttttggcctggtgaaaattatggcgcctaatcatcaaagacaaaaaacaaatagcttgtgcttgcttcagcaacacatatactaaaattggaacaattcagagaagcttagcatggcccctgcacaag

SEQ ID NO: 6180 - DNA, 201 bp, Bos taurus
tttttcttttggtcaccttgatgtgtgccatttcataagtgtttgatactctcttctctgatatacctacctgatatcgagttcttctcctttgagtgcttctccttttctgtatctattgccatttctccaggcaaacagctacttaagctgttgggagcaacgtttttgttactaggctgcctcctctgagagctctaa

SEQ ID NO: 6181 - DNA, 201 bp, Bos taurus
ttgatgatgagtttgagtaaactccaggagttggtgatggacagggaagcctgtcgcgctgcagtccttggggctacaaagggtctgacatgactgagtgactgaactgaagtgactttccttgaatagctcagtgcataaacaaaatacttcaaaaagattagatagattttggagttgtagtagatagttgagttttca

SEQ ID NO: 6182 - DNA, 201 bp, Bos taurus
cttgctaaggaagtggaaaaagtgcacttttttttttttttaaaataacaaatctttaaaaatattccttttagggaaaggaaacaattatcataatgtcaccttttttttgctaattctattcatcacttcatgggaaatagatgcggaaacagtggaaacagtgtcagactttatttctttgggctccaagatcactgc

SEQ ID NO: 6183 - DNA, 201 bp, Bos taurus
gtttatcagagaatgggactcaatctttctttaaagaggatgataaatgtgttacattctatcagtaattactctgcaggaccaagagactttactatgtacaggcaacccaaataattggacttagaagtcacaagttggatgcacttgtgttaaatatatattagatttgtgtgaaagtaattacagttccagactctg

SEQ ID NO: 6184 - DNA, 201 bp, Bos taurus
atatttatttatcctaaacataaatattaaaatacaagaggacaatccctggtaggcacttgtcttgacatacaagtattctttgtaattgtcattgtaccgcaaagatctgaactctgatatatttttactgtggatattcttgagcagcacaaataaaacctgatcctttatttattaattaaagtattggaatataca

SEQ ID NO: 6185 - DNA, 201 bp, Bos taurus
tggaaagaaaactgtccttttccattcatgtggccacagctgagttttccaaatttgcaggcatattgagtgcagcattttcacagcaccatctttcaggatttgaaatagagaaggcctattgagagaagaatttgaggaaatataggagtgagctgaaactgtaagctgtgggaatgctgagaaagttgaataatgtat

SEQ ID NO: 6186 - DNA, 201 bp, Bos taurus
aattttcttaggacttctgaatttatacttataaggtatcattctatagtttacttttattgccatatctggttttgataacaagttaatgctggcctcacaaaatggtctcctcttcctcttttactttttggattagtttgcaaaaaaaattgtgttcatattttaagtattttgtagaattcaagagtgagccatctg

SEQ ID NO: 6187 - DNA, 201 bp, Bos taurus
ttaagtctatattaggactttatgttagcaaacattgtccatacatgaaaaacaaaagaatatttatgctaatagggattctttctttgctattgcatgacaaattgaaatactaagtttatgcctgtagttgtttatgattttggggaagtaactcaacttacatttttttttaaacttctggtgtcaacaggaatagag

SEQ ID NO: 6188 - DNA, 201 bp, Bos taurus
aaatatagatgcattttctgtgtgttcatggggtaaaatgagttccatgttctcctactgctactcttgaactcttcatgtgtgcttattttctgtgagtacttagaaaataaaatctttgaaaaagaaggaagaataataaacataaacacaccgttataatgtgcaataatggggcattttataaataatagatgtaga

SEQ ID NO: 6189 - DNA, 201 bp, Bos taurus
tacactgtgaaagctcaccagttaatgattttttaagacaatgtgaatttttgagaatttatctagtctgccagaaccaaactattttcaaaggtttttgtcttaaacaaaaacaaacaaacctataacagtgattggaggccattcaacattcttatatcttatgggtatttctttactgaggaaaataaaaaggacaaa

SEQ ID NO: 6190 - DNA, 201 bp, Bos taurus
ccacaatttgcttacatttatcacaaggctttttttttttttttttttcagatctttcctattgcatgtcatggtgcaataagaaaatatctggttgaggtagaaatcatttagttgaaagaaatagaaatcacttaccttagttcaacttcatttgttcatgagatgtcttagaattctagtagtaagacattttagcca

SEQ ID NO: 6191 - DNA, 201 bp, Bos taurus
tcaaaagggatggctgcttaagggtggctaggaaactaaatctgtgaatattgaccatgtagaacagtacagcagttatgtatgatataaaatgccttgtagaactagtataaagaaactgaagtgtacatcatgaaccaaattgggcagtaaggtctgttataatttatcatcatctccttaaaacggctcattaaaaaa

SEQ ID NO: 6192 - DNA, 201 bp, Bos taurus
acccttccaaccatgagtttactttattttctaggcatatgccaaatgaaattcatgtgcttttcattcaattcagtatatatatgatatccaagagtgaattttataggcttacaattcagacctttatctgctatgactttttatattagattatggaagtacctaggggctaatgcaatgaatgtgtctaaagatttg

SEQ ID NO: 6193 - DNA, 201 bp, Bos taurus
ttttcagtacctttgatgcatttgactgttagcatcttaacatctgatttaatctttaattggtttgctgcttagtctcagcctgagttttaacattccccagggagaattcaaattgccctggtttgagtcacctactcatccattaaccaggagaggtgattaggagcttgaacaccagtgatggatccagatgagttc

SEQ ID NO: 6194 - DNA, 201 bp, Bos taurus
ttttcatcttacatgagacccttcatgtgtaagtcaacacttgttgtaagaaatccaaaatacagtttagactcaactgttcttttggtttgtaatttctcttcatcagggacttgaaacttaccagatttagctttagctagaggcttctctctctcaggtagtcctccgtctaccatgagcattgtgtaaggtacaaga

SEQ ID NO: 6195 - DNA, 201 bp, Bos taurus
tccattcacactcacctctcactaagctaccttaacctgttaggaaagaaactgttagtgtcagcagcactattttgaatctcccctctctgctggtggtgttaaccatataagctttgcccatggaaggtgtatttgaaattatttaaaagattggttttaaaagctgaagagcaaaggagtgactattttaaaagacac

SEQ ID NO: 6196 - DNA, 201 bp, Bos taurus
tgtgcttggctgtttatttttatttgtaagaatgtacttcagtgaataaatcagaaaaaaaagaggtcccaagccatgtttgaaaaaactagacattaagtatttatttcatatcaataaggtagtatattaacctttctgttcacagttcatttcttcttttgaatactgcacttgtatggctgactcaactagagaaac

SEQ ID NO: 6197 - DNA, 201 bp, Bos taurus
acttttagtgtgtagttgatgaggtgctagcccagtgtacagtatactctttccttatcatctcttcttttaaaatatggtctatgtggtttcagtgtgtttctgattttcagattgtaattacttatattttcatgttacatgtgggggatatacaaataccgctccacaaggtgggagtgagaagggagatgatcacct

SEQ ID NO: 6198 - DNA, 201 bp, Bos taurus
tgttttttagagctctgtgatatcttagaggtgataagtctctcttgccctcttttgtataacagagaaactaaatgaaatccataaaagctcaataaatatccatgtttagtgtgtgccaaaagtgagattataattcaagtattctcattttaaactgtgcgctttctttctggactcttaaattcttcaggtgttcac

SEQ ID NO: 6199 - DNA, 201 bp, Bos taurus
gtttatggcacggctgggggatcccagtctccttttccaatgaaagccctgatgtcctatttactagaaaagtttgtggaaagactggaatgtagcctacgtatggattttgttttatatggaaatccagagatgagatttttgagcatcctttttaatggaactagaatatagagtattgacatttatagatattcaaaa

SEQ ID NO: 6200 - DNA, 201 bp, Bos taurus
taccagcacaccacagtatttgtgatcaagccataggaaggccaggaggtagccctgaccaccagtgtgcccacagtggtcatgatggacctcagagccagcagtctgagggcccaaccttgtatttcattgaacctgcagcaatcatgacaaaacattaaaaagacaaagacaaaaaaaagataaaacctttaaaaaaat

SEQ ID NO: 6201 - DNA, 201 bp, Bos taurus
ttctgggggataagtgttagttctttttgctttgtgtcaagtgctttcacattatcaacggaaatcgtaaggaaagggcccccataatctgttctacaaaccctcttccctttaaaagtgttggcgtgctttgtggtctttgcctccatatttaataaataagaaatatagtgagttgttgtgctacctcagtgcaaattg

SEQ ID NO: 6202 - DNA, 201 bp, Bos taurus
ttctttttgtattgtctcttttccttctattgaaaacagggccaggccttgccttgttcataccatgtaacccatactttggaaagaaacatgagtagattgaatgaaaatattttcttgcttataacctatattcttaagatccagtaaaatatatatggaatttatgtatcatgagaagatgggcaaatcaggagttca

SEQ ID NO: 6203 - DNA, 201 bp, Bos taurus
acagatgtcacagaaggaaatggatgtgtatgcaaatgtggccctagtgggtgatcataattgttttttgaaacagtgtattttaaaagaagatatgactagaattataggttcacactgtccctctgccatttgctttctgtgtatctctggactattcactttaattatatggctgtgtctttaaatgaaatatgcaaa

SEQ ID NO: 6204 - DNA, 201 bp, Bos taurus
ctttacaaaatcacataactcctctagagttttatttttgacccactcaaagagattttaccagggcatctgcaggtgtccttttcttttatccagctaaccttttaaaatgacaacatatggcccacaattgagatatcaataaatctctttaggatattttatatacattcaatacattataagggagagagagagact

SEQ ID NO: 6205 - DNA, 201 bp, Bos taurus
ataaacaagtatgtttcatccactgaccctggagggtttagacaggaacagagtgtacacggaaggagtaactgtcatacaatggaatgcatgctttgttaaacaacaggaagaaagagctattgcactcaagagataatgataaatatatgtcttctgtaagagagaataggatcagaaaagacttccaaaaggaagcca

SEQ ID NO: 6206 - DNA, 201 bp, Bos taurus
gttagcaattttattctggagcatgaggaataaaagcgaactttcaacaggttcagattatttggaggctttaaaaacctacatgaattttctgtgtatggtaggcagatagaaagatattacagatggaattaaagtccaggtccaaagtaatgggcatgcttttatgctgagtgaatagaaacccttcaaatgaagttt

SEQ ID NO: 6207 - DNA, 201 bp, Bos taurus
acctggttacaacatgggtgaagaagagaaatgcattatgtgatgtaatctctctctcccagtcttgctcactctctctccttcatatccttctgtttctggttttactgaatatcaccatcatcatcatctacatgcccaaactacaatccaggaaaccatcttgactaaagctcttttcttctcatttcactaaaatac

SEQ ID NO: 6208 - DNA, 201 bp, Bos taurus
gaataaaatatgagtgaaaggcctatgattgtataacccagtcatcagaccagtactgcaatatcacaatggaatggagtcatttgtcaccttagcagtgtaagagaccaagccagtggccactcaagctacagtagccttcaccttgaggcagtgtcggaatgattggtgtggtgagactgaatttccagctttgtcctt

SEQ ID NO: 6209 - DNA, 201 bp, Bos taurus
cccaataatgcagaaaagatatctccttcagaattttctctaaagatgttattgaggtgcggttctccttagttcctctgttgctttactgctagagtgacacgggcctttatagtaagaaatatacggtttatcttatgtccccatttaggcaaagaactctccaaactcttggaatttcctaagtgatgagggcaaaat

SEQ ID NO: 6210 - DNA, 201 bp, Bos taurus
tccacacagactttggccattttgtatgtttgggtcagtgatggtagagtgtattatggctggtcaggaatgtaaaccctatgagaatggttcttctccccctaaaccttcagacccggccatggctcttaacatcatcccagattcacctcctgtgctttgcatttctcactcacgtctggatctcccttcctgagcttc

SEQ ID NO: 6211 - DNA, 201 bp, Bos taurus
taacatgaatgagtcccttaagaaccactcagtatcagatggatcaggagctcccttccctctgcccttccccctcatcgtgctcatgccctaccccatcccacagacttagaaccaaatctctaacttagaagtgcaggcatggctgaagtgattgaggcactgtaattggtacagttaacgaacactgaaatgctgcct

SEQ ID NO: 6212 - DNA, 201 bp, Bos taurus
gcaatgcattttgagtttaccttcatttttaatttaattgcttaagcaggatttctgagatatccacaattgagttttgccagctccagcataccactaacggatagttgaacaaaactgtagaaattgaatgtgtagaaatctataatttgttattgggcagggcagaaggcaagaacaatgcaagatgatccttccatt

SEQ ID NO: 6213 - DNA, 201 bp, Bos taurus
tgacagttctgctaagttgctgagggaagtaggaatctgtctcctttcctaaactactgatctgaccaggtaggtcccaggctgggtcaagaaggggccaagtcttcctcttttgcatacccctagtgtgagaggaaggacatagactcttgagccaagtagacttgcttttgaattcaggtctatgactctcctgtggta

SEQ ID NO: 6214 - DNA, 201 bp, Bos taurus
aaaagaatggagcccacttcttatacagcctcttggacagagtctgagctcttgtggtttgagggacctgacagctaataggtgcccaaggaaagcaagcgatctttaaaagtagtccaagcaagagaccagaaactgatggaaggattcttgggaatttgtgaaatggcagcacagagattactgtgtccaggtccagct

SEQ ID NO: 6215 - DNA, 201 bp, Bos taurus
gatactatgaagctgatgagctctcaacaattctgtgaggtgtcaaaatttgaaagtagaaccttcaaaacatgaatgaaagcagcaccttcaaacttctgttcccaccacttctctgctgtttaccctcaatctcacatgataaggttaggtctcaacctctcaaggccttgctaaggtatataatactaaaaatttaat

SEQ ID NO: 6216 - DNA, 201 bp, Bos taurus
ttttcattactactgttttttgttttttggttttattttccctgtgcctacatttgtgggaaggggaatgctttagtttctaacaatcatttgagcaatgctatcgttctaacaatttgaaatttttatcttctttaaaccacgtaattgtgtactaaataaggtaggacaaaatgccttttcacttatatttttccaaat

SEQ ID NO: 6217 - DNA, 201 bp, Bos taurus
tctatttatgacatcatgtcataattcaatttatgacatcacaaattgtacaacatgcaacaaatatatcaaaacaacaatccacaggccaatatcactaataaatattagtataaaaattataaacaagacataatcaaatagaatgcagatggtgtcgaaagctagactgactaagaatggctattccaggattttaac

SEQ ID NO: 6218 - DNA, 201 bp, Bos taurus
cctaaaaccgtgaaacattttagtagttgtgagtcacattttccctgttttgaatttttataaacttcattcttcaatgggcaaactgagtttagatacttctccccaaaagcccattttcagtgtattattatgtaaaggctttagctttaaacctcaaatcattcttagcttaattaaaagtgtctggttactatctat

SEQ ID NO: 6219 - DNA, 201 bp, Bos taurus
atattttgtatattaaccccttatttgatatatggtttgcaaatattttctcaagatatggaaacgctttgtaggagactgtggatactgttggtgaataacatactaacatgctatttgtatactatctgtactatttgcatactatttttactaatgtttactatttgtatactagtctgcatttttaaatgtatctat

SEQ ID NO: 6220 - DNA, 201 bp, Bos taurus
tggagcagtaaagatctaggagaggggacggaggacctgaagaagttacgaactggtgttctcaaagcactgacacaggtggacaagatggggctttcagggaaatttgataagctaggctcatccagtcactaaagtggaaccccaaatgaggaccccttcatgaggaacacagcagctgatgcgtctacatatctacca

SEQ ID NO: 6221 - DNA, 201 bp, Bos taurus
ctgagaagcttgaaaaccaaagcaaaaagaggatgtagacaagtacataagcttacttttcagaaaagatgtgcattattcaggtttctccaaagaaacaaaagcaccaagacatatagagaaaaagaaacatagagaaaaagagatttattaaaaggaactgggtcatgtgattatgaagactgagaggtcccacaacct

SEQ ID NO: 6222 - DNA, 201 bp, Bos taurus
cccatgtacagcaatgaagacccagtgcaacaaaaaataaaataaaaacattacagggggtcctttcccctcagagggaattaaccacaaggttaatgctgttctgataaaagtcaagaccagcacactccatgatgccatgcacaatcacctcctgccagtccagggtcacctttttctaaacttctctactgtacttaa

SEQ ID NO: 6223 - DNA, 201 bp, Bos taurus
taaataatgacaaatggaaggaaaaaggaaattaaaagcaaaccaaaaaaaagcagttgtatccagatcatggagcccattaaaggcctgatgaaatggagtttggggccttatctcataggcaatggagatacttaaagggttttcagaggcatcaaagctatgcttcaggagaagtaatctataaccttcatattatta

SEQ ID NO: 6224 - DNA, 201 bp, Bos taurus
actaaaaaccctgcaattaattttacacttgtgccatgcttcctgcatttccacttttgtctggttctgattttctacatcctgttcccaagctaggactcattcaaaatcaaacaccttctttgtaggttctactcagcttcccactttcagccaccttcagaatcctgagaaatccttgttccattattgctggaagtc

SEQ ID NO: 6225 - DNA, 201 bp, Bos taurus
ttccctcaactgatttcataaggagaagagaagatattgcccaataccagaaagcccaagatcccttttatttgatccctcattttcacagaataaaacaaataaacaaaaagaatcttttaagtatcttctttcatgtagctttcagagagaattctctaaatttagctctctatagatagcttcaaaataactgcccct

SEQ ID NO: 6226 - DNA, 201 bp, Bos taurus
aaggccagttccagagaagaaagatttaaaacatgaccagagcctctggttgttgagtcagctgtaacttgttttacaaatttatataaggaaattgccagaagcaagtggccttctggtcacctgttcctttgtgcaatgtggctttctaaggtttgtgtaaaattattttttctctgcattttgcaaagaggaatggag

SEQ ID NO: 6227 - DNA, 201 bp, Bos taurus
ccttttctccatacactctccagcatttgttacctgtcaattcccccataactggtaatctcaccacacaagcactacctccttgagaaacctgccaccacgttctgctggccatcctctgctcacagtgggatgttgttctaggaccttgcttcagacaggtaagctgaccagggtgaggtggtacctcactgtagtttt

SEQ ID NO: 6228 - DNA, 201 bp, Bos taurus
atttaggagaagacacacggacctccatcctgaactccagagtgacagcagttgaagtggaggtcagttctgctctggctgctctctaggacccgatggagaactgggctcagagggacaaaggccttccaggagagagactcccaatatgttaaaaaattgaaaaaaatccctaaacaagcttaccaaaactgtgacaaa

SEQ ID NO: 6229 - DNA, 201 bp, Bos taurus
cctatggaagctctgtaatcaaatcctgctggccttccaagtcatattccctggggattcccagtccttggctggatccccaggctgaggagcctgatacagggcctagaaccttcacaacagtgcaagaacttcttggatattactgttctccagtttgtgagttgcccacctggcaggtataggatttgattttatcat

SEQ ID NO: 6230 - DNA, 201 bp, Bos taurus
taataataaaaccgatttaccagcagcgccagttaattatgcaccattgctatggttattctgtgagacaataaaaggtaatggggccgtttctgaagttggtgggaaggaacccagcacaatcaccgaggtggactgctgactctcttgaaaaatttctccccaagtcagcatgtgtctgggtgagcagaagtcattaaa

SEQ ID NO: 6231 - DNA, 201 bp, Bos taurus
cccagtaaccggcatgcacgacagtgcagaaccccggtttctcatgacaaggttcaatccagctctaaatcatcattgctctgctcttcacctcagcctcttatgcctctaattcttgtcaaaagggggcacatggctgtggtccttaggaaggaaggcataaataatgtggtctcctccctccaccctcaagactctcaa

SEQ ID NO: 6232 - DNA, 201 bp, Bos taurus
ttctgtaatgttacattattatttgaaaaatacttataaattgctttaatagacataagaaaatagcaaaggataattttctctggatggcctcttcctagagaaattttaaagcaaatttctgcagcaatagtgtttatgtcttttactatgtactataaacaaagtaaaaacaacaacttaacactttaattctccttt

SEQ ID NO: 6233 - DNA, 201 bp, Bos taurus
aagaaatgacacaaaaggccatgtatgagtgacatagatatttcatctatatgaaagctccagcataggcaactccattgagacaaaaagcagattagcggtggccagggtctgagatgggatgaaggatgaaatggggagtgactgctgatgggtacagggtttcatttagaaagtcttctaaaactgagtgtagtgata

SEQ ID NO: 6234 - DNA, 201 bp, Bos taurus
agaaatactgaaagcaaaacttgaagggcactttaaaaaccaagaactaagacaggttaaaagacaggaagaaaactatgatcaacaggttgaaatgtctctgcaagatgaggatgaatgtgatgtttatattctgaccaaagtatcagatattttgcactcattatttagtacttacaaggaaaagattttaccgtggtt

SEQ ID NO: 6235 - DNA, 201 bp, Bos taurus
tggggaactcaaatcaggtgctctgtgacaactagaggggtgggatgaggtgacaactagagggagggacgttcacgagggaaggaacttacgtatacctgtggctgattcatgttaatgtaaggcagaggccaacacaatattgtaaagcaattatcctataattaaaatgttttacatgtattttattcaagtatagtt

SEQ ID NO: 6236 - DNA, 201 bp, Bos taurus
tctggaccagcgcagggtccatttgtcagttagtttaggggagcttcaggggcccaagttaggcactcttttaaagaggcagtgcttgctaagttggttccgtcatgtctgactctctgcgaatctatggactgcagcccaccaggctcctctgttcatgggattctccaggcaagaatactggagtgggttgccatgccc

SEQ ID NO: 6237 - DNA, 201 bp, Bos taurus
aggttctgcacgctctctgttgttcttggctattaaaaaagaaagcatatttgttactgaaatgtagttaacatcttaccactgaattatgtatgtcacttagataaatataattgctgtaaatgtctatatggtctcggattcagtttttatttagaaatgggagcttttttgtttataggatcatcaacaactaaaaaa

SEQ ID NO: 6238 - DNA, 201 bp, Bos taurus
gagtagatatgtaggctggaaggccaatgagacatgagatatgattggttgggtgtggaacctagaactgcctcaagcttgggtacagagtcaggtcacccgtttggtggggccaagaaaattgcagagaaacagagacagtgtcattctctctgtgtatttcttgttacatggtataataaacttcctttttatttaagc

SEQ ID NO: 6239 - DNA, 201 bp, Bos taurus
ccactcaaaaatggggatgtcagacctgagagttacaaattctctaggggtttaggtttttaacaggagctcagtaataggccagttaactgcctccctggtttttttttgaaagtagttcagttcagtcgctcagtcgtgtctgactctttgtgaccccatgaatcacagcacgccaggcctccctgtccatcaccaatt

SEQ ID NO: 6240 - DNA, 201 bp, Bos taurus
attcttctcactttttggcagtgatcaaccatgatcaacttgataaacattcacaccttaaccttcccactcacttgcctctcatattatctgccctgtctttgtcacctttgccaattcctcttctttcactcactctccaattatgtgcagttcccaaggctcaatctcagatcccctgcttttctctctaagcacaat

SEQ ID NO: 6241 - DNA, 201 bp, Bos taurus
catctcctgcattggcaggcaaattctctaccactagcatcactgtgggagaatgtcaaatattttaacatttacgtaattaagtcttataagaagaaagctgagtctcaaaaaaatgtgtctgataaacttaaaatggctgaaattttcccatatttagtgaaaacataagcttatggattcaagaatgccaacaaattc

SEQ ID NO: 6242 - DNA, 201 bp, Bos taurus
tggattataacccaaagtataaaaacaaatatccacgagtccatactgatataaagtactgaattaattaataaaaagagacaaatctcccttgcagaacgattcaaagtaaattgtggaggtattccaccttcaaagatgtgagcataattccgcattccttatgtgtgggcagtattagtaacgtccttccacacagca

SEQ ID NO: 6243 - DNA, 201 bp, Bos taurus
tatgcagtcttctactagtctggcccagcagatccagcatcactccagcagactgatcataggactgaccatagttcactaaacaagcaactccctgaagatttcaatcaactggcaattggtgaagagaaaatgtccatgttggagagcccagaaatacaggccacatgttcccctccaccatttaccaggccttgtctc

SEQ ID NO: 6244 - DNA, 201 bp, Bos taurus
ttgaggctgcctctgtggccgcccgaggccccagagctgtgagacttggcaaagtaattaagactgagaacccaaccgagcggagctgagtaaaaggtgggcgggcccatcccacaggccaaatgttttggaaaggcaaaagcaggagagttggagaaactaggtaagtgccgcggagtggattttctaattctcttccgt

SEQ ID NO: 6245 - DNA, 201 bp, Bos taurus
agtactatatcattgctaaatgtcttagtttgatgattgtgttatggttacatattttggggtgaagggcataataaaacaataataggcttatatatagcgagagatggacgatggttagatagatcaacagatggaatttatcaactgataaattagatagaagattcacgcactgttcttagagctattctgtagatt

SEQ ID NO: 6246 - DNA, 201 bp, Bos taurus
taaatactactgggcctcaaacacactgctgcaggaatgcaacagaagcaagaagaaaagcacaccagaactaggaagagaaaccctctctgctactgtgccttgcaggggccctccagcttcttttgttgacaaagcctaatattttaccagctggcaaagaagaaatgtttacagggttcagctttagttttacaaagc

SEQ ID NO: 6247 - DNA, 201 bp, Bos taurus
ttttgaaatacactgggagcatctagacagcatctctctgcctcttcacccgggaatggaatgagagcagggaaaggcactggccactgcaggtgggatcggtgctcatgctgaaagccgatggcaacttctgagcccacatgaaaggctggacttgtcctggccaagctgttcagagccagtggacaaatgtaattgtag

SEQ ID NO: 6248 - DNA, 201 bp, Bos taurus
gaggatcctaaggtttcctatgacttcctactctgtaaggtcaacttgtgtcccctgttcctccactgcaacgaggccacttctcagcctcccctcaccccgtgcacactataagtacctgctcagccctgcctttgcccaggctggtgaactttctcttttattccctgccctaacaaattgttcaaggcctccttagtc

SEQ ID NO: 6249 - DNA, 201 bp, Bos taurus
tgtaatgctgaaactgctgtctccttttaaaaagtatttctttgttgctttactgataagatttctgtattatttaattagactacaatgggtattgagttcagtagcattggactgtagatcatttcatcaacaccctaatgagtctaagccatttaccatatctccactactgattcagttggaataattttgagagtc

SEQ ID NO: 6250 - DNA, 201 bp, Bos taurus
gtttacttctctgtgagtaaaacttgtcttcattggtaatgtgtaaacttctttctaaagtcagaatgttctgacccattgttcttcctttttgagaattcagcacagttcttcacatgttgtaaagatacgtaagtactggatggagtcatggaagaagagggaaggaggcaagagaagtcgtgattgttttcaaaatgt

SEQ ID NO: 6251 - DNA, 201 bp, Bos taurus
taaaagctcagctctgcacggccacatggaaagcagcagctctctcgtttataattaacaaaagctaccctgagctgcttaagtggtgagggaaaagttattgaaaagacaaagggtacaagataaagagacaccagtgatggaactgaaatgctaacccagcatactcgctctcttatctttcatcgctactcagtttgg

SEQ ID NO: 6252 - DNA, 201 bp, Bos taurus
aatgtcatttgctttgcttacatgctgatgctttttgtatttaaaacaaactacagttaagaaggccactaaaaagtttcttattttaaactgtcacctcgacagaaacctcattttttcctgcttttgactccacacccacaattaacccacgtaaaacaaacgactgacataaaattcagaatcaacagaaagaagtaa

SEQ ID NO: 6253 - DNA, 201 bp, Bos taurus
gggggcattaagggatttgcatatatgtatttgcagtcttagtagtactgatgaacatttcttaaaagtttatttctcaattttattttttgccctgccttgtaaggcaagtattcccttttgctcttcagcatctaccatttcagtaaacaagttgaatttttacacctcatctagcaaccaggtcagaagtatcccagg

SEQ ID NO: 6254 - DNA, 201 bp, Bos taurus
gacttgagggctatagagcttttatatatatctgtgatgcatttatttgtattgctattgttcactgaggactaattatataaaggaatcatgcccagaagatggcgtgatttaaaccccttggaatgatgctcttataatagaactgcaacttctaccatcatagaacttccagagtcttagtgtgcaatggtaaatatc

SEQ ID NO: 6255 - DNA, 201 bp, Bos taurus
atcactcatcatacactgagattacacagaataaaattgtttctgtggttgtcccttttctttgttggctctgaattattttctcttctacattccatttctgctatcatttctaatatctctgcctcaccaccacatcttaaaatatgatataggatccatgcttacgtctaaatgtgtctatactaatgatgctccact

SEQ ID NO: 6256 - DNA, 201 bp, Bos taurus
atcagtgaacacacacataaacatacataaatatgtacacaaattagttttttaaaaattcagctgccatagtctcacgttgttataaattgctaatatcttctctactgcaccaactgacagttggtgtcctgactaaagattgattaaaagtgacattgtcatggaaaatttcaacatgtaaattctctactgatttat

SEQ ID NO: 6257 - DNA, 201 bp, Bos taurus
cttttgctccctgtggcactgacaggtaactccttggcactcagctggtagccagcatggtctggggtatccaggaaggctttttcacttgggctggcatttgggctggtgtgatagttaattatgtatgtttatttgggtgagccatgtatccagataactgaccaaacattattctggatgtgtcagtgagggtgtttt

SEQ ID NO: 6258 - DNA, 201 bp, Bos taurus
tttctttgctttgatacattttaaaatagatttgcttagacatccagagaagttaatagagttgtccatggctatggcctaaaaggagaggagacaccagcagaaacaattaacttgagctcatgtaggggaaggaggaaaggaagaggaacagggctcatgggtctgggtgcctctggccccagggaagcatgcagtgat

SEQ ID NO: 6259 - DNA, 201 bp, Bos taurus
ttcttttgtgtttgacattcttctgagtactttacgtatattaacttacttaattatcaaactggagatttttcttgtccctcctacacagtgcaacccctgtcctggacaatggtgaacgggccagaaatagactttttcccctcatacaggatgcaatctaatgagttttgagggaactgatcaaaaagttaactgtga

SEQ ID NO: 6260 - DNA, 201 bp, Bos taurus
cgtgcccccagggttacctcccttactctctgaggtgcagctgcctgtgtgccagatgggggctgtagtgcctcagcagcagtaggaggcaggggagaaacgcatgtggcctcagtaaagtgggcactgttcacttgtacccatgcacaatgtgagggacaggagaagcctctgctgtaggctctgtgagcagcagtggaa

SEQ ID NO: 6261 - DNA, 201 bp, Bos taurus
aagatgttcagcataattagtcattagggaaaatgcaaactgtaaccacagtgacattctactgtgcagctcttagaatggctggaataaaataccaagcactgaggaagatgctggaactcttactcattgctggtcagaatacgaaacagtacagctgctttgaaaaacagttgagtagtattttctgtagttaaatat

SEQ ID NO: 6262 - DNA, 201 bp, Bos taurus
caaagccctgactgcatttattccccaggaaatgattgaagccatccgagaagcagtggtgtacctggcacacacgcacgatggcgccagagtggccatgtactgcctctggcatggcacgcccaaggtaagggtcagtcaggaattgcattttcagtctccttggggtcttgccctgttgtgcacagcattgtctttgca

SEQ ID NO: 6263 - DNA, 201 bp, Bos taurus
agactctctgggtccagttttcttgcatcttttaaatataaatttcataatgcaacagattattgcctaatggcttttctgtgcgccaagatgaaagtattaattttgtttagtctgtagttaaaaagtagaatttggggttttggtgttattactgttagaggtactgtacagtcacaccccacattttaagttctgatt

SEQ ID NO: 6264 - DNA, 201 bp, Bos taurus
acatgtatgtgctgtctcctagtttctgtgggacaggaatgcaggcaagatttaactgggtgcttctggcttacagtctcttatgaggtggccatcaagcggtcaccccagtcctgcagtcatctggggctggtgggtctacttccaagttcattcctgggatggggttgttcataggcctcacttgctgtctggctagtg

SEQ ID NO: 6265 - DNA, 201 bp, Bos taurus
ataggtccgtgcacacaccccatagccccaccttcctctccccttcctgattcccagcacttccccaccccctcctgaggcctctatttctagaaggcagagcaattcatcaatctatccctctccccaaacccagcccaagacctccttcggcctctccaaagatttcctttctctcgcagcagtataaaaaattcattt

SEQ ID NO: 6266 - DNA, 201 bp, Bos taurus
tgttgatgacatacagtctcaaaagagcctccgaactcatcagcacaaagctgctgctcctgtgctgcctggaagtggtgacatctgtaactcagtggccgggcacacagctgaaattcgactgactagctggagcctgggcagatcttccgtcggctccatggctggggagccaggccagcctagactacctggcagtcc

SEQ ID NO: 6267 - DNA, 201 bp, Bos taurus
gtctgttacttccaagactttcttggggccacattttggacattttatggagcactttccctcccaacccccacaaaccaaaagctgttattaaatttacgctgctgcttggccattttagagtcaagaaagtgtgggaagtgcatgcatggaggatgcaagttttcgattctgccaaaaggaaagaatgagaacatgata

SEQ ID NO: 6268 - DNA, 201 bp, Bos taurus
acctgggtggaaagtctgagagagtgtgtatttatcttcttgggctgatcatgtcaatgttatgatcagaggatcatcaggtttccctccttcaaaatgaggatgttaggccatgtgagaacagggagaatgtggttgtcaccaaagagtccaacaccccattattttttttcctgttctgacctttaatcaaagcagttt

SEQ ID NO: 6269 - DNA, 201 bp, Bos taurus
gctaattgttgtgcaaggtgcttctgccctcccccagttgccaggagagctcacagtcctagctcagcagagctctcattagcatctctgtgtctgtgacgcagtccctaaggggggaatcctcctcgcagcctggcaaacagccgaatctcctccgtagacccagagccaagaggctgtgtgccggccagcaacaaaaca

SEQ ID NO: 6270 - DNA, 201 bp, Bos taurus
actccccttatatgtgcaatctaaaaagaaattacacaaatgaacttatttacaaaactgaaacagactcacagacttagaaaataaacttatggctgccgtggtggaaaagatgaaattcagttccatccactagaacacaggcacaaatttccccaaccagaaaaccttcacaaggccctagttcaaccccacccaaag

SEQ ID NO: 6271 - DNA, 201 bp, Bos taurus
taagaggatgagccttgagagggggaggttgtcctgggttatccaggtagaccgaacggaataagggtccttagaagagggaggaggtgggatcaaggaaaggaaagctgaggtgacaatggaaccaaagactgcagagatgcactgtggaggcagggtcgtgagcaaaggaaggcaggcagcttccagaaggtggaacaa

SEQ ID NO: 6272 - DNA, 201 bp, Bos taurus
agaccctcagttagagtgatttcacatataggagcaattgaaaagtgggtgatccagtagcttcagatgaaaaactcatgtccctgtatagaagatgtaagcttttgccttatcaaaatgacaccttgcagtaagccagggacacgggccacctgcaaatgcatcactattaagcagaaattgtgaagcacggtcccctta

SEQ ID NO: 6273 - DNA, 201 bp, Bos taurus
cagtcaactattttcatcatctgtgtgctaaataccactcagtgtgggacaagcactatggtgagacagtaggttatccttactggagcaggatgctctccgcacacagcaggccagaccctgattagctaagacctaatatcaggtaaaaccctgagataagatagtaagaaactccacactcattttgggcagtaacta

SEQ ID NO: 6274 - DNA, 201 bp, Bos taurus
tttccagagggagcttgttagttaacttggcaagtgtgttaagtagaagtgtgttattttctcaattgaaagcaactgagagaataatgcgagctatgtgatattctaactatgatgtgccttgatgatttgatgtactgtgttgataagctcatcacactcccttcccatcaccttccttaaggtaggtttctggtctga

SEQ ID NO: 6275 - DNA, 201 bp, Bos taurus
ggggtcacaaagaaaggcctattagcttgcctgttcttttttgtcatccagtcctcttctcccctgcaataagatggaatagctccattctgagtatttcggatgttattatgggccacaccccattagtcagattttacatacccctttcatcacgggattgccctatttgcattcttaagttttcctcagtgaatcaat

SEQ ID NO: 6276 - DNA, 201 bp, Bos taurus
agcagggcttcattcagcagagtacagtaaaaatggatgcaaaatcccttacctctccatctggtcccagggcagactctcctccttctgcgttctcttccgccttctgcaaaacaatgtcaaatgttaggtatgaacccagaaggtgggtacaggaaggacctcatggcaactcagtggcaggcacataacagcatttca

SEQ ID NO: 6277 - DNA, 201 bp, Bos taurus
cttatttcaagagatgaactgtagagtctggccaaagaatccctagaaaaatataggactgcacattgctgaagggagatccaagaggaaggagaggacagagtggtttgctgtaccccaaaacattgtcttccgtccaactgagggctaactcatcaactcaaaggcattctaagacacaatgtaatattaaattaaagg

SEQ ID NO: 6278 - DNA, 201 bp, Bos taurus
ttagtttggtagctcctgagacaaccacagtttactgccttaacccttcaaaggtggcactgacagtatctaaccgagcagggtgtcacggtgacctgaccttggaagtgggttagtgggagctgagctccagcttgtgaatcctgttttcagtcttcatgtggttttaagatttagcccaatttccagactatcccatac

SEQ ID NO: 6279 - DNA, 201 bp, Bos taurus
atgtgctaggaactgcactgctaactctgatctcagcacaggatatatcctatcgtgggggttgaatggcttgtgaatatctagggtctttatctgaatggcttggtatcttgaagcagtgctctgtgtggaatggttctttctcagcaaatccctagaggcaacatccagccctcatcctgtggttcagaggtggtatgg

SEQ ID NO: 6280 - DNA, 201 bp, Bos taurus
aagccaggtgtagcctctaactcacaggctccttctcctgcctcacaccgtctctacggaaagttgctacagagggccatgcatcactgaagagcacgaacgaaggtcagatggctctcagaagggtccaaactgcattcaaagactcactggaagctgtctccttagtcaggtttcctttcagagtggccaggagagttc

SEQ ID NO: 6281 - DNA, 201 bp, Bos taurus
tcaagggactaaaataaaggatcctttctctcctgtttgcagcccatagggactgtgcccaaagaaagaccaatggtttacagccatcaactttctacctgaactgagagaagatgggatgatgtaaaaagcagttaaattttttcattctttttctttttatatatgaaattctccagagctagaggatttccttgaggg

SEQ ID NO: 6282 - DNA, 201 bp, Bos taurus
cctcatcatcactccaacactgggttaggagaggcaaaggctccaaggaaaggtatagaaataaaactcaaaatactaaaaggaagtactaatttcttccgttgatagtagaagctaaatagatggaagaggaaaaaaagatgacaagtacctatttactgtgaatgacacagaaagaaattaatttgcctttagaaattc

SEQ ID NO: 6283 - DNA, 201 bp, Bos taurus
ctctaaaaatcatgctttttctcttcatgacttttgaaaatgatcaataaatctaatgaatagacagtgccatggctgcatgcttatctcatcttattcccatatattttgataattttgtatggattgctgtttactgccatcctttgggtcacagtaaatattttaatcattatttcctctgtaattttctttaatgaa

SEQ ID NO: 6284 - DNA, 201 bp, Bos taurus
cgtcttaagtacctcatgactgggaaagagcattcaggccaagttctgggatctaagcaacaggtagatatagattctattgctcccacacctgtcatcaatatcaatatggccacagtggcccccagtttctgtatgtctgggttccaatattcaagttccagagacagtaaagagaatccagttgggccagctgtccgt

SEQ ID NO: 6285 - DNA, 201 bp, Bos taurus
agtggccaatgaatctttacatttacaaactgatattgcccatttcagagaattgtttagggcagtccctaaccagtatgaaaatctcctctttaaaatagtgtgaaagcagaggtaatttaagttccttctgatttagcttttattaataaacaaatctgttaaccccctggaagattcttttgagacattcaagctgtg

SEQ ID NO: 6286 - DNA, 201 bp, Bos taurus
atgaatgctgaacattttcaggcccttccttgattatatcacatgggttgatacatgggtcgatctgattcccgttgagatggcaaaataccaccacatcggctctctctctgactttctctcactgctgtcttatctcccagtgagggtctgcacttgtttggacactgttcagatcttacttatcgtggctgtcaaagg

SEQ ID NO: 6287 - DNA, 201 bp, Bos taurus
agccttgaggcccccacagccactcccatcagggtttgatttagagattgtcagaaagtgctttgataattgcacacgggcccccatcagtcaaaccatgctgttcagttcccattcagcaaattcctccaaatctagattccaaaagtcttaggtcacctggggtcactttgacctgggagagcttggggttctgagagg

SEQ ID NO: 6288 - DNA, 201 bp, Bos taurus
ggccctcctctaatccatcatccatactgcagccagagcaattgaagtggctggaaaggaccctaggtgtgctggctggatccttacctctcacacccaggcaggcccttcaggaagcagacacattttggcccctggggctctccagatctgtagctttagaactcttgcacaagtctgaggacttgctcttccaaacaa

SEQ ID NO: 6289 - DNA, 201 bp, Bos taurus
aggcacattaggtaggaaaaatgggaccagctttcgctgtcatttaggctgtggtttttttcctagcctatatcagcctatatcaggctcccagatgagcgaagtatagtagaagctgcattttcctttcatttttgctgaagaaaggtggatgattttgtcagtgaggaagtagatcaagtgccagcagccctctgagac

SEQ ID NO: 6290 - DNA, 201 bp, Bos taurus
atccagtggcttggcctgggcccagcatgcccccttggttcattccaaggctgggatggaggtggggagggtaccacagacaggcagacagctgctcttagagctcccatgaactggccacagttagtgaggctcaaaaactccgtcaccctgactgaccctcatactcccacagaccctggcaacgcctgtgttctgacc

SEQ ID NO: 6291 - DNA, 201 bp, Bos taurus
tggcacagacaaagccagccgtctttagaatgggaaaaatgaacaaaattcaacaattttaaagcgtgatttccctaattgggtggtccagaagccaaatgttctcctcacccctgaatatagaatccgaactgtagcctcaaaaatacttttctctagaaagtacgtcattgttcagtcactaagtcatgtctgactctg

SEQ ID NO: 6292 - DNA, 201 bp, Bos taurus
tgccgtggactgtagtgttttctgggaaattcaaagaacaagagaattgttggtcagctgctctgatggtagcgaagctaagagagggttcttagggagggtgggggactgtttgttgattcccatggtttcaggataagtgatatgtgaccagttgagggcactgaactagagataaagctgctgtgtggtcatcactga

SEQ ID NO: 6293 - DNA, 201 bp, Bos taurus
accagatgccccctgaggaacagggacaatagaaaaggatgtcacctacagagctgggagagtggcagggacacggccagctccaaagacatcaccaaagaagaaagaaagaaaaatgtaggaagagacccaagccttctctcttcctcttgcctcatttcctggcagtgtcctcaactggcagaacctggccaaggagcc

SEQ ID NO: 6294 - DNA, 201 bp, Bos taurus
cacacactcgtgattccaaagtcttactcatcaagctgccttggtcagcctcatgattttcttgggccctgtatgggtcttttcccactctgagtccttccagtctcttgtcaccatgtaaatggagtctgagttcctcaaagggggagttttcctttgaccatcacaaccataaacttcagaccttgacttcagtggaaa

SEQ ID NO: 6295 - DNA, 201 bp, Bos taurus
ccctctcttctgtaggatcacacaggcagccactgaactgaaataggaaataaacagcatcagagctaacagaccaacctgggagatgaactttccaggcgaggataccacagtgaagaaacacgtggacacttggctgagggggggactgaccggggtttgtaaatgctagaaagatgttcatggggttatgctaattaa

SEQ ID NO: 6296 - DNA, 201 bp, Bos taurus
aatgtgaatattagaccaacaaaaagacaaaaaaccttagtgattgattccgatgcagaaagtgaaaatgaaactgatgatactggagaatgttattctgctcctgcagatgcctgaattgagatatttcatgaaaattaaaaacctttacaggtgtgtcgggtgtacccgctgtatgtaataacccacacaatgttagtg

SEQ ID NO: 6297 - DNA, 201 bp, Bos taurus
cctggatggacgtggctagaaaatcggtagcctcattctgcttgctctgtatctctctagaggtggcccagagtaactcattcctgaaaggccagcctctttacgaagaagcgtgcagcaccttcctcagaggagggagtgcatgcgggcaccccagtgcaggcttccctggaccacccgagttcatctggagacccgctc

SEQ ID NO: 6298 - DNA, 201 bp, Bos taurus
tgaaagctctgccttagcttaagaagcactctttatggcaaaatcttttggccccggaagtcccttgacaataatgttaaaatgcttctacttaagaatgtgtgtggttgtgcgttttccttcgggacaatccctcttcctccccatttccataggttcttctgaatcccaactgtctctgatgtagccacctgcctctca

SEQ ID NO: 6299 - DNA, 201 bp, Bos taurus
actcgttgatcccttagagatagtggactacctgctggactacatgtctgaccatactgtagctgaatttgccttctagcacctgcccagcacaggttagagggtcctgggccttctcaacaagccatggtacactcaatacttgcatgtttcaaggccactgccattgctcaaaacactttggccactcctttacaggaa

SEQ ID NO: 6300 - DNA, 201 bp, Bos taurus
ttaataaatgaaaaaaatagggatatcaatccatcttccatctcagtgtgttgttgtgaggattaaatgagacagtataaataaagggcatagcacacttcctagacatggtaaaaaatgataaatgtttaggaagagtaatagtagcagtaggagtaaagcttatagtgtataggtatccttagtataatttcagaacat

SEQ ID NO: 6301 - DNA, 201 bp, Bos taurus
taggtcatttgctagtttttattaatcttaccacgtctttcctgtagtaggggctcatcatttattttagagatgttaatctcaaaaccagagcccagactatatatctcacctacttagatggacttagttcctaaaaaccgcaatacatttccttcccaacagattcttatttgataaggaaaagaacttcctttttaa

SEQ ID NO: 6302 - DNA, 201 bp, Bos taurus
ctagaaaagattggattttatgcaacctcttttccttgaattaacagcaataaaaaaaaaaaaaaagtctagaggataacaggccaagagtggtatgaaagttcgataaattgtcagatacctactgcttcttgctttctgctctgccatcccttacaaaaggcccagtatggctgctggaaatctgccattatgtccaca

SEQ ID NO: 6303 - DNA, 201 bp, Bos taurus
cgataacattcagtagcaattactgcatcaaattaagatgtatttcttgattgcctctgtaaattagacgcaagatatacaaagatgtatgagatatgatctttgctcctcagagagcttatagaattaagttatatgaatgataattccagggtatacattgctccctgtctgcaactcccaatggccaaattaagtgac

SEQ ID NO: 6304 - DNA, 201 bp, Bos taurus
gagctttgtatttgtactgaaatgtgactctgagcttaaggaggtcctttgcctgtatgtttgtgaatactccaagtccacagaacaatgtatgcagttgcgtacaagacaaatacgaaaactgttctaatgagaggattataaatattccaaactgagaggacagcttaatggctcttattcttcctttttcctcttccc

SEQ ID NO: 6305 - DNA, 201 bp, Bos taurus
gagcagattgaagtaacccctcaccctagtctttctgtgatgtagcttctatctgtcctggagttacgacctgagaagcaggcttcaagagtggcatacattttgtggcttccaaagttattctcagggcatataggctacagatggcatcctggcactcctgccttgctccagattgctggtatttcccagaaaagagct

SEQ ID NO: 6306 - DNA, 201 bp, Bos taurus
tgtcttggctcatgctgccgaatgtttacttctgactcataatgttccttccatgtggagggccttttattacagcaacattcctggcctttccctacccctttactcatccctcccaggacaggttaggtgacataacagaatgatgactttgagacaaggaattgaattgtgtggctcagtttctccctcttcttggga

SEQ ID NO: 6307 - DNA, 201 bp, Bos taurus
ttaacacagaagctcaaatatcagtcctatgaaggcagtggagttgtcaacaagttgcattttccaattctgttcagagtgagctgagaccagtggcccaacagtaacagaacttgtcattagggtctaaagaagcaccacattaaaaaaaggtgctgtccaactctgattttgccagcccattagtcccttccttccttt

SEQ ID NO: 6308 - DNA, 201 bp, Bos taurus
ccaccctcatgagaaaggtggttgtttttgtcacagtttcctttttcatagttgagggaactgagacatacagaagttaaataacttggtcaattttataggcagcaaagaactaggatttatatatataaatcacacacacacacacacacacacacatcatctgatcccaaactctgttgatcatttttcacatatccc

SEQ ID NO: 6309 - DNA, 201 bp, Bos taurus
aggagtccagcatgtattttcaagtagactggctgctgttatgggcccagtcaacttgaagtttcaattgcttttcaagcactgcttcattgaccatacttagcaatcacagaaccacccaggccagtgtgacaaaggctgggagagaactcgaaattctcttaaagaaaaagcatattttagcagttttctaaatcaagc

SEQ ID NO: 6310 - DNA, 201 bp, Bos taurus
tcctgtgccagacatcaatacgagtcacttggagaatacctatgtgaatcctaaatcactcagtcagtgattctgttctgagagttctcccttgactggattgaagaaatagagggatggaatggtagccagctggtgttcccatcaatgactggggatgaaacattgtattgcctccatttctccttttgaaaacctaaa

SEQ ID NO: 6311 - DNA, 201 bp, Bos taurus
tgccttcagatagaacactaagctgttcttcattctcaaaaaggggtctagctaatgaatatatcttcttacctcatgttcaaatcatacagtttttcttttggatttgaaagagatttcttcctccagaatccttttcaaatataaattatttaaaagaatttttgccttgggaaagagtagagaggtatattttgaatc

SEQ ID NO: 6312 - DNA, 201 bp, Bos taurus
caaatggaaggagaaacaacatattccctattttgacatatcaccaaggactacataaatgcacatctctttcactccatctcctttagtttgttataaatgccctacggtgaaacaaccttcccttctcgcccacagacttagctgagaatatagaagtgacaggaactgatctcctaacgtgaagaaacagcaattccc

SEQ ID NO: 6313 - DNA, 201 bp, Bos taurus
tttatatttcaaactggttgaaaaataaaaataatatttcatgatatgtgacaattacatgaaattcaaatttcagcgttcgtctcttcaggccactataacaaaataccacagattgggtgggttataaacagtagaaacttattgctcacagttctggaggctggaagctcaagatcaaattaccaccatggtcaagag

SEQ ID NO: 6314 - DNA, 201 bp, Bos taurus
gagaggccatattcacataacttctgttagagtatattgctataatggttctatttgattattagttactgttgtttgttttttactgtgcctaatttacgcactaaattttatcataggtatgtacagggaaacatacaaaaaaattacatacaagtggacccttaaacaacattggtgtgaactgtgttggtcctctta

SEQ ID NO: 6315 - DNA, 201 bp, Bos taurus
cctagtaacttaagacctgactaggagaatgcactcccctgatcttgggccaagaagactctgaagcactcagcatcttgactcagaacttcttaaaactcactagggaagaagttatgcaactggcccttaggtactaggaagtataagactgaagaatgaagaacaggaacaacttgtaaccactggaaggacattaca

SEQ ID NO: 6316 - DNA, 201 bp, Bos taurus
ttagaatcctgtgggagaccatacttcagtacactcactgcctgggaacccagaaagtgctcaattttgtcctcatccagggagggtgtcagaaatcaaagacaggtcatctgctctcccccgctgccttctgccccttttctgccttctcatcttttattcattttctaggttaaccaagttgggaactgatgaaaagcc

SEQ ID NO: 6317 - DNA, 201 bp, Bos taurus
ctctagtattttggcctggagaattccatggacagttcttgggggacactactgagcaactttcacttcacttcagaagttttaatagttctactttctatatttaaatattccaattacatggcctttatttttcttcatactatgaggtagggatttaactgcatttttttctatgtggaaaatcaacctttctcacat

SEQ ID NO: 6318 - DNA, 201 bp, Bos taurus
gctaagcccaagctcagatgacatggcaaccaggcagctggggaaagttatccaagaactgaccatatattgtgaagtgtggccatatcctaagggcagtatctaaatcagcaggcacttgggaaaacagcaacgaacatccatcgaaagatgtcattaatcatgtagagaagatgattcatctctcatttggccttttct

SEQ ID NO: 6319 - DNA, 201 bp, Bos taurus
taggaaatgaagtagataatgtttctagaataatatcctgttaaaaatacttttaactattagccaaacatttttatatatgcttcttcacaaattaatgttttcattgcaaatgatcatatttataaggaaacatgatagttaacaatagttaacatttattaaaatgaagggaaagaaattgtcaggttggctaaaata

SEQ ID NO: 6320 - DNA, 201 bp, Bos taurus
ttttaaatttagattgtcagcatcccattgtatattcccatcaactagacaaaggaattttggcaaaccagctcagattttaatagtgacatcaagttttcttttaaaattctagaaacaatacttagcctatcattttatattttaggttttattttccatataattttttccctcaggtactggctgtatttcctctta

SEQ ID NO: 6321 - DNA, 201 bp, Bos taurus
atgtcttgggtctttaaagcacatttacctgagaacaagagcgaggaagaaaattgttttggaggtattaccttggggtagcagcagcaaatcctatgtagaccagagttcaagtcgggtctctaccacctacctgctcaaagcccatgggtgagacatttaacctctctgagccccagtttctgtatttgtagaatgaga

SEQ ID NO: 6322 - DNA, 201 bp, Bos taurus
aagagaaatgaaggaaataaatctcatttaccagtgcatcaaaaagagtatttaggaatatatctccctaaggaatcaaaagacctgtcctctgaatactataaggtgctgacgaaagaaatcacagaaaaacagagctgaaggaattgggctccctgacttcaaactatgctataaagctacagtaataaaaacagtttg

SEQ ID NO: 6323 - DNA, 201 bp, Bos taurus
tctcaacttcctttccaaccacagagtgatttaaacttgagacttctgtctcctaaggagtccaactgcagtaccagcatgcgaattagctgtgtggcctcctggaagaccccacgcaggcttccctggttctgtgtggtgttttctgtcgaaccagcagacgagtgtgtgtgtgtgctgaccctgtcttctctcatttca

SEQ ID NO: 6324 - DNA, 201 bp, Bos taurus
caaaacagaaattagaaagtgttttgaactgaattacaataaacatataggatttaaaaaaattttggaaactgctaaaacagtatttaaaggaaaatttgtagcattgtacacctgtattagaaaaaaaggaaaggtctcaagtcagtgatctcagtctctactttaagaaaccaaaaggaacagaagagtaaataaaac

SEQ ID NO: 6325 - DNA, 201 bp, Bos taurus
ggaaacaaagtggatgcctgtgggtctatcagtattacgtggtaggtgtatgtgtaggtttgtagtcactatagccctcatattccagtcttatgtttttattttattgtcaatcaaaaattgtctttctaaatttttgtcagtctttaatttagaattgtagataattttatgcctccaaatagctaagtcaaattgggc

SEQ ID NO: 6326 - DNA, 201 bp, Bos taurus
tgggctatagtccatagcgttgccaagagtcaaacacaactgaaatgacttagcagcagagcctagtatagtttcttacttgtagcaggtattcaataaatgcttactaccaggatagagtaagatatatgaggttctgtttaagattccttctaactttactgtttgggaaaaacttacaggcaaagtagtgaaagatgc

SEQ ID NO: 6327 - DNA, 201 bp, Bos taurus
agagaaggaatccttactgtttgctgacccgtctgactgatcttgaaatcaatgaggtaaggtcattcaggacaatcttgcaaactgcttagcaaagcatcgaagctcttctgtggcttggacccaattaaacacaaacttgaattttccagcatcttctatcactctctcggcccatgcatctcctagactctagctgga

SEQ ID NO: 6328 - DNA, 201 bp, Bos taurus
ctgtttttcataatggaatttttcattttccaattatctttgtaattttaccacatacatctagtctgtctattggttatttacaacttttacaatttcatagagatgttgacaaaatttatagaatataaggatggtgaagttgtagcatgcataacacgttggaacgagaacttaagttagaccaaaactgaaaaactt

SEQ ID NO: 6329 - DNA, 201 bp, Bos taurus
actaattgccaagttgatctagagtgtcaaaaactgaagcaaagtagagcttttgtgagctttacaatgctgaagaggctgtaagatttaattcagaaatggtcaaagagaagaggctatgaaaaacatcctagattttcacttagaagccctgaagagctataatgtaggagtaagacagaaaccagaataactcatttc

SEQ ID NO: 6330 - DNA, 201 bp, Bos taurus
tttattctgcctcagttaaggttgtgttactttcagaagacatcctctgactctcttctccacaggctggattagatgccgctcaaagcggtgatcataacaatctgaattttcctggaaaagtgcttattctttgagttgtgattttgttaatattgtctttctccaccactatgatggaactcttcaagaagagagact

SEQ ID NO: 6331 - DNA, 201 bp, Bos taurus
taataacaacaacagccaccaataaaaaataataataaatctattcagagtagttgaaattcccctcccccttacaggagattatatatcagactgaaaatgactggagcacagataagctttcacaaatggtaatgcggactggaaaaggtcagttttcattccaatcccaaagaaaggcagtgccgaacaatgttcaaa

SEQ ID NO: 6332 - DNA, 201 bp, Bos taurus
ggggggaaagttagacacgttaactcactgagtatatattctggagtcattccggtgatttcctgtgtcacagagacagagagtcacaagatacatttcctagatttccttagacctaggtttgtcgttgagattacaccaatcagaagcacctgcagacaacacagaattgagaacggcataattatataacttcatagc

SEQ ID NO: 6333 - DNA, 201 bp, Bos taurus
gtcagctcccatacacttgatcatttttactattcagtttatctctgtttcaatagggatttactcatactctatacatagctgccaaactattcacttcggggatgactctttttgtctaacaccatagaatcatcagaagaagacataaaagtgatccttatttgtaggtttaagaaaaaagatttgctgatatatttc

SEQ ID NO: 6334 - DNA, 201 bp, Bos taurus
aataagcttttgctatctggctgggaatctaccctaattgctttgggggaaagatcaggttagaataattgacttgtacatacatataatccactcaaaagttggagtctgcctttgatgtactcttgcttatttctgtaaattacacaagatttgtgtgcatgcttatgtatgttcctttgtaaagagggaaaaaaggta

SEQ ID NO: 6335 - DNA, 201 bp, Bos taurus
aaaaaaaataaaaatacaaacaactaattttctccataaaacactgtaggaaatccatgggtactcagagaaaagcaaagcaaagaaaccaacacaaggagatgatacttgtgaaaaaaaaaatgttttcttagtaaacttttgtaaaacctaggttaagtaaatgaagctcaaagaatgtaagacatatagaaaagatag

SEQ ID NO: 6336 - DNA, 201 bp, Bos taurus
atagatttgaggagatgcttaatggccttgtatagccaactaaagaaaaattaaatcatcttgtagaccagaagccaatgaaagtgtttaaaaaagaaaataacatgatcaggttgtttattggaaaggttacaggctaagaaaggatgaaagaggatccatcctgagacacagacaaacagagaagtttctgaaatagtc

SEQ ID NO: 6337 - DNA, 201 bp, Bos taurus
atctgttagtaattacatacaagaatgaacattttcatagtaaaagtatatccctcctccttgctcctctttgtagtagtataaatctagagaactgagacctcttctactgatgtaactaaaatatatgcaagtggaaacatatagcaattttaatgtatgttttgctacattactttcaactaaaagtaatcttttaaa

SEQ ID NO: 6338 - DNA, 201 bp, Bos taurus
tcaccacttcaggaaagaccaatccaacttcccaaattcagtgcctaaatgtattttccagaagaactttttctggccactgaagccctctttagtacccgtttaatagaccacagaagtaccacctacctacctccagttcagttcagtcactcagtcgtgtccaactctttgcgagcccatgaactgcagcatgccagg

SEQ ID NO: 6339 - DNA, 201 bp, Bos taurus
atattcccttcaggccaccagagctgtatgctccaagggtgctctctatgtggctctaggagctcttctgttagggtgggctgactactgtgggtatgctggtaggcttggctggcttctggcctggttggttgccaagccctgcctaatgtggctgttggaaagtgtggagggtcttgacacagttgtctgcattgcctg

SEQ ID NO: 6340 - DNA, 201 bp, Bos taurus
caatcaccatctgcagtggttcagaaaaacaatattatgtatatgtgtgtgttatatgtttgtgtgcatgtgagagagtgagaagcggggagggaaaaaggatacaaatgataaagctaatgggacaaaatattaacaaaagttgaatcttggttaaaaacagttttgcttactattcttacaacttctctgaaagtttga

SEQ ID NO: 6341 - DNA, 201 bp, Bos taurus
ctggacctcctgccgcctggtgcaatacatttgcatcttgaactgaacttccttcctttctctgcagctgcaacctgagaagctcaggttgggcccaatcgtcattgctttttgtctgtgtccttctatcctacatcagggaaaggtatgtttcactgaagcatctggcctctttcgtttctttttggacagttgcaggca

SEQ ID NO: 6342 - DNA, 201 bp, Bos taurus
agatgctgcaagtatagcccccaaatgaaagccagaaaatacagagagaattacgggtcactccttagtattctcagattctggccttatcccaagattttacttcctttgccgatggtttatgtgctacaaagaataccttgttaataatttgattcatttaattctcagtgggagtcttttatcatatcagaatcacct

SEQ ID NO: 6343 - DNA, 201 bp, Bos taurus
tgttttagaaaaataattacacgtcttcagaagcaatttagactaatttgaattaggtctaaatctcagcacttacataggtaggtgaaatacaacgaagtttaccttctgtccccttcctacccaccttttcctttcttagaccgagcctggctgatagaaccaaggaaggtccagaagcttcaggaaaaaatttatttt

SEQ ID NO: 6344 - DNA, 201 bp, Bos taurus
aatctacagttatagaaatcagtatcatggtaggggctggagactgcctggaaagaagcatgagaaaactttctggggtgatgccaatgttttctatcgtgatctatatgagtgtgtatatatgtatactcatacatatcatatatatttgtcatactcatatatatgtcaaaattcatcagtctgtatgcttatatatat

SEQ ID NO: 6345 - DNA, 201 bp, Bos taurus
taactatataactttaagtctataatatgatatgggtggggaggacacaatgaaatatctatcttaatattttgcttaggctaatatagaatttatttcttcaagaaatatggcagagaagcacttaagaagggcagacaaatttaacaaatagaaatgcaagtaaccctaaactgcaggaatggtaaagagaagaaactc

SEQ ID NO: 6346 - DNA, 201 bp, Bos taurus
ctccagtcctcatccacttggaactagtcattttacaattatttatggaagtgttcccaaaacttataagccaagcactgataaattaggatccaggcattgagagcaatatggtttactgcaagtcagagattttaagtagctaattcagtcttgtaagctcaccatgtatgggggcaaaacatctagtcttacttcact

SEQ ID NO: 6347 - DNA, 201 bp, Bos taurus
ctggctagactttataagccatatggtatctgtcacaactactcaggtctgccacggtagtacaaaagcagccatagataatacgaaaacaaatgtggccgtgttccaagaaaatattatttataaaaacaggtggtggactggacttggcacacaggtccttgcttcccaacctgtgctgtagatgaggccccttctgcc

SEQ ID NO: 6348 - DNA, 201 bp, Bos taurus
tacagatttgacccctgtgtgtctattgggtaagtaggaagtgagtcctttaactctgttctatgtctctagagattctctaatcattttcttaaatatagtgtatatctttgtccctatatcagattttaaggggttctgctttaaataaaagaaaacattttatcatcatgttatggtgctagcttttgtttttataga

SEQ ID NO: 6349 - DNA, 201 bp, Bos taurus
tctgattcactggtatttcttcttttcttataaatgatgctttctgataggctacgagagtctaacattgacactgatcatctgcatttccctgttaactttgactttgtgcttgttctccttaattttgtgttgtaaatacatatgcagcagtaatacacagacaactatacgttgtggagtcaaacttcaaagtgtctg

SEQ ID NO: 6350 - DNA, 201 bp, Bos taurus
gagggctccacaattttgtaaggtgccatcactttgaatgaattaagagattacttatttaattgaaggagtctgtttagtcagtctattaagtaagtgtagtatactaataaaatgggactgaacctggagtttaactgtgaaattaatttatccttgttatgcatgactctcattggcctagataactaagaattacac

SEQ ID NO: 6351 - DNA, 201 bp, Bos taurus
aagagtcaaagacacacaaaggcatatatattcctaaccccatattataatatcctctgtattttcctgttctcatgtttcatcaaagaaaccttaatttccccttccttagaatttctaaaatgtcacatttcctcttttaccttccacatttgtgtaacaaggcaggagtgtactctagaaatctcaatgcccccaaga

SEQ ID NO: 6352 - DNA, 201 bp, Bos taurus
tctcaagaattttcatcaaatataataataactttcatttttacaactttgatcagtaaaagaaatgaaaaccttaagtttctgtgtctgctatccatattctcagttcctcctagaaaagacttgttcattgattggatgttggaggggggtaatctggtgaggaaaagtcagatagataatagatgatagagtcttctc

SEQ ID NO: 6353 - DNA, 201 bp, Bos taurus
taggtagcaagaaccatacagaagtagattcagcaatggagtggttgagtaaatcattgaattacttaatttcaggcctcttgttatttagaaaatataaaacactatttgattaagtcactgtcagtcatatattccatcacttgcagccaaaacaggcctgtttaaattccacacttgaaggtaccaattagaataatt

SEQ ID NO: 6354 - DNA, 201 bp, Bos taurus
attctgtcaacacctcacaccccaggagcaggggttaggacttgatccctggaagctgtgtagttaaatttgcaccatgacacagcgctagaacatgtgagcttggtaggatctggccttgataccacaaaagccattgtcctgaagagctgtcagacacagccagctgcccaacaccctgactgcagatgccacaccaat

SEQ ID NO: 6355 - DNA, 201 bp, Bos taurus
gaggctcttgttaagtatagcatttctagcccttccccttaaagtattatctagtgggcttggaaattaatgtattcaataacttgaatggttcctatcaccagagaagtctcagacctgatgttagaggaacttttgaaggcaagtgtggctgaagcctaaaggttacggggttgttggatgagagcaggacatgtccat

SEQ ID NO: 6356 - DNA, 201 bp, Bos taurus
aaggtaaggtaaaaggacacttctagttcctaccagtctcaatgaattatgggaagaaaaagttggaggtagcgaaacaggttgtgagacgtgttggccttagttctatagcagggaggtggtatagataaacccaggggaaatccaagatcagagaggcttttgttcacttctcacttgtgaccatgtaagcaggaggga

SEQ ID NO: 6357 - DNA, 201 bp, Bos taurus
caatataagaaagatggagactccatggagacttggaggaaaaaatggggtcccaatacagggaaaactgaattctcccagaaatgagatagcatgcgaggactgtctggggttcagccattctttcatttactttctccaggtataattttgagagcttatcttgtgcaaaatactgggctagacaccagagctttttcc

SEQ ID NO: 6358 - DNA, 201 bp, Bos taurus
acttccctcagtgccaagtttctttagaaaacactggagattcctaaaatgtatcaaagctttggaaaattgctctcataactgacaagaaacacaaatgcgctcaggcacccacgtgtgcatccatcatttgacaacatcttattcaaaactgtctcaagacccaggaatgaaaatagcaatggctctcctaccagatcg

SEQ ID NO: 6359 - DNA, 201 bp, Bos taurus
actggagcagttacaattattttttaaaaaaagaattgctgcttaaatgtaataagtagcttcctgattattatatagatgaaaaggacatagtagatgtcaatcctggggactgttagttattccttgagagcctaacactttcaaattattatgtaatgaattgaagttggaaaaagcaataatatgaaaggtctttga

SEQ ID NO: 6360 - DNA, 201 bp, Bos taurus
cctgcataataaaagcatgacaacacttgatctctaaggcctcttctggttccaacattctctgtcaatctactcatgttaattttcaaggtttagtttccaggtctgcaatgtggcctttctacactggtaggataaaattctctatttggttcaaagactgaatatgttcatgttgttgactaatattttattgacagt

SEQ ID NO: 6361 - DNA, 201 bp, Bos taurus
caacacacatcatttaggatataattggctgctgctggcactcacacaagctgtaacattttctatcagcagatgagtaatatctggagagtcaagtaaacaatgacatgctgcagaaaataccttgatttgggaaggaaggaaacatataacaaaccagctcttttccatttcaaacaggtattgagaaagctataatac

SEQ ID NO: 6362 - DNA, 201 bp, Bos taurus
ggtcactggcgttgctcaggccggggagagagtggcaggtggtccctgcttctatttccctcatcctcaccctcccattaatcaccctcttctggaactcctctcatgcaaattctctggccctcaacacataaggatataagaaaggcttttgtgtaacttggaaaaggaaggttgcagcccagaattgacacaagtttt

SEQ ID NO: 6363 - DNA, 201 bp, Bos taurus
ttaactgctttaagtcaggaaacagctgtcattaattgacatgcatctcctgtatgtagtcaacatgattcagagatcttcatcactagcgaaacattctaacacttctacaaagagttatacaatttggctcattctgtatcaatagctcatctgtataagattttggaaaagtaataaaatatacagaatcctaagaat

SEQ ID NO: 6364 - DNA, 201 bp, Bos taurus
ttctgcatatttaaatatattttaaattaaatacattcaatataaatataaaattgttttgggaggatccttgagaatatcgtgatatgattgggggtgacagggagaggaagtatatagtttgataatttaaaccattctcatggggtagataaaaaaatacttttttcccctagagaagtccagaaataccgatatggt

SEQ ID NO: 6365 - DNA, 201 bp, Bos taurus
acaattaaaaagactttctctgggagggggaaaaaaaagggcaatccaagacatgcttcattagaataaagcaactgaataagaaaggctaaggaggcccgaagggaaacatgactcaggagtgtcatggatcctgaatccatgggggagtgacatctttatagacaatgacacacagccctcttaactacacaggggcca

SEQ ID NO: 6366 - DNA, 201 bp, Bos taurus
accacattccactctgtatatggaatgttactcaacagatgtgaaaattgcttttgtagattgacgttactgagtgagtctagtgaaaaggtagaaagagagtgagggagatgaaggaaagggaaagaacaaaagcccctacatttctgccagtgcctcatccagctcatgagttcctctcccagggcagggcagattctc

SEQ ID NO: 6367 - DNA, 201 bp, Bos taurus
caagaactgcagaggcccatgtggaagaagcaatgtgcttgctatagctgggtcagtcttaacttccaagcaggcagagatgcatctttgaggtgggccttctctttctgggtttgaggagaagcagcttctgagaagagttatcgccacggcacccacgcctcagccagccttagacttccgccagatgaggagagggcc

SEQ ID NO: 6368 - DNA, 201 bp, Bos taurus
ctatgggtattttcaggtgagaagttggacatgatgatctcaggtgccatgactcttaaaggagtgggtgactggaaggagggtggtcttgatgttaaactggatgctcctgttcttaatggccgcatctgtggtccttccaggtccgtgggaggcatccgggtctctctgtacaatgctgtcactgtcgaagacgtccag

SEQ ID NO: 6369 - DNA, 201 bp, Bos taurus
tctttctctagctttgttagagccctgtggcttaaacttgggtaatctgatgcactccatttctctccgcttctatccaggcccatccgaagatactttccgtagggatcttgtgagatttaatcaattattattaaagggctgaaagatccttggatgaaaggcatgaagataaaagcaaagtctggccctattattatc

SEQ ID NO: 6370 - DNA, 201 bp, Bos taurus
tcagtcacccagtcatgtccgactttatgccaccccatggccaggcttccctgtccctcactatctcccaaagtttccccaagttcatgtccattgcatcggtggtatttgtatccatggggccatttaattgagaggtaggagagatgagagaagacagttaggcaagagcaagagatagccctgtgtcttagttttctg

SEQ ID NO: 6371 - DNA, 201 bp, Bos taurus
aggtacacagaaatcctatgactcagatggggaagagtctactttcaaactcagctgcatagttgttagcaatgttcagctctttaaggactgttggatcgagggccttggtttctcagctggctgtggcctccctcggtttcctgctatgtgggcctctctgttgggcagattacaaggtggcagctcacttcattggag

SEQ ID NO: 6372 - DNA, 201 bp, Bos taurus
ttgcaggaaattagaccagccagtttgacaccagttaaatctcagaagcatttttaaaagatcaaatgctggaacatttaaaaagcacagcttgataacagtcaattaaggtagcctcaggatgtggccaggagattttagtaatttgtgtgtgtacagcatggatggaaattctaaaaggcattgccataagagtcaaga

SEQ ID NO: 6373 - DNA, 201 bp, Bos taurus
caagtgtgtacctgagaaaataccttgctcaggcatacagtgctaccaggtacatagtctcaggcaggagaacgttattgatagcattgtttgaagtagcgaagagatgaaaacaaactagaaatgaataaaaagaaagaatatgtataaaatgtaaaatattctcatgagggtctattccataggattccaaagacttaa

SEQ ID NO: 6374 - DNA, 201 bp, Bos taurus
ctctccagccctaggataataaaagatttctgctcttgttgcggttttgtcacttgcctcactgtgaggccttcaggcctcctagcttcttaggaacagatcctcagtaccaaaacctctctactcaaattcttattgggaagtgctgtcttcctcagtggcctgttgtaaacacaacatagtaatcttcattcagttcag

SEQ ID NO: 6375 - DNA, 201 bp, Bos taurus
gtagtgactgcaccaatttccactcccacctatggtggaggaagattgttttttctccatatcatcttcatttgttagatttttttgatgatggccagtttgacaagtgtgaggtaatatataattgtagttttatttgcattcagcaatgttgaacatcttttcatatgcttgttggccacctgtatgtcttctttggaa

SEQ ID NO: 6376 - DNA, 201 bp, Bos taurus
aaacagaggagaattggaggaaagcatctttttatttaaaatgccaaggaggatgtgagacaaacctaggaaagcagaggtgatcataataaaataatgctgctaaattatacatgatagtctgtgcttctctggcccttttcatccatggctatcaaggccacaccacagacctggttaggccctcttgtcatttctttg

SEQ ID NO: 6377 - DNA, 201 bp, Bos taurus
gaagcttaattaacttataatatgtggtcaatttggatggcaaaacccatctttcttccctgtgactcaaacctcctgggctttcctcataaaacacccacgtcctatttgctacccatgcccagttgccgttcgtttgtgttgacagtttcattgtttcctgctgacccctgtccatccacaattactgtggtatgtagc

SEQ ID NO: 6378 - DNA, 201 bp, Bos taurus
gttttgagaggtgggccaggacagatggtatggaacaggcgagatggttttctgatcaccatggcagcctttgggggctctcagaggagagcagctcagttgtgaggctagagattcaggccctgtgtaatgggtgtccagctcgactcccaaaggtttcctgatgggatctagagagtgaatgtgcatccctccccaacc

SEQ ID NO: 6379 - DNA, 201 bp, Bos taurus
gtgggcctctcaaaaagccagttcatgtgctgcacagcagagccgtcatttgggtatttattgggacagacaaaagacatttactgtctaagaaaccactaaactctctggccagcaccagcagaggagttgggagacaaagcagagtgaaaaagccaggtgtgatagtcaatgtatctcagccttggtggggcacacttg

SEQ ID NO: 6380 - DNA, 201 bp, Bos taurus
gattcttacagtaaactcaagggtaaagagcctttaaaaattaatctaattcctcctgatacacttttctagggagatcatgacatagtgtgcagccaagcggactttgaaaaaaacatcactagcagctatttttcctgatcatttaaaatgccagttgcagatgtcaaaggcataattggcctgaacctgtactggaaa

SEQ ID NO: 6381 - DNA, 201 bp, Bos taurus
tggaggttcctggttgagcttgagggtgagcctttgagagagagactcacccagcccggcctgaagggccgccagcctgaggaggtaggccttgatatgagtttcacctgctcctccaggacgggtctccccaggaaatcacggaggtggaagtctgctcgcgagaaccagggcagacagatccagaagggcccagttcag

SEQ ID NO: 6382 - DNA, 201 bp, Bos taurus
agcacgcaaggcatccctgtccttccctatctcctggaatttgctcaaacttacagccatcctgttacttgatctttacgtactaaattctattttttatgaaaggttttctgttttaagtggactaaattaaactttctatatacatcacagagcctctttatacgtgagctttctttcccctgtccaaacttttgcaat

SEQ ID NO: 6383 - DNA, 201 bp, Bos taurus
gctgcaagcccacacgtggcaaattacggggcaaagggcggggccccagcgcatgacccctcctgaactctctagcagccgaggcttcccactgtgggtgccaggagtttggcaccagatgggccaccatgcagagactgttcaggactgtgggggcctcctcctccagagctcatcctgtctagcacctcatcatgcagc

SEQ ID NO: 6384 - DNA, 201 bp, Bos taurus
ataaagagataggacaatatgaacttataaatatatatctgctctcataatttatgctttacagacatagcaatagggcctatagcataggatactgaaagtatgactccccaaacccaaaattacagttctagaacaaactattcttgtcagttaggccccctccagcttagaagcaattactggagccacagcaaaaac

SEQ ID NO: 6385 - DNA, 201 bp, Bos taurus
cttgagtgatacaaataaaaggttttgtctgtctgatttgaaaggcgttaagaatggaagtaaaaatcagaaatgaaaacatttaaaaactggcaagcactttaacattgtaattgcctgtgcttaaagacccaagatttattatggactcaatactctaaagattttcaagtcttcagcataaccgctgggttatctaca

SEQ ID NO: 6386 - DNA, 201 bp, Bos taurus
atcctagatcatgttaagtcttttcatgtattagattcccatcacgggctgcccagacatttatttaaagtagatacccccatctccacccaggacatctatctgaatagggcactgtagaaaatgaagcccaggtgcctttatcacttgttcactcgctattctcttttaatttccattctgatcaacatagtagcatag

SEQ ID NO: 6387 - DNA, 201 bp, Bos taurus
ggccagctgttaccaagccagcccctttcattcagggcacacagacaaattacattcccagaattcactgcagttagttgcggtcatgtgaccgggccctcaataataaaatgggagaggaagtgatattctctactttcagaattggcaataaaacctcccctgtgattctccactagcactctttcctcataggccagt

SEQ ID NO: 6388 - DNA, 201 bp, Bos taurus
tcttcccttacacactgcttgaaacctgaaaacagattctctgaatatttttttctcgagccactcaattaaaaaacttccagcctttctcattttagatcgtaaacacatacttgaaaaatgaataagaaacagaagattggtgttctgtacacaagagaagatatgtaaatgtaaatgtactgcatcttacactaaact

SEQ ID NO: 6389 - DNA, 201 bp, Bos taurus
atcacaatcgctgcagggtgtcccacaagggggccactcttcaccttgtaatgtctaaccataggagtgtctgaacagcagagattgatttacaacccaaagtgtctggtccccaagggccacttgcttcactctagccttcaagaatcatatttcacagtcccagataacctgttcgggtaacagtcaaactgagcacca

SEQ ID NO: 6390 - DNA, 201 bp, Bos taurus
gatatcatacagtatttgtccacgagaacttgaagttttcttatctttttaaagatgacaacaacactttcccaagctgatagagttgttactgggagtcaataaggcaacatttgcacagaggtgatggaatagctagaatgctacatcaacagtaggttttaaaaaacaatacatactattaaaaatgttatctatcaa

SEQ ID NO: 6391 - DNA, 201 bp, Bos taurus
gggacaaaatgaaaatacaggccctggctcaaaaattgagcatttaaagatggtggagagcagaggatgaaactaagggtgagacaggttccttttaagagcagggccagcgcagctggctcagaccacacaccatgaagctagtcctacatttctgtatcccctcttatgaataactgcagaagaaagcccaaaatttaa

SEQ ID NO: 6392 - DNA, 201 bp, Bos taurus
gcattccagctccaaggcccataagcttttcactctgtctcaagatatatgcatcttgtacacacttaaaacacagttttacatttattagcttgtatccaaaagtaaactttaaggcaaaactaaaacatactggttttgagtcaatttcataggtttacttacacaaagagctttcccctctcaaaatattaaggttaa

SEQ ID NO: 6393 - DNA, 201 bp, Bos taurus
tagagagaacggcttgttcggaaaatatataagctcccctaaatggaaccaaaccaaacagcattattttcttttctgaggccttgagtgtttatgttgtgatattacatttacacagatgttattgttgatctgttgtgccaaaggatgactttgaagctctttatcaataattattgctttggccaatatgtatgtacc

SEQ ID NO: 6394 - DNA, 201 bp, Bos taurus
cctattcctccaccatcttgttctttcccctaagtcaaaagttttaattgatgagtccacagttatagaaagctcttttttgagatacatttttgttgtgccttcagtattaccaggaaaagattcttttgtgagatataatttcaagcattttttgctttatgtagtaatttttgttttcagaagctcaaaacaaaaatt

SEQ ID NO: 6395 - DNA, 201 bp, Bos taurus
aaggtgtggtctaggaccagagttctggagtggcccaagagtatacagtcaggagggatgagttagggtccagaggaacagtttagaattgaggtgaattggggcccttcagctctgagcaaagctatggaactagcagaatgctaggggtcaggagggctcaggcactaaagggaaagctatagcctgccaggaccaatc

SEQ ID NO: 6396 - DNA, 201 bp, Bos taurus
cagtataaacttaggagagtctctgtaggatgatataacaaagcatggttatttccataattgcatttggtccagctcttgggccaccacatttctgatgctccagtgaagtagaaaagagctcatagattttcaaggctgccacccaagccagaggtaggctgttaacagttcaagacaggagaaaattgtaatatatgg

SEQ ID NO: 6397 - DNA, 201 bp, Bos taurus
cttctgcatccattctctttgggaaaaatatctccttttttcccagagtcaaatagtttcactcactacaaatccctcatacagcaccccaagaacacaaactcagtaacagacaatgagaattaacacacataaaatcacatgatggacacaggaagagagccccagctttcatagtttacagtgtgtttactcgtaaac

SEQ ID NO: 6398 - DNA, 201 bp, Bos taurus
aaggtcccacgtgctgcatggcacagccaaaaaaatcaaaaacatcaagaacatgcaggaatgcttctaatgaccactggtgttttttgattaatagataagtgatttgttttaaatgttaaaatttggtaatgaacaaagcatttgttccttaaataagatattgactgcaagtttaatacactctggtcgtctttccaa

SEQ ID NO: 6399 - DNA, 201 bp, Bos taurus
tatcaataggtgcagaaaaagcatttgacaaaattcaacatgcattttcagcaaactaggattaggcttcccacctgacccaaactatcactggatagatgttaaagtcctgacactcctccaggcttcctctgataccatcccagcagggaggtggaagaataaactccggggggctggaagtcccagctccctatgtgg

SEQ ID NO: 6400 - DNA, 201 bp, Bos taurus
gctattcatgctaaattgctccgtcccagaccaatgagggaggagatatgtttttaagtttactgcacgtgccctcagagcaactgccatcctctgggccggtcacagtgcccagggatacagcataaatgcaggggactgttgactttggtaatactagtctctctcttttttaaatcactgtggttatggaaactggcc

SEQ ID NO: 6401 - DNA, 201 bp, Bos taurus
tcacaaaagtgtaagaatatctatttcatagcacatgagttcaagatgccccaatttaatcagtctacgtaactatcttgagtccttgcagattacctacctataaacgtcaaactggaggctggtgtaaatactagaatgactagcttgattcagcaggttattttctctgcatcatactcctcttcaataaggcatcat

SEQ ID NO: 6402 - DNA, 201 bp, Bos taurus
gccttaataattttcatagtgttttacaatgagtgatattgagaagaggctagagggctgtgaatgaggaagattctcctagcaactaagggactggacattggggaggtaattgcttttatgtgtgattcagagtgggacagagatgattcaaagggctagctcactgatgtttctgttagttatgagccgaatttgtag

SEQ ID NO: 6403 - DNA, 201 bp, Bos taurus
gcttcttctttatttgccctttattccttcagcacagaaatgtgtcagcctttaggggtgttttggaatacccctccccttagcttagcaaaataaagccaatcattattaaggaatcataggtcaggagtcataggtcagatgcagcgaggaagggtttctgcatgtagtttctggctcaggatactgggctcctaactc

SEQ ID NO: 6404 - DNA, 201 bp, Bos taurus
aggtcacctttagactcacaagcacttcattatcccaaggaaagatatgagacctaaaagggcctcaaggaattgttgacttaaaatgtcattctttgaagaaccctagattgatgccagtgacatggctgtagtggacatgaagagacaggctgaacatagcagaagagttgggtgctggtgatgactttgcccaaatcc

SEQ ID NO: 6405 - DNA, 201 bp, Bos taurus
ggctctgccaagccgagatcttctcttcccagtcggcatagtgcctcagggcatagtggctgagggcgggtgctgcatcaccgtctgggccaaagaaccttgtgtaccgcctgggtggacagaaggggaggcatgagaacacgggctccactcagacccccagcaccatgatccgtgtacactcgcattcccgtcacctgt

SEQ ID NO: 6406 - DNA, 201 bp, Bos taurus
tctgctccagaggtgctggccctccctgcagtccctcagcatcatactgagctgagtgaggattacaggctaaagcagaggacatgaggggccaagagagatctgggtttggtgaaagagcaacagggtcatgctgtaggtggaagttgctccagagttacaggccaagcaggtgactggcttctggatagttggagatct

SEQ ID NO: 6407 - DNA, 201 bp, Bos taurus
gcctctctgattttaagcagatgacttctgtgagcctcagctttcctatttataaaatgattgggctggatgagataaattctataagccctgattctctgtagccttagagtctaagtctggcctaaaatcaagtaagcaaaatgaatgtattcataatcctggatgccattagagtagtcaaatatatgtgtagacaga

SEQ ID NO: 6408 - DNA, 201 bp, Bos taurus
agcagtcacttgggacctcagagtttcctgccacattgccttgtgaagaaattctgagacctttcctccagcatggcctctggttccaggtttatgtaggcgggctcctgggaaggatcataacactccagcccccagggcacaagccaggccctctctggagagtcagccttgttggaccctgcatggtcaaagagctgt

SEQ ID NO: 6409 - DNA, 201 bp, Bos taurus
tgacttaaacaaggaatcatcctggacaaagggccctaattaatgcatttgctaattagtctttcccttctctcttttgtcaagccttacttccaagacaatactataggcctgccttagaagccgacagagaatgggggtggggagcagaacagctaaaacatttatgtaaaagtacttacaacagtctttattcaaaga

SEQ ID NO: 6410 - DNA, 201 bp, Bos taurus
ctatatgaaacttttccagattctttaagaaggttaaatctctccctctttggttctcctgcagcactttgtttattctgctaggataacacttacctaactgagtcttatagcaggcccctgacacacacctttatgattcctgctcgttattaactgtataaggcagagtatgaggagaatgtttaaatggggagggca

SEQ ID NO: 6411 - DNA, 201 bp, Bos taurus
ttacttggccatgctgtgtggcgtgcgaggtcttaattccccaatcagggattgaactcacagagtcttaaccactgggtggccagggaagtctccagggttcaaacatcacaatgtgaaggcaagttttaggctgtccagtgtgccagaagagaaacttcgtgggttccccttgggacttgattgctttgcgacttaggg

SEQ ID NO: 6412 - DNA, 201 bp, Bos taurus
gctggggccgcgggctgctgacatgccagcccatccctgcccagccctcccctcccacagaaaggccaagtcaggtaccagggcctctgagaagcaaagcgtagctccgactcttattcgtaagcctctgccggttctggtatcacctatgccctgcccctctcctgggccatcaggatcacagaagggagactgcaacac

SEQ ID NO: 6413 - DNA, 201 bp, Bos taurus
actggggtacacgtgtctctttcaatcctggttcgaggaatgactttcagccttgtcttctgaataaattctattctgtctgcagtggaggagcctggccctgagcacagccctgcagtgcaaagtgagaggagcacagctagttcagagcagagggggacagtcactgccccaacttcggctcaggcctccagagaccat

SEQ ID NO: 6414 - DNA, 201 bp, Bos taurus
gaaaactggggatttggtatagagaattgaactatttggagtaatggtattccagaagcacatctgaaaaagtaatagtgtgtggggttagattaatacagattctagaggatggagaggattggggtggaatttgggtttgcacagacattatgcttaaagtttaaatgatatatttattatcttcatttattcttttca

SEQ ID NO: 6415 - DNA, 201 bp, Bos taurus
gtcttttggattttacaacagcagttaatccatattttttaatagtgttgaggagccagggatctttggttcctagatcccttctaagtgcttagaagctgcttggagaaaatactaagtgaaaggaaggaaacagccctttattgaatacctttattggatagctagatactgacagatacctttatccgattcctctaa

SEQ ID NO: 6416 - DNA, 201 bp, Bos taurus
ttgcatttccatggtttaggagttcatttttttaaggacagtattaagtcagttttgtaattagtgatttttaatggtcattttgagttttaatgatgaaggatgttgagatacaaagggcagctttgaaagttacagcagagcatgctccttagatgaatcctttgaatgaaagaataatagtatggatggtgatgatga

SEQ ID NO: 6417 - DNA, 201 bp, Bos taurus
ggcttaagggatgtgggtatccacctcatctcactgcaacaagaccactcagagcgtgagctgtgtctcctgcagttatgggccctggggactgggtctgactcctttccctaatttacaggaaaagagcaggactggctgatgctttggcagcaaatcaaaggaggttgctgctgctcccagattggccaacactcctag

SEQ ID NO: 6418 - DNA, 201 bp, Bos taurus
aggcaaggcctgtctgagccatggagaggcagcgagagagggagccagtcatgcctgaaactgagagaggcagcccagctctggaagaggtggggtaactgtaaagaagtgtgcagactctggggccacaccgcctggagtcctggtcccccgacaactaaatatattccacggtcaggttatatatagtcttctgggttt

SEQ ID NO: 6419 - DNA, 201 bp, Bos taurus
attttaagttctggaactctgtcactcagttctctgcccactgtgacctgtagctccctttagcaccataatatggtgtggagatagaaccatgagatacgtgccagatacttcagtaaatgtgagaggtaccttgatccttcctgcaattatatattgaaaaattagaaaaataagcaaaaatttcaaaaataaaaattc

SEQ ID NO: 6420 - DNA, 201 bp, Bos taurus
agagaacccagggtcactgatttctcccctacaaagccccatgagtgaccctttccctgcatttctacttccctcagggcctgcctatctcctaacacgctgaatacagccaagacactggagagcagaggtccagtttcacttctgaataaggaaggaaagctcttaatcttctggagaggatgccagggcccggctcca

SEQ ID NO: 6421 - DNA, 201 bp, Bos taurus
ggaactttcagatcagaggcagagagagcatccaggcctggacgcagcatgctgtgtgcgtctgcaggagtcactgcccttcctccttcctgcctgctgtacatcttgctctcgtagcttagaggacaggatagaccgcacgtaactgtgatgcgcagcaggatgaatcccttttgaggagagtcaaagcattaggctcgg

SEQ ID NO: 6422 - DNA, 201 bp, Bos taurus
cctggatgaggtcatcaaagtgtaccggtactttgctggctgggctgacaagtggcacggcaagaccatccccatggatggtgagcatttctgcttcacccggcatgagcctgttggtgtgtgttgccagataatcccatggaacttccccttggtcatgcagagctggaagctcgccctggcacttgccatgggcaacac

SEQ ID NO: 6423 - DNA, 201 bp, Bos taurus
aggacagaggggccattctgggcaagattgctgtgttcttcccgccctgctccccacaacctgtagcatggagcgggacattgatcacggggccaggtgtgcagagcactcaggctactggttaaccaggtgaaggacttcagtccactgtgtgatcaggaacccagggcgggggagttccagacactccctcacctagca

SEQ ID NO: 6424 - DNA, 201 bp, Bos taurus
taggacagctctctaagggagcttgggagtgccattctctgtaggggagagagtgagctctccagtgcccaggcctcaaccggcctgcctcactcccccatgcacaccaggtagcatctgctctcagtgaccttgccacgcagaaaggagcctcatccaaggggcacagtgggagactgggggccctcaagggtgaagaga

SEQ ID NO: 6425 - DNA, 201 bp, Bos taurus
caccccctggctgaagtcctccaacatgctggggccatccgagctcctgtcttccgatttgccctggtcacttgcccagtgggatggcttcccaggctcccctctctgctgttcaaagagaatgacaactccatggaattccaacagggacacagaaaagacaagttgaaagtatatagggaacttggaactccagtagtc

SEQ ID NO: 6426 - DNA, 201 bp, Bos taurus
agataaagtggccctgcccagaatgaccacatagagctgtaccggtggtttttcctgtacacctctaaggaaaaccagtctcgtagaccatgaagtgaacaccctcatccccatgtccagagatgtgtactactgcagccctggctctgcaggcgaggaaatcaaggactgacacacacagtgcaataaagatcacttcca

SEQ ID NO: 6427 - DNA, 201 bp, Bos taurus
actttacactgttttgtgctttctgagctagagttccccataacgttgaccaggtaaatgtccaactaaacaggaggccggggggattggaggcccagtgagatttggaggacagagaactatggttttcaaaacaggctgtctctgcgagtagggggcaaccacctggaaacccagcgtccctcaagccaatgggagatc

SEQ ID NO: 6428 - DNA, 201 bp, Bos taurus
cagaccttacctgtaccagattccagccttggagggactctgcgatgatggacgtaacagacggacagactcctccaaacaccatcaagtggttcggcccgtattttattgcatcgtagaaggctttcaacccttttgcattatcacactggggagcaacacagaaagagtagccaaaattagaaacagctttccccaggg

SEQ ID NO: 6429 - DNA, 201 bp, Bos taurus
atcatttcttacaaaacctctgagcctcagtgtcttcatccagaaagagggaatgacaacagtacttattacagggctgtggcgtggcctaaaggagccggtacacctgaagtaactaggctgcagcacctggtccacagccaataccatggaagtgctcgcttagtcattatctttcagcaccatataatgagctgcacg

SEQ ID NO: 6430 - DNA, 201 bp, Bos taurus
tatggagtatctgctgacacctacatctgggaataagttgaaagctggaacaactttgcttgatatttactaagttattgaaggccctgcctggcaactacctttccacctctctgtctccatttatgaggttacctgacctctagacaccagggatcagccctgacccaaggaactccagtcttactctccatcagtctg

SEQ ID NO: 6431 - DNA, 201 bp, Bos taurus
aggcaatggggaaggtctgatgatggtgggagcatcggccatgtgaagaggatactgagattcagaaagctcacgctgctgaccacaaggaggagggtcacgtgcagggattgtttccaggggccctggtgttgctggcgctactctcgaaggaagagtggaaattgtgaatggtttcctgtaaaatctgtctctcgcgtc

SEQ ID NO: 6432 - DNA, 201 bp, Bos taurus
ttttaactaagtccttatcacatgacttcaaatctcaataactggacccgttactaattcccgactcagggatccacaaaagccatagtaaggaagaggaatcacttctgttatttcagaaaacctagaagaaatattggtgggatgaggtcaactcaagtgtccagcacctttggcttttgcttggaactccaccaactt

SEQ ID NO: 6433 - DNA, 201 bp, Bos taurus
gaatgtggaccctgggagatggagacacagtctctgtgggatcataggtgacagccccaggactggtggactcccacagagcccttgtggcagccgggccgccctggcaccagttctctgcacaatacagatgttctgctcaacaagactttcactgggagcataatcagtggctgaggcagcccctggagaggcgagtgc

SEQ ID NO: 6434 - DNA, 201 bp, Bos taurus
ctcagccagatggccacagaagccttgccagggagaaaaactgatctcccaccctgaatttcctctttgttctggaccttgctctctctggatgtcattggtttcccacccctttcatgcgccagccacccagactgagtcttgtgttcagggagcttaaggaagctttcccctagattaggatttggggatagggaatcc

SEQ ID NO: 6435 - DNA, 201 bp, Bos taurus
ttacttgcgtatgtcatttcactttgtatacatgcgcacatggcctgtttgttctcactcctcccgcacatcctctacatacacagacactgtccggcacacagtaggtgctcagactagcttggccctcacataaccaaaaagcatctgggtgttccctgtgctctccaaaggattgacaaagtctagtctagttggagt

SEQ ID NO: 6436 - DNA, 201 bp, Bos taurus
ctcatcaactctctcagagcagaattgctacaggcatattgtgggacagcccaggcgtcccggagtcagcgagggccctgccagcaggtctcggggcgggacctggattatttctctggctgcgagggtctaccgctcctctgcagttcacttcggctccctgccaccctcctgtcttcaacatggtatgtggccccagtc

SEQ ID NO: 6437 - DNA, 201 bp, Bos taurus
ggtctgtgggtttcatagccaggcccagcagtcctcgagcctggcaggaactggaggttctgaggttgagactgtttctcccttgtccgagggcaggcatcgggcccaggcctccctgcttcatccccagacgacacccctgggagagggatgctgtctgcattgctttcagtgctcttgccccacttgccctagggacag

SEQ ID NO: 6438 - DNA, 201 bp, Bos taurus
ttcaattctttttgtaaaagagttaaaagagatagatgtgatatagaaaaggagtgcggtcgcttttccccacctctccccacccctgcaagaagtgtggtggatacctgtctcccctcttggagcatttacacatgttcacatattaatcctatatctctgctgcctgcttttttcactaagtaatatattgtggagctc

SEQ ID NO: 6439 - DNA, 201 bp, Bos taurus
aggcaggatgcactggggacatatatgcattggaccaagcaggccagtggggctgctcaagaaccctggtcacattccgttaccgtctcctggctccatgtggggttggaggtgaggatgggccatggaacttccagaagtatatcagagcaagaagtctacccaggtgcacctgcctgcctcatcaaccggcatggtgac

SEQ ID NO: 6440 - DNA, 201 bp, Bos taurus
gtgatattgagcatcttttcatgtacatatgggccatttatatgtcttctttgggaaagggccaagaaacaggttcttaagtaaatcggatttgactagaagacttggactctgaaagagggcaccttctgctttttcctcacctacaaaggatttttcctcattccctacaaaggattacctttcccacaaacaagggag

SEQ ID NO: 6441 - DNA, 201 bp, Bos taurus
cctaccacccccacccccgtacgcccagtccaggcctcggtgacccagcatagtctcactgtgacctttatcctttctcctggtgcctgcccccgtccccccagagcctactgcggaagagcgcagcccggcaagccccatcgctgagactggaccctcagcggagccgggcagcaccgcagccacttcacccagccggac

SEQ ID NO: 6442 - DNA, 201 bp, Bos taurus
ccaggcccagaggaaagccaattttgaacctgtcctctggcattgggcttcctgatatgacaccgagggtcttctccctctggttttgctccccggcagtactgaggcctggcacagggacccatttgactgaacgctgcaggcctaggaaatcagggaatctagaggacgcagggtcctccttaacaattttacaatgaa

SEQ ID NO: 6443 - DNA, 201 bp, Bos taurus
agtcaggattaccccaatgtgtgctgattgcctccatttctcacgttcattcttatgaccaccagtcctgaatcctctcccttattcaaacttctgaggagggatgctactctaggaggaaattattacatgaattagcattatcttgctaacagtaagtactactgtctttgcttaatactaacaaataagatgcagatt

SEQ ID NO: 6444 - DNA, 201 bp, Bos taurus
ataaggcacagttgtgaacccattggcaaaagttagcaagtctgacaaaaccaagtgcggagaagatgtggggaaacaaaaattctcaaacataactggtgtgaatgtaaattggagtacctacttgagagaacagcttcagcccagcagtttcagaaattctggtacatgtaccaagagatatatatgagaaaattcatt

SEQ ID NO: 6445 - DNA, 201 bp, Bos taurus
ggttggtggtggttacaaatctgccttccaacacagaggacactggttggatccctggtcagggaactgctatcccacacgccacaggccaactaagtccgtgtgctgcaaataccgagctcacgtgctctggagctctcatgctacaactaagagaggcccacacgcagaaacgaggagcctgagtgcccaactagtgcc

SEQ ID NO: 6446 - DNA, 201 bp, Bos taurus
ccttcctgcaggagctgcccagggcaaattaccagtccccaagggtcttcccaggtaatcccgagttctctgtggaaacactgaggttttgttattatggggagcactttagctccaaatctgaaagaaactcaattttctattcctcaaaacaaggaatctccagttgtatttgtcaaatacattaatgaacagagagaa

SEQ ID NO: 6447 - DNA, 201 bp, Bos taurus
ttagagctgtcatcacttctcttcagtaaaatgcacacaccagtcatcctcagctttgacaaacagatgacatggcagggaccagagcctctgcaatctagggcagggccaggtgagagctgaccatcatcttcctcaggacaccctctgaacatctggagtagtaggcttggcctttactggccctatgaacacataaat

SEQ ID NO: 6448 - DNA, 201 bp, Bos taurus
aagtctggtaggggacttgggaccatatctccccgctatctgcatcagccctcttctgcatttcaatcttgtgatgcactgggcaagtgtaactccaatccctctcttctcaatttgatttccaatccttgactaaaaataagtaaatgtacaaccagagattagatatatgcagaaaagatgaaagaggaatacaaaggt

SEQ ID NO: 6449 - DNA, 201 bp, Bos taurus
gtggattctccagggaggaaactaagagtcacaatgaagaaagggccaatcttcatttctcaagctgatgagaggcaaaactaagccatccatggtctaggggctctagctctttgcgcttggccatttgcttagctgatttgagaacagcgtcaggtgttctaagagccagtgacccaacctgtgtgagtgtatatacca

SEQ ID NO: 6450 - DNA, 201 bp, Bos taurus
acaattagagataacctcctcaccttcctcaaatcagttgtgcaagatttaagtaagcttagttgctgccttatttgaacataagaatgttgaatttgggaaagtgcagataggcctctatgcaaatgtttggtgcaaaggagaaggggccaatttcaagttagacaaatcaaggatgcccctcagcatataatcgatgat

SEQ ID NO: 6451 - DNA, 201 bp, Bos taurus
gaaatacatagatagatctgcctatgcatgtatgtccaagttgtaaaacaagtgatttgaatgtgtttagcccccctgtaatggtagagaaattagacaacctaaaacaaattcagttctatttatcctgattcaaacaaaaagcatttagtatctatcaatactcatatatgtaaggtacctaagcaagtccttaagtgt

SEQ ID NO: 6452 - DNA, 201 bp, Bos taurus
cgcaagaaactttgcaactaccatggacacccagtaacactcaccaaggaccacattgttatcaaggccatggactcaatggcctgagtttaagagccatgatgcctcctgagcctcattgccaccgcacacttctcacttggcaccctgcaaccctaggcctagggggccataggatgcaccagtgtgtccacacttgca

SEQ ID NO: 6453 - DNA, 201 bp, Bos taurus
taggactcctaaaaacaggtgtactcaataggaaatttttttaaaacctttaaattttttaaaaggcaaaagatgttcattacagtggtacccataatagcataaattagaagcaaagtaagtgtccaaaactgaggcaatggttaagtgaattgtggttcaacaaatcaataaaatcaacctagcctctaaaaagtgtag

SEQ ID NO: 6454 - DNA, 201 bp, Bos taurus
ctcaaagggccaggagagctggtcatcagcagagctttccttggcataagactaaattgaagaaaatctgcattcaaataaatgtctcgctaagtagatattttggccacctgatgtaaaaagccgactcattggaaaagaccctgatgctgggaaagattgaaggcaacaggaaaagagggcggcagaggatgagctggt

SEQ ID NO: 6455 - DNA, 201 bp, Bos taurus
gcccaccaggcttctctgtacattggggttctccaggcaagaatactggagtgaattgccagggaatcttctgacccaggaatcgaacctgcatctcttacgttttctgcattggcaggtgcattctttaccactagtgccaccttggaagcccaataatgatgcggaaagctgggcaaatgttgttgagagataaaaggt

SEQ ID NO: 6456 - DNA, 201 bp, Bos taurus
agtctgtatactagtccccttaaatctatatcttagtattagactacacatgcataggttgaaacaaagacaggctagtcaaaggataattcaggaaatcgctgaccttaacacagtctggaggtgttagagtttgaccatgtggagaggagagtcctcactgagcactcagggcttcctgtggaaactccagagatgtcc

SEQ ID NO: 6457 - DNA, 201 bp, Bos taurus
caaggccaaggttagataagatgaccttcactttctttctagcaatgagcattccttgtttgcccactggagccccagagaactctgctcctgggactactctaaagggtttctggtcacatgtctttccttccggagtatttcttgtcccatgttgccaacacttggattctttgctggactgctgctgaggccctgggg

SEQ ID NO: 6458 - DNA, 201 bp, Bos taurus
aaaaaaagtctctctttccattaacctcctcagtcaggtgcttttttcttggtaagaagcatgacaataagcttgctaatggctcagaacttgccctagtgtggggtcacattcagtggggtctgccctcccaggaaggcagatttgggagagttaccagttgggtttcacttctttggacgcaaagggaaatcatgagga

SEQ ID NO: 6459 - DNA, 201 bp, Bos taurus
ctggggcctcaacctctctctcccatctcctagttggtttgtttgtttctcccttattcatatttctaatatttgactttaactttgttatcacctgcttctccttcccttatagattcccctgacatgtttcttttaaaatatatatatatattggagtatagcctgcaatgcaggagacttgggtttgatccctggttg

SEQ ID NO: 6460 - DNA, 201 bp, Bos taurus
acactgaacatcgctataaaaataagcaagataggacaccggaaagatccaggctcttgccccaaggttataagggccaaggcagtgctcaccccagcaggctgggatcctggaaatgccatgcatccatgctgtgtgctctgaacaaaaagatggcaccctaccactggcctaggagtaccaggagtctcacggggttct

SEQ ID NO: 6461 - DNA, 201 bp, Bos taurus
tgagcgatgcctttgtagtaaacaccactgagattttctaaccattcccaatatggattaggagaagagcacccctcaaaggcccatctagtgaaaacaataggattcaggggagagaatataggaaggacagagtaatgagatctcattcccagactctagtgataggacttgatctaggatagatgtcaggccctttag

SEQ ID NO: 6462 - DNA, 201 bp, Bos taurus
tttaatgccacagagaagtccaaaactggcagaaagcagcagccattctcctgcatgcctgggccacggctgtcccctgaaaaggtggcccacacagaccgaggaaccagggcgatttgctgacatccttttgtcctctaaatgccagaggttccacttaggccggcgggggtggcaaaagaagaggaagtggagaaggag

SEQ ID NO: 6463 - DNA, 201 bp, Bos taurus
ggccctgagggcagctgtgacccctgtgtttgcacctgtgtgtgcttcctcacatgtgaggagtgagcaaccagcgtctgtttgcgtgtgcacatgtgcacaggtggctgatggccgatgtgtgtgcgtgtggtgtctgtgtgagaggggctggtatgtatcctgtgcacatgtgtgtgtgtgtgtgtgtccctgtgggtg

SEQ ID NO: 6464 - DNA, 201 bp, Bos taurus
tctggctttccagactcttgaactgcccctgactagaaccctatcagggtcccctcagagttccaaagcctgacttatatatactttatctcctcaagggcaagatacagatggttgtttgcatcatcatgggtacacgtgatgatctctacggggccattaaaaagctgtgctgtgtgcagactcctgtaccctcacagg

SEQ ID NO: 6465 - DNA, 201 bp, Bos taurus
gcccgaagtgggtgctgcattggacatctttgtgcaccggggattaagcaggttgggacacagatataagtgtccagaaggagaggggtgggccagaggctacaggtattcactgtgtaaagttttcaacatatgagcactaaaaatatatactgtacgtgaacaaaataaagtaggtgcccctctcttctctccttccct

SEQ ID NO: 6466 - DNA, 201 bp, Bos taurus
tgtcctggactcctgagggctggtccagcttgagtgccaagagaccctctggcactgtgcgaatgttagagactgcctggccttgggaaatgcacacaagcagcttctgcttttgcagtcagccctgggctcatccatgccacacacccctaggcccccaatggcctcctgtcctctcattctagtctgtgctgcccacca

SEQ ID NO: 6467 - DNA, 201 bp, Bos taurus
tgaccacttgccatcaccgggcactcaggaccactcacagcaagtgagcgactgggcagcagacctgtccagaggctgggggttggatcagatggcccatcaggtcccttataactctataattccacacagaggactcaccacaccaatgcctcttggctctgcagacccacactggtccacggagagtctagggggcct

SEQ ID NO: 6468 - DNA, 201 bp, Bos taurus
gccatgacagagacagagggtaggtcctgccctccagggggtccagacatcctgctcaaaagagaagggtgtcacctgggtggtgatatttggttcaattcctgggacgatgtttgccctgccagtctaacagtgagccagaggcggaggaaaaaaataaagattgtgtcgcgtggatttctcattaggtaactgtcaaat

SEQ ID NO: 6469 - DNA, 201 bp, Bos taurus
atgcatagaaacatcacaaagcattttgtttttcttattcaaaccttacaaaaaccctaccagatgggaattattcaacccattttatagttgagaagctatagcttggggaagtaagtttcaaatccatttctatctccagcctgaacctctccttttgaacatcaaactctttttgtatgaaaactcactcaacatctc

SEQ ID NO: 6470 - DNA, 201 bp, Bos taurus
gtttcctgagtatactgagggcctcctctggccttgcagtcctcccaggggtcaggtaatcagactgacacacaatcctttacttctcagcagaactgctggaagggccatggtggtaccatgattcctggggcagtgaggggagatctgaggtcaggggcagtctagtgaggggatgggaaaagcaactgccttatggag

SEQ ID NO: 6471 - DNA, 201 bp, Bos taurus
agcatgggctctaggtgcgagcacctcagtagttgtggcgtacgggctcagtggttatggcacatgggcttagttgccctgccacatgtaggatgttccccgaccgggggttaaacccgtttcccctgccttggcagacagattcttaaccactgaaccatcagggaagtcccctggatctttttaacttctgttttacct

SEQ ID NO: 6472 - DNA, 201 bp, Bos taurus
cggcccctgggtgggagagatcccctggaggagggcatggaaacccactccagtattcttgcctggagaaccccatggacagagcagcctggcagcctacgggccatacagtcacaagaagttggatataactgaagcgactaatataagtgccagggagcctaaattggcaaactggccctcttggtagtctgtggctgt

SEQ ID NO: 6473 - DNA, 201 bp, Bos taurus
gtttatgttgttgtttagtcactaagttctgtccgactcttttgcaaccccatgaactgtagcctgccaggctgctctgaccacgggcttataggctttgccatattccaagtctcttctacttctcaagctttgcaaatccacactcccaagaaaagtgtagcaccttcctttagcatttgtgacatgtgctttggaaga

SEQ ID NO: 6474 - DNA, 201 bp, Bos taurus
gatgataatcaaaagcttaaaaagactgttgtaaagattgagtgaataatataaatgaaaccaactgccggtgggtgttagggccctgagtttctcctctatttaaccgtgtacaaacgtcttgagctgtgtgtactaaggatttggctcagaggtatcactcctgtgttcccttgtgcaaggccattgtatctgttaagc

SEQ ID NO: 6475 - DNA, 201 bp, Bos taurus
tctcagagcccctcaccacaccagtactgactcacctggtctctgtgatcatgccccacatcaaatgttatttgccctccttttggacttttcaagttcaaccactttttgttgttgtttatatcagctcaagtcctcttcctgcaaaataccatctttgttcacccagcccaaatttagtatcctattttataccccctc

SEQ ID NO: 6476 - DNA, 201 bp, Bos taurus
atgtttccccaaggccatggtttcttttattagagaatggtgttagaaaccaagatctgggtactagatgtacttaatcaatgcttctatagtgtcattgtttctaggccctcttagatgaaagaacaagaaaatatatgtgtgtgtcctaaattgtatatatacctaacattatatgtgtaatgtgtgtgcgttcaattg

SEQ ID NO: 6477 - DNA, 201 bp, Bos taurus
tgcagcacgccaggcctccctgtccatcaccaactcccagagttcactcagactcacgtccatcgagtcagtgatgccatccagccatctcattctctgttgtcgcttaaaacaaagacaggccactatgtacctattagaatgaccaaaatagaacagtgacaacaccaaatagtggcaaggatgtggagaacagaaagt

SEQ ID NO: 6478 - DNA, 201 bp, Bos taurus
tttattttttaaaaactctgagacatccagcaatcaataaaagtagaaccaattatctttttatttcctctcatgttcaggaaatgaatcagcagccccagcagtgagaggctgttctgtttattatgagtcaacaacgcaagcagtgaaatgtctgagagagttgtggggatttaagctgccaaactctcgtttaaaatg

SEQ ID NO: 6479 - DNA, 201 bp, Bos taurus
atattgattctgaaagaatgaacatttaataatactgagccttgcaattcatgaacatattatcatcccatttatggaggtcagaaatatttaatctcacacagcaatattatgtattgtagtttttagcatagcagtcttgactatcttatgttcaacttattcctaattattgcatatttatactattataaatagatt

SEQ ID NO: 6480 - DNA, 201 bp, Bos taurus
agcaaacaaaatccagctgaagcccttagtgggtaaactaaggatttatccttagtgtatatctatagagataagcaaggccagatagtcacctttctttagttgattttatgtctggtgggggaagagtctgttctgactgtggagagacatgtggccagtttccacttggtctgagtgattcacaaatgttgctctgca

SEQ ID NO: 6481 - DNA, 201 bp, Bos taurus
tgtcaccgggtgttgagaacccacaaggggaaaaagagtggaaatttctatcacaaacatatatagatccatagagagtttacaatgtcaggcttgttcatctcctaatgatgcccctgattttcatactggacaaaaggagctgttgactagtgtgattatagtcaccagatcctcatttctatgtctgtaatccattta

SEQ ID NO: 6482 - DNA, 201 bp, Bos taurus
gaagcttagtcatgagaggagctactctgaaagtccagtggtccagaatggcagtctggtggtgtgagggctgggtcctctctttctgtgggaacattgcatgggggaaggggcaggggacggcttgggaatcaacaaatgtggatcctttttagaactgtcactcaccagccatttgatcttatgtaagaagagggcagc

SEQ ID NO: 6483 - DNA, 201 bp, Bos taurus
acagggaaagaatgttgactgaatgatataattcctaagacaagagtatccaaaaaaagcagtatgttttttaatgcttcctttacttttcgtatatgaacgttgttctctttctccatcagaaaatagaggaacaatgattttgactggggaacctttaatttgtttaaagcagatttcaaaatgggccagactcctagg

SEQ ID NO: 6484 - DNA, 201 bp, Bos taurus
taggatatgttttatttcatcccttttcctgcatttactcatattaatgtcaccgcattcactggtaatagtcaagcttggaaatagcccgcatagccacgtaaatactagcctgaaacacaccgcctgccatgcattatgaagaaagcagggaatggaatccagtggaagtaacagtttcttttggagttcttactaaat

SEQ ID NO: 6485 - DNA, 201 bp, Bos taurus
agagaactagcccagttctacaagacatgctggtcccacgatgaaaacaccaaagcagctccttgtagggaaatggctagagacagaaggctacagggctatttgctctcactttgtggactctgtggcacatgaaccacgctgactcccaaggtgctacagcttgcttacctctgaatccgtttccattgccactggagc

SEQ ID NO: 6486 - DNA, 201 bp, Bos taurus
acaatctcaacagtggtttcaaaaaccaggcctcttttttcataaccctccagcagcctcgtaatgccaggcaccttcctgttgtgattactggaccaaacggggccctaccacgtggagagttgctagtattttcacctcaagccctgagaatatttcctttttttttttttttttttgaaattctgatacatctctttt

SEQ ID NO: 6487 - DNA, 201 bp, Bos taurus
atttccttctccagagaatctttctgacccagggatgaaagccatgtcccctgcattgcaagtgtattctttaccactgagccacctggggtaccactcattaacgccattaactacctgatgtttttgctccttatctcgctgtcgtttgcatgttgagttttcagtctcatgtttactgctttttggtaatgagatggt

SEQ ID NO: 6488 - DNA, 201 bp, Bos taurus
cttcccaccaaaggactgacctcttccacctcatggaccatcccccctagtcgcctgggtaggtctccacttttgaaacatggagatctctccgtggcttccagggtgacttgcttgcctgccaaattctactcttatcctaaagtgtgtgcatgtgtacacacactgataaaagagaatttcacatattgaggtctgggg

SEQ ID NO: 6489 - DNA, 201 bp, Bos taurus
cacagactgtagatctattttctgtctctacacccacccacttcgtatttgctacgcccctctgtgtctctcccggccataatgcgccccaccatcactactgtgggagcagtaagtgagaatctcgtttcaatctctgctcccagtattccaccacggccggtggttagaccgaagctctagtgtccccgcgcctcttat

SEQ ID NO: 6490 - DNA, 201 bp, Bos taurus
gggggaagaccattactacaacattttccaaagtgacttgctataaaatgctagtctggagagatgctctgtcaacacagtgtcctacagggtcgaagggctatggaatatgtggacagttacaacacacataaacacataagagcctgttttatttggttagtcatttgacactgtaccatttctacacttatttactca

SEQ ID NO: 6491 - DNA, 201 bp, Bos taurus
ccttcctcttcttggtgctctcctttctggggcagtggtctgtaaggcagtacaagggagtggggtccatattctaggggccagaggtggtgccttggaatagaagtgcataacagacaaggaataaaaaatttctgtagcttttctggaaaggtccaggttagtggtttcttgttacctttaaactggtgtagcttaggc

SEQ ID NO: 6492 - DNA, 201 bp, Bos taurus
ttattttcagagatattagttctttcttctgacttaacgaaaaatagatgttgtatgtcccctccagtacccatgtgttctttggaaatttctaatttccgtattgtctttgtttatgtttgtgtggatttcctcattaggaaataatttccatgtccaggaaggatactagaagggttttaaagttcctcccagatatct

SEQ ID NO: 6493 - DNA, 201 bp, Bos taurus
tcaaacagaagggtaaggattcaatactggccattctctgacctaattgcaacggaactgttgggaaggtcaggttgtagtatgttgaaatgtggttggagatcaggaattttctgggcctagatggaaagctgttcttcaaacacagcttcaaagtaagttttaggaaatggccaaaatcagcactatcagaatacctgt

SEQ ID NO: 6494 - DNA, 201 bp, Bos taurus
ggaaatcagtgaggcctagccttccatggcttggtacattattcattcattcaacaagtattttttagcacttttgacatgtcaggcattgttttaggtgctggggcctataccacagtgaacaaaacaaagcttctgctttcaaggagcttacaatctagtagggaaaggcagaccattaaaagaaatacaggtcatgta

SEQ ID NO: 6495 - DNA, 201 bp, Bos taurus
agtcttaattgatagcttctccccatcctatcattcttgcattatctctttttaatctggccaggcaagtgttcagaaaggaaaatattggtctaaaaaattcggcgataaacctgtcttataaatacattgtaaaaattacaaaaatccttacatgaggctttaatatttattagtcatgagggaaataacatgaaaatt

SEQ ID NO: 6496 - DNA, 201 bp, Bos taurus
aagttaatccacactcaggagacgatgggtctaccgaagacagagatgtgacctgggaggtctgctcccttccctgctggaggcctcatcatcaattttctaagctaaagagggttactctgagctgcctggtagtccctaagcagagttagcagggcgaaggctgctccgaattagtaggactcaaactcccgaaacttt

SEQ ID NO: 6497 - DNA, 201 bp, Bos taurus
gccttgctttctcatgcctcggtgttttgcatatgcctctccctccctctggagtacctgatcctaggtcctgaaaaacgaatactctactttaaggccacgttcagatggcacctcctctgaatactctctgttttggatgtattgcctctgagagacctctaggtgtccagactgctggaaatcagagtctagatctac

SEQ ID NO: 6498 - DNA, 201 bp, Bos taurus
acatgacttagcaactaaacaacaacaaataaagacataatttcttgattttgaaagtctgtggcatatattaatagcatcactgggtatatgtttttcacatactattaatggacaatttaagtttgttctgataattgacagatttttgaaactttcaacaagttaataagaaaatatgtttagattgcttttgctgtc

SEQ ID NO: 6499 - DNA, 201 bp, Bos taurus
gattattcaagctccagatagctttggccagttccctccaaccaaatggccaatcctttgatcccaacctatgcctgctgtgatctcagctgaagtgctagtacattacacaaagatgtttacattacagaaacactgtctacacatatggccaattttacctcaatcctcatcagtatacataagggccttctttacata

SEQ ID NO: 6500 - DNA, 201 bp, Bos taurus
ttacctttcagatttcattttggatttttagagattcatcgtgtttcattcaataacattcactactttttccagttttcaaatctacctagctttgggcaataggagttcctttaagatcaactcctgtgaacttttgatgtaactccattggtatttgaaagcgtccttgatttttccatgtaacatctcctaagttta

SEQ ID NO: 6501 - DNA, 201 bp, Bos taurus
acggttttgtgtctacattcatccattgagcactgaatctcctagatttgagatctttcatcaaaattggaacactaacatagaaggttccttttacaaaggtccatgttctagctttggtttttccctaagtaaaaaacaaggtctgtctgcgtcttgagctgcttctctggtggaaatgggtttaagccagtttactat

SEQ ID NO: 6502 - DNA, 201 bp, Bos taurus
agccatgctcttactcagcactgggtcactgtacccggcttgtaagaagtgttgacttagcagaaacaaagacatcatattaaagaactatttttagaacctttttagaactattaaaagatggtttctattatttgatttataaaaagttgaatatgtaagagaatcaaaaggtaagagattagagatacgaaagtagag

SEQ ID NO: 6503 - DNA, 201 bp, Bos taurus
ctccaaactggcccatccagactgcccttgttgccacctggacagatgtcatctcttctcacaggaaacctaagagtcacccttcttaactcacccagctcaccctgggtggagaagtaaggcccagcttcttgaggagctctctgtgacaaagccactcagttcttcaaggatcactcttttccaaactctttacgaatt

SEQ ID NO: 6504 - DNA, 201 bp, Bos taurus
acccgtctctcccttgggacaagagagttgtgaaggaatgttccttggaaggaggcccagcacccattcccacatctcaggcccctgggattcgacctcctgactcagaaagcactgccccttgctctagttaccattttcatgtgctcaacacctgggtcaacagaacagctggacggagcctggcctggcagagccccc

SEQ ID NO: 6505 - DNA, 201 bp, Bos taurus
ttaggagtgagtcagtcatgctgtggaaactgcttctccttcagggagctccactgttaagacaggtttggtgcaggcctttctgtgccctaaaggcctgaagccagcttgccccacttactctctctcccctccatgctgggggatacatctggtgtgttctgtcacacttctttctcctggttcctcctacttgtggcc

SEQ ID NO: 6506 - DNA, 201 bp, Bos taurus
ccgctgcgagtgcagcctggaggccaggagtaggagacgatataatcaagtcgccgaggtttggggagcactcctaaaccagtgtcctggaagaatctccgggcgctgcgggtttcactctggcctgtgtaactaacaaagtgccctttgcagctgagaggattctcgttccttaaagggtctcatctgggaaaagttcaa

SEQ ID NO: 6507 - DNA, 201 bp, Bos taurus
cttttcaaagtgctcttccacgagagagacacttgtttgcagtgaatgttgtctgggcactagtactcaatggtggggagagcacttgttaatcagatgattgggatccaatcccagctctgccgctgcccatctgtgtgagcttgggaaagtcatgacatctctctgggtcctgataacatcctcattatttaagcaagt

SEQ ID NO: 6508 - DNA, 201 bp, Bos taurus
taagaggcctcttaagaccttctctctcaagaggctgtaagagtgacccagagagtctagggaaatggcaccaagtggaaaatggccttctggttggacacgacttggggaggaagctgtctgtatctctagcctgaagcaaagtaattgaatggcagcacagggagggccctggagtggaacagcctacactaccaccat

SEQ ID NO: 6509 - DNA, 201 bp, Bos taurus
gggctgggcgtgttggcgggatctcccttcttgcaccagtctccctgagtacccctcacacactgtctgccggtcatcccgtgactctgacagactggtgggacaagtataaatgactaatgatataaaaaaaagttgcttggcctcattattagcaaaaaaaaaaagggggggggaattaaaacaattaattagatagat

SEQ ID NO: 6510 - DNA, 201 bp, Bos taurus
ttagagtctcaaaaaattatttgctaacgtaacaccccacagattacttcctggttgagtggattaagcttgtctcccttaatcctgaggtcaatcaaagcgtcactaatggtagggaactaagtgttacttgtctccttgtgtggggcaaaatgaagtacactacagctctctgatggatcctagccaggaagtgttcgt

SEQ ID NO: 6511 - DNA, 201 bp, Bos taurus
atggtctcatccacgcccttgcccacctctctgctaacagcccccccaaagtatagtgtcccttccaggctctggtgcaggtgtgtacgaagcttcctgcttcatctccatctttatctgaatgtttggtgtcatctgaatttcaaacaggcctcaaaatgaagtcattctgttccttgctccaacctgattcctagattt

SEQ ID NO: 6512 - DNA, 201 bp, Bos taurus
atttttactgaaatgcatgactctgaccttgaaaactgcattctcattaatctctctttttcatgagtttaaaatgtttccatctgagcattaatcatataaacatgatgttgacactttcccaagaaatggtcaataccaacaatagctcaggaatgcatattttgacaaagctgaatttgatgatctgcatgttttgag

SEQ ID NO: 6513 - DNA, 201 bp, Bos taurus
ttcttgccaggaaaatcctatggacagaggggcctggtaatctacagtccatggggttgcaaagagttggacacaattgaaacttctgagcacagcacatttgggatcttggccccacaggatatccagcccaggtcctggcatatatttcaccatctgtgtgtggtccgtttccaatgcagagatagtagtggggtgtgg

SEQ ID NO: 6514 - DNA, 201 bp, Bos taurus
ctgcaaatgtgtttttccttttacagtaggttttgcagttaaaaaatcataaagatttactcatgaaggtttttacaaagtcgtaagatttactcatgagatataaatgagattagaagatagaaataaataggccctcacattaagctatttagcgtggacttaatagaatggtggacgacattggttcgatactgttgc

SEQ ID NO: 6515 - DNA, 201 bp, Bos taurus
cctaaaatacacactttatgtctttcttgatgaaaagccagcttgttatactgataagcagtgtgtagtgcctgcatgtaaagcatggcttacaccacccctcacctcaaggaaggcaagtcagtctccttcccatatacttgatactcacacataccactgatacactaaagatacaccaccaactcatgaaaaattagt

SEQ ID NO: 6516 - DNA, 201 bp, Bos taurus
ccactttattcgcctttaaattcacctttacaaagccagctgggcgcttgctttggatctatagaggggctccagcctgccaccatgcctctgagattcacagaggggagagtaagcatcaccgtggttggagaatgagctgtggggaggacaagaatgatgctttgggagataaaagaattaggcaaaacaaagggcaat

SEQ ID NO: 6517 - DNA, 201 bp, Bos taurus
accccattgaccaaaatagaccaaaggactctcttctctggaagagctctgacaaaggaaatcctaggggaaacgagatgactctttcctatattatcatgtctttcttcatgtctattcctatatagaatacttttctgggtatctaggattttgaagtgcaatgaaataacttgttagcttgcccattaacttgctaaa

SEQ ID NO: 6518 - DNA, 201 bp, Bos taurus
cgccttgggctttatttcccacacttcccacaaagaggatgaaggcattcctttctccccaaggatgccagggaaagggtatgtgagaatccactgtgtgcggtgtgtggtctgggccactctaagatggaaaatgtagaaacagaagtatgaaagcaaaagacagactataaggagacagtcttctttgatctcacttgg

SEQ ID NO: 6519 - DNA, 201 bp, Bos taurus
agaagtctacattcagggaaaatatcctttaaatgtgaaaggaaaggagagatatttttggacaaacaaacaaacaaataaacagaaaaaagaaaatgcacagctaggatacccactttaaagaaaatattgaggattgtcctcaaggcacaaggaaaattaaatgagatagaaggctggagatgcagaaagaaatgaaga

SEQ ID NO: 6520 - DNA, 201 bp, Bos taurus
gtccaggtttgtattctctccaactgtctgaattattggcaagttcatcagatagccatctcttactctgatctctgtggttgtcattgatccaagtgggttgactgtaaattgggttcttaaatgcatatggattgctagaaacagcatagggtccttttctgggggtattcccatagttccccggtgttactttttttt

SEQ ID NO: 6521 - DNA, 201 bp, Bos taurus
acatttcagtgatagaaatggggtgacaaaagttctgcaaatattgagaagagagataataagaaatatgtgggaacattgctttgaaacatctgaaacggctctattactttcctttctttaattcactttctagtccttggctctccagggtcatcagaagcagaaaacttcaataattccagcaaatatcagcaaaaa

SEQ ID NO: 6522 - DNA, 201 bp, Bos taurus
gtagttgttttatcagttcaataacagcagcctgtttgagcagcggtttctagtttattccattgctcatctcacaacttttgtgtggatttgaggaatcagaaagtacaagacagggtctctgtctcagtctagtgggtgtgggtaaggatggttatggagagggaccaaatgaacaagttagaagcttgtggaaagtac

SEQ ID NO: 6523 - DNA, 201 bp, Bos taurus
gtgccaggacaccagagagaatgagacagtgtcctgctctctggagctcctggtcctgcacaccgcagtgtgacaaagctgtcttctccctggccctcccggtaggaactgtccgggagctagcctccagctgctccaaatgcccaggctgctcctccaaggggcctttgcattatttgctgtttcttttcttaagggaat

SEQ ID NO: 6524 - DNA, 201 bp, Bos taurus
tagggtttgcctcattctcctctgaatcctggtgtcccgaatggctgtgggatggtgattctgtcccatttttctctaaggtcaggcctgctcgtgcccttgcttcacaagggcaggagggtgccgagacctgacagaggacaggtgggctgcccaacgcgcgccagccctcccactcagccagctggcaggccttgtatg

SEQ ID NO: 6525 - DNA, 201 bp, Bos taurus
cctggctctaatgagaaacagaggtgtctgcaagggaaagtaataaagcgcccagcaagtaaacgctgccagctgaggaaggcgaggtgagaagtcactgcgtctctgggcctagaggaacaatgcacctccggtgctgaaagaatcccggggctttccgtctctccagcaccggaaggctagtgctgaatttccctgaaa

SEQ ID NO: 6526 - DNA, 201 bp, Bos taurus
aaataataataataataactgctgaagtgggatgcctgcccaatgcatccacgccattgggaaaatggctaaagagatagcttaagtggctgtgtttatgcctggtgacattcttggccatatcagattagaccaaagtgatgtgtcgctgtatggaaccaggcatcaaatctttataccaagagtctgaattaaaaggtc

SEQ ID NO: 6527 - DNA, 201 bp, Bos taurus
tgttttataccaacatgtttgcagagtataaacatcacagtgcaaactcttgcacccaagaaccctgtgctgctagtggacaatctttggaaaagtttgagtttgtaaactgataatacatataattccatgggctccatatggttcctgttatgctgagggaactatacacatttgccttgccccaggatgaaaagataa

SEQ ID NO: 6528 - DNA, 201 bp, Bos taurus
ccactaagctggctttttagaaaagtggcatttggaatgaggtttaactatatggacaaattctaaagttaactgttagaatcctcgggcttgcctaagacattttccccctccttgagtgataacagaatttcctagtcactattattctttcctaaaggcttctcattcttggatacaatgtctttctgttttgtctgg

SEQ ID NO: 6529 - DNA, 201 bp, Bos taurus
gtgcggatccttcaacgttcagtttacacgtgattctcattacacagtccccaagggctgtgaaaacattttcttgagctgcccccaaacatccacaactatgaattggtcagtgccaattggaaaagcactgtttgtttaaactgcatcccgggtagttccctggcccgatccctgcttgggctccccacagctctgtcg

SEQ ID NO: 6530 - DNA, 201 bp, Bos taurus
ttggggaagaagagagaaaaggaggaggggagcctcagaccaatgtatacttttttttttttttttttgcgaaatgcacacccagtgcaaattacacagtaaagttagctgaggggcataatttgttacacaaataaacactatttggttcagtctgtggccactgaagttataatgaaaatctaaaaacaactgtaatgc

SEQ ID NO: 6531 - DNA, 201 bp, Bos taurus
atttagtatgaactaagaacatcactgggagcttgtgcttaggggaagcttattatatactggagatttactgaatgaataagaaggaaacctctcaaaagtcacatttcgtggatatgtttaaggttaaggtttaagagtatgtggttgaaatacttggtttaactagaattaagtcactttattcctgtggcttttagc

SEQ ID NO: 6532 - DNA, 201 bp, Bos taurus
cgtgtttattcctcgctggttgtttccacctggcaaagagaagcatgccacgtgaaacgcttcagcaaatgcaggcagggccccttgtacctttcagtcccggtgggcacagtgaaataatcacacaaagactgacctcgttttcggcttgcttccgtgaagcaggccccgaactgcgttttccagagcatctgcttggta

SEQ ID NO: 6533 - DNA, 201 bp, Bos taurus
tgaacattggggcatgaatggctacataaagatggccaaagaccggaacaaccactgtggaatcgccaccatggccagttatcctactgtctaaatctcaaaggctggattaagaacaatatccaaaggaaggattttctcttaaaactgaccagactttattgtgtgggaatgaaagacttgaatcattgaagatccaag

SEQ ID NO: 6534 - DNA, 201 bp, Bos taurus
caactgtggctagagcaggccaaattggattttccttatagcttttccttcacctctgagagtgatgtcattaaacggtcaggccatgaaatgctaaggacagcctgtttccactgtaccatgggtcatgctggaatgccagggaaatataccccagaatgtcataaagctttaaagacatacaataaaacctgcatggag

SEQ ID NO: 6535 - DNA, 201 bp, Bos taurus
ttggagagttagcaagagaaactatgagttagcaatagaaacaaacaactttaaaatctttgtgctttgaaaatacaaagacatgtttcttgctcatgctgatgtccatcacagttcaactcaaggctcttagcacagtcattcagagatagaacagctaatatatcatattttgtttgccttaagagagggaagagaaca

SEQ ID NO: 6536 - DNA, 201 bp, Bos taurus
atttaaatagtctccaaatggcccattctatatgaagtcatacaggatgccccctttgggctgtcattctcctttaaatggatcgctttgtgtgcacagtgttttaatgccattcaaccttaaaccccatctgtgggcctcatcaggccacgggcttcagtgcacatgtggcagccataccttcgacattcttagtctctg

SEQ ID NO: 6537 - DNA, 201 bp, Bos taurus
gtgggaaatagctttttctcatgtattatttacatttgggacaggcccacctcccaaattgtgatggcttttactctccctagtgtgtgtgttcctacttcttaataaaagcaggatggtttaggcccattcctgtcatttgcaaattgtgatttcattgggttcctttgggaggccagatgataggcaccccagtgtgag

SEQ ID NO: 6538 - DNA, 201 bp, Bos taurus
cactaaagtttgagaaacactgctctactctttaaaagtctccagaattagttatcaatctctaaaaatcaactgaatactttaagaaaatataattgcacataaggtttacattattattaatttcttataaattattagtttagctgtattatttacttgataacagcaaaattctcatagagacaattttttgtctaa

SEQ ID NO: 6539 - DNA, 201 bp, Bos taurus
caaaacatgaaatacttggatataaatttaacaaaatataaccaagaaatatatactataaactgtaaaatactgatgaaagatgttaaagacttagacatggacagctacactgtgcttacaaattagaacactcaacactgaacactaaattgtccccaaattgatctatagattccaatcaaaatcatttcaaacaat

SEQ ID NO: 6540 - DNA, 201 bp, Bos taurus
atacaaactgataccagatagtgggctgcagacaacacatctttgcagaaaggaggggaatttagaacggctcctaggccaagtcaggtaaaatggcagcaaaactcctgttcctattatggaactggaaaccagaagtccatggaagagggtaacacagatcaatgaggcatcaccttcacacaagggccctgaatcatt

SEQ ID NO: 6541 - DNA, 201 bp, Bos taurus
atctcttgacaatttcttccacccaaactttttcatacccctcccttattttcatggtttttcctatagggttggccttactttctggacatctgagtgggtgcctcttctctctcttctaattacggaggtagctcttttctctctcaacgcagggcagggggcctcctgcttttctctgttcctgcctcatcttgctcc

SEQ ID NO: 6542 - DNA, 201 bp, Bos taurus
ccgccaaattaggtttaccttctccctttggggaaaaaaagaattaaattatgttttggctgtattgatggaaaacatgaaaagcaaactccggggcctcatgcctcaagggcacttgatctcccgttagctgcaaacaagaaagtccgcgagcccctctgtgagcagcaagcattgggttgccgatctccaccgggccct

SEQ ID NO: 6543 - DNA, 201 bp, Bos taurus
aaattacccctgggctcatccaggagcaagcctcctgaggccaaaaatgggacaacttcttgaggaaacatattaatcttgaattttttattttcctctacagcagggatccttacttttttcagtgccatgaactacaatggcagtctatagatggctacagcctccttctccaaataatgtttttaaatgcaagaaata

SEQ ID NO: 6544 - DNA, 201 bp, Bos taurus
cccacctgtggcttttcttattgtggtacacagggccatccccagagtacagccctctggggacagctgggcagtgacaggccaaagaggtcaaaggaggaactgacacttccatctggtcccctaacgtcacttcaccaccagtaccctcactatccatcaaaaaggcaaggcagggtccatgtccttctctgcaactcc

SEQ ID NO: 6545 - DNA, 201 bp, Bos taurus
acagtcaagagggttggaaaaagcagagagaataaggaacgagaaggatggaaaatctactgtgactaatcttaaattctccagggcctttacacattatgaagagcttagaatttcagcattttgctttttcctttaaaagtgtgacttaaaagcttattaattgtgtgcatggggagaagacagtttggggattcttct

SEQ ID NO: 6546 - DNA, 201 bp, Bos taurus
ctgtaatagctaacttccaagacagccccaaaaatattcatctcctgatattttcatccttaaggaacaggtcaccactctgtaaacagtggccagcttctgtggtggctcagatggatttaatggtagaatgtgacttctgaggctagatcataaaaatgttgtggcctttaccgtgctttctttaggactcctcattcg

SEQ ID NO: 6547 - DNA, 201 bp, Bos taurus
agcacctataaaagaacgtgaaaatcagaatgcttttcagtttaagtcacacaccaaatctagttcttaaaatatttagccatcttcatctttagtgcctctaatttaagaagcaatactcaacttaaaaggtgctctgtaattacctcctttaccaataaataagatattcttaaaaagaaaacaaagtatctcatttta

SEQ ID NO: 6548 - DNA, 201 bp, Bos taurus
caatcatattacacgtatgtatcaaagtaacacattgcatagctttaatttatacagtgttgtaaggaatatttgttcaattttaaacatagagtttatgttagaagtttttagtcatgcagtatcagcttaacttctggagaccaaggtcagctttctggggtgttaaccatgaagctccagtaaacactctggatactg

SEQ ID NO: 6549 - DNA, 201 bp, Bos taurus
gttgtacatatataccagatatgagtactaatgttactctctttactaaacacatgaacaagatgattcaggcgatggattctcctaaagcctcagtcacttcacttgggaaacagtaactagctccccatggtggaaaactgtcttataatcataataatcataattgttctgtttttactgtttgctccctgcatctgt

SEQ ID NO: 6550 - DNA, 201 bp, Bos taurus
ctttcagggtcaacttcagatttttaagagttctaaaactggtaggccttggctccggatctctaacagatgaaggaacccagtaatatctgtattccacgtggaatgaatagaaaattggctaaggtctctctgagtggatgagactagtgggaaggagggatctagaagcctcaggagggggcagggatctgtgcttct

SEQ ID NO: 6551 - DNA, 201 bp, Bos taurus
aaacactatgaatgttaagtccatcatccctgtgggttcattcagtcccaaggccctccttctatctactttaattaaacctacttcctatttcatctccgctgaaactagcctccagtccacttccccagtctgctcccttctccttccatgaagcctcggtttctagaacgtggtccagtccttctccctaaacccaca

SEQ ID NO: 6552 - DNA, 201 bp, Bos taurus
agctatttgaggaaatgattccagtagcatcagctttaaaatgaacacccatgtgaaacgggattatagaaaagaacacaaggggagggctaaaaagtcagtagagaaattgttggaacagccacagaagctgaaatcacagaagtggatgatgtaagtgggagtaagagaaaacctatctttaaagacactagcccgtgt

SEQ ID NO: 6553 - DNA, 201 bp, Bos taurus
ataaatcagtataacccctttggaaaagtctttaaaagtgagagacaatgaagcatggtccttgagtcaaatctggccattaccagttttttgtacagcccaagagctaagaatggttttgacaggactgacagaccatgtggcttacgaagtctaaaataagtactatctggccctttacatagtttgccaactctagta

SEQ ID NO: 6554 - DNA, 201 bp, Bos taurus
aatatttatacttttttgttactgttttaactttctttttgttatttgtgccttatactgtattgagccatatcattaaaaaacatagaatgcctcacgaatttgtatgtcatccttgtgcaaggggattactagtcttctctgtattgttccaattttagcatttgtgccaccaaagtgagcactaattatgtcttttct

SEQ ID NO: 6555 - DNA, 201 bp, Bos taurus
attcaatttagtggacaagagagtcacaacacagtgaaccgattctcagacaaagggaaatatggcttgcagcagagatatcagttctgtgggagccagtggcttaaccctgcaagaatgagacagggaaatctttgtagacatcatttggccaagatttagggagattagcaggaatggataatagaacataaagtactg

SEQ ID NO: 6556 - DNA, 201 bp, Bos taurus
tcttccctaagagactctcccagggtgccgcttggcctgaggtagaggaaggaaggaagccagccacacacaaccacaggcgggggtctgggcccagaatcccccctgagggctataggagagatggtcggcacgtgtctgctctatggctgctaaggaggaagcagagacccagcaaagggagggtggagagaggactgg

SEQ ID NO: 6557 - DNA, 201 bp, Bos taurus
aaatctaatggaggagaaagagctgcttcatggaactccatggtcatgaggtcacatagaggccatggacctttggaggagctgctgtgggcctacatctcggaggggcatgggatggactcccatcacactataccatattcaccatgtggcagttctcactccaagtctggtgaggcctctgtgacagtctgggggctc

SEQ ID NO: 6558 - DNA, 201 bp, Bos taurus
aagtcaccccatggaaggctgaggtccacagcccctcttgctcacggctgggattggaacacaggctttgacctgacaggaggctggggcggagtagcacagtgatctggccctgcagggtggtggcagggagcccagagaggtgctaagtgtgccgcacttcagcttctcagcctgacagcagctggaggttcatggatg

SEQ ID NO: 6559 - DNA, 201 bp, Bos taurus
gccatgttcagaaagtggttgtgtcctgttagtcagaagctgtggtcagacccatcgatcctccctgcccgcccccccccccccgctcccgctcttcatcagaacagagacgggcgagggccaagcctttctttgtgcacacgaacagtgaggtctgctgtgcttttctcacatgtccatcagcagcaggccggatgtcgt

SEQ ID NO: 6560 - DNA, 201 bp, Bos taurus
aaccaaccaacaactaaataaactgttagaaaaaaaagaacggaattgtggttaccagaggtgggggggggggcgggaattgaataaaggcaatcaaaaggtttacattttcagttacaagataaaaactagggatgcaatgtataacatgttgaatataattaacactaatgtacgttatacatgaaagttgttaagaga

SEQ ID NO: 6561 - DNA, 201 bp, Bos taurus
ctcactagggctactccttagcactcccactgagcaccatctcacacagttcataccctctccccttggagaccagccatctcaggccttgttctttcaaactgtcccctttcagccctgtcttggtggcaggggactgccaaagcctgaagtttctctaccttggcacacttgagtcccagcaagaacaccttccccgcc

SEQ ID NO: 6562 - DNA, 201 bp, Bos taurus
aatttctaaccacatatcagactggtacttctctctggctttcattttactaaaagaggcagagaaaagggaagacaccattaaatgcaaagtgcaggagactgacctataagtggatctcacttaactggaatgtagggctaatgcaattagagacttcagtcaagctgaatttattacttataacattccagataaaat

SEQ ID NO: 6563 - DNA, 201 bp, Bos taurus
ttcccttgaacacttctgagtctctgggctagtttatcactgtctgtttagactttcttttacaggacctttcccacattatattgtaataatccacttacaggcctgtttccacagttgcactgtaaactttctgaggatatggcacatccctcattcatccccgtctccacagatttcagcccagtgtttggtgtgtag

SEQ ID NO: 6564 - DNA, 201 bp, Bos taurus
ttctggtaccatctcttttcagatgtgtgcacacaccccaaggccacagtcttgcttgtcctgatgtggctttgcacatttatgttgatcatgtgatctcatcagttaaccactggactggcatggccatgtgggtctgggctaccaccatgatctctggaaatcacagaagacctcctagggtaactgaacatggggagg

SEQ ID NO: 6565 - DNA, 201 bp, Bos taurus
ggggttaaattatgcagttttctgtgtgagagtcacctgtgctgctggtgtgcagagttccaggagccacttcattgatgccttggcctgacatctgcatttttgccagtctttaccctccaggagggagagtttccagaccttactcccattgacttttacgtggtgttagatttggcatctgttttggtgcatatttta

SEQ ID NO: 6566 - DNA, 201 bp, Bos taurus
ctgtggtaaatgaaaaggctgggccagaacagggctcccgtgccagctcacctaacccagtgccagccatgggtaccttgctgggtctttggagggaaatgggtgccagcagtgccacctgctggccgcactaggcacggcactacaggtgatgggtggagctgaagtgtcccaaggaccaaattccaacctctctaggtt

SEQ ID NO: 6567 - DNA, 201 bp, Bos taurus
gcagatttaaaaattaaaaagattttcaggcagctctttttctcaagtgttttactacctacatggaacaatagggcatttagacttttctccacctgctggtccaggggccctgtgttgaactctattttttgaaatctgacttagtggagtgtgcatttcttttctgttccaaattgggtgctcaatagctgaagactg

SEQ ID NO: 6568 - DNA, 201 bp, Bos taurus
cggacacgattgaagcaacttagcagcagcagtagcagcagtccccaccagaaagagccctgtgtctactgctgatctgaatgggagcagaggagagaaagaaccaaaatatgaatgggaagctccctctggggcactaggtgaataagccataacgcacagccctacctcaatgcttgcctggaaatctcagacccaaaa

SEQ ID NO: 6569 - DNA, 201 bp, Bos taurus
cagggcaaactacagcaaggatggctggcagattcctgaagcttctctttcagtcatgtcatgattgtgttcctcttttattgaagtgagtaggaggtgagcaatctatccagactacctgttttgagaagcttggttgtgagagtaggagagattaaggaaaccggatgaagagaaagtatagggttaagggaggattaa

SEQ ID NO: 6570 - DNA, 201 bp, Bos taurus
ctgaagtcccacctgtgtagtgggtgggtctcctctggcctccttgttcatgctctgagccctgacttctcttctgtacccctgtggccctagaaccttgaaacaagagcctgaactacaggggtgcctgtgttctactcacttctgtgattttgattcccgttgttcatctctgaaatggcctggaaggtcattgctgtt

SEQ ID NO: 6571 - DNA, 201 bp, Bos taurus
ctagaataagtcaagaaaagctaagaatgtccaccatcactctttgcatccagtattttatctgaattacacactgttataagatactaaagagaaacaataagtgcagaatttctaagggggaagcaaagttgacattacctattaatgataagattgcctacatagaaaaatccaggggaatctacagacagatgatta

SEQ ID NO: 6572 - DNA, 201 bp, Bos taurus
tttctcaacagtgatgacttaataatatgattatgtatcctttaataacgggtccctgcccactcccagactgggcaactatcatctaattttagcttgcgagctctctggaaaaacctactatttcctggcacagagtacctattgaataagtctgttttatagtggagccaagaataacaatcatttctcatagttgaa

SEQ ID NO: 6573 - DNA, 201 bp, Bos taurus
atttctgcactcacactcagcttgaaatcattcattcaactttccttgtaagagcgcctatgtttataaggctgtagcttctgctctgagacctcagaaactgatctccatattatatctgggttcttggataagcttagtggagattcccacccctgccccaaaaagcacagggatgtagttcatatgaaggcaagagtt

SEQ ID NO: 6574 - DNA, 201 bp, Bos taurus
agaaaacacatatgcgtgtacattcttagatcacagattctctgattcagttttgaggcgccaaaggaggaaaacagagggaagctgttctccaattcatagttattaaatggaaaagcaagtttggtataatgatacagcacatttctctaacagtggtctacactgtttttttctgatatatctggtgacttgcagcag

SEQ ID NO: 6575 - DNA, 201 bp, Bos taurus
ggaggtcaataaataatttttgccatgaatgccagatgtcaaagagtaaacctgacatccaggtgaaccagatcacatgatataaaatgcttccttaaaggcagcatttggcatccaaactgagggaagtgagtataatgatacctgacctctgagactgtgttcttatttgctagttgttttctgcagccaatgccaagg

SEQ ID NO: 6576 - DNA, 201 bp, Bos taurus
gagaagagaaacatgattatggatttagacctcagggccagtgtcagatggggctatctgtgttttatactaatgcaactggggaatcctcagggtgactaatgaggatgtcctggccaacatccccagttgtgtaaggtaagcccagggatctcacctgcatccgactttccccccaaacaacaagggtgcaaaccagta

SEQ ID NO: 6577 - DNA, 201 bp, Bos taurus
acatttatttctcacagttctgggagccggaaatcaaagatgaaggcaccagaagaaacagttcctggtcagggctctattcttggtgtgcagatggccaacttctggttgtatcttcacatggctttccccagtgtgtgaacatgaagaaagagagacagatcttataagcacactaaccccataacgagagccatatga

SEQ ID NO: 6578 - DNA, 201 bp, Bos taurus
gtatcatagaatttgagttctggagggactgtgtgaggccatttttggtatttgggtagagtataagctttcagagaaattggcatagacattccagtgagaaggaatcaaatgaaactttggggacctctgatgtaccatatctcctggtagtcccacttcctctagaatctgatctttcccagagacttgctttaatca

SEQ ID NO: 6579 - DNA, 201 bp, Bos taurus
ctgtgctgtgccttttcttggtaccccaaagcagttctctttctttttccatcactcagagttcacatgtagtggcctcttgcattatttccagagctcacagtagtaattagtggggaggagaaaaaaaaaggagtgtatagtcttatctacatggaaagtgagtgcccccaactaattattaacacaggtgcaaaaaca

SEQ ID NO: 6580 - DNA, 201 bp, Bos taurus
cgtttagtaaatgcttataatatgcctgacatagtgttgtatattcagtacatagagcagaggagaacatgacttctgctttctaggaggttaaaatcccatagtggagatagacatggaaacaggaagtagagtagtgagggccatactgtatggatgtatggaccaaattgtgcagtagcacagatctgaggagtttag

SEQ ID NO: 6581 - DNA, 201 bp, Bos taurus
cctcctgactgatcctggtgcttctctcttggccctgcatggcaggtacccacctcttgagaactgtaagtaagaaactatctttttaacagcagttgtcgccttctcctgatttgttggcctcagcatacctgagtaataataaagcttacattttaaagaacaacccaagctagctttagcaatagtggaaaccaacag

SEQ ID NO: 6582 - DNA, 201 bp, Bos taurus
ctttttcagcccatcttgctccagtgctgctcttccactagggtggaggctgaagtagtcattgccagcaggaatgtccctttgcagagttgggaaggggcagggccagcttagcatgcagtactgacccagactttaaccaaggcatgcacaaagggggaataaataaaactaaaacagaagtgcaggccctagccctca

SEQ ID NO: 6583 - DNA, 201 bp, Bos taurus
tttccaactcagagaagaggttaggatgtttgtgtctctggccaagctaaggagagccatggctgcctctctgggggcatcctagcagtggagggtgggtgtaagactgtcccgcagcagaggcttgaatgtacatggaagcagaaggaactggagtggggcagaccaccttcatatcactaggagatgagccatcacctg

SEQ ID NO: 6584 - DNA, 201 bp, Bos taurus
agattccttattgattttggctcaggactcacaaagaatatggaaagacaggcacccataacaagaggagaaatgagtaaaaatctaaggttcaatgcctggcatatgagaaaatgattcctaaatgatgaacccaatataaagagttattgtaattatcactagtaatccactaaccacatggagaggtattcttgctca

SEQ ID NO: 6585 - DNA, 201 bp, Bos taurus
acacacacacacacacacacactttctgctctagcatcctgaacctggtaatacctacatctccttctgatctcgtgcctttgatccagggccctcccctactcccttcccattttccgtctgagttcctcaccagctgactctcacaaattcttcttagaaatggcaaaagtcagatatcatctcctctatgaggccaga

SEQ ID NO: 6586 - DNA, 201 bp, Bos taurus
cctcctcataccaccttccttctcaccaactctaagccaccatactggctctgttggcacagccaagttcaggtggggcctggactccatggctccccaaatgcgcccttgctcagagtgcccgttgcctgagaggacctgttgagaggtcacctccccagggggcctggcctaaattctcacaactctccaacagtccat

SEQ ID NO: 6587 - DNA, 201 bp, Bos taurus
gagcagcaatgtgcagacctccttactgcaggaatggccaggggcggagagcaggggaactggaggacagaggataaggaactgagggtacggaggggatggagagagaaacaggccactgctaaaccccaaaggagcagggagagggtggggaaaatgcatttctggcctctgcctcttctcagtttgtacactgtatgc

SEQ ID NO: 6588 - DNA, 201 bp, Bos taurus
tgacgcagctgcaagccaagggccaccaagggctgccaggatcaccagaggctgaaagagattctgcactgaaccccggagaaggaagcagcccagccgacaccctggagtcagactgcgggccctggaaccaggagagaacagattcctgttgtttaagccacccagtctgtggtacttcattacagcagcctcccagaa

SEQ ID NO: 6589 - DNA, 201 bp, Bos taurus
taggtaagaatcacctggtaggcctaagcagatatagcttatgcaaactcagagggctgtggagggctgagaatgtgcccacaggacaggactctgctggcacttctgctggcccggcctggaactttgtgtcgccttctagacctcgggtgctacaggggtttagaggagctcagaagggagtggcagtcgctggcttgc

SEQ ID NO: 6590 - DNA, 201 bp, Bos taurus
cacttttggaagctcgtgatattctcttcttgaccagggcccacaacagatttatggtactgtaagtttctctctatagtggagcacgttatagctagacatctagatagaaaaggaggccctgcagaagcaagcatgccaaagcaaaggaaaaacaggtcagaagacactgaggggtatggtatatattagtagtatggc

SEQ ID NO: 6591 - DNA, 201 bp, Bos taurus
gtattggagtttcagcttcaacatcagtccttccaatggacacccaggactgccccatgcatcatgcacacatatgtctgaggcatccttggaggatctccgggatggcccagtaggcaatccctggcaacactgctctctctggagaagtagtgctcttatgagcatggtgtgttttggagggatgggtacctgtcagat

SEQ ID NO: 6592 - DNA, 201 bp, Bos taurus
atttataaacattcaacaaaattagcctcatgtggtatttaatattgttggtaattgctgtgagtgttttttccttagaattctagcattaagtcataaggggatgatgaaaaggaaggctaatgtaattcaaagggcgtaaaacctcagagttgatcctaggaagtttttatacttcttcctcccatggggaagccctct

SEQ ID NO: 6593 - DNA, 201 bp, Bos taurus
gagtcaaactctggggtggagagggcttagcactctgggctcaacaaggccttcgggtgcttctgatgtgtgctcaattttaagagccattattctaagcatggtttccttcatgtgccttttaaagtgaaagtgaagtcactcagtcgtgtccgactctttgcaaccccatggactgtagcctaccacgctcctctgtcc

SEQ ID NO: 6594 - DNA, 201 bp, Bos taurus
gacaagcagatcaagtccaaactcaaggcccccgggtccagtgtccacatggtgaacctaagactcaggcttgttcactaacatggtcacctgtggttccggtagtgctggagttacccttggggcccagggacctagttctttccccgctccccagtctcccctcccctctccacattgcagagcttgatcattcttttg

SEQ ID NO: 6595 - DNA, 201 bp, Bos taurus
aggtaattttgttttcctggtgctaactaaattccataaggaaatgatcgaattaatttttttttttaacaaggaatgctgtacagtataaaagaatcttcaacagtagttttcagcagatgtcataaatgtcatagttctcttgtggtcatgtcttacatccccctgtcttagatggggaagggtagaaagcagggtgga

SEQ ID NO: 6596 - DNA, 201 bp, Bos taurus
ggaggtacagttcagacaaaaggtatcagggcttgagaagggagagaattgttaggaattgctgacagaagctgaaaagttgtatctctgtgtgtgtgcatgcgcacacacttgtgtgatacgttgtgtggccgtgccaggaagtgtgggtggcttcatgtaggtaatatgagtcattgaaatgttttaagcagaaacaga

SEQ ID NO: 6597 - DNA, 201 bp, Bos taurus
taggccttgccggtactgctaatataaaacacaaagggctagtgtttagaaaattagtgcatagagtgttatgaacataaactggaaaaacaaaaaccccaaggctgtgtactggccttcattagattggttgagaaagctgaaagctatcggttagcgtactgcataaataacacttgccagcaatgtgttgaagaccaa

SEQ ID NO: 6598 - DNA, 201 bp, Bos taurus
agtgtgaaagggtgatctcagagttaaaagacaaggctgtgggctgaagtcatagtttgctgctcagatagctatgtgaccctttctgggcctctttttactcctgtgcaaagagtcatgttgtaaagatcacaatattaagggaaccttaatgtgagggtgatatataaactgtgaaggacagtacagaaagtgtgaagg

SEQ ID NO: 6599 - DNA, 201 bp, Bos taurus
ttattttctcttgaatgaaggacaccagactcctcacttcttttagttttgtcacttgatactaggcttgcagtaaacgtggcctgaatccacatgcctttgcacttaattttactggactggtccttccccggggaccacaggaactaccaccaggaacttcctctctgacttagttttctccttgtcccagcatcctat

SEQ ID NO: 6600 - DNA, 201 bp, Bos taurus
agtggccgtggagatggaaatcagaaccaaattcaaagggaaatgcaggaaccaatgacttggaagtctgaaaaagcactctagtccctctgaccttaatgacataacacattcccttggccactttacagaggtcccagttcaaacaggcactcctatttacctctcctccctgtgaatctcaaaaaaaattttaaaaga

SEQ ID NO: 6601 - DNA, 201 bp, Bos taurus
cagtgtgcactctccagtgctccataatctctggcatttcctcagctggccttcagctccctcgttcactctgaaatccatcggtcacaggcagaactcctgcagccttgggatggggcagggagtccctctgttttccctcctggtgctcctgtcttgtgtgctccttcattttccctccctcattttaccaaagtgttg

SEQ ID NO: 6602 - DNA, 201 bp, Bos taurus
cccagcacttctttctcctaataaatcccaggaaaatattccttgagtcaagaaacatctctccaatagtcacattaggctggatcttgacttttgcaggcaagtgtgcattttgcctccaaagtaaaagtgaaagtgttagtcgatcagttgtgtccaaatctttgcgagttcctctgtccatgagattatccaggcaag

SEQ ID NO: 6603 - DNA, 201 bp, Bos taurus
tattcctgtttgaagccttaatgaaatttgtgtccaggatgagtcagtccacctgctgttcactagctgagtactctattaaggtcagctggcttccttgttacagttatttaaattttggatgttctactcatcagtgtctttaaatttcttgaggccagaataatttcaaatactatagccccctttcatcttataatg

SEQ ID NO: 6604 - DNA, 201 bp, Bos taurus
agcggcagatcgcccaggccggcctcgatggccatcactacttccaaagacaggttgtagggcagcagtccttctactcggttcagattgtccacggcgaagaggagggcgtcccgaggccaaagggtctcggccctggcgccctcccccggcttccgtgcgcccggcggcccccggccatgcagggcgctccccaaccag

SEQ ID NO: 6605 - DNA, 201 bp, Bos taurus
aatttatttcattattatttaaatttggacgtgagctcaaaatgtgttgttttaaaaacttagtaaagagttaactgcaaacacaggggccttcatatccttagctgtaaaggataagaaaagtgaattataatttcagtcagtaacctacatcccacctcacccaacactctgtcaagttgcagataatatggaaagatt

SEQ ID NO: 6606 - DNA, 201 bp, Bos taurus
agtctcctgcattgacgggcgggatctttaccactggcggcacctggtaggcccctttgtaccataatgaaatgttattatggagaagaagttgaaacagcagccagaaactttaagcctggccaataccttaatagcttctctggtgaggagagcctatgtgatacctccattagaaatactctgccttctgcagagaaa

SEQ ID NO: 6607 - DNA, 201 bp, Bos taurus
gtccaggaaagatcaataggaagttatggcagagctgacaccaggcacctattgggggagtagcttgaaggtttagttctccacttggttcgggtgacaatcatggtgacaagcctagaaaaccactggaggtaatggaagatggcaactacttctcatggacacatgcgagcacaccatgaactgctgtgggtcaaagga

SEQ ID NO: 6608 - DNA, 201 bp, Bos taurus
taggctgtatagtgcaggatatacagcatatattacattcctcttcttgagatgttcatgagctaaaagatgaatctgaaacctttggtctttctggatcattgcctccaaagtttgcttgggaaactacaataccacttattagaatgacatataacaatatgagtacctaagtgctgagtgaggactttagcttttctt

SEQ ID NO: 6609 - DNA, 201 bp, Bos taurus
ctaataaatattagcggggttgtaggatataatgtccatatacaatgatcagttgcttttcctgcaagcaagtaaggaacatttggaaattaatttttttgtaatttatgaaattccccaaaacacggagtattaaaaaaaaaaaaatccaagtaaatatacataggatatgtatgcagaaaaattaaaaacaaaatgata

SEQ ID NO: 6610 - DNA, 201 bp, Bos taurus
tatgtgcgtggatttatctctgggcttttctatcttttttgtgctttctattgatattgtaaatggcaatgtaattatcttccttgtgggaaaagaggagggcaaggctccagagaattaagagagtctttaagagaaactctcatagatactggagttgtccctgatagaagtggcaactggtatataactcagttgacc

SEQ ID NO: 6611 - DNA, 201 bp, Bos taurus
attgttatctacttcttgtgatatatttaggaaagagtatctgtattgttaaatcatttgccaaaatgaaacagcaattatgaagattccagtcctcagactaggaaagggaaaagaataacactgtttctctaccttctctttctactagattaagcattacctaattgatttgaaataacagggtttctaaaaattata

SEQ ID NO: 6612 - DNA, 201 bp, Bos taurus
acgtaatcaactttcccaaaatgatagtttaattttcaaccaaatataatatttattctggtagatgaaagaacatgggcactttcccacctggagtaaaattatttaaaagaaacctgtttaaattttacatgttctaaaataatattcaattgtatggaagaatgatatatttataaatgcttaatagcagataacaga

SEQ ID NO: 6613 - DNA, 201 bp, Bos taurus
tttgtaaacatccaagggctcgcatttcaaagcagcatatatttattgctacataaaaagtaagttaggacatgatacatgttgggtaaagcaaaaggccatgccaaaattcatattgttaaaaagaaacttgaggggaattccctggtgatcaagtggttaggactttgcagtttcactgacaagggccagggtacaatc

SEQ ID NO: 6614 - DNA, 201 bp, Bos taurus
taggttgatgtgcaatagcacacatgacagaaaagaggcatgctcattttgaagaggtcgtgactgctatctctggggtttactgttgttgttttttttttccccaattggcttccttcttaaatcccagctatgttctcttccttgtttttcagctttctcgaagtacaagtgatgaatataattgtaagatatttaaag

SEQ ID NO: 6615 - DNA, 201 bp, Bos taurus
caaggatgactttgctaccattcaagctcaatgggaggtgttagaattcctataagaaaggtcattataaagataagtagctttaaatccaatgtcattattttcatcattcataattgctgtttgcacttgctttagtacacatttgctttgttgatttatgttgttattcctcccatatgagcgaattaaattgctaca

SEQ ID NO: 6616 - DNA, 201 bp, Bos taurus
atactagatatttcaaccatttagagtaacagaaaaaaaaatatgaattctgtctatcctagagatgacaagaactgtccaaaaattcttcaaggtgaatgtgacctatatttaagatgtgcagctgtactctaggcaggaagcagatatgtgaggacagggagtcagagcgcaactcaaacctcccccttccctgcctcc

SEQ ID NO: 6617 - DNA, 201 bp, Bos taurus
tttatatttcctttcttggtgtatatatcatgctatttacttgacctagaatatcattttctttcactgtttctgccttttttttttttcttaatatcctccagtgttcctatttaagcagttatcttcacaagtttcagtcctataatctgagcttaaggccgcaggtgggtgtatactagagaaatgttgagctctctt

SEQ ID NO: 6618 - DNA, 201 bp, Bos taurus
ggtgtacctgacctaaagagaaatactttcacaagcattataagagctctaaatttcaaatgatttcctattgcttcaaactctcacagcactttaactttctgttttcactgtggtgaagtaatggaacaaagtttgtaggatttaaacacaatacttcaaaatctacaattttatgcaagaagttcttactttatcttt

SEQ ID NO: 6619 - DNA, 201 bp, Bos taurus
agatgccctattcttaacaaaaaaatataaacaatccaaataaaatatgggcagagaacttgaatagacatttttctaagaaagatatagtaaggcccacaggcatgggattagatacttaacaacagtagtcattcagttcagttcagttcagttgctcagtcatgtccgattctttgtgaaaccatgaatcccataata

SEQ ID NO: 6620 - DNA, 201 bp, Bos taurus
tcacacaagcactttctcatttatttccttttttaagttcctctatccttgtatctagagcctctcaaactatggtagggccaatgttctcatggtcatctgtttcattgatgaacttcatttatgttcaattccaacttcaatttcggctttatcacacttagtttcttgctgcactttcatctttgttggccaatcctt

SEQ ID NO: 6621 - DNA, 201 bp, Bos taurus
ggactttcagtctccccatcatcacttccatctcctggagtggagaagggctggaggttgaatcaatcaccaatggcctgtgatttaatccgaaatgtcagtgtaacacaactctccatcagatcagatcagatcagtcgctcagtcgtttctgactctctgtgaccccatgaatagcagcacgccaggcctccctgccca

SEQ ID NO: 6622 - DNA, 201 bp, Bos taurus
cttgcataaatcattgtgaagataagtaatttgtttaaaattatagagttgaaatcaactcctcatcttgtgttattcatgatatactgttctacgtggcagtgttaatgatggtttaagagaataccagatattttttattataactctcacagactagattttcattttcaattaatgactcactctactgaatgacaa

SEQ ID NO: 6623 - DNA, 201 bp, Bos taurus
cttcttgatgtaattacaaaaccctttactgataaaagcaaatgagaattacttctttaatcatactaccaaatcaaagagaaaacatttagaacattttccccctaaaatgtggcagaaagcaaaattattttgcaaaaagattttattcttatacattgaaaggagactggtcatgaagtcaattttattagtgtacag

SEQ ID NO: 6624 - DNA, 201 bp, Bos taurus
ggcatggaaatccaatccagtattcttgcctggagaataccatggacagaggagcctgccaggctataaagagttggacaggactgaagtgactgagcatgcacacactcaatcagtatatattttgaattatttatgtgtactgattaattgttgcttttgttgttcagttgcccagttgtgtctgtctctttgtgaccc

SEQ ID NO: 6625 - DNA, 201 bp, Bos taurus
ctatccttgcttgatcctcacaataagaagtataacaaaagtaatccagtcattcctttctaaaagagacattcctgaaattcagtgttcgtatatctagaatttatgttgtgataataacattgtttagcattactataactttaacctaaaaagaaatgttactatctataggtgttacatcttccagaaattcttaac

SEQ ID NO: 6626 - DNA, 201 bp, Bos taurus
ttgatgcattttgtttgtccttgacagataataacaattcaaccctgttttcaagacgttgatttgtattttaccctagacaagaacaatttacactgatctagaacaagctttctgtatcgttacccatttcacctgttcccaatataattgccctattaactgtactttaaaagaaagagcagatgttttcaatgtgtg

SEQ ID NO: 6627 - DNA, 201 bp, Bos taurus
tatctccagacctttggcctcagcagcctccttcacattccttcatatttgatttgacaacttacactggaaacttgaacacagcctattttttttttaaataaaattgtttaaaaatgtttggtctaagttttttacatggttaaccagaagttcataatgaacaggtgaattctagaaatctaaagaattttggatagg

SEQ ID NO: 6628 - DNA, 201 bp, Bos taurus
atatatttgccaatcactattatttaatatcattattattaataaagacttggcatataagagaatacaggttggtctggatacaagagttggcccacaataggaattgaagaagcagagaatagaagaaggcagatgagcaattatgatgtgatgagcatgattggggtttagagtgtgaagtcaggaaataggagacat

SEQ ID NO: 6629 - DNA, 201 bp, Bos taurus
catcttagttctttatgtgggcaaggttgcattaagccatggcccaccagaatacaggttcatcctgtatccacccactcagccacattgagatatgtattagaaaaagagtaaggcctatctgaaaggagaaatattaagcctgactaatttcagcctttggggcatcagagttctctactccctagtctatctcattgc

SEQ ID NO: 6630 - DNA, 201 bp, Bos taurus
gatgtccctctccactgggaatgagacaatgtcttccttactctgttcaggaaatgaagtacgcccacagttctgtgcacccaggtgtcaacaactccatcacactcggcctaaagcatcgctttgctggtgtctgtgttcagggaatttgccagaatgcttatcaggtgggtatgctccctgacaccacagaagaaaatg

SEQ ID NO: 6631 - DNA, 201 bp, Bos taurus
cttttttctctaagattacaattttgtttgtatgacatgtaaggatgtgtcttctcacatgtgttgcatgacccacaaccaacacaaaccagaattccagcggcctagaggaaaaaaaaaaaaaaaaactgttttaactatttaaatcatgattgaacttgaaacatgaaagaacatgcaacatcattatttttttcttat

SEQ ID NO: 6632 - DNA, 201 bp, Bos taurus
gacatcagtctcatgaggaccccagagtggtggcagctggtaagctatttcactaggcacaagttattcttacaacaaatcagatttagtcaataactttgtatgccttcttatgaatttctttttcagttcgagaaagtgtcaattgcctagtgtctcagcagaatatgcttctgattcctatgtcatactcaccactga

SEQ ID NO: 6633 - DNA, 201 bp, Bos taurus
ccaatggatgcctaaaactacagataataccaacccctatgtatactattttttcctatcacctgtcattttctttgaaggtcaatagggccactatcacataaaataaaagttacttggaaataagttctgtaatactgtgacagtccatctgatcaccaaaagggccagggcaaggagcacttacggtgtgtggatgtg

SEQ ID NO: 6634 - DNA, 201 bp, Bos taurus
tcacagcgtgtcttagatgactgtgagtacacaccaaggaaatgccatagacacccagctcccaagtgaggaggacaacccctagtgttctatgtgtgtgtagagaaaccagtatcccatggagtaaaacaaggcagccaaggcaggcagagagcatcgcccgtgaaactgacaagttcccactgtctggacatatgcaca

SEQ ID NO: 6635 - DNA, 201 bp, Bos taurus
tttataatctctcataaccctgttccaattctgtgatgtagttattaggatcatcacttaaaatgggacagaagctggggctcagcttagttgcctaaggtttcaaagccaatagttgctgggatcataacttgaagccatatttcataaactctgaaacttacatgttgttgcttaattcctacattgtaatgcttctct

SEQ ID NO: 6636 - DNA, 201 bp, Bos taurus
attgcgggcagacactttaccgtctgagccacaagagaagtccttagtaaatgttatggaaaaccccaaacaaactttctggccaagtcaatattttgctatctccttcctccccaaccccttcctgtagaaaggagaattatttcagtttcataactttgactcagatttttgggactctcaggactattagagataaac

SEQ ID NO: 6637 - DNA, 201 bp, Bos taurus
aaatacattctcgctaaacagaaaaagttgagagaaaggctgaagttacaggaaaatatatagaataagataattgttacaatgttaaggacattgttcacaacatccacagtagatatcatttattaatcatttaaacttgtgccaggaattagcacaaatagatgtaactacatttaattacaatgctattaagtgggt

SEQ ID NO: 6638 - DNA, 201 bp, Bos taurus
aggtcctcaaaaataagaggaacagttataaacatcagtgcagaatggttaagcttggctgtcttcataagaaaagagctcgaggggcggtccttagatcagttcacttaacaaacattagagatgttcacactgaattaagatcaacagtgtccaggtgtgtcgagaatgtcctctcttgtcacctttgggatgatgtga

SEQ ID NO: 6639 - DNA, 201 bp, Bos taurus
cttccacgaaggccgaaacagtgtagctggcattcagttgaatgaatgactgagggaacgaaaagctcataaaactgttatgaaaatcagaatgaacaccacaggaaccttgtgaaccatgaataggtgggcctgggcaaggggctgttactgtgattgccatgagcacagtcccctggtcttcgtagcagtgttcccata

SEQ ID NO: 6640 - DNA, 201 bp, Bos taurus
agcttgtgttttgtgagtttcgtttttagataacagcccaactgccgctctgatttgtgcagtttttgcacatgctattgtttgcacacacgttttggccgggacctcatctgatgagccatttgttagttctgattgagtaggtcacttgtgggctcaattaaccacttgcccttcatctgatggtgcaagtggccaatt

SEQ ID NO: 6641 - DNA, 201 bp, Bos taurus
actaggctccacctgtgacgtccaacagtgttgtataagggttcccttttcttcacaccctctccagcatttgttagttgtagactttttaatgatggccattcttatcagtgtaaggtttgatttgcacttctctgataattagtgatggtgagcatgctttcatgtttctattggccatctatatttcttcttcttatc

SEQ ID NO: 6642 - DNA, 201 bp, Bos taurus
gttctctgcatatgtgtgtgtgatttggcacttattattttcatttattttaaagcatcatgatcttaaatttgagaatatttgtcagcgattaaaaactggaagttttaaacactaattcgaaagtggtaaagactgcaaaattagccaaagctagaaataaactgaaatcactcaccaagaaagccgtgaccttacctt

SEQ ID NO: 6643 - DNA, 201 bp, Bos taurus
aatgctatattggcttattacatcacaatagaaacaatgaggatattttgaacacatgttctagatcacatgtgtgttcattatgaagaataacttagctaacttaggacatgtagccaaagagatatgtatctctaccaggaagtcatccctgggaagaaaactggtaagaaacagtcaaatgaacagagaacatcagtc

SEQ ID NO: 6644 - DNA, 201 bp, Bos taurus
agtaaattaaaaaataataaaggaagggcaaagtgtttaaaaaaaacaactggaaagcaatatgttggctagcccaaactcccatcgtgtaaacacacaggttgtttctaccaaagtaatcagtagaagtgagcactcttacacaacaaaattgctttcgaggaagaaaggtgctgactgtctgcacagataagtattctc

SEQ ID NO: 6645 - DNA, 201 bp, Bos taurus
tggtccaggaccactgagctgctctgaatgctttctatgttgactccctgggactgagacccaggatttaaaggggagaacgtctagggtaaacacacaatggccagacagtggctagaatttttcctcaggctttccgagtctcttgcagaacaccaagaggccagcaacaggcatgtggcctgagtcagcggccttctc

SEQ ID NO: 6646 - DNA, 201 bp, Bos taurus
ttttttcaaagtctgttgccatggttgttaagaccagcatgcattccttcagattacaacaatctcacagctgacgatgctagaaattgcattgtgaggtgtcattacacggggagcgaaaccaaaaaaaagaaaaagaaaatttagtttacagcaataagctttagcacccaaggccactgttccattcggaattgcatt

SEQ ID NO: 6647 - DNA, 201 bp, Bos taurus
ctctgggcaggcaggggagtggtggtgtatagatgcagctttgtttatctgcagggtgtggatcattgactaccagaactctgccatcgttttcttgtgtatgaacaaagtgtgataatactttgcccggaaccgggtcagcatttggcagggagggagctctgtttcacaggcagagcaatctgttaacgtgtaatttga

SEQ ID NO: 6648 - DNA, 201 bp, Bos taurus
tctctgtctgagcttccctcacctcacttcagctaagtttagcttgaatagagagttcagctttgccaaaccaccacactcctctctgtcggcctggaccgctgaccgagacagggtgggctctgtctccttcccacttagcttgcttcatccttacaggatgttacttaaggccttatgaagcagccaatccttttcaat

SEQ ID NO: 6649 - DNA, 201 bp, Bos taurus
agaagattctagcatgatctggttagtgcaggccactcatcctggagcagtgtagtacgactgtgatcttgagaagacatgacagtgagacatcagaaactacagggccacactcagaggaccctagatccctggtgggccatcacccatgggtcagccttgtccatatttggagaagtctcggaagtcgaaggaccacag

SEQ ID NO: 6650 - DNA, 201 bp, Bos taurus
gactgttcccccaagtagtagccctcctagcaaaaggattgtgttacttattcaccttggggactcataatggccatgcatcttgctttggccaatgaaatgtgagcagaattgacatgtcacttccaagctacgcttttaagagccagtgtatactctgcctcatgcttttcttctgtcacagtggccagcaatgttcag

SEQ ID NO: 6651 - DNA, 201 bp, Bos taurus
ggctctgtgttgattattaacgtctgcttgcaattggggacagaaaaaaaggaatccaaccagctgaaagccgggaaatcacacacaggggcctgagatccgtgtaaatgaaatttaataataaatggtacgtgctcccagattaagaagtaaataagagacagagaaagaggccattcagattatagaggccggaagagg

SEQ ID NO: 6652 - DNA, 201 bp, Bos taurus
gatgctgacaggggaatgtacatgggtgctgaggccttcggtgcctcccatgtcggtgtctgttgtctcctgcttctagtgattagcagtcacattgtcagcattccaagggcctgtggatctgttttaagggacaacaagaaactgaggaatggggtgagtctatccaatttttagccttctccaagaagatgacgagct

SEQ ID NO: 6653 - DNA, 201 bp, Bos taurus
atcgagcaaatccaatctggatcaccctaaatcctggctttgtgaggccccgatgccttccacatttcaacaattattcttttggaataaatacagttcaatccagattggttctgggcctccccatgccaaaggctagctgcatggtcctataaaccctccctctatgatccatttcattatctgtaaaacaaaggtaat

SEQ ID NO: 6654 - DNA, 201 bp, Bos taurus
gggcatggttttcaaagaatactgaaatatccagagcagtccagctgatacttgtttaccagggtagcaagaagacaaggccaaagtaaaaagggttctggacttgcgggtcctgcgctttgtggaccctcgaattctgggctcacataagggccctagaacactggtgggaggaaaaatggactaacctgaaggagcttc

SEQ ID NO: 6655 - DNA, 201 bp, Bos taurus
agtgcctcatacccacagatactggaaacaaccaggctatcacatttcctccacattcatccagctctgactacctttctaatttgtgagatatggtgttgatgtgaacaaatccactactgacaaataacgaccgtgcaaaaaagttgatttccaaaatcacttcctgtggtatccaggatggcctccaagaattaaagt

SEQ ID NO: 6656 - DNA, 201 bp, Bos taurus
cttccaattcaccactgggcagacttatcacggagaaagagaaactgaggcctgctgagatgggcaccagccatctctgtgatctttcagacacgttcattctttatcaattatttttcaacaaatacatcctggattgcatttctgaatgtcaactctggttgtagccagcattaattctggcctgtgagtcatttggat

SEQ ID NO: 6657 - DNA, 201 bp, Bos taurus
catcctggcctagtgctcattcttacttggaaagattaccaggactgaatatcagctcttgccatgatttctgggaatggcaatcatcacttttttcaaatagataatacttagcactcctcttgggctaagacttttatccactacttcagtgatcggctctaatcaacagtcaagggggcttttgaactcatcaggata

SEQ ID NO: 6658 - DNA, 201 bp, Bos taurus
agctgcagccctcaactggacgttattaggcttctgaccctgtccctctgcaatgtgtgggactggtggtctccaaaaagatatgtccacaccaaactcctggaagctgtaaatactgccttatttgggcaaagggtcttttcagaggtaattacaactcttgagatgagatcatcctggactacctgggtgggcctgaaa

SEQ ID NO: 6659 - DNA, 201 bp, Bos taurus
ctctgacttttctaaagtaaaccttcagaatattatttttggatgattatattttggatcaactctctcatccagaagcctgataaaacctgtttttactttgaacctggaaattacttttttttcctagtttcagaagtttaagacttcatggtttagatttcattccaagttcagactgctcagaggcccggtgggatc

SEQ ID NO: 6660 - DNA, 201 bp, Bos taurus
tctgtaaatggtctggaacttgggcctctgtggaatccagtcagaaggtagaaaccagaggtacatgggctgagactcgggcctggttgcaggttttctgaggctcactgagaggctgaaggtagagactgagctgaccttgctcagaggaatgatgggaagcccaggactctgaggccgcatcatctcccataggctccc

SEQ ID NO: 6661 - DNA, 201 bp, Bos taurus
tgccacgccgcgtggagccttctgatggccgcgggtgcagcaggtggcaactcggcagacagagaactcaaggctcgaggtggtcacgccgcacttcactctggggcctgcagcaggcagcggcagagtgcttggggaatctcttcatcgggacaccctctggaggacagggcccgtttctgtggcccccaccctccccac

SEQ ID NO: 6662 - DNA, 201 bp, Bos taurus
catctctgggaacatttacaggccgtttaaatctgcaggtgacccgattgttctcaaaaactccttcttcatctctggcagggtttctctgaatctccttcgcccactggcctacattatagaagtgctgtatgcggaccctgccattgtcgtcgtggacgcaggccatgacatcgtcaccaccctaacacaaaagatgac

SEQ ID NO: 6663 - DNA, 201 bp, Bos taurus
attctgatttttagactaatcagactaataagactttaaaagttagccaaagctaggagcatgcttcctatgggatcacagaggccctgacagattgctactgtgtgtgcagaggggagaggtgtaatcagatagaacatctctgcaaggaaattttattaggcaatatccaaattaaatgcgcacattccttttggccca

SEQ ID NO: 6664 - DNA, 201 bp, Bos taurus
ccaggcaagaacactggagtgagttgccatttccttctcctaactgtcaccaaataccttgatgttggcatgtgacaggccatagagcagtggttaaaatataagacaaaggaccctgactgcctggggttgaggctcagcactagcactgactgacggtggccctgggcggactatctacaccccggcactagttccctt

SEQ ID NO: 6665 - DNA, 201 bp, Bos taurus
ccgcagaagaattcttataatgagattactttctacctactctagagatgtgcctacactgcatcctcatgcttggaaacgtctccctagcacgtccccatgtgcagcaagatactggacacctccagggtggggcgtcatggatgcatcacctcacatgggcgccagcacctccatcccagtgttctttaccgcaacagt

SEQ ID NO: 6666 - DNA, 201 bp, Bos taurus
ggagtcagagttcagggatgggccatggcccccagccacaccgccccggctttctcccggaggccctgagcccctcagggtccctcgatgagtctggccgcctggtgatgacttgggcagcccaccgagaccccaggggtctcttacctcaaactggatcagcaccgtcccactttcgaggcccttctttagctgctccat

SEQ ID NO: 6667 - DNA, 201 bp, Bos taurus
aatgagccacaactggcattttaagcgaagaaaagagaaagcttaagggtgctttgcacttactactgtttcaagaaatgtctgcttcagtaatttacatatatctgtgtaatatattacaaagcaaaatatatatgtggggttgtgataaaaaaaaattcccactggttaaaaacacacacacacataatccatcatgac

SEQ ID NO: 6668 - DNA, 201 bp, Bos taurus
tgcaaagcatgtgagatcctagttccctggccagagatcaaacccactctccccattggagagccaaacctttatcgctggatcaccagggcagtctttagcacaaagcgctggccatgattatcctatgatggtctcgggagttactgtaatgtgtggggtcgtgtgttcctagactgaaggactccaaaatgatgttgt

SEQ ID NO: 6669 - DNA, 201 bp, Bos taurus
gaagaggcagatacacatggatagcatcacgtgtagccagacggggaagtgggggcccttccttgacctcagtgaggccttggccccttgtagccccacgttggatcccagatctggagctggacttgatttactggatgatgcaatcacaaggacactggccatgtgggtgttggaaaggagcttcactggcaatgtcag

SEQ ID NO: 6670 - DNA, 201 bp, Bos taurus
tgtttctttttccttgtgttgttctatcagatcccttggagctgcagaacctcaggaattactatttaatgatatattgaggggctgccctaccctctcctttgggccccaccccctgccacctcttctcaggagcagaaaccatggagccccagccccataagagctgtagtccatgagcctgtagccagtgaccactgg

SEQ ID NO: 6671 - DNA, 201 bp, Bos taurus
gttgatgtaggccactgagtttgtggtaatttgttacaacagccctaggaaaccactgtgctcagatctaccccagaattatacctactcttctagatcgtcaaaccatagaggccaaaagccagtattctacacgtccatcaccattttctcatactatgctcactctttacagggcttcccaagtggctaagtagtaaa

SEQ ID NO: 6672 - DNA, 201 bp, Bos taurus
cttcccgtagaaaataaggaccagtgggcagagaagaggccttaaggagtagcaagagcacattacatagtctgctttgctgctgtgtcttcgccccaacatacatctcagcttttgggcctattagttggtacatttacttaggagacgacaataaataattgagctataggaaacagaggtacagatatccattgacta

SEQ ID NO: 6673 - DNA, 201 bp, Bos taurus
gcaaaactgtcatttcttctggggctagcaggacttttcatacatagagcctgaggctcaacaaataagatgcaggcaaccctgaagtacagatgtatctttggaaaagcaaaggccacttagaataaaatttacagtctgttattagagctaacagctgctaaaccttataacaatatccttatgccatgtcttagaaat

SEQ ID NO: 6674 - DNA, 201 bp, Bos taurus
agttcctggtagaataacagtagccaaccgtggccctggcagtgggcactttatcttactacatatttttttctctttactcttcactgtctattcttaactatgttgagggaaaggcacacatcttcctcagtgaacagcataagaatggcccttagcagtagttttggagaaggcaatggcaccccactccagtactct

SEQ ID NO: 6675 - DNA, 201 bp, Bos taurus
acctgggaaatgtttaaacatttttttttttttttttgggacaaagaaacaaagctaactcaagtgatcaatgcctagtcatctaattttgattctttgatgagatttgtttaaaaaaacttgagtctggaaaggtcaggggtaaaggggttggagggagggaaggaggaggaggggctgtcacactgaataaataatcta

SEQ ID NO: 6676 - DNA, 201 bp, Bos taurus
tccagctctctcctctgaccaccctccctcctgaccccttgaccctccctgcaggagctgctttgagcaactgtgcccagcacctgggagagaactctgcggaggccagcaagtcagcattccaccaggagcaccgtggctagagctcaacaaattcagctgtgatccttccacgccctccatccaggcctgcaccaagcc

SEQ ID NO: 6677 - DNA, 201 bp, Bos taurus
tcctgctacagtgttccttattccataattcacaaggccagtgtggggatgtgccacttgttgacagtatctattccaaatactacttgcaaaccgagggaaaatccatgggtgctttcagagtctccatatgtggactttgaagtgaatctcaatcacctgagactcacaggcagactcactgacatctatattgcagtg

SEQ ID NO: 6678 - DNA, 201 bp, Bos taurus
ttgttttgggccacgtggcatgtgggatcttggttcccagaacagggatcaaacccgcatcccctgcagtggcagcacagtgtcttaaccactggacctccggggaagtcccaagggaaggccgtttttcttaagtcctgttctgaatgtgttatgtctaacatatcttgaaatgacatccaagtgacaatgtcaagcagg

SEQ ID NO: 6679 - DNA, 201 bp, Bos taurus
ttaacctcctcctaccatttcctccaggtcaacactcaatggagaaacagtgtgtccatttgaagaaaaacatctcctgttttatttagaaacagtctaagatgaaattctaggctggccaatatactgataacatctactaaacattatgaaagaaaacttactgcaagtcagaaaatagtccaagacaatactcactgt

SEQ ID NO: 6680 - DNA, 201 bp, Bos taurus
tttccaacatttgctcgttatgccatctggaacatacagcctccaaggtctcagaggtaaggaaagcaagacctggaacattatacaaagttttcaaacactggcctgaaaagagcttagaaccatgggtcccagtttggtgccaaggtgtccccagagcactgtaaggaatgcataagagctgcctgaaagtaaaagtgt

SEQ ID NO: 6681 - DNA, 201 bp, Bos taurus
ctgcttttgtgacctctgatagtttcacagaacgtaattataacagcatttaataacgttattgagcgtgtctttctagacacaaacttcttcagcaaaatgaattcaactatcatgtcatcttcatgacagtcattataggattgaaataagttcaaaatatctctctgggagagtcttctgctgggctgtctctatact

SEQ ID NO: 6682 - DNA, 201 bp, Bos taurus
tcacatcttctggattctggagtcttttcaccctatcagaggtttctttccttgggcctccttatcccaccttgagtaggcattgctttagaaaccttcaaaaacacttaggcacctagggtttgggcacatcctctctagtctcttctagtcagtcaaacttttaatttctttaggtggaaaagcagctcttatgttaac

SEQ ID NO: 6683 - DNA, 201 bp, Bos taurus
aaggagtattcgggaacattcttccggactttatggatgctttggcttgatgaatcttaatcgcctctctgcacaagacttgtgaactgatgggatggccgtgcttttcctcgttgattttcattccctaacatctcagtctctaaaattgttactgtcctttccatcattttagcttactgttttatcctttgaatcttt

SEQ ID NO: 6684 - DNA, 201 bp, Bos taurus
tgtgtcatcttccaacacctgaccaataccaggccagtggaaggaacacaggcaggaggttagagaattccgcagaccattgatgggctgctgtggagcgcggaggcttcccaggtggcccagtggtaaagaatccgcctgacagggcaagggacacagggtcgatcctgggtcgggaagctctcctagagtaggaaatgg

SEQ ID NO: 6685 - DNA, 201 bp, Bos taurus
gaaaaggaaaaaaaaatgacacgtgaagatcccagccaggactgggattctctctcctgccgacaggccatcccagggacagtgaagtaagagtgagcccggggctgcactagccagacgtctgggaaagacagcctgccatcagctgctgctgctgctaagtcgcttcagtcgtgtccgactctgtgccaccccatagac

SEQ ID NO: 6686 - DNA, 201 bp, Bos taurus
ggccagcaattctgcagtcacgtatccactggcctcagaagcttcgctaaagaatgaagcaacctcttcagaatcacaagcaaatgtgctttggagggccgagggaagcactaacacctgatatgaactgtaagagaaaagaaaacgtctatcagacccttgcttgggttgcggccgggggtggaggggtcattcattcat

SEQ ID NO: 6687 - DNA, 201 bp, Bos taurus
aagcaaatatagagaaggtaagtactaatctatagcaaaaggtattagccaggcctggggaagaagaaggaatagaaacagctggcatggagggttgaacgcttaacactcagctagcctgacggagcagaagggaacacttaggaggccctggaacattggaggattatccctcccaacgcagtaaaggaaagggtggta

SEQ ID NO: 6688 - DNA, 201 bp, Bos taurus
ttttggcacaaattaaataaaacacgtggaaagcacttaacacagtgcctgcttgatctttggtcctcaatacttgttagccaatatgtgaatgggcctcacctctctactgactcagctctccctagagcacaagccactcctaacccacacctgaccctgaccatgaacaatgagcatgctggcaggggagtggccaca

SEQ ID NO: 6689 - DNA, 201 bp, Bos taurus
cgaacacacacacaaaccaaacatcctaccagcagttagtttgtggagcttgggcaacaaatagactattggctgttacatttgactgtgctagaagccatccggacaccagggttctcagaaaagcaaagcacacatgggtgggaagggatgactcagcagaacagtggcccctccccactttacactgttaagtgcact

SEQ ID NO: 6690 - DNA, 201 bp, Bos taurus
caatcctaccccacaaaagtatgaaaaagagaaaacatagtgggaatcactttttcatttcacttaaaaattaacagaacctttgttgcactaacatcaggactccaacatgtaagttagtgtgacccctttctagggaatctccttagggtcaatacaggattttcctgattctccccattgggtcatttaatgtattcc

SEQ ID NO: 6691 - DNA, 201 bp, Bos taurus
ggaaccattccctagcttagtgagtggttctgtccatccattttcccagtccagaaattgagttatctgtgacttctcccttattctcagtcctattttccgtatagaatcaaggtcctaaagcagtcagttcctgctccccaagatttctcagttctgctgtttgccccagacaaatcacatactaccctgtcacctttg

SEQ ID NO: 6692 - DNA, 201 bp, Bos taurus
cacctcctcttcattcagtccaactccaagtcctggggctaacacgtgagcagaaagcagagagggcctatcagtggcatcatgcgttttgagaaaaacacgggaacagtagataagcaagtagcagaatatgcaaatattgtgatttttcacatacagtgtaggatcatagagagatccagaaaaccaagcagtaaaaag

SEQ ID NO: 6693 - DNA, 201 bp, Bos taurus
ccaggtcagtctgaatggacctggggatcacaagctctcttttactatacaaacaatctcattctagtttatgtaacattctgcctcaattcagtttcattcctatttgaacctgggcctatagatcaattccagcaccagaaaactactgtagtgcctttgccttggcaatgaaaaatgagacaaaaaaaatctagcttt

SEQ ID NO: 6694 - DNA, 201 bp, Bos taurus
cacacgcacacacacataagccacaaataaaggagataattaagataattttgaaaagcttacaatgagggcagccttcttaccagtgacactaaaagtagtaaccctacagggggaaaaatggataaatttgactgtttaatgattttaaaaattctgtgtaataaaagctatttggcaatcatgatagttgcctgctgc

SEQ ID NO: 6695 - DNA, 201 bp, Bos taurus
gtccccaacgctcactaaaaattgtacttggatttaatttgaattgagaaccacatttgagtcctgtatttctaatctctgcacctgattttgacttaaattgacttctaacactgacatatcttccaagggaacctaagccaagagcatcagctccacatcaccctcccctcaggaggacatggaaaaacacaaagtcac

SEQ ID NO: 6696 - DNA, 201 bp, Bos taurus
tgcacagggaggtcaccggctagttcaggttcagccgggactgtgccctcacttgccccctcacctgggacctctcactggatacctggaagccctgacggtagacggccctgagaccctcccaggatgtgtcccccgccccttggcctgagagtgagtgtgtgcatccctgtcttccctcccctgtgttctgggagggta

SEQ ID NO: 6697 - DNA, 201 bp, Bos taurus
cctggtgctctcccctgtagaccccagcgccttcagggagagacatgtgtcttgccaccgttgggctccagtgccctgcacaggccctggcacgtgtctgacactgggtaggtatttgctgagtaactctaggggtgggggtgaggtgggtgagcctgggacacagtcctgatgagccaaagcagagcctgcccagggcca

SEQ ID NO: 6698 - DNA, 201 bp, Bos taurus
acaccctggctgagcccctcctcctgtggccgcagccacttgctggggctccttgcgtatgtggcttgagcttgagcaggtgccccaatgatcctctgctgccaccttgtggccatttcccagatagcagcacttaggaggccctggtttttcccaggttcccgtccatctgttcagttcagttcagttgctcagtcatga

SEQ ID NO: 6699 - DNA, 201 bp, Bos taurus
tctcaaccccatgatatcctggtcctttctattcagtcatcctatgaacctaaccttacaacccacagcattatgacttatgtgtgtgtagacacacaaacgtgcttgttcatattcaccccaccaccacacacacccatgcactagcaatcttggtagagttaatggttgagagctgggactctgaagtcaggctatcta

SEQ ID NO: 6700 - DNA, 201 bp, Bos taurus
ttctctgttaaatttgtcttttttctaggtgtacttttttaaagctatcatcatagtgcatacaattttatatcctgcttttttcacctaacactgaaacagcagtaattttagccagctacatggacgtcagtaattgtgttttattggctccatggttgctgcagggggtctgtcatttgagctcttacactgtcttgc

SEQ ID NO: 6701 - DNA, 201 bp, Bos taurus
ttgaaaagagtggggcgcaacttagcgattgaacaccaccaccacaacactgatgcagtttccaggagacagcatcctggccctcctccatagcaagttccttaggtgtccgttaagtcccacacaaggctagacatatagacttctagaaccttccaattcctatggccacatgcttcctctgattattaagtgattgtt

SEQ ID NO: 6702 - DNA, 201 bp, Bos taurus
ttgtgcagcaggaaatgggcctcatcttaatgttttccattcactgcgagccttagcagtgatcactatgagggaaggatgcaaccatgccaagaatgaaagtccaggagagcggaggccctggtggagtatcagtgatctaaggtcctttgccttcccagctccctctttcttatccaagatggctagataacccttttc

SEQ ID NO: 6703 - DNA, 201 bp, Bos taurus
gcacaggtcaggataaggctgtcatgagacgtcaccttgcagttagggtagttagggtcctggctcttccctccataccctggggacaatgagaataacttcaggcctctcaggacagatttatctgtgtttgtccctgcagcctcatgagtggtcgggtcctggtcagagccttggtttttaccgttgagaaaagccagc

SEQ ID NO: 6704 - DNA, 201 bp, Bos taurus
gtcatgtcagcactggggatccggtgttcactccaggaccctgcaccaaaatggcttgtcgacagtccacgctgacccctggcctttgcagaagcggatggtcccactctgagctactttctgtgctgcttagaactgttggcatgagtggaaggggcccctcgcccatccctttcattgtctggtgagccctgaaaatgt

SEQ ID NO: 6705 - DNA, 201 bp, Bos taurus
ttggggtacactgggggaacaggaaaggcaaacacagtgtcagcacactgtaaagtcctgtgcattcagcagagcccacagattgcatgcatgtatatagcaacaagcatagattccaaacagttgtaagaattaaataaagtagaaccatgcctgacacacagctttgaataatgcttttgcatgtgccacttagaggaa

SEQ ID NO: 6706 - DNA, 201 bp, Bos taurus
ctctcctgaggaagagctttccagagccagtgttcgaacagggctgcctccttgtgactcaaagagtttggggttctgtagaggcctccagctactcgacgtgggtgcctagtggggtgcgcttgacctcagtacatttgtctgctgaggattcaaggcctcagggacaaaatgctgtgtgacccataaaggcctgtgagt

SEQ ID NO: 6707 - DNA, 201 bp, Bos taurus
aatgtgcctgtgggaaagatcaccgtgggtagggtgaccaccttcaactcttccccaggctcagccctggactaggagcacacgaggttgtagatggaagcttgtgggaccctctgaacctgggtggtcagagataatgcagtacaggctagggctggaggctctggtccatgcaggctccgtgccacccactgctcttct

SEQ ID NO: 6708 - DNA, 201 bp, Bos taurus
tgtcagagactaggcagccattcggttgaggcggccacatcctagcgggcttgctcacggggattttagagtagcatctgttggactcacaatcttccccgttgccctctgtcctggcctgggaaaatccctcctggtcgtccttacagtgggggcttgcagtggtagaaagttaagtgaagagttccccctgctgtctga

SEQ ID NO: 6709 - DNA, 201 bp, Bos taurus
actcatttattcacgtacttagcgaagatttgaagactgatgctgcacatagcactatgctgtcaccacgaacacaatggttttaggcagatagatggtacatatgtagatatcgatatggctatagatatggctgtggatgtggatataaagagagacagagataatgactggacccttgcaaagctcagaatccggaaa

SEQ ID NO: 6710 - DNA, 201 bp, Bos taurus
ggaaagctttgtatgcccggcatccccttgaccagtggttctcctcaggatcttcatgggctaatacacgctgtctctgtggtttacctggcccggggtgtcatggacttctccctgatgtgaagaacctgaggtcttgcccctgaggtccctgcctccccgtctcagccctgctcgggcccttgcaggctctcacctgac

SEQ ID NO: 6711 - DNA, 201 bp, Bos taurus
cctgtgacaggcagaggagacagcagttttagagaccagggccagtgccaagggctgagcagagagggggcttgcagtcttccaagtgcatgagtgtacatttagctgtatgctggccagttgacttattttgtcttttggaatctcagtttcccatctgataagctataagtatcatcggagtctctgcggcactaagca

SEQ ID NO: 6712 - DNA, 201 bp, Bos taurus
atatacagatatcctgccatatgtctctggagaaaggagagctgagaggcatgaatggagccattgactcagctgttttttgggcacaattgctttggggaaggaggtggggggcagtcctcccactgtgaatgaactgctggggcacagctagtggatggacttcacccagtaattcctggttgattttttatttgggtc

SEQ ID NO: 6713 - DNA, 201 bp, Bos taurus
actctcttcttcactctagaagccagactgatgaaaacagctaatgtgtatagtattgctggcaaccttggcataaggaaaaaagagatcctccccaccccgatgtcaccttgataatcgaataaaacagcctggaagtgacacagattatttctgcacacaactcgttggactgaactgattacttgcactgacccaaaa

SEQ ID NO: 6714 - DNA, 201 bp, Bos taurus
agtttcccataaagaactgcattaacagtaactcacatattttgatatgttgtttttattactttatttttttccaatttaagttttaattttctatttgccctatggtcacttagaaatgagttatttatttcccaaagtttttgggttttctggagataattctaatttaattctaccttggtcaaggcaatgctttgt

SEQ ID NO: 6715 - DNA, 201 bp, Bos taurus
gagctccacagccacctcctcaccccagctgcccaagactccttcagaaagtctctccctgttaggccttttcaagaattaaccaaagtcctgtctccatattcaccaaagtcaggggtatttacataattttcaggagtctcctccatctgaataaatctcctagcatctcctctgtacccacacctggaggattagccc

SEQ ID NO: 6716 - DNA, 201 bp, Bos taurus
agtaactggttcagaaaatgacgacatggcactgtattttaatcaactgtcaaaatcaggttgttcaattcgccagcacatcatcccttcccaaccaaacatatcttgcttaaaatgaaattgctttgtattgatttattttgtttccatgtaagaaagtaaggatgacagctaccaaaagacaaaagggcaaagggtgat

SEQ ID NO: 6717 - DNA, 201 bp, Bos taurus
tgttgttctagatctttccttttcaggtatatgttcattcaaatgtacatgctcccctccctctcattataaaacgtctaaaagcactacctactttccttgagataatctccctctccccacccctataccaaattactaatcgttgcttctctccaggcaaaatcatcattccatccatggagcctgcactgaacctcc

SEQ ID NO: 6718 - DNA, 201 bp, Bos taurus
ccatattggcagccagatttagcataattgtttttccactctgaagattctaaagaatagagacaaagaagcatatacataaacaggattgctgaagtagacggtttaagttcactgacccagagtatgtatacttctccaggtatagaagcctaacataaaatttcatatcttggccagaccagctgtttgcctattagc

SEQ ID NO: 6719 - DNA, 201 bp, Bos taurus
ttttctgttccggggtgaggtaggggggttgttagccagaagcggaagagaaggtgagcagagaggtgggatgtggggagggcagggatggggacggggggcaaggtcagaggggcagggggtgaagtccagaagcctgttctctcatacttcccatagctatcagtgcaagacataggggagctcattccaaatgtggag

SEQ ID NO: 6720 - DNA, 201 bp, Bos taurus
cagagaagacaatgttagaggtgaggtggggaagtcgcagcaggtcttacccaggtaaaagtagtgaggggaaggccagagagaatgatgagagagaagcgtgctcctggcagagcgcagagtctgtgcaaagcccagaacaggggaacacaggaaactctgattccctgaaaagggccagagcacggtgcaagaggtgaa

SEQ ID NO: 6721 - DNA, 201 bp, Bos taurus
gtgtgaaaaagcaccgaatccagagtcaggggaaacacggcagccctgcctctttgagacaccctgtgcagatcaggtcctctctttctgcagacgcaaatggccacgatggaaagaaagggcatcaagcttcctcccaatctgtagctgatctgatcttgcagctaatgtcaacatcgcgacccctctgttttcctctaa

SEQ ID NO: 6722 - DNA, 201 bp, Bos taurus
actcttcccactgatggaaattagaggggcagcagggtaagggtgcatgaaggcagggagaccagctaggaaaatgctacgaaacccgagagaacagtgacggggtgaggggccccggcccaggggcaggcggctcagagaggagagtaagaaaatcagtttactattgggaaatggaggctccaaagtgcaagtcctggt

SEQ ID NO: 6723 - DNA, 201 bp, Bos taurus
ttctatgggaaccttaccttgactttaggcctggaagcaggtttctcttccagacaccacagcgtgctgcgtcacagctaaccaacacattcatttgcccgtctcacccaacagattctgatctcaccaagaacacaggccacgccttatccacatgagtcttctcatgagactgagaacacttattcggtcaagatttat

SEQ ID NO: 6724 - DNA, 201 bp, Bos taurus
gtggagactctaaaaagaggataggtctacaaaactgccaaatcctaagacaactgatgttctaacttgcagcttcttccctaaatgcacaatatgctcaactgcagaagggcagctatagcacagtgacttgcttgggtttaaattcaagctcttccatttccagctggatcaccttggacaagtcacttagcctccccg

SEQ ID NO: 6725 - DNA, 201 bp, Bos taurus
tccctcgcctaaactcctgggtacaattgctaaactcttgcaactctacagaacatgatctgaaaaccactgaacacagcatcacttagcttccagttcatgttattggccatgtggctatgggcaagtcacttaacccttcctcttacggaaactgatctttgcctctatgatgggtgtaagatgtaaaacaatgttaaa

SEQ ID NO: 6726 - DNA, 201 bp, Bos taurus
cctgaatttgtatctgggttccacccccagtcccttgtgtggctctggttgcacagaatgatgaatttttttctgggccactgtttgcttatcagaaaaataggagtatcatttttataagcaaaaaggaaatcaatcctggatattcactggaaggactgatgctaaagctgaagttccaattattcggccacctgatgt

SEQ ID NO: 6727 - DNA, 201 bp, Bos taurus
gatggagtggccttttaaaaatgtgagtggtattatagcccacttctgctcagaccatgtgtgggcttctttctcttctcgctcagagtaaaatccaaggcactgggcccatgtggctcagggccctctacaaaccgccacaccgcccctcttgacatccattacctttttatttctagccctttcccctaccactcgcct

SEQ ID NO: 6728 - DNA, 201 bp, Bos taurus
agtgaattatttaagttctccctgtctcagtttttctacctacatataaaagggacataaagagaccacgtcagaggccgcagaacacagcgaactctcaagtacctggagctctcatcattaccaccaccaccatcctcttcatctcttcatgaaatatcagataataataataataatggcaatgatgcttccggccta

SEQ ID NO: 6729 - DNA, 201 bp, Bos taurus
tgtctcttttccttgaaaatggttggatgcatatgaatcctccccccagtagaaaacagtgcaagtgacgctctgtgacttgcagggctcggccataaaacgccatcctgtgtaccttcctctcttggaactggactgccacagtgtgtgtgcgggagccccgtcagcccatggagaggcccggctgaaaagttcctgggg

SEQ ID NO: 6730 - DNA, 201 bp, Bos taurus
tataatagtgattatatgctaaatgataactgtaatgagtgaaatgtgctatctagattctaaccactttttttccatttccatggctatcaccctggcccagttaccagcatctctgacctagatcatcccatcagtcttcctgttagcttccctgctaccactcttgtctctggccccatataattttctcaatagagt

SEQ ID NO: 6731 - DNA, 201 bp, Bos taurus
gagttcctggcatgggaaaaggggcacacaatcagtgggaggtaaggccacaataagaacaggcatggagtattagctactatgtcaggggaattgtacagcatttttttctcaaatctggccaaaaattagaattgaaagaaaattttataccagatcccttggccagatattcccatataatgtgtctgaaataactag

SEQ ID NO: 6732 - DNA, 201 bp, Bos taurus
acaaggacagaggggcaagacacaaagtcgccgcacaccgctgcctgtctcaggcgccattcctagttcctccaccaaccacttaccttgagtctaatgatagtcagccttcacctctccaggccagaaacacctccggaagccgtcacagacccagcacttagggattacctccttgtggataccccagcacaacgcagc

SEQ ID NO: 6733 - DNA, 201 bp, Bos taurus
ggaggcccagtttgcagagcagcagagggctggggttcaggggactggagtctcagcagctggcgctggctctggctagtccttggcgtctgtgtttgaacccaggtggcccaggcacctcctctaactgcccctctgcctcctaagaaggagagccctgcaagtgtagccaaggaagctggacacaggccggaaggtggg

SEQ ID NO: 6734 - DNA, 201 bp, Bos taurus
ggactgggtgtgtggagatggttgaacccctggtcagaggtgctgggacctcagcaaggtcccagatccaaggtggcccagaatctctctgctttctttcagattcctgttggaaccacagtggagtgcagacagaatggagctcccgggccaagttacaggatgctcactagcaaggctgcgtggcccagggtaaggggc

SEQ ID NO: 6735 - DNA, 201 bp, Bos taurus
gcatccaacctgatttcaaggcttggccccattggcagccctgtgtgtgaccatgaacggtgcccttccctctccagccttgctcttcccgcctgtaaaagaaaaggctatcccaggccatcgtgtatacctttctgcactgagaagtctatgctccaggatgacctagcagttctcaggattcactttttacttctcatg

SEQ ID NO: 6736 - DNA, 201 bp, Bos taurus
ccacccttgagcaaagggatatttgaaatggtgtgcagtaagtcggcctgatctgggaagtgagctgcagctccatcttgctctgcatcccatgctaggtaactgcagtatttgaaccatagtttcctcacctgctaaaaaaaaaaaaaaatgtgtggggtgacttcctgaaaaagatacccaaaaggaagggggcatcag

SEQ ID NO: 6737 - DNA, 201 bp, Bos taurus
acctggggtgtgagccaactataaaggagaggaggagagggtctcagcctcttggaccactgcccaggacacagaagcctggtctccgggagtcaggcctgcgggtccctcccttctggggaaagacacatttctctgatgcccacaaaactctggtccttctctgccagaatcccagggcccctttactgaatctgtacc

SEQ ID NO: 6738 - DNA, 201 bp, Bos taurus
ggccttgtaacctgtgttagctgacccttggatttccttcatgctgttccctttccctagaattcctggccctctgttcccatctatacttgttctgagacaccacctcctctgcgaagcatttccccacttataactgacctccctctcctctgtgttcccaggatatgtttcatgaactttaataaatgcaaaactttg

SEQ ID NO: 6739 - DNA, 201 bp, Bos taurus
tgacttctacttctctgctgtaaccaggaataccaacctgttggtaaaactgctttgagatgaatagtatgaaatggggaatgaggattgaggacagaagtggcagttgccatggaaatgcaggggtttttgtagagcccagttttgggtgatgccactcataaaggtctgtgaaatgagaatgttctcctgtgatggtaa

SEQ ID NO: 6740 - DNA, 201 bp, Bos taurus
gagagtgcttaggacctctcctgaccagggtgttacaaggccaggacagggcgtcaggcttttgtagcagtgcagagagcagacttctcctgcctcgctgaacaggctgggatcacctggcctggccaaggagctacagaagcaaaacacagagggagaacacatctatttaaggtggtaagaaagtgcagagaagggcca

SEQ ID NO: 6741 - DNA, 201 bp, Bos taurus
cacaattttgattagtgttgaccaaaaaggattattactattgtcactcatccgtgttactactgcggccataggaccctgtcaaaaagtaaattaaagacacacgtgatgcctcttgggctacaggatgcctggatgctcagagcctgaggccaaccgtgctaggaccacagaggggagagaggctctgccctcctcttt

SEQ ID NO: 6742 - DNA, 201 bp, Bos taurus
tagctattctagccttgaaaaagaatgattcaaaagagacttgaaaaagcaggacctcgccatccccgggagcacaaacgatggccgtgagaacagaggaaccccttcaatctccgtgttgggaattatttatcactggagctgtgaatagaagggccaagctgtgcggttattacgtcctcgtctcaaagccggccaggg

SEQ ID NO: 6743 - DNA, 201 bp, Bos taurus
ggggcaggcatggagaagaacagctctatacttgggttctgctaagttttgttttctcagtgcaaaaaggatccacagggcctttatcccaaagagtcctcccttggattcggatggcagccaataacatcagctcatgcaagcccatcaatggcccaagggctggaggattattaagagtctgggaattaaaatctgagc

SEQ ID NO: 6744 - DNA, 201 bp, Bos taurus
gattaacatcagcagtaatggttcaaactgaaattgtgggccagtcaatagaatgcagttaaaagcacattactctgtcatatttctgtacccacctcacaaaaggcttaactcaagtgtaattatgagaaaagatcagacaaatccaaattgaaggacactgtataaaacaattggctttaatctttaaaagtatcaaga

SEQ ID NO: 6745 - DNA, 201 bp, Bos taurus
gttgcttaacctgagaactagctgggcagttatcactgaaggcaaagcaactgatgccaagtggaggtggaccagggcctgtagttgtgggtgtgggcagtggttaaatcagaggcgactgagagcaaggaggctttttcaaaactgtgtttttacataggctgtttcctcttcctgaaatctctgctttctctctgattc

SEQ ID NO: 6746 - DNA, 201 bp, Bos taurus
gggatctataaagagctaattccaaaagatgagataagtacagtaccagaaacaaagacgaaggggaaaccaagattcaaagatcacaacacagaaaataggacgactaatctgggttctgtgggaagaaatttgggtccacagagtgaggggtcaattctaggctgaggggtcagcacattgaaaatgcatgtaattata

SEQ ID NO: 6747 - DNA, 201 bp, Bos taurus
gcagacttctgtctggcatgtaatgaaagatttcaagataaaaacctaggagacaaatcgagggaaatgaaaggggagagtacgtgatgagtaaaacaaattgctgatattaatatgaaaatgatattccatagtcctagttcaaggaggaaaaagacaaaattacagatgacagttcattgacttgactttttaagtcaa

SEQ ID NO: 6748 - DNA, 201 bp, Bos taurus
ctcattatgaaaccgtccccagtggtggcctgcccagtgagaggtggcaaactggtgtgattaagctcctccctgcaggtggcataaatagtaagtatattggaaaataaggagtcctttaaggccagacttcatgcccaaacaatgagctgctattctgcttcccacaaaatttattacaattagatgtggacccaggat

SEQ ID NO: 6749 - DNA, 201 bp, Bos taurus
acacatgtataagccaagatccaagtccactcaatcagagcagaattatagccaacccatagaactgaaaagcaaacttgttgtaaggaactgaaatttggagttgtttattatatagcataattatactatgcaatgctcttttttcttttcatatctaattgaatgcataccacaatcatgcacattgcattattaata

SEQ ID NO: 6750 - DNA, 201 bp, Bos taurus
gcgtcagctgttgtggaactttctcttcccttggtcttgcattgatttacctccacatagtctcccaatacactcccaactctacccttaaccgaagtttgggagaagggaaaaaatgaggacagtggcttttgggagttctcatatctctgggaaccctattcctggggccaaataacacaccacttctgtttatataca

SEQ ID NO: 6751 - DNA, 201 bp, Bos taurus
catataaacttttttaccagagagtttttggtttctatcaaatatgtatgtcttgaatgacatgaaagatacttgtgcatactcagaaaataccagaaacctaagcacactaaagcttacattctctctctctctctttgcctctatccctgcccagttctctctccttagattctagtatggaaataggcacttggaaga

SEQ ID NO: 6752 - DNA, 201 bp, Bos taurus
gaacccacgaggatttagcattgacatttgtaaggtatgattgatggttgtagtggtcccatcccactctaacatgctgcaatctttatgactccctccggtggctcgatgcatacacaaaacaccaatgtgcagcagagttgttaccagctttgctgcttttaaagtagagacattccacattctggggaaaatacttct

SEQ ID NO: 6753 - DNA, 201 bp, Bos taurus
tgtgttggagaaagatgctgtggggtctcatggttatctacatagatttgcagtcaattcagttcgtttcacgtttgttctctgcagtgaaggtatcacagagttctgtgcttctctagaccatttgaaccaataaacgtactttccttctacaaaggtggaggtttggtggtagttttatagctatatgtgctaaaagga

SEQ ID NO: 6754 - DNA, 201 bp, Bos taurus
ggccaaagagaaaaaagaaaggtattcccaacacatggttttcagtgggaaagggaataatacaagtgaaaaatgaaatacctccccgaaagagttaaaatggagggggaggcctttcatgctttgccttctaagtaccattaaccattttctcccatcaactccctaagacccaaccactctacctgttttccagggaaa

SEQ ID NO: 6755 - DNA, 201 bp, Bos taurus
agtaccattacagatctcagatggccttgtgggttaaatgagataaagtacttaggattatgcttggcacgtggtagaattcaacaaacggaaatttatatgatttattgttattgttaggccccctgtgttcaaattcagcatccgcctttaatattaatattactttacattttaaataatgactttgtctggaaacaa

SEQ ID NO: 6756 - DNA, 201 bp, Bos taurus
tagtatcctcaacacctactcccaatgggatggcctttccacacacttttttctctctaatgctctcataggcatctgcatgattcactcattatcttacctcctaaaggcctctgatcacaggtcatgttttgaatgaaacacttgctctgaccactctgttataaatggtaagggcccactgaagtgaagtgaagtcat

SEQ ID NO: 6757 - DNA, 201 bp, Bos taurus
acattttccttacactgtggagaagttccatggaggtttcacttcagacgctaacaatatgaggctatagcagaagacacacaacacattacaaggcatatggtatacatgaagtttaaaactagcttttatccctctgtactttcaaaaggcaaaatgttaaccttggacagaaattgtcccaagggatgtataatttta

SEQ ID NO: 6758 - DNA, 201 bp, Bos taurus
atgatttgaataaagtcatactcatctttcatctttccccatcatatccatctttttcatctacttctgtgtctattctacattcattttttccaaccccattcatttttataaatgataatataattattatgcctaaaagaaattgaatgactttcctgagttcatgctgtgaaatgacatatccttgcaagtatttaa

SEQ ID NO: 6759 - DNA, 201 bp, Bos taurus
tattattattatccccatcctaatgtgaaattgaggctcatggaaaagtaagcaggctgcctagggcatagttgctttattgagtggatgaataaatacagctcatgcatattttagtaacagggcgagaaccccaactaatacctacatgcctgcgtggattaatcttttaaccaccatgtaatactttatatttaatat

SEQ ID NO: 6760 - DNA, 201 bp, Bos taurus
accaaagctgaaggagtggcctctctcaggtatatatgccattctcagagggaaaagggtaaaagccaaaccaggcagtgtctcctaaaatgaagcgtgcgttatattccactggccaaagcaagtcatatggccaagtccaatgtcaactaagtgaggtgtatatgtctcctacaggacaacactgcctgtcacgtggta

SEQ ID NO: 6761 - DNA, 201 bp, Bos taurus
ggcctctggaaatggtcaatgtgagactgcaggagccaagtcaccatgctggatgccatgagaggtggctggtgcaaaagccctggtcagggtgcccgggcgccaggcccagctgggcttgactccatgtgtgatctgggtccaatcccatcctgaccgtggacctcagtctgtccgtgaagaaaacaaggggagctttta

SEQ ID NO: 6762 - DNA, 201 bp, Bos taurus
ttatactgttctccccaaaataaatgctccttcatccattgtttgaactcctctgcagggggggaggttattatcttacaaggccctctcttttagggtgaaacttcactgtgagacaatcttccttcaagctgaaatcttcatttctccttccaggcaatggccctggctttgccctctggaactccctagaacaaagct

SEQ ID NO: 6763 - DNA, 201 bp, Bos taurus
tctttaccgcctgagccaccagggaaggccccactgcatacaggagtgtacaaaagcccagcggttaaagctgctgtcccaaatctttctgactgcttttgattaagtgtctgatggagatctggctcttgccctgcttttagagctatcgaagagtctgttgcagccctctgtatcctgccccacagtttctgatactct

SEQ ID NO: 6764 - DNA, 201 bp, Bos taurus
gtctggcttaaaatcatcaccagcaatgcataaagagcccgcatttggaaacgactgaatttctcagcggcagccgctgcctgcctgccgcccctgcccgcgcacatgctcagtacccgcctctgcatatgcccagggataggtacagcacgtgtgcattcttttcagttctgcagaagcagcagatgggtaattgcagcc

SEQ ID NO: 6765 - DNA, 201 bp, Bos taurus
tattaaaggcacagaaaagcataaaaagatttgtaattaagataaaaaatcaaggaacctacccttctgttttaaaagttcagcccaagcaagggacaaggggctgcattcaaggtcacagagtgtatatttgtagatttataggtttaatgtgaaataaagcacttgaaggaaacaaaaaagagttgctaccagtcatgg

SEQ ID NO: 6766 - DNA, 201 bp, Bos taurus
ggccttttccctgtcaaacttcaaaaggtggaaagacatttgagtggttgaggtcccacctgaccatagggctgcagtgtgtcaaacattatgtggatcttagtgtgaggggccagcatctcagacagatggccatggtggcatccagtccccagaaatgttctgtttgatctttccaccattgaaacaattgtcaaattg

SEQ ID NO: 6767 - DNA, 201 bp, Bos taurus
tcagtggaaagccacatatttgtatgatagaataaccatccaagtcaatgtgtatttattgaatgttttctatgtgttcagtcttcctaggccccatgggcaaaagaggagggagggtataaatgtagcataaagcatgaccactgatttctctatagatatgaccgggctattctttaagctggtctccaagatagaggg

SEQ ID NO: 6768 - DNA, 201 bp, Bos taurus
gaatccatcttttacagctctgtaaacagatgtccaaagagacaagtcattttctcttcctgcctggaatgcacttcacccagaaatccacatggcctcattcattcacttccttccatctctattcaaatgacacattatagtctacatcattcctgacctcacagcaaaatatcaaccaccactttccctgctcacacc

SEQ ID NO: 6769 - DNA, 201 bp, Bos taurus
tctagcaaacactcagtaaatgtttgtcaaataaatgattcagggaatgatcattccagagctggtggcttcatatgatttgagttattgcatttttttttccgctatctagaaagaaaagctcccagacgacccctcggcagtgttcagatattgtaaataattgatcataaagatgaaacacacaagctggacggggac

SEQ ID NO: 6770 - DNA, 201 bp, Bos taurus
gagaaggaaacggcaacccactcctgtattcttgcctgggaaatcccatgcatggacagaggaccctcgcaggccacagtccctggggtcacaaagagtcaaacacgactcagagacgaaacaactgcaacactggatcacacgcctcattccagccaagtccccctccttacgcattcctgcactgtgcctgcacactgt

SEQ ID NO: 6771 - DNA, 201 bp, Bos taurus
ctctcaggcacccagtgtatgccacccaaagggtcagggacggaccacgacctccactcacggactttccagaaagctcccacaggctgagcaccatccacgtgccaggccacgtactcagaactagcgatgacgcaggcgctgactgttgccctgtgtttctatctgaatccgaggctagcccaagtcctgaccactgta

SEQ ID NO: 6772 - DNA, 201 bp, Bos taurus
ctgcagcccagatcccagggccaggcctggagtgcgggcatcacaaaacatcaagtgcatcctcccagaaacgacccaaacttgcggaaacctacaggcagacctgttgacctaagaaggcctccaaagcccgtccacagcaaaggtaatttccacagagacccccagaacagatgcagccttgacacgtgtgcggggctg

SEQ ID NO: 6773 - DNA, 201 bp, Bos taurus
cctttcgggagctgtccccaggccaagcagagagcctgcacaaagcgctcagtgtggctggacgcacgaatggactcctcctttgccaagccagacacagaggccacgaaaaggcctgggcttatttgcgtcactccaaaagcaacggcaatagcagctgctgagtgggaggctctagttaatgaagagcttagttaacag

SEQ ID NO: 6774 - DNA, 201 bp, Bos taurus
gtgacccaccacagcacaggaacagcagcaattcagctcagagaagtatctcctttcattccaaagatacctaaaacctaggagtggccttcctccaatactgggctatgggttggttttctgttcagagaacaagccacctggtactacccaacggtgaaacaagaacactgcattttggggggtgggtaatgccttaac

SEQ ID NO: 6775 - DNA, 201 bp, Bos taurus
actgtgggtgccgggggagggagcagggagagggctgcatcgggagttaggggttagcagatgcaaactgttaccagggtgggccaacgacaaggtcctattgcacagcacagggaactgtctccaatctcctgggataaaccgtaatagaaagaacacttaaaaagaaagtgtatacatatgtgtatgtataactgagtc

SEQ ID NO: 6776 - DNA, 201 bp, Bos taurus
gtagtacccccccccaccccccgtccccgacaactccgtgtataaaagctctcaccccctgcttgttgagggcaaggggagtaggcccttggacagattccgccttcctccccagttgctggcatctgaaacaaagccaactttcctttccaccaacctggcctgatttttggcttttgagtagcgagcagctagacccca

SEQ ID NO: 6777 - DNA, 201 bp, Bos taurus
gtagggtcaacggccttctcttcaacgcaagaggaacagtaagcaccaaagacagacttgaggcgaagagtgtgaggggagccgtcaagtccattcgcctgttccaaacatgaagagcctgagggccggagcagcggagggactcgctcacccactggttgtcccagtggggacgtttgtgtagagtgagccccgagagaa

SEQ ID NO: 6778 - DNA, 201 bp, Bos taurus
attttccatctgctctccaaaatctaatgacctgacagattatccccaaaagaataaatctgtatgatccagaataaatcaagcaggtacacaagaaggcataccaacattcaacaactaattttgaggaatttctcaaaaacggcaagttcgtttttcctcttaactatcttcctgggaaacacaacaaccagggtggct

SEQ ID NO: 6779 - DNA, 201 bp, Bos taurus
ttattaataatttcaagacaggaacaacagagccccaaacttagcgtggggccctgcagagtgccaggccctgctccgctgcataggcttcaggcccacaaagccggttctggagcagctaagccaggaaggaactcacatgtgaccccaagggcaagtctcagcacatcacacagaggcctcctcgaacaacacagggca

SEQ ID NO: 6780 - DNA, 201 bp, Bos taurus
gtgacagatgtgaggctagagagacagggccacatcccgcgggctctcatagatcgtgataaatatttcatttattacagacccatagattaaccttttaaatagatcactctggccacaatgtagtgatggaagaggaagggaagagagcttatagacaaatcagctagaagctgttatagtagtctgatgagtgtgtga

SEQ ID NO: 6781 - DNA, 201 bp, Bos taurus
tgattgacgtgttcttatacagaggttcatttagattcacagtatttagtttttggcaagaagaaggtagtgtccataggcacttccttttgcgtcaccaagacacacatcatcatgcctgtttgtgtcttttgtgactttgggttaatcagtagattcagatattgtcagccatagtggaaaaggtttttaaaaaattgg

SEQ ID NO: 6782 - DNA, 201 bp, Bos taurus
gttccaaactgtaattccacagtctgatagtctagcttggtggaggagtccactcctaacgctgtcaacgtgtttggagtggactcggagttaaaatgaagtcacgggtgccacccctgtgggtggggaaaggcagtttcagaagagggaacaggtaccccatgttgtctactgcatggcctgggtgtggcttttgtctcc

SEQ ID NO: 6783 - DNA, 201 bp, Bos taurus
tcctgggaactgggcctcagccctgggctgggtgaagctgggctggattccctggagcctcccagcgccccctgtcggccagttcccccctccctagagcgccttctacagacctgtccagctctacgttttctggagtctcctctggggccctggtaccagcagaaggagagaagttaggaagacaggccctggacgggg

SEQ ID NO: 6784 - DNA, 201 bp, Bos taurus
acagtaggtcaaaatgaaaggtcttggcattttttgagtttttcttaaaagcatatttattcagcatacaggtgttctttttcggcctcactggagattcaaagtcaaggtgtggcaacttttcctgtaaacagccagagaataaacacaaggctttattggccataaagtctgttacaaccagtgaatactacgcgaaag

SEQ ID NO: 6785 - DNA, 201 bp, Bos taurus
ataattcaaatatttggtttatctttatattgatatcagttgattgccttttctcattcaggttgtgacttttctggttcttggtatgatgagtgattttcttgtatcctggacatttcgagaattaagttgtgagactctgcaccccatttaagtctttctttcagcaggcagtcaccctgtttatgcttagggcagagt

SEQ ID NO: 6786 - DNA, 201 bp, Bos taurus
ttgaggcctctgtctggacacgtcggtgtcatcggggacggcaggtcacgtagccatacctgacgtaaagtgaggggacaagtgaccctactgacgctagtgctgagccccgagggcccgacagctcctgccagctgatcccggaccggcagcccttggcttctgctcctgtgcaggagcccggccttgaggtcagcccct

SEQ ID NO: 6787 - DNA, 201 bp, Bos taurus
gtccatggggttgcaaagagtcggacccacctgaacagctgaaaaactactgaggacactgatttttttttttttggcccacgggtgtatctgcagggctcggaaagttgcctgccacacgggtgtatctgcagggcttggaacattgccggccacatacaagatgcctgacaaatacttgctggattaatgaatgagtga

SEQ ID NO: 6788 - DNA, 201 bp, Bos taurus
ccagtcagcaccttctcagcccagaaggctctcacgcggccccgcagttctgagtcagaacatgccgcggagagtaaccaggcgaggtgcgggcagctccgtcagcgtgactctggggccggttcacaagaagcctgcagaatccagcatcacaaagctcgccgcacatagctgctgcagcttctgtttgccagttatcct

SEQ ID NO: 6789 - DNA, 201 bp, Bos taurus
atgtacaaaaaggaaaaaaggcctggtgtaatcaggtaagtaaagagaaggcgcccgtagtaaatgtttgctaggtgtctgtatgggggtgtggagagaggtgggggccattatgggttcatctaagtttcctcgagtagcttggtagaggggttttgcatggagggcaaaatttgggacccatattcagaagaagtttaa

SEQ ID NO: 6790 - DNA, 201 bp, Bos taurus
gagcggggcagatggcccagcgggccgggctctggggtctgggcgtggccgtggtccccagagccctcctctcccgggggtctggctgtgcgcttggcctgggggtcttgctccctccatctgctgagcagcaactagcatttcacccggaccaactttttcctgcttgtcagccctcggggcccgagcttggatggcagg

SEQ ID NO: 6791 - DNA, 201 bp, Bos taurus
ctgaatgctgtgtcccccccaaacacgcacatgggagccacccctgacgtgacagcggcagagggggccctctggaaggcactggggccgtgaggatggagcctcgtaagggtaatctcctggctggtggaagggttgagatgttatgagaatccccagaaagtgacagagataagaagtgagcaggcgctgctgcagaag

SEQ ID NO: 6792 - DNA, 201 bp, Bos taurus
gctggtacctgccgggaggacggtcgggcgccggccagccctgaagcactccagtgctttctgcctcacaagtgcacgtctacccagccatcctgtgcgtaaactgacctgtcgccttgggccgaaggcttgtgctgtcaccttctggggaccccgtggacgcccctgcgcgggtcacgctgtgtcccaagcccttggagg

SEQ ID NO: 6793 - DNA, 201 bp, Bos taurus
cgcagtcatggggtgtccccggggacacctcggttacctctggtgagagctggatgccttcacagctctatgcgggagtaaattaatttatcacttaggaccctaagtgtgtatggccatcaatggtcatcttagtaggaacacatgcaggtcagtccattttaaaatattctaaaattgcaaaagatcagaaatcatatg

SEQ ID NO: 6794 - DNA, 201 bp, Bos taurus
tgggaaacgagctgagtgcgtccaaggcagcattgaaaccggcgtcactttaggctcgaggcagccaagcccccgaggggaggtcctggctgggccagacggcgtcagcggcaagtctgtgtgagaattcggattcccttcttcccaccccggggctcctcctcacgacagatgtgaggccgacttggtctagaaccctca

SEQ ID NO: 6795 - DNA, 201 bp, Bos taurus
tcatgctgtgggagggtggcccgtagcctgatccctggtgtccttagagcaaaagggaggtttggacacggacatgtagagagggtgtactgcgttgaacgtggggaggagggcctgtgacgatggaggcagagcctgatgtgctgaaccaaaaccagggagccgatgtggggagctgatacggggagcggatatagggct

SEQ ID NO: 6796 - DNA, 201 bp, Bos taurus
tgcacgtgaccacggagcccagtaacaacagggcctagggcggcctccgagcacaacaggcaggaaggagtgttctcaggagctgctcttctgcccatccgagtttcttctctggttataagtggccacatggacaccagtcattgactcattaagggccagtactcagggacgcccatggaacctgtccaagcagccctg

SEQ ID NO: 6797 - DNA, 201 bp, Bos taurus
tagtgaccgtgcctgcctgtatttgacggtgaatgcagcttgctgacagcgtgcctttggcttccccccttcaaagaaggctgaagttaggcttagcaggcggtcggtttccccttagatcagatttatcctctcgtgggcttgtttgtggtaggcagagcacctttgctctggtctaatttcaccaacctggaggagaga

SEQ ID NO: 6798 - DNA, 201 bp, Bos taurus
acatgtagatagaaatcacgtaccatgagtctgtcctgggctccccatcctgtgaaatctgattatttacattgtggagaagtgcagcttcccttctcggagctccattgcctctggcagcctggccgtctgtggaggagctctaggtgttctccctctgtctgagctttgggagctggagtagaggggagactctgggga

SEQ ID NO: 6799 - DNA, 201 bp, Bos taurus
tgacatcaagtagagttgtttaataagaattttagcttgtgctgcttttcttctgagcaaaatattgttaatacatgttaagactagttttacaagcttcccagcagtaatgtgatttgggcctttttttttagcacacaaatttttaacttttaaacatagtcctgtagttaggggctccttcattattaaaggcagaat

SEQ ID NO: 6800 - DNA, 201 bp, Bos taurus
gactgaaaaaggaaaatcttggctattatgaactgaaatgcaaagccatttaataacagatgtaagaagatgtgctttttttctatgtgtgttaatgtaaatgagctttttattttatatacataaacataatgatgtatctatctcccggggtttgctcaaactcctgtctgtggtctcagtgatgccatccaaccacct

SEQ ID NO: 6801 - DNA, 201 bp, Bos taurus
gaaggggtcaaagaatgtctggactgcgctcagagggccctgtgtcctcacccacactgtttccatcctgctggatcaggtaggaggacacagaggggctaacatagaggcctttcattctcatgagtgattctttccagttctttaaagtaagctgtttatgatctttaaccagcaacattgggtgaaattggtggctct

SEQ ID NO: 6802 - DNA, 201 bp, Bos taurus
aagaatagccaaaccacttggcaggtacagatatgccttctggtgtgacttaaaagttagttagacactctccaggtccatccacatccctagagagaatcatacagagtaaagtaagtcagaaagagaaaaacaaatatcacattttaatgcatatataactgcttagcaggtggcactagtggtaaagaacacccctgc

SEQ ID NO: 6803 - DNA, 201 bp, Bos taurus
agccagagatcctggagtgtgaagtcaagtggcccttaggaagcatcgctacgaacaaaactagtggaagtgatgggaattccagcttagctagttaaaattctgaaaatgatgctgttaaaatatcatttaatatgctagcaaatttggaaaactcagcagtggccacagaattggaaaagtcagtttttgttctattcc

SEQ ID NO: 6804 - DNA, 201 bp, Bos taurus
atatctcaaaactacaagcacaatccaattacccatggtagagaagcattcattttctgcacctcaaacttataagatcttctgtgagctgggcgggggacttcagtgtgaatcctggcccacctgttttgctaccagcagacttatatcccatctgtaggtggcagtaagtcattaccggttttgctactctgcccagtg

SEQ ID NO: 6805 - DNA, 201 bp, Bos taurus
cttacctaatctcctttggtaagattttcatgatgccgtctaattgattttctctcacttgtcatatactcaacctttacatgcttgcttatactcggttgattcatttcactggtcattttgggggccatttacttacttactaaatacttactgtattcctagaattttttatagtactttaagtgtgacaaagggaat

SEQ ID NO: 6806 - DNA, 201 bp, Bos taurus
tgttgtagcctaaatagtcccgtttatagtgttatttaagaatctttagcactcagtgaaacgacagttttcccattatgagtaaattgacagtaaaagggaaaatctctgtattacaaatgtgagcacttctcctggagttgttctaaatctgtgggatggtcactgttcccagacggtttttatacttaggaggggtgc

SEQ ID NO: 6807 - DNA, 201 bp, Bos taurus
gcaaatagttataatgactgatgtataatgtgtgagggtagtctgggtaatgttggtgaaaaagtataaaataatgcaaggctaagaacattttatagttttggataataacttttgtaatagctaatacactgaaaatgtattcatcagttgcatctctaaggtcatggcactggcaaattgcatgtatgcatgcttcgt

SEQ ID NO: 6808 - DNA, 201 bp, Bos taurus
agcataactaaaatcaaattgggaattctatatatatgaagcagttagaatgtgagaaaaatgaagctactatatgaaaataggttttggcgcatctttctaaataaaatcctgtcattgctattaccaacatggcctagctgttgttcagtcagtcagttgtgtctgactctgtggcactccaggcttccctgtccttca

SEQ ID NO: 6809 - DNA, 201 bp, Bos taurus
ggtttcagaatttgctttccacaaccgcagcaggaacaggaaaaatgctcactttgaacctggtccctcaccaagctcaacttccttttaaccaaagtctagatggggcaatgatcacctgtattctctgcaagtgatgtgactgcttacaaaattctctttgtgacatcgatggtatggaagtgaaattgtgtcccaagc

SEQ ID NO: 6810 - DNA, 201 bp, Bos taurus
cgagtgaggttccttagcatcacacaggaaagaattcaattaaatgactcatccacaagcaccatgacagttccaaggcctgtcataaaagaccaaaaaatggatggtgtcccagctcctggaaatccccgccccttcacttcactatgacttggttcatttaattgaaccaagtcatagtaaagtgaaagaaggtttatc

SEQ ID NO: 6811 - DNA, 201 bp, Bos taurus
gtattcatatgggattggttctaggacttacatggatactaagatctataaatgctgaagtcccttacataaaaggatgtagtattgcatatagtttattgcatacaatatttgcataaaaggcaaatttaagttttgctctctggaaatgtctggatttttcttttgcaaagtattttttttaacagttttcttttttta

SEQ ID NO: 6812 - DNA, 201 bp, Bos taurus
gttatatttgctagtttgttgtactttttagagtccacgtataagtgatatcatacagtatttctgaaaatatcgttgaactctgtttctgtctgggagatgtgaataatgagatatatgtaaactgcagagtagttgtgaagacaaaaggaagtgacacatgtgacgttcttagcatgagacagttcgtactggtcacca

SEQ ID NO: 6813 - DNA, 201 bp, Bos taurus
agaatacgaatctaacatagcccaagcaaggttgtctaaagcagcacttaatcagattatgtccacaggtgtcttggcatggaaatctctggccccttccaatggaaaattatctactcagtaatatcaaacagggaccagatgagaaatatgaagattttgtggccagattgaaaactgttgtaaagagaacaattaaga

SEQ ID NO: 6814 - DNA, 201 bp, Bos taurus
agcaaatgctgataagaatgcagcaatatttttatgttaacgtctaagttttgctcagaatttaactggatttttaagttactgttttatctcacctaaattttagatttataacatttagttcatgctcacacacaaacacacacacacacctctgtattatcatctcttggtaaaataatttaatttattcaagtattg

SEQ ID NO: 6815 - DNA, 201 bp, Bos taurus
gctaattggtcaatgagctctatttaattggcctaaagagaattaggcacttgcaaaccaaataattccaattcaagaaaattaaactgaaatgaatttcgggcctgtgtgaactgtgggatattcactagtgaattgatacctggtattgatgtttgttgattgatctaattaacatagacattgcaaagttgcttttat

SEQ ID NO: 6816 - DNA, 201 bp, Bos taurus
taaaaaaaaaagaaaatgcagggcctcttgttcaaattattttcaggatttcaatgatatcagccaagcttgaaattaagagtgagtatttctaagcaataggccctgtacaactgcacaggtcataggcccagaaggcctgccaatgggtcaggacagtaagaattagaattacaaaattatttccctattcttttggta

SEQ ID NO: 6817 - DNA, 201 bp, Bos taurus
cctggcagctccctgacagcctgggagccccctgctgaggttccctggacaagaggggaatttaccagcaggggccatgtctggcccacccagatgaggatgactactttttttttttaacttataaatctcaatatttacaagaataattccattcttggttctaagactactggccacataaggaactgtttacttctg

SEQ ID NO: 6818 - DNA, 201 bp, Bos taurus
taatgggaaaagggcaagcacatttttaaatttatgtgactacttataagaattgatttttattttttgccaaataatattgtgtgcataacagaaattgtctaaactcagattatctgactatggatttcttcagattcatgtgtctctagctgtaccttcacatggactaatatctttcaaatattaaaatattgtatg

SEQ ID NO: 6819 - DNA, 201 bp, Bos taurus
tatgcacaataatcccaagtttaattttataatattttattgggaatcttttggaggggtggtaggattttgaaaatcttagaaggaaacaaaaagttttcaaggtaaggatataattctacttgaaaagagtggtcccaggtgttaatactggtagaattaaaagatgcacaactgttttcacacctagactttcttgga

SEQ ID NO: 6820 - DNA, 201 bp, Bos taurus
ctgtaaatttcaatcaatgttcatttgataaaattttttctcacattgtgctgtttaacatattctctggtttcctctctgggaagatgctatgcaggcccggaatgcaagaagtttggattctgcactaagacaacttttgagttcagttcagtcattcagtcatgtccgactctttgcgaccccatgaattgcagcacg

SEQ ID NO: 6821 - DNA, 201 bp, Bos taurus
attcctgcaggcattcactgggctctcaggcagtccagcaacccagctccagcactggcttgtggacacattactcccaggttctgcagctctattagctgcttttgtaggcttggtaaggattttcattaaatgcagccttagtgctagaaacttgaaatatttgttaatttggaggctccctccattagtactactatt

SEQ ID NO: 6822 - DNA, 201 bp, Bos taurus
tatcttagttatttttacttttgtaaaccttatgaatggaaagcttcttatttgttattctaaagtctagaaaatctatagtttttacttttaaacttctgaagtgttagttataacaagattatgtattcacagtcagcagttatcagtcacagtctttggacaaacatcgtgtatcaccttaacagaatatactcattc

SEQ ID NO: 6823 - DNA, 201 bp, Bos taurus
tgtagcttgttgacctgggcagagacaaaacaggttagacaattgataatgcatgaaacagtcataagcagaatcaatatggtgtaacacagactagtagaggcattagccaattctaaattcccatgaccaggatggctcaagtccctccttgttcagggatcagaagatttatctcttgcctgttttgtagtacagtcc

SEQ ID NO: 6824 - DNA, 201 bp, Bos taurus
aacctctttcaagagcacttatgccaacatgctgcacctcccaagattgctgttgctagtgctcctgatccagtgaaggctactgtcaatccacagttctgccagagactcccaaacacttataggcaagattggcacattattttgtggggtcactgttccttttccctgggtcctggtgctcacaaatgtttgtttgtg

SEQ ID NO: 6825 - DNA, 201 bp, Bos taurus
tcttcagtggtgcttaccaggaaagagttttatatactcccttgtttctttcagattatttgtggcttgtggcatttaacaggggtccacctatgggtaagcccagagccttagtgccaatcttgcatttccatttctctctgccctctctcagttgagtaaacaaccaaaatcattttgttctgtcattttgttctgtag

SEQ ID NO: 6826 - DNA, 201 bp, Bos taurus
gagtcttaactgtacaattgatatgttacactaaggcagcagtgaacatgaaaatgttaaaaaatatactcagttataaattgaataatttgtccagaaagaggttactcaatttctgagaagctcagagggaataccccatgtggggtacaattttttgattgtacccattgtaaatatgatagccctccaaaatggaaa

SEQ ID NO: 6827 - DNA, 201 bp, Bos taurus
tcatactgaagccctgagtgacactgtggcccaggaacctacaccaactctcagctaaaatggcatcagcattttacattacatctctaagattttgaggataattgtcattttaacctgaactagcctatcctaaccgcatacctggactgaaatattgatatattaaattaatatctaaaatcgagatgacaataacaa

SEQ ID NO: 6828 - DNA, 201 bp, Bos taurus
ttagtgagtaactctatctggggctgggaatgaagactgtagaattgggtgctttgggtgcatgtaaatcacttaaaggagaatgtggtattgcagcatgttcacactacattacaggatacttctgagaatagcactacagcatggagagaacacccagaacatattcacgggactgaagaaaagccacatagtcagcat

SEQ ID NO: 6829 - DNA, 201 bp, Bos taurus
gttatctatagtctagattggactattgcttaaatgtgattcagaacttgtgtaagatttaaaagagatccaaaacagaaatgtcaaaaactccctagatctgcactgctcaatactgtagctactaactacatgaagctacttgagttttagtgaaagtgaataaaattaaaaatctacccctttccctcaatcacattt

SEQ ID NO: 6830 - DNA, 201 bp, Bos taurus
ttaaatctcagcttgtctttcctaactaccaccattaaaacagaacatgacacagaattatgtgacacatagattttttggaagtagtcctggtgagcagaagctaagatgaaaacaatggtcatagtgcttctttaggtagttacataaaaatttttaaattgacttattttttaattgaaggataaacactttatagaa

SEQ ID NO: 6831 - DNA, 201 bp, Bos taurus
taggagtttcttgaaagcaaatgcagctccatttctgttttccaggattgagtctcccaacctgtggagccattagggccacacccatgattgttcctgctccacattaaccaagattgacactagatgtgattccaatacaaatgtgcctgcagttggccatcctaacctacagtttttagttaagttgtgtcaaagaaa

SEQ ID NO: 6832 - DNA, 201 bp, Bos taurus
gaagtcaagcctccagacagctttcgttggaagtcccatctgcagaaccctgagaaaatgcatttctgtcattaagtcactagtacttgacattttgtatggtaatgctagaaaactaaaacaccatctaatgaaggcaggaggataccataaataaaaataatcacaaaaatatggttctctaccatggtaaatattgat

SEQ ID NO: 6833 - DNA, 201 bp, Bos taurus
gagaaaggactaaggtcccgggctacttctaagtggaaatttagatgcctacacaggtggtacataattcctctgtgactgcaggcctcacttgctttgaccatcacctccattagggcagagcacacacgcaagggcaatggagcctgatcaaacctcaaccttagggcttctactccaataatggaagagaccctgggc

SEQ ID NO: 6834 - DNA, 201 bp, Bos taurus
aacaggccatatataacaaacctatcgttaatatcatactcaatggtgaaaagtgggaaacatatcctctaaggtcaggaacaagacagggacatccactcttgccaattttgtggccaaagcaattacagaagaataaataaaaggaatccaaattggaaaagaggaattaacactgtcagtgtttgcagatgacatgat

SEQ ID NO: 6835 - DNA, 201 bp, Bos taurus
gggtctgtacaccaacaagttcagaggcatccatctagaagatttattccaggatttcagaacccaggtttttcatactagatcagtggcctctccatttcttgaatatttcaacatctcttcaactttacaaatctattgtatttttaccttgctggtcaggcctcaagtcttctcacaaaagataaagtgtgctttgta

SEQ ID NO: 6836 - DNA, 201 bp, Bos taurus
aagctgaagctccagtattttggccacctgatgcaaagagccagctcgctgggaaagaccctgatgctgggaaagattgagagcaggaaaagaagggggcaacagaagatgagatgattgagtggcctcactaactcagttgacatgaatataagcaaatttcaggagataatgaatgacaaggaagcctggcctgctgca

SEQ ID NO: 6837 - DNA, 201 bp, Bos taurus
aggaaaatgaccccacaagacactgagccatgcttgcctgtaagtgtccaggagtctctggcagagctgttgatcaacagtggcctgccttgagttgaggggcagtgactacaacaaacttgggagcaatgggatgccagcataagtcttttaaaggaggtcaccattactgccattagccctaccatagtttggcctcag

SEQ ID NO: 6838 - DNA, 201 bp, Bos taurus
aagactatggatagcctggcctccatttagaagaaaaatgcatattctcactggctcccaactcaggaaagagagagcagactgaattaccacgtggctgaccagtttcctatggccacactggcatatgtaccagcatgagctgagtgaacactccagcctcatgtgctttatatcacagttccacactggagaaagagg

SEQ ID NO: 6839 - DNA, 201 bp, Bos taurus
caccgccaggacggaagagagccctggctcctggtggcacctctgctgaggaggagcgcagctcctgggaacgtgaactctacgaccagaagcacacatctaggccctgttcaaagagtccatcatgtagctgtgcactgcacggcccgagaggccatgacattcctcagggaatactttgagaggttggagaagaaggag

SEQ ID NO: 6840 - DNA, 201 bp, Bos taurus
gtcttcccatctgtgatgagggctcagggatttccctcctatgtgtctacccacctctgtctcctctccagatgagggatgctgggctggcctgcgggctctatgctgtctgagagctgcaggagcagggactcactctacctcttccttggacctggaccagtttttacttctccaatttgctgctcatcttcctagatt

SEQ ID NO: 6841 - DNA, 201 bp, Bos taurus
ccctcatggagatggccgagtggagcagacgcaaaggcagtgaggaaatgtattcctgtggtcatctggagcagagcgtttcagccaggggggccctgggataaaaggtattaagtatgaatgcagcaggcttgcccaagcagagcaaggagccccgggcggcaggagtgcacctcggggagaccaaccggaggcggggtt

SEQ ID NO: 6842 - DNA, 201 bp, Bos taurus
tccactgaatgaatgaataaatacagtgtgatccaagtacatttactttagagcagttaccaaaataccactttatgcatgctaatcataccctaaaaacgaaagaagtctgatcattttataagaatctggactcaagatctggactcattggagcaaatgatgagaaccctcaagcaactaagtatgtaactgaagaca

SEQ ID NO: 6843 - DNA, 201 bp, Bos taurus
cagtaaacactccccagcatcaaagtgcagtcaggacccagagcgtgtgttggagggaaggaggggagccaggtttacatgatccctgtgtcgtggtacatatgtaggggagaagtgaactcgagagaaaccaagctcgctgcagtatgtggcaggaacttgagtcaagagagagcagagacgggtaaggaaagggtggcc

SEQ ID NO: 6844 - DNA, 201 bp, Bos taurus
agctcgtctcacccatgtttgactagtcccctgtattgaattacttctatttgcaacacctagaaagttttctgttttcctgactgtactatcattgatatagctcattgaaaagctttttaaaaagtatagattgcagtgatctttcctgtgcacagttggtcattctgtgcatgcatctgaactaaagagaacaggccc

SEQ ID NO: 6845 - DNA, 201 bp, Bos taurus
atattacgtgaatgatacctgtcttgaaataatttgaaagcgtctcttctttgtaatagggaaagacattcataattttctattttcaacccttgctttagtgcataataattaagatgctatttgaaaacttgataatgatgggtaaccctgaatatgtctgagacttctcacaaggagataataaaccaaatactttag

SEQ ID NO: 6846 - DNA, 201 bp, Bos taurus
actgagactcacgcgctgtcccttggcaaccataatgtggtactcttctcggaaccagtaggccatcactgctatggtgatttcaggccatgacaaggtggcagtttcaaactaggctgatgatctggtttgaggatgtttttgcagttatctttctaggtaggaaggggcccagatttcagcatctaaatttttcatttg

SEQ ID NO: 6847 - DNA, 201 bp, Bos taurus
atcaagattaagaataaagtttcttaccttcaagagttcattcagtctaaactcttgactgggttacaaaagtaaacaccagtattccctgtggcccagaggaacaaatgttctgatttcttgtgtgtaagacatgaaaagagtccattggacaggaaaatatgtggctgaggagaaacagaataggaacaggaaaacagg

SEQ ID NO: 6848 - DNA, 201 bp, Bos taurus
actgtcggatctgctaaccagagggggcctgctccaggaaagtggatggatgtcaagatgggctggacacggcagtgagaggacagtaggtcggaggaggcgttactgggggtgggcctactcttggggaggacctgatgcaggctgttgttactgtttagtctctaagtcatgtccgactccttgcgaccccatgcactg

SEQ ID NO: 6849 - DNA, 201 bp, Bos taurus
accatgaaagataaaagattatgtaatatagaagaagatttgtgttctagtatgagtttatcactaaagggagattgcctatagccttaaaatggcccatctctgcaaacccttcctcctcggtaataagcatgagctagaataccttgttaagttcacaggaaacatcctgaccaggcccacctgtcaatggctgctgga

SEQ ID NO: 6850 - DNA, 201 bp, Bos taurus
atctccattttaaaagtaattttgggcgcttccctcatggtccaatgggtaagcctctgtgctcccaattcagggggcccagatctgttccttgatcaggtaactaagatcccacatgccacatctaagcccacacactgcaactgctgagaccactgcaactagcaaagcctacacaacaaagggcccgagctctgcaac

SEQ ID NO: 6851 - DNA, 201 bp, Bos taurus
aaaataagaatggagggaaaaatttttaacaatgtaggtctctttgtgatggagttattagtggtttctacataaattttttatgctctttcatattctgacaaatttctacaatgaatatatgtattacacaggtatatgttatgcacacaccatacacacatacaaattctattcaatatagacatttctaaaacttga

SEQ ID NO: 6852 - DNA, 201 bp, Bos taurus
tttccatctatttgggccctttgccctaaagtgggtcacatgtaggcagcacattgtaagctcttgttttttatatccaatctgccactctctgacttttgattgtaacatttaggccattgacattaaggtaattattgatacataacctcttttattttttgccattttacattgtttgccatttgatttgtatttctt

SEQ ID NO: 6853 - DNA, 201 bp, Bos taurus
gggcagaataggccctcagggagttaggcattttcagaagacaactgtatgagcctgattcttgcatctcttcagatctagcactaaaatcattaatgccgacttctgctcctcatgactggccaataaccttctgccaacatgtgtgcctgactgcatgcaccccttcactaaaatcatatacaatactgactttccctc

SEQ ID NO: 6854 - DNA, 201 bp, Bos taurus
ggaaactcaactgtggttcccattagatctgggggctccaggaacagcaagaaacttttgaagtaaaatcattttgggaaaatttggcccctgaaataacgtaacctaagtaggtccccaaactatatgtgaggatttacgttgactagatgggaaaggtatctcctgactgccacagtgggtggcctttggagaataagg

SEQ ID NO: 6855 - DNA, 201 bp, Bos taurus
atggactgcagcctaccaggctcctccgtccatgggattctccaggcaagagtactggagtgggttgccattgccttctccggaggtcaggttagtgatatataaaatcaaaatcagatttacttctggcttcctcttttattggttttcatgttaggattctggcatttcacttcagatatttatttcagctatttcact

SEQ ID NO: 6856 - DNA, 201 bp, Bos taurus
cacagctgggttgggagttttgaaaaggggccttcacctcatctgtgtaaacctggggaccttcaggataggcatggccaaagggcacactgggaaaaaggagaccacctatctgtattcctagaaagcacggtcacttccatcctatatgcgtgcccaagagaggtaagctcatggcttacctgacctgcctggcttcct

SEQ ID NO: 6857 - DNA, 201 bp, Bos taurus
cttatggaaagccagcaagctgtattggtccccagcctgcagtgctgacaagtccggatgctggtcgtgctgagaaccaagctgacagggctcaccacagagaagaaggcaggccacctgagcatttccccactcgagcaactagattctcttttttgttcctctaagttcaaagtgggacgttgtcttaggtcccccatt

SEQ ID NO: 6858 - DNA, 201 bp, Bos taurus
cagtccatgggggcgcaaagagtcagacacgactgaagtgacttagcacgcacacatgcacgtgattgacttcagctggataatccaggccaatgtccccatctcaaactgaaccgctttgaccaagtccttcttgccgtgtaatgtaaggtagtcataggttctgaagattagagcagggcttctttgggggccactata

SEQ ID NO: 6859 - DNA, 201 bp, Bos taurus
caccaggtgctgagtcccctgcaggtgcctctggggcctgcgtgtggcagagccagcacccacactggacacggacagctggttgcaggagagaggctgtaaggtgggtgtggggaggggccggagccccagggagctgcctgtgatgtgtctgtgttcccgggagactgctgaggtcggggtccagagtgtccaagggct

SEQ ID NO: 6860 - DNA, 201 bp, Bos taurus
gcgctgactccccacgcaggactgccttctgagtaggctcccttgtcactagagtattcacccctggttttagttattctttaatagaggaaaggttgcatatgcagagcatttacagatagcatcattacaaaatggagttcaggttcaagctggttcaagcaggttcaatctgagtttcaagctcaggaaaaataagta

SEQ ID NO: 6861 - DNA, 201 bp, Bos taurus
tggccaatacctcttctaagctcttaaatcttgtcactcatcaacctacatctttccaaactgctttcactacacaagatacattttccatctggtaggaatggccctttcactagctgagggaattgactcaccacttgttcaacagagagacacttgctgttgacttgaggagacagggcggccggtcaatgaagaaaa

SEQ ID NO: 6862 - DNA, 201 bp, Bos taurus
gatatagcctttcctcagaagctacactgagaattaattattttgtttcaaatttctccccagtgaatccatccatcttttctgaggccaactgacttttataaaatacaagtctgatcatgtcatcaatgaatcagctctgggaccaagttaccatcaggagagagtctgccccatggcctctgagcctgcggtcatgac

SEQ ID NO: 6863 - DNA, 201 bp, Bos taurus
aaagaagcctgaattctaacctaggtaagatgactctttgaggcatgagcccactgtgttcttaggtctactggctttttaaataaagtctctattccttgtctgatcaactcatttcttgacttattggcatgttgtgtggccagcagtgcgagcttggactctgtaacattagctcttcttgtttacaaatctcatcct

SEQ ID NO: 6864 - DNA, 201 bp, Bos taurus
ggctatagtgtcgtcttaggcctaatggtgacctcctccaagaggacttatgccaacatgcctcacctcccaggaatgcggcttcccatgcccctgaccctatggcaggcctctgtggaaccacgcctccatgagagactcccaaacactcacaggcaagtctggctcagtctcttatggggtctctgcccctttctatca

SEQ ID NO: 6865 - DNA, 201 bp, Bos taurus
aatattgtgtacatgttaaaataaagaaaaaactgacacatatgggagacaaatgatttggagaacagagagttagagatgcatatggatattctttaataatcatctctaaaagatgatgctgttaaaatgctgcacttaatatgccagaagatttggaaaactcagcagcgtccacaggaatgcaaaagatcagtttca

SEQ ID NO: 6866 - DNA, 201 bp, Bos taurus
gaagattggagccaggtcttcaaaccatctaaagtactctgctcactatttttatggagagcttttaattgagaatagaagaaacgaaactgtgtccccagaagcttaagtggaagcaagatgtacaaaatagtgaggaagcagaaaggtcagagtgaggctagtgaatgaaatggaataatgtgacgtaggtagaaaaag

SEQ ID NO: 6867 - DNA, 201 bp, Bos taurus
tttctaattgtgtaatgaatgtagtttccttaaaaggaggcctttggggcatcaacaagctggttaaggggagattgggggagttagaaagttccttctcaggtggcaccaggccttctgtagctgatggtaaagattacctgatttaggacttgctgttggtgtgggggaggctcctcatacagccccccagtcccgtga

SEQ ID NO: 6868 - DNA, 201 bp, Bos taurus
tgtagagtaataccaaaaaagggactgtgaaattaggagtgagagctttctctggggagagtaactggagttcccagtgtctcctttggggataagaaaacagggctggggagggagagctccttgcgctgctccccggggaagcccttcttgggggaagtgcctgtccgccccaggctgttcataagaagcagaaatctg

SEQ ID NO: 6869 - DNA, 201 bp, Bos taurus
catggtgtccccctttgcctggcaaagcaataaagttattcttttctacttcaccaaaaactctgtctctgagattcgattcagtatcagtgtacagagacagagttttcagcatcagctagggaatgaaagatttcagcttagataccagttttaagttcttttcacactacaccacacacagtgccctgaatagatctt

SEQ ID NO: 6870 - DNA, 201 bp, Bos taurus
acccaaacctttttcctacaaccacttttctagggtgctgcaacaattggagggctgttagcatcaggatgggatcaatcaggactctgctctacatgagcgtttccctgtggttcctttgaacagcatcttgaagtagtttctcttataacaattatatcatgtgcaatatcacgagcatgagactatactggcaatatt

SEQ ID NO: 6871 - DNA, 201 bp, Bos taurus
ctttcagatctaatcctttgaatctatttgtcacttccaccatataaccatgagggatttgatttaggtcatatctgaatggcttagttgttcccctactcatttacaggatatctagaagcaagcataaaatcactggtgatactggtactgctaaaaagctccaggaactggagaccagtgacagaatgaagagagaca

SEQ ID NO: 6872 - DNA, 201 bp, Bos taurus
cagattttgattcctggctccctcttgagctgcagacctgttaactcactggatgattccactgggctatctcagcaggcaggccatattccatgtgaagttgaagtcaccgtcatccccctccccagatggctgtaccagatggtctttccaagttcagtaaataacaccagtagtcatccagacactcaggcctgaaaa

SEQ ID NO: 6873 - DNA, 201 bp, Bos taurus
taaatagtattataaattctgtagctgagaattattttgtgtttctgtgtatggaaggaaaaaagagtgttatggactgggtttttgttacactcaataagctctgggttatatactatacatcagtattaagactgttaaattatgttaaattccttccacattagatgttatagaataatttaaaacattacaattaaa

SEQ ID NO: 6874 - DNA, 201 bp, Bos taurus
aaatcctatgtactccttgtagacttaacaaccagttctactaaaacaaaattggaaagacatgtgtgactgttctgcattgtctccagaaatgacagaactcacagttttcttgagatccttacacgcttagaggtagaatcttctttccttttaatctaaatcttcctagaattataatagctttcaatttctcttaaa

SEQ ID NO: 6875 - DNA, 201 bp, Bos taurus
agttacttctaacaccttccacatcatgacaccagtgaagaaggaggcttttcttttcctaagtgattagtacatacagtgaaccatgacaagtaattattgtgacctttgaaattttaatatatgggaacgttgtcacagtattatttttagacaagtctcctaaattgctttctacgtaatcttttcaataacacatat

SEQ ID NO: 6876 - DNA, 201 bp, Bos taurus
agctttctcaacatagctgatgaatagaatttttgagttctgttccaaagtttaggaatgttttcctcataggtacataaaggcaaatcaataaattagagtagggtaatactaactctacaaatgtatggatgtgagagttggactatgaagaaagctgagcaccaaagaattgatgcttctgaactgtggtgttggaga

SEQ ID NO: 6877 - DNA, 201 bp, Bos taurus
aataagtatctcaactggaagaagttcattttatttcttcttatatagattagagataattgtatttttctttccaaaacacttcctctggcttggggccgcctccacctttcgcactcataaccggatctttctttctgatagtgtggatcaaattcttggaaaaggacaaatcacatcagacaagaagagcagagagaa

SEQ ID NO: 6878 - DNA, 201 bp, Bos taurus
ctcccacagtccccaactgcagagtctgtttctgttgtgcacacctctgcggttatggtaatgcagagagataaatggcctgaattgtaaggggatggctcgtgttcaccaagatcttaaggggcttcatttccaaactaaatatgatggagggattgagtggtggcctatgaagctggaatcatctcttttcttctggat

SEQ ID NO: 6879 - DNA, 201 bp, Bos taurus
aagtcactcagttatatatgtatacacattcttcttcttttactatttatttatttgactatgctgggtctttgttgttgcatggccttctatctagtttgggggagcagggactaccctctaatttctgtgcaaggcttctcattgcagtgatttcttgttgccaggagcgtgggctctggggccacaggcttcggtagt

SEQ ID NO: 6880 - DNA, 201 bp, Bos taurus
ctgtctagtcaatacaggaattttccttcaatttagaccctcgttgatgacataagttggcaaatccaagcatactgggaaatttgtggccaaacttgaatatttctttaaatcatttgttttaatcagaactcatatttctaagtcaaataatacattgattctgctcttcttcccagctgcaggccattgttttccttt

SEQ ID NO: 6881 - DNA, 201 bp, Bos taurus
actgctgatgggcagggtcagtttctgacttggctagctgcagtgtccggcatatttcagagctggtattgatctgatggtgagtgaggctggattctggatggccaggtgaggagcccaggatgtcagtcttcttgtggtgggccaagttctgacacagctggctgagggactatgtcagtccttgtgttggtattcaca

SEQ ID NO: 6882 - DNA, 201 bp, Bos taurus
tgggtgaaagttataagggaaatctttatattatttttgatatttaaagatatttaaacatatctttatataaaataagattaaaaaattagaaaaggagaggttgattgaagagagtttaataaagggacaaagacaggacaagatagggatggtaaagcatcagggttggcaacaggatgacactgttaccttgaaaga

SEQ ID NO: 6883 - DNA, 201 bp, Bos taurus
gagttggtgatggacagggaggcctggtgtgctgcgattcctggagtcgcaaagagtcggacacgactgagcaactgaactgaactgaactgaatgttttgtagcttagagcatatagatctttcacctcctaggtttagttgattcctaggtatattattatttttgatgtggttttaaaagaaattgtttttttccttt

SEQ ID NO: 6884 - DNA, 201 bp, Bos taurus
tcctttcccttcttggctggaattaaggccacctaattgtcttctgctgagacacttaagcataaacttgactcaacatggggctgtgcacagagagccagagccatgggccctcaggcccaaaggaaatggaaaatgcagtaaggccgatgtagaatgtcaggaaagagacactaatgatgtgtatttcttccttcatct

SEQ ID NO: 6885 - DNA, 201 bp, Bos taurus
actcatggtcagtcaccattctttaaagatctgtaggtacgtaaaccattatggtgttggaagaagttgtaaatatgggaaaacttacagtatgaaggtagggtaaacaggattcctgaaaggatgccctaagtgccactagtcaggcaagcctcataattaccagtagctaatatgtaacatgctgatggccatgttagt

SEQ ID NO: 6886 - DNA, 201 bp, Bos taurus
attaactcctgtctctaactttgtaagacaactgaacgttcaatatttaattttcttctgactcatttcacttttctcttgatctcctcagtctatgtttgttcctcttctgttttccccttttaacctcctctataatttttctttttttttagtaagttaccttgatgtctagccataggtttaacattaaatcttcat

SEQ ID NO: 6887 - DNA, 201 bp, Bos taurus
tcagatatgctaaaatgttaaaaatgtatattgttaaaaatgtaggaaaatgccatttttctgcaagaggatatttaataatggggttaaattgaattgaccaaacttctgaatattgactctcatttttaacagatatctgatagtctcagaattagcaaaaatcccaaatgaagtatgtgttaataattatcctctttt

SEQ ID NO: 6888 - DNA, 201 bp, Bos taurus
tatgcctgagcaaagcttacctaacacatgttctctccttaaggcatattacaataatcttttgcttagaaactgacaatactttctgacaatacttcagcaacatacttggaggccattgtaaacagcaaaatcaccaaaaaaagcaaaaaaatacaaaaactgtgacattaaattgactgaaaaggacatatttattta

SEQ ID NO: 6889 - DNA, 201 bp, Bos taurus
gcacatattgaatatattatgggccatattctcattcttttcccttcttttgatatgtaagaggatacttttccttcctttgagtctgaatcctttaacatactgatggttcattctttggccgctcatgaacataaaaactggttctcctcttgctgcttttccagagacagtctctttaatcttaccctatatgtgatg

SEQ ID NO: 6890 - DNA, 201 bp, Bos taurus
tgattgtttggtggtgaggtaacagggattctgtgctcagcctgaagttaccatcttccacctcaatgggggccttattcctacagaagaattcaaagttactattaagtatattccttgaggaagaacaagaactctgtccccagaactaaactattgtttcttgactgctcctacttagtttctgcattcctttaattc

SEQ ID NO: 6891 - DNA, 201 bp, Bos taurus
aaagcttaagccctatttgcttagactcatattcccaaacgggagctggctgagacccctaatggctggctctggggccctggagggtagtaggagtgatagaattcctacaaatttggatggatagaccaccattaaaaagaatgaggagcactagaagtgtaatgatgggccaaagggctgtgctgctgctgctgctaa

SEQ ID NO: 6892 - DNA, 201 bp, Bos taurus
tcaatcaaacaatcctggattgaattcaagagtgaaaatgaagaacagcagtataattctaaaacagatcttgatttttgtataatcaaacatcaacatacttgattttattctgtattttctcaaccagatttagttgaaaaagtctgccatgcctctaaattgacacatctagtctcccagattttttgcaaatattta

SEQ ID NO: 6893 - DNA, 201 bp, Bos taurus
cccggagcttgagtccaggtaattttaaagctatccgtagtctcgtctgtcacctttaggtttcgaggtgctcctttcactaaaatttaaaaaataacaaattgactgattatatgtgaagaataaaaagctagttttttgatcactaagttacagcatttctctaagcaaatccatgagcattttttgacaaacatcctg

SEQ ID NO: 6894 - DNA, 201 bp, Bos taurus
atcttattacttggccaatttaacctgctttgaacctggccaaaaatattccttttcaccagatgttaaatattgggtagttcctaaaaggaccagtagatttgtggaacaagtttatggccttggctctccccaggttggttaggaatacgcagagttggtttcttttgaggtcaaggtcccctatgtgtagccttggaa

SEQ ID NO: 6895 - DNA, 201 bp, Bos taurus
cactggaatcatgtgaagccttttaaaaagtactgattcctgtcttccacttccagtggttatttatttggtgtgggtgtggcctgaccatttgcagccaagtttgcaaattacttccctaagagaacctggctcttccctgaagaccccacttctctaagggccctcagaagaagtgggtaagtttctctcccactctcc

SEQ ID NO: 6896 - DNA, 201 bp, Bos taurus
cacattctgtatggatggctgagtcccttcactgttcatcacaacattgttactcagctctacccccacgcaaattaaaaagctcaaaaaaaaaaaaaaatgtcatgaaaaaattttctgcttctagagaagcttaacattgaaatcagctctatccatttatccgttcattcaacaagaatgtattcagtgaaacttgcg

SEQ ID NO: 6897 - DNA, 201 bp, Bos taurus
cagccaaagtcgtggctcatgggggctgcagtgaaggtatgcgtggaaaaaaaaggcgtgaaccaggagaggatctgtgaggagctggggccttgctttgagaaccagcaaagcaagaggcagagggaggatctggggaacttctgcagtgtcctgttggaaccagccgaggcatcaataggtagtcaggctatctcaggg

SEQ ID NO: 6898 - DNA, 201 bp, Bos taurus
caattagaactctgagatagtaatgtttaatataaacacaatagagtccagaaacaggcccacatacaaatgggaatttattataccaggtactcattaacaataaagaccttatactggcacaaaaacagacttgtaggtcaatggaacaaaataaagagcccagaaataaacccacccccctacactcagttaagctga

SEQ ID NO: 6899 - DNA, 201 bp, Bos taurus
gcttgcgctggcaggcagaccatctttgtttttcattagtgtgtgttgtcgtcacagtaactgcaagcctccaaatacaggcccgggctgtcatttcctcgtgtacttaggctgccacactgaaatagcattatgaactcagcaatgcctcttcctttcctgttgtgctgtggtgcctcagtcaaagaagcaggccctaaa

SEQ ID NO: 6900 - DNA, 201 bp, Bos taurus
aaaggcaggctattgatcacaattacaacccacttcagttgtgcacttaagtcatgttacttggagtgatgcaacaatggatgatccattattgtgaactgccaattatggttgcctacatcacctaagaaacagaaagtagctgtacagtatccatttgacactaacaacagtgttacttttagcccccttttgggggct

SEQ ID NO: 6901 - DNA, 201 bp, Bos taurus
ggacattgaaacagccttggtttcagcgcgcctccatctctgctgcgttttggtggagccctttattgtgctaatggaatattttacagaggggtgtgctctgtgtgctcattcacttcagtcaggtctgactctctgcgacgacaccatggactgcagcccgccaggctcctctgtccttggggattctccaggcaagga

SEQ ID NO: 6902 - DNA, 201 bp, Bos taurus
ttgtgtattcagcatgtaccgtgaggtataaaattaaggttaaaaagatgttttgagcctaatattcttttactcaataataggtctttaattatagataattctcctgtagtattttacttggccctatttatttgtttccattcacaactgacattttgtagctgtttattttctccttcgcgttgactgtgcgtgctc

SEQ ID NO: 6903 - DNA, 201 bp, Bos taurus
tattaacccctctttgagaaaggcaaggtagcattgttgtcccatttacagagaaagactgagaaaacttagaagtcctactcaaaatttacttgggctcttccctaaaattcagttttcctaacttatccattttacttccaccaagacccccctaccccaaagttgttgcttctctgccagggcttctttcactcattc

SEQ ID NO: 6904 - DNA, 201 bp, Bos taurus
cagttcttctgttacttcttcctcttgtctctgtcctttctctggacctccaattccatcaggtcttcatcagtaagccccttgtgatgcacagcaaggaattcaataatgtattcttgtaaatttagctcagcttctcactgagggtcacttagttgctgaagacctctttagattctttccccaccatctcaaattcac

SEQ ID NO: 6905 - DNA, 201 bp, Bos taurus
tacttgtaagttatcccagagagtaatctctcagtgtgatggtgagaagcagcaatgtgccttactggatgcctttggatattaaatgaggattaactctatttctcagaacagtaccaattatttggaaaagaaatcaagggcctagagtaaaatgaaacagacacttttcaccagactccaactaaattctcttacaaa

SEQ ID NO: 6906 - DNA, 201 bp, Bos taurus
tcttctgttattagaataatcatccaatcatactttttccttttagggttaattacaagcttaagacttgccatcagcctctctccctagtaccattactgtatcctagaaagtttcattgtgattctgacaaagcagaatcttggcgctacatctatcttttctgttctgtttttggaagggaaacgagttaaagtgact

SEQ ID NO: 6907 - DNA, 201 bp, Bos taurus
gactggaattatttcttttttacatagataatataaggcaaatgtggtgactgagctgatgaagatcaaagctttgattgaggctttgttgtctcaaatagcgtttaacaaaatctgctgtatttgccctggatacatatattcttccattatttttttcacgtgtgtgtgtgtgtagaaaagttagcaatactcgttaaa

SEQ ID NO: 6908 - DNA, 201 bp, Bos taurus
aggaaatggcgagggacagggaggcctggtgtgcagtggtccacccgtcacaaagagtcagacatgcctgggtgactgaacaacaacagcattctgtattctttacactgaaatggaaaggccccttgctccatattcattgttcaagtgttttaattctcatacctgtattttttttttcatgttggtacctcaagttgt

SEQ ID NO: 6909 - DNA, 201 bp, Bos taurus
agatgttaaaaatatcaacagtattcagacaaataagtattaagcttcaattatgttgaagaaattattctaggctcttgaagcatataacaatgatcatcttacagattctattttcgaagaacttaatctattagaagaaagttgccataaaatttccataagaaaggtacagacctcaagcttcattagctaaattaa

SEQ ID NO: 6910 - DNA, 201 bp, Bos taurus
agctctttatatggttgctgttgatggtgtaacaaaaaagaaagttcaccaaagtaaattttaaaaatatactaagctttactgaatgattcatggacccagaagcctcccatctaatgagtagaggggaactgcaatggtccacagaaagggaaaggttttcagaggcaggacaaagaggtaataaacaaaaaacacaat

SEQ ID NO: 6911 - DNA, 201 bp, Bos taurus
aggcactgggagatacaaggggatttagtgaaaatttacagagtgacaatttctgcagtttactccttagaagccagtgtgcaggcccatgcccattatggagaagagtggatagttcccctctgatccatcctacataataaatgtctagacacttaggcttgtgagtcaccgatgaaaaagtggccacaaccctataag

SEQ ID NO: 6912 - DNA, 201 bp, Bos taurus
tgagaaactggaatttttgttggagaacttccatactttagttataaaatcacggtactattatggaacattttcacctttttttcccccaagtgttcaataataagaaagtagcagggtcttttacttcagaacaaatatgaatatatgtaagatcatgttattgaatagtcaaaggactgctatggagactaaagaata

SEQ ID NO: 6913 - DNA, 201 bp, Bos taurus
tgtttctatttcttcctgatgaaaagaaagtattcgtcatcacccagagttgtgaacaaactaattcaaggagggtaaaatgcagatactttctgacatacgaaggatcatcttaattacaggttgcctgctttctcattcaaattgaaaagttgaatggaatggtatgaatcacttattatacttgtttattactagact

SEQ ID NO: 6914 - DNA, 201 bp, Bos taurus
tttttactccagtgtttcagacctgggtggtatcaagttcataataacctaaaactcaacatcattggaatctgaaagcaatgattacaaagaactatgtatattgtcaggaatcagttaacaacctacactttctgttgagcatcttcatccttgttaaaaggcaacattttagtgagaaatcactacctattttccccc

SEQ ID NO: 6915 - DNA, 201 bp, Bos taurus
aatcaataataataaaaaaataccacacagtttagtaatagagtaagaaagtgatttgttaattagcctttggatatagttcctgtcagcatagggtaaacagtacttctacagccacaaggctacagataaagccaacattattgctggcataagagagagatgggaagaacctgagaactcagcttattgctaagcaaa

SEQ ID NO: 6916 - DNA, 201 bp, Bos taurus
acggctttgcacaggtaagaaaaaagcagagaagtggaaaatgagacgctgagagaagacatgaatgtggtgagggcctttggatactagaaaacaattggaaatctctagacaagaaagaggaaagagggtttaaaaatcaatgagaggatgctacaggaaatgaaatattttgcaatttcctcttggccaggagagcca

SEQ ID NO: 6917 - DNA, 201 bp, Bos taurus
tcacaatatctgctaattggaggccatgtactaattagtcatgtgtttgtatcatcacccttgtccattttccccacagtccttttccttcttctctgcaatgacatccatcatcagcttattgcttatgctttatttctagcttagtcttaatatttcaaaatatttcataaccagaaacatcactagaagacatcagga

SEQ ID NO: 6918 - DNA, 201 bp, Bos taurus
gtgcagcacacgactttaacatttatttttattttgaaatgtcttaaatcccgcacctgcattcgaatcccttgggagctgtgaaaaattctgaggcctgcgttgcactccagatgagcaatgtcagaatctccgggggttgaactgaggtatccatattctttgactgtccctccgttattctgaagtagggccaggatt

SEQ ID NO: 6919 - DNA, 201 bp, Bos taurus
tctaaggagtgagcgtcttttaaagttgctaattagttttctataaagcagggagattagcctgggttatccagatgggcatgtaatcacaggagctcttaaaggcagagaagggaggcagaacatgcaagggaaaaaagagatgcaacatttagaactgagagcacaagccttgcatctggaggaagggggctgttagga

SEQ ID NO: 6920 - DNA, 201 bp, Bos taurus
ttgcacggacaaattttgagaagcagaggccttgacattgtctttctcagtacactgactcaacaagtatctctttccagctcacaatacgctaggcatcgctaatacattggccaactagaaagatagtttcctgcctccatgaagctgatagagtagaagagaataactgtttaattaattataattgtgataagtgtg

SEQ ID NO: 6921 - DNA, 201 bp, Bos taurus
gagttgtccagaattgaggaagggtctggcctttatatcctgcaacattcatccgatgtggattgccctttggggagaagctgctctctgttgctgaggatagttgctgaggaggccctcagcagtgagctgttaatgcaatctggcaatttggaaaataagcgcttcatcctaaaaggaggtatgagtacctccttaaca

SEQ ID NO: 6922 - DNA, 201 bp, Bos taurus
tgcaattcattttctcactagggcaaaaactaccatgaccaaggagagtgcacccttaagggattcaagccagctcacctgcagcattgcatctgaaccatccaggggcctgtcattgctggcatttgtggagatggtaggtcaggagccatctggaactctagttttgagttttgaaaaacttaggacaccatgaagtct

SEQ ID NO: 6923 - DNA, 201 bp, Bos taurus
ataaaggctttcccagacaaatagaagccaaaggagttcatcaccactagacatgccttacaagaaatggtgaagggagtttttctactgaattgaaaagacaaaagtacacaaaactttaagtaaggtcataaattgacagacggaactagaaaactgctactctatatcagaaaaggttgttaattacaacataaagat

SEQ ID NO: 6924 - DNA, 201 bp, Bos taurus
taataataattattataataacatcttgaatttatatagcacctttagcactactgtctcatcagtcagctgctatttctttgatggtcttcctcttgatgcttacataaaaaatggagagatggagagaacagaacccttgaattataaatattactttataggatcatttagttgaatacggcgatgcccagaatacat

SEQ ID NO: 6925 - DNA, 201 bp, Bos taurus
caactgtactttaattaaaaaaaaaaaaagaatatgtcctaaatgttggtttcaagcctaattccttgctttgtgatttacctccagttcctaaacatgagggctgaaactttcatccaattcagggattgctcagtatgactctgttaattaagattttattttattaagaataggcagaatgggcctgatgaagccaca

SEQ ID NO: 6926 - DNA, 201 bp, Bos taurus
caccgagctgagctccctgtgttatacagcagcttcccactcgctatctgtcacacatgctagtgcgtatatatcaatgctgcttcccaatttgtctcactctctctctctcccactgtgtgcacagctctgttctgtgcatcctgtctctattcctgccccacgagtaggttcatcagtaccatttttgtagattctctg

SEQ ID NO: 6927 - DNA, 201 bp, Bos taurus
agtgaggtgaaaaatttgcatgcagtgtatcaaatgatttctttgttgacctatgttttacagtagtacttgcttgggtggcatcagtgtgtttgtttttctgtttttttttattttgcttacagaatactgagggcaaatataataactaataggacagaaacattgctatagattgtcacaatattattaataatatta

SEQ ID NO: 6928 - DNA, 201 bp, Bos taurus
atgacatatacacctcttccgatctgagcctatggacccttccaactttatttcttactaaggactgtcatgcatcctttggcccattccaagggacttgctgttacactctgctttgcctttgctcaagctactgttttcctacagcgaatgttctttccctatattcacggccctgctccagtgacacttccctccttg

SEQ ID NO: 6929 - DNA, 201 bp, Bos taurus
attgactgcagtaaacatcagccatctgtaatttctgagaaatgacttcttaggatagttttttatatagatgacaactgtatattctttgtgggcttctctgatagctcagatggtaaagaatcctcctgtgatgcaggagaccctggttcgatttctgagtcaggcagatctgctggagaagggagaggctaccctctc

SEQ ID NO: 6930 - DNA, 201 bp, Bos taurus
agacaaccagatggcttcagggaaaattgtaccctcgatacatgcctaaaacagcagtgtaagatgtaactggctgacaatcttggttttggttagggccacttttttattcacggtatgctgggaactcaggggatgaggtcagtctctacccttaagactcttatgatggccagacatagtatttccctctgtcgtcaa

SEQ ID NO: 6931 - DNA, 201 bp, Bos taurus
tccataactctgtagaatatccttttaggaaagccctttcagactcttctttctttgtcaccccttccctgaatttcactgtttccaccactccttgccaccacatgccagacagtgatcaattctgtccattcaacatctctcaaatctgtctttgagaccagaattctaataacaacccttttataattccccttcctc

SEQ ID NO: 6932 - DNA, 201 bp, Bos taurus
taacttctgtcctgctagtatttctatgccacattagactgattggctttagaaccagtttatttctagccaaagaagtgatgaccagaaaattaataacgtgggagatgcctttcctttgtggacttccaggttggaagtctgaatatttacagtatatttcaagctctcccttgctttcatcccattctttttacacgt

SEQ ID NO: 6933 - DNA, 201 bp, Bos taurus
catgacatggaagacttaattttcaaagattttttttttttagatcttgaaacaaaattcaaatcataaaaattttacataacactttgaatgttttttttcaatatatacagacaaatattcagagttgagatgttttagtaccatgctcactcattattcttcccttttcatattgatagttcttttttttgaagtaag

SEQ ID NO: 6934 - DNA, 201 bp, Bos taurus
gatattttgaaagaaactttcaataaaaacacattttaaagtcagttcttttaggtttgtaaaaatagatgttcagttgtagggaggtaacatatcttaaaactcacagaacaaagcaattgtgcgttcaaaccagagctttgtagaatcatgcttttgagtttcactgttactattcctattaagaatgctacagtagaa

SEQ ID NO: 6935 - DNA, 201 bp, Bos taurus
gatattgaatggacatcaaacacaaatactactatgaatataggcatccactacccaagcactcagaaagcataagggcataatggaaaagcagcaatacggtaataacatgtctttttgagtatcccagatttctagcacatatctgagtgccgcttcatgtgaaaatgaaaactagagagagacctacctgggatacgg

SEQ ID NO: 6936 - DNA, 201 bp, Bos taurus
ctatatggacctttttcagcaaagtgatgtctctgctttttaatatattgtctaggtttgtcaaggattttcttcaaggagcaagcatcttttaatttcacggatgcggtcagcatcttcagtgatgttaatatttagccaatagaaatttgctgtatgactcagggtactcaaactagggctctgtgataacctagagga

SEQ ID NO: 6937 - DNA, 201 bp, Bos taurus
tataacaaataaataatagaaaaattaaagtttaaaaaagtttgtggttagtttaaaaactgaattattaggtgtggctagagtaggccactgtgtctgcatgtgtaagagagtcagagaaggcaaagcctaagaagcagaaagggtgataatgttgcaaggaaatagaagtttggggtcttgtcaaactaagaatttgtt

SEQ ID NO: 6938 - DNA, 201 bp, Bos taurus
tgaatactttgtgatgatcaaaaaatctgtgtgctcctagaccccaccagacctatagctttcattttaaaattgctttttcctgggacagtattgaagaaagcccaggtaaacaggctttgccagagactctactaaccacaggatgttgaatggaaattattatcattatttttatatttaagtccttgacactatcag

SEQ ID NO: 6939 - DNA, 201 bp, Bos taurus
ttattggttaattcataaaacatatggcacgcttcctctgccagaagtgtttgggcaaaggaaaacaaatgaaaacaagaagaaataaatgatacaacatgaaaacaatgcttttgaagcagagcagaaaggtcacctaattagggtttaattgatctagtaaagaggaaatcccatttctgtcctaggtatatctgtgca

SEQ ID NO: 6940 - DNA, 201 bp, Bos taurus
ttggtcctgagcttcctacttctgaactctgaaacatacttaggagaactccccagcacaggagctataactggggatgtttctgctgtatttaaatgagtgctgttcaccccacctctcatcactcatcctgcttctcatgattgtttttgtcagctgtataatcagtcctggtgagtcataccttaactacggtgggaa

SEQ ID NO: 6941 - DNA, 201 bp, Bos taurus
gcattactctgtagaaagcttggatgtttggcatcattgcctttgcttggaacttcagctaagactatgaactatgggaaattcttacttaatatccttctacaacaatttaaggaagcaattatatttggggtaataagaaacattccattacccattaatttttgatttatcagtatatggtgtatccaaaggcatagg

SEQ ID NO: 6942 - DNA, 201 bp, Bos taurus
ccctgaatccatcttgtacccagagagatctcctggggatgatatgtaaagataaacagcagcccagagcagctaggccatattatatttttattaacatcgtaactcttttaccccagaaatatcccaaattggataattacctcccacgttgcttttccattggcttgggagctaaacaccaggctctttctcaattag

SEQ ID NO: 6943 - DNA, 201 bp, Bos taurus
tgggtgaacaaactaagtaaattccctaccacaaccggtagacttaaagggctaatttgtgatttgctaattaattgcacattaagcttattattaagaagttgttgtttagttgctaagttgtgtctgactcttttacaaccccatggactgtatgtagcccgccaagctcctctgttcttggaatttcccaggcaagaa

SEQ ID NO: 6944 - DNA, 201 bp, Bos taurus
gaaggagaaactgtgctaactagcccaacttctctcttgggagagctgcctttgcaagcgatgctctcagactctctgagccttgaggtaacctagaagcaaaggtgctgtcctcttggagaaggcctgcagtggtccagagctgcccgtgactgatggggagcatctcccaaatcctggggcacagttccagctccctgg

SEQ ID NO: 6945 - DNA, 201 bp, Bos taurus
gaaaagatgttcacgtatatttagtttatggcattgccataaattccagacaagacattgaccaattatgaccattggccattgaatcaattattctctggaagaacaaatgcttctctgtatcccaatttatggaaccagtcatagaccatgctcttgtatcaaccacaaactttcctcttttctttcctaaagatgtat

SEQ ID NO: 6946 - DNA, 201 bp, Bos taurus
atggccctccatgtcttctgaaagtacatgccagtcagagagaacacagaataaaatgcacagaaccagggaaaaacaaaacttgtttgaaaagtggtagatactgcatggacagtagtttggaaaacgaaatcataaagttcgacaggggtccagttgtggacagggaaatgagaacatttacttgcatacttcaagtca

SEQ ID NO: 6947 - DNA, 201 bp, Bos taurus
tccagactcagcccgtcagtgtctcactctcctgagccaagggcactggcattgcaccaaatcaggtgcacctgctccagctagccatggccagagccaggatcatggagagaggggaagtcactcctgcagcggtggttgtggcggcaagatcaggctccctggccgcagaggcggtgtgtggagctctgggccagcagg

SEQ ID NO: 6948 - DNA, 201 bp, Bos taurus
gcactggttttatgggttggactgcctgtgaacatgattcagaattcagactgagaaagaaaatatactcccaggcttccaactgacaacactctttttttcttagttgcttttttcttggagtagagttgaattggaattctggtatacaggttgcattagtttctggtatacaacaaaatggctcagctatacctacac

SEQ ID NO: 6949 - DNA, 201 bp, Bos taurus
aaagattttggtgatgagggtggtggaggtgaacatgttgagaagtggtcaaatctgtgatatgaatgtaacgctgaccggatttgctggtgaattgcatgtgggatatgaaagaaagaatgctttaaatgatggctcagaaaagttttgggcctgaggaatcaaatgttagtgaagcagagtccatcagtgaggggatgg

SEQ ID NO: 6950 - DNA, 201 bp, Bos taurus
caatactttgaaggcttgatattagcctaatagaccaaatttaacatttggtctccttgcttctttagtagggtattggccattgttaagcaagtgacacttgttaccccctccaggaagggagtcttcctgcattgaggctcccattaccagaagcagtggcccaggatgtcaagccactgcatggtttgcaggtattag

SEQ ID NO: 6951 - DNA, 201 bp, Bos taurus
ggaagaactagcttcgtctaaacacatcaacccatcgtcaaggatgaaggagggactagcttgggaggctatagctgttgatcctactagttagccgtggaaaagctctatggaaacatcacccaggcaataatgagatgctgtaacaagtggtcctggggcaggactacttaggtgcacatgtacagaattctgtcgagt

SEQ ID NO: 6952 - DNA, 201 bp, Bos taurus
tttaagactgcaaaatttttcctgcggcagcttcggctcttctgctgggttatgtacagagcgatttgggcacattaatcttacaaacattatccttttcatggccctcttctcagcagggaagagagaagtcaaaaactttaacaagtacagatgccataagtgaaaagtgcccacagaccttgtatcaggtaatactgt

SEQ ID NO: 6953 - DNA, 201 bp, Bos taurus
gttggaattttttttccctatcccttttcctgttttacttttcctaaagccttgtgtgtttatatttgtgtgttttcggcccacctcttgccaccattagactataagctcattgagagcaaatactttcatctttgctgtattttcatctagctgtatacctagcacctagaatcttagtttgggccctagaacaggaac

SEQ ID NO: 6954 - DNA, 201 bp, Bos taurus
tgcagtaacttccaaggagatgccatttataggtagatttacatacatcaacatcagatagcaggctcaccagcaagtctcatcaaggtggccccaaatccaactgtgcttgaagccccatttagcatcagatagctggatgttacctcagctggtataaagcagcatcagcattctctaatggtctgctaccgaacccct

SEQ ID NO: 6955 - DNA, 201 bp, Bos taurus
cctgtttcttgctgttttcattttctcatatctttatttctagtctttctgtaacatttctttttcaatatgcaacatggtctgcttgtactttgtgaaacaacccaaaaataattttattagcaggtgagttaatcttcattcatatttattgataatgaccaatcttctcttaattctgtcattatgttatacttaaca

SEQ ID NO: 6956 - DNA, 201 bp, Bos taurus
gttttaaaaactatttctatttatttgttgggttttcagttgcagcctgcaggatttctgttgcagcacctgggctctttcattgtgttgcgtggcctctttgttggggcaaacaggcttctctctagttgtggcatggacccaggagttgtaacacacaggtttagttggcccatgtcatgtgggatcttagttccccaa

SEQ ID NO: 6957 - DNA, 201 bp, Bos taurus
ttaccacacttatctgatatattcaactctaggaactgaaactttaagcaacctcagttggaaattccttttctaaaaatgataataaaagcaattcttatgattctcccttaaataccacacagtaagttacagttactgtccactgtgaattcaggttagcgtggagaaacagaacacagatgagatacctatatgcct

SEQ ID NO: 6958 - DNA, 201 bp, Bos taurus
tctttaaacaaaatactcgttaggtggtctcagagcctcagtgacactcatagtatgaagttttcgccatttaaaagtgctgacgttgataaaacacagttaaagaattcactgcacaacactgttttcactttgtcaggcactctgtagtggcttaagcaagatttgaaattgtcatagtaatgtaaataggcatatcat

SEQ ID NO: 6959 - DNA, 201 bp, Bos taurus
cctttttttttcccttctgatagtccatggtccttcagatcttctgaattttctggaattgagttcggtattttgcttttcaagtttctggcttacctaaatttcactgtgctaattatggaaagggggttccaatctaacaacatttaagcactaataacaagcagtatgctaggaagggagcagaagagatctaaagtg

SEQ ID NO: 6960 - DNA, 201 bp, Bos taurus
gggagcgggcgccgtgggcaccgcggccatggccaaggggcggcggagagaccccgagctgcttctgccgttcgcaagcaggagcggctccactggtggagggagggaagaagggaggccgcgagggagggacagggcgagggagggggagggggacggccgcggggggcggggggagcttgggggcggggaaggaaactg

SEQ ID NO: 6961 - DNA, 201 bp, Bos taurus
tttaccaaagaatattccttattaataatgttaaatagcatggggaatttctttttattaaggaaattgtaaattatttctgttattattactatttttaggataggaataataactaggaagacatttgtggaaactctttttgtcttagttcttaattacattctctgggttgaagcctgatgaagttttgtgttttcc

SEQ ID NO: 6962 - DNA, 201 bp, Bos taurus
aggtgagtatagaagatgtgtctaatgtttaattaatattgtgtctaatatttaataactatggatatagctatccttaattttccaaaataggaacaccgttctgtgtcctgtggtaaaatcatacacatagtagaggtccttaccctgaccagaaacttcagcaggctagattgaggagcagattttaaaactattcaa

SEQ ID NO: 6963 - DNA, 201 bp, Bos taurus
acatgatttaatctcttggaaaaaggggaggatcttaccttgtcagaacacaatgctgacagatcaatatttgaacaaaagagcaaggtaagcacatatgcgtgaggagaggttagaatggtttgattagatcactaacagcatctatcagagataccaattagggagtagaactctgtgagatattaagatggggaatct

SEQ ID NO: 6964 - DNA, 201 bp, Bos taurus
aaatctaatcatggtttgaccaataaatgcagtgataatagtcactgtaaatggattaaaaacaagacggaactaaaataagactatgtgtttgtatgatgggaaagattaatgatagtaatagagagcgaagcaccataagtttattataaacatagaaaagtggagatagcaatatttttaacctacagttaagtcaat

SEQ ID NO: 6965 - DNA, 201 bp, Bos taurus
tgtgaccctcccccagctccttctctggccctatctccttcagtcctcctcctctgctcactctactccaatttggcctctgggcttttttctagaatcccgcctcaggagtcctcactgttgcttcctcctgaaatcttgactcccagatattcccagggctttctctctcactctgcctagagatagagggaggccttt

SEQ ID NO: 6966 - DNA, 201 bp, Bos taurus
ctgaaatgggttgccatttgccctccccagggaccttcctgacccagggactgaaccctatgtctcctccatttagcaggagatcctttaccactgagacactggggagcccataaagcaattatactcaagttttttaaaagtttttaaactgaataaagttaactgtaatatatatgttactactataataattttgta

SEQ ID NO: 6967 - DNA, 201 bp, Bos taurus
aaaacaaatccccacctcccaatccaaattgtttccacattaacacttgtggttgccagtttagagactctcataatagatataaataacaaattaagttacagaaaatttggctttcattttcaaactcagaattgtcatcacttgtatgtttttcctccaatttgaatgtgaacagcaatcttgcattttgtttattga

SEQ ID NO: 6968 - DNA, 201 bp, Bos taurus
ccttgctcattgcaacttcttgaaaatagtttgcatttgtatctgctgcccctactccccttcactcctcatcaagggtgtttcccttgcaaccttactgcgtccctactgctggtggaaactgcacccattgggtctcttcccagttgccaaattcaatgaactcttggtgcttctaagattcagcatttacttttgttg

SEQ ID NO: 6969 - DNA, 201 bp, Bos taurus
cagattccaaattcacaccctaacatgtctgggggcttttagtgggctccttgaggtttaaccaacacagactctaggcctgtctgaaatgaggacattcttttgttttctgtgacttatactcatctgggtttggggtactggttgcttaaagaagaactgaatgtttgtggcctgttgcctcaccttaaagcccacagt

SEQ ID NO: 6970 - DNA, 201 bp, Bos taurus
ctagtccagcattctccccttttccatcttatcttcttattctatcctgctctctctttcttttcccatctcccttctctgtcctgtggagttaggggctgtgaggaacagactgagatctgaaatgccagcaaccatggattcaaattccaaaatgctaacttacacgctttgtgttaagtgcagtgtttgggtagtgtt

SEQ ID NO: 6971 - DNA, 201 bp, Bos taurus
atcttgttgggtttcttaactaccttttaaaagaagccacatgccaagaaccatcttcaagccatagaatcagaatgagtgagagctaaatggaaccttacatatcatccatctggatccaccagtttctgaggaaactgaagtctgggtctcagtaagccactagcagatcccatatcatctggctctggggacattttc

SEQ ID NO: 6972 - DNA, 201 bp, Bos taurus
agccagggatctggcaagcgctgttctattactaacagcataagtctgcttcagggcaagccagacactccaggactttgactaccattttcatctaagtagaaaagacatggttcacaaaatgtttcacataataggttcagtacgtttatggtccacatagatatatgtaaatatcacacctatgaacagtacactctg

SEQ ID NO: 6973 - DNA, 201 bp, Bos taurus
gaatttgttttaatgggattttatctagagtatcttataccttagacaggagccattaaaacaaagtcaatgacaaagaatttatatgattatatcacacgtttcacgaaacaaacatgaagaaacaatttaaggctacccagtaatagcttctcataaaacccagtgaaccttacaattgtaattagacttcaaagagat

SEQ ID NO: 6974 - DNA, 201 bp, Bos taurus
agggacagtgcagtcacagagcagctggcttcaggaaatgctccgcacagggcccagcactgatgatgcaaccagcaggggccaaggtttgtgaggcctcagtaggcaatttctaattctggtctcgtttgacccttcagctgtaaccaacactactaaccagatgttttccagccttcttgacacctcccctcctggtct

SEQ ID NO: 6975 - DNA, 201 bp, Bos taurus
tagttaaatgaattagctatgacgcagaagtttccaaactctgtgctcaaactttatgttagaaatacctgacggaattgctggttaaagactatggtgagggtttccctgatagctcagaggtaaagaatccgcctgccagtgcagaagacacagattcaatccctgacctgggaagatcccacatgccgtggagaaact

SEQ ID NO: 6976 - DNA, 201 bp, Bos taurus
cagttgtttctcacatgaattctctccatccaggaacatattttccaagacctggttagtcagtggggtgatgtttagttgaccaggatcaactggctgaatcattgtgtccacagtcatttcgtgactggtgaatttaatgaagctgatggaaaccaggatccattcagactctaagtctttgagggtaataccaatctc

SEQ ID NO: 6977 - DNA, 201 bp, Bos taurus
attgttttcattttcctgatgaggaaatttaggcactacgaagttaaaaatattaagaaattcatcccaaggcacacagatagtaaatggccatttcaagttgcaaacttagatctgacttcaacacacttattaagggttacaaatgatgttcatattgcctctgacttcacttttctattatctatcaaactggcaggc

SEQ ID NO: 6978 - DNA, 201 bp, Bos taurus
ctttaatccaattttctgccgatgggtcaggctgtttgttgtttggcctagcatgccctatcctggagtctacagactatggtaggcctgggacgacctccagaaggacttatttcaatacacacctcccaggattgctactgcccatgcccctgtccgtgtggtaggccactgccaacccaggtctccacagaagagcct

SEQ ID NO: 6979 - DNA, 201 bp, Bos taurus
tctgaccggtgtgaggtcatatttcattgtagttttgatttgtatttctctaataattagtgatggtgagcatcttttcatgtgctttctggccatctgtattccatccaatgcaacaggcatgaacttgggcaaacttcagaagctggtgaagaacagagaggcctggcatgctgcggtccatggggttgcaaagagtca

SEQ ID NO: 6980 - DNA, 201 bp, Bos taurus
ttttccagggcaagttgatgaatcaggcatggaaattgatggggaggataagtaatacgttggaaaagtgattaagttttaaactgtactgaactggaatattaatatctgaaagagcttgggaatctataagatcaatctgagaagttttcatagaatgggaaatgggggtcagacatggtcaaaggcaatgactataga

SEQ ID NO: 6981 - DNA, 201 bp, Bos taurus
actaagtttcaccacaattctatgaacctactgaattagtaagatctatgaccttggggaaaaaaaattaaaagtaacgtatttttctatttttattgaagttttatgcttaaaagctagtgttatactcaatcttcatacacagttacttaataaaagaaacatgatctaagattaacaagtatctattaatttagatgt

SEQ ID NO: 6982 - DNA, 201 bp, Bos taurus
tggacaaaaacaaattcattagttatcaaaacagtatatataatgttagggctcagaacaggctgctccaatgtaggccacaatggtatattgattattttgaactaaagttacttgagaaatagctggtggggaaaatcacataaaatacactctgaactccacccaccccggcccctgtcttcctcaaaagtgggaaat

SEQ ID NO: 6983 - DNA, 201 bp, Bos taurus
aaaaactgaaatgttttttttttctgaagtagatttaagaattgggtttaagtggatgaatagccctacctaaactgaggaacaaagatgactatgaaaacaaatttagtttggcttctttgtgtgaagcacaaggacacagagtgaccataatttaacttagttaaccacattggcggaaacaggtcaggctaaagaaca

SEQ ID NO: 6984 - DNA, 201 bp, Bos taurus
ttattatcagcaaataaacatacacacattaatggttcaaatatctattgcaattcagtgttaagacaagttatgcagaaatcttccaaagaacgccaggacttatttttatatgcccaagaagattgtatcagccaaataaggcaatgcattattagtaatactcattcatccattcagctatgatttttggaaagcaac

SEQ ID NO: 6985 - DNA, 201 bp, Bos taurus
cagaaataaggggataattctaagtacaggcaacaaactgaacaaaggcaccaaagtagctactgttaggaattgcgggataaagcagtactttactagatcacaggataggagtaggaaatgaagcatgcaggagtttaaggaaaggaatactgattacagacagtcttgaatactctgataagaactacgagcaaaatg

SEQ ID NO: 6986 - DNA, 201 bp, Bos taurus
ttttctgggagataagaggcaagcactggttgtttcctgagtcctgacgaaagcagtgtttggatttcacaggctctggcaatgtggccttgaggacttaaggactaagtgatcacagggtcatatttatggcagtgcacacttgtggagcactgccatgctgctctgtgctctgggtgtcagtcattgtccactctctgt

SEQ ID NO: 6987 - DNA, 201 bp, Bos taurus
ttacagacaagccagcaaatatctgagtctaaagagatatgttatgcagaagctggtgtattaacttctgttgcacaaaatgtcttcactcctctgtattttttgtcctaaaaattaatatcaccattcacccatgttattcaagctaaaaagttaggagtcattttgacctaaagtggtatgcacccctgactggacctt

SEQ ID NO: 6988 - DNA, 201 bp, Bos taurus
ggaggccttctgtttgtccattgaagaaactgttcactctcactctcataacgttaatttaacctttatgcagatgatgtgaaaatctccatctctcttcgaaggccatatattttcccattgtctactcagtgttttcacttgaagttactctattatctcaaacgcaatatctatttgtgttatgaacttcaattaaat

SEQ ID NO: 6989 - DNA, 201 bp, Bos taurus
gctgcgattcatggggtcgcaaagagtcggacacaactgagcaactgaactgaactgaaaattaagtttattattatcaatatatgaattgatgtcaatataggccaattatgtgagattggatttaaaacatgcaggtaaaaagtaacacaggacatcactttttcttttaattacatatgattaagaaaatggttttaa

SEQ ID NO: 6990 - DNA, 201 bp, Bos taurus
atgaaagataaaaaattgtttcttcctattcttattcaataatgaaaagggattatgtattttatgtgtactcctgtatagataaatgcagtgaaatacagtgaaggcaaaggatgcagtgtactttgattaggggttaggggaccatttgaattagaaaaagttttgtggcaagaaacttgcaaaggacatctgcagcta

SEQ ID NO: 6991 - DNA, 201 bp, Bos taurus
acttctcagtaattgtagtggtagttgaatttctacttcactgactgaaattaccggttttaaaaagcacttattctatgccaagcatcctgctaagtacgttacataaattatctcatttaactcttataaaaccctatgatataaatgttgttttactcactttacaaatggtgacactcaagcttagaacaaaggtta

SEQ ID NO: 6992 - DNA, 201 bp, Bos taurus
tcccagcattaatcaagcaaagggcctggtatcagaagacttcaagatggaatctcttcattgttcctcattagctgtgtggccctggacaagtcaatgacttatcattctgaggctgagttccttaaatgagagtgtctatgactatctcacagcaactcactggcagtggccaggtgagaggagggggaataggaaggg

SEQ ID NO: 6993 - DNA, 201 bp, Bos taurus
ttattaaaaaaaggaaagatgggagaaaaggagggaaggagggacaaggaaggagatgggaaatttgaggggcggtgggggtaggaggagaagccggaatcgggaattgctctacttaccatgatcattttgccgtccttaatctctcttacaaaatttgtttctttgccatcccatttctgtacatgaacaagtttgtct

SEQ ID NO: 6994 - DNA, 201 bp, Bos taurus
aatgaattcattgatatagtctctgtttagtgagactgttttagctcaaggggctagaaaggggtctagcatcttgtttggttggttgaaacatgggccaacattacatgaagtcaaaagaccagaactgaatgccttggtatactgtagaataaatgtcaaatagctttatcatgtaaaacctgcttacctacccctgga

SEQ ID NO: 6995 - DNA, 201 bp, Bos taurus
gagggtcttattccagtgttctgagatttaatattatatctggctccagaagccccatgatagaagtacttattctcattttttaataaacaaaaaaatatatgaatgtaactacatgagttaaaggttatccttaattacacacacacacacactatacatagtgatttcaagaacagtattttcttctgagacatatta

SEQ ID NO: 6996 - DNA, 201 bp, Bos taurus
tcaatttgtcacccgtcacatttctcctctccatcctaaaatggtgcacctgcccactgagttttaccccttcatcctgaattttgcacagaaattattttccccctaactatgctcttttctgttgctttccagtcaatgcatcttgagtaaatgattgtcttccccatttaaaatgagaagaaaccactccatttttcc

SEQ ID NO: 6997 - DNA, 201 bp, Bos taurus
gatttaactttgatgttcactggtctaaagctgacctgtatgcataacaggaaatgaaaaataagacagggtggtagtcaccatctcttctttcactgcaggtggtcagcacttattctgagccctcctaatacatttgctgcttcctatgcctgtgtttgtgtgtctcatttccgctgctacaacttttttaagaaaagc

SEQ ID NO: 6998 - DNA, 201 bp, Bos taurus
agatcagctttatataagaatttgcaaaagtattacatggggtaacagagaacacaggtagtggagtgaggtgcagagagctggggtgagaatcaacaagtgctgtctgggataacttgaaatcaagctgcttaaaatgtcaaggacctcctgggagcaccctatggttacaattaactctggaggggagaaagctaaggc

SEQ ID NO: 6999 - DNA, 201 bp, Bos taurus
acatgtatccacgtactctgtattttctctccaagcttagaagctattatggtggcaaccttgacccacagttctcatttgaggtgtttttctttaccttttgagtatgtaaactctttcaattttcattttctttttgaatcatgtgcttctggtactccagagcttaatgagtgtggactctgtccagagctacagtca

SEQ ID NO: 7000 - DNA, 201 bp, Bos taurus
ccttacagtaagcctgccccaaaagaatgtctttggagactgtacagttaactcagctgaggaaaaggagtggagacatttccaaaatccaccttaagttgcttccacctggaacccacatcacagaatcattttgcctgagacccagcctgttccaaattcctctcactcttaatctactgccagaccaaggtctactca

SEQ ID NO: 7001 - DNA, 201 bp, Bos taurus
gaatgttagcaatgctagaacaccatgaccaaggtcagtctgtcaaggaatattgctcagtgccaaggtccccagtttagaagagggggtaaggacaggcggttcctagttttttctgctttaggtcagtgttgccccaagtgattctgatacacttccagaaaaatttctcattagattcagatatctgctagacagaga

SEQ ID NO: 7002 - DNA, 201 bp, Bos taurus
atgaaatagcctttcttactgttttatgcagacttaggccataataactctacctcactttagcacaggttcctgcacagaagtctggtaccaggaaaacagcgaaaccagaaaggagcaaggccctgaatagcacccgggaattgtccccagtggccttgtttgaagatgctcatgatgtgagccctggtctgcactgcc

SEQ ID NO: 7003 - DNA, 201 bp, Bos taurus
cactgcaaagtaatgattgtcaagtgaccaaggaaaaatcacaaatctactgtatgtctagctgtcacttgattattctaaacctccaggttcatgtactcaaatcacagcaaagttatttgctactccagagaagtattatgaaattttaaacctctgggactttacacaaactgctccttctattgataatgccctgtc

SEQ ID NO: 7004 - DNA, 201 bp, Bos taurus
atcctttaaatagctgcttcctttgtgcactcatggcctctctaaggtgacagaacacggttacatgaagcgtagaatgaaagaatgaaatagtgcccccaaaataaggccttatttattactgaaggcaaaatattgaattacgggaaaagaaataggtaaccatctcacaaacaagccaatgttattcatttggaatac

SEQ ID NO: 7005 - DNA, 201 bp, Bos taurus
atcagggacttttgagagtccttttaattactttcaccaagatctctgttcttttcaacaatgcccttaggcatagaattcttcacaatctgttgcacacaaagtcagtttccccagggagaactataaagctctttgtctttaaggcctgcctctccctagggcaaaacctctgtgatgctgcaaaggagttggaggcag

SEQ ID NO: 7006 - DNA, 201 bp, Bos taurus
accctatctgttcttttacagaattctgagagaatccagggcataatcaggagctatcttacaggttcctgcagagaaatactcatggcagtagaggcagggggacactcagcaaagtctcagggcacacaagagtgtccttctgctggaaatttcccaaggattaggcagtcatccaacacgtccacagacactggcttt

SEQ ID NO: 7007 - DNA, 201 bp, Bos taurus
ttcaaaactgagcagtaaattctaatgtttttctttaatttttgtaagaccccctctcccctgtggtgaatgactttgagtgggctcagttgtgaccattcctcttatagttacaacagctagatgtgctttgggtagtattcacacccacattcaattaacataacccatgttcaatctgtcagcaaatgctataggttt

SEQ ID NO: 7008 - DNA, 201 bp, Bos taurus
aaaacaaatatacaaatggaaaacatactacaactttgctaaaaatttagaaagcaatttaccaatgtattcctccaaaagccaccaaagagaagtttcattcataatatacaacaaaattctttgaatcctctttttcacctatcttcttagagtcctgccccacatagtagagcaaatcaccctaaactctcatcccca

SEQ ID NO: 7009 - DNA, 201 bp, Bos taurus
ttctctggcttatagatgtctggaaacatctcttcatttgccacttcctgaatctgcagtttagaaaatgtgtttaatgcctgaatgctggtgacttcctgtggaactgaccactgcctttgaactatactaatattaaaagattgttaaacactgttagctccctcttctgctgttgagtaagagtagtctgcgtctgac

SEQ ID NO: 7010 - DNA, 201 bp, Bos taurus
gtcttcattcatgcattcattttctactcatgtatttaggtatttattggactgagtgctttgccgagttctatggatgcctacataccttagagaacttactatatagtataaaatacaaataaataaatacaatatggcaatatagtatgctaaatttatgatacaaatcatagagggttcgtacaggctaacttgggg

SEQ ID NO: 7011 - DNA, 201 bp, Bos taurus
ataatcaaaagatgttaaagtaggttttgcttacttttgcccaggaagaattattagcgctatttttcaaatgcagtcattccctattgtaattcacatataatgaacaataagcattcttttaaaaatcatgaatatgcacaaagacaatttttctggcattaagtttttttttcttctggttagaataacacattactg

SEQ ID NO: 7012 - DNA, 201 bp, Bos taurus
atgcagagccatcaaggtgatagatgggcaatatctttataattatttctatcataactcttacagtgatagcacacagtgacttcagcagaagatatatgtatttaagtcttcttgggaatgccaaacacagtatgttagaggtgcagagtgtattgctgcacattcataataccaacaaacggaaaacttgatgacgaa

SEQ ID NO: 7013 - DNA, 201 bp, Bos taurus
atacttcttaagggattacattgtgattagtgatttatgaaaattgtctaattgtttcttttgaggtaggtgctattatttctatcttattatttctatcagattggaaaatggaggctcataggaatgaaacagtttcctggtgttactcacagtcataggagaagcagggtgcactctcacggtagaaacaaggaagtc

SEQ ID NO: 7014 - DNA, 201 bp, Bos taurus
aattcagcattatgttaaaacattcaacttcatacatgtccaaaatgatgaaacttactagaaaattgcaccaggtacgtatttcctaacaatttgtatcactgcataagacaatcagtgatattttagggaagatcatgctataaatgaaatgcaagaagatgatgtctgatgttgaaagaaggaagaagggatagaaaa

SEQ ID NO: 7015 - DNA, 201 bp, Bos taurus
atcgttttaacttttagcctagtttatagaggactcagtgaaaggagttaaatgacagagtttatagcatctaccacaaatttctaggtaacattttgataaatcaggtataatatgtgtgtatttatatattaatatcttgtaagaaaacagattgtaatggtgccactaattattacaatatttatgttacttaaataa

SEQ ID NO: 7016 - DNA, 201 bp, Bos taurus
tttatattacatatgtaatgattgtttttgattactgtctttaaaattacaagtttccctacagtcatttttagttgtctgccacatttgagtacaaggccctagcaacaggactggggtttgttgactgaagatatctcaacatgcagtctcttgttcagttgatgcaaatttggaggcagagtctgtttcctgatattc

SEQ ID NO: 7017 - DNA, 201 bp, Bos taurus
taaaccaaatatttgtataaaagcttatttgatgactgcaaataattggagacctttatctgggttcgttcattcattgctttacataaaaaatgtttactgatggcctacaatacacagaacactggaaaaatacagaggttgaaaatgtaagacttgtttctttgtatactaggttaacaaattgagaaaataattaaa

SEQ ID NO: 7018 - DNA, 201 bp, Bos taurus
tgttaaactttgtatcatccttgtatacacacctctggaaaaggctataagtttttgtttttaatatactgggtgtttaggaaaagagtactgtagttgatatataagaaaacctggaattttggcagtggtttttcctcaatagttactggctattttaccaccatgaaaaaccacctttaatctcttaggctgaatgaa

SEQ ID NO: 7019 - DNA, 201 bp, Bos taurus
tgctagcaacaaagaatttagagcagactcagagggaactcataatcataaagtcatccttagacaagaataataaaaacacagttactgtaaacagacttagtcttcaataacatgggataaatcacaaggtgaaaaatggaaaaagcaaactacagacatcatttgagcacggtagagagaaattatcaaacaatgagg

SEQ ID NO: 7020 - DNA, 201 bp, Bos taurus
ctttatataaggcctctagtttgcatatccaatttgcatttctgacaggctcactaagattaatttgtcctaaaaaacaactcttgactctcctacttttattaaacctgctcctactcacacatctccccactctcccagttacccttgacaagaacttaagcatcattttttattcctctcctattcctccctaacaca

SEQ ID NO: 7021 - DNA, 201 bp, Bos taurus
agaaatgtggagtctggtggcacaatgtccagtgatatattgtgatgacaggagaagtgtgcacttgggtgcccaggaacagtgtaccttacctctcccctatcccgtattgccactgagggctttcggttctttgagagtgaaaggcagtgcagtatctcatcattttctccagaaactcttacaaaggttaagatagta

SEQ ID NO: 7022 - DNA, 201 bp, Bos taurus
aataggtgcaaagtttatgcccagggcttataatttgagagagaaggaagataggatgaaaactaatatgtaggaaaatcataatgataaccttttataagggtgctaaaaatgtagaggttacagatgcagttgcttaaatgcaacacatcctccaaaaaacgctgagctgagtctttcaaaaaatgagaaggacactga

SEQ ID NO: 7023 - DNA, 201 bp, Bos taurus
aataagataattgaagccactgtcttagtgacagtagtaaagtaacaatattagattggaaatctcaatgcccgtactctaggcctgtttctgcaactaacagctaacgtaaacctgtaagagagccataccctgcttggattaaaatatgatgatgcttgaggccctgtctatccccaaattctgtaataataggaattt

SEQ ID NO: 7024 - DNA, 201 bp, Bos taurus
aagttttgtctgattgactctcagtagattttggagtggttgtgaatgatgcaaagctggaaactgccagctttacttcattcacttcatccacttcattcacttcatctaatggcattagatggtagaggttgaagtcaggcagcaggtgtggacagtcagtcagatggacgagtttccacagtgtctccctcataaagt

SEQ ID NO: 7025 - DNA, 201 bp, Bos taurus
tctgttaagattatggcattttctacagcaaacacaacagtaatgattatcgaatgctcccattagaatatttcatgagtcattcactcagaagcaaacaaacacccaagattaatctaaagtagattgcttattactggttcttggcattatgctttcctaggggtaccagactctcctgtgaacaccaataaaagtatc

SEQ ID NO: 7026 - DNA, 201 bp, Bos taurus
tatgcttttaaaggatagaatcacagtacgtttattgtcactctatataacccttatgactatttaattctaatttttaatctaaaagaacatgagtagagatggttatctgtagtatcccctttctcactgtagagcctgttaaactctaatcattttctgaagacatttgtcaagacaaaagtgcaacacagcattggt

SEQ ID NO: 7027 - DNA, 201 bp, Bos taurus
ccaggaactgacatttgcttgtgacccttgggctgttttcaagggcacactcttgcctgaggggctagtgtcaatttaaagcccctgccagccacttggcagaacaaaatggatactgagtcagtaacaccgtgaagtagcttatctaatcacaccacatgcatccagcagcagctgcatccactttcccataaataaggt

SEQ ID NO: 7028 - DNA, 201 bp, Bos taurus
agaattaaggagagttccttaaacttgatgcagatttgattctaaataattatcttaaagcctgaaggtgcaaaggagcaatatatctatcaaggaaagtgtgtgcctctataattcctcaatcaaaatccatggctgaatctgttctacaaccttaatttgttattcaaatagtcaagactgttatttcacttactaaaa

SEQ ID NO: 7029 - DNA, 201 bp, Bos taurus
gaggacttacagattacttgtaagataatatatctttttacaacttcccccttctctgtaccctagtaaataagtgaaaccagaacaggaccagaacttgggattttcaggccaagacttaaccggcagcagcagttctcccctgggcatgcacattggaatcacttgacatcacaggtggtgctttaagaagttctgatc

SEQ ID NO: 7030 - DNA, 201 bp, Bos taurus
aatgtatttgatacttagtgtcaaagtacagattattatgaatttctgtgatatgaatatgcttctatgtgtatttctattattggaagggcaaaaacagttttgtatgagatgtaaaaaacaggaaactagaaagttaatatttctgttttgactatttgtagcatatatatataggtatatatatattttaaagattat

SEQ ID NO: 7031 - DNA, 201 bp, Bos taurus
tttcctgcataggcaggcgggttctttaccactagtgcagcctgggaatccccttatataggagagggggtcaataaatattaatcccattcctcaggccactcccccttgtcaacctctgctgacattgtctttaacaaatatatttttgtatatattttctcctctgatggagatatattctacattattaggggccac

SEQ ID NO: 7032 - DNA, 201 bp, Bos taurus
atcctcacacattttgcagaaatgagttacaataaaccccagggctgggctttcccttcctctgacctctgtgttatttatcaggcagaggctgcaaaatatcccacttcatactctgaaaaaccatgctcacagtaataataacctctgtctgtccgtgtgtcctgtctccttaggaatgttaatttacaaagagtaaag

SEQ ID NO: 7033 - DNA, 201 bp, Bos taurus
tatagtttcatatgataaagctaaatatatatttccaaatctactgtttttatataaatgctgccaacaacagatgacttgtcaaaacagttttaaagggttatgttcatagtattttttataaatctaatgaaccaaagtcattatactcttctattcttaaacttagggagtttgtatctgcttctgacatgttgaatt

SEQ ID NO: 7034 - DNA, 201 bp, Bos taurus
agagcctaagactatttattatagagctatatgcagagataggtctagatttcagtggccagaaaaccagaaggttatccttttaaaaatgagtacaggaactttgtcaaaaccctcaaaatgagatatttgcctgttcttagaaattactgacccaatacttgatatatacaggttacccaagcaaatcagagaagctct

SEQ ID NO: 7035 - DNA, 201 bp, Bos taurus
aaaactattttcctaatataccacagaaatctacatcttctccatgtattcactgacataggaccatgaaagtgtgttgtttttatgagtttgaagtataatcattaattgatggtcctgcgtttttgaagctcagtggcatactgtttttccaaaggagactttttttcatgaatgacataaaggtaaaccaccatttaa

SEQ ID NO: 7036 - DNA, 201 bp, Bos taurus
gccacaataatcatatcctctctagttcttattcatcttttaaagagatacagatataatcaaacctttctacattaaaaaaaattttttaattggatttttaaaaaacttggtttttttgggccacaccatgaggcatgtggaattttagttccctgaccagggattgaacccacatcccctgcacaggaagcatggagc

SEQ ID NO: 7037 - DNA, 201 bp, Bos taurus
ggagactcaaataagctcattttgtcatttgttggcagctctggttaaaagtttggcaaggtagtgcattaaaagcacgcaatgaaagtaaacttgatcatgtacctctcatttacccaggctctttcaggctcccagtgctggggttaaattgtaagctggcagaactgcacttgatatcttatattatggcagtgaaaa

SEQ ID NO: 7038 - DNA, 201 bp, Bos taurus
ttgcgggctgtacaaggtgggaacccccaggggcaggaggcactgagtcttggttcacggctcacctgagctatgcccttggtcactaggtcattttggcttgaggaactgcctccagttccctgagcaatcaaatccatttatatgagagactgcatgacggcatttcagttccaagaatcagcagtgagcgctaaggga

SEQ ID NO: 7039 - DNA, 201 bp, Bos taurus
ctttgggcaagagctgaggaactttaaaaagcagtgtaaagtaatgataaggccccttgacttctttgcatgttttaaaaaattgatcttatatcaagctgccattaactattctacaaaaagggcctactacagtgcagtccctcgcttattaggatgatcttagaaaacaaaattaaaaggaaatttaactccgagcac

SEQ ID NO: 7040 - DNA, 201 bp, Bos taurus
ctgattttgcaaacttaatattctgcatatttatatacagatgaacttcactattttcatgtatacatacatctcatgaacactcaaatataagcaggtttgtatctctataattatccctcagaaaagtcctgtgtccaggccaagcaaagtctcttcacaaggagcactctcaattatttatttgaattccaggtagta

SEQ ID NO: 7041 - DNA, 201 bp, Bos taurus
ataatttagaaaacaatagtggaaatattagtatttccttctttttaaaagaattagatgcactactggacatgcttatgtgtttactaacttttcttatacctttccttttatcctgtagtccttaggtgattttctgggaatttgtcctcaaatacaccttttctgtatattgtctgtcctttactgtgtgcgtactga

SEQ ID NO: 7042 - DNA, 201 bp, Bos taurus
ggtggccatggttcaaagcctttcacggtgcagtgcacaggcagtcaagcagttggttggagctgcagtctctgaagacttgactaaggctgggaatctatctccaagctcactcactggcctcagtgccttgctcacagctggccagagacttcctgaagttccttgtcacataggtccctgtagtgctctaatcaccac

SEQ ID NO: 7043 - DNA, 201 bp, Bos taurus
catgacacagcctgtttggggcccgggtcagaggagtgatgtatccagtgaaataggggtgactgtattcccaccatgaaataactgctgtgtcctgatcgcatgatgtttgttcaaagtggcctcagctatccagagtcgccaactttctggatgagatgaaaattcccgggggtcactaaggacatctgtatcatttct

SEQ ID NO: 7044 - DNA, 201 bp, Bos taurus
ttgatgaacagtcttctgtgacctggccctcccagggagaaaagcagctcttggaggcagctggggaaaacatcaaaacattgttgaagaaggtgtacttcggcccgtagagagcctcagtaatgaaaggcacaccgttgggagcgaaggtaaatgagttttgatcaggatgttcatgccctgcgttaaaattcctccagc

SEQ ID NO: 7045 - DNA, 201 bp, Bos taurus
actccaaggggctggacagcatggtgttcacggcctcagtgagccgggcggcaatgtgctcgtgggagctggcggccctcagctggagctcggccacctccgctctagagaagtacagcattgggtggctgtcatagttggcattggtgaaggggatcatgacttctggattctcgtcagtgacgcaggctgacacgaagc

SEQ ID NO: 7046 - DNA, 201 bp, Bos taurus
ttcttgcctggagaatccccatggacagaggagcctggcgggctacagtccatggggtcacaaagagtcggagacgactgagcgactaagcacaccatgaagttaatggtaattattgctgtatatatggggaaattgaggcacaggagtattaagcagcttgcccaaagtcaggaagaaatctaaggtggagccctgatt

SEQ ID NO: 7047 - DNA, 201 bp, Bos taurus
aataaaatgtcaggagacatctttgcaaaattacaataatggtgttattgtcatatttctggtgtttatctatgcaaaaattagcaaactgataagactgatctctgtagatcctctttgtattggccaaacatcttgggttatgaacctggaaggaaacaagtaggaagtttcactctaaaagagctattatatgttatt

SEQ ID NO: 7048 - DNA, 201 bp, Bos taurus
gctaatatgttaactcttttgtagtaggatagagtatctgagtctcagtttccatccacataaggaccaagaccatcttggttgggatttgtgtctgaggagtatacacttgacactgtcttaatggctgaaaattaaggcaaagcatttgacctttaggtagctgaagtcaaaagaaaaagagtgtgagctaaagttctt

SEQ ID NO: 7049 - DNA, 201 bp, Bos taurus
tcattcctctgatcttccattgctgtcactttataggtcagatgtatggctagcagacaggcattgcagagttaatacacgatgcagatagagagtgtcaattcagaactgtgtgtcgattcagtggtctctccagaattcagggtcatagacaaaaaagctcagtcttatattttctgccagccaagaaaacatgcttga

SEQ ID NO: 7050 - DNA, 201 bp, Bos taurus
tgagtgatttgcaagtagagcatctaaattttgttctcctttctactctcctctatttatttcaaattcctagactacctgagaaattttattaagtggcgtaaatgtgttctaccaaggtttgcaatgtcatgcattgggttggtagagccaaaagaaagtgctttcctgagttatatgattttgctctctcccagtcta

SEQ ID NO: 7051 - DNA, 201 bp, Bos taurus
gatagtaccacaaaagcccaaatcaaattgaattttgggagctacagagtaataaaaaatagtcactcttttatgtaattaatatttatagagtacttattctatggtaatagtaattactgggtgacaatggtccatgccttcattgatctaacagtctagttttatggaagcaacaacaaagataaatatcagactaaa

SEQ ID NO: 7052 - DNA, 201 bp, Bos taurus
agagaccaagaagacttactctttgtcactacttcaggacataacacactgaatgggaaaagttatacggtcttctcttgctatgttaaaagcattttataaaccagaaaaaaaaaataaaaaaggctgctgcctcttcttccaagaattgtccttctaggatataacacagataaaataaaaggagaaatgaatgaatat

SEQ ID NO: 7053 - DNA, 201 bp, Bos taurus
tattaaagttgctatggtttacttagagacttgacgcaaggaaatatttgaaaaggacaacaaagcgaaatgattatggaatgggcctcattaggctgtttgctagaaagttttctggttaatattttgatccatctcatgatacatcataagtcattatggtatagaacatttagttatacttgtggcctcactttctct

SEQ ID NO: 7054 - DNA, 201 bp, Bos taurus
tcttggacttcactttctgccttgcctttctctctcctgcaataagtcctacatttttgcacctaaacttcccttaagcactggcctccagattttacactcatatcagtagaataacagctttggcgcgagggtgtctgacagagagctgctctccttctggccatcccaccaagtattagaatgaatcaaacctcaaaa

SEQ ID NO: 7055 - DNA, 201 bp, Bos taurus
ctaatagcctaagagaacagggatgctggggtgcagcattgttagagaagtgttaggtttattttggtgttctccaattataaagtcaattctctggataccagcttcttttacatattaatggcctaacccttggcatatggcaggaatgtatattcaactccgagactgcttgaaaaatggaatggtgagttcaaagat

SEQ ID NO: 7056 - DNA, 201 bp, Bos taurus
aggccaattcactgcttgagagcattaaacatctgggtaactgctcctgggaaatgagagtgtgggtgtatgtcagactagtgcgtggctgtcctcaggcgtaggccatcatgagaattaaatgtacaacccataattacctcattcatacacttactttcttttaaacaaaacttactaagttgcaggtattttcatcaa

SEQ ID NO: 7057 - DNA, 201 bp, Bos taurus
gggcatggctcagtcagaacaaagtgtatacttgccttctcagaccttcaacagtacctaaaggtcatctgccttgaagacaggttaagtctggtcataatactgaaaacccacaactcgaggagtaaaagagttctcctggcacagagagaaggccctgtgagtgttaatgtcagcattaattccctctatgacctgagg

SEQ ID NO: 7058 - DNA, 201 bp, Bos taurus
gttatttctgctcttatcttttttatacacacgatttgctttcccaattagtctgaagaacaagacacattttacagttgtatatctctttaagttcttacatagttaccctggtaatctacacagaggagatactcaacacagtggtcactgctaataataattacagatttcctctttgagatgctgatacttcccatc

SEQ ID NO: 7059 - DNA, 201 bp, Bos taurus
tgaggacaatagtggctgtggaatcaatcattcaattttcaaggacaattaaagatgaaaattaattatccaaaataccagaaagatattaatagtccctcatgggcaaaaatggagttgtaagtaggataatcatatgttatagcttgcctgtcatcctgatagaattagaaatggtggcctttttgtatcctcatttga

SEQ ID NO: 7060 - DNA, 201 bp, Bos taurus
agagaaatttccctactggatctgtgaaaaagtgtgtacagtggcatggtgtggtgcgttctcaataccatgctaaaataagtgcaatatcatggctcttataagtattttgggtactattcctcagctcaaaacaagacagactgagattcagagtgcttccaatgaccacagagctcctctaaaaaaaggaaagtagcc

SEQ ID NO: 7061 - DNA, 201 bp, Bos taurus
tgtcatatgctgagttccattttatagccataaatgattgtggaatgctgaaatcacagttgtttattagttaatatgtttggctaaggtaaagaaatcattcaaagtcaagtcaataacatatgaatcataaaccataggtttaaagccaaaaggattctagaaaacaaaagcttagagaagcagatgtttaatatttca

SEQ ID NO: 7062 - DNA, 201 bp, Bos taurus
aacaagctatcttgcaataggctttagagcaaacctagagtcagttacttccctgaagacgtggaggtggtccttatgaaaaaattaacctgagataagaatctatctctgccaggagaaagggaaagaagaaagacaaatattgggcttataaaaaatttactgaagaaacaaatataaggactgaaggtgggatggaga

SEQ ID NO: 7063 - DNA, 201 bp, Bos taurus
ttcctgagtgttcaggagtctccagcagagatatgggtcgacagtggcctgccacagggtcagggacactgaatgcagtaatcctgggaggcatgtcacgctggcataagttcttttggaagaggccaccattattcctaccatagaccaaactacagggagggaaacagtgcacccatcagcagaaaattggattaaata

SEQ ID NO: 7064 - DNA, 201 bp, Bos taurus
gctttctcaaatgttctaccttgaataacctgcacctatcacttaaacataaaaaaaaattacacattttaatgttaagaatcatttgaaaaaactacaaggatttcttacaaagactgaactgttgctgtacttttaggtcatttgctgcaagttacacatttccccaacccatcatgattttctcactcattggagaaa

SEQ ID NO: 7065 - DNA, 201 bp, Bos taurus
tggcctcaaagccagtttacatttttagaaacctgtggagaaggaaagagtggagaaagaggagggtggggcaatgactgtaggaataaaattccagagaattccaagtggcccgagggtcattgatttaggtcactgacttaggttagtggccgagaggacttggacttgagagggagcaagccatcctctgagatagga

SEQ ID NO: 7066 - DNA, 201 bp, Bos taurus
ccttgaatttttcccaccctcacgtctcgtcaaccacaggatctggcccattttacctttggagtatttttaactatcttccatcttttcccttcctctatgacttctccagtgtgggcctttgttatttctcaactaaaatagcctcctccactcccctccattcttggttctgtattgtgatcatctgctagtggatgt

SEQ ID NO: 7067 - DNA, 201 bp, Bos taurus
ttgttcttggcccctttctaatttgttttttattcatttatagaccaccatgatttttttaacaaccaaattgtatggttttattttctcaattgcgagttaacctgaacagactattggccctaattatggacagaattaagaactggaaatcaactgttttgtaatgaaggaaattattactgctaaatatacccaact

SEQ ID NO: 7068 - DNA, 201 bp, Bos taurus
ctccagacctgctcagagcttccagtgtgtttgacatggaaaatgacattttctacttacctactgaaaaatgtatcaaactttccaaaagagatacaaaaatatgcaattacaaaatcatgccatggttacaaaatttaggtttctgttcttgagaactaatagtatttctctccacagatgagtctttcaatattggat

SEQ ID NO: 7069 - DNA, 201 bp, Bos taurus
cttgcctgggaaatcccatgaacagaggagcctggtgggctacagtccatggggtcgcaaagagttggacacgaatgagcgactaaaccacctcaagtcaccctagtcagagatcacatttgtctgtctgtttcatacagtcctcctttggccagactgttctgataagcctgccgctctgccctcctatattgctagctt

SEQ ID NO: 7070 - DNA, 201 bp, Bos taurus
ggagctgaggaaggctccttgaagggggaagatgggccaaggcctggctcttggagatgcagaaactgcacgggcagttgtgtggagatgtgtaccatcatgggtgtagctcatgttgggccagtgggagatgctggaagaggggcagggcccctggtgtggaaggcttggaagccaggctgggtaagttgctgagcaagg

SEQ ID NO: 7071 - DNA, 201 bp, Bos taurus
tactcagaagtcaggagctaagtgaagataagagggaacctctgtgtgctgtaggagccactgtcctcccacctctcaaatgcagggctgtgtgctcatgacgtcactggccttggatgcacagacctcccccacagctggtgtcagcctccacggttcctgggctgggcagcccatcacaccatagagtctgcgctccag

SEQ ID NO: 7072 - DNA, 201 bp, Bos taurus
ttgctctcctctggatgttgtggcccaggtaactgagtaaacgggaatctcgcgtcagtgtcttgcatcgctacaccagcacaggcaggtcagaaggcagagagggcattctgcttcttatggggccctccatgtgcgtttggatttgcaaggggctttagaagaatgctttatcttggcccagagcccgtctcacttgga

SEQ ID NO: 7073 - DNA, 201 bp, Bos taurus
cgcatttaacaggacgaggaacggcgtttgcattgacttttcttcaaatacaaatactctaagaatcacctgtgcctcagggaaagatattaagtggccagaagtgacagctcagagaactcaccctcccaactccccaagaccccaatatttaagacaagctactaagggaagttttctggaataaagtaaccgccttat

SEQ ID NO: 7074 - DNA, 201 bp, Bos taurus
aagcaaaagcattcaaatttacaagctctgatttgctgctgtggacagtgcgtaagtgacacgcttcaagttttaagcacttgaaaaggaggactttttttccttgtaaacagcaaagtttctgaaaggaaatctggaagatagctcacagattttgaaaagcaacatgaagaaaccaagtccttaccttacaaaagaact

SEQ ID NO: 7075 - DNA, 201 bp, Bos taurus
cctctctctctggaggagtggccatagcacccaggaagtcctgggtctgggtctcctcttagcaggggctcaagttcccttggaggggatcacctcctcctctgtgttgtagatcatggccaaggctgcgcccgcttcttgtctctgctggataaggactcatccctaatgttgtgttttgtcttactctagcagcaattt

SEQ ID NO: 7076 - DNA, 201 bp, Bos taurus
accaaacttagagaaccaatggtttacagcattcacccatttagtagaccctttgaagggtagagaaaatttaaggtctctggccattaagtagaaggaggtctacatattcttgtctctctaagaacacctcctctctccctgcactgtgcctcccaccgacccaggccagagggaaagctgtggtactaggcagcctag

SEQ ID NO: 7077 - DNA, 201 bp, Bos taurus
gggtggtggttgctgtttctcttgtttgttgattgccttcccccctctccccactgtcagctgttaattgcaactcaagtaggctcaagtagggcctctcttcagcacatcacaaagccaggagctctggtctctggtctctgagcctgtgctccttcatcgggatccgccgactgcctcccaccccagcctttgtgatgt

SEQ ID NO: 7078 - DNA, 201 bp, Bos taurus
acctcctgactgcaacaccatcgggcctggtgaccagccagctggggttcgtgccttggagcacgcttcttcctgtctggttttaggtgacagagtcaagctgaagaggcccaaggggctgctcttgccccagagagtcttggggaggccttttaaggtctatttgtttgatacacacctcgaccagtaacagtgggtggg

SEQ ID NO: 7079 - DNA, 201 bp, Bos taurus
tcgggaagagccttgaaaggcaggagcctacaattctagtctcctctgatctggctgagatgtggattcacttgggaggccaagaccaccaaaattcagtattcctctaaaagacatgaggaaagcaagcaggagcaaagtaactgcatcagtgtctggcttctatcctgcttcaggagtaatccaaggccacgtcttcat

SEQ ID NO: 7080 - DNA, 201 bp, Bos taurus
ggcaggaaccaagggagacctggcagcaggaaaacatggccagagtcacgccccaggcaagtgcagccagggtgctgccatgggtgcctactggcccttgagtctccctgccgccttcactgagcataacttctctgttctccttgggtctctgtggctccccagaggccgaaggccccaggcagaagcacctgaccagtc

SEQ ID NO: 7081 - DNA, 201 bp, Bos taurus
ctcaggactccataggccttactccactgtcttccagcactgagagaaactctaataaagccagaggcagccagcctttttctccttctatgggacttgcgtgttcagcctgatcgccataggccgccttcttgcatttacgcactcaatcagcaatttctaatggggtgtgttctacgtactgggcacggtactagtgct

SEQ ID NO: 7082 - DNA, 201 bp, Bos taurus
gtcttgtagaaataagtttaggacgattatataaccattgaataagaacaggattggttttactgccaggactgttttctggagctacctgtaattcttatatgtttgtcaaaatatgtacctgttgatgaaaatgtttgagtttactaattttttcaagaaatgcttttaggggaaataactcttaactaacaaggtgat

SEQ ID NO: 7083 - DNA, 201 bp, Bos taurus
ctgtctttgtgggggaccatgattagccaaccataggaagatttgtcattcatctgtgataggaaatgcaaatatttgattggccaaaaaagttgttcggattttcctgttaagctgttatcagatcagatcagtcgctcagtcgtgtccgactctttgcgaccccatgaatcgcagcacgccaggcctccctgtccatca

SEQ ID NO: 7084 - DNA, 201 bp, Bos taurus
cgagccagggatggcgccagggcggtggcctgtggttttccttctagagaggacagggcaagctgggagctgcaggtgtcaagagaaacgctatcagtgccggccagggaggactgtcaaatgaaaacccagtgaccaatttgtcataatggagggtaatctagtgattaagaaaaacacatgctttgtcttcttgcaact

SEQ ID NO: 7085 - DNA, 201 bp, Bos taurus
acctagaacagatccagttttgtccgtactcatttcaaagccagacactgcactgtccttctaacctgtccagtccggggcttgggaaggtgtgtctggaaaggcccatcggaaggagtggaaagtacacatccccatacttatccactctccagggggtgcctgagaaaaccaagcaccagatcctgtcaagatttggtg

SEQ ID NO: 7086 - DNA, 201 bp, Bos taurus
tggagaattccatggacagaggaacctggcaggctacagtccatggggtgtcaaagagtcagacatgactgagtgactttcatttcacttcattgacctcatttaactgtaattaaatggccctatctccaagcgcggtcacattctaaggtactaggggttaagactaacatatgaatttggtgggggacacaattttgt

SEQ ID NO: 7087 - DNA, 201 bp, Bos taurus
tattctggggcagagtgaaggtttacctgactccgggagcccacctttgtgggttattacctggtttagttcatattccttccagtgtaccttgtcctcctctccttttttccctttaattcatgcaaactaacctgacccaaatttgttatttttcatttaagtgctgtttgcaaagtgagcatctgtaagccagctacc

SEQ ID NO: 7088 - DNA, 201 bp, Bos taurus
aagtgaaatcagtcagatagagaaaggcatatactgtatgatatcacattatgtggagcctgaaaaataaaacaagctaataactgtaacaaaaaagaaactcacagacatagaaaatatactagtggttaccagtggggagaggaaaggcaggaggaacaagataggggtagaggattaagaggtacaaactaccatgta

SEQ ID NO: 7089 - DNA, 201 bp, Bos taurus
gactaagtcacagtttgtgtgcccaagcatctcacaggccagaaaacacatgattagatgaacagactataataaggtcagtgcaacgagagctggacctgcagagctctgggccctttatctgccttgagggatgacgagctagagaaggatctctggagaaggtagtgtgtgagttgaatcttaaaggacaagcagtac

SEQ ID NO: 7090 - DNA, 201 bp, Bos taurus
atcatttctttttagatcccacatataacggatgtcatataatatttctcctctttggtcttacttattacactcaatatgacaatctcttgttgttgttgttcagtcactaagtcatgttcgacttggtgacaccatgaattgcaacacgtcaggcttccctgtccttcactgtcttccagagtttggtcaaactcacat

SEQ ID NO: 7091 - DNA, 201 bp, Bos taurus
actcagtcgtgtctgactcttagcgaccccgtggactgcagcctaccagactcctccatccatggattttccaggcaggagtactggagtggggtgccatcgccttctccaagtaagttgctattggttatcaaaggagtataataattctgtccatttaactcccaaaggtttcttgccaataaccaaaagggtttacaa

SEQ ID NO: 7092 - DNA, 201 bp, Bos taurus
acacactctccgatgatggcacagtggcactccgaggtgagggctccgtagccaggcctgcgggagtcctggggcccgcgctgacagctctgatgtgggtacagtcgtcccacccttgagagaccagacagagtgtgaaccatattgtgaaacagaagcacatgcaatgtcgggaaagctgatttcggcacagtatattta

SEQ ID NO: 7093 - DNA, 201 bp, Bos taurus
tcaagtgtttggcatggagtataacctcattctcaatttgactacttataggtatctacagactcagtttcctctactgtcattgtaagactgctccacgtgcttgtctgttttgaaaacacacacacaggaaaagcgtcttgccattccattgtgaccagtcccttactcatctctgtggctttgtccatgcttttttct

SEQ ID NO: 7094 - DNA, 201 bp, Bos taurus
aaaatagttgggcaggtgccaaaaagctacacaggcagcacgtgtgcaggaccataactagtgtggttctttcatgaagaacatcttgctctcatgacctgaaggaaatcccaaagacagattcagactccacttatttgattgagatgattcggtattgcttgtggagaatccttgcacttagaattttgtcctggcaaa

SEQ ID NO: 7095 - DNA, 201 bp, Bos taurus
aattattgtattgtctgtggatattgatttcaaatagaaaattgtttgagaatttgattattcatctggcttactatatagtctggcaacttttttcttcgtctatccttatctatctcctaaggtatattctgtctactgattacataattaaagaaagtgttgtgagcactttggaagacacttaagagtaatgatact

SEQ ID NO: 7096 - DNA, 201 bp, Bos taurus
tggaatggtggtcgtggggtgaagaatgaggtaagaggcagattccggccttcccctaccccgcccccacactccagcccaccggatcttgggccagtgggtgagttggggggctcaaggaacaaactgtgggctgtctcctgcatggctccagagtcctctccagggccacccactggctgaattgaggccttgagacag

SEQ ID NO: 7097 - DNA, 201 bp, Bos taurus
tactggtgttgactattgagtcactctctgcaaagatcagtgggtcataggcaatgagaaaactgaaactttactctgagaaggctgctcatgaatgatacctcagtcaaagcagaacacaaatgaatgcatccaggagtgtgtggatgagcaatgtctgtggggacacggatcctcagaatctaccctaagtcatgacag

SEQ ID NO: 7098 - DNA, 201 bp, Bos taurus
tagattaagaaacattaatttgaagatattccagggtacttaaatatgatccaaatcatcacagactttcaatatttttattttatagccctatttggcataatacatattttttccatgttgtccagttgtcaggatttaaccatgaaaataaaagtatcatattgtattggcttggagtgtttccaagaaagttgacat

SEQ ID NO: 7099 - DNA, 201 bp, Bos taurus
actatttaaaatttactaacatttaggctttttgtaaatttatgttaacttcatctagagcatttgaggtcatagcagtcctcctatgttttttcttctttttttttttttttttctattttttctttcatctcctttcttttccgctaaatgatatacctctagcatgcagaaataacattttgctcagatgtacagctc

SEQ ID NO: 7100 - DNA, 201 bp, Bos taurus
tagcttttaatagggaggcctgggcaacttctgcagattcagggcttacagttatatctaaggattcaacatttgaacttaaccctgtcaagttagggtccagtatttccccaacattggccctaaatttgccttggcaaacctgttttggttttaaccttatctggaccttagccattcagactattaaattcttggcct

SEQ ID NO: 7101 - DNA, 201 bp, Bos taurus
atcttaaatatttactctgtaagtaattgtaatttcgtgtgcccataagaggaggtgagttcagggtcttgtattccaccattttggccaaaacaaacacgttgatatgttattgaaattgccttaccttttgatttgtttatatatacttagtatattttggtagaggcatattaaatatattaattaaaattatggatt

SEQ ID NO: 7102 - DNA, 201 bp, Bos taurus
ttcattggaaggactggtgctgaagctgaagcttcaatactttggccacctgatgcaaagagctgacacactggaaaagaccctgaggctgggaaatattgaaggcaagcagagaaagggccaacagaatatgagatgattggatggcatcactgactcaatggacatgagtttgagcaaagtcagggagatagagaagga

SEQ ID NO: 7103 - DNA, 201 bp, Bos taurus
caatttaaatgtcaactatatttactatctctaacaagctgatctccttgctctcacttcctgttttgtcataatactttttacgtgacatttttagcacttaacatactgccttgtaatttactttcaataccagattttaaatatttgaagaataggaaatgttttactcacatttgattcttctttggccaataaagg

SEQ ID NO: 7104 - DNA, 201 bp, Bos taurus
ccttgaactgtctttgtcgccatcaagtttaaaacagacacatgttctacagaagaggattagaataaattttgaggtcttcctactctcttcatgccataatcctatagtagacaagacttccaccaccattaccagagcagtaccaccaccacacattaatcatctaacttaaatgattctaaaagaagaaactgaggt

SEQ ID NO: 7105 - DNA, 201 bp, Bos taurus
atccattctctttcacactcccctgcagtttaatgttccctaaatgaatcctcaaaactgttataagagaaacgagaaacacatcatccactcagtggtcctttgtcgtcttataagggttcaaagcagggaagggagggtggatcaccaatgtgagggtgtttcagctatagcggttctctgaggcaatgcaaaggtaaa

SEQ ID NO: 7106 - DNA, 201 bp, Bos taurus
ctcaaaagagccaagtacaaactacagtaattccactaggcttaactgaagtccccttcatactgtactctcctccttgtctcctgctgtgcacatttacctgactctgctttggggatttgtttgtttcccttgcaatagtcttggctgcctttcttttgctttgccatatgttgttcttcatcataccgtctttgaatt

SEQ ID NO: 7107 - DNA, 201 bp, Bos taurus
cctaaatgcaggggggagaaacaactaaataataagcctgttagaatacacacagaagaagctctgtttaaccctaagctatttaacatctcagtggttttgtaagcaccagagtcttattaaatcttatgtgtgtctgtgtgtgggtaaggcacggggtggcccaggaatgatcgctgccaccctgacggtcacactgaa

SEQ ID NO: 7108 - DNA, 201 bp, Bos taurus
cactattctgaagcacagaaaaaaatgaaaaaacatgcataaaaatatcaagtctttccccaataacatgacatttccaaatatagtgatatccatgctcattaacagcaaagattcattttatttacatttgatattggaatccttctggcatgtagctggtatgtgtgtttaaaatcagttagatatataaaataacta

SEQ ID NO: 7109 - DNA, 201 bp, Bos taurus
ttcagagcaaatatctctcaaagtattttttatatcaaattattaaatacagcccaaagtatttttttaaatcaagataattccctccttgagaactgtgtttataatgtttctgtctcatgaaaaaatgatcaaacaaaaatgatagtgaacaagaatgacattactatctcactgtctcacatatgataatgaaatcaa

SEQ ID NO: 7110 - DNA, 201 bp, Bos taurus
aattgcaaaatgcaattcattctttaaataattggaaatcagtattgtgaatggattttgattgctaggaaaaatttttttggctttttcttattagcaaggcacagctgaaaatgaagatggaagacaaataaaatattaacttgttaatggaccctggaaaaataaatgagtttttcttaatttcttagtgactgtgga

SEQ ID NO: 7111 - DNA, 201 bp, Bos taurus
tcactttgggagttagggctttagtttatgaaacttcggaatacataattgcatccataatgtggaaataactgctccagatattggtgtacaggtttttgtgcgaatgtaagttttcatttctctgggataaatatccaagaatgcaattactcagtcatattataattacttgtttagttttctaagaaactacagtaa

SEQ ID NO: 7112 - DNA, 201 bp, Bos taurus
atgtttgccttggaggaaccagcttccaacctcaagacgcagcagagattggcagtggctgcagctctgactccagcaacaccaagtcggctgcgggaggaggggccttttcacaaacgttgccttttataagtgtcttcatggatcgctagatatgtaaagtgactacgcccgtaggagaacctttcaatttgtgtatat

SEQ ID NO: 7113 - DNA, 201 bp, Bos taurus
ctggtcctaatgcgaacctcccctgtatctcctgggcttaccagccctctgtgacctctgccaggcctcagtgcctgtggccttttgcctcaaatcccaccgatgccctctgtttcacctcattgcttttagttcccttgtgctgccggcacttccaggccttggcccagttggtctccatgcttgaaaggctttcggggc

SEQ ID NO: 7114 - DNA, 201 bp, Bos taurus
gataacagtacatgccccgggcaggtcagcaggaagctctgctccttgtagttagttaggaaccttgacctcagttttctctggcaaatgagagggagaccgtgggtttagcacagcagttcttaaatgcctcagcatgcaagtctcacagtgtacttcgttcagatttaatgggtgcaactagtcagctggcctcaccta

SEQ ID NO: 7115 - DNA, 201 bp, Bos taurus
ggttttcattctgtctgccctctgacagataaggataacaggcttatggaaacttcctgaaggagagactgatggtgagggtaactggatcttgttctgacgggcagggctatggtggctcggtgtctgcccgcaatgtgggatacctgggttcgatccctgggtcgggaagatcccatggagaaggaaatggcaacccac

SEQ ID NO: 7116 - DNA, 201 bp, Bos taurus
ccaatttccagtatacaagttttccaacttttcaagatacctcctagcttgctcctaggtatcagctaccagcatattcagggatgtcccacaagaatccctccacttggttctaaacgtcctctaaatcccccttaactagcacacgctaatttgttctggcgttccatctcaacaatggtacaaaggagagaagaagaa

SEQ ID NO: 7117 - DNA, 201 bp, Bos taurus
tcatgtaaacacagaccttttatcacaaaggagctcttaggactaagttgctacagaagcatacttcggcaaatgatgctctgaggccttcttcaaggaaaatcagctccatgatgtaggagaaagatgctcacacagaaaaaatggaagtcaaccaagagacatgccaagtaaaagaagctcaaaaaacatgatcaggcc

SEQ ID NO: 7118 - DNA, 201 bp, Bos taurus
aggatcccccgtccctgggattctccaggcaagaacactggagtggattgccatttccttctcctccatcagagtctagtcagtaaataaactttccctagagtagggccttaggaagttgcagctcctgctgtatgctccgtataggcaggacctcatctcttgtgcattcttctgctaaaattcatggctcacctcaag

SEQ ID NO: 7119 - DNA, 201 bp, Bos taurus
aacatgcaaaataaatattaaattcatatttatgtttaaagactggttctggagtcttttcaatgcacattattgacagaatattttgtgtatcaacactgtatcagcttacttagctatatttaaaatatccttcatatttcagaagtttattatttcaaaataaaatatctcaggggcctctttcattttgactgcagt

SEQ ID NO: 7120 - DNA, 201 bp, Bos taurus
agactgtgtcaggagagcctgttccctgctcccaggcccctggtgctttctcccccagagcacttccggtactatctctgaatggtaggcttgactgtctactcagctggactgggtgccaggcctggtggataagtttctgtctctagagcccgaacaagcccctggtgcatatgaggcttttagcaagtgtttgttgaa

SEQ ID NO: 7121 - DNA, 201 bp, Bos taurus
ctgacctcagtagaagcagtaagttataaagggccgaacagaaaagccaagatgtcccttctgagagcttccatatccgcctatgtgataaaaaaggaggtgatggagggctggcctgctaggaaaagaataatctttcatgttcatggagtgtcaaggtcaacctttctattcctgtccagcagattgtacaaaaagaat

SEQ ID NO: 7122 - DNA, 201 bp, Bos taurus
catagatacttattttttctcattaaaattatcttttaaaaaaagttagattttccttgaggtgtcggagcatatatgctttctgaccccgataagaaaaggaacctccccaattctcctatggacctaaaacctgaattcctgaggctaagattctaagcccttctctaactcacctgttgaagcctctaccccaaatcc

SEQ ID NO: 7123 - DNA, 201 bp, Bos taurus
atgttccaagggctctggaaaggacaccttgcagagactgatttttctcagaacagctgagcttcccaggtaactgtgggccactcaagccagccaccacttcattcctgctcccttatgtttctgtgcctggcatattgctgggaacatagctgctcctcaagaaatgacatctaaagaataaatggatcaggccgtaag

SEQ ID NO: 7124 - DNA, 201 bp, Bos taurus
tcccttctccaggggatcttcccaaccctggaatcgaacccaggtctcctgcattgcatgaagattctttaccagctgagccacaaggaaagcccaatgacgagtaagagtggataattaagattcatagaagaaactaatcatgttataaacctattattttgaagagccttatcctatcatatcctttaccttaaagca

SEQ ID NO: 7125 - DNA, 201 bp, Bos taurus
tattaagtcctctgcccctctgtatattctagaaactgcaatagctataaggggtgtaggaaagggtcagagaaaggcagaaacaaagcatgcaggataggttggttctatgatctctccaaggcttaggggcagatcttcctgatatgactatggtaaaatttctggttcacatatgcccttcagaactttgccattctt

SEQ ID NO: 7126 - DNA, 201 bp, Bos taurus
aaaactttatgaggaacattaaggaaggaaatgagttgtgttcagctaattaattgattctgctatttctgccttcttgtagtggaaatatgaaaaagccggtggtgtagatctcataagttaaggaagagttgactatggggatattgactaaataataaaaatataggatatagaaaaagggagagagtcataaaggtg

SEQ ID NO: 7127 - DNA, 201 bp, Bos taurus
aggaggttgcttgctttccgagtggaatttatgtaacacagataactgccaggaactaaactgagcccacaaaagttactgaaggtgtgagattagatccaggcctggtggaagggggtggcagacgagaccccagaggggattccgagggagcggagcagtgctgaggcggcgcgcagggtccgctccccggcgggcaag

SEQ ID NO: 7128 - DNA, 201 bp, Bos taurus
tcatcatgtggcacaccttgaaaacatacttatcttattttaaaattgaaaaaaaagaaagactgctcaggcagtagtaggatgacttgatcggaaggatcggaaggcctaaaggctggagtcgggggtggggtgggcgatcagtgacaatactaccttagttatgaagcagaaatgaaaaagccctgattaaggcagcat

SEQ ID NO: 7129 - DNA, 201 bp, Bos taurus
tagaaatatcaaaacttggtcttttggtgtgagagacaggaagaagacaagatgcttgggggagctgaataggtggacagaaggagttatggatcaagattgctggaggtaaaggaaaataaaccaattagcagggaagctgagcctgcctaaagtcaattctttgagccattcttgctttacacagctctcttttctttt

SEQ ID NO: 7130 - DNA, 201 bp, Bos taurus
tcttgcctggagaatcccagggacgggagagcctggtgggctgccatccatggggtcacacagagttggacatgactgaagtgacttagcgtagcatagggaaggaaatctttaaagaaatatattctcaaaagtataatggagactctttggatgaaaaagaagaaagactcaaggatatattcctgtaacagtaaaatg

SEQ ID NO: 7131 - DNA, 201 bp, Bos taurus
ctgcacccaaatctacaggccaggctcctctgtcctaggatctagatctgcttgtcctagcccatacactggtaatgtgttgacattaggacattgagttcgcaatttgtaaccttgcggccatgaaaactcacttccaagctgtgtcctagtcatctgctgcccaaatctctgatgcctgcttctttcatccccactcat

SEQ ID NO: 7132 - DNA, 201 bp, Bos taurus
tatacaaacaggaacctcttacactgggatattttttaaaaaatctaaattgtgttaaagtacactttaaggttattcacatattttccaataaaaactacgatggagctgcttcaagcacaataacaataaatagcaaaaagaaacttttaaaaatcctattcgtcctgcagcctcctgccagagtctcacacaatagca

SEQ ID NO: 7133 - DNA, 201 bp, Bos taurus
ggtggagaagaaaaggcctggctttctagggaaatcttgtgcttaccaaatcctgaaggcatgcaataagaagggcttgtaccctcatgaatagagggcagttttgactgttacaaggcctgtgcttcttcaggaaaagggggtggggttaagcaagcataagatcattacaactggctaagaaaggggatattctaaaaa

SEQ ID NO: 7134 - DNA, 201 bp, Bos taurus
agaacccaaggtccagagagagtattgccaagggtgcaaggttccatatgtctatccaaaagatcatttgttctgcaaaataactttggtatttgttcctgtaagtataaattacaagcttgaatctctagttttttttaagagatttcttttaatatcctataaatgctgggaaagattgagggcagaaagagaaggggg

SEQ ID NO: 7135 - DNA, 201 bp, Bos taurus
acaccaccgggataatatgtgcatgagggtcaaatttttaaaacattctcttttttgtctgcagggttaagagaagaaaacaaggaaaagataatgcctcatgtttatatactcattgtttgtcaaataagaatattcttcctcaaatgaagaagaatccttttgaactttaccaactcaagcatgtagcttaatgattat

SEQ ID NO: 7136 - DNA, 201 bp, Bos taurus
tttccataggaaaagtgagtaaatgacaaatcaaaacttgaggcagtattgaattcacgttttactgatttttggagaagaatgattttattattttttaccatgtgaaaatgattatgggtctttttggaccaaaagactaataatgttgtatctagcacagttttatattccagcttaatgtctatgtctgctctaaac

SEQ ID NO: 7137 - DNA, 201 bp, Bos taurus
agattttagaaacgtttagtatcaccagtcacagagttgctgagcatgagtgttgcagagcagcagaaagaagtagaatacttcttagcttccgtggtggttacttatgtcaatagttgtgtggagcgcttgccccacggtggccctctgatgccaaaacagttcacgtaataaaaattcttaaaaacttcctaagttaaa

SEQ ID NO: 7138 - DNA, 201 bp, Bos taurus
gtttaactttgtccagtaatatttttgctttggtagttcaaatattttggataggtcacaactatcaactccatggccagaagtcaaatcaaccaaacactagagaattagtgcatcagcttaacgaaagtggaataatcaatcaatactaatggacatataaaggagaggaaaccagtccaggccaaccattactgtctc

SEQ ID NO: 7139 - DNA, 201 bp, Bos taurus
agccaggagaaaataggaaacaatgcgatgtttagaggagagatacgtgtgtatatatgtatatgtatcttcataactattaataatggcctgcaaatacagctctaagcctcctagcattaaaatcaaaaaagaaaatgtagcctaatacaagataaaaagatgaaaatactgaaatgaactctagattctccaggccct

SEQ ID NO: 7140 - DNA, 201 bp, Bos taurus
gaggaaacagctgtgcaaagaaaggccctgaggtgagcatatgccaggcatatctgagaaacaacagaggtcaatgtgatggggatggaagggcaagagttatgggaaagaggcctgagggtgtagaaccaggtaaactaaaagacactggctttcactctgaatgaaagtggaaatcatcagagaatgctgagcagaagc

SEQ ID NO: 7141 - DNA, 201 bp, Bos taurus
ctgctgcatctaccactgcaatgttcatttggtgtatgtgtgtttgtgtgttcatgctggagtatccaccttctctggggggaggggacggtgtgatgggataagatggggagggaaaaggccaagacattatgtcttcattgcagcttacgaaaaagataggaacatccacccagttggtctctatggacttacctgtag

SEQ ID NO: 7142 - DNA, 201 bp, Bos taurus
ctgctcaaatgtttctcatagagttttattcaaattattttcttttattcaaattatttcttttctttaagtctgggcctttaactgtttcctcttttattgttctactttaattttgcctctgaatttggagcattagaagaaaacagtaattgatgggggtcacttagggaaaggtaagtaaacttcacagcattaaga

SEQ ID NO: 7143 - DNA, 201 bp, Bos taurus
aagtccaaatcaaggggaaaactgaagaaaagagggaaacaatcatataaaaatgaattaatttgcttcctctgtctaaaatgtggtaaaacttgaattggtatgcaaaatagacttatgaatagtatttgatggatagaaaatgtgcatctgaattctttcccagatttttctctgataatatagaaggaaactaataat

SEQ ID NO: 7144 - DNA, 201 bp, Bos taurus
aatcttggtgctttttcaaataaataaaagaggaaaaatattttaaggctttataagttattatatatccttatgtattatggtttggatagttttaactcaattaaatgaacccacatgtttgttgcattggcaaaggtataagaataagatacaattcctacaattccttatctaaaggaaggggaataatgatataaa

SEQ ID NO: 7145 - DNA, 201 bp, Bos taurus
atatgctaaaatgaaggtattttgttgatttcttttgaacacagcttactgctttattatacttatagtggcacaaaaacttaaataatacttgaaattcgctgacattcttcatgcagatacatccacatgtttttctaaggtctataaacttttaatctgatcttattcatgttcttagaattttcacacatccttaaa

SEQ ID NO: 7146 - DNA, 201 bp, Bos taurus
ataattgtggcctcctggcatctgctgccaagccccacatcccagactcatctctatggatagaaacaaacccaactctgtggcctcctctgccacactcgggcctgcactgcagagaaggccaccaccaaactacttagtgatgctggcacccagaccagtacatgcctcgtggccttgctgaatagttctttactcggt

SEQ ID NO: 7147 - DNA, 201 bp, Bos taurus
tatatgtcagtgcccatcttccaatttattcctcccctccctttacccctgttaccataagtttgttttctacacctgtggttctacttctgttttgtaaataagttcatctgtacttaaaaaaaaatgattccaggggtaagcaatagcacacactgctaaatatataaaatagatagctaataaggacttactgcatag

SEQ ID NO: 7148 - DNA, 201 bp, Bos taurus
cacagagagctgagaaaaactgactgcgagaagtgttagcagagagtagccacagcaggaggactgggtgtcacgctgagtggaggcagtcagggaaggggggcctcctggaggaggtcatgtttgaactgaagataaggagaggggacactaggtgcaaagggccaggacagaaacaagcatcgcatattcaaggagcac

SEQ ID NO: 7149 - DNA, 201 bp, Bos taurus
acatttatacatttctcacagcaaaatatgtttatactgaataactgaaattcagtacaaaatggtagcttcagaaaatcctgtattttgctaataaactgaataacgaatttcattattcaggtagaaaaacatatggtccttttatgaaaaaagtgtagcaaagacattaaaaagtaactatgttaataccatgttgat

SEQ ID NO: 7150 - DNA, 201 bp, Bos taurus
ggactgagtggagccagagcattggcttggtctgggctggggcacatggtgagatgctcttaggacacctggcattcaccagagcagacttttctccactcggccttggggccaagtcgcctttgtctctcatggttcttcactgacctcagcctctcctgctttccctctgtgttaaactgccctgcaggggagtatgag

SEQ ID NO: 7151 - DNA, 201 bp, Bos taurus
aagatgacttttaaatttcaggcccaggtaaccacatggaagctaaatattgtcagtctgaatcatagctgtttccaaggccaaataacagagagaacacgggtttattggggcattcaaaatatgctactgtgtatgtgaggactattggccaaccactgtgtttatctcaatgcaaatcaggtatctcatagaagtgat

SEQ ID NO: 7152 - DNA, 201 bp, Bos taurus
ttccagctggactggaaagtggctgaaaaaatccattctctccaccagtacctagagtactaagatatgaaaattataactaggggaagggaggatattaggaaagatgcaaataagaacttcacttggtgggaaagggattgttcttagcagaagtccacctaggaaccaccgggattaccctattggatctgcaggcac

SEQ ID NO: 7153 - DNA, 201 bp, Bos taurus
caggtggtctttcttttatctctcagagcccccaacatttggttttattttctgagaaaactaagaaatgaaagaggcagtggaatttataggcttagcacgtggagaggttttgttgtgcgtgactttggacttccctgtgggaacagcaaactgaatttggcagactgtcgatactgatcataggctaggtttgatttt

SEQ ID NO: 7154 - DNA, 201 bp, Bos taurus
tggataaaatgcttttcagacaccttagaaactgtttttacctacaaattataccaaatacaaatgataccagacttataaacaggcttttcttaaagtataccttaaatagaaacaaagtaattgtttccatattcctagatatttcatcaaaattctcttttacctcaaatttttaaaaaaagttactttgataaatta

SEQ ID NO: 7155 - DNA, 201 bp, Bos taurus
tctgctattatagaagattggttacaaagatgtttggaaggttgcaaacaaaaaataattattgagataccaaagtattaatcactacaggaagggaacagtactcatttagttggagaaacaaaggggacattagaatccagattcttggaggaggatggtctcccagacacaaattggaggcaggttctacccggctgt

SEQ ID NO: 7156 - DNA, 201 bp, Bos taurus
acaagtctgcctctaggagtcctcaatgaggagactaggaaaaaaacttacgtgacaatgtattttaactaaaacctttgcaaattgatgtatcacagtatttggaatgagtggagaataatttggaaataattgcttgtaaacattttaaatttccttctgtcattcagtgattagtttctcagcgcctttccctggtca

SEQ ID NO: 7157 - DNA, 201 bp, Bos taurus
cgagttggtagacttgccacacacagtattcaaggttactgattttcaacagcactaacaaaatgctattacaggggaaatatcgtatgcactggatggataaccacaaaaaaggtgaaaagtgacccacagcagttagctcagtaagaatataaaaataaatatgttttaaaagctaaggcaatgaggtaaaattccctg

SEQ ID NO: 7158 - DNA, 201 bp, Bos taurus
catgcttaagcagatctcatgttttcttaacaacagaacaagcaaaatcaaactatacagcatatacattattccatatcaatttgtatactcagttattcgggggctagaaaataaaatttacttggtagtagcaatgcccttgtattctaaaccaagtcaatggtagatatgtagtaacttaacaaatgtatacatgta

SEQ ID NO: 7159 - DNA, 201 bp, Bos taurus
aaatgggtaaaatataaaagtctgattattctttgtcttgtcaaggatgggaaacaacttgagctctcatactaccgaagagaatgaatttagtcccacctctttagaaaacaattttggattttcttaaattgtcatacattcatcaactagataaaccagtcattctattcctaggaacatattcaagataaatgaaag

SEQ ID NO: 7160 - DNA, 201 bp, Bos taurus
agtagtacaagtataatgaagtctagatgtttgtgatcttctattatggactttatgccctgaagggcttctgatagggtgttgcctaattctgggagaggtttcaaggcctctatttgaatcttgatggaaggcatgctatgaattttgtcactatcacctggagatttgacctataaagagagtggtagctaattaaaa

SEQ ID NO: 7161 - DNA, 201 bp, Bos taurus
gtaatagtttacacaaatatcagaaatgtttaaactcaaaaccacttatgacaattgactgaggtaattcttaaactggaatcacattcacatttactacgtatatttctttggttacttaccaactggaatgcaatcctgagaaaaagtgagtggcagttttcagagaggctttaaatatatatggtccacaggagttgt

SEQ ID NO: 7162 - DNA, 201 bp, Bos taurus
attcaaaaaggccatttttgtttgtggatttcagattccttgaattcttggaaagcaaaacagaagaatcctgactaaaggctttctggtaagtacctacgaaaagctatgattcctatacctaacaggatgaagagagactaggataagcctctctggtgttgctgagtagataaaaggtagaggccatctgtcatcaaa

SEQ ID NO: 7163 - DNA, 201 bp, Bos taurus
aaaaaaaaatcttattgttttgataattacttgaataataaattcttacattccttttctgactgctatccatgattttggagactataatttttcaactcatttgtcttatttaattttgcagcaactaacactgaagaaatatttctcctgttaactcttttagggatttgacacttaaatttataaattttatgagac

SEQ ID NO: 7164 - DNA, 201 bp, Bos taurus
caaacataaggaatttcccttctagcagcttccgatcttgatgtggaatataaaagaagagtatttaaaacaaaaattaatgatgcagataattagattatagaattagggaggacaaaaatcctggtagcttgataataatcataaataaaatgtaagacaagaagtaatattgttaacttgattgaaggattggacttg

SEQ ID NO: 7165 - DNA, 201 bp, Bos taurus
ccattatgatttatcacaggatattgaatatagttccctgtgctacacactaggactttgttgcttatccatttggagtttgtagttattggccaacctttacacattagatttttattagcatatctgtttatttgttactataacatcaattaaaatatgtaattttatttcatatatccttatttttctgggggccaa

SEQ ID NO: 7166 - DNA, 201 bp, Bos taurus
atttcagtgagtttttgctttcactaacaggacaactgcatgcatccatctggtgataacaatattagagaacacatagagagttctgaaggccaaatattccaagtcccaagagaagttccacccagctcaaagcaggcaagagagtctgagtatagtctgtggtgcctggactaagatgcagagatgggcccctagggg

SEQ ID NO: 7167 - DNA, 201 bp, Bos taurus
ccaacactagggatgcactggagaggtggcccacatgagccatgggctgcaggcagcctacaccaacccaaaggccccaggtccttgcttatggccctacattcctagctttcctgatctgttggtcccttcatggatttgctaaagaactgaatcctggaatcagaggctaggccaaggagccctccaggcctcttgacc

SEQ ID NO: 7168 - DNA, 201 bp, Bos taurus
gaaggggacaggtaatgattgattttttgaggacttgagagaaattatgatcaaaagcataggaaggataattagctttgaaggatggaaatatttcattgaactgatagtagtgggaaatgatagggattggagaagatacggagattattagcttggtaaaagattttttgctatattaactctgataaactgtgtttt

SEQ ID NO: 7169 - DNA, 201 bp, Bos taurus
atacttcatgttataaacatctgcaggataaaatgtcagataataatcataggaaattaaaattcagtttaaccacatcatattgaacctatattttgcctttataatttactaaatttgatcctttctatgtgttacttgttgattttttaaaaataaacaaccttattcatatctgtcgctttttcaaaatcatctttt

SEQ ID NO: 7170 - DNA, 201 bp, Bos taurus
tctggaaggaggattaagacctacagtaaataatttaaattgatcatctacaacttgatgtcaaagtatagattttaaagaactagtctgtacttcagcaatttttttttttagaggcactgaggtttgttgaagttttttttagtctttttcttagcaacagtccctccctcttcctgtggatgctaagaaccaaaaaat

SEQ ID NO: 7171 - DNA, 201 bp, Bos taurus
acaatatttcttaggtgactgtgccagcaaaggaggttgtctaaaattttggtgcctgacttgtctgccctggaattgattcttccattcttcttaaactcctgagaagtgaccaagaatagagtgtggctttcactggtctccaatgcccttcaccttccaacagacaaaatagcctttaatccagggaaaatcaaagta

SEQ ID NO: 7172 - DNA, 201 bp, Bos taurus
aaaggagaacaaaggcctatgaaatcactccagaattaactggcctctgttgccataaaacagcagttcatttcatcatgaatcaaaaatgagaacaatatacaaataggttaacattctgaagtgtatggatgagaatagccatgtcattgtagattaggaaatgtaaaatttcaaggaatgtgatctttctgaacattt

SEQ ID NO: 7173 - DNA, 201 bp, Bos taurus
gaatctcagtgcactttgctagttgatgatgggaaggtaactaacttctgatgccagagtattcatgcaagttctcgcccatttctccaactggctctcactgccactttgcatttatcccagaatgcccaactcttcctcactgtattcctgtggaaacctttgtgagcccagttcaattgtccatgactgccatgtaaa

SEQ ID NO: 7174 - DNA, 201 bp, Bos taurus
gaaatgatattttatttggggaactgcgacaaggcctttccagaaaggtgatatttgggcattaagagaggagggggtgtttctgacctgaaagaagagtggttaaacctcaagactgaaggaaagtaagtgactccttctcatacttctgatacatccagagaattccaggattctttacacactgtcccaaatagaaat

SEQ ID NO: 7175 - DNA, 201 bp, Bos taurus
aatacattacaatggactttcagtatgaggagaaatttcacaagcatcttcctgaaacagggaaggtttcagggaagaagtgaaacttgaaccggcccctctcacctgataggcacagatatttgctgcagccctggtagggaatgacttgtttttggggcttacgtaaagtgaattgcttcgtatctctgtaaagatgtt

SEQ ID NO: 7176 - DNA, 201 bp, Bos taurus
tgcttttctactcggttccatttttaaataattgataggtaaaaaaagaaaagaaaggaaaatgtaataggagactagtctatgccaagttgtatgccaggtgcttttatttacatttcatctcatactcataacaaccctatgaagtagtatgattatttccaatttacaaatgggtaaactgagatttccagtggctca

SEQ ID NO: 7177 - DNA, 201 bp, Bos taurus
aagcttctgatgctttctttctccatctttgtccccttcatcttcactggtgctcaaggggtagtcttttggcaaatcctctagttcattctgttggttcgaagccagaagattgttctccgcaacctggttcgcgctcatctcagcagcctgtctctcacatggaccaggagcagaagtttaaaggcaagacataatccg

SEQ ID NO: 7178 - DNA, 201 bp, Bos taurus
aagaagacagtttcatattgagattatagcagctctctcagacttgccctactcgtgggcccagccattatcagaacctgaagatggagacaggacttgacattcaaatggtgcatttgaagcacacagtgaagtatattgtataaatgcaaatgaacagaaatatggcattgtaagagctcagccgtttgtgcaattagg

SEQ ID NO: 7179 - DNA, 201 bp, Bos taurus
gtaaaacccaaaggccctgctccctcctctgctgtccactgccctcatttctgtgactctctgcagcacccattcagctccaggaacaccagccttcttgctgttcctggaacaagacaaacacacctgctccaggggcactgggcttgctgttccctctgcagggctcaccccctcagggaggtcattcctgcccacctt

SEQ ID NO: 7180 - DNA, 201 bp, Bos taurus
gtagacttacacaaagagcttccacacagggcctaacgtagagatcttcagtcactcagcacacctcctctggctctgccatacttaaaatatccaacactgagcccacaggccattgcacactcctcagccttcagagcagaaagttctaatatgatgaggaagatgtagtcccaggataacaatgtataaatgcactaa

SEQ ID NO: 7181 - DNA, 201 bp, Bos taurus
ggggagcaagggaaaaatagaatcaactaaaaatatgccttcagtgattgtgctgctcattagaccagcactgaaccagcactggtatggactgaataactgagactctttataagtaactgaagagctataaaaagcatagcatttaagaaaacaacaaacagctgtgtcgaatgagcaagaaaactctaaagaaagagc

SEQ ID NO: 7182 - DNA, 201 bp, Bos taurus
gggtccacctgagccatgctggctgtctgcactggagatctacagacagagcatgatctgccgagtgaagacttctagtctttggaatcagatttctcctcgggacaccctgagtctccccagaaattccaagtgaattttgaaaaatgaaaggaccatatgcttgcacactctgatctggcatcctgggagtttctattt

SEQ ID NO: 7183 - DNA, 201 bp, Bos taurus
ctgacaggcgggtaattcgagccagagaaagggcagcgctccaggtcctttccacaaagcaattcttctcctccctcctgggagggctccagacttggcctgcttcaggcagatggatttgttgagtcatgtgagatcatttacacaaaaacacagtgaggcaatggaaattgaaaaaaaaaaaaaaaagggtgggggtag

SEQ ID NO: 7184 - DNA, 201 bp, Bos taurus
gccacagagaaactaggactcaatttttaggggtcacggagaagtcagcagtgaacatggaatatgcgccgtcttctgttgtctagacagatgctatgctcgctacaggttttatgtgtgatctttaataccaaggagagactcaccaagagtctttcaagggagctcctagaccagctctttagataccaatatggaacc

SEQ ID NO: 7185 - DNA, 201 bp, Bos taurus
ttcctcctaataacggccttaaatttcagttccctagccactaactagtacacacgcagatggagtgtttgagtaaataaagaacatggaacgttttagttctccatgtcaggccctcaatttagctatctaaaggcattagagacattaagtgacaggcactgcagttttccattagaaaatgccaaaattgaattgctt

SEQ ID NO: 7186 - DNA, 201 bp, Bos taurus
ccctccatgctcctgactaagagactagagtccttaacttggaccaaaccacacttgcattcacagtctcattggtgaaatgaaaattaacccccaaagcggtaaagggaatagatttcttctagttccttcttattaaaagtttaaggccttttttcatatttcaatttactgtgatcattgaaacttacagatgctctt

SEQ ID NO: 7187 - DNA, 201 bp, Bos taurus
gacatcaggcaagtgagatgtgtattgagaggcatggcaaggtgaggtagccagagtaccggctgatcaccagcctgtgacaagcgtgccaggaggccaaggtcacagggaaacccaggagcgttgatgtttgggagtgggaattcttttttctttgaatttgctgctagaagttatatttctcatacaatgcttaaatga

SEQ ID NO: 7188 - DNA, 201 bp, Bos taurus
tcaatctccaagtctccctaaccatctggggagtgcagtggcctgtcaactctgaaagaggcttgggggaaagtgaccattagtaggaaagctctgtgactgaaggcattatttataattcctagaaacataacaaagaagaaaggggaagatgaaaatagaaagagggcctgtcaccctcatcgtcttttctccaagttc

SEQ ID NO: 7189 - DNA, 201 bp, Bos taurus
tcataaacacagaatacaactgatgggccaagcgagagcgagggcataattcgtaagccataggaattatgaattagttttctgaaaaatgggtgctctggccttttaagagccttctctcgttgaccagatatctcgctgagttgaggatccttatcacgcattttttcacctgtcgttttaactttctattttatgctt

SEQ ID NO: 7190 - DNA, 201 bp, Bos taurus
aaggtgagtgtagaaagccttgtaacatcccttggctcaccaggcctaagcagcaggagggtactgtactatttaggtggagagggccagctggcttatcatcaaagctcctaccttctgcagtcactgcctacagtggatattagcctccagcaacagggttacacagactccttgcttgcagcccttggtcctgtcctg

SEQ ID NO: 7191 - DNA, 201 bp, Bos taurus
gaatggagacaccacccaggttcagacgatgctcatggccctagaaggtatgaccaaaacaaacggattccatacaaccatttacattggagctaagtacgcagaaaaacaagatgttctgatgaaggaaaattaaaagctggccaaagtgtaaccggtttgtagatgggagccaacaaatgggccaggcgagtagggaag

SEQ ID NO: 7192 - DNA, 201 bp, Bos taurus
cacgataacccccttcccaacagaggggacagtgcccagaagcagggcggtgggctgaaacagccacccaggccctggaggccaggcctgtggccacaatgaacggtcttcttccctttgaggacaggagggcatgaaagacaatccaaagccaaccacagcacccaggccagatctgtacctgcatttgaacagtcttgg

SEQ ID NO: 7193 - DNA, 201 bp, Bos taurus
aactcatcttggcggtcaatacattgagtgcctgtgtacttttctgtgttttaaaatatctctacaaataattaaaaggttcaaataacaaaagagcaaacggaagagtctgttgtaggaattgcccaaagactacctttttttgtttgattccacagaccttattctatctctaaatcaaaatgctgcatatgaaatagg

SEQ ID NO: 7194 - DNA, 201 bp, Bos taurus
catggtacattttaagggaggatagaccagaatagctgtcactagaggcaagctagcaccatctgttggagaattagttcacagcataagatgagaccagctgacttcattactgtggaatttatttctccaaagtacttttcatcttccaaatttcaacacattcatgcatatccaagtacaatttaattttcatttacg

SEQ ID NO: 7195 - DNA, 201 bp, Bos taurus
ctttgtagatagatttgaactctaatgtatttttcttttccttttattttcagggtgctatttttttggagggtgtaactgttaaaggtgtaactcaagtgacaactcagccaaagttaggagaggtacagcagaagtgtcatcaattctgtggctgggaagggtaataagcattttaaattttaattaaagttttaaata

SEQ ID NO: 7196 - DNA, 201 bp, Bos taurus
tttttcactttggggaataagataaactaaaacaataaaaaagactaaggctcctattttatacaatttcacttacaacctgaaaacaatcattcttaatgttttttctttgccaactttaaaggaagcagaatggaatccaagactaaaaaagtacaggataatgggaaaaaacagtgaagcaaatactctgctgggaat

SEQ ID NO: 7197 - DNA, 201 bp, Bos taurus
tactcatgtttaagaaatgcccttttggcctaagctgagtatgattttagctacttatgatctaaagagtccaaaccaatatctgtgcctttaagaaaaggcagaaattaaacagatggagaagagtggggaggaaattctaggcagagcaggagttaagccaaggtttggaggccaaaatgccatgctctgttctgacag

SEQ ID NO: 7198 - DNA, 201 bp, Bos taurus
caaaaggccaataataaatgaattccaggaaggcatgggcatatgtgataaagcagaaaaaaaaatcaggagtgccaatttcaacatggactcccttgatatgtatacttaggccactgagctacattttttcatatgtattgtatacacacaatcacctgttcctgcatacatctccagtctcatctcccactgctcatt

SEQ ID NO: 7199 - DNA, 201 bp, Bos taurus
tgcaactcttctgacaccactcctacaaagtataggtctttttcaaggtaaagcaccacgtttatcttagttatgtacgtcttaaccactagatataaaattgtactgcagttcttacaagactccatgggtgacactgatgaagttttgagtgttgtacctttaaccccatttcccccataagccttgtgatttttgttg

SEQ ID NO: 7200 - DNA, 201 bp, Bos taurus
ttaacgtagactcctaagaggcacaagtccacacagtgtacacgtgcaaaatgtagctgcagaagaggcctctgtgcaactagaaaagctgattaaaaaacaaaccctctgtgcaaggactttgattctgtcattattgtaagctgcccgtcatgccctcagtcaaaggagattgaacattattgatctctggaaacttgt

SEQ ID NO: 7201 - DNA, 201 bp, Bos taurus
tggaattatggtcaattcaaaagctaaggatcttaaaacttctgaacaatgcatgtcagaaaacctactggttcccactgaccccttggaggcataatctctaaaagcatcaggaggtgcttcagcttaagagactggcatgggtgattcaaggtctggggaggagggagcaacctaccctaaaaggcaggtttcgtagcc

SEQ ID NO: 7202 - DNA, 201 bp, Bos taurus
tgcaacaatcctattgttaaaaacaataatccaataagccaagaaatataaactctagcacttaattcttttcctgaactatctgtaaggcctagaagagtaggcattcaataaattttatttgatggattaaaacaaaacaaaacaccaccctttcatcctttctagttccactcttactgctagaacatatcccaactt

SEQ ID NO: 7203 - DNA, 201 bp, Bos taurus
caatgtgaagaagcaggacatccacaacagaataaaatcattagttaaatgtgtgtgggggggaagttacctcttaacagataattctgtctttattgagaaaaaataagacaactgactcagtgtctgagagtcaaatgatacctcctgggaatgttttctgtagttgaaaatgactgacagcatcataacctgtgacag

SEQ ID NO: 7204 - DNA, 201 bp, Bos taurus
acatactatggaccaagagcctcaccagcatcactgagaggaagtccatctgttcagttacatattaccaaagccattcaggaagcaaactatatactttgatctaattcttagcaagttcacatgaagaatattaatttaaaacagcattttgaattttctctgttaaagaatgaaatgaacataaagtctcctcctatg

SEQ ID NO: 7205 - DNA, 201 bp, Bos taurus
cagtggccataatgtttctaagacaaaggcggtatttccatgccacagagtccagttgctatctataataccctatgagtcaatggtaattgccatgttttgagtgaatgggccaagggcattccttttattttcatatgtaaaagggggatctgatttgcattgcccaagttcaggtaggttcatcaaactttcctttaa

SEQ ID NO: 7206 - DNA, 201 bp, Bos taurus
actttgtgaaactcagagacagtacaataaacatggtaatagaagggacaccaggatgtgaaaggccctaggagaacctgtcctaatcttggttgccagggaaggttccccagaggatgtgttgtttagggggattgtaggatgctcagaatttaaggtacagatgggctgaagaaggaagcaggtatttcatgagtagga

SEQ ID NO: 7207 - DNA, 201 bp, Bos taurus
tgaacactgaacctcaggagactgtgtctggggtttgcacgtgcatggaacatcactggtccctgacttaaattctctgaatatctcacacgcttcagagcgggacaaactgaacatcaggattttgtgatttaacattagggatttaggcctaattctcatttatcaactgctgaaatccagtctaacctagattttcaa

SEQ ID NO: 7208 - DNA, 201 bp, Bos taurus
cttctgatagcagatgacctccatgtatagctttgtgttagtgttagcccatttattatgtccatttggaaatgagactttagcactgcagtcagcaccccgatctcccttactctgctttatttggaacttaagtatggtttataaaatttgagcactggcaccgctgtaccttaagtatctagacacctggcacttggt

SEQ ID NO: 7209 - DNA, 201 bp, Bos taurus
tgatttcatgcctgcctttgattaactgcgaattaacaggtctccatcttctcagtaattcaaaggttacctgaatgggaaaacagtaatgaggtccatatataattaacttaaaatatttattgcaacaagtattaccaaagtgtacgaggtaaaaaagtgtatgatggtctccctccaccctatccttttttctaattg

SEQ ID NO: 7210 - DNA, 201 bp, Bos taurus
atgacatcagctgtagtaacaaatgtggggatggagacatgaaagctgaggcagtcagaaatgttccaaataagaaaagaggcttaaatccaggtagaaggaaaacaacggaaagacgaattaagagcagcacaggatgcatgatgcagaagaaaagaatttcagttttaatccgcagaaatcgattgtaacaacatcaaa

SEQ ID NO: 7211 - DNA, 201 bp, Bos taurus
tcctgcattgcaggtggattctttacctgatgagccattggggaagacctaatttgttgcaaaataagtctggtctcaaaaaaccatggcctgataatttatgtaactataatttatcatataggctttttgctttgcagaaacttctggaaggagttgcagactgaacttaaaaaaacaaacaaacaacacctttgaggg

SEQ ID NO: 7212 - DNA, 201 bp, Bos taurus
tctattccccttcctacccttttcctccttagcaaccacaagtctgttctctatgtctgtgagtctgtttctgtttcttggatgagttaatttttgttgtgttttagatcccacatataagtgatattgtatgatatttgtctttctcttcctgacttacttcacttagaatgatcacctccaggttcatccatgttgctg

SEQ ID NO: 7213 - DNA, 201 bp, Bos taurus
atccctgaggatttatgctttctcatcatttctgacatctgaggaattcccttactctctagccaacttatccatgcattaaaatcatgattctatgttttaaatagcagctttatttgtgcagtacttggaggggtttctacattgcttgaaagataagtctataatgtaatttgggaaccaaaaaaagttggagtaatc

SEQ ID NO: 7214 - DNA, 201 bp, Bos taurus
tagcaaaggccctaagatactagttttcattagttcaggtgtttgcctcctccagctgtttatttttgaagataaagacaatctgctgtatattttcttggctgcttcaaggtcactggctttcaagggttcagggcccccccttttttcggtatctgtccaatattaagtcctctgaggtggcctggtccctctccaacc

SEQ ID NO: 7215 - DNA, 201 bp, Bos taurus
gggtaccatgcaggtctgatatctatgaaaggagacaggggaggcataatgctatccctgttatatgaatgaaaaaactctttccatcctttttgtggccggagataagggaagaattcccctaaattgcgtcagagtcttattgatgccatggcagctgagggtgaagctaccaatggccccttaccactgccactaagt

SEQ ID NO: 7216 - DNA, 201 bp, Bos taurus
taactggcctgaaggtgaacagcaaccaaccttcatatgtgggtacatgaggactttctgcagcaacaaggagaggtgcacaggaagtaacattccacacttttgggcctgccagtcaaaggacggaccttgagaaggaatagctaaagtgcattagctcattcttactctgtgtgtgggtgaagccaggcaagaaaaacg

SEQ ID NO: 7217 - DNA, 201 bp, Bos taurus
taccgctgaaccacctgggaagcccttttctaattagaggagacttgaatgttcattcttttatcctacgattatggcaggtgctgtgcttggccctggggatgcagcaatgagcaggtttaataacctgagggaaggaggggtgggagactgaagagggagtgagatagagatgcagtaggattacctggtaagaacctg

SEQ ID NO: 7218 - DNA, 201 bp, Bos taurus
tagacaatgaacttgccaagtgtaccaccttgaatacagggatttcttcagtagttatcagctgagttgagtgtgcacttactgagtacctgccatgtgcctggtgccatgaagtaaacaagtagtaaaatcagtcttgatatccccaaagagctttcagcctaataaagagaaaaggcaggtaatacagatcagtgtcac

SEQ ID NO: 7219 - DNA, 201 bp, Bos taurus
tcaattaagttcatcattttttaaaatgttatatcattgtatttaagattttaatatgaattttctttaaccaccaagtttttgagtgagtgagtgaagtcgctcagtttccgactcttcgcgaccccatggactgtagcctatcaggctcctccgtccatgggattctccatgcaagagtactggagtaggttgccattt

SEQ ID NO: 7220 - DNA, 201 bp, Bos taurus
cctgttttattaagtgtggcataaaatgataggattttatgctaataaacttaaaacaaccatctttgccatcagcatataagctttgtaatgggccacaacaaaaatggcatcagaagtttacacagagatacaaggagatacttacacaataattttaattatataccaaatttttaacaatgaatactgatggccaat

SEQ ID NO: 7221 - DNA, 201 bp, Bos taurus
tagatcttggtgcaattatggcaggcggcttctttttctttttaataatgagaaacataatggaaacaaaagtttccagtggcctacagaggcttcccaaaacttccactgtgaaaactgaatgcctcaagccacacatgagccaatggctcaggggcccactgtgtgtggttttcctctagaactgagctgcttcacagg

SEQ ID NO: 7222 - DNA, 201 bp, Bos taurus
gattctccaatgtgtatctctagccaaataattctcctgcactccaaatatctacttaagctctccacttggatgtctaaaagatgtctcaaaattaacacgtttaaactgaaattctgatcttcccaacccaaacctaatctatctgttgctcattcttctgagaaaactcctctcatgctttaggcagggtgaggagaa

SEQ ID NO: 7223 - DNA, 201 bp, Bos taurus
taaagacctggttttcatcttatggctgaaagtgattttgatctctatccacatctccttttatagataactgaggcctggaagagcttaatgaattctctaagcacacacgattaactgggttataagaattaaagagttagaattaagaactgggcctcccgaccttaaaaagtttttctacatcaagcaaaaataact

SEQ ID NO: 7224 - DNA, 201 bp, Bos taurus
aggggatcactgcagttactcaaggaaagggtgacgatggtattaactatggggatggctgaggaaatggaaaaaatggcccttatctttgccaccttcaatgtccctagcacagcaagtggcatgaagtgtgccttccatacacagattttcaggtaagaaaaatagaaatgagagttagggaggccagccagtcatagg

SEQ ID NO: 7225 - DNA, 201 bp, Bos taurus
atggcttttactctggtcagtgaccattgatgttcatgtgtacgagctcttcaatggtacataaccactactgtggtgggcctacttcacctactaagagcgttttggcactctgggactgtgattatgtgtttgttacataacctgtcaatatcagtcttttagaacaaagagaacaggcccctttcctagctccaaggt

SEQ ID NO: 7226 - DNA, 201 bp, Bos taurus
atctctattttacacacttatcaatgttaacacatttccctgcaacaatagcatttgattacagttcttctacatatgacctatagaagaatgtgatatatggtgtgtgtatgacttcactgttttaaaattctgaaacttcttaactttgatacatagcttgctccatgaatttcaggaaagacattgtagatgtgaatt

SEQ ID NO: 7227 - DNA, 201 bp, Bos taurus
tcagattggcaatatattttcacatggaacaggaaagaaatcctttgtgttacttattcacttctccttatgtttgagaatttttttgaagtttaaaattaactataaaaaatgaacaataattgcaataacattgaagttctcaattgatgctagagatagaagggtagtggcttcaaaattatgagggaaattgttttt

SEQ ID NO: 7228 - DNA, 201 bp, Bos taurus
tggcatgtggaaactttgttgtgtcgtgtggaatcttttgttgaggcaacagggactctctggttgtgctgcttagacttagttgctcagggacatgtggttcctcaacccgtatcccctgcattgcaaggtggatttcaaaccactggaccaccagggaagtccctatagtactggttttgattgttgttttttcgcaat

SEQ ID NO: 7229 - DNA, 201 bp, Bos taurus
tgcacaaatacagttaaattcctaggatatacagggtactgaatccatctagtgcttaggataaagaaaaattaggcctaagcttaaggcatttatgctcttgatgcgtagaaaaaattttccaacataaatttacctaataaagcaaggccagaatggtaagtgtacataggatgtgcacgtactggtggaaaataaagt

SEQ ID NO: 7230 - DNA, 201 bp, Bos taurus
cttgtttcatttcagcagcaactctgcaggatacatatagtttccacattttctgcagaagactggggaaggttaagaaaacgtctgagacaacagggctgtagcagaaccaggacctaaatttagttctttgtgtgtgtagatcccattccttctactattctattctggttaaatggatctttttaaaattttggtctc

SEQ ID NO: 7231 - DNA, 201 bp, Bos taurus
ttggtggccactctgtagttggtaatcattaaaaggtgtatgtgacagataaaaaataaaaagaactgaccctactttccttggtaactccatcacttgcgccagtttcaagattccactaaggcctcctgtgaggtgggaggaagatgttgagaatatccatgaagtttacttcctggaaaccatgactggagggagcaa

SEQ ID NO: 7232 - DNA, 201 bp, Bos taurus
cccatgaaagactgtccccatctctgcttttttttaggggcagtgggcaacataaaataggcctgccagatggctacaactcattactgcctggcagcaggctggggaaaatgagagtaaattaatcagcattcaggaggaatgaatggcaaaggggcgatgtgtattgatgctattttaacgcaagtcaaattaaacctg

SEQ ID NO: 7233 - DNA, 201 bp, Bos taurus
ttgccattgccttctccagagtcaagactgcctgggatcaaatcctaaatccatcagtttctatgatcttgggcaaactgcctcattttgattctctacaccttcttttgttcatctgtgaattaagagtaagtgactacaacataagaattaaacaagacccacaaaggtcttttcacagtgtatggcaccaaagtgatc

SEQ ID NO: 7234 - DNA, 201 bp, Bos taurus
tttatatataatcaccactgtttgtaccctgcatttcattaccaggatgtataaatacaaataatgaaggcctgtggataaataaaacttacagtctatattcacctaccaactgactgtgagatgaatattagatgttgggaggtactgcaaaggtcacactgtgaccaagcattctgggcatcctcaaaaccatcacag

SEQ ID NO: 7235 - DNA, 201 bp, Bos taurus
gattgctaaaagtttagcctgcctggattataatagctcttgcaaatcttttttttttaatgagaaaagagtgcttggttagcatgataaaagattccaagtgcatttatctcataaaaggaaaaatgaaagttttttaggatgttcatttgaacattactctttctcttattatgactatcatgtcccccaaaagatgga

SEQ ID NO: 7236 - DNA, 201 bp, Bos taurus
gctagggccagggtgatcacagggaaagaacaagtggtgtcagaaagtaagaaagtgctcagtaaacatggggtcattaaaacaagatgcacaagtcaaactgaaacactggccaaatctgggataatctgagaacaaaataataaatggtaatgttttaggtcaggcagctgtaacaaaatacgatagactaagtggctt

SEQ ID NO: 7237 - DNA, 201 bp, Bos taurus
cttccgactctcttcaatgcctcagttttctcaccagccaaccattttttattctctaggtttggtttttttttttttttttttgctgcactgaagttgcttcctcaaaagtcaatccttctcccctgtccttctccctgctaagtttccataacaacagtacacagatactgtggagtaatttctcactttgaattctct

SEQ ID NO: 7238 - DNA, 201 bp, Bos taurus
taacacgggtgataagagacctagctgtaggccagtccactcttgttccatgaccaggagtcaatagaaacagaacaccataccttaatgttctcctccaggtcagcttcgcaaggcctgaccatgcagaggcggctctgcttctccagcctgcagaatgcgttgtcattggtaacccgggtggagatgcccattccgcag

SEQ ID NO: 7239 - DNA, 201 bp, Bos taurus
cctgtgtgggagggagacactttgctactgtgtcaaccgggtcagtcacttcagctttgttgcagaattttatgggacggtacattttactgaaaacttcggattaaaaaaatgctcttttatgtgacattaggggaaggcaatctatgactctcagtggaaatatttcagaagaaataagaaacctgtgaaaatatttgt

SEQ ID NO: 7240 - DNA, 201 bp, Bos taurus
agagttatttcaggcaaagtgtgaagatgtcactgttcagaaaacattgactaagacattcactttatagcaaaggaggtgcaaccatgggcccacagtcatgaaatcatctggtcttgtcatgtaccacagcattcaaaacaactggcattgaagagcaatagaatagcttacagatagcatagaaaaggcccaagttca

SEQ ID NO: 7241 - DNA, 201 bp, Bos taurus
actccagtattgctgcctggaaaatctcagggacagaggagcctagcaggctacagtccatgggatcgcaagagtcggacatgacttggagactaacccatacaacattcaaacttcaactcgaacattaggtaactgagttccaaaggtgttcttctgtctctcctccactgggaaatttacaatggccccctctctcta

SEQ ID NO: 7242 - DNA, 201 bp, Bos taurus
catctattttatgtctttacaggcttgccagttctgtacatttcatattaaaggaaacatacaatgtgttctttttgtgactgatttctttttctcagcaggttttcaaggccaattcatgttgcagcatgtatcgattcttccctcctgttcactgctgctgctgccgctaagttgcttcaattgtgtcagattctgtgc

SEQ ID NO: 7243 - DNA, 201 bp, Bos taurus
ctgctaccagaacatcaatgggtcctgtgttaagacctcttacacaccaggtcctcgggcaattctatatgcagtcctcggtttgggggctgtgctggccgtgtttggaaacttactggtcattattgttattcttcacttcaaacagctgcacactcccactaactttctgatcgcatctctggcctgtgcagacttctt

SEQ ID NO: 7244 - DNA, 201 bp, Bos taurus
aatagcatgtacagtcattgatggtatttcctcataggttgcaaggatgacacatcaaaaataaggaagcaaaacagaaaaaccaggcccttcttttaaaattgttttctcttgatactatatactgaaaaaaaaaaaaaaaaaaaaaaaccacaatatagttgaggcctttaagcccttgcatttttatcagtataattt

SEQ ID NO: 7245 - DNA, 201 bp, Bos taurus
aggctatttctgtatcttggctattgtgaataaccctttgctgaacatgggaatgcagatatctcttcttgatcctgatttcagttcttgttgatacatactcagaagtgcaattgctggatcatatgatagttctcttttcaattttttgataaataacctgattttttaaatggaaaaaatattgaatagacgtttctc

SEQ ID NO: 7246 - DNA, 201 bp, Bos taurus
gaaattacttttacatcagttatgagaacagcagggggtggaggtaggggagacactaaaaagggctctgaaaaatgaatggtctaacacatcattttttaaaattgcatttagtattttacaaatgacaagtacattctccaaattttgaggacccactgcttttctagaggaaatctactaccacctattattattgct

SEQ ID NO: 7247 - DNA, 201 bp, Bos taurus
tcctctcaacagaaaccagtaacagcaaagtgaagtggaaaagggtagggaattaaaagaatgtattcaataaacattttatctcataaatatttattgaactggaaagacagaatttactgagctgttaaaaaagatatagctcctgtaatcaaagaactcacaatttggaggaagagagaaaaagaaagggaagcatga

SEQ ID NO: 7248 - DNA, 201 bp, Bos taurus
cctaacagagctgagaatccttgaaacccaggccaatactttggtttcaaaatagagaataagtttctgttgttttaaaccaccaagtttgtggtactttgttatagcaggcctagaaaatgaattggagaaggcaatggcaccccactccagtattcttgcctggaaaatcccatggatggaggagcctggtgggctgca

SEQ ID NO: 7249 - DNA, 201 bp, Bos taurus
ttgagctgtctgaggaagcctgagaaggccaagcctgactcaattcaagaaggactggtttaggctcattctgagggcccaaggctcacagtaggagcactataaatatgccccaacctcaaaaacatgacctgcataaccagagcagtgatggacctgaggtttgctaatgtgatcctgaccccagagctggctcagggc

SEQ ID NO: 7250 - DNA, 201 bp, Bos taurus
tcacggcgggggtgtgggggcggggggagtgcgggggagaaacgcccggttttctttttaccctagttcttgtatttccgggccaggagctgatggtttgtaaggcattgctgctgctgctgctaagtcacttcagtcgtgtccgactctgtgagaccccatagagagcagcccaccaggcccctcggtccctgggattct

SEQ ID NO: 7251 - DNA, 201 bp, Bos taurus
ttactgctcgtggacattctctagttgctgcgagcggggtctactctttgttgctgtgccaggcttttcattgaggtgacttctcttgttctggagcacaggctctaggctcatgggcctcattacttgtgacgggtgggctctagaattcaggctcagtagttgtggcttatgggcttagctgcttcaccgcaggtggga

SEQ ID NO: 7252 - DNA, 201 bp, Bos taurus
actgagctatgagggaaaccttgctttccttttattatgtcttgtgtggatcaacatcttttttcaacatactgtattcttttgaatacaaaagcttacaatattccaatctgttaggtatgtctttaatgtgatccttttgaactgtagtttctcatcaacctctttcttatcaatcctacctgccttctgtttttcaga

SEQ ID NO: 7253 - DNA, 201 bp, Bos taurus
tgcctggagaatccatggacggtccatggagtcacaaagagtcggacacaactgagggactttaacacaggctcctctgtccaggggattctgggcaaaaatagtggagagtgttgtcatggcctctttcacaggatctttccaacccagggatcaaacccacatctcttcagtctcctgcattggcaggcaggttcttta

SEQ ID NO: 7254 - DNA, 201 bp, Bos taurus
tgtgacctggaaacagtgagggccaccttgaagggctggaggggtggaggaggagcctggctttccacagagcagtggatcaggctcccctaataagaaagtgtgaagctttgctctcaagcaggccaagttcaagggctggttcatggtttggaagtcacttcgtttctacaatctcggcttcttcacgtgtgatatggg

SEQ ID NO: 7255 - DNA, 201 bp, Bos taurus
gaaaagcagagtgaaattaggtagtgagtctaattgaaatcaggtcacaaatctcaaacaaataaaaggcctattccttttagagatttctgatttgtaggaagaacactgacttttactgcaatagtaagctagtttttttccttcactaggtaaaatgaaggaaagcagacagaccaggggtagggtggagaaggacgg

SEQ ID NO: 7256 - DNA, 201 bp, Bos taurus
ataaccattcatgctggcggagtgttgatagatgcaagctgcatagggagagaatgctagcttttttgtttataaagcttgcaatgaagagaacgggttggttttctggaacatctgcagggctaataaatttcgtgtttatacaaatgaaagacagttttacactgggagttaattttggtgaaaattgaccatacctct

SEQ ID NO: 7257 - DNA, 201 bp, Bos taurus
tcaccaccccctcaacaacaattcatataaacacaatgtaaataaaaggatcactctatcacaattgaatgaagaaataaactcatttctactactgctacgattacttgttttatgctaaatttttacttagaattcttaatgctagactatcgtgcccttgtatgtgatacagagcggatgtctgtttttgcatcccac

SEQ ID NO: 7258 - DNA, 201 bp, Bos taurus
gccttttcctgtagcccaggcagcatgaattcccatcacccctactcccctactccttttcattgtcaccagcagcctgcatgtagccgaatccagaggttactgcctaagcctcgttttactttgcttactggcagtcttcaacagaattgacacccccacgctcttgaaccacctgcctctcctcactctagggtacca

SEQ ID NO: 7259 - DNA, 201 bp, Bos taurus
gtctttctccagtgaaggtgctagaaaaccctttgtctcctgttttggtgtagatcttggggacctagggagtcttcgaggaaggctgaggcctgtccccatcttccacaccctgggggctgcgactctggaaatggggacacaatagctcgcgggctccaagacacccgcgcaagcaaaggcgacctcccgggccccaca

SEQ ID NO: 7260 - DNA, 201 bp, Bos taurus
gtcacaaagagtcggaccaactgagtgactgaaatgaaggaaagagctgacttattggaagagaccctgatgcttgtaagaattgaggtcaagaggagaacgggcccacagaagaggagatggttggatggtatcaccgactcaatggactgaatttgagtaaacttcaggagatagtgaaggtcagggaagcctggtgtg

SEQ ID NO: 7261 - DNA, 201 bp, Bos taurus
ttggatatccctgttttctacttcaggtcctaatgatcctccaatcttcttgttcagtggccctctaactctagagtatattgtaattactcattgaactatattctgtgggccttacctccagagttttggattctataagtctgagacgaggcctgagaatttacagttctaacaggtttcaagtgatgttgctgctgc

SEQ ID NO: 7262 - DNA, 201 bp, Bos taurus
gaaatacaaacatagtgaaatgatagtttcagtccacaggcagttttcgtaatttgtggccaagaaggagctccctgtgcttgaccaggcctctcttcctgcgtgcactatgctctgcccatttcttaagtctatgagacatcaaagtgccttcctgcagggcagggccttattttcagtggacatagcatgaggcagtag

SEQ ID NO: 7263 - DNA, 201 bp, Bos taurus
tacaaacttccagttatgagattaataagtcacagtgttctatcgtttagcatagtgagtatggttaataaagctactatatatacttgaaatttcctaaaacaggagatcttgtattcttaccacaaaacaaaaatggtaactttgtcaggtgatggatgtgctaattaatgtcactgtagtaaccatttcacacagact

SEQ ID NO: 7264 - DNA, 201 bp, Bos taurus
atttctgcactgaaggattcccagaaaacagatgcattatataagatggtagagcttgaggatgcattaattcaataaagcacagctggaacatgaaacaaagccttttcccattcatctgattagcttttggtccttataggaagtgacataccaaggtttatgaatccccctgatacatacttcagcactgggctcttt

SEQ ID NO: 7265 - DNA, 201 bp, Bos taurus
cacgaggccaaggttctcctccgtcacccactgggctccccacccaagataacctggagcaggcaaaagcccggagcgcacccgactataggatggccccaaaaaaagtctctcttgcgaatactcgggtcttctcagccagcgccaggaggcacgcgccacgttccccgtaaccacggcgccctcctccggccggtgccg

SEQ ID NO: 7266 - DNA, 201 bp, Bos taurus
aaaaaatatccagtgactagtaagtcttgattactaatccagagtcttttctcttgctttccagtggcaaccactattatcagtttcctggtgtttctttccaaagatattctatgaattgaataacaggacatgtatacacatatacacattttgaaaacacaaacggtggcatattaaacactgtttttcactttgctt

SEQ ID NO: 7267 - DNA, 201 bp, Bos taurus
gcccagcaggaaaatgggggagagctgaaagggtagaaaagggctaatccccctttgcctgtcactggcccctctgtgtcacatattgggcattgactcaccctagccagcacaagatttagaacctggtatttttgtcttatgtgtgttggatgagctgatttttattcacagtttcaatcaagaaaggaactgatatta

SEQ ID NO: 7268 - DNA, 201 bp, Bos taurus
tttacttaaggaaatttaagttctaggccactttttcctatcacttagtacaattgtgagctaatgttctgaatttcctgaaaagggaacataaactaacctcaatagaaaagtggtatgatgtaatgaaacaacatctaaacattaaacaatatatatgatgtgttagaaacctcaaaggtaaagaatccgcctgcaatg

SEQ ID NO: 7269 - DNA, 201 bp, Bos taurus
gaggtgggcaaagcagatttgccgactgaggccgtgtgctttcctggccttgagaagctgcagatgttagaacagggccacatagctgctatctgggtttagcacatgaaatccctgacctgaagcattctgggtagttaaataaacccagtatagttaggtaggcccagcagatttttctcccatcctcatctcctagtc

SEQ ID NO: 7270 - DNA, 201 bp, Bos taurus
taaaccagcaagagagtcctcatcagacaccaaatctgccagcaccttaagcttggacgtccctgtctccgggactatgagaaataaatttctgttgtttataagccaccattctttggcatttttgttatcacatccctagcaggctaagacagtacatttgatcaaaaatgaagacctgataacaatgtaaagctgcca

SEQ ID NO: 7271 - DNA, 201 bp, Bos taurus
aggcaaaaggaaaatccaacatattgcattaagtggatgacagaatttacatctgcttgggtaccatttagggagatttagtgtggccttaaaaagcaaatgactatttttaagcactttttaattggatatatgagcttattatatggtaagatgtatgaaactggataaagaactcatttataattatgcctcatccaa

SEQ ID NO: 7272 - DNA, 201 bp, Bos taurus
atcctatttcctgactgacatcctctcactgatccagagaatgtgaagaatggggtagagagtgaaagaggaggggccttcagggagagtaaaattgtccggggatagttcttgtcctgtctctaagaccctccctgctcaatgtgttttctgctgagagtgaattacaggaaatgaagcagatgatccaagtggcccttg

SEQ ID NO: 7273 - DNA, 201 bp, Bos taurus
tgtttatcatttctgaaaactgcatcactggcagcaccctgctcgcagagtttggtgtctcaaacacgcacatggtcactgcacacacatggaggcatctaattgctttgttacctcttctagtacagtttcacctgagcaatgactatgaaattactttccttttagttctccttacattatagccagggcagtatactg

SEQ ID NO: 7274 - DNA, 201 bp, Bos taurus
tcgcaaagagtaggacatgacagcgcgtgaacaacaacaaaggaagagagacaaaatgcatagggttgtgcatggtctccaccgactgactttgggaatcgtggaaagttaaactgaataaggaagtggggggtttcagatggtagtgaaccatgaggtttagtcaaagaacttcgaacgtggtatcaaagagccaaggta

SEQ ID NO: 7275 - DNA, 201 bp, Bos taurus
ttagcattgcctgtaagtggacgtgaatgccacagtgacaggaggtatgaggtaactgggtagtcaaaggtaccaatgaggtaacaatggtctcctgagaggaggccaaaaatttagggaaatttgaggaattcttgcaaagtcatgactacttcaaaagacagagtaatctcgccaggtcaatcctagaatccaggataa

SEQ ID NO: 7276 - DNA, 201 bp, Bos taurus
tttggatgacaagcagtatattaacatacttgtgggcaacttctcagatagttttcagcgatgcccatatcctggtattcatgtcttatatgatcttctcctcctgactgtaggctgagcttagtgagtttcttctaaggaacagagtgcagcaaaggtgatggatattacttctgagattaggttgcaagtgactggctt

SEQ ID NO: 7277 - DNA, 201 bp, Bos taurus
acaatttttacaatgacactgaagagtgaagaatgtggctccctggggagaactgtatattgttgggtgtggatctaagtatctctctgtggccatcaacatttgtgaagcatggttgatttgattctttggatttttatcaacatgctatgtctacatgattgtccactcagcaattcacatcaaatggtgaaggtggtt

SEQ ID NO: 7278 - DNA, 201 bp, Bos taurus
ttagactcattgaccttagaatcttcctcttaaaataaggtgcctgaatcaggtgagctctgaagctcttccagtttgaatagtctacgcctctctgactatccctctaactgggttgtaacctggatttctttgtaatttctgggtcaaaggaaagggcactaggcagacataagatctattctaattctgcctttaaaa

SEQ ID NO: 7279 - DNA, 201 bp, Bos taurus
tttcaatggaatgctttgagaattgattagatagtgtgcataaagcaagttgacctcctcaagtaggaatacaatgtatgattttattcctgttctccgaactcttaggccaggcctctccagtacaacgtggtcattatctgtgcttttggactgcctggagaggaaattcacaccattcagggcaaaacaatccactcc

SEQ ID NO: 7280 - DNA, 201 bp, Bos taurus
ctactcttgctgttccccacagttcagtcctaggccctcttctttgcctctttcagtatgtggagagagagcttcatttcacagattcaaaaactgtctgttcatgactccacaatccatttttacctatgcatgcctcttcatctgtattatgtaattgcacctccgtcagcttattgaatccttctccttaaactcttc

SEQ ID NO: 7281 - DNA, 201 bp, Bos taurus
ctccaacaccacagttcaaaagcatcaattcttcagcactcagctttcttcaccgtccaactctcacatccatacatgactactggacaattggactatccgtatttaagcttgtctcctttttgaggtagtcatttcttaagttggcaagtgtctttatgatagtctgtttttatgctactttagctaagctctttcctg

SEQ ID NO: 7282 - DNA, 201 bp, Bos taurus
cttggatgacacctaaaatgtcaaccaggcagagacgcaagaaaagtgagaacatttcaggcaaaaaaaaaaaaaagacactgtgagcagaggaggaaaagaaccaagtagtattaggaagactaaaagaatgtctgactgcagtgtaactatatatgggagacaaacggaaaataaggataaaaacattgctgccatgtc

SEQ ID NO: 7283 - DNA, 201 bp, Bos taurus
ttttataatataaatatgtcccaaatatttcatgagacatattgacacttctaatttaaagctgtatgttgtttatctgaagtccaaatataagtgtcttgtatttttatttgttaaatctggcaactctatgcaacaggccaggaggctcctgtttagtgaagggtaatttgagaaggaagcagctgtaaggcattagct

SEQ ID NO: 7284 - DNA, 201 bp, Bos taurus
ccgctgaggctcatggcctgctggacggctggcgtgggaacagcatcaggtatgcagtgggtgcagcctaaggctttgggaaccaatcatcaagaccccaacctcgaagccctgcccccggccagctatctgccccgtggccatgtaataaatgaggttactctcagacctcaaagctgtaagaaatttgagctttatagt

SEQ ID NO: 7285 - DNA, 201 bp, Bos taurus
aaaattcagggagagaagtctgctgttagctcagttgaccagaaatgggatcataacacatatatttaaatttagcctgaagaaagtacagaatttgaactaggagtatgaaaaggaaaagggcaaactaagacatttttggaaaatgcaaaggatccagatgtagaaaaaaataaggcatgtgcgaggtacaggagacag

SEQ ID NO: 7286 - DNA, 201 bp, Bos taurus
aaatttttagatgtcagtacttgacatctatagtacagaaattgcattttttacctgtttaaacttcagataaaaagtagtaaatgtcaacctaaaaatgtgtgaagggatacatttctgtaaccttagagcaaacaaaaattttctaaattcctagagcaaggaagaattttttgtgagaagaaaaactaaaggttattt

SEQ ID NO: 7287 - DNA, 201 bp, Bos taurus
accactatgcatctatatttctctgtgaaaactgtgaagccacctcccattcatgtctctctgagagcagagacatagttttaaagcattcttctggcctccctgtctctcatactgttaatggcgaatgaatgtttattgaatgaacatgtaaaggtctataataaaatcttcttgtcagctaacatcacagaccagagg

SEQ ID NO: 7288 - DNA, 201 bp, Bos taurus
ttaatctatagcaaattctaagtaacttttaggttttattacactctctagttctctactattttccttaactcatttctctcctggtgaggcctttttcatcttggacttgctctgtccagcctgcattttgttctggtctgccagtgcattcattctccaaatgggaacaggcccatctctttccatcccccaccccac

SEQ ID NO: 7289 - DNA, 201 bp, Bos taurus
cttctctgccgtcccacagaccgatgccctgtgtcccaaggttagtgcttaatcagatctagtgtcaaattgatgcctgctgctctgtttggggtgctgtagtctcaccaattacatgggcattttcctcaagtctgtgtacctgtagctagttcttggagtcttacctggtcttctgtctcctccctaaaacactaaaat

SEQ ID NO: 7290 - DNA, 201 bp, Bos taurus
aggaaaggcacagaaacagcctcccgtgtagacctccacagaggtctcttcaggataacagctgggtgggattggcagccgggcagcccagctctgtagacgaataaaggcctacagtacccagggttgtcaatctgggatcttttgcttagaaaaacagtatcttagaaaaaaactttacctcaggaaattaatcattac

SEQ ID NO: 7291 - DNA, 201 bp, Bos taurus
ctgtaagcacctgaaaaacctataaaaatggctccatttaaagtaaatattctgaaggccacaacacattgaagttcatcaggtctgctctgaattatatataatagcaggaaaagctgtatcaaaccatagagaacagagtgcaaaccttatttgaaacctcatcaaatctttatgtatatgcatgcatgctcagccatg

SEQ ID NO: 7292 - DNA, 201 bp, Bos taurus
atgtggcctagtttacagaactcagatggaaatgttcgctggtgccctctagttgatcaccgttaagcagctttgaagaaacacacacatcactctcttcgtagaaggatggcaaagttcctaattcgtaacagttgagtagttaactcctaacataagatgtgggataatgaaacattaaatctagagtctgttttattt

SEQ ID NO: 7293 - DNA, 201 bp, Bos taurus
tcactctgagaactttctctggaccagtgaaggcaaatttccttcatggtatcatttggatagtttcaaagtataaagcgtatgaacaatattagcagacaagatggttggatggcatgacaatggacctgagtttgagcaagctccaggagatggtgaaggacagggaagaacggcgtgctgcagtccaggggtcgcaga

SEQ ID NO: 7294 - DNA, 201 bp, Bos taurus
cggatttctggccggggttccccctgagcaggtgactccgtgggaggggtggaaattagtctctggaattccgggccaaatacattcactgtggttcagcttttaaggcaggtatttcaccgacaactgcggactgttttgcgtctcaagtttcagatttcgcggaaagggaccaaatgtcaaggcatatcaaatattccc

SEQ ID NO: 7295 - DNA, 201 bp, Bos taurus
tggcctgctgtccccccgagggtcttgttgattgtacatatattgttcttcctgcctgaaatagccagaattgatgtctgaagaacacatcatgggtcttcggaacatttaagagcaataggccagataaataatagcttggatcaaatgtattgaaaagctcttcaatatattgatgattttatctgggtactggttatt

SEQ ID NO: 7296 - DNA, 201 bp, Bos taurus
taatttttattacccatgcaataaagtaatttgtatcctaattagtcttcagaattaaaacaacggttgagaaagtaatgaacccaagactgttttggaaaatagcgctcagcagttgtgtcaggactaaaccaacgaagcagatattcttactaaacttttaaaaacaatggaaattaatgacatattcccagtgagcct

SEQ ID NO: 7297 - DNA, 201 bp, Bos taurus
gaccaaaggagaaagtggatagaagtaaaccatcctgactgcaggatcctgctgagcctgtgtcctgaccccacctcttagatcctcggaggtacaggatgtggtcttcctgagtgtggttcttacacattttcttcatttccgtgagccatgcttttttttttcctctcaacttgaccagagtaaatgtttttccctaca

SEQ ID NO: 7298 - DNA, 201 bp, Bos taurus
cagaaggaaatgcttcttcctttaatggacaagaagagagtaggggtgaggagtggggaaaggtttcacttgaatgtattttaataattgggcccttagcgaaaaatattcacctgccttgtaaccatcctccagtaggcaggggatagaaggtgctctttctggagtgtctgtctgttccaggcccggtgctggatacat

SEQ ID NO: 7299 - DNA, 201 bp, Bos taurus
tatgcttataagcgttctctgacttgtcttatacaaatcatatgtgttacgttatatagttgtacactggtaacgaatacctgtggatttttagtacattgctggccagtcttttacaactgttttaccaataattaaccaatacatttaaattgggcatggggaaagcaacacactttcatctagcttttccaaagtatt

SEQ ID NO: 7300 - DNA, 201 bp, Bos taurus
tactgtgcattcttcatgctgtaacagcactgaaaacaaactatgttttattgattgtttttcattcttagtgccaggtatggggcctggtatgtagtagatgcttactaaatatttataggcttaatacatgtattccctgaaagtcaggttattgttagtgtgtttttgttttctttctttcctttttttttttttaaa

SEQ ID NO: 7301 - DNA, 201 bp, Bos taurus
aaggaattgatgagatgagccatgtggggtttgaaaaatctcatccggtaaggccagaggccaccaggcagggattggcctcaggtgagaagcagcagggactagagcagagagagccaggggagggagtgtttaggagaggatcaggttggggggaaggccatcctgcgttgggcggcatcatagagaccatgccaagga

SEQ ID NO: 7302 - DNA, 201 bp, Bos taurus
agttcttactttcccctctcctgcaattccctgcctgactgagatcactgtgaattcctcgtagaagggcatactcggcctctctgatcttttaaagttggtctttgatggtaaatcactcaatgagcctgcctttaaaaagaaataataataatactgttttttattttttaatttttttggccatgccctgtaacatat

SEQ ID NO: 7303 - DNA, 201 bp, Bos taurus
tttccatgagatattggcatttcataaccacaaactgtatttttgcctcctggtcatctcatgaaatgtaaaactcatttaggtttagaaaatgcaagggagcttttaaaaggttgatttggtaattatcagtcagagtatacttgttaagtgtgggtaatgtggaaggaagtattggggaacccaggcatatttagcttt

SEQ ID NO: 7304 - DNA, 201 bp, Bos taurus
cctttagagagataatgatggctaaatgaggtcctgtagtgtgactctaagtcaacagatctgatactcttataggaagaggaagaaacactgaagatctcgcccacacccacagagaagaggccatgtgaagacagagagagaaggcaactgtctatgagccaagaaaaggggtctcgtcagacactgaccctgatgaca

SEQ ID NO: 7305 - DNA, 201 bp, Bos taurus
ttgtttgaggctgcagctggtgaatggacctctgaatgggggtgagggggatgaaaaagaattcacacagggatgtgttgctttctctcctgagttattagtaatagtttagcaaaatcatcatgtttcggagatttggtttcatttgcaaactttgtaatatccttacctacactcaccatgtttcctgtcttttttatg

SEQ ID NO: 7306 - DNA, 201 bp, Bos taurus
ttcttaattctttttaaattttgctgctctgtttgacttgagttcttgacttccatctcaatgatttgttcttctgccttatccggtctgctagtgaacctctttaatgtatttttcaattcagttataacttttgttttgaacttgcttatgtttttatctctttgttgaagttctcactgtgttcatccatcctgagtt

SEQ ID NO: 7307 - DNA, 201 bp, Bos taurus
gaggcccgagatctatctataggtcccaaatagggtgggaatatttatatctctgatttctgtgctaaaactcccattacttcagagtacatttagcccaattctctactcgggcctagaagaagcaaagcagtaaaaggacatcaaagtatgctatagactcaattttttatgtcccccaaacccataagttgaaatcta

SEQ ID NO: 7308 - DNA, 201 bp, Bos taurus
ggtgagagaaattctattcagaatgcttaagttataaacagaagagaaatttgtgaatttaaagaaagctgaatgaactgcattattaaatcaagtcattctttatactcattttataaaaatatttattataatgcatttctatttgtactgcttagttctctaacttgtcctgataatttcagtgatttactcttatct

SEQ ID NO: 7309 - DNA, 201 bp, Bos taurus
aatgaacagtgaagagtagacttaactttgctctgacaaaaacatgtaaaccactggcacttcattctgaagccatgtacttcagttactgtgattgaggggtttctgtcagtgtcatttggcaggatgttattaaggagaaatatccaacatggtgaagtgtatttgggaacaaaacaagtgagtagctaaattaaaagt

SEQ ID NO: 7310 - DNA, 201 bp, Bos taurus
agttacacactgagtttactattgacttattttcatgaatatgtgtatggtagccaactaattattttagggggctgcaaacattcacatggttccttaaatttcaatttatgtctattcaccagtacccataaagcaaacagtacagtgcatttcatattcctgaacggcttcctgacatgttttagctatattatgtaa

SEQ ID NO: 7311 - DNA, 201 bp, Bos taurus
ttgtagatgagcgtttgggttgtttccacccttcggctattgtgactaatacttctggtttcttttgctgctggctggtctcagctctttgtgcttcatatgagctggcttcctctccgctctagtgttgcttgtctgtaaatgtgacatcagtggctgaagtacccatccctccagctggctggggcagccattatttct

SEQ ID NO: 7312 - DNA, 201 bp, Bos taurus
aattatggaccttgggtagaaacagcccaaatttctaaattaaagtaaggatgcctttcttctgaagagtccaactttattaccttgattatttctatattcctttaaagtgttttaaattatgaagtattacaaacttcttgaagagtacagatgatattactaacacctataaatacatccctcagatatagctaatgt

SEQ ID NO: 7313 - DNA, 201 bp, Bos taurus
aaatgaagacagtttggattggaattccaaagccgcctgttttctgtttgtcacaataatgttttgcttgtgaattaatttcatttagactacattttatcttttgctttgaaaagataataaccagaaagagtttaaagcacttcatttctattaagtaataaaccatttgtgatatacctagaaatatgtacttgaaca

SEQ ID NO: 7314 - DNA, 201 bp, Bos taurus
caagcacctctttaaaaaaatttatgtcaaaatggtgttcagtggtccatcacattgaatcaacacacctttatggagaacattatttagcacaccctaggggggcatatttctcttggtctttgaacttgaaaaccttttcttgttgatctttaatatgggtcattgaacagattctgttttacctgattagataaatgg

SEQ ID NO: 7315 - DNA, 201 bp, Bos taurus
gttactagaatgagttcagggttctctaagatcagtgtagagacagcagtgggaagtgatgactgctttttaagatcagtgggccttaggatatcagtggaactccatagtccaatgaccaacatccatgtagaggtccttcttcaggttctaacctttcattatagaatgaactatagctgcttaggccaggtggagacc

SEQ ID NO: 7316 - DNA, 201 bp, Bos taurus
tttaaaggctttccttgcatcatcttaacttagtttgttgtccttctgcctcttcctggggaaattaatcttctggccaaattctttttgaaacagtgggaaaaaaaaagagtggttgtgttgagctgataccattagacgtgtctgctatagccaggccaccttcatttgggggtgtcctttttttggggaatattttac

SEQ ID NO: 7317 - DNA, 201 bp, Bos taurus
tgctccccagtgcagctattctgagcttgaagataaggtttaatcattaaactcaatttgctgttaaggtgactggttgggaggccaggataattgcaactgatctcaagtctcagtgtataatagtctcttaagtggcattatccagagtatctgtggatacatggagacttgtggaggccaaactgttcccatttagtt

SEQ ID NO: 7318 - DNA, 201 bp, Bos taurus
tgattactatggcacagcaggccttctaggtgtcatgtccataattattttcctggctccctagtcccaaataggcagctgaggtagatgttatacccacagtgtggccttgtatcccaggtaatgaactggagctgaggaaatattcttttaatgggactgtcagcaaacaacattcaacctttgctccagagagagatc

SEQ ID NO: 7319 - DNA, 201 bp, Bos taurus
ggtgtaatcctacaagagtcatggacgaatttcctaatggggtgtgcagaagggtgtggaaatctgtggcttgggaacagcttgtgagctgcagaaagaaaggcaacattccttctggctctcaacattccttcctcgaccacctgtcactttcatgtcgaggggattgtctcatgcccagaatacagagtacctttatga

SEQ ID NO: 7320 - DNA, 201 bp, Bos taurus
tgcttgaaatgccctttcatgcttttcggcctatcaatatcctaatctcccacaaaatgttccacgaccaggtatgctgagttaagggcctctccttcttgattccaactgctgcagtgttctcagctgtttgactctgaactactcgaaagctgggcaggaacagtaccctattcagcactgtactcccaatgccgggtc

SEQ ID NO: 7321 - DNA, 201 bp, Bos taurus
aaggcaggatgctgtggtcagaagtgacaggcagagaagccggaggaaatgtcactgctgtgtggaataagatggggcctatgcagtgcactgcaaaggaaggacagttttattcctttcttcctaagccactcccacttctagaccttacctcttgcatagacatccccactggaaggaagagttgctattccaggcccc

SEQ ID NO: 7322 - DNA, 201 bp, Bos taurus
ggccacagtctctgttgttctggttcagccttatttttaggcagcactttgttcctgcatctcaaggtagggaccatctcagtgactcttgtcctctttcgaatggtctgggcccagtgtctgtttctgctcctactcccataattagagaatattatttgttcacttctcctaactacatggattgttccctgtgcctta

SEQ ID NO: 7323 - DNA, 201 bp, Bos taurus
gttgagaactactagcatgcatgatttcataagaaggcaaataaaagtaatgagaaaacagactatatatgggaaaaatttttaaaaatgcaaactatgagtgacaggcattctcatgagagaggctaagaccattcaaatagaaatagtaatatacaacataattttaaaagggcttcagtttcaaagaaaggacccatt

SEQ ID NO: 7324 - DNA, 201 bp, Bos taurus
cctgaggtggtgctcagtaggagtctcttcacaaaggagcattaagtaaagagaaaggaaggcatttctccccaatggagacttcacctatctgtgctttcaccttctcaatggtaaaatggtgataatatacctaaattcatacagttttaaggattgaaaaatgataacatatgtaaaggactttgctaagtaccaata

SEQ ID NO: 7325 - DNA, 201 bp, Bos taurus
ccctacttaacaaattcagtcttttggtctctatttagtcttcctcacaataggtaataaacatatctgttttttgctaagacatgacttggattattttgttgttatctactttactttggccacttgatgcaatgaactgactcattggaaatgaccctgatgctgggaaagattgaagacaggagaaggggatgacag

SEQ ID NO: 7326 - DNA, 201 bp, Bos taurus
tttctctcatcgttccccaccccccaccccctccattcctttcactcagtagaactcattgcctcggggaagagatcatatagcagagaagcagagaaaaatttttggtgttaaaagcataactatgaagtatataacttctaagccataaaacattatctttgggaagccagagacagagccgggcgagcctgtcctcag

SEQ ID NO: 7327 - DNA, 201 bp, Bos taurus
gaatgatagtaaaataaggtcataagtgtggggacttgataagacaggaatcatgttctttataagaagggacacaagagatcgcccctggctctgtgcaaacacagagaaaaggccatgtaaacacagtgagctggtgaccgcctacaagccaaaagaagaatgaaaccttccctgctagcactttggtcttggacttct

SEQ ID NO: 7328 - DNA, 201 bp, Bos taurus
tgtgagaagaggcttaattgcagtttgccagatgggtgcaaaacctgtcactggtcccattcccagttcacccaggtagctcttctccactctctggggagtgactggccagtgatgcttttcactacacaggtaagactgggcatatattggagagaaagggctatcctttcaagtatttaagtcatctgtcccaatcca

SEQ ID NO: 7329 - DNA, 201 bp, Bos taurus
attaactgtaaagctcctagtgtttttctttttttaagggaaactgctgtaccctctttcattttcttgtatttctaagacctggaatgagattcttatctaccatgctcatgaatgttgacggtgataatgatctcctggacattacttgtacttttttctcataggaaagaaaataaatcttcccccaaaaatatattt

SEQ ID NO: 7330 - DNA, 201 bp, Bos taurus
atgatggaaacagtgtatgtcaagattccttgtgtaagcttgactgctctgtgcagaatgaacaatgtgtatttttgcctgcatattccactatacatacggctttgtaaaaaaaaaaaaaaaaaaaaggtctttaagaatactttttaaaggaaaattgtattgagctttatagtatagctatcactcttcctttgaaca

SEQ ID NO: 7331 - DNA, 201 bp, Bos taurus
aaacagaggttaatcctcttcaggacagcccacgcctgctcctgctgccagggaggaagaggggtgagtgtagggaagggcaaggatgtgcaaaaatgaacgtaataacagaaagagggacagtttacatttttaaaaagaaaccatgtatttaaatcaagtggaggattttaaatcaactatgtgctgtgctaaatcact

SEQ ID NO: 7332 - DNA, 201 bp, Bos taurus
caacgtcagaagccagaaagagcctccaagaaatgtatgccttgatgggttgacaagtgtttcttttctcttcttactagcttttcctccttcagttcccagaacccagtgctgctgtgatttgccacaaaggttgtatttgtgcccaccaggtcaatatttgaaagtctgattgcctgttgtactgcaacctgacaaaat

SEQ ID NO: 7333 - DNA, 201 bp, Bos taurus
ataattgtggtgtgctacaaagtcttcacaactctgtcaggaagatatcattaacagatgaggaaatccacattcacagagcttcagcatcacacggcttatatgtgctattgcaaggtctatccacctgaaaggcccaagttcaaggctgctttaccacatggtagcttattggaacagatacaatcctgtttcttatgg

SEQ ID NO: 7334 - DNA, 201 bp, Bos taurus
ctggatttgatccctggtcagggaactagaccctgcatgccgaaactaagacctggtgcagcaaaataaataaataattttaaaaagaaacaaacgatgtctgttttatagactgagggccagtatcacacaatgtataaagtcacttggggttactaagcatgagatggaccggtgagcagatcaggctgaggatgacac

SEQ ID NO: 7335 - DNA, 201 bp, Bos taurus
tcaccctgtgacagcctgaaattgcactttttgaatcactccctgataactgttggttgacttcacatttgcccttttcccaccaacatccggtcagaatcgggtagagagtagccgccacactggtttgttctggttgttgagataatatcagactgtctgaggatagtccttctgtgatgactcagccggtgcttcctc

SEQ ID NO: 7336 - DNA, 201 bp, Bos taurus
gtgtatgtatatataatgatcataatatataccataatcagaagagcatggtaaaggagcatactagtgtctaaagctaatttttataattaatgaactgggcatattcagaccttctattgccttttatgtcactgagaactactgagttgacttcaaatgaattggtcaagttctgaaagcctcacagaatgacacagg

SEQ ID NO: 7337 - DNA, 201 bp, Bos taurus
cttataagccagaaaaagagtcacagaaataaccacccacaatccatcagcaccttctgctggctttacatccaaattatatttcaggtatgacacatcctgcaatcttccctgccagaatccagtttaagacatcatgactttgaatccagactatgactgtgctcttggcctgcttatggtctgttccccaccagctgc

SEQ ID NO: 7338 - DNA, 201 bp, Bos taurus
gatgggatgtcattttaacgttgcttttaattgacaagggcctcggtgactgtgtgcgtgtggctacatgcctggcataggatgggcagtggaattagaaatcgttacctgctccttctggccaagaacctggagctgtaattgtgtcaactggctagaacacattgtgttaactcgtcatcaaaggccttattttgctga

SEQ ID NO: 7339 - DNA, 201 bp, Bos taurus
ccgcacaagatgctctctttgctttggtggctttactggggggtactttgggtttcagccaaacagtcagccaaaaccagcccccaaatggaccttcccacgggggcactgtgcccaggttatcatccagattcaggctaccctggaaatgggcatcttgccggggaccctgggtgtcctttcccatctgacccatctcag

SEQ ID NO: 7340 - DNA, 201 bp, Bos taurus
ccttcaaaatattttgcagcaacaatgagaaaagagcttctgcaggaaaaataaaaagcaaaaccctgactctaattccaaggccaatgacaccacgctgtatataatacagtttcttttgtgcaaaagtaagagcatgagtacaaagggaacatttatgagagccagcatgatcaatttgaagaaaacagtggccagaaa

SEQ ID NO: 7341 - DNA, 201 bp, Bos taurus
aaaaagaatcaagcacaccaactagtagatcccttcatctgtctccagaaaggacgtttttacctgtattcatgttttgaatctgtgataaatgccagggctgtaattaagaaaagacttaaggcaaagcagaggaagggccattgtgttcaaaatgtttagaaacgaacgtggacaaagacaactgatttttcctttggg

SEQ ID NO: 7342 - DNA, 201 bp, Bos taurus
cttactgagtgctgtctttacccacttaaacatagcctgaaagttcgattttcagaatgagggtgttctgtgagtttatcctgtgtagacaaggccaggctcatcttctgaaaatggcgctgtcccccttttctcttttccctccacagtgagtggtctctctctgagccctatgagcccacacacctggccggcccatca

SEQ ID NO: 7343 - DNA, 201 bp, Bos taurus
gaccaagtgccaaaggccccacagcacccagtggacacccaggcaccacagcgggatccctgcgggtcctccctgactcctctctcaccgttactctccacggcactcgacggccccaccctacaacttgacccttgaaaggtttcttaatcttcgttctcccacccattccacacctcaatccccgctcaactcatccgc

SEQ ID NO: 7344 - DNA, 201 bp, Bos taurus
ttagaaagctgctgggtttagtgtgatgatgcaaaggcacaaggtcagacagacaagtcaatggaacagaaacagatgctggtgtaaaaagtgctgtggtgtaatttagagaccattacaaagaaagagtaaataaaggtgtcatatagttggctaaattttcagagaaaaaaatggaatctcatgttatattatagggct

SEQ ID NO: 7345 - DNA, 201 bp, Bos taurus
cctgggttgggagtagcacccagtactcctggcttgaggccaacacctctggggccctctccaacaccctcttctcgtttcacaggtgtttacttctacctctatcatgaattggccaggcagcaaaaggggtgcacttagaggaacgcttcagagcactatcgagggttgcactaagtcccaaggaagtggtgggtggtt

SEQ ID NO: 7346 - DNA, 201 bp, Bos taurus
cagttctggagtctgagaagtccaagatcaaggttctgcagatttggttcctagttagagccctccttctgccttgcagacagccacgcccttactgtgttgtcacatggcagaaagtaggagagagacagtgagggagtgcattctggtgtctcttcctcttaagggcagtattcccataatgggggccccacccgcctg

SEQ ID NO: 7347 - DNA, 201 bp, Bos taurus
ctatagataaatgaacagataaaatatcactgtacaaatccagcatcacttttgctcaagagtaatggcatgtatgtccctagcagtgctagtttgctagagctgtaacagttgactacaacagactggggtagctaaagcaatagaaattatttttccacaattctggaggctgtctgtaggactgattcttccttaagg

SEQ ID NO: 7348 - DNA, 201 bp, Bos taurus
gtgcagtatgatggagagatgagctttgatgtctgatagtcatttagcctttagcaagttctaggctctctgtttcccatctgtcatatggataatacctgccttgtaaagtagatatgaggattaagtgagatcttatataaagcattaatatatggtccacatatatgatgagcttgcttgactcctcctttacccagt

SEQ ID NO: 7349 - DNA, 201 bp, Bos taurus
aggatgggaggacaccatgaagatatcatcaaataatttcagaatgtggaatattctacaaagcaactggcctgaactcttcaatctcattttaaaaaaatgtggttggggtggaaggatagcaggaaactcttttagaccaagagaataaaatgacaataacaagccctacatgaagcatggttgagcctgggtttaaaa

SEQ ID NO: 7350 - DNA, 201 bp, Bos taurus
aaatttaaaagttagctgtacctttaaagtctggtaaaaatattacttctgcaagttgtgctttgatggttcttatgctacttaactgactttaaaaacgttcatcagaattgactaatttcacaattcactaatggaatgcatcccacaggttgaaaaataaagcttcagaagacaaatggctcaatttacatacaacct

SEQ ID NO: 7351 - DNA, 201 bp, Bos taurus
ttttatttcctttcagaagagcagacacaaagctcccctcagctgtaattacttgaacgagtttctatatcctgtttcctctacttgatttcattaaaccgtgacataaatgcatactttgcacccaaagcgtgtctaatcactgaacccaaatgactgctttgagagaggagtcagggaacttcgggcgaggctgtatag

SEQ ID NO: 7352 - DNA, 201 bp, Bos taurus
actgtgggaagcattggacttgcagctgaatgagtgagtctgcaggattggaagagggaccctacctagggactcttgcattaaaccaagattttatttcaaatagtgtgacctaccaacttttaaaaatctctcttttctttcttgtttaacattataatttcattttcctgctagatctgaaccattgcaaaaaaaaaa

SEQ ID NO: 7353 - DNA, 201 bp, Bos taurus
ggggccatcctgcttttagcatcgctctgttattccttgttttactgcagagcagtggtaattgatgttgatgatctattaaacagatggcgggatgagcaggaagcatcttagttaaaagacagttcaattctatcattcttgttgaaacactttaacctctgatttaattttattccactgggattgagggttatggtt

SEQ ID NO: 7354 - DNA, 201 bp, Bos taurus
tggggtgggagaggttaaagatccaggactagtctaatctctctttggtaatttgtcatttagatggtcttcctgtgaaagatgagggacaggaactgtgggggagggcaagaaaagatggtgtgcttcagagaatccttttaacctcaaggacacccgaggagcattgagtctcgggcattaaaacaagcaaaattactc

SEQ ID NO: 7355 - DNA, 201 bp, Bos taurus
ccttacaaagatggccagtctttacaaagtttgacataaatagccacacaaatgcaaaaagctccttcaattctttgaactcacaagatgagtgcgaataactataattacaaatgtaagattattatcattgtttttctaacagcaggaatgggttatgtgggtccatctacccatctagtccagttcttgggtaagcca

SEQ ID NO: 7356 - DNA, 201 bp, Bos taurus
ctggagctgcccgagaaaattaagaatggtgatgctgatgttgagtggagaataaagctgccaactggtgagagagcccttgtgaggccaagcagcagagtgctcaccagggtttataagtgcaaaggatttccttccattctctgaggacgtttgacagacgaatgattgcagcttattgatgggcatatcagcaagcat

SEQ ID NO: 7357 - DNA, 201 bp, Bos taurus
tgagagccaggtctttgcatgttttgctctttgctatatactctagaaaaagccagacatcagggaaggccaaatatttgctgaaagattgaatgagttaatttccttctttagaaaagtcatgtttccccctcttgagaactagggccccagatctctggtttgaggtaacaactgtggtgatcagatgctggaagggcc

SEQ ID NO: 7358 - DNA, 201 bp, Bos taurus
gcactgatgatcaagccccagagaagagctccgtctgggggcattagtggcccttcatagagctgatcacttgctttcagcatcactgtgttatctccaccacctcaccctgaggatgaggccaggcagcttctgctcatcctgatggttttctgggatccctaccagcctgcactccctgcccacccagcctcctacggc

SEQ ID NO: 7359 - DNA, 201 bp, Bos taurus
agcatcatctctctgcctcactgaataacttcgtcgatagcaagcgtgcctgccaacagtggcttttttgttgctgttttttctattcagtttgtaccatgtgactcacagtgtcctagcagataagaacagagagacctggttgtccagtgttggcttttgtgcagagcgctgtttcttgtgaggtcaccaacagtgttt

SEQ ID NO: 7360 - DNA, 201 bp, Bos taurus
tcaacacttgttttttacactgtactggcgcctaattctccttggggaaaggtgacttgatctttcatgagatgaaagcacatacgatatagatttctagtcaatactccagaacgttgcctaaacactctaattctcctaagtgtttgggaattaaagtcattaatctttttcttttcttttttggttttgaatcacagg

SEQ ID NO: 7361 - DNA, 201 bp, Bos taurus
ggtcctggaatccttaggaaattttgaaaccttaccttcttgatgtgatcagagcagggtagtttagggaatggggcctctctgtaaggactgtacaggtccagctggggcggaaggcaagtggagttgggtttgtccagccttgtgcagaaagcacagaggtaccatctgggtccgcaggggccctgcccaatctggaag

SEQ ID NO: 7362 - DNA, 201 bp, Bos taurus
gttggagggcagctgggagagctgggaggcctcgggcccctgctcctggctcatccgggttgcctgcggccgtggctctcggccaagtttctcaggcgccgaggtgatcttggtggcttgtcttagctggtgatctgcgatctgaatgccgtacaaggatgacgccagtgggaaaacttggtcgggatgagaaaaggcccc

SEQ ID NO: 7363 - DNA, 201 bp, Bos taurus
caaatgaacaaaatgtacaggaatcctttcagcaactttaactttctgaggcttggccaagattcttgaaaaggcgcttcctcttttgggtcttggctccttcttatcttaatcccctttggcctgaggtagatctttgtctgctgagtggatgggccaatagaaatagaaaatgaagcttttataccttcccagaaaagt

SEQ ID NO: 7364 - DNA, 201 bp, Bos taurus
taaatacagtgtgtttaaaattgttctatatctctgtttcccacctgcctccaaaatcagatcctctttctaattcatagttagaatagatttcaagacatactggcagaaaccatgagtatctttgacttcttcctcctcttctttagccctaagaatttgcaaagctatttcaaacctcttcactcttctctctgcttc

SEQ ID NO: 7365 - DNA, 201 bp, Bos taurus
ctagtgaccccatggactgcagcctaccaggctcctctgtccatggggtttgccagacaagagcaccggagtgggttgccattgccttctccaagtaccatctgggaaaccctttatttaattcagtatgtccaaagcattagcttttcaacgtgccattagtataaaatattatgaatcagctagtttgcattctttgtt

SEQ ID NO: 7366 - DNA, 201 bp, Bos taurus
ggccagcatcctgggtggtaacaacaaaaaaaaaggaaattggtagaaaatgcatcatccaagttggattcagtcagctctgtggcctgggcaggttcccaggatattccagccagacggcagggcttctgagagacaccaggctagaatgtgtgtgtgatgacataagggcagggagaggcagggccgtggggctcagca

SEQ ID NO: 7367 - DNA, 201 bp, Bos taurus
ccgctccgccgggagccaatagtcatcatgagttcatcatacatgtcctaagaaacagataaaactcatgttcaatttaaactcactctacacggggtacatctgacacctgtcctcacagaatgtcaataattgatggaggtttaaaatgctgaaaagctgttcttgcagctaagggacatgtcatggagaatgcagttc

SEQ ID NO: 7368 - DNA, 201 bp, Bos taurus
ttttcttccactcacaatttgttttgccctccctctcctctttctttgaccttgacctcctttcccacactggtcactgaggactctagtctatcatttttccctttggtctcccacgccaatttatgtgtactaataatcaactaaacgtcagtggttctaacacctttcctctcccacataccgaaatatgcctgatat

SEQ ID NO: 7369 - DNA, 201 bp, Bos taurus
gcgataatatatttgaaaaatgaattcaaagacaagatgacagtcaaataagaaaaggagatactcagttcagtgaggtgagtgttacttgggggcaaggtgctgtgctgggctaggactcccgggagcggggctatggtgcctcacctcagtgggctggggtaggatggctacagtcatggtgctggtgtggatgcggcc

SEQ ID NO: 7370 - DNA, 201 bp, Bos taurus
ttaggagggaaattctaaatagaaagatcacatttaaatagaaaattagtactcattctgccaagcttcactgagctcttacgtatgtgtgcacacataggggggactataacaatattaggacatgaggctgctttgctgattaaataagaaaccccttaagaatttattttggttacatttccgtaccgtgtcctatgg

SEQ ID NO: 7371 - DNA, 201 bp, Bos taurus
cacttagctatttattaaaaactattaattaaaacttcccctcaccttattcaaagttagagctgtacaagaatccctccccatattactaaaatgactcgtgtgtgagtgtatattttgagagaggagtttttttctgtgtatttttcaggattagtatcagtttaatcctccagaaggagatggaagtgaagcaaccca

SEQ ID NO: 7372 - DNA, 201 bp, Bos taurus
cataatagtggtcggtatatagtaactcaaattatattgataaagaccattgtgtgaatgaggaaaactttgaaaaaaaggttagcactagtagaatagatacatgtcttctaacactatagattatataagtaaaataaaactttttaaaaagctcacgtggtaaaaaaatagctataacattgaacaagctaacagaag

SEQ ID NO: 7373 - DNA, 201 bp, Bos taurus
ctaaatatttgaaaggagctcagtgagaattcggaaagagagttgtctaaggatagcaagaaagtggatattgttaaggcccatgtgatgctggactctatggatctcttcttccataaattgtaaaatgctccacctttcctttattttataccctggatttagagagataatgaagtcaaatctggcctctgtatcctg

SEQ ID NO: 7374 - DNA, 201 bp, Bos taurus
aataaaacatcatttctggacaagaagacttactgttataaaggtatctattatcctcaaattgattgaagagttggacttgttgactgaacaacatcctagaattaatatttaatctgcaattccataaatcaaaattccagttgattttttgagggattcagtaaacctacaattaaaggcaaagtgaaagaattaaag

SEQ ID NO: 7375 - DNA, 201 bp, Bos taurus
cactagaggatgaccctcttcccagtatatctaactttttatttttttcttgagaatctcaggtttcttatgcatacagaatccctatatcacccacatgtttgcacattaacttgcacacacacaccacatcacatgcatgggcacatacatgtataggcacatatacacactcctgatagacattctaagaacttttca

SEQ ID NO: 7376 - DNA, 201 bp, Bos taurus
ctaccaaacccacagatagtggccattcattataaaaatggactgaaggtgttggtggtgataatcaggatggtactgaagaggctggggctctaacagggggagagaaaaggcctcagaaggaagccgaccacttgcagagaatgctgtgggtgacccagccacgcggccacgtcctgatcacccggggcacgctggcca

SEQ ID NO: 7377 - DNA, 201 bp, Bos taurus
atcaacaatcatagatgaaagaactaaaatgacccaacgtcgatgacttgggaagtctctcttcgctatatgtttagattgaagtcttgagtttttatgtttggaccaaaacaccatcacatcgcatcattttccagttcagaatatttgaacttttctttcactgtacagcttgaggaaataaacatcctctcaaacgga

SEQ ID NO: 7378 - DNA, 201 bp, Bos taurus
gttgaggctcagggaaacagactccccaagcatatacagagggcctgtgagctctctgcaccaaggaatggatccacacctcagcctgaccatcttagacaacatctgaagacacggggcccaggacccaggctctccacaaacagaagtagaaggaaatgggcatttccatagagcgggtatttccctaaactccaacac

SEQ ID NO: 7379 - DNA, 201 bp, Bos taurus
gacagtgggtacaatgtctgagagctgaatctggttgtacgagttcatgtcagagcactaaccccttcctgaacttcctaccatgatactgggagagaacggtgtgaactagggcccagaggagggaggaggaagtcatgcagtgagtgccttcagcggtgtctactgtttgtcaggacacggcatggagcatagtgacca

SEQ ID NO: 7380 - DNA, 201 bp, Bos taurus
taagggccaacagaaagccctttgctgctcgagcttgtgatgcctgggtcctggaaaatccttggtgtttgtaggaaagaaacaaaggaaggacccgcatcacaccagagaggcctcacctctgtcctgctccaaagaatgtccactgtggacgccagctaggtggagcaagagataagaacaggagaaatacgatgctgg

SEQ ID NO: 7381 - DNA, 201 bp, Bos taurus
aatctcctttgtttcggccggtgggatctagttccctgaccagggatcacacctgggcctcctgcattaggaatgtggagtcttagccactggaccaccctggaaatccccagctacaagtgatcttacaacagctgcagaagtttttgggtgcttttgtgctgattaatgttccaagtttgattgttattagctagagtc

SEQ ID NO: 7382 - DNA, 201 bp, Bos taurus
ccctcttaaccaagttttatgtgtacaatacaatcttgttgaccagaggtacaatgttctttagaagttgttcatcttgcttaactgaaaagttgtgccaatttattagtaactccccattgcctcctctctcatcagtccttgataaccaccattccattgtttgattctataaatatgactgttttagttaactcatgt

SEQ ID NO: 7383 - DNA, 201 bp, Bos taurus
catcccaagacaaaacttaaaacaaagcttcccacccgtcatcagaatgatctgtatctccacctgagtcacagatcaatgtggtcgtattttataaacacggccatctcatggacatgccctgcatgcaggaactggaactgtgacttccctctctgagcaccacttcactttaaaactcaagtgatgggaggcaggatg

SEQ ID NO: 7384 - DNA, 201 bp, Bos taurus
agacccggaacagccaaaagtaaataaataactctaaaaaaaaagaataaactgtatatgtgtgggaatatgtatatacaacatctatttccaaattttctaatcccttctagtgaaatattgatatatagatttataccacactaccacattgccttgaagctgtagctttataataatatttatttatttattttggcc

SEQ ID NO: 7385 - DNA, 201 bp, Bos taurus
agtaggatgacctactgtctgagaagccagaaccctggaggtggtggagtgcgctcttggaactcgtgaccttgggcccttagttcagtgaaaatagaggggttcgtttcatgagcatattgaacttacacagcagtggcaggatgtagaacttggctggcctgtgatgcttgtccttgcaccactatctcacatacacac

SEQ ID NO: 7386 - DNA, 201 bp, Bos taurus
gtgaagtagtcatctctttcttccccagcactttctccttgccctggttggcccagcagtgaaagttttataaacactgggcactgtgcacttaggccagagcttgaccacagacttctcgattgatgaatgctgtagccattctttagatgtgggcccctccctttttttttttttttttaactgatacagctgaaggtt

SEQ ID NO: 7387 - DNA, 201 bp, Bos taurus
aacatatgcggccgtgtccctgaaggggctgccttgtttggtctcagcatccatggagctagaaaagcttacccggcagcagtctcttgcaatatgtcgtatataaaaaggaaactattttcttagttccacatagacattgtctagtattttttaatagctgttttctaacaattatcttaaagttttgaaaaacaagta

SEQ ID NO: 7388 - DNA, 201 bp, Bos taurus
tgtggcctggtttgtgtttccatgggactaggatggcttggatttccccagtcaggggtctctagagagggcatctcttagcaataggttgtacagtcacgtagggaggtccactggcctccgtatgaaatttaatagaaacaaatttcagctgtaggaagggaacttttgaatctggatgttctgagatcctgggcccct

SEQ ID NO: 7389 - DNA, 201 bp, Bos taurus
tctctccacatcctaaggccctgagcttgtacactgagctggaggctgaactgaagtaaggtttctcctctaggggatgagttaaaaataattcactgtgttcaggcccagcagtctttagggagagacatctgtactgactgcagattcaaacatcacagaggaagtgacccttccatcatcagggattgactggtttcc

SEQ ID NO: 7390 - DNA, 201 bp, Bos taurus
tttcaaatgtgaccaaaattctgctcatgagtgctttgtattattctatacacaaggcttaaaatcatacaaaattaagctccaggccatggttaagaaggaatcattattctttctttatctcatgttttatgttaaatgttgcaaagacccaatcaaaatgtgtttatcagatatcacctgggcctccctgacctttaa

SEQ ID NO: 7391 - DNA, 201 bp, Bos taurus
agacacacacatgcaagaagaaacaccagacaagacacgcatagaggaaagatcatgacagacacagcaagaagccagccaccaaggagacaggcctctttgaggaaccaaccctgccacaccttggtcttcagcttctcgcctccagacttcgagaaaataaatttctgtcatttaagccaccaagtctgtattttatga

SEQ ID NO: 7392 - DNA, 201 bp, Bos taurus
aaatgcagatcataatgtatgtttctgccgtccctggccaaactcagcagttcctgagagcagaggttatttggcatatacctttgtagccacacggcctcaaccatggtacatgctccataaatatttgctcaaagaaggacttacctatggaaagtagacagagtgaaaacacagcaaacagaagtcctggcagggata

SEQ ID NO: 7393 - DNA, 201 bp, Bos taurus
aagcgtgcaagtgtcaggccacctccatatgtcaaaagctggagacatgagggattgagccaaccttgcagtttcagaaaagcaagaccctaatgaagcaacaggaccaggacaggcccttgtctgattctgggaaccatgactccagagaaatcccacccctcagcccccagacactcacccagatctgcgagtcacttc

SEQ ID NO: 7394 - DNA, 201 bp, Bos taurus
gaaaccttcaggccaagaaattaagatgaaaatgtttccaaaatgctaatatctttaaggtgtctggcagaagaagactcaaaactaccctgaaggagcgtatcccaaactcaggccacagagaaatgcacagataaccccaccaaggacacgcatgtgacctagaatttagagacatgcgcctgataagcccctctgcgg

SEQ ID NO: 7395 - DNA, 201 bp, Bos taurus
tccatatatgaccactggaaaaactatagccttgactagatggacctttgaagggagcattaaggtgagtgaactaataaaagtgatcagggtaggcctcgttaacaaggtgaaatctgcacaaaaatgtgaaagatgtaaacaaacagcccaatcaaaaaatgggcagaaggcctaaatagacatttctccaaataagac

SEQ ID NO: 7396 - DNA, 201 bp, Bos taurus
ggggagatttctgggacccctggagtgggtagcacatcccttctctgtaagttacattctctgtccagattgtcagcatcatctggccctccaacttccctgtcccattggctgggtctccccatcattgccctggctcagaaatagagagccgtgtccagcccactgtggccagtgggcccaggtctcacatcctaagcc

SEQ ID NO: 7397 - DNA, 201 bp, Bos taurus
tatctaccatcttttgaggcctattggaagccatgctttgtaagtataattttacagatgaaaattcatcagtgttagtatttcttctctaattcaccttagggccatagtcctcggggtgtctgagatggacactgacatggtctgacagcatgggtggaagtccaccaagctcagtggccggagcagggcccaggggtg

SEQ ID NO: 7398 - DNA, 201 bp, Bos taurus
aagaccaacagcagatgggcagggcagtggagggtctgggcagttaaaagccagaggctacacaaaaaaatacagagacagagaagcagacagcgcacagaggatgtgtggtttccgggccacgcgggcacagccggtgctcagacgcactgatgatggaatgacgctgggaatgcggcgagcgataagatctgggtttga

SEQ ID NO: 7399 - DNA, 201 bp, Bos taurus
gaaaagggccccggtgtcttccttccctgtctctcgtggcgggaggagttttgcagtgacatctgcctgcctgcttcttgcacgcacatccagagtcaggttgtacaggcctccagggatcctggctctcggctgtcttccccccggtgactcagtccttggggagtctgtgcacttcctctgcccccgtcctgaccttta

SEQ ID NO: 7400 - DNA, 201 bp, Bos taurus
tctggcaatgaaacccaaaggcctgtatcatctgagctgccattggcccagtgtctacgtgagaggctcggtttccaggccagttccacatgggtgtccacgtgtccttcattccttcactcaacagggactccaggatgccagatgctgggtgtccagtgataactgtacagacatggccctgaaatgtacagtgggcgg

SEQ ID NO: 7401 - DNA, 201 bp, Bos taurus
tttgactatcccattctacaaatggccatcattttcaaaatggtaaacataagcttaacatgacttagcaattccactcctagtatatacacaagagaatgtaaaacatctccacaaaaaaacttgtacatgaatgttcacagcagcattattcataatagccccaacatggaaaggacctaaatgtccatcaactgatga

SEQ ID NO: 7402 - DNA, 201 bp, Bos taurus
tcttttaaagtttttgaaaatattgtttacacatgttaatatttcctgaattattctccttctttgatgtctctggcccttcatttcacatcagagatcatgagcttgccgatgtgtgcggcgtgcgcagacgtctccttaccgtgccagtgacgggcctccgacatctcctggacggcctgcagtcgggctgctctgtca

SEQ ID NO: 7403 - DNA, 201 bp, Bos taurus
ccagcgacattgaactgagtgatgactgggctgccaagaagtctcccaaaatctcccgagctagcaaatcacccaaactcccaaggtaacctggatgtgcaggagtgtgctccctgctgtgtgtctctggagatgtgtcaggtgtgtctgcggcagagtcccactgaaatcgacagctgaggggcacaggcagcaaaggca

SEQ ID NO: 7404 - DNA, 201 bp, Bos taurus
agggacccctgggtgcccgatcaggaaaggacgccaggaggcacagagcccgagatgctgggtggcttcacggggcggtggcctgtgcagtcccgtgacttctcgccctgtgtttttcccgtctgtggtggcgtcttgggagttctctggactggcgtcagaagtgcgggccagcagtgccagcttgaaagctctgggtgc

SEQ ID NO: 7405 - DNA, 201 bp, Bos taurus
ttacagttagggtgtgtcaacgccgagggtggtggttcccagtgccgccagcagggggcagcagaaagccgtgtgtgtgggcccagcctcccggggctcaggaagggtatttaggaatgtgatggggagaccaagctgaggtttaggagggaggtacaggcctggggtagaaaggcaattagcgaggggagtgagtggaga

SEQ ID NO: 7406 - DNA, 201 bp, Bos taurus
gtctccagggacgcatctggtcaagccgtggtctagggcttggctgttttccaatgatgctggccgggtgacgacgtacatggattttattgggtataacgggaaacggggacagacttggtcacatagggaggcacgagtgtttcttttctactcagaggctagagtgttcctgtgatgcaatctatccctgtgtatatt

SEQ ID NO: 7407 - DNA, 201 bp, Bos taurus
gagcacaagcaggggtcagagggagccctctgggccagacatcacccaactcacctgattactttcaccaactagcccctacactcgctgggtaatgcgcgggctctgcaaaccaggccttcccttgtggctcagctggtaaagaatctgcctgcaatgcgggaaacctggattgggaagatcccttggagaagggaaggg

SEQ ID NO: 7408 - DNA, 201 bp, Bos taurus
tctgggtagtcatagttgaagtgggtttgctaatcatgaaacccaaggaacacgggaaatagatcatgtctggaaagacgttccgagtgcctttctggccgtgaaacccaccgtagccttttcaaggtcattgtattgtggttgtggtcccgcttcgcacacactggtggttcattcggccaggaattgtgggctctgact

SEQ ID NO: 7409 - DNA, 201 bp, Bos taurus
gatactgaatctagttccctgcactatatggtaggtccctgttgtttatccattcacagacaagacttagatgatgtttctggttttgttgactggaagcgttcaatgtctgcaatggaaaatatgtggataatgaggccaagtttccccgatgcattttgcatgcaatattgtgaaggctgctaaactaactcatgctaa

SEQ ID NO: 7410 - DNA, 201 bp, Bos taurus
cacgattttactcaagtttgaatcgtccttatcagaacctcccgtctctgacagtgagctgcctgggctgatcccagggcagagttcccttcagtcctccgggacttctcgcctcaccctttggggctctgagccccaggccagggcccctcgacggatcctcctttccacagggcctccagcaccccttgctgggcagcc

SEQ ID NO: 7411 - DNA, 201 bp, Bos taurus
tcatgtttactaaatcacctgtttgaggagcagagcttcctgacagcccaggggaccgtgaagaaaggagaagaagctggctaagctgagaaggccctgtcttccctttccaggagggagtcactcctcagtggactgacccaggaaatgcatgacgtgtttctgcccggacccagagagcccccctcagacccttgactg

SEQ ID NO: 7412 - DNA, 201 bp, Bos taurus
aattcacaaatatgtatatataatataatgaacttttgaatgtgatacagctaactggcctttaattgtatctaaaatttttcatcttggccactcttcttaccaacatttagtcaataagtgtatcttacatagtcaagctccaccgaatgagcttctgaacaccagcgcatttgaatgaatagacatgtacttaatttt

SEQ ID NO: 7413 - DNA, 201 bp, Bos taurus
gtggctagcgtgccctggatacaagggtggtgttcgtaaggctgaggcccagaactggcccagagtcacttccgctacattctgatgactaaaaagatcacggggtcagcccacattcaagttgtcgttgttgagtttgctaagtcatgtccagctctttgtgaccccatggactgcagcacgccaggcttccctgtcctt

SEQ ID NO: 7414 - DNA, 201 bp, Bos taurus
tgaaaatacaaaaacacagacaagacatgggcattgccccaaggggctcagtcttaggaaagaaaggactgtaaacagttaagatacaatgtaacaaggacttccctcctggcttagactgtaaagtgtctgcctacaacgcaggagacctgggttcgatccctgatccctgtgtcaggaagatccgctggagaattccat

SEQ ID NO: 7415 - DNA, 201 bp, Bos taurus
ttcttccatgctcagctttctttatggtccaactctcacatccgtccatgaccactggaaaaaccatagctagtgcttatattcatctatgatcctggagagtcgatgtccacagccccacaggcctgcacatgtccaccagcgccatcctcaccctgagcagacagggcagagggagatggaaaccaaactctgatccca

SEQ ID NO: 7416 - DNA, 201 bp, Bos taurus
ccctgaagggccattctggggcaccacgtgacggcccaggttgcacactggtatttctcttagctctcctgctctgcccttgaccttcggaagctgctgccgtgtactctgtgatggcctggaatgcctgctaaagacgtctcttattctccggcttggatcctagtctctggcaaagttatccctgatgggttcagattc

SEQ ID NO: 7417 - DNA, 201 bp, Bos taurus
gaagtccctttcaaatgggccctaattagcttgaaaggtaaatagatgctttacaatgcatactcaattgatgtttaatttttccaaaacgatctaaagggttgtatgatacagtggctgatcaaaagtttttatgaaacaagcaaatgttaaagcagaagttacacaacatctcaaagtcttaagttttctcatccacaa

SEQ ID NO: 7418 - DNA, 201 bp, Bos taurus
ttaattttttctttatcttctttctaaccaaatcacacacacacacacaacgaatccagctgcctgcctgcatttctggcacagtctggattaattagaatgctccagtgagtcccaagacagacttcaccagctgaaaactcgctgcctcggctccctctctcttgtcaagtgcaaatctgaccatcctggcacggggca

SEQ ID NO: 7419 - DNA, 201 bp, Bos taurus
cacgtctctctgtggccgggaaaatctctggctaaaggtttggctgcagccagtgccaaaaggctccggttttcaagcagttcattatttcttaattgccgatttgcatgcaagcctccaggccagggacatcagtaagcatcccggaaacgtgcccctgtggactctgggacactcacatttattgactgcccactgtgt

SEQ ID NO: 7420 - DNA, 201 bp, Bos taurus
aatctcattaaagctcagtttccttatctataaaacaaatgtgtttctctgaagataaaattagataatgcttagcaaaattttcggcccacagtaaactctgattactgttactatttttatgaaaagtaataatcacaaaaatattaagttaatgctgtcgtataggcctcctttttgttcatcactggcattttcact

SEQ ID NO: 7421 - DNA, 201 bp, Bos taurus
tgggtggcggcctggtggatgggtgctcacaagcaaggagtgcaaagattttttagaaatctaaccattataaatggccctccttctgaaggtgataatcaattcaattgttgctgttgcttaatagctcactcgtgtccgactctttgcgatcccatgaatcgcagcacaccaggcctccctgtccatcaccaattcccg

SEQ ID NO: 7422 - DNA, 201 bp, Bos taurus
tctgtaagatctttgggctttttgcatctgtggtggggggaccactgaagaactgtgggcagaaaaattatcttcaaagatttgaaaaggcagaacagagtagctattgtcaaatggtgtaaccataagggatttgatacataggaaatgaatactgtctatcactgttctttaactctgatgtggttcatctagactgta

SEQ ID NO: 7423 - DNA, 201 bp, Bos taurus
ggccactcggccactcgtgaggccgggggtcagtgtgtctggaggagatcacaagccccactcggagaggcggtctcctccctgggccgaggtcagcccccggctggttccactgacagactcctcgtctgggaacctgtgtgtcttttgcttgtgaggacctagctctcacccagacgtgttcggggatttccctgataa

SEQ ID NO: 7424 - DNA, 201 bp, Bos taurus
gaaatactaacttcccccggcagcatcaccgctgacggccaccgaagagcaaatgcaggctggcataaggtgcggaaataatgaaaacctatggtctagaccattcgggccacaggaaacttaccccaggggcacatcatcaccggaatggagggtgggggacgtctcatgttacagacacgtgcacaagccgtcgcggtc

SEQ ID NO: 7425 - DNA, 201 bp, Bos taurus
ctccaggcccttgaacagagtagcacatacctgtgtgctttccccagaggctgcagggggagtgttttaatgatggctgaaggacatcgtgagctttggtggggaagggtggcccatgggctgcttcatctgtcagcccgctctgagcagctgagaccccagggtgctggtggctcttgctcatcgtcccctgagtgtccc

SEQ ID NO: 7426 - DNA, 201 bp, Bos taurus
cattcctccttaagtttttatttgtcttgagtttttatttcttgaggacaaccctcttccaaagctaggatgaacctaatcagtccaagctggccacatgctgtctgggtgctgtgatgaaatgccaaaagcattcttaggtggttgttactgtttggttgctgagtcgtgtctgcttcttctgcgacccacggactgaat

SEQ ID NO: 7427 - DNA, 201 bp, Bos taurus
ccagcggcaggcaggggcgtctgtgtagggctctgtcgtccaaacagaagtgctgacggcccacccgggcatgcctgggagacaccaggaggtgggttccggaccgccaccacaagacaactatagcaataaggcaagtgacatgaattttttttttatggtttcccggtgcataaaaaattatgtttacactataccata

SEQ ID NO: 7428 - DNA, 201 bp, Bos taurus
ctattgtcaaggcaacttagacccgagcgtttactgttggccacacatagacaccgtggggatgacttatttggaaaaggcccaggtggcttgctgcatttcagtcttcctcctctctcctcctttccctgggttgagggagcatggagtcccactctttaattcaaaagcctttccagtgcggctcacctacctccatgc

SEQ ID NO: 7429 - DNA, 201 bp, Bos taurus
agggctgatctccttcagaatggactggttggatctccttgcagtccaagtcttcccaggaatccttttaagcaggtaaggcacataaggtatggaaatagaactgatttcaagtcaatatctttcacttgaaaaagtcccttaacttgtctgagcctcacttttgtctgctgctgctgctgctaagtcgctttagtcgtg

SEQ ID NO: 7430 - DNA, 201 bp, Bos taurus
ggtcagtcctatggcctgtgccatgacactttgattacccaaacactattgatcacatagaggcaagtcattcaatggactacatgagttccgagtacattcccacaggccttaataaagaccagtgatgcagaacagcaggagaaggaaggtacagcagagatcagagaggccccagccctccacctcagggccctttct

SEQ ID NO: 7431 - DNA, 201 bp, Bos taurus
atgaaacaactggccatatttcatcacacattttcctgtacccccctttttctagagttccaatttattcagtatatattcagtatattcagttccagtatatatttggcctcctgatgcttcatatcttactgagtctctgtacatttttttctcacattaggttttttctgagtttgtttgtttatttgtttgttttta

SEQ ID NO: 7432 - DNA, 201 bp, Bos taurus
tgtagaagaataaacagtgaacacttccagaagaaacgcatcctccccaaaccgccgggcagccaggcagacccttcccgcggggccgagggcgccgcgcacgcggatccccgacttccgggagagtaacaggtgttagcgaagccagccgcgtcggcctggaggtttcggaagaccgggctatgcggctcggccgtttcg

SEQ ID NO: 7433 - DNA, 201 bp, Bos taurus
agttatccagtgggagctgcccacggccctggcatttccacaggccagagctgagccagtgaccgccgtcgtagtcaacaaggctggagagcacttttctagagccagacctcaggggccagcgcttccgtaggaccacgaaggagcggggaccactgagcagcacgggcagaagacctgggcactgcgcgctggaaaaag

SEQ ID NO: 7434 - DNA, 201 bp, Bos taurus
gttgccctgcaatgtgccaaagatggtggcgggaggaggggagctcggggggcaagaaggacagggatacagagggtggtgtccaggtggaaccttcacatgtgggccagaaagggagtcccatgtgtctgaggagactcgcccatcccttgttcctgtgtctgtagcctcagaagattgaaccagatgacctggggggtc

SEQ ID NO: 7435 - DNA, 201 bp, Bos taurus
gtttgtgtctctccaaatccacccattgaaaccctgacctccacgatgatggtattaggagatggcgcctttggcagtgatgagcacgagtggtccccttgtgagtggggttagtggccttataaaagtgaccccaaagagctccctcgccccttccagctatgtgagagcaatgagaacttagcagtctgtgaccccccc

SEQ ID NO: 7436 - DNA, 201 bp, Bos taurus
ttaaaaagcaaactctaacctcaggtcccggggtttctgctccaagggctctgacatgggctggggaactttaacaaaacctctgatgggggccacggtcgggaggggcagatactgttgcctatcggtcgtcattcctgaggaggggcggctcatgcactcagtgaatagaggccagaggtgctcctcgacgtcccccag

SEQ ID NO: 7437 - DNA, 201 bp, Bos taurus
cttgggggccgcgggaggcgcgtcccggtctctgccccgagctcacagcaccttcccatcccccacacccgtgtccagggtccccttttcttaggacaccgtttctcctggcctaggccccccaccaggacggcccaccctgactactcacgtgctcccaggccctgtttccggtccctgcgggaggccttcagcaccttt

SEQ ID NO: 7438 - DNA, 201 bp, Bos taurus
ggatgtgtctaaggcgaagccccgaccgtggcctcggctggagacaggacccacccaggactggatgagtcctctgtgctcagcagcccggcctcgtgctaattccgcgcagatccctcgacgcaggagtcctccccacgcctcccgggagcccctcccgtcccggctcggtcaccaaggcccggaaggccaccctcccga

SEQ ID NO: 7439 - DNA, 201 bp, Bos taurus
ctcgtggtgggcattcctgcctctctgcttcgtctctgactcgactctcaactcgctgacaagagagatgcggaagacggcccctcggcttccacacctgtgtggggctccctgagacacacgtcaggtccttaccacctgccccgactgggcccccacggagacggagcagcaggtgtgtgcgcaggatgcaggaccagc

SEQ ID NO: 7440 - DNA, 201 bp, Bos taurus
ataatactccactgtatggacataccgtactttatttatccaccagtggatggatattgggcatttgtccactttttgtctactgtgaattgaccgatgctgctatgaacattcatgtacaagtttttgtgtagacatatgttttcatttctgttggttatatacaaaggattggaatagttgagtcatatgctaactctg

SEQ ID NO: 7441 - DNA, 201 bp, Bos taurus
ggagctgggcctctgggaggcaacgggtcaggagggtggggccccactgggatgaacgcccccacaaaaggggcccagagcccctgccgccacatgaggatgcggggagaagacaccttctaccaactgggtcctcaccgcagaggaccggccagcatcgtgaccctggatgtccacctccagagcctccagaagtacatc

SEQ ID NO: 7442 - DNA, 201 bp, Bos taurus
gtaacacgggacactctgcaacccgcatgctggccaagcttctccagcggaaaatcagaaatgctccagcctcggggcactttcctcctgtccctaattatgggaggctcgtctgggccgactcagcagttctggaaccaggagtgttctcccctgtcggttacttgtctcctctgtctcttcttacctgtcgctgctcta

SEQ ID NO: 7443 - DNA, 201 bp, Bos taurus
ttgctgttgagagatactggctacaacctagctgaagggtgactgaagtttcattgctctgattcactcgggctgtggtgtggcccacttcctcctggtcagtgtctagttctgagcgttggagtctgatattccaggtaacctggttggtagctgtgttgctgatgtgggctctgtcttctggcacttgtctgtgcttcc

SEQ ID NO: 7444 - DNA, 201 bp, Bos taurus
cggggcggggccgtagagagcagattgacgggtggcggcgcgggaggcgtgagcgtcggtcctccagcccctcagggccctggcctgctcgcttttccccgggacatggggctgcttttatagagtgcttcagtagacagtacaggcaagcgcatcaccggggcccacacgcaacgggaggcaggcatcactcccgctcgg

SEQ ID NO: 7445 - DNA, 201 bp, Bos taurus
gatgcaaagagacgcctgggtagatatttaacctgaactcaggccggagctgccgctggaccctgaaccgctgcatctccaagagaaagcccgttccctggtgctgagagccaggcccctgtgcccctcggctgggagggagatgcctgccccagaccccacctaggcgcccgcctgctccctgactcagggtctgcatcg

SEQ ID NO: 7446 - DNA, 201 bp, Bos taurus
catcccggggcaaactcattcctgtgggctatttcaaaagctacatggcattacgggatcacaagagaaaacggttataagacaatgacttccatattccgccggcctggaatcctttaaaacatgcaaatgtgaaatgagtgctcgttgacagctgcgattgttttatacggagctttgctttgggttagcatcaatcat

SEQ ID NO: 7447 - DNA, 201 bp, Bos taurus
tgcagtctggactttatcagatcagaggcagacccgttcccggagccgatctctcccagcccagaggtttctgccctccaggcggccctctgccagacccgtgctttagtgctgtggatgctgagaccacgctgcatcattgcgtgcattttcctcctctctttccccttccgtccctctcagccaaccaacagtcaggcc

SEQ ID NO: 7448 - DNA, 201 bp, Bos taurus
gcccagtccccgcatctgaactctgccgacgggacagggggaggaagaggcacccgccactgctacgtgctgtccatccacgagttaaacatgtttccacgtggcccttcatgttctttctcccatgtcttctcaagcaatgacttcatccagggtcacgttgggttttctaccaaggtgtctgttgcttttcgccttctt

SEQ ID NO: 7449 - DNA, 201 bp, Bos taurus
ggtggcctcacactccagccttggggcacatggtaaggctctgcccttgcagttgctgatgagggcaggagtgtgtggcccaacttcagccaatgagtcacgagggagcagtccagctgagaggcttcaggagagaaacacaaatagaaagaaaccattttttcttctcggtgttctcaggcccgtgtcttctcacggctg

SEQ ID NO: 7450 - DNA, 201 bp, Bos taurus
cattcacagcagggtggctcacagcagctgaagtgtggaagcaacccccatgtccatagatggatggacaaacaaaaagaatgtggcccatccatgcaacagaatagtagcattcagccctaaacggacgaaagtcctggcacctgctacagcacggtgggcctcgagctcattatgctcagtagaacaagccagttacag

SEQ ID NO: 7451 - DNA, 201 bp, Bos taurus
gtgacgtgtattcaacctgtgatgcacgaacagctcaaatcatggttgaatttacaacagaagacgcgagaagaagagtcagaggccaactagacaagtgcctaaagagaagcaaccagagcaaaagatttcaagagataagaaaagggagaggaaaggaggcctggggtaagcgggctgatgttaggagtctcagtgcga

SEQ ID NO: 7452 - DNA, 201 bp, Bos taurus
aggaagcagtcatcttgtccccgccagcccctgtctcctaggacactcatgacaggaggtctgtttccttaggatgtagtcggggccatggttttcagaccaactggctgctggagaggcagcgtctccctgactccccgctcacctgtgaccgccttcgggcccatggcatccttgggtcccagtggagagagcaggtca

SEQ ID NO: 7453 - DNA, 201 bp, Bos taurus
ctccggtggctgcgtcactggccggccggccgtgccccaggagccatcctggcaatgtcctgccacctgcagcaacgcctcctcttgattccagtcagttaacttgggggaaggccgtttgtccaacaggggcaagaggtgtcctcttagttgaaaaagttagtttaaggtttaagaaaactctgacacacatcatgtaac

SEQ ID NO: 7454 - DNA, 201 bp, Bos taurus
gcgggggcgtggggttccggtaacgctgcaagagcctggcagccacacagcgtctccccgctgagctctgtgctgctaccgtttgggattctgtggaacgcggccttcacccacagttcatgcgtaacagcaggtgcgaacctgagcagtaagcactcagagcggtggcccagctcccggggaacgtctgcggccactcac

SEQ ID NO: 7455 - DNA, 201 bp, Bos taurus
gggcttccctggctcttcccaccactccgggaacaccaggcgtttccatgagtttctgcggtccttgcaaactggagggcctgccgcagcccctcgggatgggggtagagacttaagactgtgggtaagagacagagaatcctcatgctaagatagccttttcttgtcagggtgccccaagcccctccccaccagtgaggc

SEQ ID NO: 7456 - DNA, 201 bp, Bos taurus
cacttgtcgagttgtatttggaacctgtggctttttccagaggatgcaactggtgtgtcagtgacccttcgtgtgtgatttcatcttaggggttacattcgaagtggtgcccaggcatccggccttaccttgagtgaacggggaaattagtgtatttcggaatgcggcatgacccatgaggcttcctctcgagtttcaatg

SEQ ID NO: 7457 - DNA, 201 bp, Bos taurus
tactgagcttagaatcaatttcgtcttctcccttggccaactgttcttatgcagtctgacccccgcacgtcttccagcatcaaattgtcccactcttcccggacctttctgggctccaggcctactttccagttcttagatagattctttctgattttcaacctgccacggcttgtcccagccctggaccacggttccacc

SEQ ID NO: 7458 - DNA, 201 bp, Bos taurus
gtaaggacgtttctttgcctcctctgatttctgggggccgctgccagtcctcggttctcctcatagacgcatcactaaaacctctgccttcactgtcacgcggccttctcacctgtatctccggctgtgtccaaatttccctcttcttataaggacactggatttaggactcacccgaattcagtatacctcatcatagct

SEQ ID NO: 7459 - DNA, 201 bp, Bos taurus
ctgtgttctggcccctttatgcccagtcagtgcaaaaagccaccctgtcttctttcccctaataacaaagtggttctttttattctatgttaacttaatggaagtaaaaaaatcccattctaggccaggatttagtaatatgtttcctaaggttgtttgtcacatatgtttgttacagttcttttctctgtcaaaatttaa

SEQ ID NO: 7460 - DNA, 201 bp, Bos taurus
accctcgatccaactctcctgaagccagattcagacctcacattcctaattatatgtgtcaacgattttatttctgtgattaatttattttgagattggtatctgtcatttccaacaaaaatacccttcttttaaaaattttaaacattttcctctcttccattttttatttccttttttattttccttccctttcctttt

SEQ ID NO: 7461 - DNA, 201 bp, Bos taurus
atacagaggttgtttatgtctaccactttggcctgtatgggtcacttggcaagcagtgtacccacccaagtgaccattatccttaggccatcattggaccatgtaaaacccacaagagaacaagatggtagcaccagaattaagtttggattctctaggtttctgttaatctggctgccaccaagaagttgcaccagtcag

SEQ ID NO: 7462 - DNA, 201 bp, Bos taurus
attctcctccagaggggtcctctacaccagcatctttctcttagtggcactcacattcccatttccctaaaaatgatcacatcacctgactcttctttaccttcatttccaatattcattctactttatctaagaggttcccactatggactgctttcctgctgtctctcctctcccacagtccccagtccaataacctgg

SEQ ID NO: 7463 - DNA, 201 bp, Bos taurus
tcagctatctgtgaagaggagccttccatcgggcatgtactcaatgttggttgattttaagtaatccctagctaaatatcaccttttgtaaggagcctagacaccttggatttaagctgagtaaccatactttgttgaggtatcagactggcccctagtgaaggaaacagtgaggtcaaaggccccagagaggagcattcc

SEQ ID NO: 7464 - DNA, 201 bp, Bos taurus
aaggatttaaccacatagggatcgaataagggcccctcggtgagggtgtagctgaagaccggagacaacgaggagaaacacagctgtcgagctggagactggggtgcagcgcccccaggcctgggcggcctgcgcgctgaggtcacgggcgccggctccggtgacgtcatcacggccgcgctgttcgccgggctggagctt

SEQ ID NO: 7465 - DNA, 201 bp, Bos taurus
atactgcatgctggatatcgtcatatccccagttctcacactggaggatctgcttgcatgcatatatggacacccagtctgtgaatctaagctctgtcctaaaaatccctggagtcaccctcagtctgatgcttgggctgagggatatgccctttggtggtgtggttgcttcttaggtgacagatctgaagaatatgtcta

SEQ ID NO: 7466 - DNA, 201 bp, Bos taurus
aaatctctatggtttatacagttaaaatagagaggaaaatatcaagaagaacatttgaaagtataaatagatcaggggccagaagtggactttgcttgttctaaattagttgagaaccagcctttgtgggtttttaaagaaaagtactgggggcaatgacactggcccatgtcctcagcccctctccatgcagctctggtc

SEQ ID NO: 7467 - DNA, 201 bp, Bos taurus
ccacctgattcgttaagtttcttccaaagtcagaagagatattacaaaaaaaaaattctttcagctgttaagaaagagctctctgaagataatatggaagggccaagatcttccaggatgctaataaataaattgcaagcaaggagaattacagaaaaaaaaatctttgaaaagccaaacttttcaaccttgaaaaatgtt

SEQ ID NO: 7468 - DNA, 201 bp, Bos taurus
taattctacccaaaataccagggaagactttcagaggagatgccttttgaagagagcattcccaggaaagccagtggcctctcccagaggtccaggctgttcaaatacaacagaaatactggacctggaaaggctgatgtttaaagcttcaacagccacagggcctctgaaataaagtcaacaagaaatggtgttacaggg

SEQ ID NO: 7469 - DNA, 201 bp, Bos taurus
gctcatggccactagaggactctcctcaacaggaaggaagtgctgaaggtaaggctgtgacatttctatccaaacctttgcctcctcttgattctcactgctcattctggcccttaattttccaatggccttgttcccagtgatttcaaattcattttgatctacattaatcctgcaatagatgttcagaagaaaaaaata

SEQ ID NO: 7470 - DNA, 201 bp, Bos taurus
tatgacgacggagcagctgcctaggggagctggaggcgatatgaatcttgtcacaagcataagggagccagcccttcaaggtgtgggagggtgcctacgtgggggagagggctggccatgggctgtgatccctgaggaggccaagatttctagatttcagcacctgtttcaagatgcttgatagggtgacgttggtgggta

SEQ ID NO: 7471 - DNA, 201 bp, Bos taurus
aagccagagtcatcccagatacgaggcccatgtcagctgcacactcctgtcagcacattaagggcagctgggaaagagcccatgtttgatggccttggcttcagcttcagtctgagtccttcctgagtccattcccctgactagctgcccatgcctatgtggatgtctattcatttaaccagaagtagctccacctcgcca

SEQ ID NO: 7472 - DNA, 201 bp, Bos taurus
aaagccttttgataactcctggggcctacagaaaaacccaaacctgtcatcaacagcacactactccctagcacttcctcaaggaagtctcagcacctttgagaccctttctcactgtgttccaaaaacaccagaatgccagaattctctgaacaagtctctgcactaacagtgacaggtaacacagggtctgtttgctaa

SEQ ID NO: 7473 - DNA, 201 bp, Bos taurus
agatttcagtgtttcattttgccttatcagtgaggatgctgtttatgatgcaagggcatcaagacttacgggctagaggaacaccactcatactctcctcttctccctcacttctcagtggtctgagtctgcagcaagctgctgtgcatcttgggtgatcataggaggactgggaagtcccatctgagaaccaaagtgaga

SEQ ID NO: 7474 - DNA, 201 bp, Bos taurus
tatatataaaatatcctctggcttcctggatatttaaaaatccacaaagcaattattcaaaagttagcagtggctatcactacttagtgggagttcaaataacttttatattcttcttcatacttttctaaattttctgaattttttaaagcatgtactattattagaataagagggaaaatttttaacttatttttattt

SEQ ID NO: 7475 - DNA, 201 bp, Bos taurus
attgagtgggagtgatccctttaacctgtggcatttgatactaactctaggtagatagtgtcaaaattgagttaaattgttgttgctggagtattggaccgtgtaaggggaaaaaaatccacacgtttggaggccagaagtgaagtcttaagagtagtgtgtgtggagagaaggaaaacaatatctttttcctttcaaagc

SEQ ID NO: 7476 - DNA, 201 bp, Bos taurus
ggcgatgtgcacggcccctcgcagatcataaagggctgcgaagtgaggataactgtcctctaatccactaatcaatctcagagatcctgctctgccagcacctggcctccagccgaggggaggaggggggtgtgtggggcgcagtgagcagatgaccgtgtgaacaaacaaaatgcgatagagtcctttccttaaaaatga

SEQ ID NO: 7477 - DNA, 201 bp, Bos taurus
gcatttccctcgatgacgggtacctgagagtgagcagaaatgcggggttcagggcccagtgctgtttctggggtgacctagttctggaggcctccacaggttgagaaacttacccgggtgtatggatctggagtttaaaggtaaacacaattccgtcatgctggctcttatgtacgcacagtagtactgtgtgtgcgctca

SEQ ID NO: 7478 - DNA, 201 bp, Bos taurus
ctctgctggccagtcctatgttctttgtaagttttacaccgagaacaaaaacaccactgtggaaacagatttgggtttttcccctgcaaagtttattgggatttttccgtttaatgcttccaaatctatgacagtctttcaattttgtaaccacatttttattctggtgctttcttttccttcaaagttataattgaaaac

SEQ ID NO: 7479 - DNA, 201 bp, Bos taurus
ttatagatgagctccacaattagttaactttaaataaaggagttgaaagaactttaaggctgtacagggttgacacgactgaaacagctttgcacacacacgtgtgacttccctgagagaacaattctgcctttggaaattaccttcagccagtgcctgagagttccagcctacccagtctgacagcctgctcaggatttc

SEQ ID NO: 7480 - DNA, 201 bp, Bos taurus
gccttggccaagttctctaacctgtgtgagcctgtttccttatctgtaaatgtgatcctacccgatttcaaggtggctttaagaatgcagtcagacattgtgtgtaagcacttagcacagtgcctgtggtcagcgttcagtaggtggtttttattgtttttattaataccaatgaggctgctgtagaagcacaagggagag

SEQ ID NO: 7481 - DNA, 201 bp, Bos taurus
tgagttgagccatataaatcctgaagctcttacattggcctacaaggccctacattctctgcatccctgctgaaccccctttcttatcattctcccctcactcaccttcgccacactggccttggcgtttcttgaacatcaaaggtatactcctgcctcagggcctttgcacttgctgctgctcccttgaactagaatgca

SEQ ID NO: 7482 - DNA, 201 bp, Bos taurus
ttctttccatctgggtgcaaaggcggccgacagaacccctgtgtttacggagcaagtgagctggaaatgacttctactttccatttaggaccagcacaccctggcccacaaaacagattttgctgcttgataaaatgaatctgaggggacattatcgctgttttaccaaagcagtcatagctgacgaacatggacaacaac

SEQ ID NO: 7483 - DNA, 201 bp, Bos taurus
ctgttttttgctccaggcctctgtccttcgggctgtggaggacagtagtagcaggtaggaggcttggacaaaagctgcatgtatctcactctggctgaactccacttctgggccccatctctccacctgccctcttcagttaggagaccagaacccagaacacaagtgttcacaagtgggctctggattccagagttgcag

SEQ ID NO: 7484 - DNA, 201 bp, Bos taurus
aagttcatgtgactcactttattgacatacttgctttgttgtgccgtctggagcccagccggagacatctctgaggcctggctgtgtttgaaaagactcatcgtggtcaccgtgtggaatgagtgctgtgtaggttccagggcagtggcaggcgggcgccttaggcactgctgaagattcaagtcaaagatggtggcctta

SEQ ID NO: 7485 - DNA, 201 bp, Bos taurus
tcaacatttaaccatagctttttcaaaacatcatcctccaaggaggtctgaatcagtttagcagcagccagacccttgacagctagtgaggcccttggacggatccatgagctgctctgaccgcctccccgccctgccacctggcttctgatgccagcagcctcctccggccctgtgtgaggcccttcaggggggaagtgg

SEQ ID NO: 7486 - DNA, 201 bp, Bos taurus
agaccactacaggtaatggaaaccccatggagtgttctcaaccagaaagctcctttaagatgtccttcaaaagagagactaaagttctgaagactctgtcagtgatcatgggggtgttcgtgtgctgctggctccctttcttcatcttgaactgcatggtgcccttctgtgggtctggagagaccaagcccttctgcatcg

SEQ ID NO: 7487 - DNA, 201 bp, Bos taurus
cgtgcacgtagtgttcatcagctatgaatctcagagttttacaggcatccctgccataatcctcctctgaaatgaaaagtactttgttcaatgtaggaagctgctcagataattaagagctgcatgaacatgaaatattgataattatattgtgcccatctgagaaagtattacatgttaccattaagaacccataccaag

SEQ ID NO: 7488 - DNA, 201 bp, Bos taurus
tgcatgcttttaaagtgctaattcctgggcatcctctggacgtttcactctctgaatgttttaaatcttggatcctgggggccagaaccagaatttgcatgtttacaagtgctacaagtcgatttttatatgaatcttcttcagaacatgaactgagaaatatcgaggaaatgccagaacttttctgaaccacatttaagg

SEQ ID NO: 7489 - DNA, 201 bp, Bos taurus
cctggtcaggatcaggtctaggggactttggagtctcgctcttgcatttaaatcccagggcagcatgtcattctggtcactctgcactgctgcagtgagtctcttttcttacctgaaaataagagatggtaacacactccctttgtactagacatcccgaggcctctgtgctttgttcaggaatgggaaaacgacaaaata

SEQ ID NO: 7490 - DNA, 201 bp, Bos taurus
tggttaagttataagtcaggaacctagggaattgttttcccattgaaattcttctaaattcatgtgtttaacaagtatttattgagaatagagtatgtccgtagagtactgtttctttatatcatggtgttagtttccgctgctcagcagagtgaatcagctattgtgctaagtcgcttcagtcgtgtctgactctgtgcg

SEQ ID NO: 7491 - DNA, 201 bp, Bos taurus
atgtgggcggtaattcatcatggcggccacaggaaaccaatataggtgcctgggagggatgccccgaaggatggagcagctgcacgtggcctcttcgcacggctttggctgctcatagggtggtgactactttctgtgatggagcttcctgagagcaagtgtcccaggcctatgagatcaaggcagaagctgcaaggtttc

SEQ ID NO: 7492 - DNA, 201 bp, Bos taurus
aagtgaggaagcagaggcctagttatcaatagatgctgtctcactcctcaccttcccccactacatgcgcctttgtatttccagctgcttctcttcaaggaactgggcagagggggccgtctgctgccccgccccccaggtccctcagaaggcactcagtccatctggctccactgcccccttagctgaggctgttctgcc

SEQ ID NO: 7493 - DNA, 201 bp, Bos taurus
cagaaggcccaggacccagatcctcccatcgtgcacacacactagtccctggagcccagttctacccacgaatgggtggggaccagccccagaaacccctgggcctaagccctgtctatcagcaagtctgctctagccttgggaatagcctcagccgctggcaggtggatgccaacccctggacaattacagctccacagc

SEQ ID NO: 7494 - DNA, 201 bp, Bos taurus
gtgttcttagcgatgtctgcttatgctcaaagatcattatgcctgcctaaatgtctcccgctgtatgtttaataatttatcccagatttttctaagtaaccacagtaagctgatcatcttaaattcacaaattctactttttccacacacttaaaagaatgtatttaagtgttgttgctgttgttgtttagttagtaagtc

SEQ ID NO: 7495 - DNA, 201 bp, Bos taurus
attaactgttgactaccttttcatatgctcattacccatttggatatgttctttatgaagtaccagatcaagtctcttggccttttttttttttcatttgcactgtgtaaacttttctcattaatttgtaagaccctccctgtctttatgacataaaatgttgtcaagttatttctcctcaactggccacatggttaataa

SEQ ID NO: 7496 - DNA, 201 bp, Bos taurus
ttcagatttcccccaatacctcatatgtctagttttatatcatttggtcaaatgcttcctccatgccttcatagctgcaggtcatgctgcttttaagcttcatttttgatgcctctggttgtaagatgactgcctctactacagtatatatatgtgtgtgtgtgcatgctcagtcatgtctgactcttttgaccccatgga

SEQ ID NO: 7497 - DNA, 201 bp, Bos taurus
tgggggactggggtggggggtgggggtggggggttggtaacctaaaatcttttctacctgtccctagctaaccccagggcctcaagcccactgttctccctgagtttcctgatattgtttctgccctgcggtatcttgggttcatatcaggcccagaatagaaaggaagataaatgataagggtgtgaataccctcagggg

SEQ ID NO: 7498 - DNA, 201 bp, Bos taurus
ggacacaactgagcgactgaactgaactgaactgaatgtgttaaagtatttcctagatcataccaaatattgtgctttttgataaacaccatgtagaacatcaacaagaaacagaaagtccatggagatcttaagctaagggctctatataaagcacatgagtagggtaccactcccaccttttggtaacatggtttaatt

SEQ ID NO: 7499 - DNA, 201 bp, Bos taurus
aggatattaaatgcagtttcctgtgctatacagtagggccttgctgttgatcccgtaattataatttttgatgcacctggctcttctgctaaaccattagcgccttgagggccatcaccatgtttctatttgaatacgtttgttcttatttttgccactgtgtctgataaaatccacacatcattttttcccacaaattga

SEQ ID NO: 7500 - DNA, 201 bp, Bos taurus
cggcagacgtactcttcgtgtgtgtgcttccgttcaagatcagctactacttctccggaagcgactggaggttcgggtctgccatgtgccgcttcgtcacggcggccttctacgggaacatgtacgcctccatcatgctcatgacggccatcagcgtcgaccgcttcctggccgtggtgtaccccatccagtccctctcct

SEQ ID NO: 7501 - DNA, 201 bp, Bos taurus
tgggcctgtttttccttggaggagtgtggcagaccaaggacactcggcccacacctgaacctgggcagacgctcctgactcagagaccaagcacttcctccaggtaaagaggttctgggccccacatcctgtgcggtaaagataaggagaagtgcgggggtctgagaacacggaactgtgtcacggcatagctcctggggt

SEQ ID NO: 7502 - DNA, 201 bp, Bos taurus
actccgggagttggtgatggacagggaggcctggcgtgttgcaattcatggggtcgcaaagagtcggacacgactgagcgactaaactgaactgaactgagcatttcatggtgtagatgtactttgtagttttacatctgtattacttcctgatttttgtcttcacaaagccagctaagatcgtgtttcctggcttctgct

SEQ ID NO: 7503 - DNA, 201 bp, Bos taurus
aaggaagtttcggtcctttcaaagttaccaaagaatggccatggctccaaatgctctaggttcacggggccggtggcctcttttccaaaggcggtcagaggaaaacccccgcctgcgcggatcccacaaaacgccaccagcagaggaggccgccggagaggatcatgagcatgttctggttctgcttctcaagaccctgca

SEQ ID NO: 7504 - DNA, 201 bp, Bos taurus
aaagttcaataagagaaaactctcgctgtcagcagttctttgctggtcatcactgttgttcgttccaattcatgattattcaagacaggaatttcagtgcagtaggggagcgtcagctgcagccctggtgagctggggcctgggcagagccagccctgggcagtggtcagctcacaccccaccccgccaagcagacagagt

SEQ ID NO: 7505 - DNA, 201 bp, Bos taurus
acgttaatttacaagctgattttgtccaaaatcacaagtatcctatatctgaatcttttaaatgctacaaatgcctttaaaagtagaaacatatatactgcattattgaaatgattacaacactattgtatttatacttatgctattataaagtacttgcacactttatttctcctttctcactatacttttatgagtatt

SEQ ID NO: 7506 - DNA, 201 bp, Bos taurus
gtctggcagctaatagttattgagtaatttgcattttagacactctgctaaagactttgtagattagccatttaatcctcaaagtcacccaaggggtactgtggcttccaacttggagatgaagaaacggcacgttcaggagattagacagttgcccagggccccctggcaggtaggtgtccagccgcatgcagtcccagg

SEQ ID NO: 7507 - DNA, 201 bp, Bos taurus
gcgcccccccacctactcttccttccacctggggactcttgcttgcctgacccaggtcaggcttccccctgtgctgtttgcctggccaccctctccccctttctcctactgagtgcacttagctcttctgaaaaccccctggaggaaggaaatggccacccactctgccagtctatcctgtagattggcaggctacagtcc

SEQ ID NO: 7508 - DNA, 201 bp, Bos taurus
gtgcggggaaggatgctacttattattcaggcacaacttggccatggtcttgttaacagatagagccaccacttccaaacacaaccatcaacacttgttcgagagatgggataaggaccccggcctctcaaggaatggctgtgttcctctgcacagggcaagtgacctacattctcatccaagtttttaaattatcaaaat

SEQ ID NO: 7509 - DNA, 201 bp, Bos taurus
aaggccataatcacaggcatctgaaactggatctccagctacagggtagaacaccacataattccaaaaggctcctggcccaaccatatttggtttcttgtctctcttgctttctttaaaattgcgctgagccttcaatttgcagaaagcgtgattagcatgggaagaaggcggcccgtaccatcctcaccacacaggccc

SEQ ID NO: 7510 - DNA, 201 bp, Bos taurus
aagcagcaagagtgtcatcagagttcttgttctctcgcagcgtccattgtcttcctccgcacgaatggaggaaaatgaggccaaaggcagctctaacctacagctccctatgggaaaaaacgtctccttttcccatagggcaaaactgaggtcttgcctactgctttaatatatcaggaaaacctctgattggcccagctt

SEQ ID NO: 7511 - DNA, 201 bp, Bos taurus
gcctccaatcttagagtatcaacagtgcttccaccccagggttagaagggtccagaaggaacactgggctcagttattcataatatctgccacaggcttgggagtgagttagaagcattttggccagctgcctgccagcccaggcgtgggatacaggctggtaacaggggtcattagttctagcactgtttctttccattc

SEQ ID NO: 7512 - DNA, 201 bp, Bos taurus
cagagccatgagcagcaactctgcagctctttggtaccgggcatttggccacacttgctgtctgcaggcttttgcccctgggctccagctctgacagccacgtcctggcaacctgtctgtgaggcctggggcctgccttgctcccccctcagcaggcctgtgggcctggccctgaaccccatcccactgatgtacacctta

SEQ ID NO: 7513 - DNA, 201 bp, Bos taurus
aattgtatgtccggcgaatctaaacttctcttgatcaggggaagggacctctgtgttgggtcaggtgagtgggaagggccatgagttggatgaggttatagagagtttggggagttattttcagagaaacagtttactaaaaaggaagaataaagtctctttaaagaccatgatctctgctgtcatttggcctgggctgca

SEQ ID NO: 7514 - DNA, 201 bp, Bos taurus
cacacctgtgaccagacaaacggtccggctcagccattggctggtgctgcagtgggccacgcccacaagcagccagctgttaatgaggggccgttaatgaagtgatcccgacaatggtcagggtagtggtgaccagtggtcaggtggagagtgaggtaagggccagatcctggccttctccctggggccctcaggtctgtt

SEQ ID NO: 7515 - DNA, 201 bp, Bos taurus
cttcatttatataaaagattatatactcctctggggcccctacaaagcaccaaccttaatcttcaaggtagcttggaaaataagtcatggttttgttattttggggccaaaacattctgaagagattgatcacaagctcctggagccaagtctggtgaataaatacactagggttgactccaggagctaatgggtcgtttc

SEQ ID NO: 7516 - DNA, 201 bp, Bos taurus
agctacccagatatactgtgtaattctgtactttggcagatttaacccattcctccctagaagaaattagagagattgaaataagtaattgctttcctgtcatgtaagaaaatacacctgcttcaggtgtattgagcagttctagctctgccacagttaactaatttttgtgcttttggccaagtaattctacctcgctgg

SEQ ID NO: 7517 - DNA, 201 bp, Bos taurus
tctgtttctactgattctgcttttgtgtcagagtattcagccccacaggattggaactatgaactagagaagcaagaagctgagccagtttctttacctcatgtgaaagctgtatctgaacatgcagttttgtcagaagaagaggacgataaatttgagccttcttccccaacttcagcttctatatttgtctcaccctcc

SEQ ID NO: 7518 - DNA, 201 bp, Bos taurus
gctattgcttttgatgagagaatctttacacacaggtttatttgtatctatttaatagcagtttttttttttttttttgctgcagttcctctggagagtctatatttgctagattgaattttagaaccctagcacagttgattgcacaaccaggctgaagtattgttccagagaaccacacagaaagccgaaaccttcagg

SEQ ID NO: 7519 - DNA, 201 bp, Bos taurus
gggaagggccagctcgaaagtcagagttggatgctagaccctagcaggaagaaaacacaacaaaaccagctaccgacagcaccccagctcttgacctgcccgtcctcgtgatctttgtaaagccagtctcgcttacccagagcctgtcactgaaccagccactgcagtggcccctgccaggtctgctgtgacacacgccac

SEQ ID NO: 7520 - DNA, 201 bp, Bos taurus
gacccagcacagccaaaaagaaactcattttacaaaacaatgataccctctgcaaaagaaagacacccaaaacataagacagaaaagtttaaagtaaaaaaatgttaaactatatacattttgcaaatataaccaaaagatagctagcatggcatattaatatgagaggaaaaaaaaaacctttaaggcaaaaagccctac

SEQ ID NO: 7521 - DNA, 201 bp, Bos taurus
actctgattttttttcaagttgcttaaaaatgattttatacaattaaattgaggtgttttgatttataattcaataagttccagattaatactgaagatacatatctaattttgttctcacctgaaactccgctaagacaatagtaaagggattttcttaaaatagataaacctataaatgtgagtagaatgggaaatgat

SEQ ID NO: 7522 - DNA, 201 bp, Bos taurus
gtctttgtcttacacatcaatgtatattcacatctcctggcacatattaactactaactatgaagtacttgtttaatgaggaaatgaatgaacacttataacaagttggcagcttatgtttcagcctttctgcctcttagtgggaatcatctagggatggccaactggctatatcattaaaatcagcctgttttggcaaag

SEQ ID NO: 7523 - DNA, 201 bp, Bos taurus
actgaactgaaggctacatatgaagagggagaaagatcccttaccgatcattctctggaaacagacctgccagtggtcacttgatcttagtcaaattaagggaaatgtacagtgaggaagtcagagggctcagatgccaatcacgacaagcaaaacctcaggaaagatgtaagagtctgggccatctgcacttaccgtgtg

SEQ ID NO: 7524 - DNA, 201 bp, Bos taurus
acgtggtcggggagatgaagataaagtcatccagtggccctcgggcccacaccttagagcctggcctctgactgctcactgggagaaggcccaccaggcaagtggtccgtctgtgtctggaaacacagcgttcctgatgcagtgagattcttccagcccaaagggaggccaatgcgctgtgctgcccccagctaatcttca

SEQ ID NO: 7525 - DNA, 201 bp, Bos taurus
cctgagtccctgctccacactccctaagcccatcaatgcaggtatcttcaaagcaaggctctctggaaccaaatatatattgtacaattcatcttttattgctacttgtcctgcagctcaccagaaaatggtggagatttataagaaaagggcacacagacctgtggggttatgtgagcctgaccatgtcagattctgagg

SEQ ID NO: 7526 - DNA, 201 bp, Bos taurus
ttaaatactattacttgttaacatttgtattaaatcactgatactttactaattcatactagtttcaccagccatctgcccaaaattatgaatatatagtaacagcatattttattacatgtaatacattttatgccatagtttctgaactcattatgttctcatggttcatcctgaatatacagtacaatattctgatgt

SEQ ID NO: 7527 - DNA, 201 bp, Bos taurus
gagagctctgaggcccccaccagctcttgcaaggtttgataagatgctgacaatgactacaacagaaaggagagaacagaagaaatgacagctccaaagattctcaccagaggttaggccagaagccagaaaagtcacttgaccaccaagactggataaggagagcaaggtagacaggagaggaaggcgcgcgggaggtaa

SEQ ID NO: 7528 - DNA, 201 bp, Bos taurus
caaggccctggagagacacctcaccagcagtccttacttctgggaaaggaagtaggttaccagttacagacagaattgacatcagatcagtttgtcggtcgccagagaaacctgcagaggcccacgccttgcactgcccctttaataaatcaccttggtggagcagttctgatgggaatattacaacaagcgccagctggg

SEQ ID NO: 7529 - DNA, 201 bp, Bos taurus
ctgtcacggtgagcctggccccgtggctgacccggacactggcgatgtttgaggccacacagtggaagacaccgctgtcctcagctcgaaggcctgtgatttgcaggactcccttgggcagcagcgtgtacctgtggtggggggcacggtcaaccaccagcacagcaccactggcccaaggacactcagcatcacggacac

SEQ ID NO: 7530 - DNA, 201 bp, Bos taurus
aacgactcaatattacaatcagaaaaacgaagtccagagagggtgactgacttgcccagttatgcaggacaccggtgtccaggcaagggcctttgcaccatgcctcacagcttctcaagagcatcagaagaggtcaggctgtggagtactgatttccacctacttctgcaccctggcatacttacagatgacctgcctggt

SEQ ID NO: 7531 - DNA, 201 bp, Bos taurus
tggcagtgtggccatgtttttgtctgtgcttgcacagaattatgaaatggctttatctcattttatcaaggtattctgttcttgtgtaatagcagagtaacgtgtcctagctgtgaatgccaggccagcttttgaatgtcaggggctgctcctttttaaaaacttcccaattaattgctccacgcatggcctgtggaactg

SEQ ID NO: 7532 - DNA, 201 bp, Bos taurus
gaaatttgcaggcaggcagggcatcaaaacatgtaactcccatcgagtctttctcactaaaccactgaaatctgtgattcaccataacaaggaaataaacgaagagggaagttactgaagccagaaagctggggatccaactctgaagagaggtcagtacaattcccaagatgatggtgaaggaaaatcctaggatgacag

SEQ ID NO: 7533 - DNA, 201 bp, Bos taurus
ttcatcagccacagctgattggaccagacacagacatctgcctcaaactggactttttcccagggtttagaatgggatcacagaaccatgagtgaatatacgaatttaagagttagaggactcgctcagccatgcgcagtggtaaaagacaacatgcagagacagaaaaatgaagcagacaagctgggggaagcagaagag

SEQ ID NO: 7534 - DNA, 201 bp, Bos taurus
tggaaaaaaattttcaggatgctttaagtagtaatcagttgtcgagaggtcaggcgaatatggcagatgaggctaaagttccgtggcccaatttgttcaacttctgcagcgtttggttgtgcgatatgcggttgtgctttgtcatggagaagaattgggcccatcctgttgactgatgctggcttcaggcattgcagtttt

SEQ ID NO: 7535 - DNA, 201 bp, Bos taurus
gaactttgtcttccgtgagtgttttaccttcaacatcaagataaaagtttctgtgccattgagtgccaccaatccctgatttggatggtgggggaggagattgggtagatatttcacatatttgtgaaatgttttatcactaagtttgcatttatgtgcaattaggtcagtatggaaagtggtttttcagatactggatca

SEQ ID NO: 7536 - DNA, 201 bp, Bos taurus
ttatcaagagatactgagattgagaaagagagaggagacagaactgactggaacttttagaggaattcacttttgtgattgtggaagcctgttaaggccagaagcttcagggtaggctggcaggctggagacccatgaaagagttgcactataagtccaaaggcagtccgctggaagaagaattctactgctggtaaggcc

SEQ ID NO: 7537 - DNA, 201 bp, Bos taurus
gacagatgtcttcatggagagctcactccttgcccagccgacgaggaggagtcactagaaggacttctgctctggtgagcagagtgtgtatgcaggcagctgggcctggccgctctgcatttcagactcgtgttgtttgtgggtcttgtccagaaagaatcctgaaagaattcactgtaaggccaacctggaaatggacct

SEQ ID NO: 7538 - DNA, 201 bp, Bos taurus
aggagaacttgccgagggattggacaggtggccttggcaggtggggatcttggcttgtgagtcatggacgggtgatgcacagatctgagctctgaatgacgtgatgtcaccaatactggcctcctgtcacgagagcaggggctgctgctgcttcctgtttgtgggtcctgtaagacccagctaaatgcgcagtccatagtg

SEQ ID NO: 7539 - DNA, 201 bp, Bos taurus
tgtgtcatcctagaccccagcatagagtggggttttgtgatattgaaagaggtgacttggaatgccatttgagaggctctaggaagagatcccaggccctccactccaccatccccctaactccctgggagtcacagtctagaattccaccgagagaggcacatgccttgacattctcttcatgagagtaaatcacaggat

SEQ ID NO: 7540 - DNA, 201 bp, Bos taurus
cagcaacaacaggaaccatttttggggactgagaatttcaaacaagatgctatcctagaagtctctgcccagagcctggcctagagcagacctgcaaaggatattggtccccacaccctcagctgtcaggtgggggcaatgtccgagctgcgggttcctaggggtggccctggggcaggcattttaaataattttgactgg

SEQ ID NO: 7541 - DNA, 201 bp, Bos taurus
agagcccctggcagacccagcagggccctcagatcttgacagctcggctccttcatttcacagaggaggaagccatgtgccccaaagcagaagtggtagtagggctaccctcagggtcaggccgtggttccctgagccccagccccgtgcagccctcactgcacagagtggctgtccccttctgatcattaggaagtcacc

SEQ ID NO: 7542 - DNA, 201 bp, Bos taurus
cacctgcttgccttcctgtcgctgtgtcttcgcaaagcatcccgtctgaagcaaggtacctcccttggctatactaaaggccccccaaatgttggataaccagatttttttttttaaaccctgacccaacctcactcagttaaaggttcagtaagtctgtcttttcgtcagcatgggtggaagccaggctcctggccccga

SEQ ID NO: 7543 - DNA, 201 bp, Bos taurus
cctaagctgaaggcccggtggtgaggattggagatttcagggagtggagccaggcgcaaaggactatcaggaaacaagcaactctctggagctggagccccgtgggtgcagggacaatggagggaccagcccagtgttgctttttggaaaagcgatagcttggttttctgaaggctgatgttgtgtgggtccgcacacacc

SEQ ID NO: 7544 - DNA, 201 bp, Bos taurus
aagggtggccattgaagggtggccttagaagggccctttctgtgcactaagcagagatgagaaaggcagatcgtcccatctgtaggaaacagagacatgtttagtgactggggccgagtttactgaagattcacccagagaaataactttctaaaatgaaggtctcccagagccacctccagagattctgatactggaagt

SEQ ID NO: 7545 - DNA, 201 bp, Bos taurus
ggctgtgaccgctagaaacacctggggccaggtcaaaggcgaaaagcgattctatattataggggcacgggcatcttaaggaatctaggtaccagggtgcgtctgggccttggggaacagacgagaccaggacctggactcagagaatcccggaagccacctccctccaactctgcttctgttccatccctttctctctct

SEQ ID NO: 7546 - DNA, 201 bp, Bos taurus
gatgctgctggtctgggggcccccactttgagaacacagacacgtcataggggcgacacattaacatacactaggactccttatttttctgatctttgcccgttggatactgaggccaggtgggctctcagtgttccctgtctgtgtctccaaggctggagctgtgcctgggtgtctggagtttctgggtggaggaattgg

SEQ ID NO: 7547 - DNA, 201 bp, Bos taurus
gaaaattttccagacataaggctaaacccagagttcttaatcttgacaccaaaggcatcatctataaaaggattaattgaccttcatcaaagtgaaaaacctgtgctctaccaaagtccgcatatatgacaaaaggctagtaactagtatgcataaagagctctcaaaattcaacaggaaaaaggaaaaggaaataagaaa

SEQ ID NO: 7548 - DNA, 201 bp, Bos taurus
tccagccccacctcaacaaaaaactggggcttggtcccttgcctggggcccctcctgcccttgcccactgcctgagcagctccaagtaaggcctccttctgaggcaggcaaagatagcactcccaagtactcccaccacacataagctcagacaccaagcaaggggggctggccccccctcgttccaacacctcaatcaag

SEQ ID NO: 7549 - DNA, 201 bp, Bos taurus
gggccttttccttggctttgggttcctctactttacattactcatacctgttaatcctgcatttaaacagtcctgttgctttgactccaagtgtcttagactggcctggcctggtccttctgtgcatctcagggcagccccgcccccgtgagccttctggaaaagctgcctctctttgggtgatttggaggacagctctcg

SEQ ID NO: 7550 - DNA, 201 bp, Bos taurus
tgaaaagttgttattaaattctgcacgtggccctgacctggatttaaagatttgcaggaagacaaattccaaacagatgcccattagggccctgacaaccgcagcttaaagataacatttacattctgccggggtttgtgtgtctctgctccctgctcagcccctcttcggcctccagtgggatcaataccttgactgagg

SEQ ID NO: 7551 - DNA, 201 bp, Bos taurus
aaagtggggagggcagcagcaggagcatcaccagtgtgttttaggaggaaaaagaaagtgagttcccgtctctctggttcatgatggccacggacctagttggaggcagacacagagccagtgacttccccgtctgccttacttaaagtcatctctcatctgcctctgaggttccctggaggagctcaagggagcagttgc

SEQ ID NO: 7552 - DNA, 201 bp, Bos taurus
tggaaaaccgcaggaacatcactgtaaaagactgctggcagtgacctccttgcccaggctcgggtgtgtttcagaagccaggccagaaaggagacacgcacgaaaagatttcagtgatgtgcctctgtgctggaagcagcggcagggaaggtccagtggctctgcagccaggagatccggctgagagcctgactgggccac

SEQ ID NO: 7553 - DNA, 201 bp, Bos taurus
aaaaatgaggccagacccagggcacacagagggtcaatgacctgcccaggacatgtcagcagtaggcaggtccgcaccaggaaaatgggaatgactctgggacgctggagccttaaagggcccgagcctcaacatgtaggagagggatgcaggggcagctgctgcaggttgggtgcagcttctggggctgggagggaatga

SEQ ID NO: 7554 - DNA, 201 bp, Bos taurus
aagtcacctgagtcaggagaatcattttattctttgattggaaagagccacctggacccacacaatagacaggtgagggcccagaaacctcagctaacacctgcttgtgatgatcatgaatgcggagctagccggtctcaccacaccgaggtgggacccatgctgatggtacagcaccctagggacccctgtctgggccct

SEQ ID NO: 7555 - DNA, 201 bp, Bos taurus
aaccatggtgagcttcctcctctttcatggaggaagccagcgtggctagtgtgactctgaagcagaaagagcaggcttaccagggctgtcagcagggccacaccaggtggtgagtcataggatacagtaaggcatttgcccttgatctgaggcagtgaggaggcttcagggctttcaaacatgtccgcatagtgaggaagg

SEQ ID NO: 7556 - DNA, 201 bp, Bos taurus
gggatattaaacgacttaagaggccaagcccaattctgacttctcatgacttcccaaagcagtgcgcttgtttcctactctgtaattcatgcttttgaaactggccctggttacctatcgcccaagacctttagcggcagtggaattctgtacacatttaagaacactcacccctctcccctcagcatcagttgcttaaaa

SEQ ID NO: 7557 - DNA, 201 bp, Bos taurus
gcaattaacagcgtctaatcagtcagttctcaatgccaaattcaccttccccatcttgagaaggggctgtgcaactcagaataagcacgtgtctcttccacatttaggtcgttaaaactgaaaacacagtggacatttctgcgtatttattgtgcttaaaactaatctatttgtgtcatttatttcctcttctgggttttg

SEQ ID NO: 7558 - DNA, 201 bp, Bos taurus
aaaaaaaaaaaagcacagagctgagtgaatgattaaatcagaccttacagtaaagtactgatattatgtactaatctcttgtgtcatcggctatggccccgctttcctgcactaaattgctgggctggactttcctcctagaatactctgggtccttaaacccagatctcttccactaggaaaacatcaggttgtgaaagg

SEQ ID NO: 7559 - DNA, 201 bp, Bos taurus
cgtgattttggaggctggcaagtcccaaggttagtagttgggaagctggagactcgggagagctgttggtgtagttctagtctgaaaggcaataggcttgaggcccaagaaaagctgttatttctgtttgtctctaaaggcagggaaaacctgatgtcccagctcaaggcagttaaacaggaggacttccttcttaccaca

SEQ ID NO: 7560 - DNA, 201 bp, Bos taurus
tctctgatatcactctccagcaggagtctctgcatctgaaatagctccacagagcctctgccagccacagagaggtgaaggcaaacccccggcctgcaacaaaagttaatgagaagtgacaagcactaaatgagaatgtgagctaaacccacacaagagtagctgggggagaagggcgtgctcccaacaccaagccacaga

SEQ ID NO: 7561 - DNA, 201 bp, Bos taurus
aatggtaggagaggaacctactgcaaattcatctttaaaatgttttgaggtcattaacagaaaattgagctcaccattgactctggagcatttgatggtagcaaactagccaggcagaggagtcctgaataaagtggaatttgtattcaaaactggagatcccagattccttctcccaccttctgtgaaggggcaaccaca

SEQ ID NO: 7562 - DNA, 201 bp, Bos taurus
gagacctaggaagggctgtatcagaggatagagtcaccagggttagccatggttctcagagacattcactttcagcttagaccttggaggactggtaagcgttgatctcctttcaggccaggggagcaagaacaaaaatcaagggcagagggacttcccaggatgtccagtggttaagaatccaagcttccactacggggg

SEQ ID NO: 7563 - DNA, 201 bp, Bos taurus
gctgggtgatggggtcactgaaatgctctgtactctttttatagctttttgtgagtcttaaatgaaaagttaaaacaataagaaggtaatgtgataggaaaatgggccagaatatttattcacttactgtgtgtacagtgttaaaatagtctgtgtgtgagagatacatgatgtgtttgatactccataatgttgaaagag

SEQ ID NO: 7564 - DNA, 201 bp, Bos taurus
aaccataccaagcccatagtgaaatcaaagttttcagcacatgcttttataactgacagtaaattagatcttaagggctgtttggagtgtatccaggccatgtgatgtctcctcttggagctcattgacttgaggcattaccaccatgttcacagatgcagtcagaagttgatcaacacttatatttaaagtctgagcagg

SEQ ID NO: 7565 - DNA, 201 bp, Bos taurus
ccctgcaccacccactctgtccccttaactccgtgatcctcccagaagcttcacactgtccccctccccctcaggctctaaggctaggccaacccctgccccagatgcacccagagatgagcccagctctgctgaggatgcatgtcacacccagaccaacagggggctttctgctctggcctgggcatgggggtggagtgg

SEQ ID NO: 7566 - DNA, 201 bp, Bos taurus
atactaatgcctggaccccatctcctgtgattctactgaattgatgctaggccagtgacaaagtactatttataagttccccaggtaattcttacgaacatgcaagattgataaaatgttggcctaaatgaatgctctgatttttaacttcagtttgttaaataaaacgcagagtctggtcaagaagtctgggacagaagt

SEQ ID NO: 7567 - DNA, 201 bp, Bos taurus
agggaatcttcccaacccagggatcaaacccacatctcttgcttctcctgtagagtgggcattccttattcaaagtggagttgagtaagatgtgacttgagggtgaggggtagagagagaaatcctgagatcagccactttcttgctaatgagtctagagcacattatgtgtagttttggtatatcctctagaggtttcta

SEQ ID NO: 7568 - DNA, 201 bp, Bos taurus
caagagaaggtggcccaagaggcagaaagaaaaccaggtgcataggttgtcgtggaagccaaaggagtgcttcaaaaaggaggaatgggaaagcaggaagtttgctgggaggccaaactgcaggaaggctgaaaggcagtccacaaccaggagaggatccatgcggcagtggcgagtctgaatccacagctgaagctctgc

SEQ ID NO: 7569 - DNA, 201 bp, Bos taurus
cagctgggaaagtaagatcccactgctgtgtgtggcccccaaaagaggcattagttggatcggctctagacctgagacattagggtctccttgcaaagacccccgagtggggccactgattatcgtgccgtaccttgtgttctctgggcttgggcttccggtgacataatgctctttttttgactcagggtggctccttgg

SEQ ID NO: 7570 - DNA, 201 bp, Bos taurus
acaggaattatagattttctccaagattcctcccttaaatgcaggactttagaaggtgctaaagcctgaggattaggccatacgaagctcagggcaagtagaggagggaatgtggaggctaaagagattctcctgccttgggctctgtgcacagaccatgtgaggcctgcccctctggctcctggacttcctctgggtgag

SEQ ID NO: 7571 - DNA, 201 bp, Bos taurus
ctttctttctgcctagattgtgatgattagagctgcagcagccattttgtgaccatgaggagaagcagagactgcagacctgacatctgtgaatcactaacacgatgccactacctacctctctggttgtgtgggggaaaaataacaacagactctgcatgtttaagttccatctctgtttctcttaactgaacataagtc

SEQ ID NO: 7572 - DNA, 201 bp, Bos taurus
agggtagagtctgacccacttggaactttttcctttgtgttcatagcattgtaaatctccatgagcatatatagcatttcccaaatctatttggccatgggtttttttttttttaagtagacccatgaatatcttaaaaggtgcaatttgggaatcgtcgatgtagaggtattcaaaggaggatggacaagattaaagttg

SEQ ID NO: 7573 - DNA, 201 bp, Bos taurus
gaatgttagcatgaggcctgccccgtgggtgtcagtggaaggaaaaggatatggcagtttagggtgaggcctcataggagggtaaatgggctttcaacacggaaagttctgttaaatcctgctttgctttttagaaaatattaatcctgtcatgtaaacacatctatgtaattgtatagcacatgtttttaatatgttggg

SEQ ID NO: 7574 - DNA, 201 bp, Bos taurus
cctggcagatcccacagctgtttgcagccccccgctgctctgcacacatggggcggtgcgcccagcttggtgcatgcctcagccgtgacgaggagagaaggcatcaggccagacactgggagaagcagcctgcaggcagtggggccccagagggatgccatctgggatccgcatggatgccgagtacctcccatggggcgt

SEQ ID NO: 7575 - DNA, 201 bp, Bos taurus
gacttagcagcagcagcagcaatacctgatttggataatggggccgggagttgttggcagtttttggtaggatggtcaggaaagatgttacttggaaatatgatatttaagcaaaggcctgaaaaagatcaaagaatgagtcatgtggatctaggatgagacaatttcagatagaacagtaattgtaaaatccctgagctt

SEQ ID NO: 7576 - DNA, 201 bp, Bos taurus
tcactctttattatatatatgagacttgtccttattattgtttgcatttgtagattgtctgttctcattttggaatatatcacaatttgcttagaagttgcattgttgatgatgtttgagttacttccaatttttagctattagaagtatactgctgtgaacatcttagtatatctcttttggtgaacacttgttggagaa

SEQ ID NO: 7577 - DNA, 201 bp, Bos taurus
tacggaatttatgactatgttcagccagtctcctaattgcacgttgtttcactgcagaactcagagcagcagcagtgggtaccggctggcacaagcagtccaggaggaaggacctcagtggcctggttagctcaggtagggcctatttccatattcagttttcatgtcaggaaaaacagtgatcccgaagaattttgtatc

SEQ ID NO: 7578 - DNA, 201 bp, Bos taurus
tgtgagaggcagatccggcccccactgactgagctgcccccgtctgggcctgagactcccggcttggaagaactgacagatttgatgcagaagtgctggagccatgagccccagaagaggccttccttccaaggtgtgctggccatccagctggcagtcgagataggcctgaatttgtcagcaggggcttttcccccggaa

SEQ ID NO: 7579 - DNA, 201 bp, Bos taurus
tgtcccctgctctctgtcaggccacctccccagtcctgactcccaggctgtccctgcctccacctccactcttctcacctggcctctccttggtccggccccattccctatatgtatataccgcagggcaaaagtgagtggaggggagtaaggtctagtgggcagatctacttacccagctgggcgggtgcagggttgggg

SEQ ID NO: 7580 - DNA, 201 bp, Bos taurus
agtacaattcaccaaaatttatgtcagaagaaacagaaaactatggataactccataacaataaaaaaattgaatcccacaaagaaaactccaggcccttgaattttgccagacatttacagaagaaataatgccaatcttacacagattcttccagaacatagagaacactttccaatccacttcataaggccagcataa

SEQ ID NO: 7581 - DNA, 201 bp, Bos taurus
ccaaagaaatagtgatttgtgacacttgttatgacccttcttctacacacacacatagaaatagcttggaaatcccatccacattttggaggccttactgcagggattccaatattgaaaactcccacatgccgcagatgggtgtggggctttccactactcggatccaggcatggctccgtacatggtggccaaatgcct

SEQ ID NO: 7582 - DNA, 201 bp, Bos taurus
tctgtggagaaacgatgctggccttggaaattaactcacaggaacactcctgggaaataagctcctcttagggggtcaggagacattcccctcctgaagatgcagtttctcagccgtttcactggcctggctctataatggccatgccaccatccttgtctactctccagccacagaggatggcagctccaggtttctggc

SEQ ID NO: 7583 - DNA, 201 bp, Bos taurus
gtcatgcagctgccatggggccagagcaggctgataggtgaagaacaggtatagacacatgagagatccaggcatggatgtaagggaagggcctagaagaaggacagtggtaggaaacgtgagtgggtcacccagagcagctccagagaacagcctaaatgctgacacccggccaaggcagtccacacccacccggctatt

SEQ ID NO: 7584 - DNA, 201 bp, Bos taurus
ccctggacgcggagacgcgcagccgcaacgaggccctgcgggtgaagaagaagatggagggtgacctcaacgagatggaaatccagctcagccatgccaaccgcttggccgccgaggcccagaagcaagtcaagagcctccagagcttactgaaggtacacggtgacttttggaagcaggaagttgcctcatccagagagg

SEQ ID NO: 7585 - DNA, 201 bp, Bos taurus
caggtgacagcgactctgatccacaggtcaacctgctgttccccatcatctacttgctgttctgggctttcctgctggtcttcagcctgtggtcagagcccgtggtgtgtggcatcggcctggccatcatggtgacaggggtgccagtctacttcctgggtatttactggcagcacaagcccaggtgtttcaataagttca

SEQ ID NO: 7586 - DNA, 201 bp, Bos taurus
gcttaaatgtaatctgaagtgaaaatgaggaatgtcctgaaatagatgtaggtttaaaaatcaaataaagatttagaatgaagaaggtggccagtctgttcagtgctttgagtcatcagtaggactatgcctgtagctataattgatgaggggaaagagagggtaggtgaaaggaaagaggtgaaaaattagaaatgaatg

SEQ ID NO: 7587 - DNA, 201 bp, Bos taurus
accacagaaacctcaggatccaactcttcagcagaacgtgcaacacccaagttggctcttcccatgtccgccttcccagtgggagtatcttctagggccatctatctgaagtgtaggaaaactgatagtattttcttgccaaaaagtagatctcagctagaaagcttttcataaaaatatttattaaatgtattactgcat

SEQ ID NO: 7588 - DNA, 201 bp, Bos taurus
tcccaggttcacggccccgagagagagaaggagagagagaaaagagacaaggttaactcactgctgctccagatcatcggccatagtaaacaagccctgctgggtcgagctgagccagcccatccctccacctgacgccagcaccagctgaccgagaaaagcgtcggataacaaagtggggcgtggccagcgccgcggccg

SEQ ID NO: 7589 - DNA, 201 bp, Bos taurus
ctgatgcagccccacaccagggccttggctcagacagcagagctcaggctgaattttagtccatttagatgaatttttgctcccttggctgagagtccttgtgtcagacaaaacctaggggtggtggctctggccaaattcagtccatgctttttttgttttttaataaatttattcattttaattggaggctaattactg

SEQ ID NO: 7590 - DNA, 201 bp, Bos taurus
agggaaacccatacgtgccagtccactttgatggggcggtgctcttacctgccacacccgtaccctcactgccacctccacacaggcttctctgacttgagggcaataactcaagttaggtttcttattcaacacacacacacacacacacacacacacacacacacacacacacacacaaccacatgattccctgacctg

SEQ ID NO: 7591 - DNA, 201 bp, Bos taurus
acaagatctgaaaatccccaggcttgtcagggacacacaaaccaaggacactactcttggacaaaacatggagagtcattcacctcttccttgggcccaattgggtcaaatattaactcacttgaatggattagagatttgttctaggaggcaaaacttgataaatgtggccttttgtccccaagttggctttttctgaca

SEQ ID NO: 7592 - DNA, 201 bp, Bos taurus
aaattcatgtccactgagttggtggtactatgtaatcatctcgtcctctgctgcccccttctccttttgccttcaatctctctcagtatcagatagagcacaggctcaattgccaggaagcatgtgggatcttccagatgaggaattgaactggtgtcccctgcattgcaaggtggatacttatcagctcctttttctatg

SEQ ID NO: 7593 - DNA, 201 bp, Bos taurus
accctgtcaccagcaatgaggttgaaagtataataattaccagtttgaaagatgcaaatttagtttttctcttctgtgtttggggctatataattattatatgatgactgtctattaatgcctcatattaaattctatttacaaatcctgtttttcttcttaaagtgatttacattgaaaacaccactgaataatccctag

SEQ ID NO: 7594 - DNA, 201 bp, Bos taurus
taatgaaccctactacactctagagcaaacatttgagcatctgtatgcccagaaacaagagaaagaacagcagactggcctgttccactgtggagctacaaccccctctccattttgtattcagaggttctttagttctgaattgtctgtgggacctacctggcctgggaaagctgtgtctaaaaatcagaattcaggtga

SEQ ID NO: 7595 - DNA, 201 bp, Bos taurus
ccgcccccagtgcacttcatagttgcctggtgtagcctagatgctagagccctgggatagggggagatggttgaagtaggaaatggggctggaggcagggcttcctctggcctctgtgggtccagctcttacactctcttctctttcctctttctatctgtagcgatccagcgaacttgggccatgagcctctcggactcc

SEQ ID NO: 7596 - DNA, 201 bp, Bos taurus
tgagtggcagtagggatggggctgcaaggatggctgagggctgtgggccagaggtgctctttggatgctatgggatgtgagctgggccgtctccctgacacggtgctcccataaccttcctgcagacagctggaagtgtgcctcggggaggtggagaactcgcagctgtttgtggggatcctgggctcccgctatggctat

SEQ ID NO: 7597 - DNA, 201 bp, Bos taurus
ggcagagaacctgaggggaagaattcaatcatagcaagaactcaagtagagaacactactgagtttacgagtgaggatgtataaggccagaacaatgtctaaaaatgtccctgtcccaacagtgttaacatcaatcgagagcctgttaaaatacaaattctcaggtcccacccctgcctagtgaatcagaaactctcagtg

SEQ ID NO: 7598 - DNA, 201 bp, Bos taurus
cccagtagagtagaaaatattactttttccagccccaaacttgtcagtgatggcatgagaattcatcagtcttttgccaatatgagccaactcagagtgccgttcaaggggaagtctattaaaaaaacagtgtggtggctgttacgtggatgatgttcctgggcctctagtgagtgctgtcaattatgggtttggggaaca

SEQ ID NO: 7599 - DNA, 201 bp, Bos taurus
ttcccctggttatcaaacttgcctgcacagacaccttcactcttgaggttctgatgctttcagatagcggtctaatggccatgtgctcctttgtgctcttgctggtctcctacacggtcatcctggtcagtgtgcggcggcgttcctcagcaggcatggccaaggcaagggccaccctgactgcccacatagccgtagtaa

SEQ ID NO: 7600 - DNA, 201 bp, Bos taurus
agactgaatctctacatctgtcttagttttcatattgctatccaagctcctgagagattatgaaaattatttttaaattatgtccctccctcaatcctgacagagtattagattagtggggatttagaaaaattttgatccaatgcagtcatttaaaagatagggaaacgaaatgttgctatgatgattatttttagaata

SEQ ID NO: 7601 - DNA, 201 bp, Bos taurus
tcagattttctctctttactgatggttgttggaaagaaggacttataaatgtaaccatctaagcagttaaacttggaaagcatatttgtcacagagaactgcaggtgttcacttaggttaaaataaaatgtttgtaattagaatgaaaatgtgttcactaaaaccataaaactactcactactcctgtgctaagtaaaccc

SEQ ID NO: 7602 - DNA, 201 bp, Bos taurus
tatggtgaaatccagatgattttgattaaatgtcttcacactccatagattttgattaaatgtcttcacactccactcatttctacctccttttaaaccaccagtgagtgagtaagaattgacagacaaaattcccagagatgatgctctaaaaatatccagtccagataacaagaagaaaaaattgaacttgatctatta

SEQ ID NO: 7603 - DNA, 201 bp, Bos taurus
ttccaaggaaatagtttcagttcacttttctgatgccatttacccatgtgaaaaggtacatgtttctattttgtgtttgaactgcccttttatctgtagagtttcacaggcttttgtatataatctggttgtattatgacttagaaatagcttaatttaggaaggctatcaaaggttaaaatagttacattattggcagat

SEQ ID NO: 7604 - DNA, 201 bp, Bos taurus
ttttataagtattaggggcaaatagggcaccaaatatttaatgagatttttgtctgcttgcattcctatcaaagactgtaattatctgctcaacccagaatattagcttaatttacattttccttcttactcacattctggtcgctgtctagattttttaaaaaacttaatccttttcccaagtatatttcaatagtttct

SEQ ID NO: 7605 - DNA, 201 bp, Bos taurus
agcatattgatttcaagatgcaaagagttgaatacattcattgttcaccagttggttatcttctttagtgaggatgctaatattctgcagagagagttaatagagaggttgctgtgaagggagccagctggcatttgcattgctaagaatagccttccgagattattttgagatagatcaatataaaaaacaaaataaacc

SEQ ID NO: 7606 - DNA, 201 bp, Bos taurus
atccccatactggctattactctctcaattttatttaactcctatggtcccatggcaaaagatttctctctttgttgtttatctttccaaaattggtacaggaaatttagcctgagtgacatttttgggagagccctggtagtgcttgcctttacggggcacagatactcaggatggagcagcatcatagtatctgcttac

SEQ ID NO: 7607 - DNA, 201 bp, Bos taurus
tgtccttggcattgtagagtagttaccagcatccctggcctctatgtactaacatgtcagtagtactctccaccccaccatggtcatgataacccaaaatatctccagagatggcccgatgtccctgaagggagaagtccccccactcgagagctaactttgcaggcaaggaccacatggtacttccatgaagaagctgcc

SEQ ID NO: 7608 - DNA, 201 bp, Bos taurus
ttaagaaattcgtggtaatttatcactgtctaataatcaatatgcttctatatatacctgtttatgcactttcaagatcttccttaatacactagaaaatcgtgccatgaaaccagaggagggaaaggatataccaaaaggatcccctaagtgctttttaaataaacggagaaaggacagcccaatacagtgtcacaggaa

SEQ ID NO: 7609 - DNA, 201 bp, Bos taurus
tggcctttatgacaccatgctggactcacccgtttagacgtgggcatcctcaccagactctaactccttgcaggtaggctctgtgtctacctgatgcatcttccttcatgagtggccaccagcagactcctagtatatattcattaaatgagtaacgctcccacacaggtggctacccaacatcagggaatctgcactacg

SEQ ID NO: 7610 - DNA, 201 bp, Bos taurus
gttcttacatgaaattgtgtatagaggaggtaattcacataataaacattcaatgttaattttagttaaaatgcaacatttatttaaatgatattgcctgaacacgtcctacatgccaggacttgtttgaggcattaaaatacatcagtgaatcaagggaaaaaagttcagccttctaggagcttgcttctaagggaaaag

SEQ ID NO: 7611 - DNA, 201 bp, Bos taurus
tgtttaatttcttaagttcctaggctcaaccagatgatctcatttcagtgctgcttccacctctgaactttattttactttttcagttttaagctcctcatgtggaagaggagaaacctcagcggaatacttggcattggccctaaattaacctctccattgacttcttcctctccccaactcctcccccaggtcctaagg

SEQ ID NO: 7612 - DNA, 201 bp, Bos taurus
caggccctgggctgcagacgaccagggctgctggactagtaactttccctgtgccataactcaacagagaggtaggatcaatgacaggtttataggagagcgggcctttaaatagctgaggtcagtgtctggaggcttcccgttaataccactaacagcatcccaccagccgagacgattggccactttgttacccactct

SEQ ID NO: 7613 - DNA, 201 bp, Bos taurus
caaatccttacctttgagagtagctatggagaatagagatgatcatatagacagcatctggcacataataggtttcctctatgttttagtttccttctcaccatctctctttaaatgacagttcatattatcagtgctctttgaaataaagcatgtcttccattcaaacacagaaaaaggttatccctcttgactgctgct

SEQ ID NO: 7614 - DNA, 201 bp, Bos taurus
ccccttttaaaatctaaacctctttccccagaacttaccactatttccgtggttgctgtttcctgtctcctgcgatcgcactgagcacggccacccttgaccttaattccataggcagcccgaagctgctgtacaaccgccaaacgcaccagcctctgatcccacatcccggacatgtcgctcactctccgaggtgcgatc

SEQ ID NO: 7615 - DNA, 201 bp, Bos taurus
aaaaggacgagaagccagtggccatcactagttaaagtgacactttctcccatttccacagataatttaatgaaaatgagcacttccaattagagtagaaaagtcacattcctgtggcctagatgcacagcacagaaatgggaacggaaggcaattctctcccctttcacagttctcattttctctgtaacccacatctct

SEQ ID NO: 7616 - DNA, 201 bp, Bos taurus
tgtaccccggcccagacatcaggtggctttcctccatgtctccagggttttgctcaaactcagactccagtctttaggccagaaaaggactccttgctgtcaaagtaaatgaaggaacaaatgccaaaggtgacttgtccattagctggtggatgaaggtttccctggtggctcagatggtaaagagttggcctgcaatac

SEQ ID NO: 7617 - DNA, 201 bp, Bos taurus
cagtcatgatgtgggcttatcgtcttcatttaatatttatttggtatctacttcatatatgacactgagttataccctgtgttcttcttccccacccctacccctaattactctctctctgtctctgtcatagtatgttcatccaggctggcaaaaggtaatagtagcactaaacagaaaaacactcctaaattcccttag

SEQ ID NO: 7618 - DNA, 201 bp, Bos taurus
ttctaggactttttcaaggccacctagctgcaggtgtgacagaattatttattaatattttaatttgtgatttgttctcattttttccaacctcatcttgaaatggccttttttccctcaagccctttgtgatgggtcaaaatcaaagtaaccagctttgttttctaacctgacctctttgaggcggttatttcagggaaa

SEQ ID NO: 7619 - DNA, 201 bp, Bos taurus
agaaaaagtcaattcttccatatgaaataatatatattaatatgaaatgtaggaaaagaaacatcatggtttgaatgctgcctgcagaaaagactgtattaatctacattaaattatctagaatcaaatagtgaaaagaacaaagtggtgctcatttaatcttcattctgacacaaaccggcaagctgaaaagtactttac

SEQ ID NO: 7620 - DNA, 201 bp, Bos taurus
taatgacaagagaatatgaaagaggatatagggataaatgagttttttattggtctggcttttctctagagagcaactataaactactttgattatcgtcatcatcataaccactaccatctattgaacacttgttcagcactgagcattgtactagatatctgacaagtatttgaatctttaactctcacaataattcca

SEQ ID NO: 7621 - DNA, 201 bp, Bos taurus
gaaacttatgtctcacatcctgtgtttgtggcatttatgaggcaaaataggcgttccccccccttcatggaatcctcaaagccttaattaactgatggcataggaggagcagtctaaagccatttcacgtccaacaataggctgtttatatggtaccaaaaaatctgagtttttaatgaaaagcattgtggtgttattaat

SEQ ID NO: 7622 - DNA, 201 bp, Bos taurus
tcaaaatcatttcactaggccagcattttcttgatacaacaaccagacaaggatcacacacacacacacacacacacacacacaaacacacacaccagatcgcaggccaatatccccaatggaaatagagacaaaaatcctcaaaatgaatatgataaagtattagaaaatcatacactatgatcaagtaggattcatttc

SEQ ID NO: 7623 - DNA, 201 bp, Bos taurus
gaaagtcccaaagcccaatcagagatccttcagttagaatagatctgatggttgagcaaaacaaatttttccaaacaatgtcttttcacaccatgatgcataaagtgaaggcagagccaaaggaaataattccagtaagccatctatggaggaaacaggtagaggtaatgccaaataaagtaggatcgagttgaaagcagc

SEQ ID NO: 7624 - DNA, 201 bp, Bos taurus
tttaacttgcttgctactgcctgaagtaggattcagcccaagtgtctgtcacctacttagaaaacactttctatggccgcccataaattttaaaaatttactcatctatatttctatagataggaaaaagtgattctataaacatgtaccaagccaaagcaggtgtccacgaaccccctacaggtaaaggcccagaaataa

SEQ ID NO: 7625 - DNA, 201 bp, Bos taurus
attctaactttggcttccccagtgttaacaaggctggaaaagtattaaacagagtttgaatttgaaatccacagaacagtgcagggcctttcgttctacacgtgtcacagagcatgagacccaggggcaaatgcagaaaggacagagctgcaaccttccagactgagagctcagcaaaagtttgttttaacagaacataaa

SEQ ID NO: 7626 - DNA, 201 bp, Bos taurus
ggcctcattttacacttttgcaaatctctttaatacctgtcttaatagaaacaagatctgtctgcttcggcattcaacttgtgatatgctatcttgattaaagaatatgaagacattctggccttagacaaaaatgtaattggaaaactatttttgttactacataatacccaacaagtggtgtttttcttagaagttaat

SEQ ID NO: 7627 - DNA, 201 bp, Bos taurus
atagttggttgttatgaactttgtgatgtggtgatctttttatcaaagtgacaacacaggccagatcatactggatgtttctcctgtatttagtatggcccaaatttctaggctttaaaaattaattaggagcatgctactctcttattcttatgtgaagcttaaaatcactggttataaggcaccgtagttattggaaac

SEQ ID NO: 7628 - DNA, 201 bp, Bos taurus
ctcattattggcaaggcttaattccactctggaaaaagataagttgtcaagtctttgaggggtgcactcactcattaaagccaccaggggattgcttagcgccctggatgaggtcatccactaaatgggccccggtgggcctcactaattaacgcacagcgcccaagtgaacagttaagtcacttgcccctccctgaagag

SEQ ID NO: 7629 - DNA, 201 bp, Bos taurus
ataatgaagagacaacttgaattttcaatgatttcattaggttttgccttctgagtgttttgtctccctacaacagtatagaaaagcataaacacatagatggacctttgttcaacactcacaaattattcatctaggtatttaagcataaaacaataacatacttaccctatttattgtcccttgaggtcaaagactgta

SEQ ID NO: 7630 - DNA, 201 bp, Bos taurus
agttgtatatattatacatacattatatactgtaaattacctatctatttccctactgtaagaatgcactgaagaattattcactaattaaaatgctactttgatgaatacttttgtgcaaagcattccccacattttggattatatttgaagatttcagtaaacaactgagtaaaaggtgtgggcactgtagcgtttagg

SEQ ID NO: 7631 - DNA, 201 bp, Bos taurus
tgtaagagataaaatgaaagtccagaaaatgagggatttgtgatcactgaaggctaaagttgtttgttatcctgagattagacagacatttaaatattagctttcatagtcaatatacccagatccttgaactggaaaccctggttatgtttagaaagcgaagggtaattttctcagcatccttcaaaattgaattgtttt

SEQ ID NO: 7632 - DNA, 201 bp, Bos taurus
aaagtacctatttgcttgatggaatgcttgtagcaatgttctctcgtttagtggagctattcctgggagtaagtacaaggcccaggaccaacctatgcgttgttgagaagtgtgtgctcactgtgatctctattgttgttcagtaaggcaatggcaccccactccagtactcttgcctggaaaatcccatggatggaggag

SEQ ID NO: 7633 - DNA, 201 bp, Bos taurus
ctctggagccattctggtttctattatttcagaagaaagtatcttcagcttttgctgtggacctctaagctattctacacatccttatattaaattcctccgttttacttaagttaccaggatcagctggggctccccaggtggcagtagtggtaaagaactcggctgccaatgcaggagatgtaacagacacaggtttga

SEQ ID NO: 7634 - DNA, 201 bp, Bos taurus
tggagatttcaattgcctgagatcaagttctctaccactgcctaatcatgtgatcttgggtaaaaaattttttaacatatttaagtcctgttttgcttacgtgcacacagggaaagataataatagcaactacaatttatagagttgttactaggattgaataaaataatccacttaagaggctgagcattgtaagtgctc

SEQ ID NO: 7635 - DNA, 201 bp, Bos taurus
cttcctagtgtcttggcccatcgttaaatgttaagagctgttgggactctttctgcagcactcaatgcttcagaaacacagatgtattattcttaaagcctaggtagaacacaggcctgttgtgaatacctgatgactttccgcagttggaggactatggggattggggaagacgaggaaacaaaggagaggaaacctcta

SEQ ID NO: 7636 - DNA, 201 bp, Bos taurus
cataccatcatctttggggttacgattgcaacataagaatgtggggtgcacattcagaccatagcataggccaaatcatacagttccctgaaaggtacagcaaataattatgatgttctgatcctgcaggtggcttgactatattttattcactggaaaaataaaggattcagagaaattggggtttctattttagatttt

SEQ ID NO: 7637 - DNA, 201 bp, Bos taurus
tgaacttaaccatatcaactttctctaccaaagcccaagtctttcagacactggaaattttttccaatcgtgtgttggcctaaccgcacttcccatcctttggattggacttctctgaagcagaaaccaattgctttctgaaggctacagtccactgaccagaacacaaacaacaaatgtcatcctgtctcagacaccacc

SEQ ID NO: 7638 - DNA, 201 bp, Bos taurus
ttggaatttaggaaatctgacttgctattaaaacacagtgttactaactgccatgtggttgcttcagattgatgattactatgtaggaaattataacttatagtttttaaagttgccgatacaaaaggagtctttcaagacctttgtctttttaatgtgattccttaatttccgtatctgtaaaatgaagaaataacccat

SEQ ID NO: 7639 - DNA, 201 bp, Bos taurus
attttggtgaggataaaataaaatgctggatgtgaacatgctttggaaatgtctatgcattttgcatgacgtgctgcccacattgaagagtgaaatgctgcgttcagtagcttgctatttccttaacagaattagtgattaattcatactagtcatagcccacaaagagaaatagctggaagcaggttctattgaaagatg

SEQ ID NO: 7640 - DNA, 201 bp, Bos taurus
cttggatcttagaagatgtgagctagagaaacaaaggagggaaagattccagaaaagcaggagcatatgcaggaaatttggcctcttcagggcacctgttcaaggctggcaggtggatgaagtaacaagacttatgaaacagaagcagcaggcccaaaggggagaaccactggagtggcatgcttacattttgcatttata

SEQ ID NO: 7641 - DNA, 201 bp, Bos taurus
actgaagggccatttgcaggtgtgagaagtaaaactttttccaaaggttcattaaatcacacagttttccttagagaggatctccatggcaaaccttgctttcatttttccaggccaataacagaagaaggagctgcagaggccctggctggggccacccaggctgaaatggaagcacgcaacttccagctgaggccccgt

SEQ ID NO: 7642 - DNA, 201 bp, Bos taurus
attgagcaagaagacctacatactcaagagtgtttggagtttctccagaagaatccatgtttcttgttggctggatgaggactggcctttttggtcctacctcagtgaggttttcaaccttgggggattgatttctatcattttgatctgggatcagagtagcagggactttggggacggccatagcatgcaagcatgtct

SEQ ID NO: 7643 - DNA, 201 bp, Bos taurus
acattctttccgtggctccgtgaaggccctgccatccttccttgcaaactcctgctccctttccccctttcaggcattctgcaggggatgggatttctctgaaaaatggtttgatggcccgaccacctgcatgccaaacagtaagcaactgctatttggcttggctgtttgcttgacaccaaccttctgctagtggatgcc

SEQ ID NO: 7644 - DNA, 201 bp, Bos taurus
tccgatgtttaaccctgggccaggcacagttggtcagtcactgaacatttcataaataaagccatgaaatggtgagatggaggggtgtgcttggggaaaagcagtatctgccattgttctggcccagtactgatggtagggggccaatattaagtatttagtttatattctatgtgcaagtgatggcatccatgcgggctc

SEQ ID NO: 7645 - DNA, 201 bp, Bos taurus
ttcttagtttccatgatgatctcttttgtttccattctggaatgctgaattcttttgaatagttaagcttccaaattagatcgtcacctcatttgtgacaggccttcatgaattttccaatagttataaagagtcaaaaagaagtagacaatatttcacaaaggcctgcactagttcccggctgggtggggacatcgcaga

SEQ ID NO: 7646 - DNA, 201 bp, Bos taurus
catgtatcatattacagttgctacagaaagctcagaatacatttatgcatcactaatttgaaattaaccacagctgctaaacccactatcatataatgcactaatgaagaagcacatatattgctatattacattttttaactatatttcaataaaaaagtattctcctttgcaatcctacatactttaaggttttttttt

SEQ ID NO: 7647 - DNA, 201 bp, Bos taurus
cagccaggaggcgggagagggaggaagacaggaaggaggccccagccctctcttcccactccaggcccgctctcgggggctctttcaagaggaggccgtaaagccataggttgagggaacagctataggaaacagctgctcagggctagagggaaggcacccggatgccaaccaggtgttgctctccagcccatgggctgc

SEQ ID NO: 7648 - DNA, 201 bp, Bos taurus
agaccacaaacccgccgccctggctacaaaaccctggcctttccgccgcgccctttgaaggcgccccagcctgtctggacctcaactcactcttactaccgctagctactgtggcgaaggccgcggcttctctgtcaatgaccgtgacgtcatcaaacggtgccaactagcagcctcgcgcgcctataagaaggcgggggt

SEQ ID NO: 7649 - DNA, 201 bp, Bos taurus
ttccccaagttcatatagggagtgtgaaccacgtggcctaacaaaaaagctaactcacttggacagctcccttgggcctgcaatgtacaatcagaaaacaatatcatctgggggaattccctggttgcttagtggttagtgttctggcctttcactaccatggcccagattcaacccctggttggagaactgagatcctat

SEQ ID NO: 7650 - DNA, 201 bp, Bos taurus
aaaggagtccagccaagttcttctgggagcttggtcaggacagcacaacaggaggaggtgacgggaggcagggaaccctgggcagctgccttctgtggcagggcagggccagacagccaatcctggtactcacatcagaccctgctctatatgaatgagtgtaagggtgtggagaaggcaatggcaacccactccagtact

SEQ ID NO: 7651 - DNA, 201 bp, Bos taurus
tcacactgagaatactagggcaggagcaaaggccgtttcttcttcccacgaatgtgaaactatgtcaaacacgagggccacaactgggatcttcttcaaaagaacgacaggagaatactgtgtgtagataccattccagaagaaaagaagtgaggaatggccaggccagtacgtgctgcttttgtataggacttcattttc

SEQ ID NO: 7652 - DNA, 201 bp, Bos taurus
aatcataaagcagtatgataggccccacagagacatacttcgtgccacagtgtagcagagaacacactgttatctgtattttcccctcagataaagatgtgcccatttaacaaggggccatattttgttttccatgtcctattcagaattaaaaagagtacttacgctaaagttaggtcattacttagaaattaattttcc

SEQ ID NO: 7653 - DNA, 201 bp, Bos taurus
gcatttcccagggctttggccaacctctatgaggatccagagtggtctcagaaggacctggcagggcccatcgagtcactgaagacccaggtggccaagagcaagctgggtgtgctagcccccaggcagctactgcggtaccagcaggagctggctgagcgcgcccgcctgggccacccggcctgcttcaccaacctgtgg

SEQ ID NO: 7654 - DNA, 201 bp, Bos taurus
ccaaatgcatgtgataaacccccactgctgaacatggcagggagtacagagatgaacagggtagtgctcacttcccttctttgagtcacagggcaaagaacagtgtttctcaaagcagcagcccctaattcgcagtgtcagaatcacttggacttattaaaaatgcccagtcctgagccaagctcccagagattctgatgc

SEQ ID NO: 7655 - DNA, 201 bp, Bos taurus
gcagtcgtcacggcttagaggctttagacctactgcgcatgtgtcgttctgtcatgctagtcaccttggattgtcaggatgatcgccaaaagctaccactgagactgtcggcccttctctctcctaacccttaaaagggtttggggaccagggaagaacccagtgtggcgtttggctttctcctccttccgttcgccccag

SEQ ID NO: 7656 - DNA, 201 bp, Bos taurus
tcactgctagggctctcattccaggtgaagcaggttgccaactccctcctagatagtgacctctctctctgaactaagcccctcaaagtcatgggccctgatggactctgcttgctgtgcatgtccagatggggaaggggagaggggaagcgaagcttcacatgcgtggccccagaggagctgctcaacttgactggtttc

SEQ ID NO: 7657 - DNA, 201 bp, Bos taurus
catccaccatcttcaaaactagagtggtttagtcaagcatcttcaaaactctctgacctgtgcctccatcatcacatctctttatttccctctgacaaaatatatatgcctcctttttgaaggccccttgtgagtacaataagcccaagtggataatgaagaataatcttcccatctcagagctttaatttaatgacacct

SEQ ID NO: 7658 - DNA, 201 bp, Bos taurus
cactgatgacactgatgctgcctttcctttacttggaaaccttggaaggtttcccattgtcttagaattcagctttggttggccttcagagcccttcacaatctaaccccaatctatcccaggctcatctgttctacccctgactataccttaactgctgtgggcaatttcccagccccagcacagccctcaggctccctt

SEQ ID NO: 7659 - DNA, 201 bp, Bos taurus
cagatggttcagcattgcatagggagagctgtgaagccaggtgtaatgccaggtgatgcttcctaggatcacagtgggggtaggagcgaatgaagcattgacatcagtctgaatcttttatgtctaggctaattcagggactcataagatttgcagggctctctgcaagttgggaagatgggaatctgactataatttagt

SEQ ID NO: 7660 - DNA, 201 bp, Bos taurus
attattagccagattagtgtaaatctttacattagaggcctatttacctcacttcttattgcccaataagatgcctggcattcaacaaaaaatcacagggtaccctaaaaggccagagagaatgaattagaagacctaaaacaatcatcagaaatcatactcagacataacacagatgttggaagtaatagacaggaaatt

SEQ ID NO: 7661 - DNA, 201 bp, Bos taurus
taagatcctataaaaaataaaagtccatttcagatacaagaaaataaaattaagacttaaacaactacttatttgaattaaaatagaaatactgccataacttagtttgtctgtcctgtttcaaaacatatatgtatgaattagggattttagtggccctggaattattcaatttttttagattaatcaaggactgaaagt

SEQ ID NO: 7662 - DNA, 201 bp, Bos taurus
atcaggtttaaactagaataagagataggaatagaagcatgctttcctcagtttctctccattttgctttttccttccaaaatccacaggatggaaagacgagggtatacattgcttcctacttcctcttcatgcctggtagatctctgactaagtcatatcttctaatgcctcatttgctctgcttcattgtcttgatgg

SEQ ID NO: 7663 - DNA, 201 bp, Bos taurus
ctatggttagtgcagaaagtgaaatggaatagacccaaaatcaaattaaaccagtaaattctccccgccctatgcataatcagcatggatatctatagcaaatgggaaggccgaggaggaggctcaggtttgtagcacaagaattttctgtttgaaatattgttgctttattgtaaaatatcaaagttcacaaatttatta

SEQ ID NO: 7664 - DNA, 201 bp, Bos taurus
gaattagcattgtatagtattaaaaatacaatcaaattcccagtatcctctgccttcatgcaaagcctagaaaagaacagttctgtgtatgtgttcagtgcagtatttcctttccttctttgatttcacagttcaaacatttcacaaacagctaaacctgattttgttctccaagaagaataggtactggagtctaatgta

SEQ ID NO: 7665 - DNA, 201 bp, Bos taurus
agtagcttgtcttgtaggggttggtgaacttggtctgcttcttctaatattgtctttcctctgtctttactcccaggagataggataaagaaaagaaagatattttgattttgagtgtgtatgacagtttagttaattccttgagttgtaatgtgggcagcaacacattgaaggtagttaagctgaggtccttttcatggt

SEQ ID NO: 7666 - DNA, 201 bp, Bos taurus
ttgctcaagctgcaaccccaagaagatgttgaatagcaagtggcaacagtgaatgtgtggagacctgttcatatggctgtctaaggggccagggtggtgttaatagaaatggagttcagttcagttgagttcagtcactcagttgtgtctagcttttcgtaaccccataaatcacagcatgccaggccttcctgtatatca

SEQ ID NO: 7667 - DNA, 201 bp, Bos taurus
cccaaatgtctttaaattcttgctgggtagtaaaataagaagacacattaaaaactcgtggagactaccaagggagcattaaatgcaaccttgaaggcactgaggtatgtggcttccaacagtgcctacacaagtgaatcgaagatttccttaaatgcttaattttaagaggtaaatgacacaggcatttacaaacacact

SEQ ID NO: 7668 - DNA, 201 bp, Bos taurus
ctcacaaattcatctggccaacatagaccttaggcctgctctctgggcctctgtatccagttggctactcaacgtttgtcttgaatatctttatattccaatatatccaaaatttaatctaggcctcaacactctctcaaaaaaaacatggaaaacaaaacaaaagtctatttcaggatctcctatgtcactgaaagggca

SEQ ID NO: 7669 - DNA, 201 bp, Bos taurus
cttttcagcttcattagcaaagaatttctactcctgtgggtaaatattcttcaccttttcatctctttagctatttggcaccattatttaactcccttccaaatatagttttttccctcttgacctgctttttctcccttaacataaaatcattcttgaactttttctcaggttaaaaacaacatctgttctctcagcact

SEQ ID NO: 7670 - DNA, 201 bp, Bos taurus
caacgaaggaaagaggaatcgtaaacatcatcaattgatactaacaattttttttcagatgcacactcttggatgtaacagaataattatcagctataaatagtatggtgactttaaagcaattgaaatctgatgagaaatcatagctagaaatgatagcacagattaggaactaatccagacacaaggaaaaaaatttgc

SEQ ID NO: 7671 - DNA, 201 bp, Bos taurus
cttaggtctttgccattaaaagaaccttaataaactttaactgtcttgccacctctatatctagctcacaagaaatgctccgagaaaaaccagtgactgcagtaggtaatgtccacaaggatttgtaactaggaatgaagggagcaggcaagaaggataactacttcatacagatgctttcctaatttgctggatgttaaa

SEQ ID NO: 7672 - DNA, 201 bp, Bos taurus
tcaggcctcctttacctacccttctgatcctactccttccaaatttccttttctcagaacacagaattaaaagtcaaccacatttgattcagaaactatgacctactagtatttgtcttaggccaagatactgacctctgagtcacaagttctgtaagatgcactttgggataagtaaatagttatgatataacagtgcca

SEQ ID NO: 7673 - DNA, 201 bp, Bos taurus
ttaagacttcttccatgtactccgttatactccatctagctacaacaagatcagcaaaggcctgtgtggcctttagcaacttgcacatgaaacgttaggacaaaaaagtatatatagtagttgtcttccttccattaaactgatacttctatttcctctttcttgttcttcagtactgtaaaaacaggacaatactaatcc

SEQ ID NO: 7674 - DNA, 201 bp, Bos taurus
gtttcaatatttaactattctatgaaaatgagaacaaaatttaattcagaaattttctgaaagaataatttctatttttttctatctaaaaaatttccttttgattatgttgtctatttttggaacatgaacaaatataattcagttctattaacttttaaccttgaaaatggactttcaaaacacgtagcagttaaaagc

SEQ ID NO: 7675 - DNA, 201 bp, Bos taurus
ctaccacagctatctaaaagtatagagatggaaaccaaaacaagaatgccaacaataaccagtatctccaaatgtacagtgaacagctaaaatcaaatgaggaagttattcattttgttttgctacttgttcaagacttgattttcatttttcccacttttaggtcataatgttgcccataaagtttttcattaaattttc

SEQ ID NO: 7676 - DNA, 201 bp, Bos taurus
attttacttcttttccatttatattcttgaattcaaattaaattttcttcatttcctgagaaatgtaatgttcatcttgaagagaaaatatttaataatacgaaaaatttttacaaaaaatattcagttttcaaaatatactatgaaactatatgtattgccatccttatgattaacagaatacagcatttcaaaagacaa

SEQ ID NO: 7677 - DNA, 201 bp, Bos taurus
taaactggaaagagaggagggcacagtgaacaggatctgacctcagatggagaaagcacaggtagaaaggtgagatctcttctctgaggcctatatatgcgtgaaggagatccaaccagtccatcctaaaggagatcagtcctgaatattcattggaaggactgttgctgaaggtgaaacgccaatactttggccacctga

SEQ ID NO: 7678 - DNA, 201 bp, Bos taurus
cctatttgaggttattgtactaaagagtaggtgtttctggattttaagttactgtttttctcttcacagacctggaatcaggcctaatgaagttgagtacatttattcttagtaatttctttctaagattatctctggcttccagatttatcctagatgcaaatctcatctttcctacttgcaggccaaactcggtataaa

SEQ ID NO: 7679 - DNA, 201 bp, Bos taurus
aaggagaatgaggtcagaaaacagccattcattccttcaggatcagagtcaggtgcagagaagagccttaaccaaagctatgaacttcccagagcagctcccatccttttaatgagggaggcaaaggtataaagacccaacatttctgtccaaagaaggatgcctgggcaatacttgtttcacaactccccagtggattgg

SEQ ID NO: 7680 - DNA, 201 bp, Bos taurus
tgcttgaaactgttttaactaccagtcttattgcaaattcttatctgttccttttctctgttcttagcacactcatgtaggagagaattagaaagaaaacgtatgtttccaataattgtagtgaatgtatgtttccaataattgtagtgaatgcatgggttccacaaagctgtgaaaagcccttggtaatgaaaacttttt

SEQ ID NO: 7681 - DNA, 201 bp, Bos taurus
gtacagatatttaatagaatgtttcttgctgtgtctttggggtgacccaaggcacagtgctgcaggcctagcaatgtcatccacaagagatagctctctacactcaacaaattataaaaaccaagacacaagcttcccatatatagcttattaaatggggaaaaatttttttaaataactattcagtgaataagccaaaca

SEQ ID NO: 7682 - DNA, 201 bp, Bos taurus
ggacggactgacagttgctggcaaagctttcatcagttaccactagtgtgacagtttctcccagcagccagcagactgcaactccctctatcaaagcatgacatttgattactggagaattattccatttttcctaccattacttctattcagctgctacaagttcaactgcactaatttacccaaagctctgaccagcca

SEQ ID NO: 7683 - DNA, 201 bp, Bos taurus
tgggagccgctgctgaggcgctaatgggccccacacaggtcttgagagtggcttcctcacagggcatctgtaataactgggcttagggtttttaccagatgaagtaaatgcagggcccagagcccaggagaacaatagcttctctgcaccagaggagatgtgcaggcttccgcctggggcttagacttgtttccactcccg

SEQ ID NO: 7684 - DNA, 201 bp, Bos taurus
gtgaagaaacatggggattgtttcagctcgatgagttcccagtggctaatttggttttcttatatttcagatgttatttgtgttgtgtatgcagtatgatcctaattttctttaaaaaaattgaattaagaccaaaaagagataagttataaaatattaactgtgactgactgggttacaggacttcagtgattcttttta

SEQ ID NO: 7685 - DNA, 201 bp, Bos taurus
ccccagggactataagcccccaaaattatttgcaaaattgtgtgtgtgtgtgtgagtgtgcacgcatgaggatttggaacaattttctggggcctgtaaatgtcatctgattcacaaaagggtcagtgttgcctctttgcctcttttccccaaccccaggttgagaacagtcctagattagagtccctggagggcaggccc

SEQ ID NO: 7686 - DNA, 201 bp, Bos taurus
ctctcaaaaacgctcattcattttcagtctccctgaaacatcacacatgttcttgccttcccttcattctgcccaggccccaacaccctgcctcagggctgcacactttctagaactttcctgagacgtggcacctctatcaaaatgcctgtggcctgagttctggtaaacaaggaaaggcatgtaaggacctgtgggcgt

SEQ ID NO: 7687 - DNA, 201 bp, Bos taurus
taaatgcacattttcaaattgtcccccagaaagtcttccctgaacttaatattttaaaacacaatttcaaataattaagtaaccttttagcagggagtctaattaagcaaccagcttcatttttctgcttgtggtaggaatttaagtctgatttttaatcctcagtgacttcactcctttcaagacatggcagaaaaagac

SEQ ID NO: 7688 - DNA, 201 bp, Bos taurus
gagaagctggcccctcaccatcccagtacaggagaggttcttcctgagttccaccaccagaagagtcgtggacctgttcaaggtcccaattaatttaacaagatgtcagtttggcctgtgttgccagagggatggcccatgtgtgaccatttttcacagagcacacgtatttgccagaattgaagtcaggaaaaataaatt

SEQ ID NO: 7689 - DNA, 201 bp, Bos taurus
tgtggtgggggcagggcagggtgccttgggccacagtcaagttggtgtaggtatcccggggtgccatgcgatgaaccggggatgtcaggtagtgaattgtgtcaagcttccaggcccatctgccagcttgaaagctgcttcctatctgctgctgctaagtctcttcacttgcgtctgactctgtgtgaccccaaggacagt

SEQ ID NO: 7690 - DNA, 201 bp, Bos taurus
gctagagaatcagagattgaagattaaaggcaaaaataactggtaccaatcacatcttgccagactcactgaggtaacttaggcctccccacatgcagccacccagagtaatctggctcatggagctctttatcagcctctccggtccacacgcaactgcctgactggtaaggccctggggagtcaaggccacccggctat

SEQ ID NO: 7691 - DNA, 201 bp, Bos taurus
agcatcctcctgttaatggtcactcaacagctcattgtgactttggtgctcttgcaggaggagatgaatgcaaattcttttttactctaccatgttgaactggactcctatattttactattgcaatcaattggaaatttgttgaattggtcctttaccacaaacggtttaagaagcactggggttcaagcagtgtcaagt

SEQ ID NO: 7692 - DNA, 201 bp, Bos taurus
tttctataaagtcagctgatattttcatgctattaattcgctacattataatcccttgttcagacactcagcggctatgcccccaaccaagtttcttaaaactgaaccaaccaagcacaccaacaagctcgggattcctgttttgtgtcacctctacattccacaggagaacccagtcctctttatctcctgttatcatac

SEQ ID NO: 7693 - DNA, 201 bp, Bos taurus
tctctagctaatatctcctccatccacactctccgctccagcgtggggagctcctcagagtcccagacgagcagcccatatcctccgccaggtggtgcccgttcccctcgcgccacaaagaagcccatgatgcaggtagccaatcaggacaatcgcagccgtggtcgctcctgcggggatgaggggtatctctcggcctct

SEQ ID NO: 7694 - DNA, 201 bp, Bos taurus
aggggcttgtaaccttgtgtgagtctatgccataacctcctttgtcatatggagaagcctatagacccttcctcggaatactgttcttaaatgtatagcacacataacataggcctatgaaggaaaccaactatattaaaatgtagttatcaaatattaaaaaatattttaatgtagatagtgcttcccaatcaatgcata

SEQ ID NO: 7695 - DNA, 201 bp, Bos taurus
ccatgaactgaaagagagaaagagtcttagggggcccatttcagccccctcatcatacagataaggctcatcagagagatgggacttggccaaggtggccggaagtaaccccatggctcagcctcacatcccctctcactgaaccccacgccacaggtcccttcccacctcaggcaggagctccaagctcctacattagaa

SEQ ID NO: 7696 - DNA, 201 bp, Bos taurus
tacccttaccgctgaaggtggcagccaggctcctgtggtctccatcttggcagtcttctttgccttcaaaaagcttattgctctaaagaaggcagggtgccggtgcggtcactctgtttaaggccttaggggtttaagaaggcagcttggggtgagggcaaggcctaacccacaagagtgcttcctccgaggtgggcatta

SEQ ID NO: 7697 - DNA, 201 bp, Bos taurus
accaaggggtacctttggcctatttatttaccagacatgtgtctgtgtaatctgacattgtcgtggtcgatactttcctgtgagatgtcagtcacacgattctaactgcagagggcctatcgtgtgctcctctactctatgtttggaactctagggggtcccaaggccttccccaaagagcttaggtgcaatctgcctgga

SEQ ID NO: 7698 - DNA, 201 bp, Bos taurus
ggctcaaccctaggtctcctgacttgaagtgtgttttttctttagctacaccatgctgcttctctacaattaatggaggctgggtatgggccatcttttcaccccaggtctggagatgggaatgggtgttgtcagactagcgccgtgccctcaccatcttctccttttaggtgctctcttggcttctatgtagcatgggca

SEQ ID NO: 7699 - DNA, 201 bp, Bos taurus
tttcaaaacccaatcccgtttcccagagttggctggtatcccagtcagcttaactagtcctcaacaaagaggagacccacaaaatcctattagatcaagccaactactgttggctactgtgcaccaaactagtaggcatttattgaatattttctataaactaatccaataggcatttatggagcacctattgtatgtcaa

SEQ ID NO: 7700 - DNA, 201 bp, Bos taurus
caccttcttattctcactcttcctcagtcttctttgtcttcatgtcttactgccccccagcccagtgtcctgctccagctcagtcagggtccgtgtgaataaattcctgaaggctggccttgtgatcccatgagggcctctttcctctaggtctgtaactgtgcagatcttttttgtcacctagaaattcctcaagctatc

SEQ ID NO: 7701 - DNA, 201 bp, Bos taurus
ctcataaaggctctttttattaggcctaattacacttcagggtgatgtcagggcaaggaagccatgcagtgtatttctcacactgttacacatggccacaggagggtcactggatctcataaacacagtctggtcttctttcactcacgttatgaaatgtcctcagagttactctgccccagcaatctgtcccgtatgccg

SEQ ID NO: 7702 - DNA, 201 bp, Bos taurus
atctgcttaggccttcctgtggctgaggcctctccctggagtgagatcaaagagccagggggagccaaggacaaggaggaccttccacatccagggtctcagtcccaaaggccctggaactctctgctgaaatgacctgaccccatttctagggccattaatgaactcttatacagatccatcctaccaaaggagggccct

SEQ ID NO: 7703 - DNA, 201 bp, Bos taurus
ctgctcagcatgtaaagttagaatgaagactccccatcacgcacgtggccacctctgccctcagctgtgaacctggatccatcctaagggctcactgccccccacccggccagcactgtgtgtgcattcacaaacttgtccccagagacatcaagctgctaacttactgacaatctaccccctgtcatatttatctgaatc

SEQ ID NO: 7704 - DNA, 201 bp, Bos taurus
tgctatctggccttttgtaggaaatgttagcccacctctgatgcagaatggtgtctggcatgtagaaagtactcattaaatggtcacttaaaaaggaaaagacctcactaggccttggggtttaacagaatttgactgaggtcctggggcaacacaaagagcctcaaagaaaaacctaaaacaggtgtgtctgtcatcagt

SEQ ID NO: 7705 - DNA, 201 bp, Bos taurus
accaacgcaggggacatgggtttgatccctggtccaggaagattccacatgctgtggagcaactacgtccatgggctgccgctactgaagtctgtgcactcgaaagcctgtgctccaaaacgagagtggccaccagaatgagaagcctgagcaccacaggaagagcagcccccgttcgccccgtttgctgcaactagagaa

SEQ ID NO: 7706 - DNA, 201 bp, Bos taurus
caggcctggaggagggatttaaactcgggcctctctggtgccataggctgtgctttgttcccagagctcacctaacagcccacacaaatgagtaattatccgtggccagcatggtctttacaaagaagagacaggggtgccttaggccaggtgaggtaaggcatcccagggtggaaggaaggacctttagggaagttgagg

SEQ ID NO: 7707 - DNA, 201 bp, Bos taurus
ctggtttggtaacaacagcttgggacagtgattcccagagagaagtgagtcccagctcactgtcagaagagcttccaggccacatagtggggaggacatgcacagagcagccatctctccagattgaaaaaacagagctgcagattcagaggggcccaggtagctaggatgtggagtgcaaagcacagagaggagagagaa

SEQ ID NO: 7708 - DNA, 201 bp, Bos taurus
tttcattccagccaagctaaaatgatttctgctttaaaagatctagaacgtaaaaaattgacaagtcgaaagagtggctggtctgatggcggccactacttctagtgctcgaaccttctcacagggaaggcacccatgtgtgcacacactggtgtgccatcaccctggggcctctgtcgtggttctccacccccaaaggga

SEQ ID NO: 7709 - DNA, 201 bp, Bos taurus
ctcctcccacaagccctccagggatggttgtgtgctcatcaaccttcctctacattcctacagccctgagaggaaactcaggagtcaaagagtcatcagaaggcaatggcctcaaagtaaagaactgggggacaagtgatgatgcctgatttctggtaatggaaaatgatacagcttctgcctggctctctctgaggatgc

SEQ ID NO: 7710 - DNA, 201 bp, Bos taurus
aaagagtattcttcatagtttgtaattcctaaaattatcaatgagtttatcagttagattagtgaccgcattgccatcagtccctttcgtcctggggcccataatactccaaggagtccctggggatgaaggacagaaagaagccttgccaagggggaaggtcagggtcactccagggagcatgcatcaagtaactggcca

SEQ ID NO: 7711 - DNA, 201 bp, Bos taurus
aggagcaggcactgaatatatgtttattaaataaatttctctaccattatttagataaattaactccttcagctgaatgtggcccacagatacccaatttgcaaccaataaatgactagggcactgagaggaataaaactaaactaaggagggccaaatctataaaaactaatttctgtccttttgcaacatctgcatatg

SEQ ID NO: 7712 - DNA, 201 bp, Bos taurus
cggaaagacaaatccaagggccagaagtcaaaggaatcacggtgacagaggggtagttagagtcaggggagaggaatttgggtggggaaaggcctgttcagtggctttagtgtgaggggtttggcttctctgagggatttgttggaatcacacagcaccagtgaattgggaggcctctcacggaagtgcaaattaacaata

SEQ ID NO: 7713 - DNA, 201 bp, Bos taurus
tagactgacatgcacacagttaggtgttgtgttgaacggccttgcagcacacagagctcatttgatgtgctcttttgtcagcccaatgagccgccgcttccgccaccactctttggtggtggccctaggaaagccccaagtgaaactgcaatgttagggcgtatctcgtgagacaattactttttcaaattgtttatgctt

SEQ ID NO: 7714 - DNA, 201 bp, Bos taurus
tttacctctcttaccatcttccttcatcctcagttcctctttctatcttctcataatatggtcgtatcataatttttggccaattatgagtcaaaatttacattactgtgacaaaataattactgttcactggatgggtcagataatatactgtgattatatttcctctgcaccagccttttgtttttctttcttaaattt

SEQ ID NO: 7715 - DNA, 201 bp, Bos taurus
cccctgtcctttcactgtcttatttcctattttgggctcttcaaccttagtaagatcctttgtcccttgacccctcccttttatccgactcctcagttccctcttggcctcacttcctttcttctcagttttagatctcatcttaacagattttactttatacttaagctgaagtgccagggctccttgctttcacaggcc

SEQ ID NO: 7716 - DNA, 201 bp, Bos taurus
agagagagttaaattggcctaactcttaccctcgagagaagttcaagttgagaacaattgagagaagacatccagtgacacttgggagctccctgattcctatgtcagggatgtaaagacatggccaagaggccaaagaaaggtgttgggagaacagctgtgttcagagggagtttgtggtgttggttgagtgttgtgacg

SEQ ID NO: 7717 - DNA, 201 bp, Bos taurus
ctccaggattttttccttttgtgattctctggctagaaagccatgttcaagtttggccttctgctgttagtcttgctgagttgctttatgaaaagctggatgtgtgcagcccctccacccttcactcttcaggggacagagagtgtgctgaatcggcatttgaggcaggcaagagcctcccccactgcctccaacgtgcat

SEQ ID NO: 7718 - DNA, 201 bp, Bos taurus
gagcccccgtgacactctgcctcgttctctggtggttacagcactttccatgctgtgtatattgcctgtacccagcatgtgagtgccttgtggtcaggaaacttgtctcagggcctagtccaggacctggtacatatgggccttgccaactcaatgcagatctgaactgaagcaagttgataatgggagattgcaaacctg

SEQ ID NO: 7719 - DNA, 201 bp, Bos taurus
actgtgttattttttattggagtatagttgatttacaatgttatgttagtttcaggtatacagcatagtgattcagttattttttccctaattatattcactataagttactataggagactgagtgtaattccctgtgctatatagtaaatcttttttacttatctcttttatgtgtagtagtttgttaatccaaaactc

SEQ ID NO: 7720 - DNA, 201 bp, Bos taurus
gaacaaattgggtgaaggctgtcttctccctagagggcaggagggagacagaccctgtgattcttttattatcctggtcacatatgcatatgacatagagatggtggcctcagacattcaaggcaatgcatcagttgtgcctggaagatcctcacactagatttggacttagcctcatgctttctgatattgggaagaaag

SEQ ID NO: 7721 - DNA, 201 bp, Bos taurus
aaccacagaggagcaaagggaggtgataccctaggtgggcagggcctcgagtccaggaggtcagacagtgacaggagtagtaaaaatgagctacgaactctgattcttcagaaggccgctttcttctggtgtcgtcagcctcttgcatgtgggttcaggtcccttcaaggttaatcagaatcagaagttcagagaactgca

SEQ ID NO: 7722 - DNA, 201 bp, Bos taurus
aggcaaagccaaagacggatcagatgacagattaaagtgaagatcagcaaactacagcccacaaaaccaatccagcctgttttagggtagcccacaagctgaggcctggcagctccagcttttgcttcttgagagccggctgctgttactatcccggtgtagaggaggacctggcagatgacagtccaagggacagagaaa

SEQ ID NO: 7723 - DNA, 201 bp, Bos taurus
gcaggcgcagggctgtagggcactgcttgttgaatttcaggtcctcagccattagtttttcgtttcatgaattctcttaccagcaagcgccttctggaaccgtaggggagccaaggtttcccccttccatccttgtaagagtcacagctcacacatgtgtggcccctggggtgcttggaggtcattccataaagaccacaa

SEQ ID NO: 7724 - DNA, 201 bp, Bos taurus
tggagtcccaggccaagatggaagggttagcctaagccggaggagtaatcctcttctctgttgatagggaggtctgaagaatggctctggaaagttaataagagtcaaggccccaggataattagctgcatgctgtgtgtcctgtacgtaagtaagccattgtaatcccagtactacagatggggagagggaggctgaaga

SEQ ID NO: 7725 - DNA, 201 bp, Bos taurus
cctggactgcacagtcactcaataaatgttgatttctttcctttacagtcctaaatcacaacataaattttttttaatgtgaacaacataaactcccacacgctgacctacagtcagtacacaccttctttcagctgaatttctactttctataactacagtactctccaaagatagtttataataatgagttaacaataa

SEQ ID NO: 7726 - DNA, 201 bp, Bos taurus
gttgggaggaccgttggctctgttctcagatttgtttttttacctttaaagtgctcagatctaggtcataagcttgtttacacatatttcaggttttgtagagggccttcttaaaaaaaaaagataccactttcctaggatttaggtccatctaaaaaataagaaaattgtttttattccataaaaattcatatttatgtt

SEQ ID NO: 7727 - DNA, 201 bp, Bos taurus
aaagcagcctgaggccagtctccccagagtagctgcaagtgaaaacctctaagtcttcccaggacctctctctctcttttcatttctttctttctctcgctcattcactcactcactcctagcaaaaaggaatctgagacattctgatcagagccaccaacatcttctactgccatggagttctgcttaatactttggttt

SEQ ID NO: 7728 - DNA, 201 bp, Bos taurus
aggaaacagctcaaactcaagccacattatgtcactgttctgctcttgaccttctaatggctctcacatcaaccaaagccaaattccttacaaggccctttaaaggtcttacgccatccacctcatcccttccacatttcaaatcacttcctccactcctttaggcatggctccagccatgggtctctcttggctgctcct

SEQ ID NO: 7729 - DNA, 201 bp, Bos taurus
ctccaataggccaggaattgttccacccaatccagtgtggatccttgttgctcaaatggggctctatacagacaaaaccagcaacaccaggaacaccagggctagaaacatggactcttgggccccacctcagacctactgagtcagtatttgcattttgatgtgatttctaggtgattcagacacatgaaaatttgggaa

SEQ ID NO: 7730 - DNA, 201 bp, Bos taurus
acatgtttgaagcttaggagagaggtctgggctgaagacagagatatggactcattcacgtatagtgtgacagccagaagaatagttctgatgaggccacacagagaagtgagacgagacagatacctagggaaatctgatattttaagagttgaagaatgaaaaagagtcctacaaggctatgtgtgggccagaaaaaaa

SEQ ID NO: 7731 - DNA, 201 bp, Bos taurus
gtcttaaaactcatgcagtagaaaatatacaaattcagacatgtttgtgttatgttactgtgttcaattttagttatagtagatgtgtaggattttgatatagtgaagtcatgctgtcaaaattagagggttttataattttggaagtttatagccctaataattttgtttaaaaaatttccaattgagaaatttaaactt

SEQ ID NO: 7732 - DNA, 201 bp, Bos taurus
ttgttagagttttaggcaaatagaagtgagtgcagccacaaaataaaagattgccaatattgacgggaaattaaggaaaaaggattatagtgttcaaaaatggtgacattattatgaagctaatggataaaacccaactgttgacccctattcacttgaaaaatgatttgatttttttctttaaaatcgtctttattgaag

SEQ ID NO: 7733 - DNA, 201 bp, Bos taurus
tcccagaacatacaacctctttcccactgcagggcctttgcactgctggttcccttcgcttagaatattctgctggctctctgcacggctggcttctctcagacttcagctcctcagggaggcctttcctgcctgtctatacagattaagttgtactggtattccctatggcagcatctggcttattgtttcataacattt

SEQ ID NO: 7734 - DNA, 201 bp, Bos taurus
agcctcctctaccctgggttgttccagggaacagaatcccaccatggatgacaaacctcccttccagttaaccgtggccatcttcacaggccttttacaaggaaaatacccctgggagacgaagtctctacttaaggagcatccttttaaaaaatgttctatttttatagggagtgtagccttattttttttttttttaat

SEQ ID NO: 7735 - DNA, 201 bp, Bos taurus
atttatgtggaaaaaatgaccaagccagtgtgttaagaccttttgattaccaaacaaaattatctggctagtttggtaagtaaagataacaacaataaggtgactgatatcaaaataacaaggccttagtcaaagaaaggcattatggagaagacaggtctgatggtcttgtctaccatgtgtagggaggggatagtccag

SEQ ID NO: 7736 - DNA, 201 bp, Bos taurus
aggaaggaggaggcccagaaagcagggccagagcagggtaaatttgagtgaaaaaatcattgctgagttttgcagcaggaaatggtggagcagtcagtcccccagggccaccgggtacctctcttctaagtggaggagacaagctggggctgaggggagcagatacttccagccatactctggttctttgcagtggctggg

SEQ ID NO: 7737 - DNA, 201 bp, Bos taurus
gtgaccccatggactgcagcctaccaggctcctccatccataggattttccaggcaagagtactggagtggggtgccattgccttctccaaaattacaagcttagatgttcttgtactctatcccatgtttcagtgaagaaaagtcctgataacttcctttagaaagagggcacatctgcatactgatgccttgggtgagg

SEQ ID NO: 7738 - DNA, 201 bp, Bos taurus
atggcccttcacaattgaggctggacaatgaactctctgggtgttgtccaatttgtaacatgatttacatggaagccagcccttcctttcctggggttatccctttttcatctggtgtttaggacgggttatatataatccatagataggaacatttgctgtcaaatacttttgctgatttagagctgggccgcaaaatgg

SEQ ID NO: 7739 - DNA, 201 bp, Bos taurus
actgctgaacacattttccagtgttctagtggaattatttttatatttaagggacacgaaagtgtgtaaaacttaagtaaaatattaggttttcttctatacccattttccataaatcatctttctaattctcagattatattactcttacctaaattcaggccaagttaatttccatctacagaactatccagtgtttta

SEQ ID NO: 7740 - DNA, 201 bp, Bos taurus
ctcccctagatcaggtcccatccccaccaacttgtcccctacacatttctgcaaactttgcccactattcccttcctataccccccagtccattttgcctataaacagtccagcagattcctagctgcccagccttccagtacagtgccttcccattgccccagctcactctgcagaagtccaacctttcttattcctcat

SEQ ID NO: 7741 - DNA, 201 bp, Bos taurus
tcaagttgcagaacgatgtgctggttctctcctgacggctgccattgaaggcagtaagcctttcatgatctcctacgggcatgggcctcaaccacagcactcgtaacttcatcgtcctcttatttgcacattttctccccacaagactctataagatctttgaagcgagaaaccatggttggcctgacttgtgttctcagt

SEQ ID NO: 7742 - DNA, 201 bp, Bos taurus
agaattttataaaacatcctttgaggtgcacaaataatttttaaattctgcttaccagtctacacgtcactggttttacaattttgcaagggtaagaggggaaaaaggcagattcaccagcccctatgaagatctgaaggttgcggagaattaaacggacagaaagaatctggctccatgggctcaggagcctgggtgggg

SEQ ID NO: 7743 - DNA, 201 bp, Bos taurus
accatgtcttctgagcatcttagctccccgggatctttttgggcctcagtttcctcatctgtaaaatgaggttgctgccacctccctctcaggaacatacgggttttagagacagaacccaggggcccagctggctacctgacatgtgaaaggcagacagtcaacaaatgtgactcctcttcaaccctgaggttattagcc

SEQ ID NO: 7744 - DNA, 201 bp, Bos taurus
gctgacaggctgcttctcttgggggactagcaggggaaggaaaacttctaggcctgctatgctctaaatctcgattattatgaagagctccacttcagaataaaaggcccattccattaaatgacgtcatcttgcattctgaacctttacaatctatgtatggccttatttttgtgggagcatccgacaagggacttgttt

SEQ ID NO: 7745 - DNA, 201 bp, Bos taurus
agaggaagatcacaagaagtaatgagtctgtaggcagtgtgggggatgacgataactttgaccccctatctgaatgattagctgagattacttccctccttcttctttaaagtttcatggccaagcagaaccttcagagttggttttcagggatgctgagtctaccatctgtacagatggctggcattctaattaaagcca

SEQ ID NO: 7746 - DNA, 201 bp, Bos taurus
gacttgaccttggcctcttattcagaaggcaagaattctagaaagctcagaggaggagagagaatagagccaatcaagtcaagtggtaggttgctatctaaatggaatgactggcctgctaacattttccccttagaaccaagggtgatgaccagtagactcccttgtagctgcctgcgctatagaagagcagccaggagt

SEQ ID NO: 7747 - DNA, 201 bp, Bos taurus
agttagtaacagatatatgggtctgtttctggactctcgatttcattccattgatctaaggtctgtcctcatgccagtaccaccctgttttgataactgtggctttgcagtaattttctaagcagaaagtatgaggcctccaacctggtctttctttttcaagattgtttcagctgtttggggccccttgctgtaccatat

SEQ ID NO: 7748 - DNA, 201 bp, Bos taurus
cttctcaatgtattatctgtttgaattttgtagatgattgattgtgtaaatggaagtagtgatgtatctggcagatcataacttcagggaaaccattcttctgagtttatatgttgcttcagtttgtatatatatacacacacatatatactttttaaattaatgagagcataaaggtaaagattgtaattgatattgtgt

SEQ ID NO: 7749 - DNA, 201 bp, Bos taurus
gttcaagtcccatatacactccttagtatccatggttttgcacctgcagattcaaccaaccagcaatcctgtggtactgcagtactgtatgtatttattgaaaaaaaaaaaaaaaagcctgtaaagtggacctttgcagttcaaacccatgttgttcaacggtcagttgtatatacctttttgaacagaatttccttcctc

SEQ ID NO: 7750 - DNA, 201 bp, Bos taurus
tcacttaatttttaaaacccagggcagatttttaagaatcattgaaatttattttgaaaagttcaagttcagaagtcatgagacttttattttgaacacatgattttgtttaattcaaaaagatatttataagtttaattttttcacagcttgtaactagaattgagaaactgtctagttttaaaaatccctttttaatta

SEQ ID NO: 7751 - DNA, 201 bp, Bos taurus
aatttcctggcagtctggtggttaggactctgtgtttccactgccatgggcctacatttaatccttgatcagggaagtaagatcccacaaacagcttggcatggccaaggaaaaaaaaaaaaagaggacagagcaatgggtaagagacataattatttaagatatagcggttaggggaaggcttccaaatgagggaatgat

SEQ ID NO: 7752 - DNA, 201 bp, Bos taurus
tggagaccgggcatctgtttctactcccttgagtctgggctggttttgtgacctattgtgacaactagaatgcagcagaagtgatactgggccaggtcctacaagtctgtgcagcttccacttttgccctcttcgagccccaaatcacatggaaagaggttccgcctcccagatggagatactgaaaggggcctggctaaa

SEQ ID NO: 7753 - DNA, 201 bp, Bos taurus
tggtgacctgggtcccagttgtccctcagtcaggccacattactctttgcttgcttccctctgaggccatttatggccctcttccctggagccctggcacttgcggataatgtcgctgatgggagccacctgaaatctcgcgagggtgggcgagacccccttccctcctaatgacgagagccagatgggccagaaaggtga

SEQ ID NO: 7754 - DNA, 201 bp, Bos taurus
tggcttgatggtggacaacattgtttattaccggaacgacagtcaatgaatgttctttgttgacaaagataataaagtttaaagatactcttaggcatttttgcatgttttttttttcccattatcgcccttgacattttaagcagttattttaaattccatgcctaataattcttacatctgtgttgtatctgatactgg

SEQ ID NO: 7755 - DNA, 201 bp, Bos taurus
aataacatgtcattatcttaaacttctagtttttcctttttttttccatatcaaagtaacattttaagggaaactcacatgcaaaatctgttacgtgtctccttgagattgaggatatggaggaaacagttaagtcctcatacttcaatctcattaagttattgaagatctgataatattttcaagatccagttttcattt

SEQ ID NO: 7756 - DNA, 201 bp, Bos taurus
ttgatttacttgctcttaaataataatttcagtctgactccattcagaacctccatacttattctagaaggtttggttagccacctagaggttgactcttcgtttatgtcagtattttttcctaaaaggaaatatattgagagaaacatgtttcacgtcatctctctgcaccactagcaaccccctcctgtccttctctag

SEQ ID NO: 7757 - DNA, 201 bp, Bos taurus
agaatacgaaataacaaagaatcaaagcagtaagggaagcttggtaagtgtgcgtgtgtgtgtgtgtgtgtgtgtgtgtgtgtgtgtgtgtgtgtgtgtgtatgaaaggccctagggttttgtctcatgttccctcccccttggcttcctatctgtccctaggtcagctcatctagatttgtagaattaattacatctata

SEQ ID NO: 7758 - DNA, 201 bp, Bos taurus
atgaggcagcaatcaaagctaaatctgatcatgtattaatatcacagataggtcaagacaaagggtgtgatagagcaacagcattctctgctgattagaacgtatctggaatatgagggtggttccttggcatcaccattttatgagaaatataaaatggaaatagcctcaaggtagatgaccagaactttgtaagctcta

SEQ ID NO: 7759 - DNA, 201 bp, Bos taurus
gctgagtgtattattaagcacctttgaaatagctactttcttagaactgattcttaaaacagtgaattgaggtggaggcttgactgagcagaaggtatgatactcatgatccaaaaatgtacaaacaggctcctacaacagacccatatggtaaacacccaccagaagacagctctgtgtgtgggatcagacatatggagg

SEQ ID NO: 7760 - DNA, 201 bp, Bos taurus
tcactactttaaaaccatcaattgcttgtcacacattcagtagcatagagaaatttaagcccattaaggtgacttgcctgaccaacggcaacctgacccccactataacttctgtctctactctccaacaccttccatgctcttgccactgagactacttataatttctaaacatatctaatgccccatgtcttctgatca

SEQ ID NO: 7761 - DNA, 201 bp, Bos taurus
aagaatgtagcaaaagtgcaggctgtcagtttcaagcctggcctaaggttgccttgctgcttcaacttgttttcttagaatcctgtctttgccatatgaacaaccttcatctggccagctggatgaaaagtgacatatagcccactcccctctgttgcccagataatagtcagacacccacagacatgtgagaaccagccc

SEQ ID NO: 7762 - DNA, 201 bp, Bos taurus
tgcaggtgatacatatcctcagagaaagaaccttaaccaatgtcagagttcttctgtaccaaggaaacacatgtgcgcctcaggcagttgtgtcagggccaaagtccttcccagcaatgcaggtcagagctctgctgccatcctcagacattctactcaggatgaaaacactgcatttggaagtctcactgcctgctgtgg

SEQ ID NO: 7763 - DNA, 201 bp, Bos taurus
gcccaccacttcaagcctccacattgcccaagccctcacactgctctagagtgggtatgtgaaccaaaagggcacagcatcccttgaaacctctatccttcgttctttgcaaccaaagtgttacatttacagtgacttgagggataagtaacaccttgaacaaagacaaaatccttgtgaccagctggtctgtagctctgc

SEQ ID NO: 7764 - DNA, 201 bp, Bos taurus
tccaatattcttgcctggagtatccccgaggacagagaagcctggcgggcttccatggggtcacaaaagagtcagatagaacttagcgactaaacaacaacgacaacagtgtacttattgctctgtgtctcaatggctgatgctaaaagttagtaaaaaagcttaagaccttagcatattttatctcggctgatttatctt

SEQ ID NO: 7765 - DNA, 201 bp, Bos taurus
ctattataatcgagtgtaataagccacaagaagtggaagctttccactggaaagtattgtttttggtaatcattaacagataatcttgtaatctcttctcttcactaaaatttataactgtttgcactcaattttggagctctgatttgtgaagtctattttggctttttggacatttttgtcttatttctccaacttctt

SEQ ID NO: 7766 - DNA, 201 bp, Bos taurus
agaaatctttgcatgcttaacaactgagtgcatgatttaactaaattttaagcaaagagctatttgcctttaagaatatccatggatagtatctgaaattttcccccattgaatcactggactaggataaagactgccttcatcaagtcctgatggtatctggggataattctttggcagatatgaacatattaggattca

SEQ ID NO: 7767 - DNA, 201 bp, Bos taurus
aactaaattccttgagagaaaaagcagggatttagtcagttttgtattctcagcagagagtacagtgtctagcacacggcaaggcaactgttagagaaatggtggttgaaggaaaaattatccgtatgttcttatgtcattcagttcagttgttcagttgtgtccagctctttgagaccccatggactgcagcacgccaga

SEQ ID NO: 7768 - DNA, 201 bp, Bos taurus
tcactgaagttataagtgaaagataccaatttgtttcctttaaactttactcaggtcagaaaaaaagaggctgttaagataatttcatattttttatgcctaatttccaatttaataaattagactgcttgttaactttaaattttaaagttctaaagatttgtctttgctggaatgaatctatgtaaatagagttttctg

SEQ ID NO: 7769 - DNA, 201 bp, Bos taurus
atatgtatgtgtgtgtgtatatatatatatatatacacacatagcatctcccattatccacatcccccaccagagtgatactgtgttttctataaaaactatgatagatatatgccattatacatttacccaaacccacagaatgtatgacactgagagtgaactctaatctagactatggactatgggtgataatgatgt

SEQ ID NO: 7770 - DNA, 201 bp, Bos taurus
aaagaagtttctgccctcatagaacctggagaaatgctaccacaaaaagaatgaaagtgactacaggacgatgagagatttattttttgtgtgtttttgtacatacttttcatgtgtagtcaactaaagtaaataatatttgtctcacattttccattatataatagctatctttttctattttcatttagaaaatgtgtg

SEQ ID NO: 7771 - DNA, 201 bp, Bos taurus
ttcatctcctataccagaccaaaacaaaatttctgggggaattttacctgtttgggcaagactaaggatgagatattgttcatgggcaagttctgattattatcatggtgcctagaacagagttcagcacaaaataatagacacaataaatactgattcgtaatatttatatacactaatggagggaattgggacacagtt

SEQ ID NO: 7772 - DNA, 201 bp, Bos taurus
gaaaaggtaagtcttgttccctgcagagaattccagcaaatctcaaagaggtactaatagtagaaaccatgagcttgaaacctggtgtgtgagcttcaagatctattcatggttctaatattctggctgggaagccttctccctgcagcagcacttacgatcctgtaaacacaaaatgacgcttcttcaaagcccaaagtg

SEQ ID NO: 7773 - DNA, 201 bp, Bos taurus
atataggcaatggagttggatggtgaatttaaatcatgtccccagcttccagcgctaacctgtctagcctgtcagaagaattgccacagcctctctgttttgcatgcactctgcaaagaaggagaaggagagaagataaccgcggggtaagcaagagaaccactttgggaaatatattcctgcagcacccgagaaagagta

SEQ ID NO: 7774 - DNA, 201 bp, Bos taurus
gggatctgggaggccacgtctgaaggagccagcaaggccctggtgctgcctctgccagagtcgtgcagccactgaagcagcctgatcctgatagttattttggggggaaaaacacctggaacccaggtttgagctaaagaaagtaagggcaagtgacagatgatcaagcatttctttgaaatgaggaagaactgagaacta

SEQ ID NO: 7775 - DNA, 201 bp, Bos taurus
aaagaattgatgcatgctatgacatggacggatttcaaaaatgctacgctaagtgaaagaaaacagacataaaaggccaaatactgtacaatcccatttatacgaaatgtccagaatagacaagtccacagaaggaaaaagtggatcagtggttgccagggcctgagggaaggagaaatgtgaaatgactgatgatggctg

SEQ ID NO: 7776 - DNA, 201 bp, Bos taurus
ttggaaggctggaaaggtcatctggaagatgagggaattataagtagcagaccgaagagcagattgaggataagaaaggtgaacctaattttcaaagttactcaactctcaaccttgccagtgcatatatataccaggttccccttccagccccccatccgtactccaggcttttctcccctaatagcctcaaaagggaga

SEQ ID NO: 7777 - DNA, 201 bp, Bos taurus
tcttctgattctgaaatttcacactgtgtggttggagagagttaggggttttcctaaattctgcagatgtttcctgggtggattaaaagctgaatataaatagatcaaattgtagatgatgtagtggaggttctttgagttttagctaaagacttggtagttgtttaacagtgaagtttccatggtgattagcatttagtt

SEQ ID NO: 7778 - DNA, 201 bp, Bos taurus
acttctgcacagaaatcagattttgctgttggctttcattaccagagaaagcctgcgttttagagaagggagatctgaggcccagagtctggaggggaaaggggtaaggggaagaggagacctgtgcttcaagaagcacactgtaaggttttcactgccttccacttgtgtggagtgatggaaggcctgagaaagggccct

SEQ ID NO: 7779 - DNA, 201 bp, Bos taurus
cctgtagtgagtggccagtgtagtcccctttcatccaattgcagcgtctgtgtttgtaagcactgtcttatccctgacctctggccaagcctttggaatggggtgtgtgatcaagggaaagtaaggatataggcatctgcctgtgttcagtgtcagatacaaatagacatattgtctcatttatcctcaccaacactctgc

SEQ ID NO: 7780 - DNA, 201 bp, Bos taurus
gggaacctaacttacagcaaaaaatacatgagagtggaccggtgacaatggtatcagctggtcatattgcttactgaaacactgtgaagctcctggcctggcagagcatcggcgtgccatgctgaaggcacagctgaagtattagctgaaatgcaacactctgtgagggccatcccccctggaagcattaaacacattgaa

SEQ ID NO: 7781 - DNA, 201 bp, Bos taurus
gagttggtgatggacagggaggcctggcgtgctgcgattcatggggtcgcaaagagtcaaacatgactgagtgactgaactgaactgaactgaactgaaaatacctgacaagctttggccagattcctgggagcagtgtgcattgtgggaggtttccttatgagttacactgattgctgtttaccttgaacaagaattata

SEQ ID NO: 7782 - DNA, 201 bp, Bos taurus
ttgtttttgtctgataaccctagaatctgttcccatgcatgccctctggagttctgctgatataaattggaaagatcctacaattgcagtgtatattgctactttcccatagctaaccttgtacttacaccctgggctaagctgggatcttactactctgagtgttctgaaggcagtaagagtggaggtagtactgaggag

SEQ ID NO: 7783 - DNA, 201 bp, Bos taurus
caagaaaaacatagttctaatcaatggtttccattttgaacatgcaaataattcacttcacaagtccatggataaaatattgcaggagaaacattttgtagtgtgttggtttatcagtcaggttaatagcagttcactttcaaacactcaatacttcaaccctttatgtaacaaaacttctaaaattcatttagctctttt

SEQ ID NO: 7784 - DNA, 201 bp, Bos taurus
tcttggcctcctgggaaacactactaataccaatgtctctctgaaaaggtcctttctgtttcacagaacactctaaacctgagtgtccaagcagatactgcaaaagggcccaagccccggggggccaatcagttgtaaaagctgcttgttggccgtccctcccattcctgtttgccactgcctgcttcatgctgagtttgg

SEQ ID NO: 7785 - DNA, 201 bp, Bos taurus
tactgaaaaccatcattaacacgagttggactgggaaaaaatagggagagagttatactcctgcaaaggactgtttaccccccttcaaaaatgtgcattagtcattagctaagtgacagtgggtagatggaaaggtgactttattcagtgatatttttctacctggctggcagctaaagagagaagaactgggagaaagta

SEQ ID NO: 7786 - DNA, 201 bp, Bos taurus
cagaccttataagtcactcgtagttgaaggcctggcgccacagcacgactaggcaaaggcagctgcagaagggatttgcacaccaggtccaagtgtgcaatgcctgaaaggctgtggtgcttgacactcagcaaaggctgcaaatgggctggagtctggattggacccatggagagatgttatgtttggcatcacatctga

SEQ ID NO: 7787 - DNA, 201 bp, Bos taurus
ctgagattcatgtttctatatcttataaatgtttaaagcgaagccagaaatccagatataacacatggatgttcccaggccctcaggccaaccagtgtgcgtccctccctgctttcacccttgctcttgtacctccagctcactggtgaccccagcagtgaagagaagcctgtactccatggtagcactcagcacgggcca

SEQ ID NO: 7788 - DNA, 201 bp, Bos taurus
actaaaattcatttggaagagtaaaggcaagaataatcaaaacaatttctaagaaaataaaatggggggaacttccctatggccaatcaagacttactacgctgctgctcagccctgagatttctttggaaggaatgatgctaaagctgaaactccagtactttggccacctcatgcaaagagttgacttattggaaaaga

SEQ ID NO: 7789 - DNA, 201 bp, Bos taurus
tgggctgtagggaagggagattgtaggcctctttaccctgaagagaactgcagcttgactgggctgctgaactgggcctttgtaaggaaagggtccccctgcctctcctcccccaccttgtaaatgtccagggagaaaaggcccacaggggagtgggtcaccctcacagttgtggccagccaattcctcgcttgcctgtga

SEQ ID NO: 7790 - DNA, 201 bp, Bos taurus
ttttgtttcatttaccatctcataaaaattagcaaaggacaaaatgttaaacactattaagtccacaaataattgttttctgtgatttctgaatgtgaaacagatcccctccagtacatcatcccatttcagtttacaaacagtttttaaaccctcagagcactttgaagaaaaacctcctttctcttttcttctctcctg

SEQ ID NO: 7791 - DNA, 201 bp, Bos taurus
tcatcagttgtaataaatgcatgactctgatgggaattccctggtggttcaatggtttggactccaggtttggactccaggcccaggttccatccctggttgtcatgcaagctctgcaatgtagccaaagtggaaaaaaaagtatgactctggtgagggatgttcataacaggagaggccaatcatgtgtggaagcatggg

SEQ ID NO: 7792 - DNA, 201 bp, Bos taurus
ctccctcatatagtaaatttctgaagatagaatcggaataagattaaaacacaacaggtgaaaaaagctaatgatttgctattgattttcatcagagttttttttattatatgataccaaaatattttaaaatatgcaaaagcaatgaaaagatactaatataacagtagtattaaatatactgtttttaatggattttag

SEQ ID NO: 7793 - DNA, 201 bp, Bos taurus
tttctctgagacattcttcaacctttcttcaaccaggagatatttggtacctctcctccacagtcctatactctgtgtgtgagagaatatgcatacacacactatattttatacagtttatcacacagtgttataactgttaactgacttccttctcctgtaagaatgtaaataaaaaagaacctattcttgcacttacat

SEQ ID NO: 7794 - DNA, 201 bp, Bos taurus
taatttacaaatttaacacaaccccagtgaaaacaccaacaggttcttagcgtgttctgttttgaattcagtagccatttttacaattaataagggaaaatgaataaactagaataatgaggaaaactataagagtaacaaggaagttctgctcttatgaagaaggtattaaaatactttatgaagctttaataagtaaaa

SEQ ID NO: 7795 - DNA, 201 bp, Bos taurus
cccctggagaagggcatggcaacccactctggtattcttgcctggaaaatcccaaagacagaggagcctgacaggctacagcctatggggctacagcccacgagttctcaaagagacacaactgaatgactgacactcacttttcgcataccctcaccttccctccacaatgcaaatcaccttgaggtcagaaagacgttt

SEQ ID NO: 7796 - DNA, 201 bp, Bos taurus
tgcccccttctggctctggctgcctgtcagcggaggggcatggtctgcagctggctcactctggtctgtgagcgggcctgatggtgtcttcggtttagttcagttcagttgctcagtcgtgtcctactccttgagaccacatgaatctcagcacgccaggcctccctgtccaacaccaactcccggagttcactcaaactc

SEQ ID NO: 7797 - DNA, 201 bp, Bos taurus
gatttagagttacaaaccattatgtacaaaataagctacaaggatatagcttgtatatagttgtatatactgtacaatacagggaatatagccaatattttataataattaccagtggagtataacctttgaaattgtgaatcactgttatataaacctgaaccatttataacattgtaaatcaagcatttctcaataaaa

SEQ ID NO: 7798 - DNA, 201 bp, Bos taurus
aacccactacatttatgggggtatctgtggaataacaaggaattagaagtcattttgtctttaagcaaactattctctctaactgctgccttcctgaaattatagtaattatttaaaaatcttacaatttaataacatttccaataccattaagatctttgatgtattttgaggaacattatatgattgatctgagtgagt

SEQ ID NO: 7799 - DNA, 201 bp, Bos taurus
tccaggtctttaataatccaggtatgtagaatctcttccaaatgtcacagtcctgccaaggatgttttgccagagcttaggatggaaattggtgacctgaaagtcaggttgatgtagatggcaatattgcactatcttggctcaggggacaggagggcaggggaggagatgggagtagaggaggagggcaatgttggtaaa

SEQ ID NO: 7800 - DNA, 201 bp, Bos taurus
catggggccctaggatgcaggtatttctgaatcatcacaacttcactccatcttatccccaggttaaaaagaaaaaaatccacctagcttgatggtttggggcttgaaggccttttccgttatccctttccaaatacaatcccacatacctccccctacaaacagccacaacccaaagtgattacaatataaggctgacat

SEQ ID NO: 7801 - DNA, 201 bp, Bos taurus
tgctggtctaacagagtccatgttactagaaagaaattgacttttgctaataattatattaattgaaaagtgaaattttaagcattctttttcatcctaacgtgagaacttgttgtgtatttatgtgtattacatttgagaaattggttggatattttgcattgacatgtactccattaaaattttccccacttgaaataa

SEQ ID NO: 7802 - DNA, 201 bp, Bos taurus
gacaaagaagctagaaatgggagtttatggttgtgcagtgatatcgtgtatataaatgtgctctgtcacactggaaagagagagcttggcaatgtgaattcatagactgttaggacagtggaatagttggtggttaaccctcttaaattttgatttgttgtctggcttagtgagcatgtagtcaatataattactaaggga

SEQ ID NO: 7803 - DNA, 201 bp, Bos taurus
tcactgtaagtgtaaagtgttccctggtgaacaaaatcaagtcataggaaaaacaccttttcctaaagcgctttgcacgaggaattgctggaacttgcgtctatccttacaagtcgttttccatggtgattgcggagcctttaaatgggagccctggtgtgactccccctggggggatgcctccttttctgttaccacttt

SEQ ID NO: 7804 - DNA, 201 bp, Bos taurus
tttaacactcgcccactcttgctgtgaattcctgaggactgacttatcactgtctcctttgccacttaagcttctactttccagtattgtgtctgttgttcattgtactgaaccggatgtcaaacaccctgacctccctccaacttctacacgcctctgccccctccccaactaccaaagtagactttgaagggaaatgga

SEQ ID NO: 7805 - DNA, 201 bp, Bos taurus
gatcttgtcagaaatcattttggggactctgaaatgaagacatttcagaggcatgaaaacaagactagcagtgcaatgagatgctatcttttccctgaccccttatatgatagaaacaacagctgatatacagtattactatggagagaaagaaaagatcttggaaagtttaatcctggatatccttggcctggggttgaa

SEQ ID NO: 7806 - DNA, 201 bp, Bos taurus
cctgaggtacaaactcacctgtaagaaggctggtgtggcctaaacagagtgatgggaggatagacattgtagaagataaggttacagaggcagggactgaaggttgcagttgtagggccttagaagcttttgtaaggacagtggcttttccagtgagtgaaatgggaaaccattggaatattttggtaagaggagtgacat

SEQ ID NO: 7807 - DNA, 201 bp, Bos taurus
atctatggtaggatacttacgttaagaaaaactctaaatttttaggtaaatttagaataatgaagaacctttaaccttaaaagctcttgagtgttctccgaagtcctcttcaaaatcactgaaaaatgctgccatttactaaggtgtgcttctttaattaaacttgcttgttttcatgtcccagcatttgagatactaaga

SEQ ID NO: 7808 - DNA, 201 bp, Bos taurus
ttactcttgcatgaaggtctatgtagtcatgagctccaggctcaacacctgctggcagactggggaccacctcctctccttcatcacatggcctctgacaccatcatatgaggaaaggttaggctcagctcccggtgagtctgtagtaacagctgctattgccatgggcccatggatgctttcagcttactcattccatca

SEQ ID NO: 7809 - DNA, 201 bp, Bos taurus
cctctgagggtgggtctccggagaagagggcagctatgagtcattaacacagcaagtgggatcagggcatcagctggttaaagggggctggcccagcccccatagcatctaccacaagagcagagggtgagtgcatgaaagagaagaaagttacaaagtgggcagagagaaaaaaagcaggtctgttgtcattatccggga

SEQ ID NO: 7810 - DNA, 201 bp, Bos taurus
accctctgccaacaaacccagttctcactctctcttagctctacattttgaagagtttccatgtgttttaaaaatctgcttaaggccgtgatatttctgtgagcgattctcgtttcctgctgtccttgcccctcaccatgaccactcattattctagcctggtccccaagctgcataaacatttgggaagggataaaggag

SEQ ID NO: 7811 - DNA, 201 bp, Bos taurus
ttttctcatttctctgattaaagttattctttggctaaaattattcctcagacaaaaggcaggctgtagacatgatcaggggaggactgtaggttcctgccctgtttcatatggctaccccaggtttggtgtttttttttgcatgaaatatctttttccatctcttcgctttcagtttgtgtgtatccttacatctgaagt

SEQ ID NO: 7812 - DNA, 201 bp, Bos taurus
atatgtcattgtgcaataggtagttcacctcgtgcttcaggtgaagtgaaatatatacgcctactctgaggaatctagaaactatttggggaagtaagactaatgaagaaattgctacagaatactgagatgcaattttgagttactgtaatttcaggactaacaaataatatgaccttgttttgtaactcgagaaagaaa

SEQ ID NO: 7813 - DNA, 201 bp, Bos taurus
gaccttgggaatgtgctacccagaatactgctaaggagagtataggagaccagtgtccctccctgaatccaacatgggccagattcatccatcctgtccctggttcatgactgagcacttgaagataaccagtggtgttcattcctacagcagggggccctcctctaatggtcagcattgacttaatacctcctatcagcc

SEQ ID NO: 7814 - DNA, 201 bp, Bos taurus
cttgtccttttacagaccctaaaatgccatactatcttatatctttataggttgattctgcctatctttcaaaacccttataaaatgtcatcttctttgtagagccattgctgattttctccaattaaatgtacctccctccactgcttctttgctttccagttgactctgctttagggtagttatctataagtttgtgtt

SEQ ID NO: 7815 - DNA, 201 bp, Bos taurus
gagaaatgcaaagagatccatagacagacacatcagaattaaaatgttgaaaggcaaagggaatattttaagaggagtaagagaaaaaggactggccacatacaagaaaaccacaataagataacacattattaaccaggggatttttgcaggaattcatgcctgtggccagtgatttgtatgtaagtgaatactgaaaca

SEQ ID NO: 7816 - DNA, 201 bp, Bos taurus
acttggaccatttccctgagtagtaagagataatgcttggccagtgaagctgagattataattagatctcaagaaataatggtctcaaattattttaagtgcctgtaatttttagtaatatgcaggcccaggcacagacatcaaaagagaaactcaactaggtgagtgtgtgtgtgtgtgtgtgtgtgtgtgtgtgtgctg

SEQ ID NO: 7817 - DNA, 201 bp, Bos taurus
atttcacaactttgcatgtgtcatgttttcattgttattctgataaaaacattttcctattttacccaagatttcttgtttaactcactggttatacagacgtgtgctacttaatttctgaacatttggagattttctagttatctttctctcactgagttttaatttagtgaagtcaaagaacatatgttatatgatata

SEQ ID NO: 7818 - DNA, 201 bp, Bos taurus
ttggatgaaaagaatatatgggataatgatatgacttttctcccatcccttgctcaacactgtggtggagaaggaagaggcctccccagaaagcactttccgaacagcaagagcagcacatgtgtgggtttgtcttagaacacagagttcctggattcggctcctggtggacttggtcaggcctgttgggctgaggttcac

SEQ ID NO: 7819 - DNA, 201 bp, Bos taurus
gactcagtatttcaagtcattatttttatagctgcctgccagacaacaatttaattttagcatcatcactttatttatccccaaagcgttcatattattaaatattggatatatatattttataatgtttccattacagttctataaaaatgttgctactagtaataagaaacatagttctgatacacttcttaatattaa

SEQ ID NO: 7820 - DNA, 201 bp, Bos taurus
tcaatggacatgagtttgagcaagctctgggagatggtgatggacaaggaagcctggcatgctgcagtccatggggttgcaaagagtcagacacaactgagtgactgaacaacaaaagtcatatatgaccaaatcctgtgcgggttggggagagaaaaataatctgtagaaaagaaagatttatcttgttcaagggacact

SEQ ID NO: 7821 - DNA, 201 bp, Bos taurus
aaccttgactcagtgatacagctttcacacccaacagcaaaatgttcttaactcttaactgagagaatagaaatgtctctccatttagggccaacacacataggggaaaggacctggcagaaaagcagaagtgtgacctggaactcagctctacccaggttagctggcccccacttgcccacctaagactctggagacttt

SEQ ID NO: 7822 - DNA, 201 bp, Bos taurus
ccagcagatgtcatcctgccccaagctgtctattgtgagggcaaagttccaagagaatgtatccaagaataggggccccctccttcttctgcccagtcttcacttatgagatggagattttaccttggggatgacaccactgagaatatgggggccctgaatatccttgctgttgtttgtgggggcaaggatcccatgtca

SEQ ID NO: 7823 - DNA, 201 bp, Bos taurus
acatacccaaacacacaccctcttcccacatgactctcagaatatgccccagatctgagagattcatctttatcaaaaataggccatctgctttagactgcaagtttgtctccccccataattcatatgttgaaattctaaacccagtgagatggtgtttgtaggtgaggcatttgaaagttgattagatcatgaaggcat

SEQ ID NO: 7824 - DNA, 201 bp, Bos taurus
cacaaattatctacagttaaaatagcaataacttcccatgtaaccctctttccttaactagaaccagaaaagataggcaggggttggagagaaggaaaggcatatgcagcaattcttgttatcatttcaatttctgaacccaaggaataaaagtttttttcttaacacaagatcagatgggttgatgtttgcttgctcaag

SEQ ID NO: 7825 - DNA, 201 bp, Bos taurus
ccatgattttcccttagcttttttgaccagtgggtctcaatacataagcctggatctgaatcacctgaagaggttttcaatgacacagtttctgattccagtagatttagggaggggccctgaatttgcatttctaacaagttccgaggtgtgcagctccctacatttggagaacctccctttcttcccttccctgtcctg

SEQ ID NO: 7826 - DNA, 201 bp, Bos taurus
attttgaacagtaaatcaccagcgaaaaacaccgaagttagaaacacgtggcactgaacaaccttgaaaaggaccctggtttacagtatgagagctgacacgggaaggcggggcctgttcgaccccagccggagcacgtgtgccagggacttattttttgccactcagcgcatgtccgtgaatgatgacgatgaaaatgtc

SEQ ID NO: 7827 - DNA, 201 bp, Bos taurus
tgaagagttaaaggaaccagaagtgaaccaactggccctgcaggacccagagagaggcatggaggtacccaggcacagtggaaagcagggctgaggccaaaggtggttcgtttaaaagtcaaaagtacagtgcagtgcagttacacctctgcccaggtttcctctctcacccctcttagctaaaccacccttaaagaatgg

SEQ ID NO: 7828 - DNA, 201 bp, Bos taurus
cctaatgcctggctttatctttagagaatagctgtcatcttgcagtgtacatggttgaggcagagtggggggccagtcaagaagcccatcacctgtggtgccatcgcttcctcctgcgttacatacaggtccacatgctccccaaatctgggacactgtcagcttgattcatgaaaacttctctggcatcctggacaagac

SEQ ID NO: 7829 - DNA, 201 bp, Bos taurus
caaggaggcacatcctcttaacaacttgtccaagcctgacagtgagtgccttacctagtgaggccctaatggtcatacccatttatctcttagacacagtccctggaagcagagatggcaaccgggtaccctgaggttcacaagacctcctccctcccagctgctgctattatttaattataaagtaaggaatacagaaca

SEQ ID NO: 7830 - DNA, 201 bp, Bos taurus
gcagagaaagtgctctctaaattgctcattaaaaaaattatttatttacttctttttggctgtgctgggtcttcgttactgtgcagcttttctctagttgcagtgagtcagggctactcttcattgtagcgtgcaacttctcactgtggtggcttctcttggcccactctaggcctgccagcttcaatagttgtggctccc

SEQ ID NO: 7831 - DNA, 201 bp, Bos taurus
gtgtgttttatctgtgtcccccttcttcccatgaaagtggtggtgagcctatagtaaagtacagttccaaacacaagagtagatcatacagagttttggccctgtgttagacctttggtttcctctgatattttttacccctaggcatttccctttggttcagtatttagatatgtctaagatatttgaaggcttttaaaa

SEQ ID NO: 7832 - DNA, 201 bp, Bos taurus
taggacttgtggtcttgaatgatggccatggcccaagtctgaaacaagaagctaagcagtgcttcctgaagatttgggccagaccctcagtgccaggtttctcaagaagcagcagaatggggcttgccatcccccagtgccctctcagtggcccctcccaaggctatctgggatgaggactaggaggcaagaggaggagtg

SEQ ID NO: 7833 - DNA, 201 bp, Bos taurus
gccagtaaatacaactctgtcaagttcatgcccgtattatcaggttatatccaaatctgcgatctgattctggactcacagcattgtcaccgtaatatagttgtcaaacccaacagaatttggccaaaatgatgctagcaatgtaacgttttttcaaaaatattttcataaatttatatacagtaaaattgactcttttgt

SEQ ID NO: 7834 - DNA, 201 bp, Bos taurus
tggggaatggaaaaagctaactccaggcttctgtgctggagatgagaggctgacagatagatatctgcagacatattaatgtaaggactgagacaagagaaaactaaagaacactggtgaagtagtatgcaatgggccatatggcttaatcattttggagttagtgactgagaatcttggagttacagaattccttcagct

SEQ ID NO: 7835 - DNA, 201 bp, Bos taurus
caaatccctgtttttctgttcccttttgaactcccacccccagtcgacattgcccggctgctcctgttgccacctgctctgttggtcctggacaaagtctcatgtgttaaatcttttcctcaaatgctgctcctctacctcaccttaactgagtcctagtttttccccaggatgctctttttccatctgtttagttcatga

SEQ ID NO: 7836 - DNA, 201 bp, Bos taurus
agatccacgaaggaagagggttttttggctttaatatggagggtgaagatggaagcaaagagaacttatgaggctactgtaataggttagaccggagctgcagtggcttagactcaagtgatggttaattttacgtgttaagttgactgagctactgggcctagatatgtggtcaaacattattcttgatgtttatttgag

SEQ ID NO: 7837 - DNA, 201 bp, Bos taurus
cctggactggacgtgctttcagatgggggcctgtgctggtatataaggcatcgtgtcctgggctgtgctcctgtggatgtgcaggggagctgcagtgaagaaagacaggggccttgggcccggccagcagtattccgtctgcaggagaaccctagtctactgtgggtcttctccattctatttttcttgtcctagaggagc

SEQ ID NO: 7838 - DNA, 201 bp, Bos taurus
tcacttgcaggacttggagcagcctgtcttcctttccgaggatgctctaagtagggtttatcccaccccagctgtagtactatgtgctctgcccagacctcggcttctgacttgtttccagtggccaccagccttggctggacttggggagtgctgtctgttgtactgtgggctttaaggaaagcctgggccatcctggaa

SEQ ID NO: 7839 - DNA, 201 bp, Bos taurus
agaagggaggaggcagatgccaaggcctggctctgccaaaaagaaacaaacacaagacaacagctccctactctgccggaacaactttccaactgtcctctctggcaggccttcttctgtacagatcccagatttcatttctactgctccaatctatctgtccacacaatcctcattgattttctcttcaggaaatttatt

SEQ ID NO: 7840 - DNA, 201 bp, Bos taurus
gactggtcctcttcctgagaagcacggcctatagctggatcattcctctggtcctgacccctatcaattccaacttatttttactaccccaaccattgcaaggcaccactgggggcctgggattacttgcagctgacccacatggacttgcaaagaaattagaacagggatagaacttggaaaatgtgctcctgtgcagtc

SEQ ID NO: 7841 - DNA, 201 bp, Bos taurus
ttcaaccctgaggagtggattaaacttacgagaaatatctacaactggactgaaagctatggaaggtatggagggcagttgtttgccatcagtgtgtagcggttttgtgtgcctaaaaaactcactgaattttgaaatgccttttaattttttagatttttttttgttttttattagtagttaatattgctatttgctgcc

SEQ ID NO: 7842 - DNA, 201 bp, Bos taurus
tccctcaccctatttatcttggcctaaaagtagcttcttccaggaagtcttctctgaacaccttgcttagccccagccaagactaggtacccttcctttgaggcttccctagccccttgccaatccccgtatagagcatgctacacatgtatgagtgtctgtttccttgtctggcaagccactctattacaagtttcatga

SEQ ID NO: 7843 - DNA, 201 bp, Bos taurus
gactcgggggagtcctttacatgtgcatccttggtcttcacaactatctcaaaattcattttaggtgattttgtcagtcagtcgtcaaaacgtaccatagtgccctagcacgagtggccactccactcaccagctggcaaggccgtaagttggaaccggaagccgctgccagccggctgcccaagctctcggggctcgggt

SEQ ID NO: 7844 - DNA, 201 bp, Bos taurus
cagcccgaggctcaggcaattaggggaggtggcacctctccatcagtatcactctctccctcaaagtggggcaaggggcggccgcaggctaacaggcgcactcagaccaggaggtctcttcccttcaccaaaggattagttgggggggcggcgaggggggccgagctccttcagggaattcggaaggcttctcgcattggc

SEQ ID NO: 7845 - DNA, 201 bp, Bos taurus
taccattatgttgattgcaaagagatgaggtagcaaaaacgttaagccatgagaaatttgaaggagacaattgtaaattgtgaaacattattcattacccgttttgtttttctggaaatggagaagtaggactattcaactgtagcaacaaaacaaatctcactctgttcctgaaatccccatgctctggtcctcttgagc

SEQ ID NO: 7846 - DNA, 201 bp, Bos taurus
atcaaagaattgatgcaaagttaaaaaactcacaagggaaacacatatatagaatattatacaaacaaggaatgagaaaatgcaccccaggttcatgttgcagttgcttcaaatagaggggaaggagggtgggactgagaagtgtacaggggagactccacttttatttgtaaggtcccattcatttaatttttaaaagga

SEQ ID NO: 7847 - DNA, 201 bp, Bos taurus
actggttactctatctgggccctgagttgctcacttcctagagaattgcctttaagaacaagagtattgactattttcaaatagctgtgccagtccatggtgaaggcccactctctgggagctagattctgccctgactgtcatggtgatcgtaaataaattaccctctgtcatgtgacccctgctcccctaattttccta

SEQ ID NO: 7848 - DNA, 201 bp, Bos taurus
ctccttgatttgtcctccccaaaacccctagttcagatgatactcagcttattggcccatactacctcatataaccccaaatcaaattgttttgaagtgttttaaagtgatattgcattcttgaccaaatcctttcctccgaggaagttcagaagatgccagtaaaagttaccacaattttaaaacggcagcttctctatg

SEQ ID NO: 7849 - DNA, 201 bp, Bos taurus
tgaaaagaccatgttttgtgcctttactgagtactgtggttcccagtgaacagagatgttataagaaggagtattatgttcctaatggatagctgtttctgatttatcctagttctacctgtgagataggtagtatgctttatcttaactgatcagatgtttaaatagtattagtttttcttggaaagttctgaggaatga

SEQ ID NO: 7850 - DNA, 201 bp, Bos taurus
atatcccgtttaaagcaacaagttattcacagttgcatgtttatgtttataaatctatttatatggctctagatagctctagtttctggtttctcttctagctctttctgaagagagataattgtgtctcaaagtattactttgcctcaaagcaatctccaggcaatgtttgcctcccctgtatgaagtgattcagcccac

SEQ ID NO: 7851 - DNA, 201 bp, Bos taurus
aagttgtaaagccaagaactttagagcttaaattcttaaactttagagggtaaatgcttattgcactgggcagtgttagacatcatgctatttagggacctgctaaaaagactcattcttcctcagtgagaaattttggagtgtttcatgcccttggataaaaatgtgagatccctaatggtttagcccacatttgcaata

SEQ ID NO: 7852 - DNA, 201 bp, Bos taurus
atgacaggaaaaagagaatccagatcatgatttcaaaccctctatcccttgctagatgccgctgtttaggtgaatatgattcatagtcagagctatgtaccgggcctcactttctccccacactgtcaaggtcaccccagttttcccagagtaggtaaggccactgtgagaatgacctgtccagaggtccaagaacctaac

SEQ ID NO: 7853 - DNA, 201 bp, Bos taurus
ttggggcctctccttatcttttattcttcacctttgtcagtttttaagctcaatggaaattctgcagttgaatcaatgttagagagcagaggtaggagagtgcaatgggcaggccaaggctgctgagctcttactaaaagtcaatattttaggctcttgcaggccatacaatctctgtcacaactactcgactctgctgat

SEQ ID NO: 7854 - DNA, 201 bp, Bos taurus
tattcaaagagtgtatattattcttagccaattccaactacccacttcaatatgttcatttttaaaggtgtctatgggttttagcacttgctttggaataccattcatattgtaaaataggatgtgatcatctataaataaaacaacccacttaaaagtagaaatgaataagatggtcaattaaagtaaaattgttttaaa

SEQ ID NO: 7855 - DNA, 201 bp, Bos taurus
aattgttaatatatgcattgatgatttgttgcccggtaactatgatttttgaagtgacaaactcatttcaatatttgccttttaattaaaatgggtatttcggcattttaaaattcatttttgaaggaaccccctactgagctgcagcatctcaggcacagcaggcgtatactaccatttttaaaaagccagctaacgatt

SEQ ID NO: 7856 - DNA, 201 bp, Bos taurus
ataatatcagggcccagttgcttgtgtcttataactttgtattccttggcatgttaacttactttagggtcccaactcactgtttgagctccggccattgtatcaacatttctaagaaaaaagaaaagaagagcatgctccctctctttaaattgcgtacagcccttttacttatgtcatattggccagaacttagtcaca

SEQ ID NO: 7857 - DNA, 201 bp, Bos taurus
tgttgctgatagagagcaggtttggccagcagtggccgggcaatttcagaatatttgctgaacacggtccacaaaccccaagagtcccgaggggagctcaaaaaactgaaagaaggggccccactctgtgtcttctgaggaaaggtcatcatatgatttacaaaggaggcttttaccaatgtttctagttactgtttttct

SEQ ID NO: 7858 - DNA, 201 bp, Bos taurus
catctgtttgtgtgaaattcctatgcactttatagtttgaactccaggttaagtttctccttaaattcagtttctccgttaagttcttctgaattcctatagtcctttcagcacttattgtctggtttaagaagttgagcctagttgggtgcctttgctttctaatggtttcatatgcgtaaggctcttccgtgaaactgt

SEQ ID NO: 7859 - DNA, 201 bp, Bos taurus
caaaattgcacttttgggactttttgatgccaaatgatgggttgtgaatagtttaatgtgttcatgtagcatcatgagactccatctatattgtcagtctcatttctctctatccctggaggtttaaaaatcagaatcgactgcagtttctttttcatgtgttcaactacatactattttattgaactagagtttttttcc

SEQ ID NO: 7860 - DNA, 201 bp, Bos taurus
gtcagttgttttatttgctattattttagaggtcctgagacagagcagctagctacgctgcactctaattcctgacccgtggaaactgtgaaataatacatgttgttttaagttactcggtttgcagggtagtttgttatgcagcaatgtgtagctgatacatcaaaagagaggaaatggaatatatatcaggataaatat

SEQ ID NO: 7861 - DNA, 201 bp, Bos taurus
gcagctgaatttcaatttataatacattccgtgagaagcatgtccttgggcaactctgtccccagtggaattgtctgatgaagtgggctctggtaaccacgcaggaggctgcatatgctttgattactgctcatgaggtttatatttctttaaggagcttaatgagatttttctggggggcaaaaataataattttccatt

SEQ ID NO: 7862 - DNA, 201 bp, Bos taurus
atggaaagcatttatttgggacttttttgtggattgtcaggtggttgaaaattttaaaacatctttggcctctaagtcctgtaagatatatgctatctttctggttatacatttatttcaaattttattgatgctgtggctatgaatgataatacaattctaagattaatatcaactgacttacctattatgtagtcacca

SEQ ID NO: 7863 - DNA, 201 bp, Bos taurus
agaaaagggcccgatgcttggccctcttcagagaaccttgcctccttcaaaatgggttgcccattctcagaaaggagcccacggtggccatccttaccaccaagaacagactgttttccttggaccatctcttgggtatagccttttcaaatcagacttgtcaccagcaagcctgaccacatccatttctcaggccaaggg

SEQ ID NO: 7864 - DNA, 201 bp, Bos taurus
taaaatcttatattgtctttgaccctagaataagaacaattctaaatcctactttgagcccagaacctccctctgctccccaaagtttgggccatgctgggaattccctctttatcctttttactactaggtcttaaatttgtatcattagtaacattgtttagctatttataagttaattgggatttttttgaatggttg

SEQ ID NO: 7865 - DNA, 201 bp, Bos taurus
cactcatcaacagtcaaactatcatttgagataaagcaaagaagtctatgaatgtgttaactgcttgatcattatcacacatatatgaaagcatgcacacacatatcccactaaatcgaaaccgaagtcttcaggaaatgaacacccagagccaagggaacatattcctctgacgaaagcctcagccagtgatcagtagga

SEQ ID NO: 7866 - DNA, 201 bp, Bos taurus
tttaactactagacggctggggaagtcccagaacagtggtgaaactgtttttgagttatgtaaacataaatctgatcctgcagctcttgccttccttctcttcactgattttgagtggtgtgtggctcaaaactgccctcagaaactttgacttagtagaagttaagtcttgaggaggcccaggcatcagcgttttataac

SEQ ID NO: 7867 - DNA, 201 bp, Bos taurus
cttataatgtgtacactaattctagcttaagagattaactttttatcttcttaagacaaaatttaagttatgagcttggtcaactataatgatcagtttttctgccgtgaaaatgttgcatttctaccaaaacaggttaaattacggttgattgggagtcagccagcaacctgctgtatccaacatagtaacagcatggaa

SEQ ID NO: 7868 - DNA, 201 bp, Bos taurus
tgggcctgcaatacccgagaaggtgtgggtccttcctccagggtccggatcgcgactctttgaggtgacaactccacacagccaccttttcggtccggcgccctgggaactctcagactcgtaggcctcaagcctcccctattgtttgactgtctgactcacacagctagaggagagaaacctcgaagaaacgaaccccgg

SEQ ID NO: 7869 - DNA, 201 bp, Bos taurus
ttattcaaaactttttgagtatagttttattgattatattctgctgtaaaaatgaatgttatttaatgtatatgaattttttagaatacatctaaaattagtatattgagttgtttgaaatgcctgtggtactaaatttctatgtctgtagtcatcttaatgagatcttttaattggagagtattttatgccattgaatgt

SEQ ID NO: 7870 - DNA, 201 bp, Bos taurus
ggccctcactcagcttggaagacagggaaataaaccagtggtaaccgtggagcagaacacctgccaagaaagggtgaaataccacgtgattgaaggcccccgagcacgcattgcccgcctccatcgtatgactcctggtcctgtatgctcttcgcctcactcttttctgttgcagggcctctgtccttgctcaccagcctt

SEQ ID NO: 7871 - DNA, 201 bp, Bos taurus
tacttcatataataaatgcatatcagtttagaattatgatatatttttaatgtatcaaaccttttatcattttctagtgaccttatttaccactagcatagcaacttttcttcttaaagatctatttggtgtgatagtaaaatggacatatcaactttttatttttttggcttacatggctgaaaggtggttttacacccg

SEQ ID NO: 7872 - DNA, 201 bp, Bos taurus
gggtacttcctcttaaaaaaacccccaaagacttgaaccgatttttagcattgcaagtcttttatagcccaaagataagagaattctgttctatttatgccaagtcccagaacatctgagttgccttatttttgtttaacaaaatctttcattttaaagtcaacttttgttcagcatgtctatttctcttgctcaagtaaa

SEQ ID NO: 7873 - DNA, 201 bp, Bos taurus
gcacaaggtcctacattcttggaattggcctaaggaagatttttttacagtatttataaaaatgctagtcaaagtgctctattgtcatatctcattttaaaatcaggccagagattggtgaacaccattgttccaactttgcttctgggtgacaaagaggcctggggctctcactcaggcaagaccagggttccaggagct

SEQ ID NO: 7874 - DNA, 201 bp, Bos taurus
tccaggggatcttcccaacctagggattgaacctgggtctcctgcgttgcagacagacgctttaccgtctgagccgctagggaaaccaaaagctctcattgatctgattctcctgcctacttctgcagccttacctccccactagcctgcctgtacaatgtcaagcattttcttatctctgtctttgctttttcttcccca

SEQ ID NO: 7875 - DNA, 201 bp, Bos taurus
ctaaatataaaattaaaaggagaggtaaaggaattgagctctagaaaatgaagaaagaatgcattgattttttttttttggcctgggatagttttatttgttgacttaggaggagtgcctaggtccctgtcagccttactatgccaagtagggttgtggacccacagcatggacttcactgggagcttaggaggcctgtgg

SEQ ID NO: 7876 - DNA, 201 bp, Bos taurus
gtgggtccccttgtttcacaacacaaggatgtctcacatcccctcatgtgagaaaggtgatgggatgcccatgtaggacaagaccagcctttggtcttgagtggctactccttacatgcctttccttcctttcctgttcttcccccgacaagctgaatgcagatttgatttggatgtcctaagttttgctgcttagtgata

SEQ ID NO: 7877 - DNA, 201 bp, Bos taurus
cttttggcctctattaactggtttcaatggttaagattcttgccaagtctaaacaaaaaattgaatctcacatctaattcctagctttcttcctcccttccagtcttgggccacactcagctgggacttatagaggggaagttatagccttcaatttctctatatttcctctacctacatttcagtatttgggggggagaa

SEQ ID NO: 7878 - DNA, 201 bp, Bos taurus
caatttgtcctttcccctctgtggtcacatattccacattaagggaccatttaattgcatcttgcaaactgtggaaaaatgagcaaatatcaccctccttcataattcttccacacagctatcctccagaatctcacttcactctctgcagacttccctccttcaactcttacttttcaagtccattcccttcaactcccc

SEQ ID NO: 7879 - DNA, 201 bp, Bos taurus
agtgtaggcagtaaaagtaaacatggaattatctcataagctcctaagtttccaagagtcatgtactattctatctatatcccagtgttagaaacatagcagatcctcaactgatgttgaagtgaaagtatatgtaaatggggaaaatattattccaaaagtcattttctaaaggttacctctctatggaagtaccaccat

SEQ ID NO: 7880 - DNA, 201 bp, Bos taurus
ctggctacccaccccagccacaggccttgtgaatgctaagacaccccctgccctctccctgtcacccctcaccctgtccctctcacagactaactgcacatattcaatattttcatagggcccgaaacgtcataaaagactataccctgctgcccatttctaaatccttctgataccatcacttgtctagatacttgagaa

SEQ ID NO: 7881 - DNA, 201 bp, Bos taurus
ttccatttttaaggccagcagaggagcatcttcagatctcaatctctttcatctctgcttttgttatcacatcttcttctgactctgaccctcctgtctccttcttataagggccttgtcattatgctgcacccattcagataatccaggaaaatgtccctattttaagttccttaatttagtcacatctgcagagttcct

SEQ ID NO: 7882 - DNA, 201 bp, Bos taurus
ccactttgcagacattggctcttgagttgaaaaaactttacttagctatgagtgacaagaagaatgacctttcaaaagccatgacttggcctggcaagaacgccagccagttccttgactgttttgataacctccaagtctacctggagcacacccaggctacagctgcctctagaagcaaggctctgaaagctggcctcg

SEQ ID NO: 7883 - DNA, 201 bp, Bos taurus
tccgtgtgcatcctaacccttgaaccacggttactgatctgtcttcattctcgtcctattttccctagtgtctacagaagtatgacaacacagagatctgtttttttttttcactttaaatatataattcatttgtcaattatttccctttttaatttgtaaatttataatatcatttttaaagattactttccatgtaca

SEQ ID NO: 7884 - DNA, 201 bp, Bos taurus
ctgtgtaggcaggccacaagagcccacagcaggatggagcccaggtttggggtcagtgggtcctgggtcaggttttcagcctaaccacttacagtcgtttacccttgaacactttcctggcctctttggttgtcctctgtaaaatgggaagaacatgttaagaatctatgccacaggtttgttgaatgcatgaaaacaaag

SEQ ID NO: 7885 - DNA, 201 bp, Bos taurus
aaatgacagtgatctatggtatgaataggtcactgtgtccttgcccaatcccctactttcttgcatacatactgcttttttccttaggataaaggcctgcaaatgacattgctgcctcaaagatcacacaccttctctaaaccttatgattgccaaatttcctccccaaggccatccctaaagcatgctacctctgtctgc

SEQ ID NO: 7886 - DNA, 201 bp, Bos taurus
accagcggacattgttttgagaaatgccagtgacatcccatgtctgacacagctcagaaaactcaagttctcagcagtacatggccttgtctgaaatcacgtccataatgcctcctagtattaataaccttaaatgtctcaaccacagcgactccattttgactttcagtttcatttttctccttaattggccaaagcagg

SEQ ID NO: 7887 - DNA, 201 bp, Bos taurus
aactttgctttcagaaccctgccaccttggagacaagcccaggatagtattaatctctggcagaagaatagaggtcacatggatgaatcaagtgccgtttatcccagctcggggccatcatagatcacctttcatctactgaccccagacacgtgagagtccagccatgatagggacagctgccgcccccaccttgagggg

SEQ ID NO: 7888 - DNA, 201 bp, Bos taurus
aattttaaaatgctgtcccttaattgcactagtcacattttaagtgttcagtagtcgtatgtggctagtggctaccaaggaattatagaacatggccatcattgtgcaaattctactgggcatgctgtgactggcacagtagagactgctgtgaggggcacaatagaggctgggtagggtaatgtaggtaaaacaggccag

SEQ ID NO: 7889 - DNA, 201 bp, Bos taurus
ccaccccatccaccacctgtgcggtcttctcagagctgtgtaactctaaccatcctctttccagaatcactgcagtggcccccaggccaagcctccccactcatctctctgcagggagaaacagcagtgtgagatttggatcagtcccccaaccccactacccgccctgtttgaaagcctgggggccttcctgctgcactg

SEQ ID NO: 7890 - DNA, 201 bp, Bos taurus
agtccatgaattgtacagtctggaatgaaggtgtataatcagctttcatgcagccatgtaagaccactccagcacacctctgggtggaccaccctgagcctgggccttctgggaagcatcttgcctggggaatggagggcatcactgcagtgcaaacatgagagattcgagtgatgagtgtgtctgaagaacccaggagaa

SEQ ID NO: 7891 - DNA, 201 bp, Bos taurus
ggcctagtagttttccctactttcttcaatttaagcctgaattttgcagtaaggagctcgtgatctgagttgatgttttctgtatacctcccatgttaccctgatgatatattgtcacggcccatactatcttgtcatatttttatttttccatattcccctttctcacatatactgttacatgtgaattccttgaggaaa

SEQ ID NO: 7892 - DNA, 201 bp, Bos taurus
agcccgctgctgtggggaggacggcctgggagaggagcctgaaggcaagagttgggcgaggacgccccaggaagagatggtggcactgctgccccttcccggggcccccagagggagaaagacctcaagttttctcactcaccgtagagaggacagcacctctgggctccttacctgccccaggcttcagggctacctgag

SEQ ID NO: 7893 - DNA, 201 bp, Bos taurus
gataagggtctgttcacaataaatgtttttttttcatccattccctcctcaccaataaaggaatgaaatgatggtttattgtacctctctcagcaggcccccacccacaccctatccacacccgatttcctgacttgtccctccgcgtgcttctatcgcaggtagagtacggggacttggagaggcccatccttccaggac

SEQ ID NO: 7894 - DNA, 201 bp, Bos taurus
ccgaaaatgcagatcagatcctgtcagtcttttgtttaaaacctccaacaacttctttagcttccaggattaggtttagtttagtaccagagccatccgcgccaagtcccctgtgtctttctcatttaccgcctgcatttctactggcagcttcatcatgtggctgcatgttccacctcctcccacacgctccttcattct

SEQ ID NO: 7895 - DNA, 201 bp, Bos taurus
agttgagtgaggttaaataacttgccacgccagggcacgtagtgtctttctggaaaccccttgccctgggttattgctgtacatcagaacagaggaagccgagtgtagggcctgagtgacgcacagagttcagatgagttgataagatgctcacaacatacttccatcagtgtcttcccagagataagcctctgggctctt

SEQ ID NO: 7896 - DNA, 201 bp, Bos taurus
cactggccctatagggcttggggtcacttgccttgagtctggttcccagagcaaagaaagcctggagactgcaggtgctccgccaaaggctggtctgtgtcgaaggcccctagggctcagaacccttgatctcctcccaagactgcggtgcagagctggattcctcctctgggctcctaccacgggtgtggacagatctac

SEQ ID NO: 7897 - DNA, 201 bp, Bos taurus
tgcaccttttgtgtcttccccttgatcaaaagaacatgtaaggcccctctgaggcatctaacatgaccagtctattcactctccagggttgacattttcccagagtttcactcgacccttgcccaaatacaatgtgccttttctcagcccaccttggaacgcagcgccaaagcctccagggccttgctcctgggcccgtcc

SEQ ID NO: 7898 - DNA, 201 bp, Bos taurus
ggaaagttctagaagcaaggcctgaaacctggccagccctctccccagagctccagcagtgccagtagtggagtggggatgtaatcaaaggaaaaaggcacttacttgctctgtccaggggccatttacctccacccttctccctacccccacaggcttcttcttcttcagtcctgggcaccaaagagtggctggtcatgt

SEQ ID NO: 7899 - DNA, 201 bp, Bos taurus
agggactgcagcacgccaggtttccctgtccttcactatcaaagtccatcgagccagaagggccagaggtaaaagtgcacgtttgagggaaatggccagcgggcagggttaaggtaggtgaactcacccagttccctgtgaaaccagaagctcaaagaggaagaagttactggcaaccatgtgagcatgccctccccctct

SEQ ID NO: 7900 - DNA, 201 bp, Bos taurus
ctatctctaggcccttagtttcctcatctgtcagatgagacttgaactacgggatctctgaggtcgctctcagctcaaaccacctttgaccctgttgatcgttcctgccagagtgaggtggccccaagccaggactcatgatctgatggtgctggcattaaaaagaataaggccagagggtgaggcatacaaaaaccagac

SEQ ID NO: 7901 - DNA, 201 bp, Bos taurus
tttatatttaggtgtataatccatcaggaattaattttcatttatatgatgtgaggtaccacccaagtaattcttgaaggcaattagctctttccgttttaggtacatccctttcctctcatcttcccttaatttgcaaagctgaggcatctttcatttccatttcccagagtagagcatagtcaaaacgctgacaggaca

SEQ ID NO: 7902 - DNA, 201 bp, Bos taurus
agggccccttgggccccacttacctatctgtggcctctttggactccagctaattagcagccacaggaaggcctgtggagggggtactcaggcctgccaccgcagagccctgccattagagcgatcgataccatggttgaggggggaagcagctaagaggagggggcctggaaaggctcctgagctgcataaataactcat

SEQ ID NO: 7903 - DNA, 201 bp, Bos taurus
ttgctggccagtggtaagggccctggctgtcttaaaggatgagagtcatatctaagaggaagttgtatgcctatgcttccctttctccaggtttctcctcatggggccttgtgttgagggatgccttggtgttcacttcctccgtatccccagcaggtggcagcatgctctgagctgggctgcaaaaccggtgggaaagtg

SEQ ID NO: 7904 - DNA, 201 bp, Bos taurus
ggctggattaagcctctggagcagacgttgcctgtggctcgccagcattccgagagctagacgggcggcgggcatggatggggattcagctagctcacaaaactgttgagtaaagacctggagagtctgttctgaaaggagaggccaaggaagggtcaggtgtcaggggactccaggcgagccccgctcagtgccttcaga

SEQ ID NO: 7905 - DNA, 201 bp, Bos taurus
tgttgtgtcctgtgaaaggctcagacctggttcttattacaaatgtcatagctgcctggcagttggagaattgagtgagtttgtcatccatcttccccccggctcataaatatggacagtcccctttccccacatcagatagaatggcattgactctaaactttaacccctcttattttcacctgtgtcagagagcagttc

SEQ ID NO: 7906 - DNA, 201 bp, Bos taurus
tggaaaaccttagcatgaagtacaagtccttcaagatctggcccctagaacttctctaaactcatctctctgaactttaccctcagtctttagtcatttgaaagagctcttgtccactttaggcctttgcatactgatcccttcagggcttccctgaccactcagcaataaagaatctgcctgcaatgcaggagactgatg

SEQ ID NO: 7907 - DNA, 201 bp, Bos taurus
acctcctctacttcaggcctcctcactcacccggcttcagccatactggcatccttgctgttctgacacaccagacacattcccaccttaagagtctctgaaatggccttaacaaatctaaataaaaagtgaaagtcgctcagtcgtgtccgactctttgcgaccccatggactatacagtccatggaattctcccggcca

SEQ ID NO: 7908 - DNA, 201 bp, Bos taurus
cattttctctcccagttatcacccaaccttaatgaggatgataaagaaaaggtgacaagaacaaagaaccctatgaggcaggaatgctagataagcagtctgggagaagataaaaattcccttcacataggctgcctgtaatattggaatctccttaccttcactacccagtaactatttcagtcttactcatctttcaag

SEQ ID NO: 7909 - DNA, 201 bp, Bos taurus
agatacttcagctctacacctcacacataaataaaattgttctcagtgtaaggaataaagaaagaggttgtccctcctcatatgttatgcgaggccagagttttggcctctggctgttttaatggtcttctctcacatctaaaggtctgggctccttaagtgcatgcatgtacccagttatcgatttcaaagctcactcaa

SEQ ID NO: 7910 - DNA, 201 bp, Bos taurus
gagtccgagctgcaccgtgcccggcgcgcgcgcgcgcgcgcacctcggagtctgaatctgcacaactctccgccaggcgcctgtgcgagaggccgggagatccgcgccccggtccgggtagctgcgcccactcagccgctctcgtttccacccggctgacccttccccttcagtcacctgggtgagcgctttgcacgctgt

SEQ ID NO: 7911 - DNA, 201 bp, Bos taurus
attaaaatttaatgtctttaataaaatattcttgcctctgatttttgttgattagaaagttttgtttgcatgaaaattttgcacgttgttatctgtccctggatgtgttccactgtctcctagtttgcagtctgtggcaactagaatagaatttgtatcctattgtgtggaaaaaaaaaaacttgttttttaattgtgtga

SEQ ID NO: 7912 - DNA, 201 bp, Bos taurus
aaattagaactggtgaaaattctctcttctgtaaatttatcagggtggggatattcactggaaaaggaaatcccttggccaaacccaaaggtgccaaaaaagatggagagcagtttttttaatagatctgagatctgggctggtaggcaggagctctatgtgacagttctggaaccttgggcaggtggagcgagatggcct

SEQ ID NO: 7913 - DNA, 201 bp, Bos taurus
gggtgtcccttggattgtagctgcatcaatccaatttagtttccatcttcatgtggccttctgcttctgtgtcttcacatggcctacttatgaggacccaccctaatccagtccaattcagatctcatattcacttaactaattacacctgcaaaggccccattcccaaataaggtctcatacacaggcaccagggcttaa

SEQ ID NO: 7914 - DNA, 201 bp, Bos taurus
catgggcatctggctgccatcttatttttacccctcaacacatgaaatgttagcaaaaaaaaaaaagtaccaactgagagtataattgcttattatacctgtaatgtctggtagaacatgtaggtacagccctttatcagaaagagggtaaggaaataagcaggtaaaagtagaaaaaaaaaaaacatcttgccatgaggc

SEQ ID NO: 7915 - DNA, 201 bp, Bos taurus
tccccttcccccaaattgaactccccccctagaaacaaccacagatgtgatttctatcatcatgatcagtttttctttctttcttttgaatttaaatgcttttatttaggaaatgtgctgtaatacataaactaaatagagaggttagaatgccataatttgacagtataagagcaattgcttaaatgttgactctatgaa

SEQ ID NO: 7916 - DNA, 201 bp, Bos taurus
aaggtattagagatggagtggcctcaacagcataaacttattgtctcaaagctccgtgtctagaagtttgggatccgaaagtccacagggctggttccttccgagggccgtgagggaaggatgtgttccaggcactctcctgagcttgcagatgactgtcatctctctgaatctccacatggacttcctgttccctgtctc

SEQ ID NO: 7917 - DNA, 201 bp, Bos taurus
tcccattcctgattttcatttgctgtggatcaggccccaccacaatgcggatgctacttatattactaagtcttctcactacagcccaggacctcccccatgcccttgaggctcatctttatgggcttcaaacctagtgtcactggcacctctgaacttttgttctggcattccccactattgccgtcagctgccgccttc

SEQ ID NO: 7918 - DNA, 201 bp, Bos taurus
ctgctgaggccttcctgtgtggtctgcctccagtctccagccagtggccaagaccttgacacctcaaagtctcctggggctggactcttgacatccccaccgtgtgtgcatctcccagaaagggccagcatcatctggaggttggggggcggcatggaggggtgggctccacctccaaggattgacaagagcagccagaga

SEQ ID NO: 7919 - DNA, 201 bp, Bos taurus
cacactgcttgttaagagtgtcccgaagactaagtctgtcatacactctggaggcatttttcacttgcaggtctgttagggccttttgccctgatcctccgggtgccaatgaaaggtctagaatgaacagagggtggcatcagcaccaggctccgataaaccctttgctgtttccttgctcgtggccttcttaacggatga

SEQ ID NO: 7920 - DNA, 201 bp, Bos taurus
atttcaatgtattcagtattggcttggcctccattccattttgatatagactggcaccacagctgaatatattgatttctcatgcattagcttttctttcataatcctctgtcagttctctgatccatgagcgagagaaaaagagtataacaggtaagattgcttttttaaagttgttttaaatgctttacatgactgaga

SEQ ID NO: 7921 - DNA, 201 bp, Bos taurus
tctaacccctcctaaggtcaagcagataccatgtggctcaagactcccaccgtggatcagattgttaatgtgacccaaggcctcctgtaaacagaaacagccttaataggcaggctgttccagggacttaaaggttatctcctaggagccaggccaaatctttctatggtgtatgcaggttttggacacccctgacctgct

SEQ ID NO: 7922 - DNA, 201 bp, Bos taurus
ggtggggtgaccacgcttagttcggactgaacagaattaaccaccagagtcatgggtgagaggtggaaacccaaataaatcacaactctgccctcaggaaataaggggagaaatggctgttgtggaagcaaccagcgggcactgaaataacccttgatttgttgtttaagggccagccaactcaccagttacgacgacagg

SEQ ID NO: 7923 - DNA, 201 bp, Bos taurus
ttagagaactgaaacagtttaatcatccgttatagagttccaggaaacagcctcctgtgcagccactgcacaacttatcatatctggccaagaacagtcgaggtgttaggcatcagcaggtgaagaagaatgaaagggttaaatccaaacatctgagacggtgtcctgaactggcctcccaaagatggttctcagaggaca

SEQ ID NO: 7924 - DNA, 201 bp, Bos taurus
acagtgcagtaagtcacttctggcctgagtgaacagttgttcctctcgctagagactgggaagtctggagtggaagctttcttaagacagacggatcaagttgttgagtgtctctgtgcagaaggccaaactggtcagacagttgtcctccacccctgccgccacgcaaggagcaagtccgtctttcagagtagttaggta

SEQ ID NO: 7925 - DNA, 201 bp, Bos taurus
ttagactaaatatagtcatcaagtcacaagggaagaaagaaacaaagaagaaacagaaaagaactacaaagacaaccagaatatggccaaaaaaatggcattaagtacacacctatcattacttcatttttgttttcctggcagcactatgagatttgcaggaccttactttccttatcacggatcaaacccggggccaca

SEQ ID NO: 7926 - DNA, 201 bp, Bos taurus
ttgaagaaataagaaataatattttaaagttattacaatatttagaagatagtattacaaatatatttggcttttgttttttgtttataacgtgtaatattgattcttaagatatgcttttctgttttatgtgaaaagcactgacctattgcatcataagtcagctacccgacatctaacctgaaccacaccaagcttaag

SEQ ID NO: 7927 - DNA, 201 bp, Bos taurus
agaaaaatgtcagacttgccaagatgtggggaaagagggtttggggttcaaaaaaaaaaaaagaacaagtgcaaaggccttgaggcagggacctgaggccagaacaaatgattcttggagaggtagaaagagggtcaatgtggttagaggacagtagcagagaaatccttagagaggcaggctggggccatgatgagagca

SEQ ID NO: 7928 - DNA, 201 bp, Bos taurus
ccccaatctctagacccaagggcaagacctgtctacaaaagccccttcctcttggtgaaaccagctgctgggcttcagtccaggtggcccccagactagcacagaacacaacagaatcctttcctctctcgttctccctttaaaaatattggcaaatgcaggcctcagaagaatggcgtggccttagtgggagatgcccag

SEQ ID NO: 7929 - DNA, 201 bp, Bos taurus
acttaaagtcaataaaaaatattttgtatgataaaataactaagaagtacatgcaactaaagttattatgcacatatattaagaaataaccttactacagtcaagtttttgtgtttataaatgagtctacacacaacagatgacttggactgactttcaggttcacagtaaccaattttttagaatgaattctaaatataa

SEQ ID NO: 7930 - DNA, 201 bp, Bos taurus
aaagcatgggatgaaggaataaatagggccagaaacagattttgggctgaagcccaaagaatctgaatatctttcttaaggagaaatgtgactttatcaccgagattacctggataaaataaaaggtaattaaagtgactgagaataaaactcatcacaaggtttgtggttaaagggaagacaaccaggatgaactgtgaa

SEQ ID NO: 7931 - DNA, 201 bp, Bos taurus
tcctaaagtgaggtacataatcagagataaactcagttcaagtatcagagtactgacccatgtttaagaatttctaagttaatagtaactgaaagggctggtttttttttcccttaatcattcggtatgattattttgtacctactatatagatgtactctgctgagcacagggttatagagaagaacattctggtcctga

SEQ ID NO: 7932 - DNA, 201 bp, Bos taurus
tcttctataaatctagttaaatagataaccatttaacacatggatttaaaccaaactaactagggttttatgtgctcctttttgctagaaggagctgctcgtacagttaaggaaggttgctgccccaactagtacccaggtttgagcctccagaataaacctgttacacaaatgcaagacagtcgtgtttcccttcatgtt

SEQ ID NO: 7933 - DNA, 201 bp, Bos taurus
gtcacggaagtttcccagggtctcagaactcagctcttcgcagcgatgaggaggcctctgggtccctgaggggctggcctcactgccagccccgtcacccgccatcctcaagaagaatccagctctgtaccgttcccaaagtggactgcatcacatctttccaagctcctgagacccagggccccaactgagcacccccgt

SEQ ID NO: 7934 - DNA, 201 bp, Bos taurus
tatccatctatttccccctggccagggggcaggagtcctgtgttttagtggagatgatcttatttaccttgatgctcaaggttgctcctcaaatatttccaaagtccagcagcactcaggcccttgggtggctcatgggccctgagcatcacctcatatctcaccccccctggctgttccatttttgcctcattctcacca

SEQ ID NO: 7935 - DNA, 201 bp, Bos taurus
ctgtgctttcaaccactgtgttaggctgcgactcccagctggctctgagcagaaatgttaggacagggctggagaggatgaaagagggaaaatggccaggtgctggtctcagatgtgatgtgggtgggggacaagggtggaaccatggtagctgctcagatgtcatgatggtaccattcattgagctgtggaaccggggtt

SEQ ID NO: 7936 - DNA, 201 bp, Bos taurus
tggtcaccactttctcaggaacctactagctatgagccacaggggaaggaagccccagaatgaacattaagaagacccgctctcctctggaagggcagagcggttccctgtgccaagcagttatttgtcccctaacctcccctcagcgtccagagtttctgtctctctgggctggaacaaacgagaaccccgattgcccaa

SEQ ID NO: 7937 - DNA, 201 bp, Bos taurus
atcttcacagtagcattgattactcttactctgaaagtgtggccttgatgtttatgcagggtcttgtatatctgtgttgcaactcttgtgactcatttgcgattctgtacaattaattttctaatgctgagtaaacatttggactctttctccatctgtcttccttgtgaagacctctgtgcaggttccgtcaccagcaaa

SEQ ID NO: 7938 - DNA, 201 bp, Bos taurus
ggggaggaggacgaaggatggtggcaggagagcctgggagccggggaggctcctcggactacagcaccttacagttggcgcccaccacctcctggccaccgtcacagcctgggaagggatggaatggagatttcctgtctgttttttcaggaagaaagagaagtcccccagagagcacactttctgctatctttgatgccc

SEQ ID NO: 7939 - DNA, 201 bp, Bos taurus
gcacatacaagtcagatgtttcataaaaggtttagatgacctgataatatgttttcaaaacccagagagtgagtgagagaaagagagagagagaccctgacgcaacctcaagttaaaaacaaggaaagaaaagtacttttgtagattggaatcgataaggagtaaggaggatacctattcgctctgttctaattttaacct

SEQ ID NO: 7940 - DNA, 201 bp, Bos taurus
gaggcctggcgtgctgcgattcatggggttgcaaagagttggacacgactgagggactgaactgaactgaactccttttagagactagagcagagggcaggggggcctgccctttggaaagggcgcagtgatgccagaagaaagtaatttctttctctctcctacagatagtcactgactgtgtatcaggtgaggtatgag

SEQ ID NO: 7941 - DNA, 201 bp, Bos taurus
actgcaggcaggttctgtagcggggctggagtgggaccagatgagcggtgtgcaggggctacgtgagcaaaggccgagaatccgggccctcgtggcagctgtccgcgctcacatggagcccacactgtaagtcaggcagacagacttcagcagccaccagtcccaaaagcaaaccaagctggcccttgcacagcaaggacc

SEQ ID NO: 7942 - DNA, 201 bp, Bos taurus
acctgttgtcaggtgagcaatcaccttgagacaatggttcctgtgtgttcaggaggcaacacttgcctatccagaggcaagagcctgtggccacagtgtcgctcaacaatcagcgtgatagcgtgatgagcagcgatggtttttatctggcagcgcataggtagggccagaatgaatggcactcatgaatagctgattccg

SEQ ID NO: 7943 - DNA, 201 bp, Bos taurus
acaatccatctgattttcacaatgcttcaagaaaagcttatattttctaggaggacaactttacaacagtttccaggaaaagtgcttaattaacactgactagttttaacctcctcaagtaaggccccacctttcacagagcataccttcatcaagagaagacaaaagaaagaagaaacagcaacaaaaggctatttcaaa

SEQ ID NO: 7944 - DNA, 201 bp, Bos taurus
atgacctgggggagcaaacttgttattacacttgggtagcgtcaatgggtgcaaatacttccttgagaaaaaaaatccaagttaaatgccattaggcctcttagattgaaatggtactctccgaaagtgaaagtgagagttgctcagtcgtgtccgactctttgagaccccatggactctacagcccatggaattctccag

SEQ ID NO: 7945 - DNA, 201 bp, Bos taurus
gagggatgtgatgcaggccgctggatcacacataaccagtttgctgtgtccatttcaaagaattgttaagctttaaagaccttcaggcctgttctgttttctagccctggaagggatggtacctagtaatcttttatcttcacatcttaggttactgtatcaaatcatagaccatatgatggaatcatagtccatcataac

SEQ ID NO: 7946 - DNA, 201 bp, Bos taurus
taccatcctccagttaaacttttttttttctttactagttgtttctttataaagttcttagattactgaaaacaaacttgtgtaatgatttttactatacataagtcattcgaacctgcctaaaatttaatattctagcaaggttttcctttttggatcagaatgacaggaagcctcaagctctttggaaaggtcagtgct

SEQ ID NO: 7947 - DNA, 201 bp, Bos taurus
ccagaccccatgcaactcgtggcataaattcgtgagttgaccagcctaggtttagtagcatagtctctgattattagcccagagaagccagctggcccaacggcgactatgctgtcaaagtcacttcagttgtgtccgattctgtgtgaccccatggactatagcctgccaggctcctctgtccatgggattctccaggcc

SEQ ID NO: 7948 - DNA, 201 bp, Bos taurus
agtggcagcagcaggcagtcggcatcacagggcagacaggtgttgggctctgctggtaactgggcagctcccgacctctccagcagcagttgtcgcggctacagcatgaaggcagtcagtctctgcctcctggcatgtgaaaggtttcagtgaggtgtaaggcacagagaacatttagcaccctgcctggcacctactatt

SEQ ID NO: 7949 - DNA, 201 bp, Bos taurus
tcagcaccttgaaaacatactggaaaaccagaaatgtctctcaactattttgccctctccatgcaagcaccctgaggcccgaagcagctcaaacccagacgacacgccttgggtgggctctgcaacatctggaaagcccagcagtcagagagctcatgctcatggccaccaaagttcatttcttttaggggaagtgaagac

SEQ ID NO: 7950 - DNA, 201 bp, Bos taurus
gtggtcagctgccacagggccctgcatgctggtggacggccacctcgggattacccctgcaattttccattcccttccatatttcttgacatctcagtgctcatgggagttaccttggcctcctgactggctcttcagtggttgggccgcaccctacaggccaacaaaccttgtagttgcccagcctggggactgaagaca

SEQ ID NO: 7951 - DNA, 201 bp, Bos taurus
cagggaccaagaccagggtagaggccaacagatagagaccgtgtaaaacaagaggtgctgacgaatggtcaggctccttgtttgtacaggacagacatgtgggggcaaggggttaggaggaggccacatattatctgagtccgtttatatataggaaatgtccacaatagggaatccattcagacagaaaacagatttgag

SEQ ID NO: 7952 - DNA, 201 bp, Bos taurus
agtggtaacatcttacataactgtatgtaccgtacgtaactgtttgtagctgtatgacataacatatatgggttatataacataactatatatatttaccggcaagatatcacaaccaggaaactggcattgacaaacttcaaccatatgcaggttttacaagttgtacttcctagtgtgtgtatgttcatgtgggttcta

SEQ ID NO: 7953 - DNA, 201 bp, Bos taurus
aactcaggtacgggcaagggtggggcctgcaggggagctcagacaggtcttggggcccaggggagcatgcacagctctggggccagcgattagggtggctttaaggagcaggagtggcatgatgatgctagagcttcttgccaccaaaggttgtgcatgaggtggcccggagttgcaaaggtggtgacgaaggctggcatt

SEQ ID NO: 7954 - DNA, 201 bp, Bos taurus
ctgctcaggcccggggctggagaagtggtcagaggaggtgatggggcttcacaagggaggcaaggtcccctggacattgcaggtatctcttgctttcagcgagatcaattaggggccatcatgtgcatcacgaaaggaaactacctttgataaaagaaaattttaaaaaagaagaaagagtaaccgtagggtttctctgag

SEQ ID NO: 7955 - DNA, 201 bp, Bos taurus
ctgggtccaatgaccggtctgggtggctgtgctttccggcacttcccaggaagaggacccattttgccaagctgttttaggggctggagagagaggcctttaccaacgaataagctcagtacaagagctgtttactgaagcaccttccaaagaggacgggctggtcctgcaggtgttcattgttagagaggggtcagcagc

SEQ ID NO: 7956 - DNA, 201 bp, Bos taurus
aaggaaaatcgctcacaggcgattttggggctcacaggccccaaaatgcaggggctctgggtcacctaagaaacaacagtagttgcggttcacttttcaaggactccaggccctactggggcttcccaggtggcaagaggggtaaagaacccgcctgctaatgcaggaggcgtcaagacatgcagcttcaatccctgggtc

SEQ ID NO: 7957 - DNA, 201 bp, Bos taurus
atacctggtacaggatccccagtaagcctcgcctaaatttcttctctggcttctagtcaatttctgttcatggagaaggccaagaaccctggttggtatccgccctacatatccacaaagagggctggttgcccagagtcacacagcaggtttcctggttgaagtgtccagtcactctggatgggccaaaccttcccctgg

SEQ ID NO: 7958 - DNA, 201 bp, Bos taurus
gagccagaggggtggcttaggtgggttgcccaccccttaggttgctgtgtgcagggggcatgcctagtagcctacttttgctcctgactccctgcttttgttccaagatcttcaaaagtggcagttcggctttatggtctctttatatcttttgagtccagaatctgccccaactgcacatgcatgcagttatttttaatc

SEQ ID NO: 7959 - DNA, 201 bp, Bos taurus
cccagttgagctctccagcggcttcaggctgaaactctcagcgatgaccatgaccccctgccttagactccaacctggaggaccctgctgatctagacattagtttgtgcctgatgcacacaagtgggacagcctggacctaggaggagccaaggtttaggctgagtcaaggttttataagaagtgatcagagggaggaga

SEQ ID NO: 7960 - DNA, 201 bp, Bos taurus
ccccctcccccagagctggctgagggctgccccacaacatcccacctcctccccccaccatggggcaaggctgcttataaatggggactggatgagtggacgggctggagactcggaaggcagcctgggtggaggacagaatgcctcccttgttaaagatcactgcttgtctttgtacaaaatccccaagcccaactgtta

SEQ ID NO: 7961 - DNA, 201 bp, Bos taurus
aaatggaaactggggggtgcccgcagcccgttttccctctgccacagttcccaggaaaggacccctttcacaggcttgtaaaaatgcttttatgagggccgcacgaggaaaaagaagtccttcccatgtcttgtttgcttttctcctatgaacgtcattcctcgtatttgccgaggtggaaaacaccaaaaccactggaga

SEQ ID NO: 7962 - DNA, 201 bp, Bos taurus
gtgccagtccccctttggtcacttactcacccattaggctagaaaaatacctgcttctaggtgccacccacctggcaggtgagacctttcaatccccaaggctcctcctgcagtccaggccctgctgctgggtaactggctggacgatggacaagtacccacccccccaaatacacacccacacacatatgcatgacgctg

SEQ ID NO: 7963 - DNA, 201 bp, Bos taurus
caatgtacaaagtaaggaatacaaaagggagcagacattttgtcttcaatggccattagtgctaactactcagaacttaggcttcaaaaaatatagcaagcatctaaaacctgcttacaaggcctcctggtggctcagatggcaaagaacctgcctacaatgtgcgagacccaggttcaatctctggaagatcctctagaa

SEQ ID NO: 7964 - DNA, 201 bp, Bos taurus
acttgcgggtgtactgccattaaggagaataactttcctgttaaagataaacacttggaagaccactgttactaccactacagacttcacacttaaaatacatgtcctgaaacaaggcccttgagagttctccgcccaaaaatgtatgcaacatgaagtttagggtatatttatcaggggtgggagacacccttgtcataa

SEQ ID NO: 7965 - DNA, 201 bp, Bos taurus
tacagaatcaaagactgacaattaccttttgttcctctctttcggttgcatggtgacacttttcaattctccaatgcctcaagaaatctcgaagatatccgaagagagtgaggacaccataccccacataagtaagcacagcaaccagcattggtgtttcttcaaaaccttcattaaagggtcttttatacagtcctccat

SEQ ID NO: 7966 - DNA, 201 bp, Bos taurus
cctcaaaaacattaaacataccatatgatccaacagtttcacatctacgtacatacctgaaagaactgaaagcatagtttaagagttattggctgacagcggcattattcacaacaactgcaacatggaagcaactggagtgtacactgacaggtgtatggctatgcaaaatgtggtatatatacatacaacggaatatta

SEQ ID NO: 7967 - DNA, 201 bp, Bos taurus
gaaatgtttctgaaggatatacataagcaggaccagcaatatgatttgggggcccagtgcaaaatgaaaatgctaggcccttgctcaaaactgattaagagttttagatggtaatggcagagcattaaaccaagttcagaatactgagcatggagatctgggtgacttcggggatagtgtaccctggaagctggccctgat

SEQ ID NO: 7968 - DNA, 201 bp, Bos taurus
gcaggatattgacaaatggcatggagtcagtgaaagctacaaaaatgatgacaggactggagggagtgatttatgagaggagattagcagagtgatggtgcggcctagcaaacaaagggatggggtgggggaggccgtgggtcctgtgaacctccgaagtccaaggagaggcgaggggctggggggcagcgtggagtggcc

SEQ ID NO: 7969 - DNA, 201 bp, Bos taurus
cgtactctcggtctctgcggttttcctttgactgttgaatcatagttagttgcatcacttcactggtctccccagtcctaactctgtctctctctgtaacagaaggccttgcgactcaaagttgaatctgtattcttgtgaaatgcagactctgattcagcaggtctggtggggcctgagaccctgcaggtgcaacaagcc

SEQ ID NO: 7970 - DNA, 201 bp, Bos taurus
tgaagtctgtgcaaggaaccaggggagcagaggcgagagcaacagaccgcttagaaagggaggtgggggcaaagggcagcgggtccactgagggccaggaagggttcagagggagcctagcattggagaggaacactggaggagtttgccaggtagtgaagtggggaagggccccccagaaagaccaaacaatataagaaa

SEQ ID NO: 7971 - DNA, 201 bp, Bos taurus
ccccgtcagagctggtgtcggccagtgccacagcagagcccccctaactgcatcaaactgcgagtcactaaccgctttgggcctcggtccccttttgttgttgtttagtggctcagtcgtgcccgactctttgcgaccccacggactgcagcacaccaggcctccctgtccttctctgcctcccagagcctgctcaaactc

SEQ ID NO: 7972 - DNA, 201 bp, Bos taurus
tgcaaatacttgatgtgaaaaatgagcaacagcacccccttccctccattcaataaaagtaaagcctcttttacagagtgcacgaacagtatttgcacttcgctcatgcggtctccgtggggtcgtgtgtgtcatttggcttcatgacagaggctcataaagtgtcagtgctactcattcgtcaccagatattactgacca

SEQ ID NO: 7973 - DNA, 201 bp, Bos taurus
cctttctaatgggttttggaggaggcattcctctgtcctcttcatcgtcctgactgttgaatgctcagtgtcctggccctcacctgagggtagctgaagcatcttccacggctgccttgcgtgagggagtgtctgggaagacagtgaagtctgcaggctccccgctcttgttcttctgtgaaagctgcagagaagaggcca

SEQ ID NO: 7974 - DNA, 201 bp, Bos taurus
acagggctgggatttgcattcagattttggattatttagagcaatggtaaacatgaaaattacctggggacttccctcgtggtccattggctaagactccgcactcccagtgtggagtgccctggttccatcttttgtcagggaactagatccctgcagctaagagtttgcctgctgcaacgaagaccctgtgtagccaaa

SEQ ID NO: 7975 - DNA, 201 bp, Bos taurus
tggataaccctcctccatgtgaatcaggggccatgctctgccctgaggtgtctggtatatctgagagtggacatctgtgtttggagcaaactgggagggattggaggccacttttggcttggtgtctttgcttcatcaaccgctctgccaaggtttgttcacagtctcctctggccatgctcatttagttatggaaaacat

SEQ ID NO: 7976 - DNA, 201 bp, Bos taurus
cggccatatctctcaaaccagacgcggggctgaggacccttgggggagctgcccagccctgacacgtgagttgcccacgtcccagcacgatcctgccctgtaggcccccatacctctttccctgaagtcttggccagggtgtaggcatcagctgatgattattattactgttattggagttattattttttaaaatactcc

SEQ ID NO: 7977 - DNA, 201 bp, Bos taurus
gacataatccccattttacgggtaagggtggagtcagtatgtgagagaatcaggcatgtttgaccttcaagtagagttcctagtgtaataagtggtggacgtagctctttcattaaacttttgatagatttaggataaaggtagtcaagaaaattgctcatggaattagtgtgaattgaattcatgagaatcacagaatcc

SEQ ID NO: 7978 - DNA, 201 bp, Bos taurus
ctgtgcactttgcagggagtctagcttgttttgaaattagcctagcttgcctgcatctgggaaggactctggcagagaaggccctgcatgcaggagctgaaagggagcatttcttacctccagacccacaggacacaggttatccctgccccccaccgggaagtgaggcagaaatgactcttggccatcagccacagtttt

SEQ ID NO: 7979 - DNA, 201 bp, Bos taurus
agagtccaattactttaataaaaagagcatctgaattagaacctggccaccaggtccatttctggtactgattagaaagccgtaactcctctgtggacacccatgtcttgatctgtcaaatgaggattgttatcactgtcacaccaaacataccctaccaaggagcccttctaacgtagaaagacaaattggatagcaaca

SEQ ID NO: 7980 - DNA, 201 bp, Bos taurus
taagggatcagatttaggtcactgctccttagacttgactctgcacaccaggcatgtgggcatcttgtggaaatgcagatactgattcaggaggtctggcgtgaggcctgaggttctatattcctaacgggctccccagggatgctgatgttgctggtgggtggatatatgttgagctgtgaagttttagtgatattagag

SEQ ID NO: 7981 - DNA, 201 bp, Bos taurus
tccattccagcatggaaataggcaccgaaacccacagtcactgccatggccctcatgtctcacagcctggattgctcgttgatcatttggacttacaacaatggaaacatcaggaaccccaggcctcctgggtaattgcctaacctttgagatttttcaaaggaaattgcaccttttgtaaaatatctcacaggaggacag

SEQ ID NO: 7982 - DNA, 201 bp, Bos taurus
tatgcatatttcttttccagacccatgtctacatatgttctggaataaaatatgtctccatgtcatacattaggtgttaagctgtttaggcaagacttgtactcctacatagaattatggtaacatgaattgcttatcttcaaaggaataggttaagcatatttgttgtctttgccaagccttttctcactttgtagactt

SEQ ID NO: 7983 - DNA, 201 bp, Bos taurus
ttcatctcatctcaaaataggaagttacttatttagttctgctaaagttgtgaccctgattgttttactgaaattgatctactcacagttaattttctcctataaccacacatgttaaaacacggaggtttccttttcactcgagaaggatgtgtacatataggctatttcactgccttttcaggcttttttacacctttt

SEQ ID NO: 7984 - DNA, 201 bp, Bos taurus
cctgcgatactctgtgacgtgctctggcctttttggtctctctatcccagtgtccaccatagggtcatgataatttgcgatagacaatcaaacgtcgattcgatggcctacatgtacagctgcactctcttttgttcagaaaccagaaaattagaagtggtctccaaccaagaggcattctttatttactcaataaaaacc

SEQ ID NO: 7985 - DNA, 201 bp, Bos taurus
gccttaaaagctgtttactttgcagttccatcctgcttgtagcctcattgcattttcttctctaattagtagatatatgcatcatctcttggccatagggtgagtcctcgttgggtagtttcctagggaagaagctcatggcatcgctctgattctgggtgtgcggcctgtcttctcacacattctcaccccaccacactt

SEQ ID NO: 7986 - DNA, 201 bp, Bos taurus
ttctaacatagaaccaggtgacctgattaaaaccagccttctttgccactgcctaccctttcaaggaggaggtcgcctgaaaatttacttcctctggccactttttgtttggagtctgcgtggggcatgttattcacacaggcatagtgtgttagttgcctctttgtggccccatggactgtagcccaccaggctcctctg

SEQ ID NO: 7987 - DNA, 201 bp, Bos taurus
agggaaagtaaaggagaataagttagaagttgcccagagctaaagcgtaccaagcaagggaattctaagaaattgcaaacagcttggccaaattcagcccgtaaatgtgttttgtttgaccagcaaagtgttttctttttaaaataagtatcttaagccccatagaggagagagtaaatccctaatatgcaatagtctcaa

SEQ ID NO: 7988 - DNA, 201 bp, Bos taurus
acattttctgcaacaaaacaagtggcatatgatactgtgaaattcctggcactggccatccaggctctccatgtgtcccacttggttctagataagaaaacaaaggatgggattctgcccagtggtggccatgagcacaggtgcacaatttggaaaaatgagaccaagtctattaaaaaaaaaatcaaacttaagtcaaac

SEQ ID NO: 7989 - DNA, 201 bp, Bos taurus
tcagggagtgttattaaatgataagggggcttgctttctggttgtatattgtgggaggctgagaaacaatgagcgttgtgacactttagaggccgtgtgcatgctgattaggggaaccccgtatgggagagcaggtcacgtggcagggctgcctctgagatgccgccgcccttccctggagggttattaatgggccttcac

SEQ ID NO: 7990 - DNA, 201 bp, Bos taurus
tttgtgtttctactgtttctaatacctttggcaaatagcccagtacaacaacaccataatgatagtgagggtgccttagctttgttcctgaccttagtagaagtgattctggtgtttccttaataaccatgaggctgacttttggaaatatacccatccttatagttatctaacattgaaccatccagtttttggtttctc

SEQ ID NO: 7991 - DNA, 201 bp, Bos taurus
atagactctgtaatttgaatcaaatatgatggaattcctccttaattatacatattactgttatttcactggcaggtgtctctatccacacaactgggccgtttttatcaacattggcatctatttttgatttatctagcagcatttcttcatggtttaatgtaaggtagaaagtagcagggccattcccttgagaatgag

SEQ ID NO: 7992 - DNA, 201 bp, Bos taurus
gtggaaacttggtttatttactttgagagaaaaaggacaagctagcacagtgtctccctgtttgatgagtccatacagttgatgatgagtatggatggtattctggccctcatattaaattctgctctgaagccattagaggcaaaacagcgtaactgactgtaacctgacacattttccaggaagatgcaagtgcttgtt

SEQ ID NO: 7993 - DNA, 201 bp, Bos taurus
cccaagggtgttctgaggtttaattaattagtctttgtgcaacactgactggaaacatgcaaagatttaatttaagcagtatgtgaacttggtgtccaaatgagggagcatttaatgacttccaagaggatgggcacccaaaacaaaacaccaaataacctgctacaaagcctgtactggtattgtagtcagattttatat

SEQ ID NO: 7994 - DNA, 201 bp, Bos taurus
atcctagggcaagagtcctttctcccaaagtaccgtggagagaatcaggctggttatacccaccccacagtcatgaggccaggagtaaaggcacaaatgatcccatacctaaactacttgttataatttgaatttctgcaaaccacctcagacctctttgttcgaaaacattttgcagaattgtcctcaggggcagctgtg

SEQ ID NO: 7995 - DNA, 201 bp, Bos taurus
cgttcatctatattgtagtctagagaaacgattattaaaagtgagcctagaggaaaggacccattgctatagagggtctatagcaatgaattaggtgagacggcttaaatgtgagccttggtagctacagtgggacaaagaaggatggcacagatgctttggcgctggatctgttgagtccttggcactgttgagatgcaa

SEQ ID NO: 7996 - DNA, 201 bp, Bos taurus
gtggcataattagattgcatgttgaaaggttcactctgactatagcatgaagaactgactagagtagcatataccagcggtgcagaggccaatttagagtttcttgagataaaccatagtgtttattggcatgttagataccaaaataaatcaaaatcccctgtggcccccctatttagccatcctcatctctaattcccc

SEQ ID NO: 7997 - DNA, 201 bp, Bos taurus
ccatcaccagactccatccatttctggggccacacaggcccatatgaccaaaagcaaacctctgaattgatttctctacctgtaaaatggagctaaagctgtcatcccacgtttttctcatgttggtggctaacacatccatgctttttgaaaagacttagtctttttaaaaaaaaatactcaaaataaaaagcaattttg

SEQ ID NO: 7998 - DNA, 201 bp, Bos taurus
tttgtttttgaggaaccctgagtgataaagatattggcacgaggcatagtcccaatcaaacatagtccattagagttaatttggtcattttgtaggctgcggtgagtgttgaactgtttgttaatgtgaaatggatagttagtgatccatgataagaactggcatatgactaatcaaggcattgctggtgactgatggtga

SEQ ID NO: 7999 - DNA, 201 bp, Bos taurus
atctaatcagtaggtttacgcacagttaaaatttaaaaaatgagcaatgacccaccactgttaatttggaacagtcaaactaacctcaccaaaggctgctccaatggaaaaagtgggaaactctttccacggtacacactggctttactggctgtggtcttaagtcaaagcacagaatgaaccttggccagtagcgtgagg

SEQ ID NO: 8000 - DNA, 201 bp, Bos taurus
tggagctttcttctgctgtattctcaggctggtggttcggttggtgagactgttggttacgaggtcatttctgactcctgcacttccattcaacactattcaggaaaagctgaagttgcacttccattgacgtgggatgtgtatgtgggtttgtgggggcggaggagaaagatgaagagagagatatggacatggggctct

SEQ ID NO: 8001 - DNA, 201 bp, Bos taurus
tcacctaatggaaagtttggcttttatttaaattcctttatcttggactgtttaggttctggacttataaggtataagcaggtatgtattttggggcctacagtaattctggctgtttgatgtgttctttgatcatctttgatttatagaaatcccaagtctttgtgcttgtttcttgatgtacctattaataaatcagat

SEQ ID NO: 8002 - DNA, 201 bp, Bos taurus
cttcccaagccaccggactctatccagcaccatgaggggctacgggcatacgaatgtgggaactgcagcacacatctgagtcttgctgccccacagacagtgactcttcagccacctcttgaacctagagggattcacactgtctttgagaagacaagaccgaaggagagggcctgaactttttctctgagtgggctcttc

SEQ ID NO: 8003 - DNA, 201 bp, Bos taurus
cacttactagactcagaaaaagtgatgaattaaggtgaagccaaaagagaaatacaacatttacagagctatttatctatagccctcttgtacataactcgacatattaaatttttgatgatgaccactgctatcaactatttttaataatataaatgagtcaaaagtacaggattatattaataaaacagcatgaggtgg

SEQ ID NO: 8004 - DNA, 201 bp, Bos taurus
tttggtggaatttgaaaggtaaattatgcaaactcaaatgtagctttcatttgggtttttcataagctattctcaattgttttaccccagtgttgaactacttaaaatatatattctggaccaacaaaaactaatacaattagtgagaaagagcaaaggtccccttgaatactgacaactttttcgaaatgaatgtgcttt

SEQ ID NO: 8005 - DNA, 201 bp, Bos taurus
gtcatctttgtttgcacaatattactatgcactcagtagctgcccaataaatattaattgataacgatggaaaagggctttataaacagatggtctagtacaaatttgctgaaaatgtgaataaaaacattccactcttcaagaaaagcataaagtagaaattaaacaagtcctgcactcagaaaacctcagtctattatc

SEQ ID NO: 8006 - DNA, 201 bp, Bos taurus
tagggaattctctggtggcccaatgtttaagacttcacactctcactgcctagggaccaagttcaatttctcctccgggaattaaacccccctccccccccccagccatatggcatggccaaaatcgaacaaacaaataagaatattcattttatcccagaattctggggtatctttccggcttccatccccatgtgaatt

SEQ ID NO: 8007 - DNA, 201 bp, Bos taurus
ttggccttttgactaagagcaaatgcatttctcccatcattctgacactgcagacctttcttttttcactcaagttttttttcctctgcatatgaacttgctcaggcctcctctgtcttggtacttcgcaccctccggagatagcattctgtctattcttctgtgcagtactactcccctccccttcctgcgtctgtgagt

SEQ ID NO: 8008 - DNA, 201 bp, Bos taurus
cttatagtccactctactgttatgagtcaagggctttgttcatcagttctcgttgacactgcacactgccttcctgggagagtggctggcctggatttcacagcaagtgagcttgtattccatcctgcaaagttctcttcataccagaccacacatatggctcaaggagagctatttactctctttttagagtccgagaaa

SEQ ID NO: 8009 - DNA, 201 bp, Bos taurus
caaagaattcagtagtcctaataaacttatgaatatattacgttgcccttctgttaacagattatgatgttatacaaggcacaccagtttactgcaaattagaaggcaatgtctgaagtttattttctgcctttgaatctcttaattcttgtttttttggggagaaaattatttgcttttcatcgagtattatttttgttg

SEQ ID NO: 8010 - DNA, 201 bp, Bos taurus
ggcaggactccagactaggtccatgaagtaaacgagggtcttaattaaatccaaagctattcacaccatgagggttttcacttagtttttttctgacatgttttcaggaaaggtgtcagtttatatttgattgattcagaaagagctgaaaagccatatcccgattttgccttcactgcaaatgaatgatgcctagaatag

SEQ ID NO: 8011 - DNA, 201 bp, Bos taurus
tagtaaaagcgagggcaagaagataaaactgaatcattagaattaaaaacaataactgtgggaaaaaataatcctgtttgaagtctttgaagaaaaaattataacacagtggactgattctcattcattctaaatacctaaatagacaggaaaaacttggtagcaatgcattgtttcaaaagatataaagttccaactcaa

SEQ ID NO: 8012 - DNA, 201 bp, Bos taurus
cgagctccccaagggcaggaatcccctcctttcagcccatctgttaggacctgctcaaaagcccaccaggccccaggattagcaggccttacagactggacgatgcaatagacgtctctggacattcctggaaaacaaggacgagctgcctggggattatatttgggcaaggaaggaagcagaaaacagcgggcctgagag

SEQ ID NO: 8013 - DNA, 201 bp, Bos taurus
cacttgctgaagctttcagtcttgaagggacataaggtcccgcagagaaaaactgcagtttgctcaaacccaggtttgatatttagggcatccgatattagaacaaaatgcacacctacatctagatggacttcatggtgacctgttctccagaaccccaaactgaatgccaactgtgaggcattttctcaggctggttgg

SEQ ID NO: 8014 - DNA, 201 bp, Bos taurus
ggtacctgatggttttgttccactccacggccgccgtgcaggtgcagctgtcccagaccaacctgaaaatgaacaaaaaggaggcaaggtttgtaaatcatagcacctgcatctggcctgtaattaaattagctcaacaagaaacatttggtcacaaaaagggttctgtccataacactgaatattaaacacttttcttaa

SEQ ID NO: 8015 - DNA, 201 bp, Bos taurus
tccaactcctggagtgggctcgctgggtgccaccacctgcttccagccaggccagctaaagtcatgcctttagggtctgaacggaccccactaaatgcccagaggtgaatatgttaaaatggaggccaaaacgttaaaagtttgcattgctctcttctccaagaggagagggggtggggctgaaatcggatcccagggcta

SEQ ID NO: 8016 - DNA, 201 bp, Bos taurus
tactttggccacctggtgtgaagagcggagaattggaaaagaccctgatgtatatgggcattaaggaaggttcaggaaagtggtaggggctatttgcctctgctggatggaaaaatattagttcagatataaaggactcagaccgagagtcacctcaggacacattctgaagcagtctgttgcagcacacttccagacagc

SEQ ID NO: 8017 - DNA, 201 bp, Bos taurus
ccttgacagtgaacaaaaaactgcccaaggttcagatttacaaacacgagttttgccagggctgttgtgatgaatgcaattaacaaacaccacacaaggcccgccttccccttttaaagtactattgcatgctaccgcctgttaagtaatttagatgatctaggatgttaataacgaaggtctgtgctctgaaacaagacg

SEQ ID NO: 8018 - DNA, 201 bp, Bos taurus
cttgggagcattactgggcccttctgagctgcctgacaagctcctaggccccagagcaggcctgtaagctgagaagcagagggacatctccttgagggggcagctgggaacctgttggtctgcatgtccttggaggtggctggtgaactcagaaattggccatggggccacgggcagggacaccaacagcatctattacag

SEQ ID NO: 8019 - DNA, 201 bp, Bos taurus
aaaaaagcttcagatctactggcctgtgttatgggagttgccacaatttcataccacaagcctcttatttctcacagcaggcttttctgtatcccaagtacttctctctaggcccagcaaaggatggaagatcatccagggtcataggtaaaatctctcagtgaacatcatttcagggtcttagtagccatgcgtggaatc

SEQ ID NO: 8020 - DNA, 201 bp, Bos taurus
acatttttagcacaatgaggaggaagtctgtttgcatgaagagaaaataaagactccagggagaagcagagatgagagagccagccacacttgagtgcctgctctgcttgtcccggccacacccttgcctgtgcaaggcacaggagcaagtattttttgtttgctttgcttaagtcagtttgagtggggacttctgaaaaa

SEQ ID NO: 8021 - DNA, 201 bp, Bos taurus
aaattttgccttgctgtctacaacaacacactgccttactacaaatggtctcccaaagacaatttgtaggtcatagctgtgagatttctctttttcgtgtactagtaacaatttcaattgcttccagctcaacatctggaagcacatttggcttcatagttggaaaataaattagcatcccagatcatgagtgagggactg

SEQ ID NO: 8022 - DNA, 201 bp, Bos taurus
tcttttcacatggaatgcctgggaataacccataacatattaatttttctgattacatagtcaaaaccaaaatgtcccttggcctggcacatggtaatctatgatcaactgaaacttgcaacgtaaactttccttttgagcttctgtgcccctatgttctttgaagtgttgttcagagagaagcagtatcagtgtcctaag

SEQ ID NO: 8023 - DNA, 201 bp, Bos taurus
aaacttgtagggactataaaatccagtgatgcccaatccgagtatagaaacctccatcatgttatatcagaaacccactgaaggaacaagctgttcaaaaagagcccagtgtgttaaattccaaatccttgggcatagtttgaaagctggaaccaagtttaaacgcagagttttgtgtattatcttgaaatttgtagaccc

SEQ ID NO: 8024 - DNA, 201 bp, Bos taurus
agtgcttgagtgattatgcagagaaaataagctggagatggacaaaacgtgtttcttttaggaaatcaatggtcgacttttgttagcctgaggaagttcaaacttgggcctaaaggttggaagacagacaaatagttctctcagattttgtgggttaaactagcaaatggaagttcaactgttagttatggttggtgtatg

SEQ ID NO: 8025 - DNA, 201 bp, Bos taurus
ctagattaggaattgaagcgtgtcaacataatttgacaaagtctgaagaaagaaacatcatccaagaccaagagatcttttattgtaaggggacacagtgaattgatcccttaaagaagatatgaaactagttaaaccatcaaaatgtaaaagttaagagaaagcacaaatagcattactcaagctgagttaggaattaag

SEQ ID NO: 8026 - DNA, 201 bp, Bos taurus
atagctgaagcaagacatatattagaaactcagggactctgggataaaaaaactgtcagcagtgttaggaacacatacagatgaatgttttgtgtgattctgtttccataacaaattgtctctttaacattgcattgttctatatttcattagattctatttttgaaagtaagcttgcaagtggagaaatactgtctacct

SEQ ID NO: 8027 - DNA, 201 bp, Bos taurus
ggattttcatttgttgagacctcttagaaatgacagaatctttctttaaactgagatcaaagaatcgattaggatttggtgaaactatactcgtatgtcaggcctgcttccagagtccaaattctcatgaaattaagtggggtttggcattcccaaatctcctctacttccccactcataattatgtacaatgccttttat

SEQ ID NO: 8028 - DNA, 201 bp, Bos taurus
tcttgagagccacataacaaatcatgccaaggcgaagaggctaaaaacagaaaacatttatgatctcacactttatgagagtgagggagcatctttgctgggttactctggctcagtccttcctgaagctgcgggaagattggccaaggctggtggggagctgcagggcgccctcgctgcctctccagtttaataggggtg

SEQ ID NO: 8029 - DNA, 201 bp, Bos taurus
gaatcatacaaataggaccccaaatttttaacacatttgtactttaacaaattcaccaacacttgataactcttacttgaacttgatgctagatgaatgatatgcaaatagtaagtgcattatgggttttccagaaacttctaacttatcaggaaagcaggaaaacaaactatgaccccatggacagtccatggttctcca

SEQ ID NO: 8030 - DNA, 201 bp, Bos taurus
ggatcccaaaagcacacgagcaggagctaccagactttcttaaaggcttaggcctggaactggaataacttcacttctgctgtattctgttgcccaaagtgagttgcaggcccagtccagattcagtgtgcaaggggactctacaagaatatgaatttggggaagaaatgtgcacagaggtcacctttggagaactaatta

SEQ ID NO: 8031 - DNA, 201 bp, Bos taurus
aattaaaaaatattttagaaaccttaacattgaacatttactaagtataataaacggactatgataaaaaccttaaatttggcaacactgtttttacccacagtttggtatgtctattgattttttgtttttgaaaacttgaataccatgcatgattatacaaaagaaggggttatttaatttaaaagatttgctcatcct

SEQ ID NO: 8032 - DNA, 201 bp, Bos taurus
gataaatatatttcatttggatttcaatcagattatggtaatatacaaactgagatgccttccaattcaccagggcaccactatactaaacctggcctttattcaatgatcaaaacactgcatactcttgaggtctccatttttccttatctaaggagaaaggctagtgattatagatttcctatctttggaggcctgggc

SEQ ID NO: 8033 - DNA, 201 bp, Bos taurus
ttacacatgatctcaaaaattttccctcagatacgctttttcccagaagtctgctggaggagatactccactaaaataaagaagttagataagaaattaacagtatggcatctggaaaactaaagatctcacatatagaaaaaggaaaaagaatcttcagggtgatggcaaagagatatcccaagaagacatcctttcagc

SEQ ID NO: 8034 - DNA, 201 bp, Bos taurus
agagctatactaaacacaatatatttcccaattaaaagggtcatttctctaaaaacattgaaaatataataaaatctggagataaaacagaatggcattcattgtactctgctgcgggatctaggggagacgcggagctcacctgtgctatgccacacagctcttcaccaggtggccttctacagcccctctgagtggctt

SEQ ID NO: 8035 - DNA, 201 bp, Bos taurus
atgacatctaatcattttggccatatgttattggttagaaccacttcacagatctcacccatattccacagaaagataataaaaccagaaatggtactggcggtggggatcatgtgtggcctagagttgatttaccacgtaaagagaatagaaggaaataaaagaaatggctgacataataactattctaaacaagccatc

SEQ ID NO: 8036 - DNA, 201 bp, Bos taurus
caggatggttaaatccctcacctccttcaagtcttcactgaaatatcactatttttattaagaccatcttgaccatgctatttaaaattatatcctccttcactcttgatcccctgaattcttttttccaccttttcatccatcatacttatcaacttatagaacttatttatttgaaatattttattgtctgtcttatcc

SEQ ID NO: 8037 - DNA, 201 bp, Bos taurus
atttgatacagataagtcaaattacctcacttaaactattgttcatgtttaccttactaactcaaaatttttcaataatttcacattaacaaaagaataacgcctaattttttaggcagagaatcaaagccttaaatatttttttttcttggaatctataattttttttccagctggccttaaaattgagtgtgtagatac

SEQ ID NO: 8038 - DNA, 201 bp, Bos taurus
gactcactgtttttcaagcaattgtctttccagggcagtacatccagactggacactctgatgtggggctctgactccttgctccttgggtagagcatccatggcagttttaatccacctctttgtgggtgaccaacccggggtggtgtgggccctgactttatcacatctctgcccctcctactcatcttgttgtggctc

SEQ ID NO: 8039 - DNA, 201 bp, Bos taurus
atgttagtaaaagaagtaagagtatattatcttcctaatgtgaattaaagataagcaacaatttaaaaaaattaagaaataccaaatacttggatatcatatagaatacttttattgatacattgccaaggacttaaacacatacaaaatgaaaatcataggatgatttgaacttaacaagacttgaaaaaatggatgtat

SEQ ID NO: 8040 - DNA, 201 bp, Bos taurus
aagcgatggtttttctagtaatcatgtatggatgtgatagctggactataaagaaggccaagggccaaagaattgaaagggccaaaaaatttgaattttgtttctagagaagactcttgggagtcccttggatggaaatcaacccttagtattcattggaaggactgatgctgaagctctaatattttggccacctgatat

SEQ ID NO: 8041 - DNA, 201 bp, Bos taurus
taacaaaggaaataccattataacaactacagaaatgaaagaagaatacataaatgttatgaacaactttcttctaattaatccaatgattctggtgaaattggcacttttaaagcataaatggccaaaactaactcaagacaagcgtctgcctacactgcgggagacccggattcgatccctgggtcaggaaaatctcct

SEQ ID NO: 8042 - DNA, 201 bp, Bos taurus
aggtcatataaaaagcaacagaaaagttacataaacaaagcagcttggtcagagagagagaaatttatttgtccctcccatgcttcagtcgggcttcccaagcggtgcaaagatacagaatccttctgccaatgcgggagacacaagagatgcagatttgatccctgcatcagaaagatcccctggaggaggagatggcaa

SEQ ID NO: 8043 - DNA, 201 bp, Bos taurus
tactgttataacaatacttactctcctattacagaaggaaaacccatgcttcaaataagactttcccttggtgcttataacataaactttactgtacctgcggccatattaaaaaaacagtggagacagaagagaatagaccaggaaaacaccaggagcaaaataaaaagatgatgtcctccataaggcaaagcaatggga

SEQ ID NO: 8044 - DNA, 201 bp, Bos taurus
gtaatggcaggaacttttttctgcctttatacctgaaggtgcaaaggaggacacattgttatcagagcctgtagagagctggggcatgtcaaaggggccatgctataggagctattctcaggggtgcaacttccagaattgcaagtaggaaagcaaggaggggagaggaaggaactacaccacatcttcacatctccttcc

SEQ ID NO: 8045 - DNA, 201 bp, Bos taurus
ctaagttaacgttgatagttagcatggcttgacatgagaattcagctaactgaatgtaagtgcctcctgacagtcacctgggcccgcttgggggatgtgcggctgagctgtttccgtaggtgagagggcagttctctgagcacgtagtgtgcacagttatgttcttagggccttttggaagccaactggcttctccatttc

SEQ ID NO: 8046 - DNA, 201 bp, Bos taurus
tgtatggtagaagccatcacaatattgtaaagtatttatcctccacttaaaagttaaaaaaaaaaaaagtaactgatttcaatgatatcactttctttagggtgacgaggatgggtttgactgaagaactggccaaagttgttgatgccaaagactctttcccagaattataacaaaggttaagtattcagaaacagagag

SEQ ID NO: 8047 - DNA, 201 bp, Bos taurus
aagaatgaggccgagaagataccaaatctcccaacatcttgaacttcgatctagacgtcaaaactgtgacaaaatacatcagttgttcaaaccacccaatctgcaggcctagaaaattaatactctgtgtctataccccccaaaataccatcaccactccatttgctacctgactgaaatgaaagagaggaaggaaatggc

SEQ ID NO: 8048 - DNA, 201 bp, Bos taurus
acttatgtaatgatgaagaatttttgatttgaataaggccgctgggactatatacatgtgccgtgcgtacatgatttgattagaaattctctgtgtagttaggactgagaggccgagaagtgaagacataatagtatacctcagtctctgaccagggcaatgaaaccatgggcagatcacacacagaccttcaattccctc

SEQ ID NO: 8049 - DNA, 201 bp, Bos taurus
acacaattctgaaattcctattcagagcccattacggccttctgttatattgttccttatcctgaacatccagccaaacatcagtcattgatcatgtcctaatgtaaatccaggcctgggtgagtatctctgtgtagaacaaatgggcagtgaaacattctgcttaatattctgccagctggaaggatctttcccttgtcc

SEQ ID NO: 8050 - DNA, 201 bp, Bos taurus
gaaagacagccgtgagaagcccaaggcagagaccagagtcagacttccataaactgaggaacatcaaggattgccatggccaccacaagcaggaagagaatgggaaggagtctgtctaccctagagatgcgagagggagccatgcctgactgacacatgggtttcagatttctggcctccagaaatgggaaagaataaact

SEQ ID NO: 8051 - DNA, 201 bp, Bos taurus
taaacatcaaaattcctcatgttccagaaaaattgtctctattataaagttatggattttatagctaacttcactaggctcctgtaaaattttattttattacaggtaatgtgaaatgagagtgcatcctaccaccactaaaagagatcagtgctacagctctgaggaggagagttagatctcagctgtcagcctgtggct

SEQ ID NO: 8052 - DNA, 201 bp, Bos taurus
tgcttagaaaatgggaagaaattagtctttcctgctgcttctgcccagaggggggggatgcggggattaggaaagaaaatgggaagaccacagtggccctctcagcctcttctgccgtcactgctgttcagcgaaggtgtgactcttagcaaagtttcagaatcatcacaggttacaaagaagacaccactaagaattcac

SEQ ID NO: 8053 - DNA, 201 bp, Bos taurus
aacactgtgaggtataataaacataatattctttacccaccaaaaataaaatctaaggaagagtagaaaatgaatgaaagcctgaatgaaaattcatggcaaattcaaggcaaatgaaaattcatgatcttttgttcatacaacttaggtatctgtctacagagatttatgatacagaaatagacgagaaatatgaagaaa

SEQ ID NO: 8054 - DNA, 201 bp, Bos taurus
tggctacccaatgtagaattctctgaaatcttgtctagctttgagggttgacttccgtttgaccttgctagtcttctcctctttgagtatccttaaggatttgttaaatgttttctgacattatagcacatggtcagttcatttgaattctttctccacttaggtctctttattttttctgtgtaaaacctggtggtgact

SEQ ID NO: 8055 - DNA, 201 bp, Bos taurus
gctcgtgagtcagtgtgtccttccttttattatttcccccattataaagcaaaaaggaatccccctgtgctctataagaaggcttcatattgagagctgtgtataacagccagttttctgttttaatcctctaaaaatacctgctggtataaaacaaatgtaggttgttacaaagccgctcactgtgttgttaccttgcca

SEQ ID NO: 8056 - DNA, 201 bp, Bos taurus
caccttgatgggcactttgctgtgcttacaggactctaagaagttgtacacaggggtgtcaccgcagctagtgaccgaggggcccttgcccccatccactgctttgcccgtagagtctttgatgtagtaggtaccatctctgaactccagccggaagacatcctagctgaagcagttggtggccagggtacccgtgacctt

SEQ ID NO: 8057 - DNA, 201 bp, Bos taurus
cacacacagagacacagatacagaaaaagacaggtattggccccaaacccatggtttggagccctaggacacctcagtcttttctcttaaggctttcaactgactggacaaggcccccgcatcatgaagagtaatctgctttacttgaagtctactgatttaaatcttattaacttttaaaaagcaccttcataatatcta

SEQ ID NO: 8058 - DNA, 201 bp, Bos taurus
atgcagagtcttggtttcccatcaaactttatgccatttcccaatcttccatttcactcatatccaatctattatcatattttgtgggtgtcttcttaacgtctcctgaatctgtacctttctccattttcataatacatttcctaattctggtgtgcgttacatttccttgaaccattgccagagcctctcttctgtatt

SEQ ID NO: 8059 - DNA, 201 bp, Bos taurus
gtgatagtcattttgacaggtgtgaggagatatctcattgtggttctgatttgcatttccctgataattagcaattctattccattcacttttgaggggcggcacaaatatgttccttatacaccttttgaatttttcatatttttaaatctgcctgcaatgcaggagaccctggttcgatcctcggtctgaaagttcccc

SEQ ID NO: 8060 - DNA, 201 bp, Bos taurus
atatgaagaacatatatttttaagagtttctcatttgcacactcaaattccatgatcccctccttcagctaaggtggacataccgatagacacgtgttagctaccaaaccacaaagtctaccaactgccctagcatgtctgtctgcagagggctgcatcgggaacacgttcagggccatatccagtctcctctgtcaaccc

SEQ ID NO: 8061 - DNA, 201 bp, Bos taurus
cagtgcttagagctttgtgacctttcagttactcatttcacttcctgaacaatggttgggtattccatacaaaataaggccaatgttagttcttaaattaatgtattattttacacagttcagttcacttcagtcgctcagtcgtgtccgactctttgtgaccccatgaatcacaccacgccaggcctccctgtctatcac

SEQ ID NO: 8062 - DNA, 201 bp, Bos taurus
actattctttattttccattaaggaacacttgatcccttagactgtccagtgcataatttagctacagatgccatatatttagcaaggctttcttattcacttgaaattagtactcaatactagggcaaagttcactgaagctggagtcctcttagattacccagaagttatcataaggatccttatgtttagccttcctt

SEQ ID NO: 8063 - DNA, 201 bp, Bos taurus
tggtagacattaaacaagatgctgtggaatttaaaaaaaaaatacataaaacgtctacacttgaagaatttaaaatacaggaagggaggcagacacatgcatatacaattacaatatgcaatgagaaatatttgattagaattgaagctacatggttctataggtgaatggtgaattcagagaagaaaggcattgacattg

SEQ ID NO: 8064 - DNA, 201 bp, Bos taurus
atgtaaagagagtatataaaataatttcttttccgttggcagggaactcattgacaaaagtttaaacttgcctccagttaactctccttagctccgacatcttaataaacctttccactcatctgtaaaaattaataataagaatagtagttattgtaataaaaggtttacttcccttacaaactcagcagacctcagggc

SEQ ID NO: 8065 - DNA, 201 bp, Bos taurus
aagagtcagaacaaaagaaggatccttgactgcaatcagcatgtttcacaataggtataaacaactaaagcaggaattttgaaaatgaataaagttgggggaaaaagtcttggtaagaacattagagaacaaaacattagaaaacattagaataacaaaaatgtgcatgaagattttacagttctgagaataccatgttgg

SEQ ID NO: 8066 - DNA, 201 bp, Bos taurus
tcattttaacaaaagaatcctgaaattgaagcttttatgtaaaacagtgccttgctaattttgctactctgtctggcctgccttaacaagataccacagactaggtggcttaaaaaacagaaatgtattatttcacagatttggaggttacaaggcccaaatcaagatgttaatagggcttattccttccaagggctctga

SEQ ID NO: 8067 - DNA, 201 bp, Bos taurus
atcatatttgtcttgcttttttccacatctagtatattcactaagacagagagttgttttattttttaattagtgaacttgtggttacatctgtgaacctctatttaaagacttatgtgatgttactagaggtttatagagactacattagcaaagcaatgctcaaaagctttcaaggtaggcttcagcagtaggtgatag

SEQ ID NO: 8068 - DNA, 201 bp, Bos taurus
gagttttatggctttgggctttaaatttaggccttcaatccattttgagtttatttttgtgtctggtgggaggaaagcttttagtctcattcttttacacgtagtggcccagttttcccagcagcacttattaaagaggctgacttttctcattgtatcttcttgccgcctttgtcaaaggtcaattgcccttaagtgtgt

SEQ ID NO: 8069 - DNA, 201 bp, Bos taurus
ttccaccacaactgcaaaatcccaggtatttttacacatttcttcttctcttgaaaccatcacaatacttggaacatagtaggtgatcaataaaatattggtaaagccaattgaatcaaatgaattgaatgggacatggttgggaaaatgacatataaccaatgtatacgaatattataattcagcaaaattaccacagta

SEQ ID NO: 8070 - DNA, 201 bp, Bos taurus
atatattggattacataaatacattaaaattcatttcatttgtttccttttgggttttattgtggctataataaaactaaaaattacatagtctaccctgtaacccatgaagtgccccatgccaggcttctctgtccttcactatctcctggagtttgctcagattcatgtccactgagtcagtgatgccatccaaccatt

SEQ ID NO: 8071 - DNA, 201 bp, Bos taurus
agatagatgtgtgaacaggaggggaagaacaggcaaatttcttcttgggaaagaaggttctgggaccatctatcttagaatgtctaagttctctggcatcgcaatactttttttatttctttattattcatctccagagaggctcttccagatacttctaactttcctccattctttactggcccctttcacagaaattga

SEQ ID NO: 8072 - DNA, 201 bp, Bos taurus
tctctgcagtcgtccgtgccctgccagcctcacagggctgctgcaagaattaaaagaaaacccttattgtgaagagcaagaaaactatgaaaaatgacataaaatgtcaaggtatctgtaatttcctgtggttccagcaagtccctgtttgttcacctttaaaaataaacatttatttatatttgaaccttatttgacatt

SEQ ID NO: 8073 - DNA, 201 bp, Bos taurus
ttagtgccgtaccacccgaggtctaaggccactctcagagtgactgcagtcttacagacggcactgagggcatacacccagcccaggtccccagtacctgcggccagacctctgccagggactgagggctgtggtggttactgggtaaaatcagggaagccacaacctgagaatcggttctcgagagctgagaaaaaggta

SEQ ID NO: 8074 - DNA, 201 bp, Bos taurus
atcattcaacgggcctgctcgccttctaccgcaagtcaagagagggcagagaagatgggcagagcccgccgtgtgggctcacaggagttggccaggcatcggcaagtgttttcctttctgctaaagttgtgggactggctgtttgctgccttccagccgacgctgaggggatgctgcctcgtcacaggccagttaactgct

SEQ ID NO: 8075 - DNA, 201 bp, Bos taurus
acatttcaggggagacctcagcttcccacagggtctgcctctgcacacgcctcagcttttatttcagctcacctctctgcagtacccactgcctggcatcactcactccgtttctcaccagcccagcttgctccggctccttcctggtgcactaggttctgaccacaccttctctccctctacatgttgggcatcccaagg

SEQ ID NO: 8076 - DNA, 201 bp, Bos taurus
tattgctcgtgaataggaacttcccatcattcaaggctgtgtagggagcttgtctaatccttctatggctctctcagctcctggatctctgttaaatttgcagttgatccaggcccctaactggatttgcaacttcaatctaaacagagctatgtgtattctctatttgttttctggttttcactatttttttttcttttt

SEQ ID NO: 8077 - DNA, 201 bp, Bos taurus
aaagaagcgcacagaggcaccaggaaaggccaggtagacaacacccaacctaacaagcagaggtgctcagatttccccggcaaagtgctaggagggcctggaagcagggtggaggctgcatctggaggtacagtgaccctgtgtcactgaagacagcagacaaggttggacactgcccctgcccaccatggggaggctgct

SEQ ID NO: 8078 - DNA, 201 bp, Bos taurus
tgattagacgccctctaccccggcccacggtcagctgtccgcagtccccgaaacaccctcacaattcacactttggtcggcagaggattaaaccatcagggcaggccttccaccctgccacagggccagtgagcgcagaggccagcagtccagagtgactggggaaagaccctgaggactgggagggcgtgcagtggggtg

SEQ ID NO: 8079 - DNA, 201 bp, Bos taurus
gagtggcctcttccccacaaggtcagcaagcttctgagcctcgctagtcaggttcccgcaggatcttgtctaaaaggccaccctagccccaggtatttcacgttcccaccttttccatccaagggtctccactgggtggagctctctagagaaaggtgccattgctcatggacaaggagtgcagcagataaagctggggcc

SEQ ID NO: 8080 - DNA, 201 bp, Bos taurus
aatcttttttcttaagttgtttagaaaactttataaaattacattctagaaaggatattaggagaatttcacttcatacaaggaagaaggaacagatgacccccaaatctatttctatcagtctatgcttttccattagactgtaagatcttcaaagcctgtgtataaattcaatatacgtatccaagagatctgcttatt

SEQ ID NO: 8081 - DNA, 201 bp, Bos taurus
actccctcatggggatgcctgcccctcatggccagcagaaaccttccacaaaaatgtgaacctgctggcatgtgctcccctcactaaaaccacatgcacgatggcctcccctgcctctctggaggcactctttcctctttctcaagtgctgtctcccgggctgcaatctcattttgccccagagaaaacttaactcataac

SEQ ID NO: 8082 - DNA, 201 bp, Bos taurus
ggggagggggttgactcagtcaggacacagggcccgtgtccggctaccacatctgacctctcacgacttcctttctcacagccctaagccccagccccatcgggccagagaagcctcagatctgttctcaggggcaggaggctttgctttatctgaacagattggcttccaagcagattgtctgcctctcggtcctgccca

SEQ ID NO: 8083 - DNA, 201 bp, Bos taurus
ttccatttcttggtccacatggacactcttgctggaagggaagaggaaacctagtgggaagaatgcagaccctcattcatcctagaatgaggcacaaacctgtccttttactcccatgtccttgagcagagtcaaatggccacacctattgcaagagagcttggggaatggcatctttactctgaggagcccccaggcccc

SEQ ID NO: 8084 - DNA, 201 bp, Bos taurus
gggtggcttaccccacatgaacttatctcccacagttctggaggctcagaagtccaagatcagggtgccaccgtggtcaggttctgacttgcaaatggccgtcttctcaccgtgcctcacatggcagggactagagagagcaagccctactgtctctcataagggcactaatcctgtctcagaggctccaccctcatgacc

SEQ ID NO: 8085 - DNA, 201 bp, Bos taurus
gtaaatgtttagctgaggaatggatgactggatgactaaaatccagctcattactatggccgctacgctccagttttatgtgaggggccaaaatggcagtgggctgattgattgggtcgtgtcacctgctgcctgaaacagtcagggctctcacgataaaatccaacatcaggccctggtggggtttcgccgctacctgtc

SEQ ID NO: 8086 - DNA, 201 bp, Bos taurus
acgagctacagacaccctaggctgggcagacgtccccgaacctcccgagaagaagcacggggaaaccaagggaaatcgtctgaaccggccgtgggtccgcgctgcgagggaagaagcacccgggctccggaggatgggtgcgcaaagccaggagaacgttccgggggctcgcggagcatcgacaggacccacggctcctgc

SEQ ID NO: 8087 - DNA, 201 bp, Bos taurus
cttgctattctttggaactctgcattcagatgcttctatctttccttttttcctttgcttttcactcctcttcttttcacagctatttgtaaggccttagggtttcaggaggatgcaaatgtgtggattcagcctgtggtcctcacccaggaggtgtcgctaactctgccatctgtctgctctgcctgacccaggccgtgc

SEQ ID NO: 8088 - DNA, 201 bp, Bos taurus
tgcatgacagagtaaatagtactgtagactggtgcaccagtgaaactgatagaaattgttttttaaaaattaagtctctggaaatggtttcaagaagataaaacaaaggaagaaacatttacctaagaaaatctgctaaaattcagtaagaacagtgagagtttgctgtatctgaactgagatgcactcttgtcctccctg

SEQ ID NO: 8089 - DNA, 201 bp, Bos taurus
atgctattatttcaggaatcaattttttatgtagcttaatagaagtcagtaaccttctagatgggtaacttgccacaattcactccacaaagtctggtaaattaagactgagtcccatccttcttatatgagaatgcattatttgcctgtcaagaggactttggttattacttcctttgatggggcccttcacatactctt

SEQ ID NO: 8090 - DNA, 201 bp, Bos taurus
tgtgcccactccttcaaaatggagtctagacttgaggcctctgtctgtcccagtggctgtcccagaaagcaagggggcttatctcctctgcactggaccccagaactggttcggccagattgtggctcagcctgctcgctctccagggctaggtcctcccatgcagactgactcctttcaaatccctcccaggggtgcagg

SEQ ID NO: 8091 - DNA, 201 bp, Bos taurus
ccctgcaggcctgtgatatccaggggcaggtaattaaaagacgaaggatgaaacatatcaaggagaaacagatgcaagagagcagatgttgatcgaaacgatatctcattttacactttgcttttgttttgggttaagtttaaatggcctgctgctgccgctgctgctaagtcacttcagtcgtgtccaactctgtgtgac

SEQ ID NO: 8092 - DNA, 201 bp, Bos taurus
ttcagctacaccagcgccctttcgtcctggtgttgactgacacacgcctggaaggactcaagcaaaccacctgtgctttccctgtgaagggaatgttcacgaacacgtggccttcctgggttgtgagcgcaagtccgcgtcagcacgcgttcatcgtcagggaggagaaagcaggcagtgcccagtgaccctggagccaca

SEQ ID NO: 8093 - DNA, 201 bp, Bos taurus
ccagtgggtctttaagcgctgcaacttgatcctcagtgaccgtgacactgcacaggcttagcttgtcacccgcactgccatctcaacttcccttgtggctttttggccactgttccccatgttcttagaaaatgaaacaaacccggtttctttgttgaaaatggcagcagactaaggagaaaatagaaatgaaaagtcaat

SEQ ID NO: 8094 - DNA, 201 bp, Bos taurus
actagcacttaaatggcaagaggaagagaaaaaaaataatgctttcacctagccctgtgttatctgtaacgggcatgttttaagactcccgttaggcccacctgatctcaaacacaaactgtctcatggtgtaaatgagccagcatcacatttcccatttctatcttggccacttagcctggcagggagaaattcgccttt

SEQ ID NO: 8095 - DNA, 201 bp, Bos taurus
ccttcttttagagcctggcacaaggcttggctttcttttctgatcggtggaactgccacgttggctgaaaaacaggacggaaagaaccttccttgttctgtgggccgctctgtggggctgactgagagcagagcaggaacaagacgctgcgcctctcatcagctgcaggaagccgcagagtccaggccagcggccagcttc

SEQ ID NO: 8096 - DNA, 201 bp, Bos taurus
tgagcatgcagttccctcaagccccagttaacagacttccggggatggttttctttgggacatgagacactatgaaagcgaaatggccttgaggcgtgaacgtgatccagaagtgctgcaaagaagctgggatgcggtgttgtgaagggacgcagcccagcacggcaggtctcttctgaacaagccatcggggcccagcgc

SEQ ID NO: 8097 - DNA, 201 bp, Bos taurus
aggtccccgtccacggccctgcggtcgtcagagcactgtaagggacacagaggacaacagctgttgcctccttaaggacactcaaggacggagcggggacgcggtccaggcttggggccggctgagaaggctcgggggtggggggtgggggtcggatgtcactttgtcagaactacctgtgtgggctgcggctgtgatcag

SEQ ID NO: 8098 - DNA, 201 bp, Bos taurus
ccgttaagtaaaacagaagaaatgttaagttccaggccagaagtctgaaatcaaggatctgacagaaccatccctcaacaaggctccagggaataacatccttccttgtttctcccaggcctggtggctcccagcaatccttggtgtcctgggcttgtggccgcatcactcccatttctgcctccaacatcacagagctct

SEQ ID NO: 8099 - DNA, 201 bp, Bos taurus
tttaggcatagctacgtgaaataaacttcatgttttatggcaagacaagaacaatttaaacataaattcttccctgccctttggcccccctctccccctcggtgccttgcattgcgtctgctccagccctccccaaccatgaagaagggataccctctcaaccacaaagagcagtattctcccggccccaccaaggtaact

SEQ ID NO: 8100 - DNA, 201 bp, Bos taurus
gggctttgtttttatttggaaagctcaggtggggtttggtctaagtgctttgtaaactataaatcactatctgagtagttttactcagagtcttcgactgtctttatcagtttgagtgtttagagccagggggcccaattggtacattacgtggttcttattctgggaaaagctccaatgttttctgaacattttgttcag

SEQ ID NO: 8101 - DNA, 201 bp, Bos taurus
gatggggatatgcctccctgtgtttccagcctggagccagaccgtctgggtcaagcccaaactctatcagctactgcgatctgacccacgtgacttggccgtgctgtgccttggtctcctcatctgtaaaatgggggcggtaacagtagctgtgtcacaggctggggaggaccaccgtcgagacaggcagagtgccgcggg

SEQ ID NO: 8102 - DNA, 201 bp, Bos taurus
gagcctccagttctgcagcaaccctcaggccatatgagtttgagacaatgtcccatagtaaggtgctcttcattatacataagcgaactaggctttaggaaaggccatgtgaaggtagtacctgcagaggactcccgtccaaaccttaaagctttaatgtacatcagacctaacaacaaaaggaagctccatgacttcgaa

SEQ ID NO: 8103 - DNA, 201 bp, Bos taurus
ccacctgggatgtcctgccgttggttctttttcacaagaatcacttaatactggagagacttagattgaaacccaaccttagaaaactaccttgcgagtttcacagtgcatgtgattcaagtcccacgaggggcagtcactggtctcatagcaggcttggtttgctgggaccagagcagagaggaggcagagagaaggctg

SEQ ID NO: 8104 - DNA, 201 bp, Bos taurus
ctggacccaccctcacctgaccaaatgcaattcacctttcaaagcttgattaaaatgtcactttcttagggggacttccgctgagcacccgtccccgacaaatctaaaacaggcctcctattttctaggactcctctgttgttattcacagcacctgtcacaaattgtaattagttatttgacttctataaatgtgtttgt

SEQ ID NO: 8105 - DNA, 201 bp, Bos taurus
atattaaaaaggaaaagaagatgacaaatgcagaatcagccacagtctgtgttatagcagaaaaccccaataacagtggcctcatcgcatagaggtttgcgtttcctgcctcgtgagaagtccagtggtctgcgttttagccctgggagaatagtccacgaggccaccggtgtcccggcgccgtctttctgtcctgctcag

SEQ ID NO: 8106 - DNA, 201 bp, Bos taurus
gtgcaggccgctactgagaccagtgtagcccaggtaaataattgaaaaaggaaaactaggactccttccctttggccacgcctctgcctcagcgcatgtccggcatccgtgtttctgccccagatcctgctctgcttgtcctgctttgccttgtgactggtctctggctaatcctctgtggccgtgccgcagactgtgacc

SEQ ID NO: 8107 - DNA, 201 bp, Bos taurus
agccaggaggaacccacaccccagagcctccgcaccacagtgcaggctcttaaagaagggttcgattctcccggtgcctggcctcaccttaagcatgaaagacttaagaaacttgttcgttccttctggttcttgaagtgttacccccacgaagagcattctggttcttaaaggccagttaaggagcaaggagtttaaaca

SEQ ID NO: 8108 - DNA, 201 bp, Bos taurus
ttttgtttttctgttatttgtaagatcttgaggcttgactgaggtgcatgtggacctcagcatggttaagaaaataaaattcagcttcaggcctttaaaccgcagcaaggtgatggggagagtccgctcttgtccctgaagactggagcttaccgtgttcctctgaacggtcccagagaccactgtatttttaccagggct

SEQ ID NO: 8109 - DNA, 201 bp, Bos taurus
taggattgctgtgggcatcagataagagacagctgggaagctgcgcacagagcctggcacaccaacaagtgctcacgaagtagaagctgtcatcatcgccatcagcatgagtgtccccgctttatggttgaagaaacaaggtccgcaggcagagctggctgtcatcctataaacagcggagccaggtcccccaactcctga

SEQ ID NO: 8110 - DNA, 201 bp, Bos taurus
ctgtcttcatctcctcctttcccgcggcccatcacacctgctgttcccaggcgtgccgagaatgagggtgatgacagacaaaaggcttgctttaacactagccattttctgaaaactgtcttacagaaatgagataaccaggattaactgaatcaataaccttgtcaagagcaaatttctgatcaggaatttcagtctgag

SEQ ID NO: 8111 - DNA, 201 bp, Bos taurus
gggagttggtgatggaaagggaggcctggcgtgctgcgattcatggggttgcaaagagtcggacacgactgagcgactgatctgatctgatacccatacatgtgtctaagaaaggaagaaggggaaggtgccaggcagaaaaacagctttagacccactgcctaacaaaaccaggcaggaactagaagaaccacattatct

SEQ ID NO: 8112 - DNA, 201 bp, Bos taurus
actgagggccagagatgcgagtgaagtgacttctggaattcacacaggtagttcagagcagagccaagacttgaatgcaggtctcttgaccctaaacctcggtgctctgagtgtgaggcctgtggagatggaagcttccagaaaatgctggaggggagagtaagagggtaggatgcaggctgcctggagctacccaggtgg

SEQ ID NO: 8113 - DNA, 201 bp, Bos taurus
tatgcctcctttgaagaaagaatattcttcttaacgtgtgtatgtaggttataagagggactggaagatgccatttgaaataacatcaaagaggccagacgagtcagattacagaagcctgtgagaggcagattcagaaatattcttgaatttgaggctagaaggagcatttgtgggtgtgggggtgagtaagggagcaga

SEQ ID NO: 8114 - DNA, 201 bp, Bos taurus
ctggagagggatgagaaacccactggagctgacaggcgtgttaaacggtactgacgacggggcacacgtgcctgccgagagcagggctgcttttgcacacacctgaaatctttgcagtggccttgtcctgcccattcgacggatgagaaaactgactcagaagtagggaccccgtccccgcaaggttcttcggagagtggg

SEQ ID NO: 8115 - DNA, 201 bp, Bos taurus
cgtcaaccacgggggagaggagtgaagacacagagcacagggcgggtgggccttgaaaacgtggggctaagaaaagccagtcacagcaaggccacgtgccacacaaagccgcttatgtgacgtgtccagaacaggcacatccacagaaataggaggtgagttagtggccacctgcggctgcaggaagagtagaatgagact

SEQ ID NO: 8116 - DNA, 201 bp, Bos taurus
ccccctcccaactgctcttaacaaacgacggcagtcccctggctgtcgaaggtgacgggagatgctgtgctccacgggaaggagaaaaaccacttccatctgcagggagccagcactgaggacggcctgcctgggcgcttagaggtgacaacttcgtcacagaaggtgtggaccagccaaagattttgctgcaggttaaca

SEQ ID NO: 8117 - DNA, 201 bp, Bos taurus
tccttccacgtagtgcagcttggccaggaccagactggactcctgtaggaattctgactggagggaagaggagagaaaagaaactgtcctcagatacacgcctgacactccctcgggcctgcggctctccactccagacggccgtgggaacttcccgccgcgccgtccacagggccccggggcgggagcggcgcgcccggc

SEQ ID NO: 8118 - DNA, 201 bp, Bos taurus
ggccacgacgggggctgcgtctgttcagtgctcgtgggtctccctcaccagactgtcagctccaggagggcaggggccttcgtgtggtcttgtttgctgctgcagccccagcacaggatggatgctcagcaaatctgtcgagtaactgagtgcggagaaggaaggtggtggggctggaggcaggcagctcgctgaagcgcg

SEQ ID NO: 8119 - DNA, 201 bp, Bos taurus
acctctgtgtttatccagagagccagcaactctggagaggggaatgctgacgcttgttcttgagactaaaaacctcttagccaggcagtgagacaacatacaaaacaaactttagaaaagactacaaagattattattaaattgaattgaattatatagtttttattctcttagaacaatggaatcaggaatgcaggcaga

SEQ ID NO: 8120 - DNA, 201 bp, Bos taurus
taccaaggacttccagggccacagttcagagaaggaagctactgcgcagggtctgggcaggtgggaaagagcaaagtatgaaggtggggaaggagataacgcggggcctcagggggtgggacagacccagaactgtaagggagtaaaaaccaaccagacttgtaagtaggtggaatatcggggtaactgaagaaaaagaca

SEQ ID NO: 8121 - DNA, 201 bp, Bos taurus
agagctctcatcaaacaaatttagctgtggccaaagcaagttattgccaactttaaattatggaagatgactgtgtccataatacccttatgaacagaatcggcccggattttagtaagtaaaagtgttagtcactcaatcatgtttgactctttgcaaccccacggactgtagcccatcaggctcctctgtccatggaat

SEQ ID NO: 8122 - DNA, 201 bp, Bos taurus
tgcagcttccacaccgctctccccttcgatcacctgtcccaggggagccagctgtcacacgagcaggacactcaggcagctgcacggaaagggccacagatcgaggacctgaagcgtcctgccgacaacacgcgagtaagctgtcttgaaagggcatctcctgccccagacaagtcttcaggtgaatgcagtcctggccaa

SEQ ID NO: 8123 - DNA, 201 bp, Bos taurus
gctttgcatttgggcagatgaaatttaaagcagcaactgcccataaacaaaatgtgctctctctgtgcagtgaaagattactcagccataaaaaggaagggaggccatgctacaacaggagggacctcgcggtaagacactaagtggaagaagccaggcacggaaggccgcagcgtgcgtttctactcacgtgaaacagcc

SEQ ID NO: 8124 - DNA, 201 bp, Bos taurus
gtgggactgtcttctctgtgaggcagcaccaacggtcataaacccgtgagggtggctggcctggcacagagcccggcccacagtggtctcctctgtgcgattgtagctgctattatttattttatgactggacggtctctggatggtatttgagggcatctctttggcagcagttgatgggcatgtacttcatgctctgtt

SEQ ID NO: 8125 - DNA, 201 bp, Bos taurus
gaaggtagatccaaagggcagagtggaaatggttgggtgggaacagatggaggatgggtgaaggcagaggaagtaaagaacagaataatgaggataaaagcacagtagacattaaatcattagagagatctacaatctgggtatttatgtgaaggataacaggaatacaaagcgtggtgaaattagttggtgtcaaagatt

SEQ ID NO: 8126 - DNA, 201 bp, Bos taurus
agtatacactatatcacaatggcaaaaactttaattcatacctcagtgtctgaaaaaaactacttctagacactggatctctcttttttttctctgacctccaggaagtctagagctagacctgtggttcactttcaactgttgttatttaaaataactgtagttattttaaacatttctgtgtaggagtttcactcctca

SEQ ID NO: 8127 - DNA, 201 bp, Bos taurus
cactctgggcctgaggctctgttttgtaatctgcaatgggcaaccctattgttctgcttggtgggttccttgtggggaccttctgcggcctggcacctcacccccttccacactaagatggaccaagtttggtctgaactaaattctcccttcctgcatcccaagggcttctaagtggccaccgatatgcctgcttggttc

SEQ ID NO: 8128 - DNA, 201 bp, Bos taurus
tgggaagctcactgaagtcccatggggaaaggcagcttttaagccttttcccaaacaccaaagggtggaggctgtcttcggggtggctattttccagcagtacagggctcaggtaaacagtgacattgtcagatatgaagaagcagagagagacctgtccactggctcctcagcagtgaggctgtgctcaagccagagctc

SEQ ID NO: 8129 - DNA, 201 bp, Bos taurus
cccagagtcacaaccagtgcaccaccagggaagtatcagcagagcctgcctcatgtttaagagagaaggccccagatttggaaacacagaggcctctctgggggatgctgttgttcccagcatccagaccctagaggggacctgggaagcaggcgtggttcgccagcgcctctgcaagcccgcagtggcgtgaggggccag

SEQ ID NO: 8130 - DNA, 201 bp, Bos taurus
aactttgggcttctgattcctgaccaaccttctcccattctccagtcagttgaactgctctaaggccagaagtaggccagaccaggggtatcattaggggaaactcaccgtgcagaagacagcagcaggagaaactgagtacgctttggccagagtgtttaattctgagagacgaatttatctgatatagtggcaatgtct

SEQ ID NO: 8131 - DNA, 201 bp, Bos taurus
aataacatacatcagtggaaaatttcaatagcaacaatctggaaggcatgagtaacatgacttggctatgtctgtttttttagaaggttattttaaagttctcagatgaattgagtttggggttctttttcttgctattaatttataatttatggaattgagttagcgaaggggccttgtgagatttctgctttgagaaac

SEQ ID NO: 8132 - DNA, 201 bp, Bos taurus
cctgacctgatttcaaactcagcttccccaaagcagacaggccactttctcctgtcctctcttcttgtttaaccaggaagctttgatagaaccatctagcaattcttgagtcctgcctcattcgggcctgtgttgaatccctctgtgagcacagcaacacctcggaaggcctccccatgacctcacttttgccagatactt

SEQ ID NO: 8133 - DNA, 201 bp, Bos taurus
taagagaacctactccccagctttgtggagaggatccattgcaatgaggcacccaacgtgcttagaacagttgctgctcaagaaatgttggccttagtagctgaagagtagagtcaaacagctatttgcaaaaaaggatgtccattgaagaaactattttgcagaaaccacagaggccatctggccttggattaaaggttt

SEQ ID NO: 8134 - DNA, 201 bp, Bos taurus
acgcccaggatgcggaggaccatgaagaagtcaccctggtagacaaggggcggagcctgacgggctcatccctgccagaccggatacgcggcgcgccgtgtggtgctgcttctccctgaggccccaggcagtcccgttccaggactctaggttctcaggtgttctcacccctttcagcaaaaaaacccgctctccacgact

SEQ ID NO: 8135 - DNA, 201 bp, Bos taurus
ggctaaatcagcagggatgacaaagccatcgacacagaaccgctagaagatctttcacgctctcacctctttgcacccaggccagtggggtccagaccctcgcttgaaggctttggagaagcagaagaaggcgtcaccctgaagacacaggtggatcaaatgctgggaccaaatggttcaaggctggggggcggggcgcgg

SEQ ID NO: 8136 - DNA, 201 bp, Bos taurus
gtcataccagaagcagctggtatgatggatgggtgcctctttatcaccttacttcagcaggaatgtagggtttcctgactcccagagctgttttaaacaaggatggcccaggacatccccaggtggtctagtggttaagacctcaccttccaatgcagggggtgcaggttcgatctgtggttgggaagctaagataccaca

SEQ ID NO: 8137 - DNA, 201 bp, Bos taurus
atctcggatcttcccagcatacccatgtgccccatggcactggccctgggttttacagtgagtcccagggaagtccagtaacaggctctagacctggaacacagatgtatctgttggccagggcatgcctcatcccccactatcaacaaagcttgttcagcacagccatgtgactgcagacctgttccccacacacaccct

SEQ ID NO: 8138 - DNA, 201 bp, Bos taurus
tcttgaatctgagcagacctcaggcttgctttgacccgaagaacacaaagtaagtggcatagggccaacgccgggcctgtttcttcagaggcccggcagcttccccttcctgcctcttggatgaagcccagcttccaggaagtccaaagaggacaactcgtggccagtctcagcctcgatcaagctcccagctgaatgcgg

SEQ ID NO: 8139 - DNA, 201 bp, Bos taurus
ctggcagcccgtttggggaaggcccacgtcagaagctgcagccccaccaccaccaccacttacatagctcctgcaacctgcaaggcatggcctggagctcctcctgggcaccatcggcttaaatctgaaccagccagtgactgggcatcaacaccagctagcatcaccgtcctcacagaaaatgaagctgcaggagtatga

SEQ ID NO: 8140 - DNA, 201 bp, Bos taurus
ttagaaaaatacagtcatcctagacttaggaaacagcacatgagacttacttcaacaagctcctgatggctttgaatcaggccagtctctgctttccttccgtggtgcttagtcctgttacgtaggaaggtcaaacatctggtaaaccctccaactcaacacatctctacacaagtagcagccttccccagctccagtggc

SEQ ID NO: 8141 - DNA, 201 bp, Bos taurus
caggaggggagtgtaactcacatccccgtggggcctctggaaagggcaggacaggttcaggaaggaagagactgcagatggccagagagcacgtcaccaagcgggacttcaggaaggggtgcggctgtgggggtctcttctgaggactgcgtggtcccagcactggcagagggcctgaggttaaagacccctttaaaagga

SEQ ID NO: 8142 - DNA, 201 bp, Bos taurus
aatgatggagacggttaagaagagagaaattcaccaataaataaggagtaagagaaaagagccagtgagtccctaggccccaggcagggacctcgagggatggcaccagacatgagcccctctgtttcctaacactaagtctgggaactggggatcctggttccctattgcactaagcaagtgagctgagatgctggccca

SEQ ID NO: 8143 - DNA, 201 bp, Bos taurus
gtaggggccgatgaaacacattctgaagcctttttaaaactctgcattggaggaaattgattctctttatttaatgtctctttactcagcaggcagatgggtaagaccttggatcttgggcctaggtactgtaaacagaaggtttttgtgcagtgttgcttgtttgtctcaatacactccttaccttctccctgtttagag

SEQ ID NO: 8144 - DNA, 201 bp, Bos taurus
gggcgtcactcatgcctccgcattgccaagggccaggctcgcgtctgtgtcctggtcccaggcagtttctcagccgcattttatacgacagacccttccccggggccactccacaggccctgctccctcctaacaggccactcctcctcagcttcctttccctttcccaaaccccaaatcagagattcccactaagactgg

SEQ ID NO: 8145 - DNA, 201 bp, Bos taurus
aatcaactaaacttcaataaaaaataaataaaaataaataaataagagacattcttcactaaaaaaaaagcaagctctgccagcacagcggggaggccctcggctttcctcaggtgctagcgtccaaacactcactggggacctagagccaggctgagccctggatgctgggccagaccacaaacaggacagatgagcttc

SEQ ID NO: 8146 - DNA, 201 bp, Bos taurus
ccatggatcaccaaaatggacttggaaaattttgaaaagggctgacgagatttacactgtccactcctttcctgagtttggatctcaggccaagaggctgtgggatggtggttatccctctcaggtgcacagagaaacagcagagtgctggctgagagcatgtgcccaagctgcagaggatgtgagctcttggtttggagc

SEQ ID NO: 8147 - DNA, 201 bp, Bos taurus
ccgttgagggggcattagttagcaagttgggctcagctctggcctcatttcagtttgtgtgggtcacattgtgtggcctctctccaaagatgaccttcaggagtcactacttcttaagcctgaaaccggacatagggttactcaggctcctgggccctgtatgtctgcaccttaagacctgtcacctcatttagtcatctc

SEQ ID NO: 8148 - DNA, 201 bp, Bos taurus
gccatgctgaagcctccggtccagccaggggatccatgaggatctgccgtggtctcatgtcatgccctcccgcactggaattaggttgaaaatggtactacggaggcagggcctccaggaggtgattaggtcatgaggggaagagccggcgtggatgggattagtgcctttataaaggagactgagaaagctcccttgccc

SEQ ID NO: 8149 - DNA, 201 bp, Bos taurus
agcttcttctgtagaagtttaaagcatgggaggactttgtcatttctgtagtttcctggaaggaaggggatcctctctgctcccaggtggccatctcgaacctgagctttggttctcaaaatccaaaaagactgttgaccaatattctgtgttgaggctcaagcttcctcatgtggcctgatggatttatattcagtggtt

SEQ ID NO: 8150 - DNA, 201 bp, Bos taurus
ggcaaagagaaaaacatggtgtgatggtctgggcccgtggggcccacggacctgatgttccctgactctccattgccccttgaacatccaccaaggcctcctcctgccactcgctaagccccagggctccgggggctcctgtgcaggtgaggatgcggcaggtcaacaggccgcccggccacagctctgccttgcttccct

SEQ ID NO: 8151 - DNA, 201 bp, Bos taurus
ctggacgttcccaggtccactgatcctgccggagggcctccccacagtcccggaggcgttttctcagcaagctcgagctttgaggaccattctctcttgataggagcaatcatctgacctcctcaacaaaggggaaaaaccttacggactggagggcctttcttccttcagactgtttaaggatattttccgaactaggag

SEQ ID NO: 8152 - DNA, 201 bp, Bos taurus
atgggccagacaagttcttactttctggaggctgttcagagggcagagactggaattgcaaatggggtttactgtttctaactttttgctgaacacgctttatacttccacgtgcgtgacatggcttgagggtaatcccaggcctgggtgagagctggtgcagtcgttagagcctcattccatggataagatcaaggacaa

SEQ ID NO: 8153 - DNA, 201 bp, Bos taurus
ctgaaacatgacataaaaaaccagaaaaggacacacacccaagagatgagcagctcaacgctttaacacaaagcaaacagctgagtggccagcgcccagcgtcctgaagtcctgctggtgctgcccctcacctgtcagtcatggttttcctgcctctcccctcagaaggctactggctgcagagttttaaggccacatcat

SEQ ID NO: 8154 - DNA, 201 bp, Bos taurus
catacacacacagatatacacatgtatctcttcctacctaactgcacacagtaacaattccagctgttacaacaacacaatataataacatcagcactgcacccaacatcagacacctgcactagctgttcacctgctgaaacgctctgccctaagacttcaccaggtaagctgaactaccacttcagagagaccttctta

SEQ ID NO: 8155 - DNA, 201 bp, Bos taurus
agctttccttaaagcatgtagaaatgaacaggattcaactctggaataaaattaattagagtattttactttaagtgatcgatcttaataactttaagttatatgtctagaaaagcagaagtgacactagatatgcacttagtcatttaatgtgttaacagttattaaggtataaattacaaaaaggaacccaagcaagtc

SEQ ID NO: 8156 - DNA, 201 bp, Bos taurus
gtatggaattaatgtttgaaagaataagttgtcctttccaacataaacattttcctcaatccagttttctgacccacaggcttacacaaaagtgacacacatgtaataatgttctgcaatactccaactacttccaagaaaaccagtaaatgaagtgctcacactcctgacgggtctgccaatgggatggtaacaatcctt

SEQ ID NO: 8157 - DNA, 201 bp, Bos taurus
cagcatataccagaactctatttgttttatggtcaattactgtcaggagatgaattgtatggatattgcacggtttgtttatccacttatcatttgatggatgtagatctgattcttatcctagcaagcagttaacttggtcggactcaaacttcaaagtgtctcccctgttaaataaatgcagaattcaccaatttcctt

SEQ ID NO: 8158 - DNA, 201 bp, Bos taurus
taaccatgtgaccatctgatgaaacaattcattttaatgagctaatacaagaaagtaaataaaattctatgccccaattctccaattttggcctgaagatttgcatttcaagtgtgcctctctagagaacgtgtttcttattgtctgttctaacgagtgactttaaagccagaacactgatcaatgctaacatgtgagaaa

SEQ ID NO: 8159 - DNA, 201 bp, Bos taurus
ctctcccaagggtcaccctccctgctgggtcagagactttgctctgtctggtcctcttctctgcctcttcctctgcaccaggcaggccttcccttgcctctaagctctattgccactctccctgcccacccacccagctatcctctttcatcccttcttgcctcagcactaatggccaccgccacccaccccgcccaaccc

SEQ ID NO: 8160 - DNA, 201 bp, Bos taurus
accctgcctgaatggggttgtcttccagggggcctgtcttgggggatggatgtcagcccgtgctgacagtgggaaggcgtgcttgacatccagggatgcaatgaaaagtgataggtggcctctgatctaactggtaagaaatatttttcttacgcttactttgctttttgaaaagaaagagttaaactgtaatacagatgg

SEQ ID NO: 8161 - DNA, 201 bp, Bos taurus
aagcagctcccaggcttgcaactgcccacagtgagtggggctgggtgcagaggtgcgtgctgcagtcggtccttagggaaaaggccagggttgaatgccaagaggactcaatgaggggaccaatgtgacacagcacagacaaaatggggaaaacccaaaccgtgggaaggccagagaaacaaagaaaagcaagggaccttt

SEQ ID NO: 8162 - DNA, 201 bp, Bos taurus
tggtacaacctggaaaagcagttcttcaggcagcttctcccaggggtgcttccaaaaacacccccaatcgcaaagacagcctttccaaacgaagtttgttttcaaggagaaatgctttagtttttcaccccataaatgaaacaatggttacatttaatcagctgatctctaaaatctttcttagaaaacacgaccgactac

SEQ ID NO: 8163 - DNA, 201 bp, Bos taurus
cccctatagcacatgaatttgttattcctgactaggacatctgaaacattagatgaacaattagaggatgattctgtacctgcagcaaaaggccacttacacagtccagcctccactgcgttctcatggcaagaggagcaccataaatcaattccagacattatcaccattatcagggggtattgggctggcaactgaatg

SEQ ID NO: 8164 - DNA, 201 bp, Bos taurus
agttcaacgtggagtccctttctcccacccccggtcaacaagaaggggtgagagacagagccaccaccccgtgagcttcttctcccaccagggttgcacacgcacggacctgcccttggcccccgcgaacctgctccatcgcctcgactcgccccttgtcccctctgccctctcagactctccctggatgctgaccttttc

SEQ ID NO: 8165 - DNA, 201 bp, Bos taurus
acaaacaaacaaaaactgaaagggtagagtatctcacttgatatttaatattgtatcgattcttttcctatctaatacagtttaaacttgtcttctattaggagccttcaatcttggaacactcctttaacttaaccaagtataacattatttttggccatccggctatgttaatgttgaccaattattagctaaaagtga

SEQ ID NO: 8166 - DNA, 201 bp, Bos taurus
tgatccccaaaatgctcattttctattgaattacattagttttacagtgataaatcaccttaatccttctgcagaaatatatggcctattaataaattcagtaagtacttttggtgaaagaatttttatagaggaacagtgagcattgttcaatggtatagatttaaagtctggcctcaagcaatgctgctgtaggcccac

SEQ ID NO: 8167 - DNA, 201 bp, Bos taurus
acaatggagattctgggttgaagtgtgagtttccgcaggagctactcagcatcagcaaattgctttcatacaattctaggtctgttatcacatcatctgatgttggcaactattcaaactttggagctaggggaaaaaaacaggcttcagccatctggtttaagatataacctcttctggggctatttttactctgaggga

SEQ ID NO: 8168 - DNA, 201 bp, Bos taurus
cagtttcagttcaggctccagatgagggcacgcacagcaccaaggcacaggttagactgccaccccgtcaacaggtttaatctcgagttcctcctcctaacaccaactgggtctattattaatgacagtctgactacacaggaaaaccacacatgacctggatccaaacatcacctcccatttctgggttggctctggctg

SEQ ID NO: 8169 - DNA, 201 bp, Bos taurus
ttttgaaaggctgtgtaatagcgcagagctgacagaccgtgtctggtgacagggaacatggacagcaattaaaataagcagaagcctagcaaggaaggacgtgtgggcctcacagtaagaagcccccaaagaggggagtttccaggaccggcaaactcagagactctggggcctcagcagggactcagtttccttccatat

SEQ ID NO: 8170 - DNA, 201 bp, Bos taurus
ggtcttttacaaatacctggaatagtttctgtgtatgatgtgaggtaggagttaacttcctttttctccctatagattaccagttatgttggcactatctcttaagaagccattctttctccattgatctatattgttagctctgacatgaatctagttttcatatatctgtgggtctgtttcctctataccgtttcaccg

SEQ ID NO: 8171 - DNA, 201 bp, Bos taurus
acccacagaggccatgagaaacgaaatcttttccaaggatctttgaagaaagccctgcaggtgaaaaattagcagaagctgaaaagtcatgctcgcctgccggtggagcccagcagtgtctcggggagcacacggggtgtcctgttgtggcgtcctctggaggtaagacctgccgagtcccagaatgctcactggccacca

SEQ ID NO: 8172 - DNA, 201 bp, Bos taurus
aaccattgaaatgaaaacatccagaaaaaattttggttaaaggagactacagcttggatgctgtttaaccatcaaggcccaaagataccatccagagatatatgccagaaactcaaaccaggaactcaactcaccacaaccttccataaccagctgggccatcactttttgtcccagggacgctacggtactcacctatct

SEQ ID NO: 8173 - DNA, 201 bp, Bos taurus
tttttctacatttgtagccctgatggaactcgtctgagcttaaaatttgctgccaaaattattttccaatatctgtaacactggtgggcctccagagagcatgtgtgccctgggctttcataattaggcagctcacacctgagcatctcgcctctggtaatgagatctcgtggcacagcttccttcccatctggccacggg

SEQ ID NO: 8174 - DNA, 201 bp, Bos taurus
atatagctggaaagtactgcagatattttagtgctcttgtatatctggggagataaaaattgtgagtccagcactcttcaagctctagtaaacacccacactttcagctgagagtctggagtacatactaaatgtagttcaatcagagacagtcttacgaagtctgtaacataggataacattaatcctctctgaaggaag

SEQ ID NO: 8175 - DNA, 201 bp, Bos taurus
cacaggggctgaacaagtccctccagccactgggttagttcccaccttccccgaacactcccaccgcccaccgtcacgggcagccggccctgggctcccctcggatggctgagtggtgtctctcctgctttccctgctggtctgcggaaagccccgcctgccagccctcctccttctcagcccagctcctgcccagcacag

SEQ ID NO: 8176 - DNA, 201 bp, Bos taurus
atgaccaccgtcatttcttgaaacttcttgctgaaacttgttgctggaagcggaaacaagccatcattagtgttaatggagttactggccgacaggtaatgagctattgatcggataaaagctctgtggcctttttcccccttggaactccctgatcctgagcatgtgcagtattataatggaaatttctctcaacaagtc

SEQ ID NO: 8177 - DNA, 201 bp, Bos taurus
tgggatgaccttggacaaatcagcataatttgcccccttttttttaaacaaaaagaaagtcattccaaattcccatagtcccagctcctctcggcctgcccaccacttgcagtgtttccttgaacgcacaaactccccacggctctgcttcctgtccaagagcgatgggctcaaggctcatcatttctgtctgcagagagg

SEQ ID NO: 8178 - DNA, 201 bp, Bos taurus
aagagcaggggggccagaggaatcagaatgaagggtcatgaagccattcacttcctccttccagtctgagcagcttgagaaacaggaggcaggttgatggttcagaaatggttggcctagagacactagagggaagatgtgaatgtggctgagggagaggagctcttgggctatcttaggtcttgcttgagtttggggtgg

SEQ ID NO: 8179 - DNA, 201 bp, Bos taurus
aaaccacaactgtcctagctttctgctccccgctttcaggttgctaaacaaagcagagcattgtgttcccggcctctgtgtcatcatcatcatcgccctttggaacttcatgagccagaccaggacttccactttcgcctgagaaagaccagatactctgaacagctaccacccacctggcagtaactcaaaattgtttct

SEQ ID NO: 8180 - DNA, 201 bp, Bos taurus
atggtgataacagcagtggtcttactggctccctgagatgacggagcatctggtgaggtgcaaccccaaattcctgtgatggccactgcatctgggttactgaggggctttgcccaacactcgcctgtcatggtcatcattatctgtgattctgtgaagctccttgctgagaagagaactaagggaggccctcaagagaaa

SEQ ID NO: 8181 - DNA, 201 bp, Bos taurus
tgccccttcaccctgatcagctcagcagccatgcactgccggggcctgtgctcaatgcagatggaagtcagggtgcttacacgtcatgaacgcagcagttcatgtcagtgctagaggctgggccagtcctggatgaagagaacttgctataaaggctcctcccatagataggcccagcaggttcagtgcacagcctccctg

SEQ ID NO: 8182 - DNA, 201 bp, Bos taurus
gggacatggccatgcccaccttatttgcataatccatggctgcctttgcacaacactggcagagctgctacagctatcctacggtccataagcctgaaatatttactattggcctttacagaaccttgccaacctgtgctctagactcttaagaatgtccagacacactttgctccctagtgttcactcatgcactcgtgc

SEQ ID NO: 8183 - DNA, 201 bp, Bos taurus
aagttttaccaataatagctggattctttaacagtcaagtacaggcctaatgaaatgactctgtcccaagctgttcatgaaaggagtgaaaaaatgctggcgtgtcctggtgtttccatttttgatcagcctcatctgggaatttaatacgttttctgatcaaagtccaaagtctctgctttgcttcagctttaatcttcg

SEQ ID NO: 8184 - DNA, 201 bp, Bos taurus
cgaggctggacagactcaggcctgtgggacccctggaagggtctacacttgttgagacttggaagtgtgggcagggctgtgttctgctggccttatagactgggggtcacttactttggcatttttaacaaagatttaaagcttagggaatttgccagttggcttggtcttagcagcatgtactttttttttacttaaata

SEQ ID NO: 8185 - DNA, 201 bp, Bos taurus
ccccagtgccttcctgtgtcactcagagcagaggccagctccagccggtctccctgggtgtctccccgctctaaccccacccatcatgctgccctcttggcttaaatgggcagcaacaggccctctgttcactcatttgacatgcttgtggcttgccccctctgccctgcctgccccccaccacctaagtgccatgggaac

SEQ ID NO: 8186 - DNA, 201 bp, Bos taurus
ggccagtgacctcctggtgggtgactagctgccccaggcaccttcatcctgggccccagggtgcctggaccagaaagaagactgagtttgatgggccctgcagctgtggtccctgttctctcactaaactgaccttctggaacaaacccatctgggctgaatgtgggaggcgtgggtccgccttcccagaccggatgaact

SEQ ID NO: 8187 - DNA, 201 bp, Bos taurus
ccatctcacactgtccagagtggccagcactggttttccatccttgctgtaggcacctgctacaatccctgctcccaggccagcgtgggactctgagagcgcgtctgtggacgtctgtctgtgtttcctaacggacgtttgtgggcatccctcagagagttgaccacgtgtaagatcgtgggatcgtggggtagcgaccgg

SEQ ID NO: 8188 - DNA, 201 bp, Bos taurus
ccctgaagtggaagtgtggagtcccagcccctggatcaccaggcaaatcccagaaaggaagtcactctgaatgtcacagtacaagtgactcctgtggaatataggcccaggaagaaaccccatccccaaacaagtaactgggccagccttgctagtggctgccctgggagagggtgtcacacagccctctttgctggtgtc

SEQ ID NO: 8189 - DNA, 201 bp, Bos taurus
ccacacggtgtgaccaaaaaataataaaaaaccatttcaaaaaagaaagaaaaagtgagaatgggccatggagaaaataaaacgagatgtgcatagggaatgtatttgtgtaagtcggaggatgaattataatcctcagtgaaacaaaacgtgctctttctgacggtgggcaagctttcaacatgtcagattactttaaaa

SEQ ID NO: 8190 - DNA, 201 bp, Bos taurus
agtaaataatatactcctggtaaaactcactaaacaacaaaatctaaacaaaaacaaaactcaccacaactcaactaaaacaatgatgaattctagtctgcattggtacatcctgaaattatatacagataatttctacttggtatttatctttaccactatcaagagattttatttttaaaagaatttgtctgaaaagga

SEQ ID NO: 8191 - DNA, 201 bp, Bos taurus
tcaagctgtgggctctgtccctgggtgggtgttgcaccacacggccctgtggaatgccgtgggctccaaaggggtccagaatacagggctggaggaccaggcagggctctgatgagcggcccgttgtggacacattgaccttcactgtcaaggcctccagtggttcttcaaggaagaacctgcttcacaccctgcttccct

SEQ ID NO: 8192 - DNA, 201 bp, Bos taurus
aggaggtgctctttggaggaggccccttccattctgtcattaacctcaaaccaggcaccaccccccaccaccccccggctctgccctgtgcatttcctgctcaagtacacctttcaggccttttgatcatgcaatgctttgcctgacctattgcttcttcccgcagattaaagaagtagaagagtaagaatcaacagatga

SEQ ID NO: 8193 - DNA, 201 bp, Bos taurus
gctcacaggcaagtttggatattcggaaggaagagagagatgtaggggctgttgataacatctggtcccagtgtcaacatcggccatgtaagtaagacatccctgcctccgttggctatcaggaaatatccaggttagttggcagctcttctcgatcttgtatcagttaagacttgaaaacgtggctgtaacttgtttgta

SEQ ID NO: 8194 - DNA, 201 bp, Bos taurus
tagtgtttgttcaggctccacaggcctagttgagaagaggctcagagcagccgaggagggggtctttgttagcgtagacaaggtgggcttgagatggggtgtgtgtgtgtcgtgtgctggccgctggccatcttggctggtaggacatctgcctgactgtgcttttcctgaggcttcatcccgggtgtgcagattctgtga

SEQ ID NO: 8195 - DNA, 201 bp, Bos taurus
agtgttgcattcatttctgatgtaaagtgattcagtcatatatatatatatatccttttgcatgtacttttccattatggtttgctgcaggatattgactatagtgccctgtgccgtttagtaggcccttgctgtttactttacgtatagtagtgtgtatctggcggcttctcaggtggtgctagtggtagagaagctgcc

SEQ ID NO: 8196 - DNA, 201 bp, Bos taurus
ccactgctccgttctgcctgctgtgttcctcactgccacccttgattaaactgctcaggggctgctttttctttaacgtttatctgctcatttgcctgcaccgggccttagttgtgacacgcgagctccttaggtgcagcgggttggatcttaattgtgacatgttggatctggttccctgaccagggatcaaacccaggc

SEQ ID NO: 8197 - DNA, 201 bp, Bos taurus
ttgcacagtatttatttcagttttggccatgttgactcttacgtaaatatggtaactgcttgtttaaaattcttttcacaatacaataatcacattgaaaggtcagtcaggttttggcacaaatggccaacatccttctgccaatgatggttctcgattaattttattgcctctagaagttcatcaatgtattttgagaat

SEQ ID NO: 8198 - DNA, 201 bp, Bos taurus
agagccttcaataaagttttaaattgctgtccattattgttgtcaatgactgggctaccgattcttctaaggaaaatgttgaacagggctggtctttgaagttaccctgcccggtggacacatatctgtatacatacctgcaatctgagaaagattcctgtgcgatggagacatgggaaaggcatctaactccttgcagaa

SEQ ID NO: 8199 - DNA, 201 bp, Bos taurus
ggcagcggcgtttatccaagcaccagctgctgtccccggccactctgctggactctaaggagaaacgacccatggaggtccacgtgcctctcgggtagtggagaagcttggccaagagttccttggtgactcctgtcttcgggcactgcaggctgggcctcactgacttgcacagtcatcctacacacctgtttagtccct

SEQ ID NO: 8200 - DNA, 201 bp, Bos taurus
cagacaggcctgaagacttcctgagcccgcagcacccacctctagatgcaccacttgacaggaccctacccaccaaagtgccaagacccagctctaccacgggtgggccagtaccagcaccctcccaccaggacacccaaacaagtctctagacagtctcatgcactagggtgtagataccagaagcaagaaaattatggt

SEQ ID NO: 8201 - DNA, 201 bp, Bos taurus
agcctcacgtgcctgcaatattgttcatctgttccctgtgacctgtctggaaacaggcctggaagaaacctcattttctcttggaattctaggcagatttgtgacctgggacggatatgttttggggttcattcctagttataataactcactcccttttttctcctccatctcaggtaaacacttatttcaccttcatcc

SEQ ID NO: 8202 - DNA, 201 bp, Bos taurus
ttttgacagatgtatgcagtgtcggttcttcagtgaaccagagggtgtaatttatctgcaggaccatggagcccaccctctttcttggtcttggctatggcgggggccccctcggtccttccttttctacccttgcctgttctgctcttttccctgcatagggggtgggtgggggcaagctccatgcatcaaatcactgga

SEQ ID NO: 8203 - DNA, 201 bp, Bos taurus
gcagacttgacgctgttcagttacagggcccgttgccaccatcgtgccagcctctgcaggtcccacaccaggcacttccttccctcagacctcccaccccccaggggcctgtcccattagcatacagctctcctcccagacaccttggtcaaggctggaggctggaatcccagggaggtaagagttctgctaccaaagact

SEQ ID NO: 8204 - DNA, 201 bp, Bos taurus
ctcccagtgatttgcatcagtttcccagctgaatgcagtcggtaagcacaagatataagagacatctgtatttggtagaaagatataaaactgtattcataaaccacatggtcatctatgtagaaaacactaaggaagctacaaaaaatttttactagaactcataaggtaaggttaatgaggttgcagaatacaagatca

SEQ ID NO: 8205 - DNA, 201 bp, Bos taurus
accttgttataatcactccagcaatttttgttttttatggattctttcagattttcttcatagacaatcatatcatctacaaagacagctttatttcttctttctccatatgtttaccttttgtttccttttcttatctaatagcataattaggatttccagggcagttgaaatgagtggtgagaggagacatccttgtct

SEQ ID NO: 8206 - DNA, 201 bp, Bos taurus
ttccagcaaggcccgggcaaacacgtgaaaccaccttttccctctctgcttccatgaagtctccgaaaggagaatctacggcaagctgcttctcgtgcctcttggcccgtcctgaaatagtcctgtcacgtgagaagctctgacccttcagaaggtttcggaggatgatatttctagccacagcaagagcgtacgccaaag

SEQ ID NO: 8207 - DNA, 201 bp, Bos taurus
atacctctccatggtcccctgagtcacaaccatttccggggacgatcccgatacacaggagggccactggcaatgccccttggccgcagctgctgatgcagagagcaggtttctggttcactgggtgcagaaagatgctactgccaagaagaggagatctgaaacacagagacattgctgtctgatgccatggcctctgag

SEQ ID NO: 8208 - DNA, 201 bp, Bos taurus
tgttgtaggaaaaggcccatggcagcagggctggtggtgaatctcttttctgctcaggggcggcggtccccgtgggagtggctggcagccaggaggggcgcagtcgagagggcctgcctgggcatctgtctgtgactcctcccctcctgcctccctcagctggagtgcaagctgcagtctttgcctgttctggaaacccga

SEQ ID NO: 8209 - DNA, 201 bp, Bos taurus
ttaagattacatttctaggggaaagtggaaattgcagtgaagttggagaggaagtctgggtttgatatgggatttagcacaagggacaccattagggcctatggttttctcttctgtgttccctttgagtggtatcactgctgttacaaagagatcatccagaactcctggccctttccaccttgtgaggacacagtgaga

SEQ ID NO: 8210 - DNA, 201 bp, Bos taurus
tgcttctcaatctgcatttacaatttcacctgaaaaaccctttatgcttccttccatgtaaagttgaagttagaacagaatctggccaaggtccatcaactagaaagagggaagctgagaaagtgaacatccccccccaagaaaagaggcactgctgccttgctgggtatcgggaaaacagaggcagcagaattccagcag

SEQ ID NO: 8211 - DNA, 201 bp, Bos taurus
gctttcccattagaggacagttgcttgggagagccttagaaactaatattgcatttcacttcataaagattgtggcaaacccaacagccagagaatccacattccaattgccgatgagaggtgaggacatgttcccacagcctctgctgctaatgaattacagttgtaacacacagtgtggcacggtaccatgttttaagt

SEQ ID NO: 8212 - DNA, 201 bp, Bos taurus
ccagatcagtttccgactgaaaacagcaggagttcagattcaggaggttcatggaagatagcgtggaggaggctggtagctctaggaccacgaactgccgcgggccagttacgaggcgattacctgggaaacccggaagtccctcgtggaggattctggggagccgacgttgtggctcctgaagcgcatgcgccaggattc

SEQ ID NO: 8213 - DNA, 201 bp, Bos taurus
actctgttttgaacctgagacattatttaacctctttggatctcagtctgcctgggtgagaaataagggccatatcaggttcagcattcctttattccaccggaagcacacgggcatgaaagagacttcagtgaattaattcctggacatctttcagctaaatgttgaggacgtgatccttagatggggcttccccagtgg

SEQ ID NO: 8214 - DNA, 201 bp, Bos taurus
tgtcagctgtgttcaccatttggaagttttataaagcttgtagatatctttaaaatgtggaaattcaataagtgaggtttatttctggtcataaataaaggtaattgaatgttgatgattttgcataatgcctattcatagcctttttcattttggagatcggtttgaaatagtgaaaactacggcttacaaggtcttgga

SEQ ID NO: 8215 - DNA, 201 bp, Bos taurus
gaatactgattattgccaaatttatgtaaacagtgatgctaattgtcagatgaattacaactcaaaggcgcctgtttaatatgtaaaaaacaaaccctgcggtgtctaggtgtgggcatgtatgtgtgtatgtgatgttggagagtggaaagaaagggacaaattcaaatttaaaaaatgaattatgctgtaaacaaaaat

SEQ ID NO: 8216 - DNA, 201 bp, Bos taurus
ggtataactctaacaaaatatatatgagactgatatgaggaaaactacaaaaccttgatgagagaaagcaaagaaaaactaatatattaatattaaagtatgtaacaggaggactcaatattgtccagatggcaggacttcccaacttgatctatagattcaacacaaggccaatcaaaatcccagaaagatattttgtag

SEQ ID NO: 8217 - DNA, 201 bp, Bos taurus
tggcagaatgccactatattcatttttatttcaaacacaatgtgaagtctttaattttaatatactttgtaactataatggttataaggcatatactgtattaattcatcctcatccttttctggtcctgggcagattccactgaggaacagaaagatgccctgatttcatgtgtcttacatacttgaaaatattgctgaa

SEQ ID NO: 8218 - DNA, 201 bp, Bos taurus
catgatacctcttttaattgcaatagacacattcttaagtcatttaatccaacaggacccattaccagtaaacaaaaagcacatttttggccgcttccccggacagtacaaaggaaggaggaaagtaaacgttttccccagtgagtggccctgtcccctctgtgttttgagtggggatttgtagatgtaaactctggttcc

SEQ ID NO: 8219 - DNA, 201 bp, Bos taurus
aacccaagaaggcaagtgaggaagaatagacagggtctgtgcctgtgagaagaggacaggattgagcaacttcataaaagaaaaaatgagggggcaagtccgaaagaaaatcatatggaaattagttgcctgtcaacatagacaggtttgaaatgtccgatagcttgggagaactgtagtggaagaagacaacagaccatg

SEQ ID NO: 8220 - DNA, 201 bp, Bos taurus
acagtatctgtcggctccacgagctggttttcctccaaggcggatggagccgaggatttgttacttgatctaacagcaatggctttccaatagccagacacgcacagcatcattgatcagtgtgccctctccttgtttgcattggaacactgctcaatttacaccaattaaagaatgcttggtttggatattgaagaatca

SEQ ID NO: 8221 - DNA, 201 bp, Bos taurus
gagctgatggttaaacagtgggttgtccaggaggaagccatggacagcccatgcctggtgggaggagcaacacacacaaaggttggtacaaaaaggcccctcgtacacactgagaaccaagggcagctggagatgctgcaggggagggggcaggctggcgaggacacagagcccggccagaggggttccaggtgcgtgttc

SEQ ID NO: 8222 - DNA, 201 bp, Bos taurus
aagttgtccttgggctttcatggcccacttccctcagcaccctctcggggccctggagtggcttcaggagctgaatggttgcaggttttggccagccaaacatctgaattctttggcaatatagtgacctggaaaaacccatcactttttggtttatttgcttctggtcaggccaggtacaaataactccaattaccatga

SEQ ID NO: 8223 - DNA, 201 bp, Bos taurus
gcatgggatctttgggcagttttcaaaaacacagaataatcttttaactttcaaatgaagaataaaaatagaatgtcctctttggtgactttgaggcctcgtcaagcattgctgaataagtttgttcttttccaattaacatttcactctaagattttctctttccttccttaacgaacatttttgtatggttggttagtt

SEQ ID NO: 8224 - DNA, 201 bp, Bos taurus
ggtgcccttcctgcttagcatatgcagtgtctgtgtggccagttcttagaatcagcaaaaccaccattgtcaggatcacctggaatgctgggaacaaaatgcggtctcccacggtccaggccttgctcagaattcccaccggcatcacccaggaatatacatttttagcaggctcccaaaagcctgtaaagatggtgattc

SEQ ID NO: 8225 - DNA, 201 bp, Bos taurus
cacagtcctgaaagtcaaaatacacaggaaacttcaccaggatacgaatcagggaccaggcacaggaagaggggatatattatgaaccaatatggcacaggtcatgcattttcagtttccccctccatagatgggggctcctgttggggttagcctgcttttcctccactgttggttattcaagttagaggtgattaaatt

SEQ ID NO: 8226 - DNA, 201 bp, Bos taurus
ttacctaccagtccctttgtgtttttggatttacacacaatatttaaaagctgcctttcacatacgctgactttttcacaactcatccaaggggatatgacctcacagtcttacggtggagttcctgtcttctagtcgctgtctctgtggaaaaggccaaggggatcaaaggtgttcccaagtcagcccttgcctgcctag

SEQ ID NO: 8227 - DNA, 201 bp, Bos taurus
tgagtaactccccagaatggccacaattcttaccttaaataccatcttcagctaaagataaaaaaggatattgggggtaggggtttgggacttcaaagggaaagaaggccattcatatggagaggtaaaagacaatgtttgataaaaaaaaataaaaatgtttgctgggccaggcagagataatgggacacagggaagagt

SEQ ID NO: 8228 - DNA, 201 bp, Bos taurus
caggatggctgcctacctgtgctggactgtgccagtcctgatgctggcccactattgaataggactagggctttgtctgtcctggggctggtgcaggcctgcggggtagttctgaatggctgtgtgtctcaggaggtcatggggctgtttctagtatacaaatgggtggtgcagggcctaggaggagaaggcaatggcacc

SEQ ID NO: 8229 - DNA, 201 bp, Bos taurus
tttattattgtccccatcctgtaggattatacaggggcatggaatttggccagggggattactaaagattaaatccttttttcgagttttaagaaaatcaatggtaatggttgtgaaaagtgtgaacaaattgtatttatctcaggagagccaaggcttgggaaccaaactctacattgagtagacagagacaaaacctag

SEQ ID NO: 8230 - DNA, 201 bp, Bos taurus
aagtagagctgaaaacctcaactgggaaaggctggaccatttatgagagttcaggggggtccctcaccagggatgaatgaggcacattcacaggccaagactggaactgagcaggagaagcctagagctcctgggagtcgtgaagcaaaaggaggtctttacacttggtgagagttgacgtgtcttcaagtaggcacaggg

SEQ ID NO: 8231 - DNA, 201 bp, Bos taurus
cgtaccttttacaagttcactaggtgattcttactgcagccaaagtcaagaacctcagtcagatgagcacagctgtctaatcctaaaacccaaggacccaacaatgaagcagtcaggcacagaggaagtaaggggaagctggagtcctaggccggagaaggcaatggcaccccactccagcactctggcctggaaaaaccc

SEQ ID NO: 8232 - DNA, 201 bp, Bos taurus
ggccccgatcatcctgcagctcccccttgacgccaccgcttgctagccctgtaagtgcttctgaatcaccattcagccacgggcccactgtggactcccactactccaccccaaaagcttccacagcacttccattgcgtcactacagatccgactcagcgggggccgcagccgacatgaagggcgagtcgaagtgcaaat

SEQ ID NO: 8233 - DNA, 201 bp, Bos taurus
atcctaccctttttcttcatagctccgcttaggcggcgcttgtctcgtgccaggcactcatgctcgtcgtatgtaatcctcataacgacctgaggagtgcggtaattactgtatcctcactgcacaagtgagaaagctgaagctcaagaagttctctgacagtcaaggatccacggttaggaacgaagagagcagagttac

SEQ ID NO: 8234 - DNA, 201 bp, Bos taurus
gtccaatgaactgttcctggttcaattaaccatggccaagaggcacagttcaggtactccacagacacagccacagagcgtcatcccttgggtgagggagtgtatgggccagcagatgacccgaagctactgatgggacaattcccgcaaacactacaggttcgcagattctcttccctgccttcccagagagcacatttt

SEQ ID NO: 8235 - DNA, 201 bp, Bos taurus
actgagcttctaatatgtagacttttacaagtccttgtagggagtagggagaagagattcctatcaaaattcatggccaaacctggccctcactctcctgcctttgcttctctgtgtaactggtgtctgtgtgcctccagtcttcagttatttggaactacggtttatgtgcattccactctgttgtcaggcctgttcacg

SEQ ID NO: 8236 - DNA, 201 bp, Bos taurus
acacactattctacatagaaaacaccaatgaacacacacaactcaaacataatcaaacttataaacaagttcaacaaagttgcagtgaccaagataaatacgaaaaaatcagtagattcctgtacagttcagttcagctgctcagtcatgttcgactctgtgtgaccccatggactgcagcatcccaggcttccctgtcca

SEQ ID NO: 8237 - DNA, 201 bp, Bos taurus
tgaattttaaaactcttttggagatgggagggaaaatggtagcaatgataaaagaaataaaacaaaagaattggggctgttctgttactggaaagtaatcgtactacctatgaaatgctgtagtgttatttgaaagtatacctgaactgggtacaaacataatttacaaattctaggacaattacaaaaaaaaaatttttt

SEQ ID NO: 8238 - DNA, 201 bp, Bos taurus
ccaaaaatgaaattaagaaaacttttccatgtatagtaacatcaaaaagatttaaatacttgaaattaatttaacaaggacatacaagagttgtatgctgaaaactacaaaacactgttgaaagaaataaagacctaaataaacaaaaagaaatcccacaggcacagatcaaaatatgcaatattattaatatggcaatat

SEQ ID NO: 8239 - DNA, 201 bp, Bos taurus
ggttgggccgatggtctttctaacaggtgggattagggcctccccaacctctgccccgtgtccaaccattgcctcgtccccaggagcctgagctgcccttcagcgaaagggcaggccaccccaatccatccccttgtgctcagagcagggatgggactgtgaggctttgacagtctgaactgggggctatggttgggcctt

SEQ ID NO: 8240 - DNA, 201 bp, Bos taurus
caccttctccccggggcctaggaggcagtcgggacccacctacccgtcccccaccccttgttcttagagcccctcttgctgaggtcaatccggccttgaaggcggagaacgtccttggaaagggcatcgaggttgccgggggaaatgagcgtggggggaggaagagaacacctacacccttggcagggcccgccaggctga

SEQ ID NO: 8241 - DNA, 201 bp, Bos taurus
tgtactcactgctatgggagagggcggtatttactcgtttttaaaaaatgtatttttcaagtttctgggttcttcctctagctcttttttccttgcaatttatttttttgaaaaaaattgtcctgtaatttcccacagtttggattttactggttatgtccctgagttgttgttcagcatttttttctgtcccatgtaagt

SEQ ID NO: 8242 - DNA, 201 bp, Bos taurus
ccttagcaaaccctgtggggtgaggaggtgctgaagggggatacttctggcccgctaaaaacgtgagagctcctctgtggccacctcttcttcgtgagacagcctgtggggtcacttggaaagccacgggaagggatgtgctgtctggtgatgtcttccttctgccaggatgaagccccacacacaggggaaagcccttgt

SEQ ID NO: 8243 - DNA, 201 bp, Bos taurus
tgttggacgggcaggtggtttccgctaatccccctgtaatgggaatgtgccaactactcagggctgggcatgtctggggcctctcttgaaaagctcacttcaagctcaccttgccccacctctcacagggtcttgttcttttgcactttaccttgggaccaaaactgcccaccccagcccctctcccatcccctcctgggc

SEQ ID NO: 8244 - DNA, 201 bp, Bos taurus
ggcctgcctccacaaggaccagtgttgcctctggttccccaggaggcatggcctcagtgcgccctctgctgtgcacgaggaggaacaaagagatctgtccggcaatcagaggcagggctgaggcccgagatggctggcagggaccatggtctctgaccgaataaggaacagggacagagggctgcctggctgtagaccacc

SEQ ID NO: 8245 - DNA, 201 bp, Bos taurus
tatatataacttgacttgtaaagtgttattacactccatccatgtgtgcatgagtgaatctgaagcagacaccattaacagcatacaattcttacagatgtgaatccagaaaatagaactgagcctgtgtattttaaaaaaatgtttattaagcagcttatccggtgcggctcctacgtgcactgtagtattgtagtatta

SEQ ID NO: 8246 - DNA, 201 bp, Bos taurus
agatttttgcctggaaaagtcagtgaaaagaatatgtatactatgatatatgatcctatttataaatgtgttatatgcacatatgtgtgtaggtaaaatatctgtttagaatagctccctggtacctcagacggtaaagaatctgcctgtaatgcgggagacctgggttcaatcccgggctctgggagatccccttgagaa

SEQ ID NO: 8247 - DNA, 201 bp, Bos taurus
cttgaatgccctggaatgtgaacttgttggggcctgtagtagcccctcagagattcaatataggttccagggagatctataccaagcaagaaagaagaccgttactatgaccatgtggctggccgagatgataaaaaggatggctggggagcttgttggcgctaatgtctgggagctgggagaggtccttgctaccactaa

SEQ ID NO: 8248 - DNA, 201 bp, Bos taurus
caacagttagccttcaaccacccacaccctagtggctgtggggcagatctaaagagtgccagtgaggtggttattatgatgaaccccaaagggccagtgagagggtgagaaggtggagagagtgcagttgggtcaagcccagagaacagagctggtggaggaatggtcgagaggggccaggctgagcctctgtagaggctg

SEQ ID NO: 8249 - DNA, 201 bp, Bos taurus
tggggctctacaggtgaacagggtgctcaccgagatagtgcaggccaagaggacaaggtctcaaggacagatgaggctctgtcctccccagagcagaatccatcctctacccactttcatctgtccaccctgttggccagttcagtgtagggaaccaaggccatgggccatgagggttgcttcctctcccagtcctagagg

SEQ ID NO: 8250 - DNA, 201 bp, Bos taurus
aaagatatgcacatgtacacacatacagaaatgcatgaaaagacggtaaccagaatgttaacggtggtcaccccaaggcgaaaggatactcctgcttgcacgtctcattcccatcttctctggcccctagagccaacaaatagtgagcatggagggtgagggaaggacaacactgtgaactggctaacttttcaaggggct

SEQ ID NO: 8251 - DNA, 201 bp, Bos taurus
ctggatggcagctcagctgtgtggggggttcagagacttaaatttggaggaaattaagaagtaatctagccctctgcgcagtgtatccatcccagtggccgcagctgcatctttgtgtgttcccattgaacctgactctctctggaccctcctaagagtggaccctcactgaaacttgggactggggaggggagaaggtgg

SEQ ID NO: 8252 - DNA, 201 bp, Bos taurus
ccccttgcttaatcagatagtgaatgcaggcgagggccacggtcttgttgtcaccatggatgacaaggtgcagaggtgtctggccattgttggtgggcaggtttacgggaaacttgtactcctccaccaagacctgcaggcatgcaagcttgccactctgggctgcaaagtggatggcagtgaaaccctgcaggggccaga

SEQ ID NO: 8253 - DNA, 201 bp, Bos taurus
tcactctcctgctcccacaaagatcatgccaagggagataccctacttcttcactggatgtgtgacttatctttcttcttcttcctgctttgccaagcccaattggcctctgctgctggtagaagcttcttcctctcattaggtctccagatagcagacagagggaacatctgtcttctcctttcaaggccccaggacaca

SEQ ID NO: 8254 - DNA, 201 bp, Bos taurus
atcagtaaatattctttgcatatattataatctccagtttggaccttcgagttagctaccagcaaggcaaagggcactgtactcttattagtcatgaggtggggaaagccagatagctagactcagtcagctgcccagtggtcagaggttattgccaggtgtggccagcatggaggtgggccgggggcggggagttcaagg

SEQ ID NO: 8255 - DNA, 201 bp, Bos taurus
ctcaatattacaggttagggatagctgaatgaatctttcaagggggaaattttaaacgaggagagtagtgggaggtagtcttagttgtccatttagctgaccagttaaggtctgttcttgtccttggcaaagagattttcataaatgcagccaaattataactgcccaaggagagatcataaaagttaaccttatctttct

SEQ ID NO: 8256 - DNA, 201 bp, Bos taurus
agaactctttgccgtaacttcagcagcctggccatgaaagtctgcttactgatcacatcaggtatatccaggagttggtcagacagggtttcgaagagtccaccctgggccctgctcagacgaagaaagaagactaatttgaacttggtgagagcctggcactctccagaggcccagagcatggcgattcgctgcagcaga

SEQ ID NO: 8257 - DNA, 201 bp, Bos taurus
ttgtgtatgttgatgttcatatcatgtttaaaactatattttttagatttatcagactttaaatcatcttaaaaatataagcgattataatgttgtattccccccaaaagtgagatattatttctgtctttatcccaatttgttgattattaactgttttgtgtttgatggattgatataattagttgataaaatcaatat

SEQ ID NO: 8258 - DNA, 201 bp, Bos taurus
ttatttttctgagactagccatttagtatttgaatagcttaaggctaacataggagcttatctttttcacatccttttttaaaatttttaagttatagcacgaaattggttatgctaattactaccagttgaaaaaaacacagaaattttgtcaaaaatatctaagcaaatatctctctaccccagtttcagacgttactt

SEQ ID NO: 8259 - DNA, 201 bp, Bos taurus
cttctgcttcatctggtactgagctgacaagacaatgatgtgtcaatatgggagggaagcactgttcgagagaagctttatctgtctccattggagggccttagtaagagatttttttagtgtggtagtaatgactacatgcagagaacgcaatggcaccccaactccagtactgtggcctggaaaatcccatggatggag

SEQ ID NO: 8260 - DNA, 201 bp, Bos taurus
ttctctgtgaactgtttcagacatctcctcaaagagggaaccttccaacatcaggcaatatttcagggtttgtacgtagattatttttgcagttgatgctggaggatgagaaagtgacaatgtttcttcagtctccctgtccagtgagtatttaacaattaaattaaatcttaatgatgaactgtgtgtaaagatatttta

SEQ ID NO: 8261 - DNA, 201 bp, Bos taurus
agatggttgacaggacaacagatctagtctcaacggttatctgtggtttagtcctggttatcttttaaagactgatatattccagcaaagaattcttgccgcagttacattcttatgtgcgtggctgttagcacccaatatttatgatacttgaaggtaggaatttttttttgtaatggacagtgagattattgggaatga

SEQ ID NO: 8262 - DNA, 201 bp, Bos taurus
ccttctccagcagatcttcccaacccaggaatcaaaccagtgtctcctgcattgcaggtggattctttaccaactgggccatttcagtaggttaatcattgtctcattgtggaggatgggtttggagttgtagtgagtggctgagagcacaaaccccattggcacgcctttgcaggaattcaaatgatagtgaggaggccc

SEQ ID NO: 8263 - DNA, 201 bp, Bos taurus
ctgagtgacaaacacacctatccttattcacgtgttaatgtgtccctgcctggttctcaggctcctctgtgactccttctacagaccgccactcccctgcatgctctacccacacagacctaaggacagttgtacttttattcctcctcacctgtcacaccttagtttctggccaaatttttttaagtttatttttcaagg

SEQ ID NO: 8264 - DNA, 201 bp, Bos taurus
tagataaaattgaatcaaataccatccaggttacctaaaggggagatggttaagtagtatacacacattaaaaatctattttcaaaatagtgtaacacaggcaaataaagtgtccaaaatggtaggatgagcacaacaaaaaaaaagtcagtgtaagaatgtaaatgacccgggcagtggaaaaacaactaagtatgcagg

SEQ ID NO: 8265 - DNA, 201 bp, Bos taurus
ccggtgagacgtggcttcaggctgcagggaaacaggtaactcttgttttgaagctgtgtggaccttgacatcgccgtgtgtcctgcataagcccctgctcatggccaactcttcctacgaggcctgggcccggggaccatcccgggatagcctgaacgccgagtcccgcagcccctgacgtgcacctcgcgtgggatcacc

SEQ ID NO: 8266 - DNA, 201 bp, Bos taurus
taaatccaatagacaatttaacgtgatttgagttttcctaaaagtgtgttgaatttttctcttaaaaacatttagaggcaatattagagtggccaggttgtatccatttcacttattctattttcttgatatgaatagataatccatacaggacaagactcgtccagaatatgcactgtctagtttaatttggcttggttg

SEQ ID NO: 8267 - DNA, 201 bp, Bos taurus
tttaaaatttactgctgtgcataatgctgtccatgttcttttagaatcaccttatgcacaggaacttgctgcttcacaagtggaggttgttttgttctccttcctccctcatatccttggccgtggaggtaaaatacacacatgtctcaggtgtcctcctgcctataccacctaagtttgactgtcctgtcaggccatagt

SEQ ID NO: 8268 - DNA, 201 bp, Bos taurus
cctctaatgtatgttcttgacaagcatcaggtcaagcatcaagcattcaccgtagtctagaactctgaaaattcctgggacaaaggaaataaagaaggcctagttatttcctttatggagctcacactgaattcagaccataagtgataaataatgttacaccatgatgtaataaatgcaggtataggggtcggcccagag

SEQ ID NO: 8269 - DNA, 201 bp, Bos taurus
ttatatcaaacaggcttttccccttaaattctcaacaataggagacttttcccctagtaaaagattatttccgcacccaggaaatttgaagaaaatcaacgcagtgatatttttaaagtcccaaattcccttcatgaatttattgttgtctaagcagtattctttagaatgtacttatttgaaggaaaatccttagacatt

SEQ ID NO: 8270 - DNA, 201 bp, Bos taurus
caatgcccaaagtcagggcggcggctgagaggagctaccccatgcccaagctcaggggccgcagccaagaagagcaccacaacccaatggtaaggagcagtggctgctctctgctggagtgcatgtaagagaaggtaagagaaacctgaggtaagataaatgctgggctggaggaagcacatgctggaatcaagattgctg

SEQ ID NO: 8271 - DNA, 201 bp, Bos taurus
cttgttaatcagtttttcagaaaatcagttgtttaactctagataaactgacattgttccatttaatactcaattatatcaaatataaaggttaaacgattgatatactttctggagaaggcaacggcaacccactccagtattcttgcctggaaaatcccgtggacggaggagcctggtaggctgcagtccatgggttgc

SEQ ID NO: 8272 - DNA, 201 bp, Bos taurus
tcaggaccaatggtaattagtaaaaggaatctttaaatgtcttctataagcactgttgtgggaatgttgcaggttacacatggaaaaattataaacttgctatataattcatacaactgtcagcccatggggagctcatatttaaaccaatttaaaataaatcagtaattacctttcatgagctaatgaatcaaacatttt

SEQ ID NO: 8273 - DNA, 201 bp, Bos taurus
aaagtgtcaggcaataaatcattaggagacatttacagaagaatccatatcttccttagaggttgtttgtgtaacttggcctaaccgtgtttgatgctcaactcaggacagggcaacagagtaagtgggtaggactgcttgctcagaaatgttcttcttcatcccttgctttttcttccttttcccttgcccagtctcaga

SEQ ID NO: 8274 - DNA, 201 bp, Bos taurus
tttatttggttgccttttttctgactttctctgattttgccattttattattagaatttttttttaatgtagtcctgggtgaaattgtgaaagcaggacacactgagaagcataaaatcatcaaatgcttatgctatggacaaaatagaattactcagcttgggatacagccatagatacttgccactgaaattttaatgt

SEQ ID NO: 8275 - DNA, 201 bp, Bos taurus
acaataattaactgcagagaattataacatatgttaaaataaaatgactagaatgatatcaaatggtcatccagtctatctatacagaagtcagaagtattggttgcataggaaccaaagtaccaatatttataaaactgttttagttaggggggacaagtatgcctttcatagcctgtatttgtaatgtttatttacata

SEQ ID NO: 8276 - DNA, 201 bp, Bos taurus
ataagtatccgaatgcaaaaattgccctcattgaatcaacaagaaactattccgcaacttaatatcagcactgtatatgaaatactgttttacataaaaggagagtcatttagaaaacaaacaataaaaagatgctaacttcactattaatcaggcaagcaatagagagatattttaccacatccataaggatgaaaaatt

SEQ ID NO: 8277 - DNA, 201 bp, Bos taurus
cacaaaatctatcatgtaatacaaccagtagctcataatttatattatcatttatctgtattagtatattgatccaattgggcatgtaaaaactgaccttaggcaaaattagttgctacctctctatttaccctctatgtaaactggctaccattctgtatacaggatgtgcattatcaactactcaaagtttttaaagtt

SEQ ID NO: 8278 - DNA, 201 bp, Bos taurus
ctccgaacttcttatccactggaccctatatatgctcacctgcctgggcggccaggacttgacttcatctctctctcacatgcattgttgtaacaaccatctgtatcttatctaattgccttcccaatgtcggctgctcttggcttgcctagccctgccagtgcccaagtttaactctgatattgctctccattttacact

SEQ ID NO: 8279 - DNA, 201 bp, Bos taurus
aagacatctaatcacagtccgagaaaagagattagagtggttagaggacaggcaatactagaagatacaggttgagaagttttcaaagccactgaaacacctaaatctataaatatgtaaatcatattatattctatgcagaataattagaaattcatacctaagcaaattctagcagaactgcagagtcgtctaagagga

SEQ ID NO: 8280 - DNA, 201 bp, Bos taurus
gaaactgggtcatttgccctttggatttcatacaggctgggttttgctaactgcattccacggtgttaacttgttcatccaaactgcccaactatctgaattgcttctgtaaaaataaacttccccataactattttggttatcttggagctatagttcgtacagtaaagggaaaccagacaatttttttattctttctct

SEQ ID NO: 8281 - DNA, 201 bp, Bos taurus
cagaagatggaaccattactataaacagagattttctcatactaagatgccctccatccatgttctaagcaatattgaaacctttggctgaaagctgtgaagggctagatttctgcagaaagtcatatattccatatgcagagttaaagagtagaatgaaaacaaaggtacaaatacaaaggggaaagcaagacatcagct

SEQ ID NO: 8282 - DNA, 201 bp, Bos taurus
actgagagacttagcatgcacaccaagtcctacattggagatgacttcctcagtgttttttgtgtttttttttaatttgttttggcaagggaggggtgcagatcgggtagttactaagaatcagagctggtaactgaaactgtcaagtggtggtaatgtctgaagtctggcctaagtaaagcttttaaagaactcagattg

SEQ ID NO: 8283 - DNA, 201 bp, Bos taurus
ggtatgatttgccgtgatgatatatttatcagaagcagtttatttttctactacaaaatgctctttgatatcattaacctacagaaataactgtggaaagaaaagcaaggccattcaaatggtgaggtaacaaagaatttgttttccactcctgaagtctgcatgaattaatgcagcaaataacagtcctccagaatccag

SEQ ID NO: 8284 - DNA, 201 bp, Bos taurus
ctgggctgtgtgagcaggggtaggaaactgctgtgatccccacactctgaacttccagtttcaggcctaccttaaaaaaacacgggggaaagaaaagagacggaattataagttttatcctccatccttctttccatctccagactctgctctccatccaaaaataagacttcttcccctctaaacaaagttcaattttgt

SEQ ID NO: 8285 - DNA, 201 bp, Bos taurus
tgttttaagttttgacaactgcatgagaaagtactccagagttatattattcttgttcattttcaagatgtgtaaaatgttttaaatttttatatattatataatatataattattctaatctcccaaatagaaaagacagccttgatacttgaagtgggggcaaagaacctctcacactagatgaagtggctgagatgtg

SEQ ID NO: 8286 - DNA, 201 bp, Bos taurus
actttgggttcattagtcaggattttcagatccacttggctgccaccttcctgcagccagaccatcttggatcaaaaggtcagcaggccattcccatctcacacctgccacaagatctgatttttcttttcccccacactgatcctagtcactttctgttaattcgctaattttattgaccctgtaatacattctgggaat

SEQ ID NO: 8287 - DNA, 201 bp, Bos taurus
tataattttcatggttaattcttccttctctcagcttggtttaggcgtcaagcaccttgctggtacttttcatccttttctgttctattggagcttgaatacgttgtgaggtaaatggcagctcatcatacctttcaggagatagtgggaaggaatgagtcttagtggctctggtcctgaaccctgcatgattacaaaaag

SEQ ID NO: 8288 - DNA, 201 bp, Bos taurus
ttttttgtctcttttacatccaaatagttcaaagctccattcaaacctacccccctaaataattcttctaggataccaggagaaaacaacgaacaacagattggaaacagaaaatgaagacaagcaaaatggaatgaaggaatttttcgagagaaaaaggtaaaaaggagaggagacagagtcatacatattcacacacat

SEQ ID NO: 8289 - DNA, 201 bp, Bos taurus
tacagctgtaaagatattaagctgcaccgcctgctggcgaacacctttggcttgtttaacacattcagcaaagtgatccaacatctgtaatctataatagaatcaagattacattagcaatactttttattcaaatatggctcaaaaaacagagataagacacactgtttaacaaataatgccccattctatctcttttct

SEQ ID NO: 8290 - DNA, 201 bp, Bos taurus
gcctaactcttccagcaaaccccttggcactccactgcagtgacaaagtgatacccgcaaggcccagcagcacagctggtgggctcttcctctctatccaatatatgacttctgcctctcaaggtgagcccagatgcattgtctgttgccccattagcctcttgtcttccatccaaacagctcttgctttccttaaggact

SEQ ID NO: 8291 - DNA, 201 bp, Bos taurus
tcctgctactttctcttggggatgctctttttatgaaaactcaagttccatatgcagctctttcacttctatctctaaatttgcttattccaagaagtacatttgttaaaaattataaacagaaggattgaaagaagagaaatctttctttccatttaagaaccacataaaaatgctctgaatgtatatttgacgttatca

SEQ ID NO: 8292 - DNA, 201 bp, Bos taurus
cagtttgaaaggggaaaagataatgactgggttggtttctttccaggtttgatttgataagctcagcaatacaatttctgggactctgggcaaagttgtgctacctctccgtttcatttcacaagcatctgtgtctttccttatttgccagtttttgaagtttgtaacattaacctaacttttccttgtattatggctatt

SEQ ID NO: 8293 - DNA, 201 bp, Bos taurus
acagcccctggggaaactgctctgcttgcctctccactcagccctgttctctcacttcccctcctttgctccaactccccatcccatccaggcccagagatggtcacagagcatcctactgtgatttgaccactcctgacagtgggagtgatggttggctgtggaaaacccaggaggccagctagacgcaagcaggaagaa

SEQ ID NO: 8294 - DNA, 201 bp, Bos taurus
tgttctctttggagccctcagtgaaaacctgcttttcatgtactgatttaggccccttccttgtggtctgatgcttatgtaaatgcattagatccactgcgttatataaatgtgcccagtcggcctaatcacaataaactggaaaattctgaaagagatgggaatatcacaccacctgacctgcctcttgagaaacctgta

SEQ ID NO: 8295 - DNA, 201 bp, Bos taurus
ttatttaatattgttttggaagtactatctctaattagaaaagatactttaattacaatacaacgtttgaacttaatatattaacaaggaataataaatagcattctttatgtaggtaaataaacttctatgcatgagaaatgtgagaaaatgaagttcaaaactattttcggtaatagaatttactgagctagtgcagta

SEQ ID NO: 8296 - DNA, 201 bp, Bos taurus
aacagccactggcccacgtgcactgcggccagcaccgagagcagcagaaggagcatggtctgctggaccgacagaagggtcggcgacaggtgatcgtccgggctgaggccagtggccatgctggggagagaagggcgaaggcgtgacactcaggtaggcagagaaagaagagggcgccccaagctcctatccacctgcctc

SEQ ID NO: 8297 - DNA, 201 bp, Bos taurus
gattagataacgaatcccacttccaagaaaggcttctggtgagcaaagagtttccctcaatttctcactttgcttttcaaaacccacttagcacaggcccaggagttgaaccggtcaaggggtccagcagttctcaaagcagagtacagactaaaggatggagtttaaaaaataatactctgggaacagatgtatggcctg

SEQ ID NO: 8298 - DNA, 201 bp, Bos taurus
atgtaggaaatcacccactctttacaacattgtaaatcaactacacttcaataaaaattttaggaaaaaaagaaagaaatcatccactccttattttatatataaggacggtatatccagggagataaaatatactgtaacattacacaagtagttacaaaaacaaatcccacatccttcacagagggacctgaaccttct

SEQ ID NO: 8299 - DNA, 201 bp, Bos taurus
ctgaactttttcctaaaggaccacaactaaagcaatatttcaaataacttcttccccattataggtcatttggaaatagttacaaaagtgatgctcaaatacatactgaacgtctcactccctctgtaatattaggaccaagaataccagtcactttcctactatatatacagataagcagcaatactaaatatggcctca

SEQ ID NO: 8300 - DNA, 201 bp, Bos taurus
ctggagggttgcttatctccacttcatttagttgtttttctggggttttgtcttgtcccttcatgggggacataactttctgctttttcatctcaattaccttcctgtaatgtggtttttgttctagccgctttggcattgtggttcttcttgctttttttatctgccctctgatggaggaggctaagagacttgagtaag

SEQ ID NO: 8301 - DNA, 201 bp, Bos taurus
ttcctatctgaagagctcaaatcaatgtacaatatccaagatatgggtgatgcaagaaagaaagggtaaaaacaactggagggataccctagaggcttgttaatagtagacaatttgttgatatgaggaaagcacacgtaggatcagaggaaatgtaatgacacttttaagatttaaaaatggttcttggttcaagacaac

SEQ ID NO: 8302 - DNA, 201 bp, Bos taurus
attactgaaaagaaatgaggaatataaattatatttttaactatcacaggtcttggaacagcagtagatacataggtgagattttttttttttaagttgtgtaatttggtcttagatttctgattgccacattactgttctcagcaatagaatgcttaagaaagatgcttaaaaatacagagaaggatgcaatatagtata

SEQ ID NO: 8303 - DNA, 201 bp, Bos taurus
aaaccatagactgtcaaaccttggaggcatatggggagtgtctagtagctccatcagcataaggaatagaatgtccatgaaatgtatctatttatatagcgggcctctgtataaaacttggctttgagtatgtggtcatacttttaagtaacaccagcataccataaatgtaaatgcagcactatgaatcttatcatctga

SEQ ID NO: 8304 - DNA, 201 bp, Bos taurus
tgaagaccctgacaaggaagtccatcactcccgaagtcaaaccctcggatgcaacagaaaatataaaggccaagatccaagataacaaaggaattcctcctgatgggcaaagcctggtctttgctgccaagcaaatggaagatggatgtactgtgactacaatgcaaaaggagtccactctttaccttaacgttttaaact

SEQ ID NO: 8305 - DNA, 201 bp, Bos taurus
ccccagccgagtggggcctgcggggtggggcgtgagctacggtgaagctgcccccattgtgtggttggaccgacagggatcccacccctctcttcgagtctctgggcctttcgtttcggaaaggggtgtgtatttgtgtactttgttcccgaacatgaagataaggactgcccagagcatgcaatgtatagtaaacagact

SEQ ID NO: 8306 - DNA, 201 bp, Bos taurus
aggtatcacttctaaagttgtttacttacccaaacctgccaaaggaaggcttataacaatgctgttagagaagtgggtaccttctggccacgtagccaaacggcaaaaatggaaaactaaaaggcatctgtcttagttcctttagatttatgatccttgaataatatttttataacaaccttgcctcactccaaaatgggc

SEQ ID NO: 8307 - DNA, 201 bp, Bos taurus
tttatgtactgtgtgtatatatctgtgcttaatatattaagattttttttttcttcttaaagaaataaattccgctgccttctcaagttaaaggcacatatgagaaaacattcctcagtggtaacagatggtctccaggtagtgagggaagaatggtttaatatgagattcctgactagcatgctaggtctctttttctct

SEQ ID NO: 8308 - DNA, 201 bp, Bos taurus
gtaggtgtccataagtgcctattcctaggaaggccacagcttaggttctttacaaatagcacaccataaatggaattggcccaaacattgctgttagccacagttttgatctgaaagatcaaagagaacttaagaaaaaaaaataagtcctgtgacttatcagaatgttgttaaatgttccttggccaggagtagtcatac

SEQ ID NO: 8309 - DNA, 201 bp, Bos taurus
ttgagtttgaccctgaagattcagttcaagtgttagattacatctgagaaggcagagcccacagggaaagccctcagtcatgggaacccagaagcaatctccaattctgtgtctcaaacagcagatctgttggcagacaattaaagggcattagaatgtcaaggaccaaactgcttctaatattttgccacctctgtttcc

SEQ ID NO: 8310 - DNA, 201 bp, Bos taurus
aggtgtgaaggatgaggtggtggctggcttaggtaaggaggccatggatggccttgctcatcagagggcatttcaactgagagcctgagcagtgcaggatgaggggagatgcccagggagagggccagcaagtccaaaggcctgagatgggacagaactttgcacattcctgggttggcaaggggtcagaatgagagagga

SEQ ID NO: 8311 - DNA, 201 bp, Bos taurus
gtaagcattaataggttaaaacaggaagattccaaaatgtagagattagtacttgctaccaggaagaatagaattatagcaccacaaataatgacaaaccgtattcttaacttctctgcttaggctataaccacaaaggaaccaccataggcgtgcacagacagctggaagttgtttccgtaatatttgtaagggttccat

SEQ ID NO: 8312 - DNA, 201 bp, Bos taurus
acattccaaaataaatggagaaactaaatatcactccatatcatgtttgccacagtcttttctacctttgtactatatccttatgctaattcccataaggggcaaataagtacctttgtactttattcttatgcttccacctcccatatggaatgcccttccagccaacttctcttctgtaagttctactcagctaaacaa

SEQ ID NO: 8313 - DNA, 201 bp, Bos taurus
ctacacaaacatactacatggggcagggctgctgctttagcttgcagttttttccagatgcttctagaattcttgagaggccatggagccttaaccaagccgtagtgtgaattgctagaagaatgacatttgctccatcactgatgtttccttacccctcgaggcccctacgttcctggttgtcactggtgtggagatcag

SEQ ID NO: 8314 - DNA, 201 bp, Bos taurus
tggtgtgctgcaattcatggggtcacaaagagttggacacgactgagtgactgaagtgaactggtttaaaacatagtgttagtttcataaggcagttctatttccagttttttaaggaatctccacactgttctccatagtggctgtactagtttgcattcccaccaacagtgtaagagggttcccttttctccacaccct

SEQ ID NO: 8315 - DNA, 201 bp, Bos taurus
caccccttatttattcccaggaaatccccaccacatcacttccttaataaataatgactcaatttatttatttgaaggaccgctttctccctccagaccctgcagagaataaccataattaattcttttatagagaaaacagtttacattttctgttttaagaccaaaaaaaaaaagcagacagtttgacttgtgaggctt

SEQ ID NO: 8316 - DNA, 201 bp, Bos taurus
cttagagactccagtggacacatggcatggctgcttcccgttcctccatgaatctgtgaatcctcaacccatatttgtagaacagatttctctctcttcagtttagcaaatttcaatgcattttacaatattcaggtcaaatgtgctctgctgtgccccattcttcctgtctccatacagttaatctaaccttcctttccc

SEQ ID NO: 8317 - DNA, 201 bp, Bos taurus
tctaagttcccctttggtttcatttaaagaatagcatgtaatgaatacatctggatggcaaacattacacaagtgagttctcatgggtaaaccgcttgccgcaaaattaacacctctggagaggagggaggggaatcccttacaagtaaattgatggttccggtgctgctttccatgagtctatcatgcctgctttgtcct

SEQ ID NO: 8318 - DNA, 201 bp, Bos taurus
cattgttggggacttgcgtggtggcccagtggttaagactctgcagttccaatgcaggggtcaggggttcaatccctggtcagggaactaagattcttcacgcagcatggcatggccaaaattaataaataaatagagattacattgctgatttacagctctgggtcttccactggatgtgaaactttaggagaggaaaag

SEQ ID NO: 8319 - DNA, 201 bp, Bos taurus
acactctgcacagtgtgtgggaaagaattctcaccttggagtcttccagtgaagctacctagaaaattaggcataaggcattactgttcaatgcaatgccatttatttattcattaatttatattgataattatttttattgaagtatagttaatttacaacactgtgttagattcaagtgcacagcaaaacaattcagct

SEQ ID NO: 8320 - DNA, 201 bp, Bos taurus
tctttgcataaccattttattatgtttttaagatagtttacctttgaaatatcctagctattcttaacttgatgattttagagagaagtaatacttagtatgagttgagcactctgaatgggtaagtttctttttaataatgcagtacttaatactgcccatgggcagtttgatgtctcactgccaggttgcaccagagct

SEQ ID NO: 8321 - DNA, 201 bp, Bos taurus
tcaaaattgcaaggtttcaaaatatatgcagaggattcaatgtatgttaacccctgggtcagaacggtcatgtaactctctgtgataagtataatcttggcatataatgatatgaaatttccatttttcacagtcaggctcatggaaactgaaatctttgtggaatgcccaattattctactgttagaaggtcaagaagga

SEQ ID NO: 8322 - DNA, 201 bp, Bos taurus
taggtgacaatgggtaactaatatttgaaagatataattaggaaatactacagtgttttccaagattttttttttgtatcaccatacaaatatgtgttatactttagactatgcttttcctcttattttaattaaacacatatttatggaaatcttgatttggaaacagcactcttaatagtctaaggaaatatgacattg

SEQ ID NO: 8323 - DNA, 201 bp, Bos taurus
tgccttctacatctgtataatttcagtccccaatatatcctttcagtagggacaatgatggccattgtggttttattgatactctggtaattatttttccattgaagattccttatttacctgagtattaagaggcctaatggtttggacatcggtttgaaggaccaggagttttgttgctattgctactatttagggttt

SEQ ID NO: 8324 - DNA, 201 bp, Bos taurus
tcacccagctctcttttgttttcagcagccccctgacttctaagaatgactgattgcctcaacaccctaagtcaaaaaaggcagaaaccagtccctggaacagctcttcataaagtcattagacagaagctccagctgtttacgtcaccagagagaagccaggagttgcatgttttctcctgtttattctgtgcttagctg

SEQ ID NO: 8325 - DNA, 201 bp, Bos taurus
ggaagcctgtatctcagcactgtattcagcactagtcctgcagcagaggtggtaaaaaatggggaagacttcaagcgatttcaagcaggagtaagaagcacagctcaaatggcactgagagctaacgagcctactctgtcaccacccaacaggtgtgattcacacaggccggaatcaagtccattcaggctctctcttttc

SEQ ID NO: 8326 - DNA, 201 bp, Bos taurus
aatagacaacatttataaactactatatgttaggtatttttaccagtattatctcaattaatccacagtttcattaagtaggtgctattgtttagtctcctttacagatgaaaaacagagacagagagtaatctgaccatcaatggcaagtctttcaaatgccacaacacttattcctaactagttcacagacctccacca

SEQ ID NO: 8327 - DNA, 201 bp, Bos taurus
tgtttcttgaggattccctccttttttgtacagtggcttttctttgcaaagagaaggcgtctttcagggaggttccgataaatcttatgagcaaatgagtgaagtggaggtgtttgagacagcacgaggcccaggccctaagggagctccccaagtgcttcattcctttagtcctgagcaggggttccacgcagccggcct

SEQ ID NO: 8328 - DNA, 201 bp, Bos taurus
ggttacataattaagaggtctctatttccgcccagagctgcttaaggaagaaggtgtgtgacttgtgcttccagggcctacctaacactctgtctctttataggtgtttgatgcatgcttgttgatacaataataaaaataaacagagcaagcagagggactttctcaggccaggatctactgagataccctagtgtcact

SEQ ID NO: 8329 - DNA, 201 bp, Bos taurus
agacttgaagggatgctccaagatgtgggcgattctgtaccccagggcagctgcctctgggaacccaacagggggcgcctgccagccagcccaggggcacaagcaggagcacacaaggtatgagccaagtcgtgggttgaggagcaggtagcagtttgagccaggacctggggcgggggtggggccggggcctttctgcct

SEQ ID NO: 8330 - DNA, 201 bp, Bos taurus
ctcagctgcagctgccgggcagccgtccagggtgacaggcagaacgcagtgcgcaagggtgtggggacagacaacaggtggcagctcggcagcagtcggctgcgggggagatgagcggaggacctcctagcatttgggaagagggggtcctgaccagcaggtgggccacagcaatgagcaactccagagggaggttctgaa

SEQ ID NO: 8331 - DNA, 201 bp, Bos taurus
taattgactaagtcaaaaatagtagtattgtgggattttagcataacgtaaaacaattgctaatagcctaaaagttggaaggggaaaaaatggggtggtaacattgtaaggttctttcattctggatgaagaagtataatattacgtggagatagttgtgattaattgcaatgtatattttaaattctggactgcagccta

SEQ ID NO: 8332 - DNA, 201 bp, Bos taurus
tgactagaggtgactggggaagaattctggaacagagctgctcagtgtaaggtgaccagtggaaaccagcgtagattggggaatatggaaatacctggaaggaggcaaggaaggtaatccaataaagctggaaaaatctggataatctctctctccatgtgtgtttaaacgtgtgtttgtgtgtctgcatacctatacaga

SEQ ID NO: 8333 - DNA, 201 bp, Bos taurus
gagggcaaatgaccagtagatagatcagaggtgaggggagggggccatgcatgatggacataacttttctacagatagtatttaatattaggaatgctctgtagtacatttggtttttaaccagagacagactgtttcattgctgagagaaaaggaggtaaggatactgatttggggagggttatttctacctgaagtctg

SEQ ID NO: 8334 - DNA, 201 bp, Bos taurus
ttggtatcatgttagcagtcagtttaggattagcaaattacttgatgagttagtaggacagattcttcaacagtctttaccacagaagagttttagggtagtgaataaaagaatgagtttttaaaagcaaatacataagtaaaacccaggccatttactattcagagaagagacttactgccttttttggtttattttctt

SEQ ID NO: 8335 - DNA, 201 bp, Bos taurus
caggagctgggaagaggccaagtgcactgtgggaatacatgtcgggcaggagtttatgaaacgactggaagctgtagacagtgaggagactagacacaggcaagagaaagggaaggcccaaactggcagatgatgggaatacaatgaaattaaataaaatgatgggggaaaggtgacagaagtcttcaacaagaccctgcc

SEQ ID NO: 8336 - DNA, 201 bp, Bos taurus
gattgatgatgctcagaaattatcttttgttcacaggagcagaaataaaaagaagaaatagccaatatattttagtatattacactgtatttggccgcgccgagagcggacttttactgctgcactgtgtctgcgtggcttggcttgcgggatcttagttgcccgaccagggatggagcccaggccactgcgtgggagtgc

SEQ ID NO: 8337 - DNA, 201 bp, Bos taurus
gaacgtggtcccctgccaaggacagaaggcctccagaaggcaacatgccttccacacctgcttataaccgtttgcgaaattcggtttcttggtctattgtgctgggcacctgggccagatttctcaagcagcccaggtagtaggcactatcttcgtgaagctggtggctgcctgaagcagattcttcacccactcctgttt

SEQ ID NO: 8338 - DNA, 201 bp, Bos taurus
gtccccaggccaggtcttcctcagagtcaagttacccgctctgcatggaccatgtgggtgacaatagggacaaccatgcattgacgattaagcctctgccgtccatcttcatgggccaggcttagcctggggtccttctattcaatacaactttctttatccactgcctatcatcatgacaaaggcagattttagctagat

SEQ ID NO: 8339 - DNA, 201 bp, Bos taurus
aggaactgtgagttgggaaaagttggggtggggaagccacttgggagctgtaaccacaggacagccagaggaaaggagacactctactggggtcagagaggcaggagaggtcaagccaaaggggagaggtgtggcagggttccagccctatctctggggacctggaaagcgaggagaaagaatctggccgtctgagaggtg

SEQ ID NO: 8340 - DNA, 201 bp, Bos taurus
agtcctagcagggagggtcagtctgcccgttttggagctttgttgtttcaaagggcactctaatatcctcagggaactcatgactgatgactccactaccaactggtaggtggcctattgtggtggaagatcagctatcaacaccaactgagtacctactgtgtacctaatagaagacagtctctaaactcatgggctagt

SEQ ID NO: 8341 - DNA, 201 bp, Bos taurus
gaactgaactgaagatagacaaccaactagttctttgggaaataatatagttgggtctgtatccaaatacttgtactaaataaatttaagatggagaaaacaattaaatgttaagaaaaaagaaaccataaaaatggcagaagaaaacaggaaaatgttttacaattttcaggcaaaaacagactaagaatgaacacaaag

SEQ ID NO: 8342 - DNA, 201 bp, Bos taurus
ctcacaagcctcttgagggcagaaaacatgtcacatattaacttttctttgtattctccagagaacctagctgagtgttatgcacttaataaccacacaacaggacttccctcactgtccagtggttaagactctgtacttctactgcagggggcatgggttcagtctctggtcaggggaactaagatcctgcatgccatg

SEQ ID NO: 8343 - DNA, 201 bp, Bos taurus
agcagaacagtgtgagcacaggcctgtgcgactgggctagaaaggctcgagcggagggtctgatctgggagcagtgggaggcgagttgagaacggcagccgtgaccagctgttttcagggccttgtaggggcttgccgttgaaggaccatgaaaacgatcacatgtcaatcagtgttttaagagtattaatgcggcaccag

SEQ ID NO: 8344 - DNA, 201 bp, Bos taurus
tcaggtctgtggtttcattaacattcaagactcatgacattctttttatatttttaatttgatagataagtctagtttccatctgtcaccacacaaagttattacagtgttattagctataggctgtacattacagccctgtgacatttttattgaagtacagtgggtttacaatagtgtgttagttgcaggtgtacagca

SEQ ID NO: 8345 - DNA, 201 bp, Bos taurus
tcgatttgttcatgttgtgattcttcttttaaatgtgaccgacagagctttaaacacctgttttcttatactgggtgtctgattttctgtaaagacttgaggaataagtgaaagccttttcagtttgtctgctaggtcagtaaatactattttatgttagtaattcacatataattatcaaatcccttaagaatacatcat

SEQ ID NO: 8346 - DNA, 201 bp, Bos taurus
ttttgtatctgtctttgaggcataattgacattcaacattattttaacttcaggtgtacaacataaagatctgatatttatatattttgtgaaaggatcaccacacagtcttgttaacatcctagcatgttgtcttaatagaagatagctagattctcccatctgcttctacaatcagtgttacaatgttatacatcatat

SEQ ID NO: 8347 - DNA, 201 bp, Bos taurus
ctctagccctcctggttgtaccccttctgcttcctctgtcttctcagtcagtacctccccttcctccctcaggctgctcaaggatttcaatggcctggctcctcaggactcactccagaagatcctccccaactggagggctctgtccctcttctcagccatgctggtctcttccttcaacttagcctgggccaactcact

SEQ ID NO: 8348 - DNA, 201 bp, Bos taurus
gcggcctggcctttgcttccactcccactacgcagccactgaagctggggtggaattttaaggctgcatctgaattttttcctggagaaggggagtgggtggaaagatgggaacaggccctttggaaaggacccaaagccaaatcctgagagaaaaggcagagacggcgcagggagaggggtctacggccagtttctttag

SEQ ID NO: 8349 - DNA, 201 bp, Bos taurus
catgcttctagttgctgcgttcccttcaagtggcctgagtaaaactctcagtttcagtgactactggcagaggggaggggtgacaagtcattgagaaccctgtttgatgaaggccgggacagggaatggttgtattcacctggcaacgtctgtgcaaaagttatgtacagttggtgcggtaggtctattggagtgtggagt

SEQ ID NO: 8350 - DNA, 201 bp, Bos taurus
agtaaacccacaggagctgtgccctgctgaagctcagtggactagccaaggaagttagttgaaggagaggatgcaaagcagtgggcacctaccaacttttctacatgatttggcccctcccttccaggcactcttggctccaggctaaccaagctgtttgccccacatcttcctgccctgttctcctgcctaagcaaagtc

SEQ ID NO: 8351 - DNA, 201 bp, Bos taurus
tctgcagcaaatctgcaaatgcaataagcagccccagcgatggagaaacggcagcaccatcactttggactcacagggatcgcaggccagcaccaccagtgaagcacgattggctctccgagcccctgccatcctcagggaccctgagtccttccggtacccacaagcagggctggctttgggatttttattggccctgaa

SEQ ID NO: 8352 - DNA, 201 bp, Bos taurus
taaagctgtgttcttgagattcccaaaggtaagaaaggaaaagaaagttacagcggtcacttaatatgttcttaacatcatgtgtaaagaaaatctctgacataatctgatcctgaagaatttaaactacagacttcctgattccccagtgctggcaatcacatccaacagtaactatgcacaatggctgaaagaactttt

SEQ ID NO: 8353 - DNA, 201 bp, Bos taurus
gtctcaggggcaggagcttgagctggagaatgggctttctcctgtcctcacggggaaaggcactggagaaatgtaaagtgggcagtgctggggccataccagagatggccctctgcacctgtgacagcctactgggtaccctatttgttgggtgttgagaatcaagcttgtttcaatttgggtggtgatggcaggtggctg

SEQ ID NO: 8354 - DNA, 201 bp, Bos taurus
tccctccagatctgttccctctttccattttagtagatattggactttccgataaagaggatcctgctactgaaagactgaaatctaccacttggaataattcgccctagacgtagaaaagaccgtaggagctataagtctggctctcaggcttccaatgggggaaatgccacaacggagcagctggaggaaccagttcag

SEQ ID NO: 8355 - DNA, 201 bp, Bos taurus
tctgggtaactgagggccagagggaaaaaggatgctgatttttcattatgattgttttttctggtactttctaaacctgaacagtgttcatgtattatctattgtcaatgaaataaaaatataatctattgtcatatatggcttgaggaaaaaatggccatcatgtgtggcttgtaggtaagctttccgaattgttacagt

SEQ ID NO: 8356 - DNA, 201 bp, Bos taurus
tgtgtcctctctcagtatcctcggggcctacctctaaagcagaccctgagtggcctctcagtaaatagtctgaagcattatgtagtagggccaagtaggcaatggatgtattaggagttgttgtcatgccactgagtagactgtccttagaatgggcttaatatggatcctgcccattatatggatccagacactcaacaa

SEQ ID NO: 8357 - DNA, 201 bp, Bos taurus
gtaccctattttaatgagtagctgtttgggtctttaaatcccttccctgttgttctgtgtccctagggcttcctgacaggtatgacgcctggctggcccacggaactgcactgtgcccaacccagcgtaattatcttcaaactgagtcagcaggcaacccagattaaaaaccatggctcctgactcaggccctcattcact

SEQ ID NO: 8358 - DNA, 201 bp, Bos taurus
ggggctccaaaaggcccctggccccatccccagtttccatccgacagaggtgcgatatgccgcttagccttctctcaactctgagagcttgggctttaggggactcgccctaagatatgtgaggcctcgcgtgggacacattttatcagagctggagaccaagagaggcctgcagacagggaaagaagtggcttcctgaac

SEQ ID NO: 8359 - DNA, 201 bp, Bos taurus
ctaacttttattcacttggttgatcaatcacgtcaatttcattggagttgttgaacatttcataacagggggaaagtcatcgtatggtggccaaatggaccatggagcccaatgtttgccctctggtatccatcctacctccacttggcttaggatttgtcctttcccaaactccagtcaacactggccctgcccctgtga

SEQ ID NO: 8360 - DNA, 201 bp, Bos taurus
ccagggaccccaggatgggcctatcgggtatcctaatcattgagcagtgcaggcctgggtgaggtgggggcaaaatctgggcatactccaaggggccttgaggaggaggcactgatgtctgattagaaccacaacaagtggaaaagtagaaggaggggggacaaaaccaaacaggccacacagcccaaccctcagatcaca

SEQ ID NO: 8361 - DNA, 201 bp, Bos taurus
gccttcctcacttgtctggtggagatggggccgaggcaatatcagcagcagaaaacggaagcagaacttcttaagctgcccttggctccagtggtctgctgtctggcccagggtgtggacacagtaggttccatgagtatactttgatgaaacccaagtgtcaagccatgttctcccctgtactgtaagcagccagacaga

SEQ ID NO: 8362 - DNA, 201 bp, Bos taurus
tggggaagcggcctctgtccttttcagctgcgagactgaaaagctagattgtggagctccaagctgccaggtgtcctgccttgtggcaaaaggtaacatttggagataaatgaaaaagacaggccaagggagcagtcctgaccaggttctggccacttttaagatccagggtggtcgttaacttgacatctcatagaacag

SEQ ID NO: 8363 - DNA, 201 bp, Bos taurus
gtgagggggagaggttctattggaataaggccaaaaagcaaccaagttcttggtaatatagtaactttgagtccaaattatcccctcttcaaaggagacccgataaaggccaagaaccatacatttggggctcaccccattctggcttgctgtgccaggtttccaaccttgagaccacaacaaaagccaaatctgcaaaca

SEQ ID NO: 8364 - DNA, 201 bp, Bos taurus
gccttgagaaccccctgaacagttatgaaaaggcaaaaggatggggacacatctatggaaatactaggtatatacaaggaagtgtggcctggagcagagctgaaatcactgcagtcttccagcagcccggagggcagaggattctggctctcaaagtccggaaggatggctgcagctccaaggctggagccccagaggcag

SEQ ID NO: 8365 - DNA, 201 bp, Bos taurus
agtttgagtccacgtgcatttattgagcatctactgaatgcaaggcattgaagagtgatatagagggaggtacagtctcagctttctttaggcctttactgctcaaagcatggtccacccacctgcagtatgggtattatctgggagctgttaagaatgcaaaatctgggacgtctctggtgatccagtggctgactctgc

SEQ ID NO: 8366 - DNA, 201 bp, Bos taurus
ttgacttgtcatctgtctcccccaactagaacacaagctccttaagggcagagatttccatctgactgatctgtttcccactaaagcctcagggcctgggctgggacacagtagatcctcaattaacatttttggagtcaatgaatgattgatgaaggatggatgaatgattgatgaaggaacgaataaatgaacttccag

SEQ ID NO: 8367 - DNA, 201 bp, Bos taurus
ggagacagtcttggaggtctgggttggaacatctgttcaagggtcatgtggataagacttcccaggaagcatgtacagtatgagaatgggggcccctggagaaggggctgaagaggagcccgtgaaggaggctttcattcagccaacaaatagtgaccgagggcccattatctatcaggcccttgggctttataagtgatc

SEQ ID NO: 8368 - DNA, 201 bp, Bos taurus
ctcaaggtcccaggtgaggtcacagccctagcagacacggtgattccagatggtgagatcctgcccaaaggacacaggtactctgtgcccagactcctctcaatacattggtattgagacaatacaccggtattgttttaaactgctcagtgtatggtaatttcttatgcagcaacagaaaactaatataagcctcactct

SEQ ID NO: 8369 - DNA, 201 bp, Bos taurus
aagcactccccttaatagtgcatcttttgttggggatttcaggggaggatgtgggactgtaattttttcctgaattgagagcccccaaaggccttgatagggctctgggagagggatacgaacgtgataaaggggaagcttgcccggcggtggcttcctctcctaggcagtttggtggtgtttcacggtttggctggcctt

SEQ ID NO: 8370 - DNA, 201 bp, Bos taurus
cttgaagagctcagctgctgagtggctggataagagtgaggtcttaacacagtctctgaaagcctttggctccctctgcagagccagagcaagatgacttcgcagtcttgagggaccctgagtgtgtgtcttttgccagctctgtaccttctccctgctcctgccacctccctgctcagctctgctcagtggagactggct

SEQ ID NO: 8371 - DNA, 201 bp, Bos taurus
cttcttatttcagtgttgtctctcgttgtggaacatgggctctaggcacgtaagctcagttgctgtgacctgtgggcttaacttccccttggcctgtggtcctcctagaccagggatccaacctgggaccctgcattggcaggtgttaaccgctggaccactggggaaggcctcccattctctatagggattctgtaccag

SEQ ID NO: 8372 - DNA, 201 bp, Bos taurus
gttttttcctgcaaatccagcctatccttcaccatgctgttacaacagtttttagctggtcatgaggttgcttagatagaacatgccttccatggccatgcgaatgaattctggttaaagggatgttgatggaagcaagtgctggtaagtgtttaactattaataactcacacacacacgcacacaaactcacaaagtgct

SEQ ID NO: 8373 - DNA, 201 bp, Bos taurus
tgagccgtgtattccacccactccatcctcctaagaaaacctctgttcatctgtttatcctttgaaatgttcaaatgttcatcctttgaaaccctttgcacgggtcttctcctcagtgatccttctctggctacctcccaccattacccctaaattcaatgactctcttctcaccacagctgtatcttccatgtattttta

SEQ ID NO: 8374 - DNA, 201 bp, Bos taurus
actggcggcccctccctggaggcccatttggctcaccagtggcagaaactgctcttaccaaagagccatgctgtgaagagcccataggtttctccatcacgatcatggtcaactagggccttcattattacaggaacctatccttaggaaatatttttactttcacccttcctgagtgccttctggcttgccaagtgaaac

SEQ ID NO: 8375 - DNA, 201 bp, Bos taurus
tgaaaagctgcctgttttgaatgaatcccagaataagagtaggctctgcaacaggtcaagctgctatgcaagctgttctgctaactgggccatatgactcggaagatatgatagtacttgaagtattggtggtacccaggatgctgtttggagccgttggcaggccccatcctataggtgaatcacagcacaaacacttag

SEQ ID NO: 8376 - DNA, 201 bp, Bos taurus
gaccttttgttacagtgttacatattacatatttctgaaaacactgtgggcaggtgatatgggtcacacccaaaacttgcaaagctttgtaaccagaacactaacagaagtaaatcttaataagaatgctagaatattttaaaaaatacattaaatctattacaagtaaagaaatattacagtcaacctgagatttaaaaa

SEQ ID NO: 8377 - DNA, 201 bp, Bos taurus
cttattttaacattgaagttaaactttttttgaggtaattgagaagatgttgtgggaagcatatttagcgaatgttctaaatcaaacaaagtcagatgtaaataaaatcctttcgcaaagaagtaatttcatgttggactattcaaactaatttggcttaacaaattcctataagaatttgtattcaaagaacaattttcc

SEQ ID NO: 8378 - DNA, 201 bp, Bos taurus
aatgagcagtttatagttttgttctatgcagcattgaccctggaagttgttcccagctcttaaaaggctggagatagcaacttggttgatgaaggctaaggaaccatctggcagggccacactgacaaggaataggctgtcttgggacagaagagaagcttctgttctcagctaagggccactttctcagacactgtggtg

SEQ ID NO: 8379 - DNA, 201 bp, Bos taurus
agagtgagcgggattggacctgcatggtgggggtcagatccccacaatggggcaattgtttggggaaccatatgaggaagtgtagctgatgggcccccaggagtaccatctcagggctgacttgacgtcaatgctaggctctgtccagctaatctgactggcttccgcctgacttttggccattgatttggacaggaccaa

SEQ ID NO: 8380 - DNA, 201 bp, Bos taurus
tatatgtaaaggacagccaactgcccaaatctgtcctgggcccttaatagaaatgtgagtgtgcacaaaggcaggacattttaagaccagtagagtctagtggaatgatggcaagtggtgaggccagccattggtaccacattgctcacctttccatttattctggggcagcttgggaacacttcagaaccaagataaaag

SEQ ID NO: 8381 - DNA, 201 bp, Bos taurus
tgggcccttcagccatgaaggctatgagagttgcaggaggaggaatttactgttagcagagattgtcaatgaagagctgggggttggagtcacccatgtgaaagggaagagcaggggcaaataaaaacagaggaaagtcactcctggtggtagaaatgaagacgagcaagcaacaatagaaggagaggtgctgatacagtg

SEQ ID NO: 8382 - DNA, 201 bp, Bos taurus
cagaggtttcagctcttccagagtcaaagtcagagcttcatcctctctgttctgccagagttcccccttcagtctagggccatgccttccacacatacacactcctaagttcctctcttgcccttactccctagaaacagggctgagggtttcttgctaataagaatgaatggcgctggccacaaagtacaggttaatatt

SEQ ID NO: 8383 - DNA, 201 bp, Bos taurus
ctcagaaaagctggacttcatcagcaagctgaagacagcagggcataggtgagagcagtgtgttttccagccctggtttggaactaggttcagtatgtatctcccagacgcagagaggggaaccctgactaacagctcctctgagtctgcttccattcccttgtccacatcctccacagctctcaacaggagcaacaaaag

SEQ ID NO: 8384 - DNA, 201 bp, Bos taurus
agaaatatcaaatatcagatcagaaagggtacaatagaatagaaatgatagatgatgatataaactcactgaaataaaagaaagggccagtaaagggacttgagttcttaattctactggggtgaatttttttgaagcaggagcctatcagcctcattaagcaaggcctgatttttctttcagcagctgcctcaactttct

SEQ ID NO: 8385 - DNA, 201 bp, Bos taurus
tcagaagtgtgtcatgtactagtaccacaaatacaatttttcaaataattctactcattaggcttttgctggtgtcttttaatataatcaaggtcaattattgtatctttttagtagtcttacatagcaatttaaaaagttagactctcaatttgagggttccttcatgagcgagaggcatgcttcagagtccgtgtctat

SEQ ID NO: 8386 - DNA, 201 bp, Bos taurus
tagctgggtatgtgactactgggagaatgctttaaaaaagaaacaaatcctgtagaggccaataaagagaaaaagcgacaactgtaatcaaagtctttctcgccttctggcaatttatactgcagataggcccttgatgctaaattcttgagcagagaggaaggagaggaggattcagactaagttttcagtttacagagt

SEQ ID NO: 8387 - DNA, 201 bp, Bos taurus
ttctatatctaagaggaaattttccttcctaaatagggctcccaggaaacaaccctgataatgtcctctttgtaacaaatgacaaaccagttttcatcagaaagttcccatagcaaagaagatcattatcttcatttaggtctcagatatcaacataaaaattaccttttccaatttcttcaggagttatgagaaaaaaga

SEQ ID NO: 8388 - DNA, 201 bp, Bos taurus
aaaatcatagcaagagtaatatgctgtgatctcatatccaacttatataattcctttgccaaacatgcccactccttcaaaatgataataaatcaaaactcattgagaagataaaaatccattgagaaattaatcacaaatatcttctaaggctaaatggaaaccatatccaacttattaactgttttgtaacattagtgc

SEQ ID NO: 8389 - DNA, 201 bp, Bos taurus
agaatgaatttctaggtcctttaactcccaccacatattcagaaaaaaactaaaattgcaacactggaaagggagaaaaaattacccattgccactcaatatatttcactcagaaggaggctttgaaagaagcaatgatcctttgtgcccaaggctgctcaatttgagcactgcatcctgttactctctgaaatgatattt

SEQ ID NO: 8390 - DNA, 201 bp, Bos taurus
gtatagagtaggcactcaatatcttactgtaaatttctcaatactttgttacttccccatgtgttgatttgtctttaagaacttatcatgattttaatttcgaaaggagattcgttttcttatgataccgggttatcaagtgaaaaatagcgagtggcagttaagtatcaatagcctttgaaaatctatcaagagttctaa

SEQ ID NO: 8391 - DNA, 201 bp, Bos taurus
attcttgtatgaaatatagcttaatttgattaaaaattaagtagagggaacattcttttagaaatacagatgactgacaagggattataaatattgcataaaatacaatccaaagtaaaaaagaaaataagtatcattggcctttaatctctgaaaagctgcaggaatgaaataacagtaaagtaataaaactcgactgcc

SEQ ID NO: 8392 - DNA, 201 bp, Bos taurus
ggggcttctttggttttcagcattacaaaggacttttttttttattgtttaatgccaacctgtgtgcagaatacaaaggcccctcccagtcccatacactatcaagagtaaaattagtatgaaatccagtagaagaatattgattatacaattagtcccgaagctcaaaggccacagggcaacctcatgcgcttgctacta

SEQ ID NO: 8393 - DNA, 201 bp, Bos taurus
aagagttggacatgactgagcgactaagcagaacacagcacatataaatatagaaggctgtttggtctattgaggactaatctgacctagatgagtttattcctaagtccaaatcaaatgttgtaaggtgctttgttcctcttggataagtgtatttgagatgcaatatgatctcaaatgtttttgatatttttattatca

SEQ ID NO: 8394 - DNA, 201 bp, Bos taurus
aactctgtaagtgctggttacaccacatttaatgtgataatctatttagccatcatgttccttcttgaagaggaaaattttaaagtagtattttttttttaaagtgagcttgcaaatatgccagtttaaaagtgaattttattagtaaactatatatgaaagcttctcaaaggttccctaaagctatgacaggatcataaa

SEQ ID NO: 8395 - DNA, 201 bp, Bos taurus
ctatactctgttcagcagtttcctttgctcactgtgttccctcattgtgtcaaaaacaccctcactgccttctttctttccgcttaggcctgtgttgttgacacacaacctgactctcaaaactgtcattctataacacatataatccttgtttaattctggtcttatctagtttagtggtgggtagacagtaaatagttt

SEQ ID NO: 8396 - DNA, 201 bp, Bos taurus
gatgtctatctcttgccttgagttaatgctgatggcattttactaggtgcagctttaaatgatggagtagaataaccaaggccttttgagaaactggagtggcacactaattatccttgtatacagccatcatcagtgatccaatctcgtattagtaaaggtcataagaagaaaaaaagagttgcaaaagacacttaatag

SEQ ID NO: 8397 - DNA, 201 bp, Bos taurus
acaaagtacatattaatacatctctggtcaataatgtgtcagctgaatccacctgctctggcaagtaaagttagagatttcattcctgaacctaagctgataggaatgggaatatccctaagcaacaaatgatccattcttctatgactcagtaacagttgttcataaataatcacttctcaattttttaacctgtctttg

SEQ ID NO: 8398 - DNA, 201 bp, Bos taurus
aggaagaacatttccccacttctaatgtttctctactggcactttggggacacccagggctcagcaccacactgttttccttttcaatctaatttcctctaggggcagctgtccacatctggtcttgcctaattctgagatcctattttagtaaattcatttatctcttactgttgaaggaaaggggaccccttccagggc

SEQ ID NO: 8399 - DNA, 201 bp, Bos taurus
tggccacatggtctcagttgcaactctgccattacagcttgaaagcatctacagacctgtctaagaaatggggtggaatgtgctgtaacgtaacttcattcacaaaacaggagcttggccagacatggcccttgaccatattttgccaacccatgctatggtgtcatgtcagttaggaattgaatttcctgaaatgtgagc

SEQ ID NO: 8400 - DNA, 201 bp, Bos taurus
agtgaagtggtgctcttgaacttttcataactttatgttgctaggaaacaactttaccatcactgcagagtttagacttggagcatctgtttcatttaaagtctggcttccaggcagtatagattgcattgagcattggggtagggggtggggtggaagcaaaagcaattgctttctaaaaacaacaatgtttaacatgtt

SEQ ID NO: 8401 - DNA, 201 bp, Bos taurus
atcacatattttgctgtgactatttatagaggatcccctggttctttactggggttacattgttatagatacttaccttaggcctatgaggcatttaaaagatcatgggggtctttaatagatgatataaacccttttgactatttttcctctactatttccaatttggaaagtatttggagatgtcatgttctctgcata

SEQ ID NO: 8402 - DNA, 201 bp, Bos taurus
agtaacagtctaaagcaactgcattggtcaggattcttgagagaaacacaaacaataggaaacatttggcaagtctaaatttgtaggccaggccaataggcgagaaacacaggcagaattcctatgctacagtcttgagacacaattctttctcttctgggaaacctccagttttgctcttaagattttcacctgattaaa

SEQ ID NO: 8403 - DNA, 201 bp, Bos taurus
aaggaaccaagtctgccgacactttggttctagacttctaacctccagaactataagaactacaaattaattcctactgtataagtcacccagcctgtggtagtttgttatgctggccctagtaaactaagataaaaaccttgtcccagttacctaattatctcgttccctcatctgtaaagcaaataaagacacaactga

SEQ ID NO: 8404 - DNA, 201 bp, Bos taurus
agaaattcatctcccaagtgtcacgctcagcagagttgcaccagcttctataacagatgtctagacaatttgactttgaaatacataccccacacctaaacggcctgaagtttcccagtcagtgcccagccaaagttcaaaaccagagaccacacaggaatagaggattgaagattataaataaacttattcatagggaaa

SEQ ID NO: 8405 - DNA, 201 bp, Bos taurus
gctctccgccgccagactgcggttgtggtcaacaagagaagcgctaccgccgtcccggcttccgtaggcagacggttcggcggccccggatgttgatacatcacctgccccggaaacggtggtgggaagcccaagggggcgggggcggcgttgccgggctctccggaaggagacgtggcggcggttgggccccgggctgcc

SEQ ID NO: 8406 - DNA, 201 bp, Bos taurus
tactgattgcctgcttttcagtaagcagctgttctctggttaggaatcctgtgagtaagcgtggttcggttatgctggaaatgctggccgagctgatgagcagaagcaagtgaaggaataaacatgttccaggtgagagcccaggtaggcagagctcagagtacagagagaggaagggttgttaagaggggttctagaggc

SEQ ID NO: 8407 - DNA, 201 bp, Bos taurus
gagctgctcctatttgtagaactagaagtaggcgctctttttctctggtgctctggctgcctccttacttagctcaggcccagcaaaagcagtttgaagtagggaacatgcctctgaactgtcttccattgtctgcctctagggctcccagctcctccttgggcaggcatctggccagatctaccccggccttgctgggtt

SEQ ID NO: 8408 - DNA, 201 bp, Bos taurus
gtagcaactcgattcttctttttttggaggatgttcaaggtaaggttttataaggttcatgtgtttaaaaatcatagctttggagtttctaccctgccacatgattgtctttacatacatcctggatcactcagcatatatttactcaaattatgagactttgattaaaatcaatgaaaatagaaaatatcaaatggttgc

SEQ ID NO: 8409 - DNA, 201 bp, Bos taurus
acaaggcacagttcaagtactcagcagccgtgcgtggccagtggtgaccatgctggacagtgcaggtttagatattcttcttccacttaccctttggaaacgatctcttctggccgtcctcctgccactccaaccgttccttctcagggccccatgtctgcttcctcttccagcccctcatatgctattggtgcttaggat

SEQ ID NO: 8410 - DNA, 201 bp, Bos taurus
atgtgagaaggaaaaaagaattcttgagacaaaaggtatttaccattcatattattcacatcttctggtacttgacttggttcaatctaggatttcggacagcagaagtctgtattttggagtaggcagcaatatttaagctgtaagacctcccaggccacctcttgcaagatagtcctccttttccatttctttccttcc

SEQ ID NO: 8411 - DNA, 201 bp, Bos taurus
aaatatttatatataaattaagcaataagatcctgggcctgaagaaagtgtttttctttctcctgctaatacctttttttaggccagaaaggcatttcttataattgagggaggtcctgtccccataacccctaaggggtcccccagcccagcttaaaggtgatgtttctccagagcaaggcctgtatctcactggagtgt

SEQ ID NO: 8412 - DNA, 201 bp, Bos taurus
ctcctatgagtatcccctctgtttccttcttccttctgttccttggaggggctctcttcactatttgcatatcatcagtagaacactgttacttgtaggtgggagatgagaggtatgctgttctgattaatcctcagtcttaggaaggattatctccctggatcttgggtgtgagaagcattctcagtgctgaagtctctc

SEQ ID NO: 8413 - DNA, 201 bp, Bos taurus
tagagcaatgggccagtgaaatcaggatcattaatttgatcattgtcttagccagtcttgtaaatacatgccatcctctgccatgaggggctggtgaaaacgtaacttaagcttacaaggccatgggcactagggggacatggaacgccacatgtttcttctaactggaagggagttggttatattctcttggtttatgaa

SEQ ID NO: 8414 - DNA, 201 bp, Bos taurus
cctccctgtccatcaccaactcctggagtttactcaaactcatatccattgagtcagtgatgacatccaattgcaagcctctccagcttatttctctacagaaaactttacaggccagaagggagtggcatgatatagttaaagccctacaagggaaaaaactacaatctaggatactcttacctggattagaacagaaga

SEQ ID NO: 8415 - DNA, 201 bp, Bos taurus
ataaaactgctaaaatacaactgctctggcccacgcagaggagcaacccagggcagtattattgacaactccacttaggggaaatgcatgacaaaagatatgcaaggccatttgggctgacccaactggaggttagtgggcttccctggaggctcaaagggtaaagaatctccctgaaatgcaggagaccaggttttgatt

SEQ ID NO: 8416 - DNA, 201 bp, Bos taurus
gattagagatctcatcaagaaaattggagataccaagggaacatgtcaggaaaggatgggcacgataaaggatagaaactgtaagggcctaacagaagccgaagacattcagaagaggtggcaaaaatacacagaagaactatatagcacagggaactctacaatactctgcaatggcctatatgggaaataaatctaaaa

SEQ ID NO: 8417 - DNA, 201 bp, Bos taurus
atataagtgatatatattttttctcaagttgacaaaaggcatttttaagatgaaaagcagaggaggaaatccaaaacaaagcatgacatttttactgtctatattttaaaacttctatacagctaaaaacaaccataaaggaaattaatattttcttgttttgcactttcttatttcttttcagcttaattgagaagctaa

SEQ ID NO: 8418 - DNA, 201 bp, Bos taurus
acagacaaactgaggcacagagaggtaaaggaacttgcccaaacctgtaaagctaggaagtactagagttaaattcaaactcaagtggtctggccccagactctcagcccttcagtgcaacttaagcatctttgtagttgagacagtacttttaagaacaactgttcttccaggcccatttcacaaggtttttcctgttat

SEQ ID NO: 8419 - DNA, 201 bp, Bos taurus
ctgcaatggcaggcgggttctttatcattagcaccacttgggaagcccaaagttgtcacatgattacctaatgatcagagaatgtctggccttttcataaggacacactttgccattcatatttatattgtcattttttaagaatggtgaggaacaagcatatcgtactgtgatttagaagctgactacttaaaggccagg

SEQ ID NO: 8420 - DNA, 201 bp, Bos taurus
cttatcctctagtttgaagtcctaaggaaagagcttccttttctgtcactcagctatattgaaccaattgttgtggccagcaggtagaataattttcctaaaacatagcactaatatatcatttccctactcaacagcctttgatgtcttccccttgttttctgaatagcttaaagatttaggttttatctaaggccctaa

SEQ ID NO: 8421 - DNA, 201 bp, Bos taurus
aaaatatacacttggtgaccagaatcaccagaagtgatgtgttgtgaatgtggaagtagtgtaagagtaaaggagatacacaaggactgaatctgtcaaacatactttgttaaggagagatgccagaaactggaataagctcaagagcagctccatttgcccgtctccctccaacttcccaaacaaatctcagttcatgat

SEQ ID NO: 8422 - DNA, 201 bp, Bos taurus
cacaacgaggtgctgtgcctacctcttaatgcagtcctgttaaaatgaggctgctttgcttcacatagtcatttggggacccagggtcttttcctccagtggctcactcatccctgtcttcagaagattcagtgccctaggctggttcatttcacattggtaggatttttttgttgtttgtttttaagagaccagctctag

SEQ ID NO: 8423 - DNA, 201 bp, Bos taurus
agacaagttctcagtcttagaggtgaacctgctgctgtgagaggaccccaaacagtaggcactcaggttacccaagcggctcaggtccctcaggttagatcaacctcattaggcaaatccagaagtttcagaagttctgtttactcatcaaaagacagagttttcagcaacatggtttaacaaggactttgagtgctgagc

SEQ ID NO: 8424 - DNA, 201 bp, Bos taurus
ctgtgagccatgtgttactggtttgccaaaaggtgaatatggaaatggaaaggaagcctgccaaatattttaaagcaatttgacaaaaataattttatgtatgttgactctaataataaaaattgaggcttgaattttgtatgttttaaaaattttttttctagtaattttttgttgttattgttcagttgctaagtcgtg

SEQ ID NO: 8425 - DNA, 201 bp, Bos taurus
aatctctgaaactctctttcctaaacactgaagacttagatattggttattgaatagaatcagaataatcaaatagaaaaaataaagatgatacaggcagggtaagaaagaatgagcacaggctagagagacaaaacaaggaaataaagaggatccttctttcacttatttttcttttcagaataagtagttctgtgttcc

SEQ ID NO: 8426 - DNA, 201 bp, Bos taurus
aagtcattcttttattaatgagatcaactctaggtgagctgagagaggtaagttcctaaagcatctgtgaagaaaaacaacatccttaaaacaccagaaatcagcacaccatgttaaaaacaaaatactgagaggcaggtttgtgctgttctttcctggggaaagaggtgaaaaatcagtcctccaaaatatcttttgatt

SEQ ID NO: 8427 - DNA, 201 bp, Bos taurus
acttgagtcagacttggaattcctaattaaatcattaatatttgcgataatatgtccacttgtaattaaacagagcagaaatccagcccaggcctgtctcttcagaggaaaagaaaatcattatgactagtattgctggatctgatcactgtctcctgtttcttcatcatgtgaaatgcccagtccccatcagccaccaca

SEQ ID NO: 8428 - DNA, 201 bp, Bos taurus
agatttctgacctccagaaatgcaagagaatgaacttgtgttaagtcaccacatttgcaataatttgctactgtaggcctaggaaactaaggtagccaccggttaggatggttcacaatattccagttctcttcccagatccatgataagattgtatttctctgtttcacatagaagctaggagtgaccatgtgacttgct

SEQ ID NO: 8429 - DNA, 201 bp, Bos taurus
tggaaggctactgtatgtggggtctcaaagaatcagatacaacagaagcgatttagcacatgctattgctattatcactattcaggtttctttgcaggaaaaagaaggtgacaaagggaaccaggtatggggtatctgagactacggggtatctgaggcctttcagaacatagttgtgattttaaagaattggctgaagta

SEQ ID NO: 8430 - DNA, 201 bp, Bos taurus
cccatcttccaaatccatcaacttctcaaatcaggccaattaacgagaaatcaattctgaaacattatttaaaatgttaaattatcacttaactacccataccattggatcatgggccaaaagcccaaatggagaataataattcttttaagacagctctggataagaatgaccttgaaaaatgtattttgcacatgttcc

SEQ ID NO: 8431 - DNA, 201 bp, Bos taurus
aggaagaccccctggagagggaaatggcaacctgtcccagtattcctgtctggaaaatcacatggacagaggagcctggagggccacagtccatgcggccgcaaagagtcatgactgagcacccacaaagaaagagggagctgaaaaagtgaaatcagcaaggcaagatatgctaaagaacagagctaatagcattaaatc

SEQ ID NO: 8432 - DNA, 201 bp, Bos taurus
aatccccttaaaatgtttacaaatgaaagatttcagctccacatattttgcttggtacttctgcgttctgtagacagattaattcttgcgccaggcccaagtatttccggatgttctgttctactctgtctacttcctgtttggttgacttttatttcctgtactctttgttgaagttgtaaacttccattttggcctagg

SEQ ID NO: 8433 - DNA, 201 bp, Bos taurus
taggaacttctcggctaggttcttgtgctactggcttcatgttcatatcaaaagtgctgtattcaggaagggcatctcgcaagtacagcaaactatcgtcaagccgtttctctaatttgacaacttggatctcctggattcgaggattataaagttcaaagcaaatctcaacacctaaaaagagaaaacatattcttacaa

SEQ ID NO: 8434 - DNA, 201 bp, Bos taurus
tttccattattgctcccttttaaacagcttctgggcctcgtgacagcacttttggaaacactggggcacatctgtagtgaagtcactaatatgtttgacttctagtcttcctcaggcctcatgactccagcattgctggggagcccctatttatgtctccatttgaagaatctcaagagagtgcttgtggctccttctctc

SEQ ID NO: 8435 - DNA, 201 bp, Bos taurus
tgacggccgaggagctggggggacagctggggggacagctggggggacaggtagcaaggtggacaaggatacaggatcagccgcagattgctgagctgcatgtgcaaagaacggattcagggggcccagaggcttgcagcttgccatacgtagaatgctgaattccttaatttgatgccttctggagtgtgaagtcaagtg

SEQ ID NO: 8436 - DNA, 201 bp, Bos taurus
gcacaggggctcgcaggctggaagcccaacaccagctttcctttgcttcttcagtatctgcattaggtataatccagtaaaatgtggataaagcgttttaagtcaaggagagaggccagcctgaattaaggaaaagtcaaatacccgaaagtatagaaggaagcgttagctggaattctgatggggatgcaaatggaggag

SEQ ID NO: 8437 - DNA, 201 bp, Bos taurus
atcaccacaaggccatagggaaagccggggagccgcagccccttctggagtcttaacagaagactcttcagaactgttagtagtattcggtcctctgctgcatgtacactggccacctaaacatgggccagacacattttaggaactgcttttatgacagattttattttcttgggctccaaaatcactgcagacagtgac

SEQ ID NO: 8438 - DNA, 201 bp, Bos taurus
tcttagtcccaggaattattctgtgggttggggtctaaacacagcatgggaagaagccctcaagcacccaagcatctctaggggccacaggactgggacatggacacccagaactccgacaaatgccagctgcccgtgtcaggcgttcagggtcagtcaggccctgttgtatctcccagcgtgctggtccaccgcccaccc

SEQ ID NO: 8439 - DNA, 201 bp, Bos taurus
gttcatcagcgtcgtcttgccctcagccctccgccttctctcagccatgagtctgcactcccacccccacctcactggtctttctgatgggcctgaggcttgcagcatctgggtccacaaccttcatccagggctctatcccagggcttccagcagaaggcagctgagggccccagatgtgggctccaggagcctcttggc

SEQ ID NO: 8440 - DNA, 201 bp, Bos taurus
cactgacctagagccagatatcctggaatgtgaagtcaaatgggccttagaaagcatcactacgaacaaagctagtggaggtgacagaattccagttgagctattccaaatcctgaaaggcctttcaggtaggaccaaaatcaaatcccttacgattatacagtagaagcaacaaaccgagtaaaaaaaaaaaaagtgaca

SEQ ID NO: 8441 - DNA, 201 bp, Bos taurus
taactagaagatccccccagaccttgtcagctgagcgaagcagctctaagtgtcttcattttgttccccagctcagctcaaggccatagtcacagagactcaaaacacagcatttctcagctgtatgggtacaagtgatctggtagcaaggtggccagggaggtaatcacagctgtgtgtgtgtgtgtgtgtgtgtgtgtg

SEQ ID NO: 8442 - DNA, 201 bp, Bos taurus
tcccggtaactctcacaggtcactaacctgcgggccgcccggggttcgctgtcctctggtgcctgatgctgcacgctccttgaactgggatacctctcctctctcactggcccagggtgtacacgtggggctttacggaaatgaaatgaaaaccccgtaaaagtagtctagcctggaggcttatgtaccattttaacaaag

SEQ ID NO: 8443 - DNA, 201 bp, Bos taurus
cactgccctggtccaggcaggctcctctcttattcttctgcctcctctcctgctcacagggcctctgtggtcacaaaggcctacaagggtgttccctcaagataagctgatcagtaacctccttccccccatgtttccccacatagcctaacatattcacaggtttccaaggaggaagatgtggacatctttgggggccag

SEQ ID NO: 8444 - DNA, 201 bp, Bos taurus
ccaccctcttcctcctcaccactccatgtccataaatttgttaattcatttcataaatgtttattgattgcctaacctgggccaggtaccagggacactatagtaaacaggacacgtgtgcccccaacacctaataagaacctactgtgttgtatagggaaatcaactcaatgctctgtgatggcctatgttggaaaagaa

SEQ ID NO: 8445 - DNA, 201 bp, Bos taurus
cagccccgttttctcaccgaggcctggagcgtgggcttgggtcagcccccgcagaaccaaaaacgcccacggggagacagaggcaggcaggcaagcgatcgggtcacttccgctcactcgggggcctcccttcgtccccgcccgtaagacagctgctggaggtcatactcacccgcggcggcggagagtccaggacgcacc

SEQ ID NO: 8446 - DNA, 201 bp, Bos taurus
ggacacaactgagccactaacagacatgaagggaaaggttgttcacatcttgcccaaaacctcagaagacaagagggcctcttccttatgccaaagactaacccattcctctatcattttccagaaatcttctttgtattagcctcccgtgtgaagtcagcttatgagaacaaaggaagccccatttttctggccgtctca

SEQ ID NO: 8447 - DNA, 201 bp, Bos taurus
ccaatgaagaaaatagaaaacatcttcctttgagtttgttttccaacaggactggcaggggagctgataagtagtacacccaaattattcaatgtgcttacaagtggtgagtgctgtgcaaagaaatggagcatggaaaggggaattggaagtagcagagagcagtttagggtggtgagtgtaagtcttgttcagaaggtg

SEQ ID NO: 8448 - DNA, 201 bp, Bos taurus
agggagccagaaacaggccacagggtgaactggaagggaagctgacttgtcagtagggaacagactttggggacaagtcttcatggtctaaggcttggagtgagttagctgcaatggggcctcacccttgaagcttctagctctgtgctgtgggggccactaatctcagatgactcttgagattttcatttaaattcataa

SEQ ID NO: 8449 - DNA, 201 bp, Bos taurus
ccactgttgatagacatgatcatctccagctggcatgtagagggcactgggaagcccatggctttgttgctctgggcaggcttaagtgtgagcacctccaggggaacactgacctttctgggggccccaggaaatgccttgctctttttgtctcccttcttcactatatcagagcatatctgttcctttaggtaacacaag

SEQ ID NO: 8450 - DNA, 201 bp, Bos taurus
aagtgggccttagaaaacatcactatgaacaaagctagtggaggtgatggaattccagttgagctattccaaatcctgaaagatgatgctgtgagggcgccggctgcggaaaatggctgctcggccgcggaggcatatctctggaattgcaaagcagccacagggtgacttgtgtgatggggctaagaaagcgattgatga

SEQ ID NO: 8451 - DNA, 201 bp, Bos taurus
gttgttcagggcggcctcgcgcatcttgtggtacatgaattcgttctggcggaacatgcgcagttccatctccgtctgcatccgcatggcctgtgggacgcggatacatcggaaacagtgatgacaaagccccaggacgtgtcggtctctgacttatgttggccctgctggaaaggacacatatacaccctacacacacat

SEQ ID NO: 8452 - DNA, 201 bp, Bos taurus
acaaaccctctggagaacacaaactcaacttattagatgctaactgagcacctaatgtactcttggcaccaaccctgggcttacatcatctttgggggccgggacagaaagaaggctagcacttgggtgacatcagagtgagtgcctttgaggcatcactgcccccacctttgagctggccctagacagacagtaaataag

SEQ ID NO: 8453 - DNA, 201 bp, Bos taurus
atgagaaaaaaagagcattcttacagttttattgttgaaaataatagaatctgagtggcagaaacaagtgtgaaggcccctttgtccaatattatgcctttatttagattgttgatgtctctcttatgaatgaactgacacactcatcatttaacgaaagatttgctacatttgcaagaatcttcaaacagttctcctgcc

SEQ ID NO: 8454 - DNA, 201 bp, Bos taurus
gtggccatggcaccacagcctcctcctcctcgacgctcgtctctaccatctccctcacccgctcagccctttgaggcctttgtatataaggttcacctgggaaacaggggtatagcgactcaacttacagcactgcccatgatggagcttttgtttctccatcttctcccctggtccaggcccgctttcacactttgctga

SEQ ID NO: 8455 - DNA, 201 bp, Bos taurus
cccaagtgggcctgggagtatgcaggaagcagagcaaactttcagggcaaaactgtagaggtgtatctttggggtcctcctttcaggcccactcttccttgttttgcccaaaggttacagcatggttgtcactgatctatctcctcagtctaccctagggtcagttctttaccttgttgttaacaaaggcctttaaaaaag

SEQ ID NO: 8456 - DNA, 201 bp, Bos taurus
aacagactggacaagaaagactggagacagggaggtctatcctaggctatggtcatggtcaaagcccaaagtgaaatgtgcgtgggccaaactggaaaaggaaagggaaagacagagacaggggcttgatccatgctctgggaagatcccacaggcttcagagcaactaggcctatgaggcacaattactgagccagtgct

SEQ ID NO: 8457 - DNA, 201 bp, Bos taurus
ttaacttctcctcttttgcttctttttttttattctccagagacgtaaatgggtaaatagacgggggaacttacacatctgacacaaggccctggagtgacaccctaccgtgtgcaacagacagaggtagcagtctttgttctcattccagattttatttatttgggccctctcttttttcttgatagctaccttttcttt

SEQ ID NO: 8458 - DNA, 201 bp, Bos taurus
taatagagagaatatagctagcacatcaaaaccatccatccattcacagctgtcattgagcagggaaaagctggagcagatctttcagggataaaacattagatggttgagagaaaatattaagtgatggtaaggtagtacaaaaatatgccaaaaatcacagaggtggcatttctacaactgaagtttgggaaattctgg

SEQ ID NO: 8459 - DNA, 201 bp, Bos taurus
gggacatgtgcggctccgttcagtcctctccagtgtgtccacagcccccacttctgatgagaatgcacagccatggcaggtgagtccagactcccattgacggaatggggggacggccctgcccccatcgggaggcggggctcttctgtccccaagcagaaagaggcagcctccgatcttccatcctgctcctcacaggct

SEQ ID NO: 8460 - DNA, 201 bp, Bos taurus
gctgctcccctcagtctccctggttaattcttgctcgtctctccaatttgtgaaagctgcagtgccagggctcggccctttacctgttttctcctcagccctcacaccccagagatcttctgtctgggtaccactgttgtgccgatgactgtgaatgtctctctgtctttaaccaggcctcctccctgacaggcttcccag

SEQ ID NO: 8461 - DNA, 201 bp, Bos taurus
ctgaagtcattaggtaaaatgctataagtcactactgaacttacaaaacctttttccctatgacaggttatgtgcataaaaaaaatataaaatcagcttgtttttaagccagcccccactacaattagcaaccagtctaaatcaagtttggatttcccccagcctctttcttgaattggaacaccccctccagatggtgtt

SEQ ID NO: 8462 - DNA, 201 bp, Bos taurus
aggactgcagatattcagactcgatacctagacattagggatgaccctcacaggatacctgcagtgggtatgagtccgactcataagcagatggaatctacggtccttgcatttgacttgttttgctacaaacaaagcaaaatctcctatttctttaggcatgcatgttaaatcagcctggctactctgtatatttctgta

SEQ ID NO: 8463 - DNA, 201 bp, Bos taurus
ctataggatgtaagcatcacatgatatgaaacaagttacattaaaaaaaaagacattctatgggaagattctgggtcactgataagtgatcttgatctggtagttggtatataggtattttgggtccagaagatcccctggaggagggcatggcaaccagctccagtattcttacttggagaatcccatggacagaggagc

SEQ ID NO: 8464 - DNA, 201 bp, Bos taurus
cagagacggcaggtgctgtgagcatgctcaactgtaacatctgagattccaggcatatgtgctgagcagtgactgtcccagggcagcccctgaggtgtgcagaccatgtacctctctgtgtagattcagaacgctgatcgatggtgagcatcgtgctaccctctaataaaggcttttactaccactattactgactcctaa

SEQ ID NO: 8465 - DNA, 201 bp, Bos taurus
agctggatacgaatgactgactaacactcatgttgggagtagggtccttcaacaggaaagattaagtgttgaggttttcaaggcctatcccttggcacttaaggagaatagacagctgctagttggagagagctttcttgtgttatctcctgtactctgtcttccatgttaagactatgaatattctggcctggaaagggc

SEQ ID NO: 8466 - DNA, 201 bp, Bos taurus
ggtgtccagtaatggtataacatatctttgtttgggttttttttttttttgctatgagagtacaacttccaatgattcctagctggtatctcagttccacttctcttcatcaattttctattgagaagaaagcattattttgcatttgttctggaaaaattcaataggtttatctgagaacagattattgtgctagatttg

SEQ ID NO: 8467 - DNA, 201 bp, Bos taurus
tttttttttttttcacttcaaaagcttttataatattttcttacaataagaattattttctgagagaacacaaactgagaaccattttggggatagcttagatggtcattctagaaaatgggacggagcaatggtgtgttatagaaaccatacaggctatgtggaggactgtgttgaatgattagcacatagtgataggtt

SEQ ID NO: 8468 - DNA, 201 bp, Bos taurus
catggtgcacagtgtcctcctctcctaggatatgagtgtatgtggctaataatttgctgtcattctcatctgttcagtgtcagctgttgtgtgtttggccgttctataatctcaagacaggaatccattcttcaccaagaagttgaataagaggtgattaaaccactctgctaaatgaaatgggctcttttcaatggccta

SEQ ID NO: 8469 - DNA, 201 bp, Bos taurus
attcttctcccaatggggttctgaactcccatacctagccatgccctgttatgggtattctcattctggttgagttagaaaaccctacacaaggccaaccacacacataccctactcatctagcctggactctgacatcccatgtgagactcacttggaagtccctttatgtgtttttgaggactaatattaggccacttc

SEQ ID NO: 8470 - DNA, 201 bp, Bos taurus
agtctctgatacttacaaactctatggttataaacacacaattttcacatctattattgcttccttgggcattgttggagcactgaaaaatcccactgtatacactgccatttctgatggaatttttttttgtcctgaaattgatataaatttcttttcattcttggaatgtctacatgttcactcaaacctttaccagga

SEQ ID NO: 8471 - DNA, 201 bp, Bos taurus
aatgaagtgatggggtcagatgccatgatctttgtcttgtagaatgttgagttttaagccagcttcttcaaaaggctgctgctgatgaaagaaaaccaggcatctcaaggactgtagggttttttcatgtatgggaagatgcaaaatctgggcttgtttaaatcattcctttgattttcagctcagttatctggagccagt

SEQ ID NO: 8472 - DNA, 201 bp, Bos taurus
tattgcattttagtgggaggaagatgaaggagctaggatagaatgggaaagaagataaatgagatcaatttcatacaagtaggacttttttttctgcctcgcaatacttgtacctttctctcatgttaattctttcttttacacacatgcacacacacacaaactgcaccttaatcttcttttactaaaataaggaattcc

SEQ ID NO: 8473 - DNA, 201 bp, Bos taurus
aaacccatatatactcaatgtgaaggttgttgttttcaaccactaagcagttccagcttcaagtaataaatactacataaaggtttgtgtagtgttgcctattgcactaaccctgccgatatatgtctattatcagaggatttctgctataattaagtagatttttgagctgtttaaatgagaagaatacttgattttaac

SEQ ID NO: 8474 - DNA, 201 bp, Bos taurus
accagtgggtctgtggggagttttgtatctcagagggcaacataaccaggaggaaaaacaacaacaacaaaacccacagaatatgggcctaatcacaactcccagtggagaagtagcccagacgctcacgtaccagcgagagggggctgaacagagagtcgcaggttgcatgcttagggtaaggactgggcctgaatgccc

SEQ ID NO: 8475 - DNA, 201 bp, Bos taurus
tgatctgatcaaatctcattttccatgggaaaatcaaattcaatgaatagagcaggtgagccagtgaagaatccatttgtttacatgatgtagtatgaaacatcctgaaagttccacctcaaccatgttacctccaggcttaaaacactcactgttggcttgaggcaccatctctcaaaatctctacaacatcagaatctt

SEQ ID NO: 8476 - DNA, 201 bp, Bos taurus
tttaaagtgttttcatcagaccctcagttgtgctctctccattagaaccatcaataacaagagagacaaaaattatcaatctgtaactaggcaacaaggacaaagctaatgaacattaggccagagatggtagcctttataaataaaatccaaataacaccttagctgaatatatttttccagtttattgctgttttgaca

SEQ ID NO: 8477 - DNA, 201 bp, Bos taurus
atggttgtttaatttctctcagtggcttttaaaattttcaatacatgggttttgtatctacattattaaatgtatccctaggtagttcctgtttgcttctgaatgaaatatgataatttttatgtttaatttttcatttgtttttcattgttgcatatagaaatacaatttatatctcataataaccttataagtcagtaa

SEQ ID NO: 8478 - DNA, 201 bp, Bos taurus
ttctcttgtgttgttgctatattaaggactggcccctggttttgaacaagataaatttttctcactccgaattcattctcatcatagggctgcaggaaaggggactcctttcagggcctgagagtgggctcttgtctaacacttggatatgaattgtccaaggagacacacatgctgacaaactgcaaattttaagaaatg

SEQ ID NO: 8479 - DNA, 201 bp, Bos taurus
ccataaggctggatacaagacagctccctcacattccctctattagtgcaatggattccaacctctgtctctttttgttacatgttagtgatgacactcctgtgacttagatattctcatgtatgatgccaagtttatctacaactccaaactctattctacctctctaagaaagccaggattgaactggatgctgaagta

SEQ ID NO: 8480 - DNA, 201 bp, Bos taurus
tttgtgtgactccatgggctatggcccaccaagctatggagtctttaataactctattgtgttaaatcacatatttaaagtttaaatttgtcagctattctatgatcattccttggccataacccactcttctatactctgatctgaactgctgagactgtggtattgaaaagctcatttcccagatcttttacccctcat

SEQ ID NO: 8481 - DNA, 201 bp, Bos taurus
aatgccagagctggagtctatttccaggccctatctctctctctctcacacacacacacacacaattacatataaaatacatatcacaattgcaccctccgcaatcctgacaatggaaaaggccatcattctctttatagataactgagagccaatgaggcaggcttccaacactaagttaaagttaccttaagaggaatg

SEQ ID NO: 8482 - DNA, 201 bp, Bos taurus
gcagaatgtctccactggctcaggtgttcagcttctggcctagagactagaaactcagtcagtgctcacatcacttatctttggagataaggaaccatctttccaattgaaatcttcatggccttcaggaaaattatattatcaatacaaaaaattgactgcttacataataagtgttgcatagtagaaacagctgtaaga

SEQ ID NO: 8483 - DNA, 201 bp, Bos taurus
tacacaatggcctgcctcagagaattctgcccctctgcctgactgttaaactaaactgcctttgttaagaaccctgtccacccagaaacgcaggaaggaaaaaattaatgtgtcccctgtcagaggcttgccattctgggagatgtttgcaagataaacggcctttttactttgcttcctcaccttcccctaatgtctgaa

SEQ ID NO: 8484 - DNA, 201 bp, Bos taurus
cctgctagcagatctaaagttaaagggcaaatagttccgtggtctgcatgaaaatgaaaggctagcatatttttccaagttgaataaaaatgtactgttagtataaatatcctttttcagaagccacaaagggaagagaggcaacaattttgttctagtgctgcattctgccttaagtaggcaaatataggacagagtgct

SEQ ID NO: 8485 - DNA, 201 bp, Bos taurus
aataccatctaatagactccagtcttttgtggttaaaatgtagttccaggacttattttgtgcctaaagatcaggaaagtggacaggagttgataccaactggcacatcatccttataaaggaaatcatgagaatgagtaacaggacagagatcagactgagaataagagaatgaaggagaccatgaaacatgcttaaact

SEQ ID NO: 8486 - DNA, 201 bp, Bos taurus
aactgctaaaaagactcttattaccaaactttttaaaatcacaacctacttaaaattgcatgtctagggcacatacagatattaaacagtttctctgaaaatattaaggcctttagccatctgaatgagtgattatttttttataaattagtgagatttttattgaatctgtgtaaggaataaaattttaattgaaaactg

SEQ ID NO: 8487 - DNA, 201 bp, Bos taurus
ctttgtagtgctgatccaatagtcatttctctttgtgtctcagtggtgaggagcagtaggctgttcctcctggtagttatctgagagccatgtgaaaatggcttaaggccctagcatccctgcccgcccctactatttacccctgggcccttcagatacatggggtaggttctaaaactctgtatcacaaaagaaaaaact

SEQ ID NO: 8488 - DNA, 201 bp, Bos taurus
gagaggaatttgaacaaaacaggccttgccaaggtctgtctagcacaatacacagattgatcccatactttttgtgatctttggtgataactattttcctggaccaaggcctctatttaaagtattttaagcagttaacagggaggtaaaatcctttcttaagtcatgtgggccttgattgttttcagtccaaaataatcc

SEQ ID NO: 8489 - DNA, 201 bp, Bos taurus
ctgtcaggatttgtgcagtgttctgcttagtactgtagttatttgcatatattttgcttatgatgtataaaataattttcctaatcatattattttcacccatcatcatttctacaaaagtctctgcaatacattaaaatgtcagaatttggtggggcaaagattaatacacgattccttatatttttaaagaaagatttt

SEQ ID NO: 8490 - DNA, 201 bp, Bos taurus
taactagatgaattgataaaatagcagaggatattgaggcacaattgccagagaggactgggtcacttggtgtgcagcccaggctgatgagtccaccagtgttgacaacagcacaagaatgctttgtgttgtgtgatatatcttcaggaagttgtgcacaaggatatgtcatgtgcacttttgttgccaaccaataccgca

SEQ ID NO: 8491 - DNA, 201 bp, Bos taurus
gtgttataaaaggaagggtggtgaacagaaaaatcagaaacattgtttgaataacctgtgttaataagtgtatgatcaggccacttgaaatagctgttgtcttgatctccatacagcccctgctcaaccaaccaatgccttcttcacctacaatctacaatctgacttttttaggccacagctagagagtgctcctatcaa

SEQ ID NO: 8492 - DNA, 201 bp, Bos taurus
ctttttggagtttttagaaacataagtgtattatgtcaaatgggaaaaattttagagggattttaaagaaaagggtaatatcatgactattttaaagtttctatgcaatttgacacattagaacatttgtaacaacaaatggctagtaaaaatccaagaaaatcatcaagaaaaataagtccaaaacttgactgtggaaga

SEQ ID NO: 8493 - DNA, 201 bp, Bos taurus
atgaataacctgtagttatttgtcttttctattatttaatattcctatagttattgcttttattaagttcttttttattcttcttttattaagttctttcgttctcattattagaagaaatattgaattgaggtgaggaatagcatgctaagatatatgctgagaactaccaagggattctctaggcaaaaatactggaag

SEQ ID NO: 8494 - DNA, 201 bp, Bos taurus
tgatttcattacttccagacctaaagaaaggccagttctctggcgagatactttgttgcatagggcttaaggaaagcttgaggaagaaggttcatatcctccttaaagtggcctggagtgcctaagctttaactctctcaaaacatcatggataactatcttaggtaaaaaatttaacctcatattactatgggaaaattc

SEQ ID NO: 8495 - DNA, 201 bp, Bos taurus
catagcacaacataacctcacacgacccttctggcccttttcaggtgaaccttatatatactcacagaacaaaagtagcttgtggccaagcgagcaccttgtgatgcacatgaactgtactataaccgatctcagctgttacataatcattatttacaaaatgtggggcaagagtgagaggccatgaggtgagagagactg

SEQ ID NO: 8496 - DNA, 201 bp, Bos taurus
gtctcaggaaagtagtttgctatgttatatgctatatgctatatgttatatgttatgtgctgtgttggatcagtgacttcttgtacaatatatactaactgcaatatttcactctgtggattgaagtttctcatatatacgtagaagctcataaatcataccctgtttccctgatgccaacacaatttgaacatccaaatt

SEQ ID NO: 8497 - DNA, 201 bp, Bos taurus
ttccagctactggcacaagatggccagctctagcagagacctttcccatttcccagcagcatgtgcaagagggtcagccgagatggggctcttttccagttccccgtttcagtattgggcctgtcccaggtctttttctagcacccagtggcaggcacatgtaggcttgccctggaagaggcctttcctagcattttgtta

SEQ ID NO: 8498 - DNA, 201 bp, Bos taurus
gttagtgaaacccatcatgcaactgagaaggtcctgaaatttaagacagaagtttaagcacccaccacaagagatacaggccattacatgagcttaccatgtgtgctgtgaccatgaagatacagaccaatgatctgagctgtgaatgcaaaaaaaatcccctcttttaaggggtgggcctggcacctgtgggtggttttt

SEQ ID NO: 8499 - DNA, 201 bp, Bos taurus
aggcatctctctctgactcagtttcctgagtcataaattacacgaactactttgtatatctttgaggaagttaaacaattttatagaagaaagcagctagtatgtatttcttgatagaaatctatctgttctagtccattattatctatctgatgaggtttgaaacttctgcccttcttatgtcactttgtcaaataatat

SEQ ID NO: 8500 - DNA, 201 bp, Bos taurus
ttactgattaatgtgacacattcagtaaaaattatctcttttataaagtttattttgtgactttttccccttttctttctaagaatattacaatgtatacgtttgactactgtgttctattatctaaagacatcttagaatggaaacactagttaaaggcttagaacatttgtttctatatatcttgatagttactgctaa

SEQ ID NO: 8501 - DNA, 201 bp, Bos taurus
ccaggccattaacctcacctttgaggttataaaactcaaaatacttacatttaactgccagatagtctcattatttttcttttcctgctcagtgataaccaagaccaatttaattctgacttctctaaagtaattaatttggggtgtttttaaaaaatcagaattctgcagaagcaggtttcttttctcttccatgcaatt

SEQ ID NO: 8502 - DNA, 201 bp, Bos taurus
ttttagtaaattatggtttactatgttctccctttatctctaaagttgcatgtaagtttctgagctcatgaaaggtgtctgagttcttggtgactactgacccattttggtatcacttgcagccttttgttttccttatcctcattcagcaagcaaaatacctctctggcatttagaagtcatttttaaaaaactgggctc

SEQ ID NO: 8503 - DNA, 201 bp, Bos taurus
accttttcactatgtgatatagtcctctcccatccaactaataatattatagattaaatccaacttgtcttgaaatcatgtattaatgaggggccttgggcataaaactaaagttaatttgcatggatgtctctgttctcttttttattgaagtctagccagaccatgtcaccgaggaactgtgagtgatggggaacctca

SEQ ID NO: 8504 - DNA, 201 bp, Bos taurus
ttttttgtttggttttcttttccttaactccttgaagtttccttttatagacaggttgctataaaatcttatcctggtttggaaaatgtaattgttgcaaagcttaagggatctctgtattgtcacttttagatcaataactcatgttaaaatataactctttattaagcagggagaaatctggcctcttctcaaatgtaa

SEQ ID NO: 8505 - DNA, 201 bp, Bos taurus
ttcatacttttattcatcagtttccttggaaatcctaggaatcttctttgctgagcttaaaattgcacacaaaaaagaagaagaacacttttagctttctcttctcattcaagatccgtggcaaattaaaaacagaaaacaaagaacaaagcccagctattttctggaaatgagagaggaaaagggtaaacacacaagaac

SEQ ID NO: 8506 - DNA, 201 bp, Bos taurus
ctcccaaggttactcacttggacctttaggaattgattctttttggacttctggcttccttcagattttgcctatgggcctcttcatagagcaattgagaatataacaacatgcttcatcagagtgagcaagtgaggagaggcagagagaggaggagaggaagagagagagagggagagagagactataagaaagaggcct

SEQ ID NO: 8507 - DNA, 201 bp, Bos taurus
tagagtaatgagtgaaaacacaggctctcaagtcagactgaggttggatttcactctacaacctattacctatttgagcttgggcctttagctcactcttcgtgtttttaattcctttacgtgtaaaatgagtataataataggatctgcctcaaaaagtgattgtttggggccaaatgaactaaaaatatataaaatttc

SEQ ID NO: 8508 - DNA, 201 bp, Bos taurus
agtcactaacaaaaaatgttgtttcttcactcattttgctatattagttattttcacattgaattgctacctatatccctgtagttctcatatttgttgtggctactttcaaagcactgatatctaaattttatacagatatatgtaaaagccttcaaaattagtactgcaaaaaacaaaagaatatgcacaacagtagac

SEQ ID NO: 8509 - DNA, 201 bp, Bos taurus
gttaaagcatctatttccctatgaaacattctatcttactcttacatggcattctttggtatgaagaagcatgcaaataagaagagatggccttacattgtgtcagaaaagtagctctatatctaagggtgcagtctataaataattcaggggagaaggcaaggaaagcaatggcatacaggaagtgtgagatatggccac

SEQ ID NO: 8510 - DNA, 201 bp, Bos taurus
tgtctcttaactaatgataagtttatccaaccttattatttatattttttaatggatttctttaaattgagaacaatatgttttgctttccattaatgccgggtctaattaggtcataatttgattgcatttgttcttttgattttattatttaaaatgaattttgacatagacatattctgctattattaaaagactctt

SEQ ID NO: 8511 - DNA, 201 bp, Bos taurus
agtatttttagactcacagtaacaattaatatacaaaaatggactggatatatcaaattttcatgatatattagttgtctcttttgaaggacggaggtagaatggcaggaatgaagaacaggaaagagcataaaaatgatattcaattttgtgtataagaatttgttaacaaaagtgttctgaggcaaatatgaaaatcat

SEQ ID NO: 8512 - DNA, 201 bp, Bos taurus
ttttaccaagtatttaagggactcttttaagttgaagacactgacctttccttctactatacttactttcttatttcttctgtgtattccctgagctccatttttataaatttctgtattttttttagtagtttgaataattatttgttagtcaatattttgatgaaagaaaaggttatattatcaaattatatattttgg

SEQ ID NO: 8513 - DNA, 201 bp, Bos taurus
agagcaaaagaaatgtaaccttagactaacaaggaaatgactgggggtgcaaaatcatgttgaaacagcaaaataatggggaattatgcaaatatggatagtattttatctttgtgcagaaaaggtggactatgtgcaaaattctataagtaaaatacccagggcaactcaaatgtgagttcaagaaattgattgtattaa

SEQ ID NO: 8514 - DNA, 201 bp, Bos taurus
gacatatgaaggacatgggtattaacagtttcagctgcattttgtggggggctgcaccacacagcttgggggatctagtttcctgacgattgtgtgcgtgcgtggtaactcgcttcactagtgctggactcttagagactccacggactgtagcccgccagactcctctgtctatgggattcttcaggcaagaatcttttt

SEQ ID NO: 8515 - DNA, 201 bp, Bos taurus
acagaaatcaatccttctcaatatttgaagctctcatagtgcccaacctgttttgttcctctcttcatttcaatataatcattaccctgatttttgtagtcatcactctcttattttccttcagttttatgacacacatatatatgttattaaatgtctcatgctttcattgcatttttcacatttcatgtaccccaacat

SEQ ID NO: 8516 - DNA, 201 bp, Bos taurus
agacttttcagggccctgggtctcccacccattctgtggagacctccaggcctcaacttctggcattacaacacaggctctgagcttttcctcctctgtgcgtcatgtaagggctggcccaactgtggtagtcctcctctttccttttcccctcaatcgaaaacagttacatttctgcccctaggtttatgccctctaaat

SEQ ID NO: 8517 - DNA, 201 bp, Bos taurus
acatatacagatattaagaatattttaccttacaaatgaattcaatgtcttctctttcaatatcctttaccaccattatcttcattttgttcaggaaatgcaatgcaagatcactaagagcatctctaaaatacagaaacagtgattatgtcaatactggtttggaacagaaattctgctatttaactccttagggttttc

SEQ ID NO: 8518 - DNA, 201 bp, Bos taurus
ctcaggtgtatttcttttgaactcctttataatggagatatgttctgctttgaagctgcaaataattaaatatgtttgtatattcttttcttcaggttttgtatctctgttgtctctcatacattttaaagcctgcccaatggttctttaatggtcttatgaataagtacagctagtgcagtgtttatcttttctcttatt

SEQ ID NO: 8519 - DNA, 201 bp, Bos taurus
aggagcttggtgggctctagtccatgggatcacaaagagtcagacacgactgagcgactctcactcactcactcactgctttcctttcattttccagtgtcgttatggcatggcttttcttgaagtcagtttgaactggcagtcacgtgactgccagatcagacttttaatgacctggtatatgtcttttgcggaggaaaa

SEQ ID NO: 8520 - DNA, 201 bp, Bos taurus
caggatttgtcttcaaagagtcctgagcttgaaacctagattgagtaaaaagtgtcactgtcaatatcttgtaattctgacgcctttatcaccttcttaatgtgagctcttgactgcatcagagaattaaaatgtgagtcacaaaataatgagagaaagatgagtgtgggagccattacattttgtgtcagaaatgacatg

SEQ ID NO: 8521 - DNA, 201 bp, Bos taurus
ccagtattcttgcctgaagaatcccatggacagaggagcctggcaggctacagagtcggacacagctgaagcgactgagcatgcatgcatacaagcacacgtgctacttcaaaatataactgtttcttccatagaaatctaaatacacaagtcatttccttcatgaatctccttaattctttcagtgagacgtaatatccc

SEQ ID NO: 8522 - DNA, 201 bp, Bos taurus
tcccacttcataattcttaactgcccaacttcccagtcaaggttttcaaatatcttagatggtgatttagctagcagaagggaaaactagatgcaaagtgtgcagctttttatctcaaaatttgagaaatagcaatttatatataagtggagtcagttctcccttatctgggacagctataatcatctctcaccgcatcac

SEQ ID NO: 8523 - DNA, 201 bp, Bos taurus
ataaaggaagctacttgagaccatcagaaacaatagactgaagagaaaggtagtatccttaatctgatctttttgatgatgctgcctctcaagcttttcttgttgtctgagaaatatcaaaaggaagctcttgagaaaggcttggggcctcagtcatttcctgactgtcagtcccaatatagattgcagatcacaggctga

SEQ ID NO: 8524 - DNA, 201 bp, Bos taurus
cttttagtattctggaatcccatgttagactcataaacttcctgtaatgcagtctggtggcccctgcttctacttcctctaccccttacttcatcctgtgcgttgttgccacatgtctcccgctctggaggcgaggtcagcaggtggctcctgcagccctgcctcttctgaccttctgcagtatagatcccactctctatg

SEQ ID NO: 8525 - DNA, 201 bp, Bos taurus
agatgttcattggttgagggataactttcagttttctgtaaatcatgcatttacaggaaaccagtccctcaatccttaggtatcattttcctgagggcccgtgtgtgagattctccatttctgttttagatttaatttctttcatgaggcagcaggaacagaatatgtaaaggccccgaggcagaagcagactggcttgtt

SEQ ID NO: 8526 - DNA, 201 bp, Bos taurus
attggtttattggacttattttccagttgtgatgctcctaatatttcagatcccttctggatattttagaatcattgtatgtttcccttgaaacattatagatgtacttttgaaaagttatgagaactcacaatgtattaagcatattattgttgttatttagtcactctagtgatgtccagctctttgagaccccatgga

SEQ ID NO: 8527 - DNA, 201 bp, Bos taurus
agaaactgacacttttctataggacaagagatggagtattccaataaatggggttctgtaaatcattcaggctagatcagattgtcattctacaaaaagtagtcttactgaaatctttgtatattttcataaaggataaaaagaaaagactagctttcttagacttagttatgggtagttatcaagtcataaattactaag

SEQ ID NO: 8528 - DNA, 201 bp, Bos taurus
ccaccaccctcctcccccagtgatgacatttaacataacatagagcattatcaaaactaggaaaccgactaaactacacacaacactgttaaataggtttactcagatttctacagtttttatgtctttatgaatggtcctatgtcatccaattatatattagattgctataaccacaaactgtaccatcacccacaaaga

SEQ ID NO: 8529 - DNA, 201 bp, Bos taurus
tgcaatgaattcatttcttacatgatcccacaggattgaattttattatctcaacttcaggatggaaacagtttagtcctgtgtgctaatgactgattcttccagagtgtggccacttggctgccagggctttttgaggttcctgccatatccaagttgctcattgttgtgtatttttcacttgcttctgtttctactcca

SEQ ID NO: 8530 - DNA, 201 bp, Bos taurus
ctcaatctgtttctgggtttttctgcagaagtggcagaaatagtatatacagggggaaataaatctatgattacttaataaattggatttgtttaaagcattgaatttttcaaaacatggggtacaaaagtaaaaaagagttttcagaatttggttgatgaaaaagtaattgctgttttggactacaaattttacatcatt

SEQ ID NO: 8531 - DNA, 201 bp, Bos taurus
ataatttgaaaataattatgtactcttaaatgagacgccactaaagaacagcagcacaacattaaagtagcatgtgacactctctaattttacctgctgtcattttaatttggggttcagagtcagggtggcaatgcctcttcaaaacattctgaccttggtaaaaaaaaaaaaatccaggcagaatatctaagagaaaaa

SEQ ID NO: 8532 - DNA, 201 bp, Bos taurus
atatatgcgttagtatactgtattagtgtttttctttctggcttacttcactctgtatagccatatttttaaaaagagatgatttgtagtgtctcagggacgtttgataactttgagctttccagtccttgcctattcactattgtgtttttacaacagactacgtcagtgatgacaattagaagattttgaagctctatt

SEQ ID NO: 8533 - DNA, 201 bp, Bos taurus
cctttctggaccttcctcttgcgaataatggatatgctgctgtagaccttcctgcttctgttttttctgcttcctctgaagaaagtgcgtccagtggtccctggccactgggtctttattggaaaagctgttttccaagatcatttagctctaaaaaagtgatgaacccacagggactttgagactttgtgtgtgtgtgtg

SEQ ID NO: 8534 - DNA, 201 bp, Bos taurus
ttcctcagacctacctgggtttgggggctctgcccattcctctctgcgggtctagctttcccacgcctgtgccagggcgactcagagctctaggcctggagacagagcccctggctttgccttcctctcttcagagcgatgttccttcagccttctcctttttgatcacactaagtcctgcctgccactcagatatggaac

SEQ ID NO: 8535 - DNA, 201 bp, Bos taurus
acttgagcttagcttcaacgtccctctgaaaccagtttattactgtcactgaattcatgggcatggagacctaatgcataaaatgcctggccttactgattgggcaacaggcaaggagccttgggcaagaggtctcagtaggctgaatctgtccttagctctcttcctttcattggctatatattgccctctggctatcag

SEQ ID NO: 8536 - DNA, 201 bp, Bos taurus
ggcctacgctgtcaccacctacatgtttgggactttgctgttggcacatgctggggatcagggagtagaagcccagtccacgtgttgacaacttggcaaatgcggccagcggaccaagttgagatgactggacttatgctccaggctctaggtgacactggcagccaacccttcacctacggtctatcaagcccctcccca

SEQ ID NO: 8537 - DNA, 201 bp, Bos taurus
tggcataaagatagatatgtcaatcaatggaatttaattgagagtccagaaagaaacactcacattgatgatcagttgattttcaacatgaatggtaagacaattcagtggggaaggaacagttttttggcaaatggtgctgggacaactggatgcccacacagaaaagaatgaagttcattctctaacacaaatcacatg

SEQ ID NO: 8538 - DNA, 201 bp, Bos taurus
agaagtagtacacagcaacccagaaacatggacattggaactgaagctgatgaaacaggaaccaaataagctgtattctttggccagcatgctcaggaagctggcattttttggtttgtttatttgttcacctaagtccaggggtctgaagactctggcccatgagccaagtctggcccactatttgtttataaatgaggc

SEQ ID NO: 8539 - DNA, 201 bp, Bos taurus
aggaaatggcaacccactccaatattcttgcctgacaaatcccatggacagaggagcctggcagtttacaatctgtggggtcacaaagaatcggccatgattgagcgactgatgcacacaggcacgcatgtgtttaaaatatctattctgaaatcagttacatttttcattctgggttgtagacagtgagttagaaggcca

SEQ ID NO: 8540 - DNA, 201 bp, Bos taurus
aggcccatgacgccagccttgctcctcccagagcgtcgcccttctgccagctgagcccgatcgagacaccagcgtgatttatgggacgctctcctgcccttttgggccgtttactgccctgtgcatggagttcttcgctggttccctttctctttgtgtgcaagcaatggtcacatcttaatgcaaagcaacctttggaaa

SEQ ID NO: 8541 - DNA, 201 bp, Bos taurus
gtgtttcaacaggtaggatggtctatgagaaattttaatcagaagaggccacaccttcaagtaagccactctttaaattcttttccaggcaaactcatcactctgtaaataaacctgtagttgcatttacataaaagtatttagtatgttagcatctcctctgaagattggggcaaaagaaaatagatgggatctctttct

SEQ ID NO: 8542 - DNA, 201 bp, Bos taurus
aacctcactggtggattcttagcacacccaagacacacgtgatcctgcgttccttcgaaactgagcataactgttcaatgccatctgggtcacagggatgtcatccaaggaggcctgctcacaggctctcattcatcctcttgcctggctctgtggtcctcatggagggtcttcgattcagtactgagaactgaattctga

SEQ ID NO: 8543 - DNA, 201 bp, Bos taurus
gcagaggggagtgtggagggcaggggccctgccttgaaggagcccctctctttttgaggatgggagttgggtggaggagcagcagacctggggctctgcagcatgagggcccacaggaggcagggcctctgacccagaggggcttccccagaggcgagagagctggttttggagctggacttggaaaaatgactccagctt

SEQ ID NO: 8544 - DNA, 201 bp, Bos taurus
gtgagatcctgagaaggccaggtggactcaggactgggctggaggtgggctggccagtgcagtgcccgtggggatctggtggaagacaggctggaaaaacaccccagagagagatcatgaaaggccttctatgccaggctaaaaagtgtgacctttatcctgaaggcaaagggcagccacagaaggattttaagtgccagg

SEQ ID NO: 8545 - DNA, 201 bp, Bos taurus
ttaaatatacccaacagcttcagaaataggcagctatcagagattctaagttttgttcttggtggcaaaaatctttttctatgtgtaaagcatgaaaaaaaaaatatatatatataatatatatatatgtatataaacagacacgcattatattaggcttcccaggtggtgcactggtaaagaatccacctgccagtgcag

SEQ ID NO: 8546 - DNA, 201 bp, Bos taurus
cccttcccttcctttcgttcagctaaatattactaatgactaaggaatctataaactatagtgacagactgccaaggtaccctaaagataaagcattcttgcaggaattttgagttataaaaaagcttatagaatcctaagagaagggagggactgattgtttagggatgtaaagaagacatctcaaaagagggacacaag

SEQ ID NO: 8547 - DNA, 201 bp, Bos taurus
acatcccaaattccaaacatgacaaaaaaatacatgagccagggaaaaagattctctctgattggttaagatatgtgaggtgggaaagcgagaaggccaatggcaccagatacaatgggcacagagcaacatgaatgtgcacccaatcctgccttctgacagctttaaccagaaggccaacgtcagatgtggaaagacatt

SEQ ID NO: 8548 - DNA, 201 bp, Bos taurus
tataccaatttctatttccatgaacattattctagtgttcccttttctccacatccttgccaacatttgctacttgtggcctttttgatgttactcattctaacaggtgtgaagtgatatctcattgtggttttgatttgcatttctctgatgattagtgatgttgagtatcttttcatgtgactgttggccatctgtttg

SEQ ID NO: 8549 - DNA, 201 bp, Bos taurus
tccctcaaactagaatgttcttatcctgcatcttcaccttgacaaactgctacttatcttttaacagccagatcaaatgttcctccctcattccataaacatttagtgaatgaagatttctcgactcctccaacgttaattgttctaactcctttattcccaaaggactatgctaatgtcagttgcacttactctgctgct

SEQ ID NO: 8550 - DNA, 201 bp, Bos taurus
ggaaatttggccacaaatgtcaagatctaggcaatgacatagtcaaatgcttttatagagaacccatttgtacttgacattaattggggttgtctgctgggaggccagacttcttggaaaagttgggaccagaagtacagcgtgctatgcaaccggataccgattgactaaagcaacttgagaaatgcaccctacttcacc

SEQ ID NO: 8551 - DNA, 201 bp, Bos taurus
actcctcagagacacttgacactcatcacttttcaagttaggagatgtggtgttgaccctgaagctctcagtatattatcaggtcattgtttggcacagatttcagcttcttttaatggtgcactttaccaggcagcttttttctacatcattaaacagcaactctaatacgtgtgccccctttcttatttaccatagata

SEQ ID NO: 8552 - DNA, 201 bp, Bos taurus
cccaaaaaaattaaattaaaaaaaaataaaaaaataaacccctactcactagtgtccaattagcctaaaggttgatatacataagattgtatatcttgcatacatgtaagattgtatataaacagcagtatacataagattcatattaagatgtgaaaaatacagacttctagacccacatgtggaaattcacatttaata

SEQ ID NO: 8553 - DNA, 201 bp, Bos taurus
tggcccaaactgaggcaccctgcctagtttttctataacttgactttaaggcaacagaaaatagaaagaggggctcataagaaaacaaagtgccatcaccggtatactctggctctttcagggccaatctcaacctgttatcaggaccagatccagaaacctccaatgcctcttgcttattcaaaatgccctcctattttt

SEQ ID NO: 8554 - DNA, 201 bp, Bos taurus
ttgtgaagaaagaaacaaaataattggccaaatataaataaagacctagaagaactgtcctatattagtgatttaaatctccttcctactgcacccttcctcactaaggaggcccatattcctcctcaggcgtgtatttctgccttgttctgacttatcctattcctcctccatcaggacaccccacattcctccatgggt

SEQ ID NO: 8555 - DNA, 201 bp, Bos taurus
gtcccaacggatctgagagcagcatgtgcccgatgccccaggttctctcaggagcagcatcaggcccttctagggacttattatatagcctataaggcctgcagggtagagcccagctctaaggaagagttccgtggaaagagaagcctggcaacctaatctcatccagagtaaggagggtggctacacaacacgatgacg

SEQ ID NO: 8556 - DNA, 201 bp, Bos taurus
atgtagaaaaatgtaaaaagtaacctgggaagcagtaggtgatagaagactgggagacttgatgtgatgttagcacaagtaagaaatgcacgcagtgggtcagagtttgaactagggccatgactgctaatggtaagagaaatggacctggtatactttagaggaaaaggatctggggtttgacatttgaatggaatgaaa

SEQ ID NO: 8557 - DNA, 201 bp, Bos taurus
ataaacacaaaatgtaggacattatacctgatctcttaaaaaaagacaatgttgtaaaacaattggcgggggaccactctagacttaaagagaataaagagtcatgagcaccacaagcagtgcacaaatctggattgtatctttctctgggggaaaaaaacagctataaaagatattttaaggactattggagaaatttga

SEQ ID NO: 8558 - DNA, 201 bp, Bos taurus
tttcttttagaaacttgaagcctgaggtccaggcaggctacaaagctggttggagacaacattcaggtaggattgggttcttttggttgaggccaaatgctctttctacttgttttagtctgttctggcatctgtaaaagagtatcatagacaaggttacttggaaagaacagaaatttatttctcatgattctggaagcc

SEQ ID NO: 8559 - DNA, 201 bp, Bos taurus
ggggcaatgaaggccagtgaagacaggggacacaggaatggaagaaggacacaaggggctgggcagaaggagagacggaagtgaaaaggtgggaaaaagcaagagcggaagttcagaggccaagaagaaaatgtgaagaaaagagtaaaagtgaagagtccaacaaatagatcccttctgatatttccttctcttggtctt

SEQ ID NO: 8560 - DNA, 201 bp, Bos taurus
ccagccgagggcagtgactgcccagagcttactctctggctccctgcccactccatgctctcaaattccccaggggtcagaggggggccccttgtcctgccgagaatgtgctgctcctcttcttcctactcctgcctgaggtagaaggaccatcctcgcagttaaaactatctctgcagttactcctatgaagcagcttca

SEQ ID NO: 8561 - DNA, 201 bp, Bos taurus
ctctgattacatttagtcttttgatgtcagggaaggcctaggaagctaaaggtctcctacaaacaagaggcaggcagaggacatgatgggtgggtggtggcagcatctgtcccaggaaggcctttaaggtcccactgggctacatctcagggacatccctttgctgtcatcctaagaattgtctttaccttcatgctgagc

SEQ ID NO: 8562 - DNA, 201 bp, Bos taurus
gataatatcagggttaaaaaatgtcaaggagaggtggtgtttaatgaggaagatggccagggtccaacctccaggaattgccaaaaggaatgtctgggccaaagaagaaactccattaactagagttgagaagaattcgccagaacagttagaagagaaacagctaagaactgttaccactgaggccaggagagagagaat

SEQ ID NO: 8563 - DNA, 201 bp, Bos taurus
cctgcattggaaggcagacttttaacctctggcccactagagaagtccctaaaagtagctttgaatgaactaatgaacctgggcaagtggccacacttccagtagaattcatggatgctccactaaccccaaaagtctctggcacccttcctcaaatccttcacttggccacactgcttgaaactgtacccatcagagatc

SEQ ID NO: 8564 - DNA, 201 bp, Bos taurus
agatcattcctttgtactgtcagagggagcctagccctgctgacaccttaatctcagacttctagcctacagagccctgagagaaaaatctctatatgccgtttcatttatggccctttattaaaaaggagccctaaatctaatgtaattagattattaatcaatttttcaacaaccctaaaaatgtaatcggagaaggca

SEQ ID NO: 8565 - DNA, 201 bp, Bos taurus
acttcagatgtaacaaaagaatgagtttttaaaaaatattcaaaggttagcaaactatgacccacagccaggtttgtctacttttactggaacatggccatgcccattcctctacttatttctacggttgctttcacactacaacagcaaactgagtggcatggcatggccaagaaagcctaaaatattcactatctggcc

SEQ ID NO: 8566 - DNA, 201 bp, Bos taurus
taagagggaagtgagaagagtgtaggtaggtaaagcagacactggtagagcaggggatgcacagagagcaatagaaaagccatctttggtggcccaaccatacagtggtacttgtttagacagcgctagcaaaccgatatatcagtctatgatacacttgagccttgctagtatagctaagttttactgtcctaaaatccc

SEQ ID NO: 8567 - DNA, 201 bp, Bos taurus
cagcagactcctcagagggctcctccaagctaatctcctgcttcccaaggtcagtcctgccaaagttcaaatcaacatgtcaccacatggaaaagtgtaccgtggctgctcaggacatactgagccaggcctgccttacctgcccccttcccacaccctggcctgtgcagcagcagctcatgccagacactccccacccag

SEQ ID NO: 8568 - DNA, 201 bp, Bos taurus
tgtcaggggcacgtcagagtcagagagcgggtgatggtctaatggcccctttggctccaacagctggaatctcagctgacctgggctgttctctttctactcttaaaagttttgcattgcagtggccagtcaatggatcaagtgaaatgacaaggcagtggtttatccagcatctttaatcccagcatttaaagagctgtt

SEQ ID NO: 8569 - DNA, 201 bp, Bos taurus
tgaccaggaggaggagtctgggccacttgtttgggcagtcttctttctgaatgtgctttagcctagttctgggtgttccagctccattttgtgatggcttctctagggcctactcaaccttatcacttgctaggtcccacactctccagttcactgtgagtagtttgggctctgtggttgcttcgcgtctcatggttagat

SEQ ID NO: 8570 - DNA, 201 bp, Bos taurus
attccagaggagcaaaagcccatccctttgagagggatatgagcaaagtagggaagcaggagagaacgtggcaagttctgggaatggcgagacattcattttgccatgaacaaaaagctcatgttatgatctacttaatgtattcattctgactttgaaatttccataaagatagcttgtcatgtttctctgtgtaggaaa

SEQ ID NO: 8571 - DNA, 201 bp, Bos taurus
atcatcattatattattattgtcctaaagttcaggacaataatattgtcctatcgtccccactgtttttagaggtaacaatgaggcctgttagaaatgttacttgtagtttagcaaaaagagccatgaattttgagtcacatgatctggatcataatggtggttgaagcacttgactcatccagtggcctagggcaagaca

SEQ ID NO: 8572 - DNA, 201 bp, Bos taurus
tctctgtcttcacgtggccgaaggggcaagagagctctctgggacctcttgataagagcgctcactaatcccattcatagggccttcaccctcatgacccgatccactacccaaaagccccgtctcctcttactaccactctggggggtagatttcaacataggaatttggggatgggggcagggagcacacacaggccat

SEQ ID NO: 8573 - DNA, 201 bp, Bos taurus
gtggggtgacttggccgaccacccagccagtgcaaaagctagatctcaagccaggatccctggactcaagctagtgctcttcctcggagccatgctgcttatccaggtcagctcccggccccagccctcatgcggcagctgctcccccggctggcgcagagcagctgcataacagacaagggccctggctctcagcagagc

SEQ ID NO: 8574 - DNA, 201 bp, Bos taurus
taggcataactccttgccagggtaattgtgcagatggccatcgccctagggagcatagagcagggcaagtcagaatgtgggcctggggggtgcatggagcgaagatccatgagccactggcagaatgaagcttgggttctacctccgatacagtgtgtgaccttggaagtgtgccttccctctgctttagggcctcatctg

SEQ ID NO: 8575 - DNA, 201 bp, Bos taurus
agctaggccttggtctcttccttccccaggccaggtgttcaatacgttttccattaacacactcctgcccagacgctggtgctgagctgtactctggcccacagcctcactgaggtcaccctgcctgttgccaggtggtctgcaccagcctcccccatgtccctgctctgccctgctttgtcttgtctctgccctggtgac

SEQ ID NO: 8576 - DNA, 201 bp, Bos taurus
tcatggggctgagctgtgagctcgtctgggatgctacagcagggtctcagtggtcaccaagagcagacctgggaatagttggctaatctagagaggttgcaaaggccattttagggaacagttcccctttggttctctgaacctactctaccgtgtgaagaagagcccaccttgcaatgtaggtgagaagcccagatgctg

SEQ ID NO: 8577 - DNA, 201 bp, Bos taurus
agctcggaacaaggggcctttagtgctacccagcttcatcagatcagagaggtcccttcagtccagaaattgctaacttgaggaaatgacttttctgaactctgtagggcctcaggttcagaaaggtctaggaagcagggtttgctttcctgcagacatggatgtggcagggcctatcccagaaactcctggcgtgagggg

SEQ ID NO: 8578 - DNA, 201 bp, Bos taurus
ccacaggataaagagatgctgtcaaggggagataagcacagatgggtggagggaggcttccttgaatgaaccttggggcctcttctgaccctctgccctgcggtcatcatacctccaggacacctgtgattcagtgacagaaagcctgtgccaggatttccccatctgccctgggacggggaagccaacagggcataaggc

SEQ ID NO: 8579 - DNA, 201 bp, Bos taurus
ccaaacattgggaagtcactattccctgtcctcaagatatacaggtcatcactgatgtttaacaacagctggccaatagtcgcatgcgattctggttaatgttggaagttcgtccgttcttgaacattatctctagcatattcgacatgagccatccacagacaagccactatgcagtgactctctacctattccccacta

SEQ ID NO: 8580 - DNA, 201 bp, Bos taurus
ctcacctgggagaaagaataattgcaggagttcacgggccatcgtcttccacatgtgcagctccagagcagtttaatttaaagccctgctgcttgggaggggaccctaagaaagagctttagggccatcactggggtccagctataaagaactatgcttgtcaccactttatgcacccaaacgacaagtttcagtagaata

SEQ ID NO: 8581 - DNA, 201 bp, Bos taurus
tttatgcaattttattttaattaaagtgaattatcactgttactctgaggggaaagaatttcacaataccttctgaggcagttgaacacaccacagggtgttgcaaaagcaaggctgaaaaatcactgcttcagagtttctgttaactgatttttatcccccaaatttatcaaaacttgaatctttcttctagtttgaatt

SEQ ID NO: 8582 - DNA, 201 bp, Bos taurus
gatcctgagagaaaagattcatcaacctgaaattccatattcagtgaaaaatacccttaagatgaagaaaaaccaagaaaatttgtcaccagcagacctgctctgcgaaaaatgcaaagggaaataatttcaactgaaggaaaaaatgacactagagggaaatttggatttttaatactgaagaaagagtaagagaaatgg

SEQ ID NO: 8583 - DNA, 201 bp, Bos taurus
agattgtgccacatcttggagtcttcatgccagcaagaggcacaagtctgaagagaatctttcttttccagttcaaggcctgcttatgttcactttagaacgtctgactgaagcactatccttttctttagggggaaacactcacctccactttggcctggttgacacagtcccaggaatcatggacactttccagacttc

SEQ ID NO: 8584 - DNA, 201 bp, Bos taurus
tctagctgtaccattttgcgttcccactagcaatgaatgagttcctgttattctgtattctcatcagcatttgatgttatcagtgttttggattctggccgttctaataggtgtgtaatgttttaattctcatttccttgatgatatattatgtggagcatcttttcatatgcttattggccatcttctttggtgaggtgt

SEQ ID NO: 8585 - DNA, 201 bp, Bos taurus
ctccagcccatggggtcacaaatagttggacatgactgaagtgactgagcatgcacacatggggcattttaacatcatccaaaggcccactggaccattccgctgagttgtcccaaggcagcatcaatcagttcaaaaccaactgcactgtccccatcacccatccagaaatatgggacttctcctggattcctctccaac

SEQ ID NO: 8586 - DNA, 201 bp, Bos taurus
ttaggattgcaaactacctgtcttttaggatggagattaaaatttgatttatggaagatgttcctttgttttcaaatgcccagttgagtaggcccttttagttatgctaatacaaagcaaaaatctatcattcttggtgagaatggcaacacacttatggggccctaaaggagatttcttaatctaaaatgttaatactct

SEQ ID NO: 8587 - DNA, 201 bp, Bos taurus
agcctcaggtttttcatgggttgaaagaggagaagcatatggccctcccaggacacatggactgcagtccctcccaggactgccatgaagatgaaattagcaaacatctggaaaagccttggcccagattagttgctcaaggaaagttatattgtctcttactggggagaaacttttaaagataattccaaaggctttggt

SEQ ID NO: 8588 - DNA, 201 bp, Bos taurus
cctcctccctctccttaggcccatcttttctcctcaactgtcgaatccctctctcttcccctcggaaagctccagaatcagctttaggcctctggaccttccagccactcccactctcactcttcctcctgctcctccctgtctgtctgtctgtcgatccgtctctctgtccaggcaggctcctccagggccgccgtgggc

SEQ ID NO: 8589 - DNA, 201 bp, Bos taurus
gtgcctgagctgtggaaattctctggccgccctggaaatcacagagcctcccaggctgggcaggcttgtccctgagctcactgcgcatgcgggcaaggcccttcctgaagcaggctgtggctgctgcagctaagagacagtcaggagctgacttgcccttggggagcctgccagggcccctctccccagggcacacaggaa

SEQ ID NO: 8590 - DNA, 201 bp, Bos taurus
tggcggaggcggaggctgaggcggccgagaagaaggactcggggccctataagatggaacacttccgctggggcagcccgcccaaggacaagcgctacggcgggttcatgacctccgagaagagccaaacgccccttgtcacgctgttcaaaaacgccatcatcaagaacgcccacaagaagggccagtgagggcgcagcg

SEQ ID NO: 8591 - DNA, 201 bp, Bos taurus
tcacaaagagtcggacacgactgaggaactgaactgaactgaactgaacccctccaatcgctcaaacgtggaaggatcaggcaggcctaatggggactggagtgcaagaagagttcgcctctcttagcctctgatctgaactccagactgagaaacccagggacattgttctgtgatctaactcaggcctggccccaggga

SEQ ID NO: 8592 - DNA, 201 bp, Bos taurus
ctggcccctcttaactctttggattcatctccctctgcagcccctcgtgttctccactcaaactatctacacttctcaaccacagcacttacttaacacctgggcctctgcactcccctagtcccttgacctgcgagacccttccccaccctccaacttcatcggacccctctcttgtgtttctagctctggctcatgcac

SEQ ID NO: 8593 - DNA, 201 bp, Bos taurus
tcgtgtgttctctccccccagaagaagttaaagcagcttcactttgtttcctttcatctccctatcagtcctcagtagtctcaaagtgaatctcatggccgttctcctttggttttccttccgtctgtttttctttttccataaggagtctctttactctttctagtttggccgtttcatttctgcttttgtctttattat

SEQ ID NO: 8594 - DNA, 201 bp, Bos taurus
cttccctagttcaggctactgggatgtttgccctggattatgctacccatttcctaactgagctccttacctccagtcttgcccaaccccatttctatgacgcagtgacctttgcatagtgaaatctgcataaatctttgctttccattttcttcagcaccgagactgaccttgaatcactgtcttactgctggggacttc

SEQ ID NO: 8595 - DNA, 201 bp, Bos taurus
ggccacctcttgataagtgttgtgtgttttctcggccatttatttggactagagttcttatgcaaaggaactggcaactctataattttcaaaagatatatgaggagggcctagtttggtttcttggtccccagctcccctcagctgtgaaaaggattcagttggctccgtggctgtcttcatggtctaattggatgctgt

SEQ ID NO: 8596 - DNA, 201 bp, Bos taurus
gcctcacctgagagagccaaaggcaaagggtacatggagaggctaccattcaaaagtacctgctatgctttgtccacaagtgatgcttaggtaattgggcgtccattggcctaaaaaagaaaaggacgaaggaaaaagaatagaaggactttgatccaaacttcacatcttattaaaaaaaaaaaaaaagaaaaatggatc

SEQ ID NO: 8597 - DNA, 201 bp, Bos taurus
acagagcagagttagaatccaaattccattatggactagctagggaacactgggcaatttaaataagaataatgatagtgccatttctaaaggccattgtgagcaaaaaatgcatgtagttgctttgtgttatttctgtcacacagaaagcacccaataaatgctaacattcattgtcaaaatgatccttgggcctccatg

SEQ ID NO: 8598 - DNA, 201 bp, Bos taurus
ttcctactcttctggaagatattatatcacttactctcttctaaaaataatcctatagacctcccctttctctatgtagtgccagtgtcttttattttactgagaaaataaaagtgattagaaaacatttcaggaacttctattaatacatctgaccatctacctacagccttgctccagtgatctttcttctctgatgtt

SEQ ID NO: 8599 - DNA, 201 bp, Bos taurus
gcaggcatggactgtcagcctcatttatcttcaagaaagcagaccatcttgaagaaagactatacccaaatcccaggaggctgcttcagtgtaaccaccagcccaccagctttgagggaatcttgagtttaagattatcagtgccaatcttttttgctcctcagccctagtggttgagaaacaatgaaaggtgcagggcaa

SEQ ID NO: 8600 - DNA, 201 bp, Bos taurus
caaacttctcagatagccttcttacattagtgaaacaatgcactgaaatccaagaggtaattcatcttggtcaccctgtcttctgcagagcactccagcccgaaggttaatggaaaagaaggctgtgtctgccatcttggatctcattccatttcaattttctggtcacaacaccatgattttctagccaagaggggtgaa

SEQ ID NO: 8601 - DNA, 201 bp, Bos taurus
agaattgggcgagaggaaatgatgaatacagatgtgttgcaacacaggctatatagctagtcctgtggggagctctgtagctagaatggccctttggtgacgcctccaatttagacaagggagttgagccttcgtgcatccccattcaccaatcattggttttgtattggccctggagaaaatgagtaaccatgggtatgg

SEQ ID NO: 8602 - DNA, 201 bp, Bos taurus
aaatgattcaccaagtataatcttagccttaaaaaaatgagggctggctagtcttctctctgtttctgtgcctggtcttccagctatggcccagactaacgggcatcctgagagctggcagctagggctgctgccaataggctctgagacacagtcacttcatcagagatgcggagttggccctggttctcttgaggagaa

SEQ ID NO: 8603 - DNA, 201 bp, Bos taurus
tggaggccagcggggcttttcaagtctccaaaacccatggcgacaactaatctagaactgggaggcagtggaggaaaagaggcgtgcaactggtcagcgctgagcactaagaggaaaaaaggccttttgtaatatttcaaacttcctggtttatctgatgaccctcaacccttctagaagcctcctcctagaatcacattc

SEQ ID NO: 8604 - DNA, 201 bp, Bos taurus
tcctttctgagtgtgatagggactatggcaacaagtgtcacagaccacagctgaacctgcgttcccatccataagcccaggccagggtcacggtcaaacagatatcactgcctcagacaatgtcctcattagctcactacagtcattactgccgtggcaacggcagaatgccttcatcctgctgatggccctgagagggac

SEQ ID NO: 8605 - DNA, 201 bp, Bos taurus
gaaagttgtgggacacacaacttcaacaaagtcatctggcatcgtgcgagagcccattcatttcacctacctagggacctccctccaaacctagagaaaatggtcaaacatcctacctacagtctaggagattgatcaggaagtggacaggaactagtttatatttcctgaaaatatctaaaattttgaagtcttacaaat

SEQ ID NO: 8606 - DNA, 201 bp, Bos taurus
ctaaacagtcacaaagagtcagagtcggacacgactgagctactttcacacgtgattatgccagaaaggttaatttactaattttcaaattaaaaaataacggccataaagtttggccaagttcagaattattttattaagtagcttccccaggttggtggcctgaataaattaaggtgatggagacctcccttttgttgc

SEQ ID NO: 8607 - DNA, 201 bp, Bos taurus
gacctccacagaaaaaaaggcctccgcaatactatcagcgattcctgaaccaaacctggagggtacaccttctctgaaaatagcatttttcaggtcaagggcaccggcgcccacgcagaggccgagcagcgaacacctttaggaggccgggaggtcacagagctgaggggataccgacccggatcgaaggctgtgggccgg

SEQ ID NO: 8608 - DNA, 201 bp, Bos taurus
aagcttctttcttacttaagtccaaggtgagtgtttctggttagcaagccctattcacagtcttacaggtactcagaatccttgcatctcatggcctcatgtcctggaaactcatcctctatattcagcttcaaaaaggaggatggaggagtgtaagtgagagtttttaggggcctggcataaatactgttcacattacac

SEQ ID NO: 8609 - DNA, 201 bp, Bos taurus
cacctttaacagaaacaagacttcaaataatttcctaatttccaaagccagtggacattttccatcccttgattccactggacccttcttaaaattctcacttctcttagcttctgtgaggccacttgttataccatatgatcaactcttacggtttggggatgtggtaaaaagaagatcattagagactcagagacttgc

SEQ ID NO: 8610 - DNA, 201 bp, Bos taurus
actatctcatcctctgtcatccccttctcctcttgccctcaatctttcccagcatcagggtcttttccgatgagttggctcttcacatcaagtggccaaattattggcgtctcaacttcagcattgatcctttcaatgagtattcagggttgatttcctttaggattgactggtttgacctccttgcagtccaagggcctc

SEQ ID NO: 8611 - DNA, 201 bp, Bos taurus
gattttttgctcttcattatgggccatccactttgaagaattgtgttctgccagcttcctctatgacatccaaggcacaagtataatctcttggtttctcctttggccctgtttgatctccactgcatttcctcatagattgtggttcaaggttatagatgtttcctttttttgttaaagatggagtttatatgtctgact

SEQ ID NO: 8612 - DNA, 201 bp, Bos taurus
tgggacttgagcatccacttctgccgggccaagatggggctgaacgtccccaggggttgtcaggggatgaaacaagctccttggcccagagcagagctccgaatgtggcagctgttaacttcttgaggggctgaaggaaaagtcacctgaggaagctggctcgtctagggtgggggtcccctgagaagccattctgcagag

SEQ ID NO: 8613 - DNA, 201 bp, Bos taurus
gagggacaggcatgattaatgacagaggggcctcctaagtaaagcagaaggaccctcctcttcattccctttaaagagccccccacctgttatgccctgtgtcctcaccagggccacaaggggagttgctgattggtttccttctctggttcttcctgagctgagaagaatggattgggctgcagcaaaaggggagagaaa

SEQ ID NO: 8614 - DNA, 201 bp, Bos taurus
ttcaagccaagaagactgttactctccacgatgcccaaatggccaggatttccctctgaaaaaccataaaaagctgggagaaccccaccctatccaggcacgtttatattcagggatatgcctctggctctccttttaatattcagttggcctctccttcaagggcaatagaatgcatgagatcacaacagccttggcttt

SEQ ID NO: 8615 - DNA, 201 bp, Bos taurus
ctgtcctgcagtcctgagcctctccattcttgaccagtggtctgaaccccttatctgtggaacatgctggctcctggccatatggccactcgaatcaggcacttgcctgcctgcctgcctatctccaccgacactcagcggcactagccatcagccacaatatatccagaagatttaagtgtgagttacctcattttgttc

SEQ ID NO: 8616 - DNA, 201 bp, Bos taurus
ggggagcctggtgggctgccatctatggggttgcacagagtcggacacgactgaagtgacttagcagcagcagcagcaaggccatctcacattctttctcgggagttgctaagataagcagggtagatgtgcatgtgtccattttatggatgaggaaacggaggcccaggctggtagaatgacttggcaaaatgatgtagg

SEQ ID NO: 8617 - DNA, 201 bp, Bos taurus
gggatagaacttggtgccgtcaatgtggaagacagacatattccttttcatcactgagtgaccaggagaggtgacatggccacagccagtccagtgggatggggcaaggagagaacaggggaccttcggagccatggcagggggataagtgaaggacacctttgtttttagcctagttgtgtgggcctgggtggaggtggc

SEQ ID NO: 8618 - DNA, 201 bp, Bos taurus
aagtcttaaccactggactgccagggaagtccctccctttctctggaagttgtttccctctcttccttcccactagaacttcccttgtccaggccaccgccatctttcccaaatggaccacagtcctcacttcccactggtctctccttccagtcttgattcttaatcactgacttctcgtccttcagccacggctcatca

SEQ ID NO: 8619 - DNA, 201 bp, Bos taurus
gggaaccctgggagccgctcccctgcatcgtggggcttggaagatttcaaaaatctttggtttgagaatggcttgcaaatagaacaggagactgtaaagccccagcctgggaattgggggccccgcgttctaatcgagccctgcctttaactggctgtgtgaccttgaggaagctcctgtcattttggggccttactgcct

SEQ ID NO: 8620 - DNA, 201 bp, Bos taurus
acccagagtccttccatggacaggaattcactattctcagagcctgtatttccagggagctacaagaaagcagtggaggctggtggaggccaaggaacacccttttgtttgcaaagggtgtgctgttcaaccagtttcttggtccagaatcgtcgtgcacagacatctgcccagtctgtaggccactgcaggtcatcctgg

SEQ ID NO: 8621 - DNA, 201 bp, Bos taurus
tgacagattctttcactattaagaatgtgtagacttcagagacacttttagcctattcctcaatgtccattgaactactatttgtttaaaagagaaaaatgcattctctattctttcagcaagatcatgctttcattcattcacttacccttcaaacccactattcactacttattacatggtagatataaaggaatgaat

SEQ ID NO: 8622 - DNA, 201 bp, Bos taurus
tcatcttgtagaggtctcaaacttctgggctgcagacaggtgtctcctgttagatcagccacagcgttatattagaaagaaagtgcccaaaaaatgtcacacgtttgaatcatcctgaaatcatgccccctgaccctggtccctggaaaaattgtcttccacaaagttggctccttgtgccatgaagatcagggaccactg

SEQ ID NO: 8623 - DNA, 201 bp, Bos taurus
gcaggtacagccctgggtatgcagacaggaggaataggtgagggagtgcaaacttaggttgaaatcatattgtaggaggtgttgactgacctggaaagaattactgggaagtcttgttgggaaataggcagtgaactgggaaggacaagagaagaggacgtgggatttcctgatagtccagttgtcaagactctgagcttc

SEQ ID NO: 8624 - DNA, 201 bp, Bos taurus
gcaggacttaggccctgggtaaatggtctcccatcccgaaattctagtgtataactctctgtgggatagactctcagaactcaagcccttgatctcagccaaaacctgtcttctcagtcctccacattcaccacaattggagtctaatgttccttgggaggggttgctgcatttctttttatcacatcagtaggtcctttg

SEQ ID NO: 8625 - DNA, 201 bp, Bos taurus
tgcctggtgggataggtccttgggtgctccaaggacattccaaagcaacacaggaactgctgttgagaatgatacaacaaatccaaggaaatgaaggaagtggccacagggtagggacaggaatttcaaagaacgagaagacagaattctgcaaggctatctggtcccactggaacaaatgaaccccagtggctgggactc

SEQ ID NO: 8626 - DNA, 201 bp, Bos taurus
aattaatacttcaatacaattaaattttttcctagaaaaatgactaagtgtttgagtggttatttttggtagtaggaattgaaggtaaattttctttattcatcatcctttcttcttgaggggtggtctagtgtcatagttagaagtgtagactctgcagccaggcttcctaggtcaaaactttgacttgtctactttggt

SEQ ID NO: 8627 - DNA, 201 bp, Bos taurus
cttttattgataatgattgggttgtttccagttaggtgcattttgaaaaatgcaggtattaatatcctatgagtatgagtatatgtcctggtgcacatgtgcaagatgactctaatgcagggtgtttcaaagtgaagtgttttcatcagcaatatcattatctgggaattcattagaaatgcaatttccctggtcacatcc

SEQ ID NO: 8628 - DNA, 201 bp, Bos taurus
tttgaccactctcacaattctaaacctaactcctcctgactttgggagcaccatccactttgggttccgccctgttgtttttccaacagtgaggtcctgcgtgtgacttcctccttacccagctttctcactatgccatcattctaagtctccctaatctctgtcttctgtccacatttctcttctggtgcaccagccaca

SEQ ID NO: 8629 - DNA, 201 bp, Bos taurus
tgagggacatatacccgcatttctgtgctgagtgacctggatgagtcctttcacatcccttggcctcgaaatggggccagtagtcccttccttgcagagttacagcaagggttaatgggaacattggatgtgtgcagagctgctgactgcccctgctggccagtggccgcccagccgaggtggactttccagcctcctttg

SEQ ID NO: 8630 - DNA, 201 bp, Bos taurus
cttccaagaggcatctgtttactctgcttaggaatcaaatggccctaagtagaagcagccagcagccccactgtgagcctgtctccttgccgaggggaaatggagagggtctacgcaggcccatgagctgcctgcagggactctatgcatagcagtgacaagttctgaaggatccaaaatggaacaagtaccacttcacgg

SEQ ID NO: 8631 - DNA, 201 bp, Bos taurus
agccaaggaacacctggagcccctggaggctgaaagaggcaaggaaagattctccgctagagccactggagggcacgaggccctacagatgcatgccttcgttttggattttgggactccagaactgggagagaatacatttctgctgctttaagccaccaagtttggcaactctcagaatgtcatacattgtataagtca

SEQ ID NO: 8632 - DNA, 201 bp, Bos taurus
gaggccaggtagataataatgttgaatcaagtctgttgtaaattctgttcttttttggtatagtcattgttacttttcacttctgcagctttcagccttaatcttggggccataatagaaaataatgggggttttggctggctggaaagctcatgacccttctaagaggataactactacctaattccagccgattatgtc

SEQ ID NO: 8633 - DNA, 201 bp, Bos taurus
ggcataccttgactcttggtacaggcacataataggatcgcagtacatgccatgtgtagtaatgtgatacatggccccagaacagtggagatacttagtagtcctgatgcctgtaggcaaagaaaagcacttgattctccatcagtaaatagaacaaatattttcaaacaaaatactagtgacaagagaactatttctatg

SEQ ID NO: 8634 - DNA, 201 bp, Bos taurus
aacacagtcaagttcacaactgaagacagcttgatccacatgactgctgatttatcagtccccactttgggtttttagtttcagtcccttgtagaccctctatccatacaaggaaagcctaatagatttgcatttaggaagatccatagtgttcctccagagtgtcacagctggctggtggaaattccattctgatagttg

SEQ ID NO: 8635 - DNA, 201 bp, Bos taurus
cttctttaaggggtctttccagatggtttgagaggcaatccattcttaagaattatagagacctggatttatatctggttccacagctcactagctatgtaaggaactaagttaggaaaccacctaatttttttgttttaattgaaatatagttgatttacagtattatgttagtttctggtgttcagtgaaatgattcag

SEQ ID NO: 8636 - DNA, 201 bp, Bos taurus
ggattagatgaactagggagacacgcattgcgcacggagcccaacggaatgccaggtgttcagttaagggggggtgacggccatgactctgcttcagatgcgctgcaactcctgctgcttttaaaactcctgcttcgggacttctggtggcccagcagttaagaatctgccttgcaatgcattgtaatagaggggacatgg

SEQ ID NO: 8637 - DNA, 201 bp, Bos taurus
cctaggccacatgctttactggtctataacaacatggattctgatcagcagagagaggaagagtgctgttacttctactgaaatgaaccctgtatttgtgcggcctatgcagggggggatactctttgagagaaaagttacctgtagcaacactcccaagagagatggcttagcttagtctgttgagacccaagaatcaat

SEQ ID NO: 8638 - DNA, 201 bp, Bos taurus
taagtattgctgaaaaaaatggttttaaaatgaccatctgtatacatttgatgtgtatgaatcttttgaaaaacttggccattgcccatgtaggagttataagaataccagctgccatccttggagctgaccacagcttgtgatgacattttttagacttgctataaataataagcaactgatttgggccctgtagtcaag

SEQ ID NO: 8639 - DNA, 201 bp, Bos taurus
tgcaaccaactagttagtagctcaaattactgcttctgtccagatgtggtatcctagctataaaagatgactatgactttgatacatggcctacagccatccatggagaaaatgagtccacccctatcagaaaagatgattaagctggttgcatttacatggaactgacaacacaacacatttcaaactttgctctggagg

SEQ ID NO: 8640 - DNA, 201 bp, Bos taurus
tgactccatgaaccgcagcaagccaggcctccctgtccatcaccaacccctggagtattcttctctaaatacaaaacattcctcttacctatttcctgtcgtaccttattgtacttcagcttccctggtggttcagtggtaaaaaatctacctgccagagcaggagacatgggtttgatccatgggttgggaagatcccct

SEQ ID NO: 8641 - DNA, 201 bp, Bos taurus
aaagtgaaagtaaatttccatatccacatatcttattcttttcccatatgttactgaaactcattagggcttagactgtggcctcatattccttcagtttgcacaaaaacttgaagaatatggtaatatgtgtttccatgttattctctaccatatgtaaaatagacagccaataggaatttgctgtatgactcacttctc

SEQ ID NO: 8642 - DNA, 201 bp, Bos taurus
cacatacacttggttcttagttggtcataatgtgggccataacctcctaagaatcccatgtaatacctttcattccactgtttctccatagaccagagaactcctggccatttcataggtaagagaggtcctgattcagcttttaaccatggaatactcagtcccttgggaagattcccttgttttgaaatacacaattaa

SEQ ID NO: 8643 - DNA, 201 bp, Bos taurus
tatccttcctccagcttttgtctcactaccttggaacacaagataaaagccaaaaaccatggcactgggtcattctaataaatagttgaactattttctgactttaaaatttcactactccataatctgtatatccagttgtgaattcctgtctggggaagatcaaattaaacaaagaaaaatgctttgagatgtgtagaa

SEQ ID NO: 8644 - DNA, 201 bp, Bos taurus
ataaatggcttaaaacaatactcgtgtattttctagtatgttcggcagatcagtgacctgggtgtggctcatctgctttggggcctctcacaaggctgccgttgagggttacagtcatctccaggttcaactggggcaggatctgcatccacgctcactcagtggctgtagacaggatttggctcctttaaggccgtgagt

SEQ ID NO: 8645 - DNA, 201 bp, Bos taurus
ttggaagtgtgcttgctgactcagagtgacatagaggtacatctaacaatcaaattaaatgcagttcagagttaaccatacactgaagtaataagcaggatgtatttattttccatttcctttctgtggccagagattcaaaggataaagtcattaaaaatctttcagatgtttgctttctctggtgaaatgagcgtgtgc

SEQ ID NO: 8646 - DNA, 201 bp, Bos taurus
tctccagtggcacccccatgggatgttccattacacagcaaaagggactttgcaatgtaagtaaggtttcttaccagttgaatgtaacaaggaggaggtcgtctaggtgggcctaacttaatgacaaggaccctttaaaatggtggtatttctccagaacagcagcagaagaggaagtcagagagatgaaaaagactcgct

SEQ ID NO: 8647 - DNA, 201 bp, Bos taurus
gctttttggaggtatcatggatcaaatagaagaacagaagtgatataaagcctggacatgctcgcgaggcggtgacaagacctccaagattgctgtggcaggcagacaaagggagtccagatggcatccaggacagtgtcattcctgtgggctggtggttagaaaatacatcccacaggaagcgattgggaataataatac

SEQ ID NO: 8648 - DNA, 201 bp, Bos taurus
gcccagtacatactccatggaacttttagtggcttgagatggaactgggcaagatctgtatctatgtctgtgacaaaattgatccaaaaaaatattgcttacatcactttataacatataagggaaaaagttatcttcagagtttgatagcaggaaaagtgtctttttgctgactaatgaatagagcttctcaggttgggg

SEQ ID NO: 8649 - DNA, 201 bp, Bos taurus
ggctgggagttcagccagatcaagtgggcttggcctggacgggaagtccgggggcctgaggtcagtggaatccagaagtcaccaaaggccattcagtgggatgggtccaaacaggagaaggatcaagggcgaaaggttagctgcagccaggtctgaccttgctctggccgctactgcaaagctacccttggctgccagtcc

SEQ ID NO: 8650 - DNA, 201 bp, Bos taurus
ctgcgttggaaggcagattcttaaccactggaccaccagggaagtccttggtaggacacttttgagtcaaaaaaagagggctctgtaggattatgcccacatatttgcagtttatgattatgcacaaactccagagataagccattcctgggaggctggcagaagagatcacagactgtatgacaggccaccacagggcca

SEQ ID NO: 8651 - DNA, 201 bp, Bos taurus
cagaagagatgaagcaagagtgaaatggacagacgagaactggcctaaacaattccggaggcagaatgtgggtgagagtagtgtcttttaatgctctcacgccctggacttgagggagggggccaagctgggggtgtttcaggagctgggctcctatttgtccaggagtctctctggggctcaggcgaggaggccctgtcc

SEQ ID NO: 8652 - DNA, 201 bp, Bos taurus
acaaaatattgggggaaaagaggcccctgtaatagactttaatggaatcagatagcatagaacttcctgtcttcagaaggatattttttgaggaagatatttggcctttaaatctggcatttgtagtaataagtataaattaaaaggtgacaaaggggaaagtgtgattgacttgttctaggggagagagtggatgagtta

SEQ ID NO: 8653 - DNA, 201 bp, Bos taurus
tgtctcaatggcctttcctccagtcagtgaattcacacatcagcaaattccccagtctcaggacagtggaggcgttgtttacaggtgactatttcccacgcgcttctgactcgttctcctcggcctctttcactcaggagcgtcagggggcaaacgggctgcgaggttctgggctcgtccctggtcagctactttcaggcc

SEQ ID NO: 8654 - DNA, 201 bp, Bos taurus
gactgtctccttcgtgacacctacatgcgtttctagttccaacaatgaattctagaaatgacatcgtttcatatacagagctatggccaggaagccaaggactggacagctaagcctgccttccccaggaaacaataggttgggaaaatctcattggctcagtgacagtacacttaaggcatgcctactctgagtcaggca

SEQ ID NO: 8655 - DNA, 201 bp, Bos taurus
gggcatattctttaccatctgaactaccagggaagcccttttaatcactataatgggtttaaatcactgttaacgattgtggggaaatgacttcagggtatgtttgcctccttaccatcatgccagcatccaaccacaatcatgacgtttacagctttcacacacatcattataaccaggcacgtgatatcccatgccttg

SEQ ID NO: 8656 - DNA, 201 bp, Bos taurus
cttactctttgaaacttagccagccaacacagtagccactggccacatggggttatttaaatctaaatggtaatttgtttaaaatcaaataaaggggagtcaattcctgagtcacactggccacatttcaagggcttactggtcatgtgtggctggcatctcacacatttggtagcacagggagagatcatttctgttgca

SEQ ID NO: 8657 - DNA, 201 bp, Bos taurus
gcgatttctgaggtctattggatatttggtgggtccttgcatatagattctgggtctcaggtagaagtagatagaggtattggccatagaaaatggttttcaggataaagttcagatacgtgtttgtttcgttaacttctcccattgagtgtggtggtgtgggttagtcactaagtcatgtccgactcttgtagtctcatg

SEQ ID NO: 8658 - DNA, 201 bp, Bos taurus
atccaccaggctctccgcttaggcaaagtcggccgtaaatctctccttgtttacaccgcctgcccggagtgggcactggttgcgcacttagaaaattcccggtgtcagaacaagcaaggcctaggagatcatccaggacacctgtggacatggccccagcgtgaactggacatggggccgggcacaggagtgggacccggc

SEQ ID NO: 8659 - DNA, 201 bp, Bos taurus
tgtgtgccaaaggccccggacacccgtgaaaggtgccaccatcaagcaacgccatggggggccggggccaggactgaggcaagcggggagaggcctcagctaaagagtgggctcgaacgcccttgggttattttggtttcgggtgggctggggtaaaggaggacaccctttggcctcagctccggctggtgatcatccttt

SEQ ID NO: 8660 - DNA, 201 bp, Bos taurus
actggccatgtggccactcagaggatggcccaggggcctagggtccaacacacaaaactgaggcagaggaccccgaaaggccccaggttaaaggaagagacagaggagggagggaaaaaaagaacagagtagtggggaaagcaacttgctttggtatctaaccattatctgtttggggccaaaaaactgatgaatacaagt

SEQ ID NO: 8661 - DNA, 201 bp, Bos taurus
ttgatccctggttggggaactaacttctcatatggtgtggtgaggccaaaagtatttaaaaaccaatctgactggtgcccttgaatagaggagcttgggaggcagacccagaggaaaggccacgtgaggacacagggagatggctgtcgatgggccaagaaaggcctcggaaggagccaggcctgctgacaccttgacctc

SEQ ID NO: 8662 - DNA, 201 bp, Bos taurus
accctcagcactcacatgggctcagccccatcaggccatgctgggtggaataatgaatggttttggattcctcaaaccccacctgacagccagagtaccacggtgggggccctgggtgggttgtcttacatatgatcacggtttcctaattttccaccctgaggaacactacaggtccctctcttccggtggctggttgcc

SEQ ID NO: 8663 - DNA, 201 bp, Bos taurus
gggacatgcagggcgctctcctgaggggccttagtggcaggaggagtaggtgggttcccctgtccagtgggagagcgctgggcaggccgcctgcaaggcgggactgaagctgctcccctgggttcactcactttgggttattctcagtggggagggggcaggacccaagctcagtgaactgggtgtcagccaaggccactt

SEQ ID NO: 8664 - DNA, 201 bp, Bos taurus
gatcttaggtccctgagcagggatggaacccacatccactgcattgcaaggcaattcttaaccaccggactaccaggcaagtcccgtgttacaccctccttttagccagtggtactgcaaaggttgacttctgtgataagcagaacatgttaatggccacatttgcataggcttccttgccccctccccacctccctttct

SEQ ID NO: 8665 - DNA, 201 bp, Bos taurus
caactccagaccttcatcttcagaaccgaaccccagggaggcggagagacaacgtgactgtctaattctttatttactgaattacagactccaccgtcccccagcccccggccctgaggtgcttagtgatgagctttccgagccgctgagcggctctctgaagggacatctcctgagcagcactgtgagaccagcagcaga

SEQ ID NO: 8666 - DNA, 201 bp, Bos taurus
acaggcagtggactggagtcttcttttggagcctgagatgctaaattacaggcttcttggagggatcctgcagcgcagaggcctgggaccattgagaacgcagaaagctctcaagtcccacccctgaggaccatgagcagagctcagtggtaagcagtggcaagtttccagcccggcctcatttatggacagtggtcacac

SEQ ID NO: 8667 - DNA, 201 bp, Bos taurus
gggaggactcatgtgacagcagccaacgaggctctaagggctgaagctgtcatccgagaccactcacacaggcaaggccttcttgccagctctgcccaaccgtcagcctccatgcgccccttccttgtatctctgcaaaccccacctggggcaggggccagcactttccagaaaagccaggagcacacagcttctaatccc

SEQ ID NO: 8668 - DNA, 201 bp, Bos taurus
gataattacaggcctctttccaaagtctttttagagttttattcatatcaaaaaacaaacatcagggggatataaatgggctgactttttctttatacataggataggccttctccaacaagtattttaaactaatatatgtacctagctttaaaaaaaactacagaggggtgtccctgatagtccagtggttaatactcc

SEQ ID NO: 8669 - DNA, 201 bp, Bos taurus
ggttcttcccctgctccccacctgctggcccctccgtgtccttcagacccctgaatccacatccctgagagagacctgcaggtaactcaagaatctgaacccctcctgtgggccaggcgctgtgctctgccagctggaaaccacagcaaggacaaaacagagaagaaatccctgccctccatctcaatctaaattataaat

SEQ ID NO: 8670 - DNA, 201 bp, Bos taurus
attaattacagaatcaacttaaaatggttcagttcgacattttacttcaggatactgaagatatttttacgtataacttggcaacaatgagcatgttttccctgagcccaagttgcccacgtcattacagtgggggtagataacgtcaagaccatccccccaaatctgatacgtaggtttaccttttcttcagctccaatt

SEQ ID NO: 8671 - DNA, 201 bp, Bos taurus
acccctgagccttgtctggaacccggctggccatgccccattttttgacaggtaacacaggaggaaatcaaccctgaatattcgttggaaggactgatgcagaagctaaagcaccaatatctgggcctcctgatgcaaagagtcgactcagtggaaaagaccgtgatgctgggaaagattgagggcaggaggagaagaggg

SEQ ID NO: 8672 - DNA, 201 bp, Bos taurus
gcctagctgaccagagtgccccagagaaggccagcatctcaaatagcaggcgaagaagatcaagcagtcataatatggggttaaaacacggcctcccctcatgtataagctgaagccatgcaaggggcttctttgttcctgcttagatgagaagtgatcagagtatgcatgccagcattaccaggtagatcttgaggcttg

SEQ ID NO: 8673 - DNA, 201 bp, Bos taurus
tgtgcaaggcactaggaaactggccatgagggtgacagggttcttctggctcagagctcaccagctgatacacagaaactgcatgtctggccctctgatggaataggagccacttttcacaggcaaggatcccagccgcctttagtatgcatcgagtgtgtggccctgaacttgggcagtttacaaagcaatgctactgct

SEQ ID NO: 8674 - DNA, 201 bp, Bos taurus
cccttctgtctatttctccatctttgagcaaacaaaaacagctggcagattcaggaccacacctcacccagccaccgccaagttaatgtcacatctgtttttgtgcaggtgtcttccctttggccttgaatgttgacatgtcattgatggtttgcttttcggggaattaatttgagatgtccatgtttcttacaagggtat

SEQ ID NO: 8675 - DNA, 201 bp, Bos taurus
catggcccccttcagacctataaacatgtttgtttatctcacatgatcatttttcatttgaggcaacttctaaaaattgggagttttcacattagaaagtccaatccgccaacactgggcccaggttttcatgtggcaatgattggttggcacttgctttaggtagacaggcactcccaacctccccccgacccactcgtg

SEQ ID NO: 8676 - DNA, 201 bp, Bos taurus
caaaggacaccgacatggaggcaggaaattatcctgcgtctgccccaaactccagctgtgatgcaagtcccttctctgatctcagttctttcatttccaaacaaaacatgagatacttaaatgatctcttcttttaagatctcttctagttcggacacctgtcgcctggagtcactactctcaaacaaaatagtgatgagg

SEQ ID NO: 8677 - DNA, 201 bp, Bos taurus
tccctatgagcttgctctcctcccattacacacactttctccacttcacggtatgaggataagggacatgtgcagatactaacttcaacaggacggccagcgttctcaaagatgctttgcaggcagtgaactcaacctccaccttccatctgtccagatgggtcctgggctgaccagtttctgagactgaaggcagggcca

SEQ ID NO: 8678 - DNA, 201 bp, Bos taurus
gagagaggaacttggaactagatatttggaagtgatgctactaccctcgtgtgatttttttgttatattatatgctaacaatgacaacaaaactcctaaatatatatgttataaaaacttaacaaaaatacattaaaatattttctaaaatgaggtatattgctttgaaccccttggataaaaatataaaaatgataaaat

SEQ ID NO: 8679 - DNA, 201 bp, Bos taurus
caccagggtagtcccatctctgtgtttctgtcacaccaattcttggacctcatctggtgcttaatggatatttcttgaatgttgatggccaccagttacacgagcttttcttcaaaacactgctttctgggatcctttgttcccacctgcagagaaggacgctgtcactagatggggcttaaggccctttcaactctgtcc

SEQ ID NO: 8680 - DNA, 201 bp, Bos taurus
aactgcaggatcaggagatggcagagcacgctcccagacagagttggcttccaagcgttctcaaagttcgctttgaaaataaagctctaaggatgtcactgcataactgggatgacagtttctccaggtaaaagaatatttgtcattctgaaggcagattccttttctcttgacgaatctggaaactcagccttctcttag

SEQ ID NO: 8681 - DNA, 201 bp, Bos taurus
gagggaccaaggaagaaagaagccatcagaacaaaaggaggtggggagttatgatggcttgaagctccctacacaaaggctttcttctgcttaggcccattcttttttcagtcttcctttccggagaatttcccaaggaggcagctacaaacagacttgagatttctgagcatcttgaataaagagaggaaatgcagatga

SEQ ID NO: 8682 - DNA, 201 bp, Bos taurus
ttgctttttacccttaggatttttgtctttcctgaaacaacatgtccaagattgtctcaaaaaaaattatgcagagatttatgcttgtctctgcagcccttggctcttcttgtgtgtgtttttctttataatacacacagtgacttcgcttcccttatatctctcatttcttttatttcctcttcgtatcaagttaaaatc

SEQ ID NO: 8683 - DNA, 201 bp, Bos taurus
gagagcaccaagcagatgtaacaaagttggagccctcagacccctccctcccaccaaggtgtttgggtgcacggggctctcatggccaggagactccaagctcagattctgacttccctgcaatgctggaccagggtcttcagcaagtcagcccccaggcaggacaggcaacccctgctcccctgtacctggccggcatca

SEQ ID NO: 8684 - DNA, 201 bp, Bos taurus
aggcatgtgctttggtccagtgggctgtgtggcaggtggtggctcagggaaggaggagagtataaggaatacagggccatggaagaagcaggaggccagcgggagatgctgtgtgtgtacccggggggacacacggcaagtaacctgggggaagggagccagccagtaatgcaggtatttggggccaaagctcatcatggg

SEQ ID NO: 8685 - DNA, 201 bp, Bos taurus
cacattttcctgcttcagtcaaatccctggtcaaaactctgtgacctcggcacctataaaaacaacccaatcaaagtgttgagattgctttcctcgaaactatcatcctctcccccagccctgcagtaggtaatgaagtcctaaaagtcctaaaaccaagcattgtgatgagatgcattccagcagcttaggcggaattcc

SEQ ID NO: 8686 - DNA, 201 bp, Bos taurus
tgtgcaggagaccaggaaaatctggtgagaaagcaaggccactcttggcttgcaccttccacctgtccggtggttttgatttgtgagcaggcaggacaccgccacccaaccttcagccagggcctgacaggcagactcactggctcacctctgatagcatcactgggttgtttggtgctggtgaaacgtatgaggaagaca

SEQ ID NO: 8687 - DNA, 201 bp, Bos taurus
aaaagaggaggaggggaggaagggggagaggagcagagggtccacacccttccttccaggacagtgtgagcattgctctctgctggccagattctgatcagaattatgagtaagtacgaaaaaagaaggaacaccaggaatgctaggttgattgaatctagaaaggacagaatactaaccactgaaaacaaattacagatt

SEQ ID NO: 8688 - DNA, 201 bp, Bos taurus
cagcgctgtctagaactaacctggcacgtggcaagggccaacgatcattgctgttaatactatcagcatctctgaagaggcacaagatgtccactcacaagttcttccaaggaaatgatggcctttgaaactcaagtctgagggctggagaggttaccgggttgtgcccctctcccttgaagccaggcagcatacccacca

SEQ ID NO: 8689 - DNA, 201 bp, Bos taurus
aggcaagaacactggagtgggttgccatttccttctccaatgcatgaaagtgaaaagtgaaagtgaagtcgctcaggccaccacatcactctccaactcaaatacctcagtcacattatagcgcccagaccagatcgcagaccaaagcccagtggggtgaggaaacgtgtttctgggccctttctccccttgcatgcctct

SEQ ID NO: 8690 - DNA, 201 bp, Bos taurus
atcttgaaaacacacgtctgacttacagagagaacaacatgaatacctaagtacctcttactctaagaaagcatccgcatcattccctttctggcccttgtgggctcagcacacaggtttagtggtgatacaagcatgtgtgtgtgcgtgtagtcgtgtctgactctgtgacctcatggactgaagctcgccaggctcctc

SEQ ID NO: 8691 - DNA, 201 bp, Bos taurus
gtccagtgttctatgaatgatgaagctttcctgtgtacaccacccagtgttgtgtgaacgatgaagccttctagtctacctgggagcaacaggcactgtgcagtcaccaaatgttttcccctataaggcctacagttgtgtgtctgttgctcttactgcctcaggttgccttctcacataccttttctgatcaatacttaa

SEQ ID NO: 8692 - DNA, 201 bp, Bos taurus
gatgatctgaaataatatattctaatactttctaaattttgtccataaagaaatgacagggaagaaaacccttagaataccaaaaaattatctctgaggttccaacatttctcacagtcaagtcataacaattaaacaacctaaaacaaagttacaaagattaaccaaccgaaaacaaagcaaactgaagtaacccaactc

SEQ ID NO: 8693 - DNA, 201 bp, Bos taurus
tcttagaaagcatctccatattgagctcattgccaatttgagatcatatcttgctcacatgtgtttcatgaggatttaatgaattatatgaaaaagtgtgtcatctagtcagcccaaaggtgttcatctgatgacagttacttctactgtgtctccctatttttccattcctctaccttaccattttcccctcctctagaa

SEQ ID NO: 8694 - DNA, 201 bp, Bos taurus
tcccctatggccgttttctgtgccatcactgagtgtgagaaggtaaagccatcagtgcaccagggcatgcgcccacccaagtcctccactgaacagatccgagcagttaccatgctgctgcttcattttgcgtctagtctggacattaaatgtggaaaataagaatgataaaataaagagttgatgtatttacagtaaaga

SEQ ID NO: 8695 - DNA, 201 bp, Bos taurus
cctgcctttaacacctcacctgagcctgtgttttctgactcacaaatggtgaagacgcagaccctcaccttagcctggagctgacaacttacttcctcccatatcccactggccagaaccagtcaccaatatcatctagatccaagaaactggagagtagacagttattctaccaactggtctaccaactcaggagaaacc

SEQ ID NO: 8696 - DNA, 201 bp, Bos taurus
cgccaaaggtcatgcagtctaccgaggaggtcatgacctttggaagaacggcctccacttataaatagctgtgtattgagtgaaatgaatggaaacccatttatattttggaaaatgtaattgggccgatggactatgaggagaggggccccggaagagaaggggaggaggtcgctgccgccaacgtgctgggtcagtgaa

SEQ ID NO: 8697 - DNA, 201 bp, Bos taurus
aactctgtgttgcttcagacccagcagagataggaagacacagaaatcaagaggacagcccctcacaatcattatcttgttgccaaacacttccctttgcgtacttctctccagtaagtcaattggcacatatagaatgtttctggctttttctttgtctgtgacaatttttttttttttttggttcaactgatggtgtat

SEQ ID NO: 8698 - DNA, 201 bp, Bos taurus
acggggatattttttatcttggcacttgtctgctcacggagcattcaccgggcaccaagtgagatgcatttgcatgctctgggcgatgtgccaggccctcggggatacagaacgagtagtgagcgccttttctgggctgctaagtgctctgcttgtgttctctgttcaccctcacggccccctccattgtggcttccccca

SEQ ID NO: 8699 - DNA, 201 bp, Bos taurus
gcggcggatacaggtgaaggcctctctgacggtgtggcatttgatcagaggtctgaagtgatagagaaagccatggcaacagctgggaaaggagcatttcgggagcagcagcagaggccctgtaactactgcagtgatttcttacttgtgtcttatcacttactgaacttggaggtccttgaaggcaagggttacatctta

SEQ ID NO: 8700 - DNA, 201 bp, Bos taurus
ttcatagctttctggatcccaactatccttctgccttctcaacacaccagacttcaaaaaagtactggctgttctctagcacctggaactcactgttccctgacctgtcttttggtcgcacctgcttacctttcagatcctgtctcatttagaaagctcttctctccatatctgcctagaaataccatcctgcaagtgcca

SEQ ID NO: 8701 - DNA, 201 bp, Bos taurus
acagtccatagggtcgcagagtcggacacaactgaagcgacttagcacacaccaagtcctggaattagactactgcagtggcctcccaacgatgctctccgggtccactctgtccccctacatttcatctgttaatcagcagccagagagctcctaaaaagtcaacctcagatcacgcctctgctgaagggcctccagtgg

SEQ ID NO: 8702 - DNA, 201 bp, Bos taurus
tgctatcaaacggcagttgttccttcttgcctgagggtatgtgttctttcccacggttatgaacaagcaagatacagattcagtttagcaaatgcatggtgtatttaaatattgctttatcatatttctgagccaactgccaagttagccagttttctggagaggactccctctagtgaccaacagactataatggtgagt

SEQ ID NO: 8703 - DNA, 201 bp, Bos taurus
accttaacatttgtcaagctttcaataaaactcatttacacatccttcaaattgacatgaaggaaatgattattacttctactttgaagaaactgaatccgagctctctgataacttgctcagtcatgctctcttactagggggagagccctgagtctttttcaaagttattgattcagttcccctactcctgaacaaggc

SEQ ID NO: 8704 - DNA, 201 bp, Bos taurus
agcccttaggggcctgaaaatcagatgtgatcacctccagaaagagcattcacttcctattctctgcatcaacacctctagattcaatataaagtggtgcatctgactggccaagtcttggtcactcacccaagctctaattcccgagggaactggaaaaacaatactgctacttttattttccataaaaataagggaggt

SEQ ID NO: 8705 - DNA, 201 bp, Bos taurus
gaccgctatgtagctatctgcaaccccttgcactatgtcactgttatgaaccatggacactgcatattgctactggccttctccacagctttctcctgccttcactccctcctgcatgtcctcctggtgaatcggctcactttttgtgcatcaaatgttatccatcactttttctgtgatgtcaaccctgttctgaagctg

SEQ ID NO: 8706 - DNA, 201 bp, Bos taurus
aagctgcagcagaccctgcagatagcagagatgctccccaagggggaggcagagttggtcagagggtgaccgtgctctccaaggcaaggcagagagaaaaaatgaatgaggaacataataaatgtttgtcagaactgttgacaagcttttttcagaatctaaaaaaaggcttcagctttatctcaaagacagaatggcggc

SEQ ID NO: 8707 - DNA, 201 bp, Bos taurus
taggtattagctgagaggaaaatttactaaaatgatattactgatttggaaaagcccgctgtaaaaatacttttaggttgttagaaaatttgaatgagatctaggaattagatgagaggaaaatttagtgaaatgctaaggtagatactgttagttgaatacagcagactgtttaactatgtgagctcattttgaaaaaca

SEQ ID NO: 8708 - DNA, 201 bp, Bos taurus
ctctaggtgctcagccgctggttactgtagctctccactgtctccctgggtgactccttccaccctacagcctcagctgtcaccactgcgtaagtgtttccgaatctacattagctcaaggcctgaatttccagctgctttttgatctccttgcggaagtctgtcaagtataccagaaaaggtataataatacggtccatt

SEQ ID NO: 8709 - DNA, 201 bp, Bos taurus
ttcattgctggataactctattggctatgttaaaatcagatatgtttcttaaaatgtccaccactggtcttaagagttcaggccacttttgctcttcaaagatgtgaagatacttgtatcttttttcagcttctctagtgtaaaaagccctagtctcttcaaatttgaaacagtttacacagtctgcattctctcccaggc

SEQ ID NO: 8710 - DNA, 201 bp, Bos taurus
cgcccccaacatggcccaaccaaagggcctccggaggaggcttctcctgacccaccccaggggagtcagtgcctctctgtacagccccactctcctcatcgcgtgtgtagttcccccagcaccaaccctgtgttatcactgagtccagtagtggccccgggtcccatctgcctgacccagggggccctgtgaaggcggggt

SEQ ID NO: 8711 - DNA, 201 bp, Bos taurus
ggttgggtaggctcctaaggacagatactctcttccagctgtggcctgtctaggcctccatgttgtcaactcaccagctggccacgtgactgctgggagacgtggacatgagccggtaagccccaaagtgtgactgacacgaagtcccagagaagagagggactctttgacctctgccagtctctgcctggccctcggcgt

SEQ ID NO: 8712 - DNA, 201 bp, Bos taurus
caactcagatgaaacacttaaaatgatctagctgtccacttccctgtttactgtgtctgtttcactagactgtaagctccttgaggacatctgtctctagatgctactatgggctgcctcatttcctcctttctttcttaacacaaccacgatttgttcatgccctcaccctcctccgtgaggacaagtgtttcaggcccc

SEQ ID NO: 8713 - DNA, 201 bp, Bos taurus
gcagtttctgaatgaacacatgaatgaaggagaggcaacagagcctagacatgaggagcacggggtccgaagccagtgtgtctgagctctcactcagcgccaccactcgccagctgtgtaaacttgcacgtttcacttcacctctctgcacctcagttttctcctctataaacagtgcctacatctcacacttgtgatgag

SEQ ID NO: 8714 - DNA, 201 bp, Bos taurus
cgtgaattaacaggtccccatactgactacctaccaaataccaggcactggaccaggtactcttggcggtgtaattttaagcactcttcacaaaaatccaatgagatattattctttccaacatatagataaattaagtctgggagagagtagtaactggtcaagttactactggaccccaatgcaacaccatagcccata

SEQ ID NO: 8715 - DNA, 201 bp, Bos taurus
tgaagacacagattcccaggtcccagagattctaattcagagtatccagggtggggtcctagtaaaaaatgttaagttccccaagtgagtctactacataatcagtcaagtttacggcctacttagttaattaatagtaccaacatcgaccacaagtaggaagagcccatagagaggagggagacagaaaattcaattaca

SEQ ID NO: 8716 - DNA, 201 bp, Bos taurus
gctggtgtgtgagacttaagtcacgagctggcctctgcccacctctctggtgcaggactcgggccctgtccatctctgggtttaaagccagccaagtacacaccaaattcacccatgctttatacgctgggtgagccctctgcctgggggtccttcccccttctcccttcaaaaactcctgctcagttgctccctccttta

SEQ ID NO: 8717 - DNA, 201 bp, Bos taurus
acatggccaacattaaaatgtgtgactgtaagtctgctgggaaccgactatgtgtttatgtgtctgtatgtatctttgtacacaagcgtgctgtatgtgcgggcccatgcacatatgtgtgcctggaggtgtgcaccagtgtgtcaacacctgtagtctgtgtgtgaactcatgggtatgtgacatatgcagctgtgtgtt

SEQ ID NO: 8718 - DNA, 201 bp, Bos taurus
tgtgggggggcaagcagaatggtatgcggcgggcccactgtgtgaaggcacagtgctggctggctgattcagctgtgcccgaggagcaagggtccactgggacctggagctgccttggcccctcccaggggctttattttcatcttctgaagtcactaaactgaccaaggaggtgtgttaacaaagaagacatggtttaaa

SEQ ID NO: 8719 - DNA, 201 bp, Bos taurus
gactctgtggctggcagggttgccagggcccaccttggtctatgaatgagaatctgcatgccctcaggactgggctgtgggtcctgagaccttctagactgtgaggcctggtggaaactcccaggaggagatgcaggaactgggcgtctgggcagtgctggggctccaaccttgggcccgggcctctccgccatgctcctg

SEQ ID NO: 8720 - DNA, 201 bp, Bos taurus
ttcagtcattaagactcagcacttgcactgcaaggaccatgggttctgtccctggtgggcaaagttctgtgtgctgcacggtgtggccaaaaaggagggggaaaaaaaagagcactctttcctctgtaccttccaggattgctattatcgtgcctcactttgttgcacttgggactccctggtagctcatctggtaaagaa

SEQ ID NO: 8721 - DNA, 201 bp, Bos taurus
cgtaactaaatcaataaacacggtggtagcaatgtgtcagactgcaaggtccaggtatcagcaccaaacagtgatcacaccttagctgaatattgaaggacaggggtttttaattttttttttttttaactttttgagtaagtgtatatttacaaaattttatataaaatgtgcttttcctcccttatacactccactaaa

SEQ ID NO: 8722 - DNA, 201 bp, Bos taurus
gaggcccactgaggcaggggacttgaccgaggccactcgcctgaggggcttacagccagtctgccgaccaggaagccctctccacttcctactttgcaaggcttttcactcttcaggggccagcccctcctctcccccatggccccagtgctggcagcccggtgggcctggggaggatcccgggcagtggtgggtgctgct

SEQ ID NO: 8723 - DNA, 201 bp, Bos taurus
tccagggcaatgactcagcgctctcactgccacggcctgacttcaatctctggtcaggaactgaaatcctgctttaagtcactgcagaccgaggccacccaagatcaactccatgccagcagatccacaggagggggacggagccacttgtgtggctgagtgtgagagttcaggctcagaggccaggttggctggtgttga

SEQ ID NO: 8724 - DNA, 201 bp, Bos taurus
tgaaccaacaccgtttctctccaacctcaaagatctgaaagttaagaaacctgaatactcctggctagagaactgagccaccccttctgttgattctacactgggggccacgtgtcctgccccgaggggagaggcctctgctgatcgaggaagaacggaggtgctgggggtggggagcagttcagacggcctggctcgtgt

SEQ ID NO: 8725 - DNA, 201 bp, Bos taurus
ggggcaagaaagtcctttgaatactgtgagactgcatttcccaaaccgcacaattaagaggagattctgagccaacagatctgggacgaggccaggagttagtgattctgatacacggtcatggtaggaactgctgctttacagtagcatgtaaatgacaggccttccctgtcttgattcttacatgggtttattggcagc

SEQ ID NO: 8726 - DNA, 201 bp, Bos taurus
tttctgttctgctttatatatcagtgttttatacattgagttattaaatctcatttctgggtatgtaaataaagtctgcttatggatcaagtctagataaggtacagatatagataaagtactttcctggccttcaagacgaaatgggagattctgaatggtgataaatcactatatacatacagtatttacttttaagcc

SEQ ID NO: 8727 - DNA, 201 bp, Bos taurus
aatatgcagctaaagttcagtttaattctcagataaggttttcttggacacataccattttcttctcatgtaaataaaaatcagtctacttggtttttaacacttgccactttacaaaataaatcaaaatgttgcagagtacttatttcttttctttagtgcttttataaggcatttgtgttaccactaaatatatggatt

SEQ ID NO: 8728 - DNA, 201 bp, Bos taurus
agcaggggagaaaaggaaggtcccttgctgggcgacgtgaccagaggaaccattccccaccccaaattccttagagcttacagccctcctaactctgtctcgtcgcctgggcccccctgaggacagcgtcctgtggggcggacgggaggtgtgtcacagacagtgcgggccgaggggacaaggaagaccctctgcttgggc

SEQ ID NO: 8729 - DNA, 201 bp, Bos taurus
ctggcagggtatctgggctcctgacatgcagtgagcccctgcattacccagcctgctttgcagctgagtggggcccacgtgactagttctggccaatgaacagagcagcacctgtcacttcaggtctgaggcagttaagacctcgtgtgtttgtcaccactttcctttcctgccctggtgaccttagaggccacacgtcca

SEQ ID NO: 8730 - DNA, 201 bp, Bos taurus
ccagtatttccaggggggcccaggcagattctcctgggtcgataggcaatgaatgaagccacccttaccagtattcccagcccttgtgactctgacctccgactttggccgttcacacccatttctatcctgggtgtgatagaaatgggaaatgtgttattttccccaaacaaaggttattgcatgagcagacttactgaa

SEQ ID NO: 8731 - DNA, 201 bp, Bos taurus
gaggagctggcaggactccacactcctctcccgccttccctcgtgtggctgcctccagccagaccgacctcctggtcacccccacacaaggcctcctgcttctgctcctgtgctctctgtcctttctgcccgcttcaccccctttctgtgccctaaccccaccattttttgcctggccaacttgtatgcctccttcaaaca

SEQ ID NO: 8732 - DNA, 201 bp, Bos taurus
ttggggttttcaaacacacacacacacacacacacacacacacacgtcttttttttcctcccccaattcggagccttccctggcctgttacctgggctcatgtgagtcaagtccatctcctcttggctcctgagcacgttgtccttatcccccacccatctctgctcgggccattgctgtgtgcctcgtcttctaccagcc

SEQ ID NO: 8733 - DNA, 201 bp, Bos taurus
ccgggccccgtgcctgctgccataatggctggtgctctgctggtaatggattgagccaccacactgttctccttctaaaccagccctgcacacattcactgcagacctcaggccctgagcctttggtacaaactcctggtctgctctggttcattcctgaaaacacttgattaccgctcccttcatttgcagtcccttcct

SEQ ID NO: 8734 - DNA, 201 bp, Bos taurus
ggttgccgagtgccctggtgggtcttcacactgcgtgtgcccttaccgtgtacaggatatgcactagcacgtccgtgtggccgcacacacacgcaggtgcgcaccaacacacacccagggctcccaggtagagtttgctttgtgcctgctgttgggtgttggcctttcagccagtggtttatcaagcccagaagggctgct

SEQ ID NO: 8735 - DNA, 201 bp, Bos taurus
cttgggttcaagtccatactcctcgtcgtgacctaggatgtcctgcggtcagactcctgtccacacctgcagccatggccttcctctgacccagccattcgggcgtccaatggatcgagttctttcccacctcaggacctttgcatatccagtgacacccttgcccccgcctccaacaggccacctccaattcttccagac

SEQ ID NO: 8736 - DNA, 201 bp, Bos taurus
gaaggttgagcccaggccgactcaaagggatggagacatacatgcacacatacacgcttcaaggcacacccatgcggatgtgcacacgggtacctagacatgctgagagagacggagaggcccctgcgggtcagccctgccccgtcaggaaggggaaggaggccagacggggacaggggagccccctctgacagcaatagg

SEQ ID NO: 8737 - DNA, 201 bp, Bos taurus
tgggctcttctgtggactaatctgcatgccctctggcagattctagattccaggagctgctggtcatggtcctgcctcgaggaggacccctaggcttgtgaagggatgttgaaggctgacttgcccctggagactcattaggggtcaaagtgtcgttggaagttgggacagttggtgggatctgggaaaagaaaacacctg

SEQ ID NO: 8738 - DNA, 201 bp, Bos taurus
agcccagaactagacccagacaaatataggcaactgacctttgacaaatgcatgagggcagttagtggagaaagggtaatttcttgaacaaatagtactgcaacggttggaagtacttttgtgtgtttgaaaaaatgaacctgcaagactttaggccttccgtaaaaatgaaataaaaattgaccatagacctaaatgtaa

SEQ ID NO: 8739 - DNA, 201 bp, Bos taurus
taggattctggggctggaaggaaagtctttagcctaagagcttggagggcgcaaatgtgtgtctccctcagaatcagtactggatttgcagcctgaaggcggcaggttccagagaacccgagggtcagctggagccagcatgaggaagcttccagaagcaagaggaagcttccagaggcaccctggaatgaactggggtag

SEQ ID NO: 8740 - DNA, 201 bp, Bos taurus
aataggaaagaccactttgaggaggtgacattggagctgagatctgaaggaagagaatgagccagctgtttgagtttctggataaggaacatcctgggccacactgtgtgttgaagctttgagtggaaatgagttttaacttgtgttaggatcagcagaccctaggactcagtaaacaaaagagagtgctgggcagagcag

SEQ ID NO: 8741 - DNA, 201 bp, Bos taurus
cccaggaatcaccctttcaaggggcattgaggcccatgtcgggtgggactgtgggttggagaggatgccaagaagtgaaaaacaacgaggtgacccagatggggccagaaggcaaaggtgaggcctgaagcagtggaactgagaggggcagagtagggggaagaaggaaattcatctctcgtgctgggatgcagacgagtt

SEQ ID NO: 8742 - DNA, 201 bp, Bos taurus
gactcagccggggcttgatttcgggccgtgcaaacccctgttgcagggaggaaatggtcgttcgtgggtttggatgaaaggctcgacttaatggattttttaaaaaatggatgatggagattgtggagctgcagcggagtgagggctgacggtggtcatatttggaaaacggcgtctctggtgttaataagcttggcgatc

SEQ ID NO: 8743 - DNA, 201 bp, Bos taurus
ccagtaacacgtttctagggacctgaagctgtttgtttggcccaggagagtcatgagaaactgtggttcccccaccaagtgggtctcctgtgcagctgagctccttagaaggcctgcggaagtgtctgcatcacattgcccaatgatttcatctttcttgtttgatttttcctaagtatctcacgtgtggggtgttcgttt

SEQ ID NO: 8744 - DNA, 201 bp, Bos taurus
ggctctggcttgccagctcgctcacgccacaggtcacctgctgctcagacagctgcagccccctgagctttaaatgatcacaaccgctatgcacagccctccagagggggctggacatggagggatgctgcaggcacggcacctaagcctgctggctgtggggtgaattcctgatgatgaggaaggcttggcacagggcgc

SEQ ID NO: 8745 - DNA, 201 bp, Bos taurus
agcatctcaaagagttggatatgaccgagcgactaaaccaccactacatataaagaaactgagattctcaatttctcagtcacccaaggccaggcagcaattggagctcaacaggtacctggagctctaggtgaaccgatttgctgcagtccagaatgccccctccgggcccctccaccctcccgggtggcacacacatgg

SEQ ID NO: 8746 - DNA, 201 bp, Bos taurus
caggcctgccgccccctgtgatttctcagagcctttctttctccccagtggaacttgacttcctagggctaggcgggggccaacctgatgcagggttgtaagggtggggagagctgaggcagagctcagatagtggttggaatgtcacttcctcctcctcctttgctccaggcaggccagtaactgtccttccaccatcaa

SEQ ID NO: 8747 - DNA, 201 bp, Bos taurus
cagagtgggcccacactactcgcagaaccacaagggcctgtgggaggtctgcagcccctgcgggagcaccaatatggagctctggtggcagaggagggggtactaggaggctcagagggccgagtccaatcagaggctgggtttgaatccctgcttctagcacagttgctgctgccgctaagtcacttctaagtcacttca

SEQ ID NO: 8748 - DNA, 201 bp, Bos taurus
gatgactagatcagtgacatccacagtccggctcccaataaggagccctagacccttcttgcgctgagatttccacctccaggaaagtggcctccagctgtggtcaggacatgtactctagctttcggtggtcttcgaggagtgagaggtcatcaccacctctggatctgcccccaggtggtcccactgctcctggtccct

SEQ ID NO: 8749 - DNA, 201 bp, Bos taurus
aaaaaatggcatctgagccctgatgaatgagtaggactgagctggggagacaggcacagacttacaaggcaagagcgtgtgtaaaggccctggggtgggcagtaggagtgtgggggctacagtgtaactgcattgtgatgacgaggcgggagaggcaggacctggagaagagggaaggggcagatcatgagggcccttttc

SEQ ID NO: 8750 - DNA, 201 bp, Bos taurus
gacctcctaggtgaggggctgacctggagaaagctggagagtgggggaggaagagaaaacttatgaatgaattcatgtggtaccaggggcctggggagaaatgttagacagtaaagaagcccaactttagtccagttttcctgtggctgctgcaccagcttgattaccttatgtgaccacttcagtggccatttgaggaag

SEQ ID NO: 8751 - DNA, 201 bp, Bos taurus
agagtaggcaggcccaggcaggagtcggggagggtcatcccctggggctagtgtggagggaggtagccttccatgccctgtggatagaaaccaagtctgggctttgtcccccagggccgcagcagacgtccagtgttagcggcgaggggtctgccagggtggggtgcacaagaggccgaatgatcctgtcccccactgcac

SEQ ID NO: 8752 - DNA, 201 bp, Bos taurus
caggtctttagaatccaaagggaccttggagatgtccttttcctaatttacggactggaaaagtaaggcaaattctaggtactagagtcagagccaagacaagactgaatgagggcctggggtcctgagaggcactagggtgggcactcgtgcccagagacccagagctatgggggagctggtgtctttgtatataggcca

SEQ ID NO: 8753 - DNA, 201 bp, Bos taurus
cctctactgttgccccgtgagtgcctcatccccggaaggcggtcaggcaagactcacatcctcaggtgacggacaatcaccagaagtggttgtctcagggctactgccattcttgatctttctttttttcttagctcctgcaggaacaccagggctgttcttctgctgatactcccttaactgtaaaaaggaaaagcagtg

SEQ ID NO: 8754 - DNA, 201 bp, Bos taurus
cttaaagacagatacggtgccattgtggcatacggaatgtgggaggccatgtcaggcactgggctgggatctgattttcctaattcgaggggcacagggagagagactgaatgggaacatggccagtggggccctctgaaaccatcagtaaagaaatagtaggattataggttggcaggaacgtgagctgagtaaatttga

SEQ ID NO: 8755 - DNA, 201 bp, Bos taurus
gccccaagagccagagactcccaggcttcctacttggaagctcccccaggactttggacatgtacagaatgagctgaatgaattcaggtctcacttcgagggtcagaatgttagtctgcttttgttttttcatgttttgttctttgaatcaatgctgttgatgacaagctgtctttaataaattgtgttctttgcagtagg

SEQ ID NO: 8756 - DNA, 201 bp, Bos taurus
ggaaagtcagggctgctgctcacacttgtccagcagctgcccccgcccctggcccccgcccccgggcaggctagctggagaagctgggtgtgggagccgtgcctgtccctcagccttgtgccgggccctttctggaaggctcactgttcccttggcccctccttcacactcaggagggttgggaagaaagggggacagcag

SEQ ID NO: 8757 - DNA, 201 bp, Bos taurus
gcaaaacaggggtgattctggcctcacagagctcacttggggaggctgacattccttaaataatttcacattttaggaccaagagaagtggtatgggggtgggggagcgtacggggccatgaaggccaaccgttcccatgtggaccgcaggtggggatgtccgggaagacatctttttaaattatttgtttatttttggct

SEQ ID NO: 8758 - DNA, 201 bp, Bos taurus
ccacaaccctttgtgtgctgaggagggagagctgagtctgctttggcctagactttgaggccagctttccccagctcagatccaggcctctgggcattgggaggttgctgtgcttgtgtgactggctttgtccccagattggcagctgaccaaggaaaggagggacccagttttgagggagggccaagagtggaggagagg

SEQ ID NO: 8759 - DNA, 201 bp, Bos taurus
tgcctgaaaactaggggtggggaataatagagcatgttatttagtgatacagacgtaaatcccaaaagcaatagtaaaagagtagaagttgcttgcccctcgggatcagaaagatggacgaatttgaggatgggggacaggaggctgaagttttcatgataagtctgtggacctacttgatgcattaaactatacgcctgt

SEQ ID NO: 8760 - DNA, 201 bp, Bos taurus
catccttcagccaacggggctcaacaccagggccccccagagttcagaagcaggattcctgcgttctaccagaaggcacgatgtccacagtgttttgttttggtttttcggccgtgccacgcggcatgtaagttccccgaccagggatcaaacctgtgccctcttcagtggaaacacagtcttaaccactggaccaccagg

SEQ ID NO: 8761 - DNA, 201 bp, Bos taurus
cccagcccttaggcaagcacatacagaggttttacccagagaccaagccaccccactgggcaccctcccaccaggcagggcgctccacgcggctggccaccggcaggtgctcaccagcttctggctccaggaacaggacgatttgcccacctgctccaggagggctttgaggtccccccgctgcctctgggcggtggccct

SEQ ID NO: 8762 - DNA, 201 bp, Bos taurus
agggagatgggggtgcccggcagcccccaggggcaagggggcagggtgttccccgtccagagggagccgagctgctgctagcgagaggccatgcctccccgggagccagggaatctccaggtgtcctgggaatgaaggtcactgaatacgtgaccctgatgctcgggctgggccccccgaccctgccagccaggcccctcg

SEQ ID NO: 8763 - DNA, 201 bp, Bos taurus
atatttaacttttttttttcatattcaggtatgaattttacactcatgacacatctcagtttgggcttttcacatttcaggagctcagggatcatttctggtttgaggttgccatagggacagtgcagctctacataaaatattctaggacttgtctttctggttttattttatttccttaagacacttgatacaaaggtc

SEQ ID NO: 8764 - DNA, 201 bp, Bos taurus
gcctgtggaaccttgctaaggtggaggtgggccagggattccaggtggggcagtgacagattcaggcacatcacacctagaaaagcctaaagatcattctttgtgattctacattgtacacctggcccagagactggaagatgcagagagcagaagggaccttcccatgttacgctctgggcagggagagaggcaggccca

SEQ ID NO: 8765 - DNA, 201 bp, Bos taurus
tgaagagtttgggagaacattagatctggctgcctcagtttcccctccacttcctctgtaatagctccacagaggggggcccccatccatccacgccccccccccaattttcttgaggggcagtgacatcttagaggaagaaacaaggatggagcacaaagtcagaggatggagacgtaaagagaggccagagggaactcc

SEQ ID NO: 8766 - DNA, 201 bp, Bos taurus
cttcccaagtctgcaggggccctcagggctttcatttttttttcttttaagtggaacctctttctctgcccctttaaccgaccagccagcagctgcttagggggtgagagtggcccggaggtgagcagtaataagctctagtgatctgctttgaccccaaacaccaggaggcagagaagccccccagacagtagctgcctg

SEQ ID NO: 8767 - DNA, 201 bp, Bos taurus
tcccctgcagtcttgctcttcagacagactcagactccatgttgaaacctgggaggggacggtctcacttccctcattggcctttatagcaacagactacgtcacatctcatccactggcttcttcctttggtggtcagaaaagaagtctccctgacataagcccacccccacgatcttgataacagggccaaccccagga

SEQ ID NO: 8768 - DNA, 201 bp, Bos taurus
ctgcggaggtaacatcaaacctgcacacactggaaaaccctcggagtctaagacaatgggtcagctcctcagatgccaagggaacctgggctccttgccaagctggccagccactctgctcgcatctgtgaccagctgagcaggggcccagatgtcggccagcagaggtcactgaaggaggtgggggttggtgtgtctgct

SEQ ID NO: 8769 - DNA, 201 bp, Bos taurus
aagtcagcatcctcgcgcgacagagcagccaggtaaatgtttctcttttgccacttttatgtgatgttgttctcagagattttggagggtttaactgtgacgttaagatttagctgaagtcacaccccttttattgagtttccagatgagagcacagcttaaaaaagctgttggccaaatggctcgggtattgtgttggac

SEQ ID NO: 8770 - DNA, 201 bp, Bos taurus
catgaggtactagaatggagagatttgagagagaagagctaaccattcattgctctgtatgggcatagaagttatatctcactcagtgtcagaggaaatgatcatataacatattttctccagtagaagtgggcagacagcatccagcatccttgaaagataaaagtgccaacctgtcagtttgccagtattttctgttaa

SEQ ID NO: 8771 - DNA, 201 bp, Bos taurus
agaccctaagggccctaagttgttgagcccttctgagcctcagtttccccctctctaaaatggggataatgctaccttgcataatgctggagcatccagaactgtgtggcccaggcgggcacactgaagggtcaagaaaggaagacagagcttcttgggctgcacccgcccccgcccaagaaccacatgtccctgctgggc

SEQ ID NO: 8772 - DNA, 201 bp, Bos taurus
cagtaatctgttatagcagccacaacgaaccaggccaaatgctggctctggggtcctgacgtgtgctcactgacacccccacacccctgaagcatgaaaacgcacagagcactggagtgggccctgcagtaaccaagccctaacttatacacacgcgtgcacgtgcacatacacacacacacagtgggtgccttttctgga

SEQ ID NO: 8773 - DNA, 201 bp, Bos taurus
tctggctagagggtggactaggggagcaacagcagagccagaggcgttattgtcatgggaatgactgatacctgggcccttacggtcagtctggtatatttatttcgttccttcctcctgcagcctgtgaggaagcactgcgattatccccattttacagatacggtaaacaacgggccctgatgctgggaaagattcaag

SEQ ID NO: 8774 - DNA, 201 bp, Bos taurus
acacttccaccgggaggaagggggagggggaagcaaagacctccttcctctcaccactcccttaagaaccccttccagcagttggacacaatccgaggcacgtctcaatggccatataactgtaaaggagttgggatatgaagtctttatcccaggctgaagctgggagctctatttggaagggaagaatggaagtgtgac

SEQ ID NO: 8775 - DNA, 201 bp, Bos taurus
gctgagcagttgtagcaaggtgtcgaccgtgtatggagagccaggggcacaggtaagacgatccacgggcttatgggcagtgacgagtggtccagtcattcggtcaagggcctagagggaaaggctggaaggtcagcacaagaaagtctaaggtgcaaggacgttcctggtggtccagtggctgagattcctcactccccg

SEQ ID NO: 8776 - DNA, 201 bp, Bos taurus
cccatagaacacccaacgaatgcccccttttttgcatatgtgaacacaagtgtgtctcttccttgaaaccaaaaaagcccagagaaggcaaaagtaaacgttggcctgttatcacctgtggcaatccccagacaagcccattaagcatgattatttcaagcgctggagcttgtcgaggtctcactggcctccaaggggagc

SEQ ID NO: 8777 - DNA, 201 bp, Bos taurus
aaaccccaggtggaagaagttaactacaggatgaccagactacacccaggacttgagctgccacaatgccgagaagtggccacgaagaaatgggaacaaatggaccctggaactaaagatcgactgtacctacaacaaccaagatgactctggtcagaccaccaatggccagtctgaagatgactgtgctatttctgcatg

SEQ ID NO: 8778 - DNA, 201 bp, Bos taurus
gtgccccgcccccagcctggtgatccgcaggatctatgtagctgtaaccggggctaatgaggcatgggccggacatacagggccgggcaggggaaatccaactggggaagaggcaggtcaattccaggctaattgcgaggtcctgttctgctgctgccctggcttggccgcctccctaccccttagcagagggagcatggg

SEQ ID NO: 8779 - DNA, 201 bp, Bos taurus
tgatggccccccacacaaggcctattaattatgacgtcacacagaatccaggttttctgaccctctggtctagggccttcctaccagaacagagactgattgcacaacgccaggggaccctgcttacagaaaacatggagtcagtggcggcctctgaggttgtgtgggagatgagggcttgcccgactgtggcaccgaccc

SEQ ID NO: 8780 - DNA, 201 bp, Bos taurus
agaggaacgcacgtggggctgtgccccgtgagggggtgaggggcagagggcagagtcagggtcgtctccgccgctgggaatccggcctgggtatgtgcccgaggacagcagagcaagagtcaaacccagagactccaaagccagtgctcgcaacaaggccagggggctgcctctctcccctcctctcgactgttctgtggt

SEQ ID NO: 8781 - DNA, 201 bp, Bos taurus
ttcttcgaagagctgaggacgattctgctcttatttccaccgtcaggggttcctctttagaggatgaccatcaggggccagagcctcagagtgacttgtacgaaaggtcacatgccttaatggggaagctccgccccctctcccaggctggggagaagtaggggccggtcagagcggcagagccctagcaagaaaggcagg

SEQ ID NO: 8782 - DNA, 201 bp, Bos taurus
agccccgccctcgaccttggcatggcagtgaccccggccaagccgcgtccccattttgcagctgcgactttctgacaaccagcttgcctgtttctcccaaggatctctgagcatccaggccgcccctctgtgcactgcccctgtcatgcctgtccttccagcacccccaatgtgcccagcagggacagtccttgccacgcc

SEQ ID NO: 8783 - DNA, 201 bp, Bos taurus
cgcctccccgacacccacgaggtgcaggcccctggtgagtggaggaagatcctgcaggaagaagcccagctcaaggtctccagctgagaggcagaatctcgggagggggcctgcagtgctttgaatggtgtcccccaagttcctgtccactggcacctgggaatgtgaccttatttggaaatagcgtctttgcggctgtaa

SEQ ID NO: 8784 - DNA, 201 bp, Bos taurus
gtccttattcctggctccggccccctgtgtctgggggacacgagccgggtgcttggcctctgtgtgggggcatctgctggcccgtgttcatatactcaccccacacacgtgtgcatgcaagtcctgggctgcccgccccgtgcggctgtggccgcgggcaccagcccgtctgagccgccctgtcttgcagagggagcgtga

SEQ ID NO: 8785 - DNA, 201 bp, Bos taurus
gacgtcccacacagggccccaatcctgggctccccttgcctccacacccaaccagctctacagaagaacctgattccgtggcagaggagagtcagagcccatgtgccccggccccagggcgatgcctgcttgggggaacagaactgggcagccgggaatcgcaggcagagcatcaagccatggaagggcgtggggacagga

SEQ ID NO: 8786 - DNA, 201 bp, Bos taurus
gtgtacacgtgtatcagcatgggcccaaagtcgcatacatgagagcgtgtgtacactcctgggcaagtgcggatgcctgcaagggggctcaccaggcacccgaggccttacattccggagtcctgagacccctgggagaggggaagacttggtcctcccagcgggccccccacccgctgctccaccccgcagggccgcacc

SEQ ID NO: 8787 - DNA, 201 bp, Bos taurus
gcctggtgtccgggtgggagccccggagctgggctgcccccggctctgcgggtcctcactcttcctcaggcgggtccagctctcccgcatcgaccttcccgtctgtaaagcagggccaacaacctgccccagagagagctacagtgagacatgcgggggacaggggcagaggggtggccagaggttagatgtggtgctaaa

SEQ ID NO: 8788 - DNA, 201 bp, Bos taurus
agggcgggagtcacaggtgtgccagggatgttcgcaccccagctccagtcctgccttcccagggaggcggagccaaggctgcctgaagccaggtggcccaaccttcagaagcactgcaggcagctgccaggtgggtgactggtgccagagtccccgcaaggcaagggggcccgccccactttccaagggcccaggggggca

SEQ ID NO: 8789 - DNA, 201 bp, Bos taurus
cctgctgatccacaccactgctgcttctcaacacgcgacgcgacgagcctgctcgttcttcagagcaacttccgaggccgtggctttcccaggctctgtactgcccgcgagtccggcggcacgtggctgctaggctgctctccggggttcccacctgcagacaggaaaccgaggggacccactaggcgtgcctcccggtgc

SEQ ID NO: 8790 - DNA, 201 bp, Bos taurus
ctagagccaattctagaaccagccccagcacggttgcctgatacagccatgttccagcctcgtaagaggcaccagctcccaggcccgttccacaggcagaaccagccatctgtccagcctcatccacagctccaccctcagcgcctatcgctaagctctggccactcccgactacaaccccagagacctcctccacctcgc

SEQ ID NO: 8791 - DNA, 201 bp, Bos taurus
agaagcaaggtctagtgggctgactagggaaccggaaaagttcccattacttcctttggtgctcagccaaaacctggaacccacagtggcccaagctaagattaagtgaactttacagaaatccctaggaataacttacaagagctaagaactctcagtagagggccaggcttgttggagggtcttaactgtgttacctgc

SEQ ID NO: 8792 - DNA, 201 bp, Bos taurus
tcatcagagccgtgcccacgatgttctggaggatctgcataggtcgaaaggtatggaatgagaatgaacgtgaagaagagacgtgtcctgtttgatgtgccggccggttccagctgcccgcgtccctgcgggcctcgcgccagggtggagtaactcgggacggagagaggtctgcagttcacaggcagggttattagcggg

SEQ ID NO: 8793 - DNA, 201 bp, Bos taurus
accttctctccccatcaaagtagggtacatctgggccttgaacttgtcatctattcagacttgctttgatgaaatgatgagggtgaacaggacatggagatggcttgattcaggggcctggcaggaagggcagcaagggaaaggcaggcctgggccagggacagaggagcctggctgaccctggcgcgctgagcctgaggg

SEQ ID NO: 8794 - DNA, 201 bp, Bos taurus
ctgctcagggagggcgcaatccaggcgtggtccagagagcaaggttattttcaccttcttggaaccacctcgaacaaccaggggaggcctgactccagacaccagggctgggatgcagacatggggtctctctcgcagcctgggtgggggtggggaagcaaagctctttccgagtctcttaggaaccatccaggccatcca

SEQ ID NO: 8795 - DNA, 201 bp, Bos taurus
agcccccgcccccctccctgctcctgtccacccagaggacagactcgcctcctggaaggcgttctcacttccgccccccgcttcacagtgcaagtgaacatgtggccggcggtggctgtccacaaaggactctaacgagaacgaaatgcaaactctgtctgctcagtgaccactgggctccagcccacacggcgagctgcc

SEQ ID NO: 8796 - DNA, 201 bp, Bos taurus
ctctgcagtcctccgacttaagtccagctcaggaaggaagcaaagttctgacttagctggaatgcctgtgcctgttcctagactgaccgaggaatgggccatggctggtcagctgcagtcacagaggtggtggcaaggacaggagagcaggcactgagctgcttggtgagcagctggcctgggcacctggccttccccgct

SEQ ID NO: 8797 - DNA, 201 bp, Bos taurus
cgcaggcacccggcagagcagaggcatcatgcagcacatgcaggcgcacacgcgtgccgcggccccgcggccccaaagccgaggccgggcaaggagcgccggcagcagccacctaccatccagaggggacttctcctctgcgttcttgtcctcctcggccagcatgacctcctctgcgagcaagacacagcctcaggccag

SEQ ID NO: 8798 - DNA, 201 bp, Bos taurus
tgctggggtgagcacattctgctcaaccctcaacccttacaagtgtacagacccccattaccacaaagcaaactgtccctcacttgtgaggctggaggcaagctggcccactcaagcctgctgcccagggggaaggcccaagcctgactgcccctgccacccccagcctgcctccctctggccccacccctgccacgccct

SEQ ID NO: 8799 - DNA, 201 bp, Bos taurus
aatgtcctagatacctttttgctggtctgacactttgacccgggtggctgggatggcgggggctggtcaggttccccttccctgaggcctcctcatatgatttgcttcagggtctgcacagaatgagaatttacaggtagtgagactgtttacctgtaggcaggcccccgagagggaggaagatgaagctgtcaggcctca

SEQ ID NO: 8800 - DNA, 201 bp, Bos taurus
cagccatctgcagaggacaagaaggatggccggctgcctactacagggatcaagatctgtgactgcgaccaggatctggaggcagcagactttgacatcaaccttctggccacttgctctttttataatcgtgttcttcacctctggaagtgggagaacatctgagctggggaagaccttgcttggtttgacatggtaaag

SEQ ID NO: 8801 - DNA, 201 bp, Bos taurus
cttaaaaagaatgtttttttcatgaaattgctgccaaacgttcaagtttatgggaatgaactccactttcccgaggccccctctagccctttctctgtgagccatcgtgttttctttccaggcacagcctcttgacgcggcttcccaggtaaagggcccgcccacctgtgagtgcaggagaccctcgttctgtccctggat

SEQ ID NO: 8802 - DNA, 201 bp, Bos taurus
tcctggctcccacctgaccccaagctggccaggcctaaggccagccagtccaaggtgggactcctgggatcacttacgtggggaacccaaacttgatgcccaggttgccgttggccaaggaggtcaccaagaccacgggcatcttcatgttgtccttggcatccaggaagctctggtcgtccgacaccgccccaaccacgt

SEQ ID NO: 8803 - DNA, 201 bp, Bos taurus
ctgggggaagcagtcccgggggcctgtggtcagggctgcctctgtgccaggaaggacgggtctggaggtcctgggggccctgacatgacggccccccttatgctgctcagataacctagtcaccccccgtgctgtggacactgctcttcttcagttcagtctctcagtcgtgtccgactctttgtgaccccatgtatcaca

SEQ ID NO: 8804 - DNA, 201 bp, Bos taurus
ggaagaggatgaaattgaagaatagggtaacattcggccaattaaatcgtttcctggtaattaactggtaattcattggccaattaagctgttagaaaacatccaagcaccagctccctgtcacgactcagaaaataaaatgaaaacgaacatcacccccagaatccccgactcggttgtttcccaggtttgcagcctgta

SEQ ID NO: 8805 - DNA, 201 bp, Bos taurus
gctgacctgacagtgcccctccttgctggttctcagcgatgccatttccctgctcttgtgtttctctctctgtcgtaacaagaacacgaactcgggtgtccggcagacttgggccgcatccagggtctgtcacctacgcgctgggccactgggcaggtgactcaccgcccgcgacccgccccttggcctcctcatctggag

SEQ ID NO: 8806 - DNA, 201 bp, Bos taurus
gtcctgcttcactcttagagcctgcccctccctcccaggacccgccatagcctggctccgcctcgtgtgccaacctttctgggacactcggccagggcagcgggcgcaaagacgagaccaccaatttgtcagatgttctgggaacaagtgcccttcacaggtctttaaacggcgcaggcccggccctagtggggaaggcgg

SEQ ID NO: 8807 - DNA, 201 bp, Bos taurus
agagtggtgagtcatcagagagagatatgctgcacggaagctgacaacccccggacggagggcgctcagacagcctgcgtgtcaggccttccctgggggcggggattcactggtgcttccccagccacaggcatcacagcagacaacgcttcagtgagtgaggagaacgaggccaggatattgaccatgcatcaaagttta

SEQ ID NO: 8808 - DNA, 201 bp, Bos taurus
gcctcagacactcagagctttagacacaggaataattctcgggctgttagaagcccctgccccaccgtcccagggaccaggccccccaggccacctcgccattacctctgcagaccctgaaagatctcatcttcaccctgtttctcccaaggcctgtcttcttgccagatgttagcagagggcaaaggtgggctggagctg

SEQ ID NO: 8809 - DNA, 201 bp, Bos taurus
cccctgcacaggtgggtgcacacacacacgcatggcacacacgcctgacacacacgcctggggaaatgtcagcttatgtcagtcctgtggacaaagggccgcctgccagccccacctaatgcctgtgcccacatctggctccagggctgcaaagccaagtgtctgcttcatggggaccatccgtggccaaaatgcttggct

SEQ ID NO: 8810 - DNA, 201 bp, Bos taurus
gtttgattagataaatagaactcagtgtatgatataggaaaagggaattgttataggggttagagagctggctatgactctatacaaggatgttgccttattgtttaatgttggacctgaagtcatgataggtcaacctagcctgcagccaggaaggagagccacatataacttggatgaaagcagagtaaacaaatgaat

SEQ ID NO: 8811 - DNA, 201 bp, Bos taurus
aaattaatttctgttgatatcttcataggcaagtaaagtatctctgaatttaaaacttcttccctctgctctattataattcatttgtgatacatataccacttaatcctccaaatcttattccttggcatccataacccttgttaatttcttcataaaatttattcacattaactttttacaatcattaatcataaattt

SEQ ID NO: 8812 - DNA, 201 bp, Bos taurus
attctgtaatttgggagaactgttctctaaggaacatgtaaatggggaaatataattaatctttaatgtgagttaatgaatcacagtagccagaccagccatgataatactatctgggaatactatctgactctgggaatccattccatcaatctaatgagaagtaaaagtaatttcactttttcctgtttaaacttcctt

SEQ ID NO: 8813 - DNA, 201 bp, Bos taurus
aagtgcatctttttatttgatggtctttgagggggtaacagactttattagaagtctctattactgtgatgtcctattggaaactaccactgtggcccctctgacagctgcagtccctgagaagtgatggtatgtattaacacttgtagtagaactaagcacccctatgaattcttcactccttgattgtctgaggcctct

SEQ ID NO: 8814 - DNA, 201 bp, Bos taurus
ggcactgctaataacacttgtaaaggttaactggtttaactctgaaaggaagttactcaattatccccaatcactatacatgaactcaaacatgcttattgttgtcccagctttcggttttagaaggagttggagccgcactgacatcaaacagtgtgttgtaacctgatctacttataggtgctttgatctttaagtgtc

SEQ ID NO: 8815 - DNA, 201 bp, Bos taurus
ctcactcactttctttagaagacagtgacagctgcacggcagctcagcaaatgagggaacaagacacagaaggagcggtacccggacagagggcccctaacacgggacgaccccaggtgtgctgagggcaaccctaggagcacaacatacacaaagctgatgagcaggacccacttccagagaagaagtcaggaatgggag

SEQ ID NO: 8816 - DNA, 201 bp, Bos taurus
tccttctccattcaaccatggctgaaacaatgatggtaagaacaaattaggaaggtataaagtctccatattacagagtcaaaagatctttttgcataaacaccaagaaatagatcaaaatcaagtgctgatacaaacagatcaaatcaagtgttttccatcgtatttacattttaaatatatcataaaataaaacaaaat

SEQ ID NO: 8817 - DNA, 201 bp, Bos taurus
cttgaaggtttctcaggccatatgatccctgtcatatctcctcaaatctacctcataccataatagcatggtctggttgtgtttcaaaaagttttataaaaacaagcagcaggtcaaatttggcctatgggccatagtttaccaacctcctacctagggtaaagctatttacctttctttcctcaaaaactagacttagga

SEQ ID NO: 8818 - DNA, 201 bp, Bos taurus
taaataaaattaacattcctaaagatatttgcaatctactttgtaacttttgtgattgtgaactacaaataagaacattaagtacgtatttcaacctggtgatgtacaatcactttttattttgatcacatattgagttctgcaatttgtaggaaatactagcaaatgtatattcagatcagctttcaatgtttatatgaa

SEQ ID NO: 8819 - DNA, 201 bp, Bos taurus
ctgtctctcacttctctgaaatcatctgcttcttctctgcagccttctgttcatttgtttcagggacatgggttttaaacgggccgtgggaccggtgttgatctggatgccgccccggggatgtttaatgctgatggtggtggagtggggtcctgggctcactgcagcagagttctcttgggccccaaagtgtgcaggatc

SEQ ID NO: 8820 - DNA, 201 bp, Bos taurus
tgccagactgtgctgtgacgtgaggtggtgtctgctgttatttaagctgcctggagctgggttttgctttgctgctgtaaacatcctgtaggccatccaggtgtccttttgggtatgtggagtgtctctttaattccctctggaaatttctctttctaaccaagtcagttcagttcagttgctcagtcgtgtccgactcct

SEQ ID NO: 8821 - DNA, 201 bp, Bos taurus
ctgtcatttccttgactttatcacttccaaaaatctctgtttttctacccagtctcaacctcccattaccttggatagtaatataccacctctaaatatggttgcaaacttcctttcctgagcattatctaacctcatacttacttaatattcccactgtaagaattctgtcaccctttaagaactggacttccttggttg

SEQ ID NO: 8822 - DNA, 201 bp, Bos taurus
gattaatccttgagagtcagttctgttcctcagctgtccttgtttttgttactgtctccatatgctcacatggtatattctcataaatctgttagagtgagtttatgttattgtacctacttatcttcactaggttagccaacatgtgccttttgagttgctgagccttttctgctgtctatagaaatttatttatatgct

SEQ ID NO: 8823 - DNA, 201 bp, Bos taurus
ctgttaggattttttctcttaggatttctcgtccatttcctgcatcttctgccttcttcctcatttacactggcatctcttgttaccgtctgattactcaatgtacactttgcaattgccttgtctgcagtatgttctattgctcaggattcccacataattagtgcacagtattattctccagaaaataaaaatgaggct

SEQ ID NO: 8824 - DNA, 201 bp, Bos taurus
ccagcagggatgcggcgtggaggacttacctgctgtgggaccagctccagggcgctctgcctgcactcagggcattgtcctcccaacgtgagaactgtaaggcagggggcctgtgttcctgttgtctgctgaacatgtggtctaaagtagaaaggtattggggccgggaggttagaccagtgaaattttggtatttgttgt

SEQ ID NO: 8825 - DNA, 201 bp, Bos taurus
caaaatatgcttcaccattttgatcatgtggcctttggcaggaaagagtctacatgtgactctgggacaaagtcaaaatgctctaaacgaagtggccttcgtttaaagctgtttggttaggcttggtgggcaaagactcagttccactaagccacagaaacttaggcctctagtgacgttcagtattccatcaacatttca

SEQ ID NO: 8826 - DNA, 201 bp, Bos taurus
tgggcctttgaaatctggctcatgtccttagaagactcggatgcagagaaagagagacactaggggtgtgcctgcaaggagggacacgtgaggacacaacgagaagggggccatctgcaaatcgggggagaggcttagaacacactcttctctcatggtcttcagaggaagccaaccctgccagaacgtgaccttgaactt

SEQ ID NO: 8827 - DNA, 201 bp, Bos taurus
ttacttttttttttttttgcagaaagtatatatacatatactcctcctattgatgattcattaatgagtaaattctagaccattcctttttaccagatatcgtattatgttagtgacttttttgcgttgctttaccatagagatattgcttggggaacgtttttgtgggtgcctgccaaatagtagacaaaggtcagatga

SEQ ID NO: 8828 - DNA, 201 bp, Bos taurus
gctctttcgtccttgggtcaccatattcttccctctctttaattttagggccaattctttggccccttttgataccctgcgcatgtctaactatctacccatttcccttctcaggcatttgggagcccagtctcaaaggtaaaggggtgatggccactctcacttcttcaggctgtacaggggcatcatggggctctggct

SEQ ID NO: 8829 - DNA, 201 bp, Bos taurus
ctctgaggcagatggtaaaatccaacagccacagaccatcagaaatacacctgtggtccaaaaataagtagttatactgagttttctgcagctagggtgactgtacctcatagcatttgtaggtcttttttttaaaatgaagtagggtaggcttaatttttttaggtattcatatttcaaaaactagacaaagtaactata

SEQ ID NO: 8830 - DNA, 201 bp, Bos taurus
ccaatcccatgagcctttgttttcttccaaggaactgaatatctgacctcacttgaccacaaaaaagcactcagagtcatctccaagacattagctgggtgtacccaaggcaagggctctcttcatttcagaattctcccaataagagtccatgtaaatctggagctgcctgccactggccatggttgccatttctaggaa

SEQ ID NO: 8831 - DNA, 201 bp, Bos taurus
gtgttggggccgtgtgtgaggtgtgaatcaggcacaggtgcctggaacagtctgtcccagtggggaatctgtaagggatgggcaaagtaaagggatgtaagcaaagaggaatttgaggccataggataggggccacattaaggagagcctcctgtgtcatacagaggactttttagtagtcctgtagtaaacagggaatca

SEQ ID NO: 8832 - DNA, 201 bp, Bos taurus
accaagagcttttctgcattggttgattctgatttttgagctaagcacagaactccagggattcaattgtatatattcatgcaatatcatttaaagctcacattggaaatgcaaaggtttgctgaatatcaatagctgtaagaaaagctaaatagcgtaaattatatttcagtaaattatgtgtaggtttgaaatcaagtt

SEQ ID NO: 8833 - DNA, 201 bp, Bos taurus
tcagagaaaatctagtcctgactaaactgtcagcagggccatatttcaggctttcagcctctaaaactgtaagaccgatatatttctattgttttatccactcagtttatggtactttgctaagggtgtcaaatgagatctacattgtataatccaggtcatcagcatagacagacaccatacaaagggcaacccatacaa

SEQ ID NO: 8834 - DNA, 201 bp, Bos taurus
tctccaccctccagatgtgttctgcttctacaaaatccagagacttattgctcttcttcattcaagctttaatcagaaatttattcatatttttgctaatatacaagaccttctcaattgatggacaggatttttcagaaagaatttgaaagtcatgctaagaattatttgagcagcattgcaatgattctcacagaccct

SEQ ID NO: 8835 - DNA, 201 bp, Bos taurus
gacaccggggaagtccaaaattgagagttgttttatttggccaacattctgagaacttcaaactggggagactggagtcttaggttgctccaagggactgttccaagaaggcaaacagaggagttagatatacaggagctttttcaacaaagaccaggtagctgaaacattaaagattacagttaactaaagaaaatcaga

SEQ ID NO: 8836 - DNA, 201 bp, Bos taurus
tttccttatcacattatttctaatcaatcaatataaaggccaagatacttaacatctttatggcttctcttgatcattggattaagtcactactatttttcatgccccttggccattttaccaggcatcagatgtatcagcataagattgatgatcacaagttatttttccctcagacatatgaaacagaagttaattact

SEQ ID NO: 8837 - DNA, 201 bp, Bos taurus
ttggaaatctcttagaatacacatagatttttttatctctctcaaattgcagatgctcttgggctgagaaacatatcaagttaaatgaattattaatgcactagcataaaatcgttaattgcttattttgcttccatgataaattcattttaaaaaaacacaccaaaaaatggaatttgggagatggggagaagaaaggga

SEQ ID NO: 8838 - DNA, 201 bp, Bos taurus
tgtattctagcttcaacactatttgtcagataggataccataatctttcccttatgtgtgggtgtgtgtataaggagaaatggctgacaaatgtccccttaataaggttatgtgagagataattgaggataataattggaaaattcatttgttttttttctacatgaggctttctatgtaatgagtagaaagtattaagtg

SEQ ID NO: 8839 - DNA, 201 bp, Bos taurus
atataggcaaagtcaatatactcaatatccatgttctagagtaaatatacataaatgcatgttatcatgggttttactgacaataacaggccatttttctggtaatagctttaacattttgtaatcattaaaacagactgaagcaaagatattggggaaaaaagtatgaaactcacatacagaaagagaggatacagggcc

SEQ ID NO: 8840 - DNA, 201 bp, Bos taurus
ggttcaagctttatatttaggttttagtattgactagcccctgaagctttgaagaaaataacataggttaacaccttctacttgatctcaggcttatgcaataaagcttgaaatttgcttacatcattattcttggctagtgtaattataaatgtgattagtaagaataaagtacaattatactgtttataaaaccagtag

SEQ ID NO: 8841 - DNA, 201 bp, Bos taurus
taaccatcattagcccaggtgccttacgatcccttgaagccacagtcaccccaagccttgatctgtccaccagagggcccaggacccagccccacacactagtgcattggcactagccacacgactacttggagccccagagccagcagtacaaactccactgtcaccacatcagtgggttggcagcaaatcttggactcc

SEQ ID NO: 8842 - DNA, 201 bp, Bos taurus
atctaggaatagagaaataaaagcaagagcttctaccttaattctactcagaattggatatttagccataaattctttgaaaattagcaaagcatacaacctcctgtattgtattttaatgtctgcatttacattatctgacttttcctacacagttatctacctgaaaagcttactgcttaatacagtaatgatctgatt

SEQ ID NO: 8843 - DNA, 201 bp, Bos taurus
aagaaaaacatgatttgtttaacagaaagaaaaaatatatgtcagtgtgtaagaaataaacatgtatagaaatcaactttcctttagaacaaaaccaaatataataaagcaaaattaaaaatcaaggtatgatctaaaataagtttatgtagcaaatagtaaaactatttttctgttataaactgaaaattgtctattgaa

SEQ ID NO: 8844 - DNA, 201 bp, Bos taurus
ttcctgatagaattaaacctgagagacgtgggtgaaaagtaaccaagtaagttcatctttgtcctagatttattaatcgagatttagatcctatcattacggtgtccacattatcacttaaagtgataaactgtagcatttagtgactctgaatgaactataaaattctgaatttgcccaatttgtgaatgaaattatcac

SEQ ID NO: 8845 - DNA, 201 bp, Bos taurus
aaatatattttcagaaagtcaaactttctcaccactatggttccctctcccaggcctcctcacctcctcacaggcatatcctgagtattcccgggcctgacttctctcaccccttcagacccactcagtctggaggactcggatgctcttatgtgctaatgacttccaaatctacctagaggccctgttctttcctggact

SEQ ID NO: 8846 - DNA, 201 bp, Bos taurus
gttccctgtcagcagagccagttgctccagaaatgtcccctggtgggctgtgtgcaccctcctgctttcactggacaatgataactataggtttgctagcatacaggcctggcccctgacacagttggctgtaaagcctagttgcaactgttcaggtagtctcatgtgctgggtcatctcctggggcaggagctactttag

SEQ ID NO: 8847 - DNA, 201 bp, Bos taurus
acaaaatcagtacaatttagtggtaactctctaattttactagcagttattttactataaattcaactcaaaaggtagtcattgagaaacagctacttatatattccaactgatcaggaggctcagaaaatatagtgtttttgataatgaaacattcttttattttctatgacatgagtggttcaaagtagtatctcacta

SEQ ID NO: 8848 - DNA, 201 bp, Bos taurus
aacttcatggcgctggccagacccaggaagaaatgtgataatcctttgttctttcagttgaccatgtaggtcaggatattcctgtaaacctccaacaagacaaatgttactctttgttttgcagctgcaacggtgcacaaacacggccaagagaagttatcccaccttcgaagtcaggggcagaagacaggaggaccccat

SEQ ID NO: 8849 - DNA, 201 bp, Bos taurus
aaccttccaaactaagggatgcgtgtgatttcatttttaaacctggtttcctaagaatggctactgggtggaggaagttgattttcagtcactatttggtcagaagttctgtttaagccccttgtgctattaaaatctctgctttttgttgattcaggtgaagcttttggaatgcttgcgcacctgccttgtgtccagttt

SEQ ID NO: 8850 - DNA, 201 bp, Bos taurus
ctcccctattctggcactttgtctaactgtgattgtgcatgtaaatatgatctgatggtttattttgagaaaaaaagtgaaagaaaggaacacggccacaatgtaataaagctatacatagaagaactataaaagaaaggtcttaatgacccaaatagccacaacggtgtggtcactcactaagagctgaacatcctggag

SEQ ID NO: 8851 - DNA, 201 bp, Bos taurus
tgttttccttgaaacataataattgaaaattcctgctttttgtttaattatcattcaacacaaattaaaagaagcaaaaaaagatgaattaaaattacaagggccaacaaaagaaatgatggtgaaataattttcttatcctatttttatatatttaatatttgaaatatcaatatctactttgatactatctaatcaaag

SEQ ID NO: 8852 - DNA, 201 bp, Bos taurus
cctgtccagctctttatgaccccatgggttatagcctgctactaggctcctctgtccatggaattctccagggaagaatattagaatgggttaccattcccttctcgaagggatccacccaatccagagatcgaacctaggtatctaggattgaaggcagattttttaccatctgagacaccagggaagcccctgttattc

SEQ ID NO: 8853 - DNA, 201 bp, Bos taurus
agtaaataaatgggatgaattcacataaagtttattagttagatataaaggacaatttaaaattaaattacttatgtatgctaaaatttcaaaaataaataatgaaatactgctttgttaagaagtcttacaattgactaattggcatatatgagagagattcagagatacaggaagccaagcaatactttgtttataaaa

SEQ ID NO: 8854 - DNA, 201 bp, Bos taurus
cactaaatgggtttttgcacagatttttaggtacatgttaaagttaatttccaaacagagattttggcttcacaatactgacaggaaatgtggctttcatggtttcctgtaggttgttcaaactacaaactgttccaggagttaccatatgtgttggcatctctctctaatccagttttgaaggacaagctaaatctaatg

SEQ ID NO: 8855 - DNA, 201 bp, Bos taurus
gaagttgacatatgttaacatttctacgcagcattatctttctcttacgatccatcttttggccctgttaatggccacacttcctctttggcccaacacttcaccataggaaattagtataaagattaagagagtgggccttgcagccgcatagtttagcattagaatctatacccccttttttcttattaaggaggatgg

SEQ ID NO: 8856 - DNA, 201 bp, Bos taurus
tatgaagatgagctatgcctaaggctggctgcaaacagaatccctgagaagcacccccagtagagccctgcgaagtgatgccatggaccttacgtttataccaacaacctgttcatggagaaacacacctttcaaagctgggaaatacatggagatggagtgatactgttaccctcagaacagttcactctgttgccaaga

SEQ ID NO: 8857 - DNA, 201 bp, Bos taurus
aatctaccttcttttctaccactggactcagagatggaaagatgaggtttctctccttctattgcctcagcttcctctttgagtatgttgcgaggcggaggaaacggttagaaacagaggagaaaagaaaaaattgaaaatgccacattagagcattaaaaaaagtcaagtttgctaagaaaaggtggtagggaatattgg

SEQ ID NO: 8858 - DNA, 201 bp, Bos taurus
tataccttgctgctctactttgatattttcctctctgctagcacagtgacttttattatacatagtagaggagtaataaatatttgaaaaccaacgactgattggtttagaaaagatctctgacatcagtgactacccaagatgattgaggctgtaattgacatgaaatgaccaaagatgagtatagaaaaatgatggcaa

SEQ ID NO: 8859 - DNA, 201 bp, Bos taurus
cagaagtatacacaggccttgatggacgactgggtgtagcagatgaggggcaagaaggagccacagtcagagtctgctcaaccaagcaaccatggaactagcagatgatggccttgagatgaaaacaaatgtaaaattctggtataatatccatttggaaatatctaatggtccatcacaatcaatatctgagtacctatc

SEQ ID NO: 8860 - DNA, 201 bp, Bos taurus
cggtgtcagcaagaaacagaccttgttagtttacattatgtagatcctgacaagtacaaaggcattttggaggtgttagaaaaagcatatgagggtgaggcattatcattcctttctttgaaactgaagagtaggaaatagacccaaaagaaaaacagaaggaagtaaagacttcatcgtatgtcagagccttaatttcac

SEQ ID NO: 8861 - DNA, 201 bp, Bos taurus
atatcttcttagtgtagctcaagtagccatcctaatcggcagacctatgaggctggtactctttcatagacttcaagtagctctccaggggagggccctacgctcattaggagagcaatcagacagctacactgcttaagttttgttgaaaaaacaccaaacaataacattagcaggaggccacctctccatctggggaag

SEQ ID NO: 8862 - DNA, 201 bp, Bos taurus
atattttcctaatattttaatctttaatgcaaggtacctattagttttgccatattctattaattttaatagcatctcactatgcctttatagctaggcttgtacaatttaactacagaatcttctagatgaaaagtggtttcatttttttccatactcatatataataacaactgcatacgttttctaaagaaagtaccc

SEQ ID NO: 8863 - DNA, 201 bp, Bos taurus
ttttgttcaacgtagtaatgaaaggcctagccagggcagttaaaaaagaaaaataaataaaaggcatccaaattggaaaggaagaagtaaaattgtctctatttgctgatggcctggtattatgcatagaaaggcctaaagacagcaccaaaattatatatatatatatctgttagaactagtaaatgaattcagtaaagc

SEQ ID NO: 8864 - DNA, 201 bp, Bos taurus
atatatatatatatgtatgtgtgtgtgtgtaaaatggaatatgttcagcatgagaaagaaggaatcctgccatgcattccctacgtggccctacatggatggatcttgattacatcatgctaagttaaataagtcaggctataaatgataaatcctgtaagataccacttacaggtagaatctaaaaaggccaactcatag

SEQ ID NO: 8865 - DNA, 201 bp, Bos taurus
taagtgcccttcctgcgggtgagcccgttgtgaatcttttgaaggaagcgtcctacgaaactgagagaggaagaaaggcctgcccttgccctcaagaggcgccaggtctgtccagctctccctgagaggttcttgcgggagagacaagatgggggtaggagcaggccagaggcacagagcaatgtccctggagatctgggc

SEQ ID NO: 8866 - DNA, 201 bp, Bos taurus
ccagacactgtccctttctctcttctgccacctctgccaactgctgtttcctctcccctagtgaaggaggacataaaattggaattatggtgaataacctatagtttgataaaacatgttttgtacaaatgaagtaattacagtcccgtttgaggaaatacttcttacaacccgggaaccgtccttagtacttatgtgtac

SEQ ID NO: 8867 - DNA, 201 bp, Bos taurus
gaccgtgggctccttgggactttgatcgggagatttcagagactttgccccttgtcaaagaaaccccgggtttgccccggccttccagctggtgcctaacaatctcaggaccaagggcagtgttgccgtgggaacacatgacttccagagaaggagctgaggagtgaagttccagcctccccttgcttcccagtcgaggcc

SEQ ID NO: 8868 - DNA, 201 bp, Bos taurus
ctcttttagtagcacatgtttctaaaatgagttatattaaaaatccgataattgcataaatatttgaaggcatatatgtgctagtgctgtatgagctattctgaagcccaaggcagtgcttcagagctactgttcactgagaaaagtaatgttgaatatttaaggacacatcccaggaggatactaaagtgcgtaagtatt

SEQ ID NO: 8869 - DNA, 201 bp, Bos taurus
aatgttttttattttagttgttatcttagtaatgaaatatggactagagacgtgtctggctcattcattatcaactaaatgtcctagcaaaaataaacctattttacctgccactctagaggacagctacatcatccactggtttgatttatcattgcttatgaaatgaagatagatgttactggctgaaaaggtacaaaa

SEQ ID NO: 8870 - DNA, 201 bp, Bos taurus
ttgcctggaaactcccatggacagaggagcctggtaggctacagtccatggggtctcaaagagtcggacacgactgagcgacttcacttttttcacgttcgtgaatgatagagaactggtcagtagggcttagcaacttcccaaagaagagctctggtaaaggtagatcagaccagaccacacggagtaaagaggtgttta

SEQ ID NO: 8871 - DNA, 201 bp, Bos taurus
gcttgtttacgtctccaagagtgtttccaagcttactttccttttactttctcataccttccccctcaaacccaatttagggccttagaattagcagtttccttcgccccaaattcttctctgatatttgcatgcctgttacgcaaaccgcttcttaaatgtttcctcctcaaaagggccactccattgcaatagtcatca

SEQ ID NO: 8872 - DNA, 201 bp, Bos taurus
ctttgcatttccattgtgccgagcacatacaaagtgcccggtaagaacctctgtgcttggggaatgcatgaacataagcaggaatcgtttggcaccttttcctgcttgagcagctgtgagacagcttgtctccgctccgctcttctttctcttatctaagctcaggcttgggctccccacgtggctcagtggttaagaatc

SEQ ID NO: 8873 - DNA, 201 bp, Bos taurus
aacagtgcaccaaatggcaaagtggcttgggtggtcaggggtgacgaatgtaattctgatctttagggtcctgccaggaaggtgagcgagttggccttcgctgacacgtgctctgtctgactttgctctgatacaacggaggagagtgactaactcagcagaaagagcaaggccactctgtgtgagtgtcaggatactgga

SEQ ID NO: 8874 - DNA, 201 bp, Bos taurus
agtccctggtcagtgccaggctatggtaaatagaggtgtgtttgtaggtctgaggtccttagcttagtatattgtgtaattgcacttccccactgctgcccggaaccaaaaggaagggccggggtaccaaaacacctagcctagctctttggaggagctgccgtcttacagccctcccgtcttcagaatcataagatgtgt

SEQ ID NO: 8875 - DNA, 201 bp, Bos taurus
agtacaaaattaaagagaaagtaaaataaagataactttcacttcaaaactataaatttcagagatggaataaacttcaagtgaagtctgattaaggacttggtttcttcttaacctccttgtaactttcaatggcgtctgctgcatcctcaggctagccttctaatgatcagggcaccatatgtcctggtaggccaggac

SEQ ID NO: 8876 - DNA, 201 bp, Bos taurus
tcatccaccttgacccttctacttcaggtataaaagtagacagggggataaaacatgagcaaatcagcagaaatcactgctggagaacatttcaagacccctgctttagggagaagtacattttttcttagaatattgattgtgcatctagagaaaaagaggtggagaggaaatgtgtaagacatctatctagggttgatc

SEQ ID NO: 8877 - DNA, 201 bp, Bos taurus
gcctgacatccagtagatgcttgataaaagttgacagaattgaattaaaaaaaaaaaaaaaggtggtgttgtgttttcttgataacagagtgtccctactgccaaagcaattatgagggccagtctttatgcccatattagcttactgggctttctgtggactaggagtgtaatcccaatgggaaacaccgactgcccaaa

SEQ ID NO: 8878 - DNA, 201 bp, Bos taurus
taaccacgggagtaaaaccccctccttaattgttcagtgcatttggtctcccacacggtgcatgtaagaaatgaagagccaccattcagtgtaagccccagccactctcttcgcagaggatggacaagcgctctatttcttgggaggctggaaaacccgaggaacagaggaacaggaggcagggcactcagaacacagtcc

SEQ ID NO: 8879 - DNA, 201 bp, Bos taurus
ccctcgttttcagttgctctggaccccacagccagccctgcctctaaaacttacgttcccagagggcaatgacttttctttatccatggctgtatgactgcagtacctcggcccctacttttgagttcagtaagtatctgttggatctggaatatggtgggtataataaagaaaaaagaccacagggtcccaaactaggat

SEQ ID NO: 8880 - DNA, 201 bp, Bos taurus
ctcagcagcctcatgccagccacggtcaccctcattctgccctgaagccacaccgcctcttccagggactcccgctcacacacagaccctccccaccaccgcgccctgcaacaaccccaaccaatctccaggtcttgaatgactctcccacacaggccttccctaaccaccctcacggtatcttttcagagaaacctggtc

SEQ ID NO: 8881 - DNA, 201 bp, Bos taurus
accaagatgtcaactacacttcagtaaaactttttaaaaactaaattggctataccattttaccaaaaaaaggaggcagactgttctagataaaagtatgtttattagacctaacaatcccatgtaatgagcggttcctacatttttgaggcaattgggaaaaatttaaatatggttgaggtattaaatgaaaggaattat

SEQ ID NO: 8882 - DNA, 201 bp, Bos taurus
actcagatcaaggcaggcccccaccactcctctatctaaaatttctggcccattattgtgagcgctcattctttactcaaacaagcaaacaaaatccaaagggaacgaaaccacaacaaaggggccaggggatgtgcagggaatgtacctcttccaagtgtagttgtttaagcacctccacgttccccacccaccaccctc

SEQ ID NO: 8883 - DNA, 201 bp, Bos taurus
ctccagtattcttgtctggagaatcccatggacagaggagcctagagggctacagtccatggggtcacaaggaagcaggcacactgaagcgacttagcacgcatgtactgagatttccgttttcctcagagaagtaggggccactgtgacgggggaagggctggaaatgtgttctagtcagagatctcaggagaacttatt

SEQ ID NO: 8884 - DNA, 201 bp, Bos taurus
ttcagagtttgcctagcaacagtgggcagagaatcccgtgagaagagccacaggcgctgctccaataacaaagaacggccaaggcggaaataaaaaataggagaaatccaggcgcaggctgagacggcgaaacttttctccagctcttcattgtgcaggagcctccaccactggggatccgtttggccctgtgtaggaggc

SEQ ID NO: 8885 - DNA, 201 bp, Bos taurus
gtcatgagttaaaactcagtttataagaaattatctaatatagagattcattggtgccctaattgttcctcgggtgtcctaagcaatagtatttgccttggaagagaaggcataggaatgatacagagaaggtgaaactgaagtgtacattttggaagtccttggctcatttaaatgtcttctactttatccttccttcaa

SEQ ID NO: 8886 - DNA, 201 bp, Bos taurus
caccgttcaaagggggaagtcaagcatgttcgctgtcgtccaccagcctccctccccctccacattccactccaggaccactgctgacaaccgtaaaatcgaattcctggcctggaaaagctgctccttaaaggcagatgtgcaaacaggagtgttaggaggaaggcctatccctcgattcagaggctctggtctcaggat

SEQ ID NO: 8887 - DNA, 201 bp, Bos taurus
gcctgtggtacagtggctccctaagcgtggccctgccccatctttctctaaatatatttttgagcagtgtcacagaaagagatgtggagtcatggaaagatccagcatttggcctgaaatgatctgggctcaaatcccagcttcgcctccgagacgtcccccacatgctctgagaataataattcttacccaccccatccc

SEQ ID NO: 8888 - DNA, 201 bp, Bos taurus
cttagcttaaaagatactccttttaaaaaaatgggtatgtataggcgcaaaggttgctgggcggttcttgccggaagtagagagaggccaatcgcggtccggaggtgagacagaagtctgaggtggtacattatggctgacatgcgaaatctggtagaaagattggagagagtggtgggccgcctggaggcagtctcccat

SEQ ID NO: 8889 - DNA, 201 bp, Bos taurus
tcccagagtcacaagaactggttgcgtgtgctgtcttctgccccccttcctccagcttgggcatctgtatgggacttgggcgtgaccagagtgctggagacggggaagtaatgccactgcataggctgaaggtgggcttccctagtggctcagatgataaagaatctgcctgcagcgcaggagacgtaagagacttgggtt

SEQ ID NO: 8890 - DNA, 201 bp, Bos taurus
cgtagcagtcacacaccttgctgtcaggtgcttgaggtatccaggcttagtgggcaagataacagtttgctgagcacagaaaaggtattcactctatagcaaaagtcatacaatgagaagacaaccactgctgaagtgactcctgaaaagtttttcagagaaataaaacatttcttcagtgtttctaatgttttgaagcat

SEQ ID NO: 8891 - DNA, 201 bp, Bos taurus
gcctcggaagtccacacagacaagtctttcagctgcaggtatcctgtggcattgactccattccttctgttctgctctggccctgtttgggcacatctgccgcccatgggatgtggagaaatggtgcttttcagggtatactgtagctgggccacaagtgctgccccgtcattcacctaagtgtctgatctttggaggcca

SEQ ID NO: 8892 - DNA, 201 bp, Bos taurus
ggaacttcctggttgccagtcacttttcgtggacctgtggttgggtcgtcctcggttttcccctttccgtcactcattcagctagtcaccaggccctatgggtattctctcctatatagcccttgaatcctgcttttctctgttcccatgggtgtaatcccagtcctggccacgtcgccccctgggtgactgctccaactc

SEQ ID NO: 8893 - DNA, 201 bp, Bos taurus
ctgcccagaaagcactctggtcttggccactgtcttgtctctgcagtggcctcatgaatggtttccttgattccaccctcactccctccagtccattctccgtactccactctcgatacagtggccaaggtgacagtatgacaactgaagttaattgtctgactctgctactaaaaccctacaattccttgctttcctatt

SEQ ID NO: 8894 - DNA, 201 bp, Bos taurus
gtcattatcctggtttgttcataggatggccctccccgctgctccctcctcacttctggactcatcctctaagacccagctttcctccagaggctccccacacacgcagacaagacccaggacactcaggggtccctgccttcctcgctcaggctcccaacaccccagccctgaagctttcttgcttggtttcatctcagt

SEQ ID NO: 8895 - DNA, 201 bp, Bos taurus
taatccccaataccttagaacatgactgtatttggagacagggcctttaaagtggtaattaagttgcactgaagtgtcagtgtgggccccaacccaacccgactgggattctaataggaagtggagactacaatggtcagcgagacttcagggatgtgcgcacactaagaaaaggccatgtgaggaggtggccatccacaa

SEQ ID NO: 8896 - DNA, 201 bp, Bos taurus
tgcaaagaataaagcactttttgttaaatacatgaaggctacttggcggaacagatatacatttttttttggaactgtgaataatgtcatcgagttgaaattttggaatggctgactcctcccgtgtttcccgggggcaccaggcatgagcagccagagacccacacacaccccctaccccgcccactgggccttacaccc

SEQ ID NO: 8897 - DNA, 201 bp, Bos taurus
ttcaggacgctttgcatctctcttagacgctcatttcatccacccattcactcatccagcaataattgagtatgtattggattggccaaaaaattcgttcgggtctttgcattagctgctgaccttgaacagacttttttgccaacccaatatataacatgtctggcctatgcgagattaaaaaaaaaataaactagaata

SEQ ID NO: 8898 - DNA, 201 bp, Bos taurus
ccatgggatttcccaggccagaactctggagtgggttgccatttaggggacttctagtagtcaaagctgttagcactgccaggcctccgtgtgcatggtggctctgcaccacagccacgcgtactctcccacgtttctgtgtgtggcaggagcagtctccacaaacacacctgcattcttgttgcttgcatcgtgggccgc

SEQ ID NO: 8899 - DNA, 201 bp, Bos taurus
ctctaatcaccattgtcttattcttacaacttgttccttgctggtttatttcttgacattcaagataagagactggattttagggcaaaacagggtagaacaaagcaatcttttgtcctgcttcatctctggttataaatttctcttggaaaaatgatagtgttctgaataatgggttaagaacaagattcaggcatttgt

SEQ ID NO: 8900 - DNA, 201 bp, Bos taurus
agttcatggacttctaagtccataccagctaagaaagaggcctagcttagtaattctattttagccacctacccccagatccccgatagacacaatttttaggaatggggcctgacaattcaacagagagattgtcaaagccagtctggtaccctttcagtgaaaaaattttacaggcaatttatgataaagaagaacaat

SEQ ID NO: 8901 - DNA, 201 bp, Bos taurus
tcacctcaactttgcagatgtagtcccggggccctggaggaaatgagggaggtggtttctccatcaccagcaagtccaccccgtcatccactaacaatgcacgactcaggcaggccacatgctctgccggggcccagttggttatatgctcagtgaacattagcagccttgcctgtgagagaggaggtagtttggcacatg

SEQ ID NO: 8902 - DNA, 201 bp, Bos taurus
tctttagtgcaccaagttaatttagccaataaatgttctatggaactcaaaatctgttcaaaataatgtttttgtctcatctgcagtgacagtgatgtaaatgtgttgatgggtggtaagccattgttgccaaaataaaagggacagagagtcacaaaaatgattccaaatccattcccaagttcagaccaagcagaggta

SEQ ID NO: 8903 - DNA, 201 bp, Bos taurus
aacatttgtccctcaaaattctgcccctactctgccctctctagtgatatccaccccttgggaaagtcttcatgtctcactcataaggcaggccatgggtcttgtccaattcagctcttgaaattaaaggaactttgtgtatgtgtgctgccccatgataagagcccaaaaagggtctcaggaggcccagcaagaggcaca

SEQ ID NO: 8904 - DNA, 201 bp, Bos taurus
attttatgtgtcaaagaaggaaatatttggaacagatttcaattgcaagtctcatcactgctcttaaacaaggctttcagtgtgccctactggctgtgaggcattcctccttttacaaattttcaagtgaaaaacatagaaaaagatggttcattcagagcctagaacagagaaatcgatatgccagggaagagagtagga

SEQ ID NO: 8905 - DNA, 201 bp, Bos taurus
atttgggtcagcattctctcatcatcacagtcaggccatgctgattctcccagtttatcagccctgtcttctgttcttctatagcactacattcattagcttcaacacactataaaaggccttgaaggaaaaaaccatgtgttccaaaatccaagcccagtgtccaatacaaagggacatatgtatacagctacttcaatg

SEQ ID NO: 8906 - DNA, 201 bp, Bos taurus
aacaataacctgaccacaagactgctaacccagtagggagctctggagcaaaaacggcctgttagataaatccgatgtgggataaaagtgccttgtacctctgcctctaactgtgatctcagtcactgactgaggaacaccacaaggtgacctcagtcgaaacactgagggtgggaggatctgaaggagctaatagctgga

SEQ ID NO: 8907 - DNA, 201 bp, Bos taurus
ctgcttcttcagcacctactgagggggggcgcatggcccaagtctggccaaggtggagtgaggtatgcaaacaagagcggcttggaatcagctctggtggtggtagtggcttcctttgtccagggcccagcagcccttgggcagtaagagaggccagaatctggtggtggcacggctggggggcaggcctggggtgccatg

SEQ ID NO: 8908 - DNA, 201 bp, Bos taurus
cagcgaccctatggactgcagccctccaggctcctccgtccatgggattttccaggcaagagtactggagtggtttgccattgccttctccaaggaagtccctaggtgttttaaaaagagaatgagaaaaaggagagagaagggagcgagcaggggctcagtagagtcagggaatttaaaaaattacaaataggaaggagg

SEQ ID NO: 8909 - DNA, 201 bp, Bos taurus
agcaggaaactcatgcccatattcagcatcttaaattataagtatcaagtggtcttatgagataggagcacacagtgtggtgggcttctttcaaaaggccggtttagaaatacagcacagggacttccctggtggtccgtggttaagatgccaaacttccaatgcaggagacccaggttcgattcctggttggggaactga

SEQ ID NO: 8910 - DNA, 201 bp, Bos taurus
ggagactaactcttccctctggttcagggcctcctctgtgtcctgcttggaaagctaggcaccgagtggtcagcaaatgattccaggtcacacagctgattcaggccaggtgcccagccctcactctctccaccttcccaggcgccatggtgatcccatgcgtcagggtccctcggagaggcccaggtcttgtggctggga

SEQ ID NO: 8911 - DNA, 201 bp, Bos taurus
ggtcaaaaaagagaacattcttagcatcccagaagccacctggaatgccctcttttcagtctagaagtaaatccttctatgtctttgatgacaatcacttatttacttttctttacaggttattttaaaatctatgtttgtttcccaaaaccacatagctgagttctgctgacttggaatagcacctgtaccctcttatga

SEQ ID NO: 8912 - DNA, 201 bp, Bos taurus
agctgccagaacagcgtctttacgcgtgtttatgctccccttgcacgaagataaaactgcagctcatcactgtggttcataaggcccatacgtccaagccctcagttgccccctggatcttagctcagactctcccccttgcgtcccctctgttccagcaacactacccgtccctcttgtaagctggccagtacggaagct

SEQ ID NO: 8913 - DNA, 201 bp, Bos taurus
cactgctgcctgaggagccctggattattttttccattctgaccaaacgagcttgcttacggtaacgttctgaaaggcgtgttagcccccacctctaagccgttgcttgggccgctcacctgttttggaaatgggctaaaaggacagcgtgtgtgcccccgtgccgcaccaacagggccttcagaacgagtacttctcaca

SEQ ID NO: 8914 - DNA, 201 bp, Bos taurus
aatctatttctggtgtcatgaacccctcctccggggacatctctaaaatgatttcacctactactctccactgcgtgaagagtatccctgtgccctgtgatggcctaaagccaaactacaatcccagcaatggatgggcagaagcacactatattcactctgtaagtgtttactggatgtcctctaggtaaacaagacaca

SEQ ID NO: 8915 - DNA, 201 bp, Bos taurus
cctttctacacagaacttcgggccagtgaactactgacactttccagagtgggacactaaaaataccccagccacctgatgcccaagcgggcagtaaatcactggccttcaagctccagaatgcaggccaggcctggcctaccatggccgcaggcggctgacccttgccagatggcccaggtccacttcttcgcacccagg

SEQ ID NO: 8916 - DNA, 201 bp, Bos taurus
gggctggggagatggcacaggggatcagagcccagcaaagtgaggggctggaggctttgggtccccacctctgcaacatctcgtttccaattcttgcctttttagtgaggagcaggaaacagagaggagcttgctcccttctctgcgaaatgaataaaccacagtgtcaggtctgcctgaatttgggatttaatcctaata

SEQ ID NO: 8917 - DNA, 201 bp, Bos taurus
ttagtttagagtcaggtttctgcttccaccaaaaaagaatgacacaagtttcccagatctgcggtgaactccaggccgactgatttcttaggatcctctaagtttttttgcctgtagaagtgattttgagctgttcctctttaaccacacgtgagctggccacaggcctgttcacgcttcgccccgttaggtctgtgcctc

SEQ ID NO: 8918 - DNA, 201 bp, Bos taurus
acatggcagcacagactcacgtaaggacatccccacaaatctatattttgttaaggttcaatgttgcattcatgtcagaagtgaccctgaaacattctcactgcaatttttttaaacagtcaggatgaccacaactttgatcaaatcccactcagcattttccttagtcatcttgaaagcaaagctgtttggtgtgttggc

SEQ ID NO: 8919 - DNA, 201 bp, Bos taurus
ctgttgtcttggttttagacaattatgtgcaaaaccattgctgtgtaacttttgattcctgaattctaagctattgtgcgtttgtccactgtattctagtaagtggtaggcaattagaaatccaaggttgtggggtttattaaaatactgaatctgttatatattagattctgatttgttcagaaaaatgttgagctgcta

SEQ ID NO: 8920 - DNA, 201 bp, Bos taurus
cttgtttacaagctccctctcagggaagtgctagcttacctcgacttcaggtataccctctgctctgcagagaaatcccaggccctccctgaacttgccagaaaagtagtgtagcaaagctaaagtgtgcattttctactgttgtgtgcctttgagaaaaattttcagtctctgggcctccacttctccatccacacagtg

SEQ ID NO: 8921 - DNA, 201 bp, Bos taurus
aaaaagtaaaaaacagaacaaacccagcagctcttttctgggaacaggtgtgtcctgacggctgcgtttccagctccccaccacgacgtgggctgatcccctttgttcatcgtctcccaggcctgcccaccccactgtgtgtggcccattcacaaggcacaccctggcctggccttcagagcaccctctagaactgtcttc

SEQ ID NO: 8922 - DNA, 201 bp, Bos taurus
tttagtttggcctgtccacggctctgcttccaaaggggtttggtttggcggtggacctggaagaaagggctgctgattctgcccatggcaggtggctccccgtaggtagggccgatccactgtaagccacagtgtgcctctgactaattaactgcagggaagggacagtccagcgccaaggctgggagctgctcaagtcgg

SEQ ID NO: 8923 - DNA, 201 bp, Bos taurus
actaagtagtcatgtgacccacttttggccaatgaggtataagcagaagtctactgtatggaacttctatggaagctattattttgttgatgaaaacggatagattcagttggcccatcacttttttttaatattttttgagagaaagagaaatgtgaggttcacagcaaagttgagcagaaagtacagagttgtcagaag

SEQ ID NO: 8924 - DNA, 201 bp, Bos taurus
cccttgacaggtggccagccagctcccctcttaggtaaggcaagagacttaaagtccgtgccctggaggtcatcatgtaaacaaaggctccgccagggatgaggccctagagcacttggggcgaagggagtcaggggtgggggtgacactgtgcagcacccagtctcactttttagtctcacccccgcccccacccccgcc

SEQ ID NO: 8925 - DNA, 201 bp, Bos taurus
ttttttttttttttaaataaaatatcaatctaggccccagtgcacatcaattgaatcaaaatgtccactgggagggcctgaaagctgatatcctcaacaagtttctgccgatgatttttggtttcaaacagggatgagaaccactgggagagactaattctaagattaaaatccacctcccagaagtggccacccctcaaa

SEQ ID NO: 8926 - DNA, 201 bp, Bos taurus
gacactgtcccttccagccttcccccttcactcctgcttggcttgtttgtcaaaaccaaagcttaaatggtttgtctcttggctagcctgcagatctgtacttggcctccctctggggctctctgtcaacctgctgacaggccgtagtcaattagggtcactgaccagggtgggccaagcttgctggaacaaaggtggcat

SEQ ID NO: 8927 - DNA, 201 bp, Bos taurus
acccagtatggtgtcacggccagggctggggtatgttttcctgacgtaggagacttcttaggaatcaaatcattttttccattcccctgtcttctgagcagtcggcctatcatgctctcctcctgtcatctcctccccttcttcctcctcctgtacctggtgtttgccttccttcctcccacagaagcattcaggaggggt

SEQ ID NO: 8928 - DNA, 201 bp, Bos taurus
cccctgggtcagtggccgcaaacgtgggggctgaggatgtggtttccagcctcaccccagcgtacagccaatcagggaggaagatgggggcttctcccaccttctcctctgttctggccttggactcacttggagagaagtttgcataaggggctctggcagggagctcaggatgcgactggggaagccaaactggacagt

SEQ ID NO: 8929 - DNA, 201 bp, Bos taurus
ctgacaggtggggaggtcagctcaaaccccttcccagctctggccacctgaacagaggctgcccagctaagacttcagaatcgatggccggatccaaatcgtccttggcttctctgatgtatactgctgggtgccacctgccttcatcctgccccagagccaagtgtgacagtgggcacggggctggccctgggagctggt

SEQ ID NO: 8930 - DNA, 201 bp, Bos taurus
catctcatcctctgttgcccccttctcctcctgccttcaatctttcccagcatcagggtcttttccaatgagccagctcttcacatcaggtggccaaagtcttgtgatgctggaggctgacacgtctcaaatctgcagggtgggctggcaagtttggaagatccagtgctctggtctgaatatttgttcccctgctccccc

SEQ ID NO: 8931 - DNA, 201 bp, Bos taurus
gtgtgtgttggggcagacgtgctaacctggagtgggtgggggccactgactataacgtccctggaggaaaggacagagaagttaatctctttcacacacataaacttgtgcagcatcacgtctggcagggaaggtccagattggttcaggtgtatagtcgggtctgggaaatgcagataatgattaatcacaggtctcctt

SEQ ID NO: 8932 - DNA, 201 bp, Bos taurus
gcaaaatcaacaataacttcagcgatttttctaaagagtatagctagcaacagatttttttcaggaaaaagcgtttcatcactgtcatagtttagaaaagctagcacatggagataataaagaacagacagacttttcgttgattttatcattgcttttaaattctcggcaaaccatgtacctgcttattacttgtacttg

SEQ ID NO: 8933 - DNA, 201 bp, Bos taurus
catagggtagtatttgaaaaccagtaagagccaacagaatccaagtcacccaacccagagtttgaaagagaaggaaagaactgagcaatacgaatgtgaagatttagcttaatttatcatgggatcaaagtgactggtgctgccaatagcttataatcagcttaactggtgagtccacagttaataacttggaagtgggag

SEQ ID NO: 8934 - DNA, 201 bp, Bos taurus
gttacttggtttgcagtttggggccaatccttttcaagagctgcctagtgtcagagacagagtggtttattccgaacaagaaattcagttcagaataaactgaataaaagaaattcagcaaggccatggaacaccaaagccaactggcactttgcagcagaggaaggaagagcccagagaagagcctggggaggcgcgaca

SEQ ID NO: 8935 - DNA, 201 bp, Bos taurus
aagaataatattttttatgtagccggattaaaattattatgtataacaaaatggatagtaattccttaatgtaattcgataccagctcatatacaaactttagaattgtttccaaagtatgatttacaactgatttgtcctcgccaagagccagtcaggactgtgtcttacatctgatgtctctaaggtctccttactcaa

SEQ ID NO: 8936 - DNA, 201 bp, Bos taurus
agcaaatcatttgcaaagcattgctagttctttagttattacattatattagctccaaatatatgataattactgcaatagaacactttgatattccccggactttctcattcttaccccactcagtagacccaggcatcctgaccaagttgtcatactcctcttagaagttagaagtgtggaaataaatgaagatcaacc

SEQ ID NO: 8937 - DNA, 201 bp, Bos taurus
aggatgagcagagccggaggttctgccccactggagataaagctgacccagtttgagagaggtcggggaagtcttcctggatgaggagacatttaggccaatacttgaaagacaggtggcaattatctaaagtgatcactttatggatgctatactaggcatccatatctgaggtgcaaaggtcaagaagcaggacagaat

SEQ ID NO: 8938 - DNA, 201 bp, Bos taurus
ttagttttgacacttcttggacttcgaatgaatgaaagcctcataggaggtgacttttggtgtctggcttttttcagtgaacctaatttctgtgagatacattcatactgaagtatatttcagtattttgtcctcttcatcactatgtagttttccactgtatgaacatgctactattaattcatttgctgggcacttgag

SEQ ID NO: 8939 - DNA, 201 bp, Bos taurus
cttatgggtaaatcatcttgaatcccttttttgatagttggtattcaaagacatcattagtgcatttaacttgaaagggccaagtgtgtgtgcttgacataaaaggcaaatcatacacatctggcaggttctgcccaccgtgcccttcagtgagttaggcctggagagagcctgcactggaaatagaagtctctgcttgtc

SEQ ID NO: 8940 - DNA, 201 bp, Bos taurus
gatagtgtttacctgttgggtttcactttagattttatgttcggcacttaaaatccttgtttcactagagaaagggccaggaagttgctgagactctgttttactggctatatctcctcaggatcagaagcaaacagaaaaggggaaagaatttgtaacactctttgccaggcccagagaaagtgattgtttttattccac

SEQ ID NO: 8941 - DNA, 201 bp, Bos taurus
acttctggcctctctcccagcaccaatgtcacttcttttctccagtgaagtgaaatgactggggctcacagacaccagcttgaaagtgcctgaatgacccaaggaggccgctgtgactgtattagtcagccgtgtctgactctttgccacccacggactgcagcccaccagcctcctctgtccacgggatttcccaggcaa

SEQ ID NO: 8942 - DNA, 201 bp, Bos taurus
gtaagctttaaatgaaaatacttttgactatgttagtgatggactatgttagtgatgaaccaaataaggaagaaaaggggagaaaactagaaagataaaggaggcacaatggaggcagaaggagagaaagatagatggtaggtaaagaagaaagtaaggagggagaaaaactggactgactttgaggactaaatccttact

SEQ ID NO: 8943 - DNA, 201 bp, Bos taurus
aacagtgtctatttttcgttttgaatgactgcaatttcagtagcagctgttgcgctgaaaattataatggtcaacatttagtcagtgcaatgtttccccatcccctgcttcatcaatcaatcatttgcttcagctaccagaaaaatctcaaactttagttaacagtaactttaaaagcctcatcagaatctggcccgacct

SEQ ID NO: 8944 - DNA, 201 bp, Bos taurus
cccctggagaaggagcaaatggcaccccattccagtggtcctgcctgagaaatcccatggacagaggaacctggcttgctacaggcagtccagggggtcgcaactgagcactcgcatgtgcacgcagaactctcagaaatgaagtcagggaaatactgaaaagttaaaaagaggacaactgctttcccccctttctcacca

SEQ ID NO: 8945 - DNA, 201 bp, Bos taurus
actttgctcagctatatggggtttctggatatttgctccttttccatgatacaggggtggtgtgggggaggtgctctgctacttgttggacaaaatggaactgactatcaaaagtaaattctctactgtaaacacacagcttttcatccaaattgcctaaagagttttcttaccgttttaattgtctaacaaagactgata

SEQ ID NO: 8946 - DNA, 201 bp, Bos taurus
ttctatggcagttattcctgaaaagtcaagttcagattacaaagaaaaaacattagaaaactaaagttctatatgaattctatggccacttcggttattgaaggtataagagctcaaataactttccacctaagtttgttgttgtttagtcgctaagtcaggcccaattctttgcagaccctgtggactgtagcccaccag

SEQ ID NO: 8947 - DNA, 201 bp, Bos taurus
gtatgtggttttagaactaatattccagagtcccacttagttatgtaatagaaagtggtgaccacacttgaaataatttagcaagagtttcaaaaaagctaaagcactgggtccagaggtttcatcagaccacactttcaagcaagatttctggaactgtacttcctgtttattcccagtcagaactattgggaagctctc

SEQ ID NO: 8948 - DNA, 201 bp, Bos taurus
gcgttctggccgagcggagggcgaggtcaagagttggccgtctgcacaggtgggccgcggcgggagggcaggggcgcgcccgcggcgggccgggtaggcgcgcgagactcggggcggggtcagaggggaacgaacggcttcctgagtggcttttcgccgcttccggggcctggcgcccgcgcgaggaagacggtgttcttg

SEQ ID NO: 8949 - DNA, 201 bp, Bos taurus
cactcactggcacaaaaagcagggtgtcagagccctgaagggtcttttagaaaggaaaggccagctctgcaagcatcacaggagcctggaaacagggtccctgagtacgacatggagcttccatactggcagacaactttgggtgatcttagaaatatatggctttctctaagactcattttctgaaagaaaataatgctg

SEQ ID NO: 8950 - DNA, 201 bp, Bos taurus
tgtaccgttggcttctcatcggagtttttggcttagattattttcatttggaatcctttttttctttccatgttcttctttctctaaattggcctggaattctgtcattcaggactcctaaaacatagaactctcctgatcagatcagatcagtcactcagtcgtgtccgactctttgcgaccccatgaatcacagcacgc

SEQ ID NO: 8951 - DNA, 201 bp, Bos taurus
cccgcgtctgttgaatcggccaatcagcgcagctcccgggcctcgcgggggccgtttccatgccaaccgcaggggggcgtgcgcgctctgcggcctcatcgctatggcgacctcctcacccgacacgctctgggaggtcgcaccgcgacccccgggcgttcagggctgggtggggccaaccggcggcggccctgggctcct

SEQ ID NO: 8952 - DNA, 201 bp, Bos taurus
caggcctgctgggaagggcagggccctgatgggaagaaccagggatcctaaacctgtggcaggacatctggatgactgcccgtaatgactctacccctccacccggcccctctgggtgggcaggggcggcccacgtctagctctgggaagggctggagcactcacagtcctggaagctgctgcacaggcctctcgccaaca

SEQ ID NO: 8953 - DNA, 201 bp, Bos taurus
taagcctccattaagatttagtggtaagaaggcactcttggcatttgtggatttgatagtcatgatttcagtgtttgggcctgttcctaatgattcatacggtaatgtgaaatttctgaggctcaactggaatggtgggcagtcaatctgtgcttttacagggcagccacatgccacagggttgacagagggcccttgctg

SEQ ID NO: 8954 - DNA, 201 bp, Bos taurus
cactgtgtgccttttatgttcttggagtcctggagttggaaacgacatcgaaagttcatcatgtttcagttcccacttggaacagaattctacctaaaccatccagcttgtgtcgttgtcgctctcttctctgagtctccggctaggaggatggtcatccggatatgatggatgggagttggctggcaacctgcttataac

SEQ ID NO: 8955 - DNA, 201 bp, Bos taurus
cttcttcctttgctctctggaggaaatgtcactggctcttgcagttggggcagaaaccaccatagggttcctgggcctttgagagggcagtgacaggggaagctcttggaacccaaaaaccccgcgcacatagcgtgtcgggcgcctctccaggctgggccccactggaccatctgttaatccacttttcctcctgctgtt

SEQ ID NO: 8956 - DNA, 201 bp, Bos taurus
ttatttttaaatgacatggtcttactggactagcaaagattaataataaataataataatatgcagggttggcaagcttaggaggaaaccagtcatctcatatgactcggttcaagattaacctgatggaactcttccgaaaagtagtttggtaatacgtaactacagccttaaataatatgaactctgtggtcaagtaat

SEQ ID NO: 8957 - DNA, 201 bp, Bos taurus
cccattctcactgctcagcccgttttggctaccgaacctgacaattaatgttgaccctggaaacactgacctccccagtggaggccttcatctgctgggcgcatctggcaagcagtcagtggtgcttacctggattccttgattaatgtagatgtaaagattttatcaaggctcctggcggccgggcttcaagatgtaatc

SEQ ID NO: 8958 - DNA, 201 bp, Bos taurus
taccctgatcaccaaggaacagaccggggcgggtgggggttaggttttgaaaagacatcaggagagccatgaaatgcagtcactgagagactgagaaatgaggccctcggggtggtagctcagggcctccaggtgacggtgacctctgctgactgcctgctggggtcagggggtggctcacacccacagtacgtggccaca

SEQ ID NO: 8959 - DNA, 201 bp, Bos taurus
ctccattagaccagatacttcctgaagacagcaaggacagcatgtaggcaggtaccaagaagtgtttgtaaagttgaagagagtgtaaatagcttacattgaaaattgttttccctcaataatcatatcattcacttaaaggtattattaaataaaatgatataagaatcaatatatttgaaatttgtttttgattttgaa

SEQ ID NO: 8960 - DNA, 201 bp, Bos taurus
ttggtgcagctcattgatttgctgaacaattacgtttgcaccaacctaatacttggtttgacaggcttgaaaagttccctattatgtactgaattaactatggtcacctttaagatctaagcactcaaaactactaacttatttatttcatgacataaatattgattggttaactcctagagagaagaaaggaattaccat

SEQ ID NO: 8961 - DNA, 201 bp, Bos taurus
ttaacattgtaaatttgttattttcaaatgaaaactgatgtttgaccacattttgttttggaattatctactcttaataaaatatattcttgaaatatcccttcgcccatcagcaacaattctgagtactcactccttgcctggcatcattccaagtggtttacaagcattaacttcacaaatccctgtaacaagcttaag

SEQ ID NO: 8962 - DNA, 201 bp, Bos taurus
ctcagtggacatgagtctgaacgaactacgggaggtagagaaggacagggaagcctggcgtgctgcagtccatggggtcacagagagttggacacagcttagcaactgaacaacagcattcctgttttatagatgaggacagtgagactcaattacccaaggtcacagagcaactgagagtgccaggaatttactttcctg

SEQ ID NO: 8963 - DNA, 201 bp, Bos taurus
tagcacaatgacattgtctctgctcactgtggacacatgtccttttcacagtctaatctgtgtcctgtttttgcacttatataatttttattggtgatttcagtgtttacaaggcccctggatgtagtactgaagagctgtctaagtgtcctaagtctgtgaaagctgggatgtgccttatggagaaaagggtatgtgatc

SEQ ID NO: 8964 - DNA, 201 bp, Bos taurus
tgggtagtgacatttacaatcaattttagaagcactatcttgcttgatttgcctccatactgtgtggatttgtttctgtttgaaacatatgtactttcgacatttcactgtaatcaaggaaccaaaaataacttgtaaatgggcctagcatttttactccaggtgtggatttgttgttgttgttgttgtttgtttgtttct

SEQ ID NO: 8965 - DNA, 201 bp, Bos taurus
ttctgtttccagataattggtatgtttagggttaatggttttgtgtgtattggttttccctctacagccctgctgtgaaaactctggatggaatgcttatctatacacatctctagccttcccagtgcctgcccagatctggctcagcaggtccacagaaccctctatttgtgaagaggacgtggctgccacgagtcagcc

SEQ ID NO: 8966 - DNA, 201 bp, Bos taurus
agcctaatgtcaaacagagcaaaacaagggaattgttaggaaaaatcatatcaactacctcacccctgaaaataagtattagcagcaatgataataatactaaatgaataataaaagctgcaagtgggcacctccataggccagacaataagtaccatttcgctttacctttcgacagtcctgccaagtaagtggtaggat

SEQ ID NO: 8967 - DNA, 201 bp, Bos taurus
tccatggggttacaaagagcaacccattgtgtgttgttcacacaacttagtgactgaacaacaacaacaatcaacaacgtgatctgtcctgcatctatctgctgaatgcttttcaccctatggctgaaggactgactctctcctgaggacactgctttcctgcagcccctcagtgggggtgttgcccctctcatagccgtt

SEQ ID NO: 8968 - DNA, 201 bp, Bos taurus
caactcttcagccctcttttctctgctatttatgttcgtgttacccttttctcccccttctaccttccaactcctcaaagtaacagattggctatctgacatggtctttctgaaagagggattcttggcctgaaatccaagaacagtggctcttaagaaagacgagaagccacagaatggctaaggtcatctgggtagaag

SEQ ID NO: 8969 - DNA, 201 bp, Bos taurus
gatgatttctgacattttataagttaataatgtcatgtccatataatcaaatgtttgtgggcatctgcactcatgcatttcatgactacttgctggagaaataaaacgatcctaccaacaccagacccctccataacaatacggaagtgggagagaaaacagtttaaaattgagtgctatcagttttacattcataaaaaa

SEQ ID NO: 8970 - DNA, 201 bp, Bos taurus
ccccagacccgccttcacgcaaggggctccatcaggtttgagatgtggctcagggctggaactgggtgaggatctatggcttcccatcataagagctcaagtcaggcccctttcaccacacctagagatagatttcttttttattttaacacatcaagaaggaccaaagagagcttccaatcagtaatcccatgatcaatt

SEQ ID NO: 8971 - DNA, 201 bp, Bos taurus
ggaaaggtttctttgggaaagtaacatttaggatgaagcttgagcagtggaatgagccagaaagggagaagagtgtattgcatgggccctgaatagggaagcttccggggtatactgaaacacttattctgccaaagaggagtgaacacggaggagaaaagcatgagaagaggctgaacaggccaaggaagagactgtgct

SEQ ID NO: 8972 - DNA, 201 bp, Bos taurus
ggggcggggggagggaatgagaggttagatgagccattgaaagtcatagaaaacaggaaatagaatctgagtctcttgacttctagcccaggggcctaaccaccaaactgaattatagcctcagagtatcaacagatcactgaccagcactgacaagtcaggttcatggcactcattcattcacacttccacatggccaaa

SEQ ID NO: 8973 - DNA, 201 bp, Bos taurus
gcttgggtccagtaacacttttgcccttttgaagcaagaagactgacattttccagcactaatgctatgtttattcaggccttaggatatcatttcattgatcattactcagttctgtgaattgtgctcttgaaagacattataccttgcttgttgtctcttaaatagaaatgaaaaaattagcatataggatatcatgac

SEQ ID NO: 8974 - DNA, 201 bp, Bos taurus
gaattcatttaagctctcaggcctgttacatggaagatccagggggaaaaaataattttttaaaaggctgatttataatttttattacagtattaacttattataatgatttggccaagggtttatttataatttccttgtttctccctagttttcactttagaaaaatttaagcctagagcaaaaatagattatgaatag

SEQ ID NO: 8975 - DNA, 201 bp, Bos taurus
ttgatttgctgacaatctttggcgttacctaacttgtagaagcatctccctgatctgtgccttcatctttacctaatgttctccctgtgtacatatacctttccagatttccccttttttataaggacaccagttaaattggatcagggggcccactcaattcccatataaccagcattaaccaatgatatctgcacaaaa

SEQ ID NO: 8976 - DNA, 201 bp, Bos taurus
acagtcacttccaacttaaaatgaatttattgtttttaaaatatttatttattcctttggttgcgtcaggtcttagttgcaggcaggtgggattttcaccatgtcatctttctgtttggcttatggactcactctctagatgtggcccgcaggctccagagcactcaggcacagtggttgctgcgcacgggctcagttgct

SEQ ID NO: 8977 - DNA, 201 bp, Bos taurus
tcagcagtaggggtctcctcaggcatgtgtctctttctatcagggagataaatttacaggagcgcctacctaacatttatcttggtcccacaggccagaacgtatacatttttctcccctagatcaatcactggagagaagaacggggttaccatttttggtttgggccagtgtgggtcagagggaagggcccaacctccc

SEQ ID NO: 8978 - DNA, 201 bp, Bos taurus
ctggagcctggtaattccactttttgctgaagctaaaaacaaaagcagatttccttagtttcttcctaatgtccatcttctctcccaagatgccatccaggacatagcattttgtttagttctcacgcccctcagacctctcctggctgttagcgtttctcttcccttgtttttaatcctcgtatttttttttttttttgt

SEQ ID NO: 8979 - DNA, 201 bp, Bos taurus
cttgtatcgtctaactggcagaaacacaggacacagaagaatgcctgagaataactgcagcatttgaaatacgcttccagcattttaaagtcactaggcttttagcagacaaaggccttcattggaagaaattatttttttcccctagcaggctaagtgatgcttttggtgaatcacttctttactcagtttttagattgc

SEQ ID NO: 8980 - DNA, 201 bp, Bos taurus
agtatattaccctgagggaacagtgtaccaagaaaaataaaggctgactgcagaatatgctaaacttgtggccaagaaaatggaggaggccaaagaaaaatgccagaaagagactaccaagagagggaggctgtcctctccaagagcttccacctctgaggccagtcaaaactaagatgtgagttggttccaggacagagg

SEQ ID NO: 8981 - DNA, 201 bp, Bos taurus
caaggtatccaatgtttgattgaactccctgagatcttgctctctgtgcaggctcctagtgctgttgtgaaactggactcacctttggcctagaatggaatgatttcagacaagagatgataagtattagggctgaaacacagatggctgcagaggagactctggcatctggcaaatctttgctttcttagggcccttcag

SEQ ID NO: 8982 - DNA, 201 bp, Bos taurus
tctcattatgtaatttagaggaacccttttaatggtaggatgctaaaaaaacaaccaaaattttaaaaaagaacaacaaacaccaaacttctccagtcttgaagctgtagtatgtttgtataacaacacatttatgcatcactgacttaggattttgatgtcatcatcagtgagattttataatacatatgtgtattcttc

SEQ ID NO: 8983 - DNA, 201 bp, Bos taurus
aagtcaagaaggagggggaccaaagacccagagtggcccaacagggggtgagcttctctacagactcaccaaggaagccatgattctcattggaaaaaagcagatcaatacagaggtaggggactgttgctgctattgttcagctgctgagtcgtgtctgactctgcaaccccatggactgcagttcgccaggcttccctg

SEQ ID NO: 8984 - DNA, 201 bp, Bos taurus
gaggaagcgttaagctggcagcacaaagaggcaaaaagccaagacggatggaagatggaagaaaatggtctcgattttcttggtgttcgatttcttattttctggccacagtttccaaccatgtcagctgcagataaggctcattcttaactgtgtgttgtaggccaaaaactctaggaatcatgcaaagcatgggaggta

SEQ ID NO: 8985 - DNA, 201 bp, Bos taurus
taggtaagcactaaatgggtcattctagcttattaaaatataataatattttattatattacaatgataatctatatggccaagtagaagtgagtagaaggggactcaatattttattatattacaataataatctatatggccaaatagaagtgagtagtagaaggggactataagcctcagagaaacacaaggcaagga

SEQ ID NO: 8986 - DNA, 201 bp, Bos taurus
tgtcgcactccaaaccattcagcccctatggccccagcccagccctgttggcaatccaggaaaccccactcttcctgcccacacctagctccatctgagggcttgcaggccaccctcgggtgaagggagaaaacagatgttgctggtttccaggagcagttggctgtctgtcctgtgcaggtcagacggacacactgaact

SEQ ID NO: 8987 - DNA, 201 bp, Bos taurus
cttactctgcgggcactaaccccatcatggagtttctaccctcgtgacctcatctaaacttgattaccttctaaaggccctgcctctacatactgtctccgtacactggggtaagaattctgttgacactcagacatggagtttgtaactcccagcagctccaaaaacccttgagtggccaaatgatttcctttaggaata

SEQ ID NO: 8988 - DNA, 201 bp, Bos taurus
tgaagtcaccagtgtaggacttggatgcgacagaacttgtgtctgtatgagaggagacaccagagaacactctccatggcagacaaagaagaggtcccgcgagcacacaccaggccagcggccaccctcaaaccaagagaagagccatagaaacctgcctcaccagcaccttgatcttggacatcccagcctccaaaacga

SEQ ID NO: 8989 - DNA, 201 bp, Bos taurus
accctctgaacaccagtatcttccacgtggacatgtagcatccacccacttgctgaacatcaagtgaagaccagtgccaggccctagggatgccagtaagatgtgggtgagacagagaagcaggtgctgaatgtttgctgtctttagaccagaaaaggtgaatgctctcccggaggtctgaccttgagtgcctgggacctg

SEQ ID NO: 8990 - DNA, 201 bp, Bos taurus
tattaattatggtatggctaaacctggcccatgtggaattcagggtgtctgagaagaaaaaagtttgttgggttgataagaattatttaaaaagtaggacaggatattggccttaagatcagttttcttaacgttttcctcttaactgctaagggcacaatttgaagagctctgtgctgacttactgcagaagatagaagt

SEQ ID NO: 8991 - DNA, 201 bp, Bos taurus
gagtctgtctgtgttccaaggccacagacaacaacctttttgctggtgagaaagagggacagtcaagtgatgctgggagatcagctccaactgcccccagatgaaccagtaagccccctggccctggtcagtagaaggatcttgggatatgcttttattcctgagttgacttggttctctgggtcatgccttgaccctttc

SEQ ID NO: 8992 - DNA, 201 bp, Bos taurus
catatttactctttcagatgaacttcagaatcaacttgttgagcttcaaaacaatctcttagatatgttcattggaattccattgaaattgacatttaatctggggagaggtgacatcttcacaatattaaaatttcccattcacgaacaaaatggcttcccttttatttggtctttcttttacatttttaaagaaaggct

SEQ ID NO: 8993 - DNA, 201 bp, Bos taurus
tctttggcaggccccaggaaccttctctaagagattctgctgactcttctttgacccttcccccatcctgtggcctgagatgtgggccatcttagacatgcggatggaaaacatgccctggggatgcaacatgatgatttggaaggaatctgtgtccctgaacatttcttagagcaaaagtcttaccagatgctctgggtt

SEQ ID NO: 8994 - DNA, 201 bp, Bos taurus
gcctgcctcagtcagctcttctgtctcacctggaaaggcttgtcttcactctcatggtctcttgagtttctgtgtgcacttctgcttggtccagactgcttgatgtcctgggatggcagggcctttggtgcagggcgcgtggtggggagcaggtgtctccgcgctcagggctttgtctgcgtggcctgccgtcctcggagg

SEQ ID NO: 8995 - DNA, 201 bp, Bos taurus
agcctcatctgtgatcttttctgctcaggtgcaagcaatggacaggtaagggtcgggtgttccctcaaacactgttaatcctttcacccacaagggcagcgggaatatcatgccagttatgggggcctcccagggttacaggcaactcaccagcttttccagctcaagaatcttcttttcctgctgatgtatctgttgatt

SEQ ID NO: 8996 - DNA, 201 bp, Bos taurus
aacatgataaaactcaactcggcagggccagcctggggacttcctgagaccagaggatgggtaagcagggggctaggaagggagcgccccaggcaaaggtcaggagggccagcaacaccaaacagcactttggctatttctggggacctctgtcaccccataagatgggcccttcttgccaagtctgcctctggttggcaa

SEQ ID NO: 8997 - DNA, 201 bp, Bos taurus
tcccctactggcttctcagcttttccactgagggatccatgaccacctgctgccaagtcaacacacacgtcttctgattagtcacacggggtggccatccgagcacacaggagcctcaccagccaatgagcactcgccccctctcaaaccctaaccaaccccaacaccttcaggccccagaggttctctggggttcagttt

SEQ ID NO: 8998 - DNA, 201 bp, Bos taurus
cccctgagccacaggtgtgccttccgtccgactgcacgctctcagttgagttccttaacctccctgaagcgcagcttaccgcatttgtaagaaggagacaataaccccttacaggatgattgccaagacagcaatggggactgggagggaggccccaaagggaggggatatatgtatacttagagctgattcacactgatg

SEQ ID NO: 8999 - DNA, 201 bp, Bos taurus
cagagtacactttaaatacgtatactgtacaatatgcaaacatgtcaataaaactattgttttaaaaaacaacaacaaaccaaacaggtggccagctcaccggctagtttgcagaccctgaggtaaaccaaagggtgtccgcagacacctgtgagcagtggggccccagctcatcaactacagaagactggagggctgtga

SEQ ID NO: 9000 - DNA, 201 bp, Bos taurus
gggaggtcgctgctatttgtgctggtgacacctggcaccattcttaagatctgacagactcactgattagaggaccctgtctctgatatatatggatctcgggccaatctagttaatctggtttcattccatgatcacaacctgcatccctgaccccaagtagttatcttcaagaggcagctaaatggataaatgagggaa

SEQ ID NO: 9001 - DNA, 201 bp, Bos taurus
ctactcaactttctggctgtagttacctgttctatgaggataataaatgtgatgagatcaaatggtgagtttggaggaggtgaatttacaattctaagattgattagaggttcatagacttacagatacatcgagctgtgacttcgatctgttgtcataaatggtagttgggtttaataagattgttctccccttgacaga

SEQ ID NO: 9002 - DNA, 201 bp, Bos taurus
gctccacctggaggacaggcgctcccttctgctgattgctgtttccagacattggaatgaatgaatcaagtccatggcctgattttctgacctgaaaacaggcaggaagagaatacttatgtgaatggtcatatctttgaggacagtgactgcaggagctggaggagagtttctgatggctgggccagccctgcttctctg

SEQ ID NO: 9003 - DNA, 201 bp, Bos taurus
gagaattccttctaaatcaacagccagtggtcaaagtaaacactgggctgaagattacttttgagaaactgcttacaacaactgcaaagtcattaacaaagcaaggagctggggtgcaaccacaatggaaggcctgaaggaatgtgttgaacaacgtcgcgtaagtcaagcatctgtggccaggatccagtgtttggcgag

SEQ ID NO: 9004 - DNA, 201 bp, Bos taurus
aataaagaaccttcaactactctgaacctcctgccctcattctgcagaagtgacaagttgtttcatcatcatctgccttgattgtcctgggcaccagaaataatgtcgtcactcattcattcatcaaatatttactgcaaccccgcgccccccgccagcctatatgaaagcactgggctagcagcactggagtgcaaagtc

SEQ ID NO: 9005 - DNA, 201 bp, Bos taurus
acatatgactgtgtgccaggatcgggccagggtctgtaatgtgctgtcttgtccaggtctcatcgtcatgctagaaagttattattattcccgttttgccaacaagaaacagcaggtccagcttcctgaaccaggtggcgtggtggcagagtgatggcagacaggagacaagcatgtgtaagttcccaaatctcaacagga

SEQ ID NO: 9006 - DNA, 201 bp, Bos taurus
tttctcctcctcaaagccgcgctgcgggtctgtcgggagccttgtttgcttcctcccacagctgtctacaccgccggggccaaatggggggccctttctgcctggatccaataaatcgctcaccccaaatttagaaagataagaagcgacacaaatcatccggaaggaggccccattcgggcattctccgtcccacctagg

SEQ ID NO: 9007 - DNA, 201 bp, Bos taurus
gcctcatctgacacaaacaaccatgcctgggacctgggcgatacgttcagagcagtgtcagtgcagaagcagatacgggacatcaacgaaaaatgtccagcggcccatctcaactttttccccccaacagttcagtatgactgggggattcaataatctgcaccacaaaacccactggctgggcaccagaaactccacact

SEQ ID NO: 9008 - DNA, 201 bp, Bos taurus
taaatataccacatcttctttatccgttcatctgtcaatggacacagattgcttccatatcttggctattgtaaacagtgctgcagtgagcactagggggtgtgaatcttttcgaaatatggtatatttatacaacggaatattattcagccacaaaaaagaatgaaataatgccatctgcagtaacatgggtgggcctgg

SEQ ID NO: 9009 - DNA, 201 bp, Bos taurus
attcctgcaggaggggatgctgctgttgtaagttctgaagacccgttattccccctgcaaagatcacatgtgttttcctcttactgaacaattacttggggaaagttactcacttgctgggtcagaaactgaaaaggaaattgctcttagctcccttggtctctgaaaacccactgtcaacaattcaagatgctgtgatta

SEQ ID NO: 9010 - DNA, 201 bp, Bos taurus
ccagctaagaccggcccagtgggctcaggtgaccctgaaagtcagaggtcggcttgcccttgaccacacacaagagccacccacacacaagagccgcacatgcggcttctgaacgagatcacggccggaggagctgagaaaccaaggcagggggttgcaggccttttctttctacagtttttactatgtcaataggcaact

SEQ ID NO: 9011 - DNA, 201 bp, Bos taurus
acccaagagctgaggcaaagcagaagcagcccacgggccaaggtagggacaagtggacaagaatcaaacctgagatccaagagcaagaatcaggtgattcgtggtgggcgcttggggggccagggatgccagacccgcaaagcacagttatagccctgagggagggtgagctgctgttctccctgaaagaagagaaagaaa

SEQ ID NO: 9012 - DNA, 201 bp, Bos taurus
attttctgagcccaaactgggacttttgatttgacaagtaagcatgttcttactgaaacaaaagaagagaatgtggaaagtggatttgcattgtgaggcctgggatgtactgtgtcgtcagatttcaaacgctctgctgtttctccagcaaagggcagtgcccactccaatacgggggatcaggattgcagccctccccgc

SEQ ID NO: 9013 - DNA, 201 bp, Bos taurus
tcccttacctgggggctgttttgcctccatgtctttttaattgaagtatggttgacccacaatgctgtgttagggtcagaagggcctggcagtgggcagctggtttatctccaccctgcattccctcggggctcagcgtcccagtggctataatgtgatggcctgatggctgtgacatcctttgttgactgagacagcaat

SEQ ID NO: 9014 - DNA, 201 bp, Bos taurus
tgttctctaggccagtgagggagaggtaccagcagtgtgtgtgtggagtgagaagagggggtagcaccgggggtagcccgtgaaggaaaagaaatccacaatgaagatagaaatggaatggccagacaggtgagtggtgtccagttgtccaaggatgctgagccctgggaggcagtgcttacagtgtcacctgtggcaggg

SEQ ID NO: 9015 - DNA, 201 bp, Bos taurus
acccatcactcccctgcccaggcccctccttgctctccagtccctctttgttcgaggtcctggtgtccaagtgaagctacatgtgtccacagtcaggagcaaggcccctctcccaggagaccctgtccttctcacagggatgtttgatgacagatgagccttggcaaggagcccaccatcgtgaaaggagataggagtggc

SEQ ID NO: 9016 - DNA, 201 bp, Bos taurus
ttattttctccaactcaatgtattttgaacagaagttaacagtttcttgcatctagtcctgcaaaaactgtgggcctgacaggcctcagtttcacctctttgtattccctgccgttggcaagcatctacacatctgatatgcacagctaagcgtttggccttagtttgcctcattcctgagttcccacctatgtcaggctc

SEQ ID NO: 9017 - DNA, 201 bp, Bos taurus
cggccacagagtcagggggtgaagcaaaagccagctgagaaagcagcttctgggctccatgtcggggtagacgatccacttgggcacccgtaccagctcactgccctggtgtccacaggcctcccgtcattgtgactgggagtgggtccctgggtggcacagggctggcaccaagctgggttaggaaggcaggaggccccg

SEQ ID NO: 9018 - DNA, 201 bp, Bos taurus
ggactctccacacccctggtgaccctgcacattcccattggcctgcggaggctggaccaggaatgaaggggtccccaggccaggtcagggtggaccccccgcagtctcgtgggtggggagtggttagggtcagtgatatgcccaagctcacccagctgctggtggcaggactcactggaatctggcctcggtgtccagctt

SEQ ID NO: 9019 - DNA, 201 bp, Bos taurus
ggaagttgtggatggccctttcatcttagaagacgtttttcctgaatccatgaagtacgattttcacctctacctcactttcctgtggtacaggcagtaatgtggaccctgggcctggctggatgtgaagccccttcagtttccacccccttccatgagcgcagtccgtactgtttaggaagtagacataaaactggttct

SEQ ID NO: 9020 - DNA, 201 bp, Bos taurus
gtggaggcaactacaatcctcacacacctcttgtgtctccgtgttcaggctcagggtccccgtggaccacccctcctggccgtgtgctgtctcttcccctgccctagacggctgggcagaacccgaggtctctgccgtctaccaggtagtgttcaggcgggaggggtggcctcaccaggaatttatttctcctttggggtc

SEQ ID NO: 9021 - DNA, 201 bp, Bos taurus
ccttgagcgaggccgcctcttcctggggctagcaccctccaacagccagtgtggagggccaatcccgcttctaaggacggcccatgagtcggtggccctgaaatcagccaacttagcagatgaccaggagccagtgctgaagaggggggctggctttcctgggagacacaaaaccaaggccctcagagccctgcccagccc

SEQ ID NO: 9022 - DNA, 201 bp, Bos taurus
gtccggtcagcccagctcagggccacacccagggcttcccctgactacggacctcagctcacaggaggaccctgcccctgagaaacagtggctacagacatttccaggacgtgtccggaggcctgaactgtgccccccagtggcctcttccaccagcggaagccctaaggtcccctgaactagtaactgctgagaagctgg

SEQ ID NO: 9023 - DNA, 201 bp, Bos taurus
gcagaattccagacagaaacgctcctcaggcctgaggtacggcccagctctcctggggtttgcagtctgcaccctgcccagctccacctccttcccaggacggcacctcacacacccagggccctgcatcctgggtcaggggcctcctgagggcactagcacagcccctcctctcatccttggaccaccctgcggtacagc

SEQ ID NO: 9024 - DNA, 201 bp, Bos taurus
catcagtttttcacttaccaattggttttctgccaattctcagaagaaaaggtttagttgtgaaagactgctttaccgtgctgaaccctaaaacaatatctgcttcctgtggactctggagacctgagtctcgctttgaatgcagggcgggcgggacccagagcacagggagaggctgccaaccaagggcagagcacccca

SEQ ID NO: 9025 - DNA, 201 bp, Bos taurus
aaatggccccatgctcgtggaaagttaccggtgccattgtcccttcctctgggcaacatgtgggtcactctctcagggcccctctgctaacagcccacttccaggacaaatttgagctgacactgtcagtcaccctgctccccccaggcaccaaatccacaggccatcatgggccattttcaaaacagtgctgtcaccctg

SEQ ID NO: 9026 - DNA, 201 bp, Bos taurus
cttgtgcttgttccccaagctgtgctacctgctgcagatggcaggggaccaaaggcccctgaggtcccgtccgcatcatcttggatgctcatcttcccacgaaacctccccaggaggaggggtgacaccaagaagaaggagaaaagctagaactggagttgatgctgggacctgcaggtgaccttccgggagagatgccgg

SEQ ID NO: 9027 - DNA, 201 bp, Bos taurus
tactggccatacaggttttgggagaaattaatttactgtatatctttttttttttttttaagtcccctcaataccaagtctcctaaggagaggcatcatatattgtgtgcagtttgtgcagttgaacacttttttgcacagatatttattttcacactcaatgaagaactgttacataatgagaactgctggtgattaagg

SEQ ID NO: 9028 - DNA, 201 bp, Bos taurus
ttttcttaagaggaaaagcgctagatttctgaactttagtgatggtcttctccttttgtttttaaagtattctacattaagaattatctgggagaagtgtatttcggggtcacttatacatagatacagacataagtaactggtaataccaaatcaaaagttgaattaccttaattctctacattattttgaatctgcagt

SEQ ID NO: 9029 - DNA, 201 bp, Bos taurus
agataacgggcaccaggccacaaaggtcagtggtccctgaaaaagggaaatgaacagactgaacctgatggttacttcgtcttactgcccgaaagacttttcaggccgctacgcagggaagggaacccagggaccgctctgagttgaggaaatactgatagattctggggaagcctcatgggaagcaagcagggcagagtg

SEQ ID NO: 9030 - DNA, 201 bp, Bos taurus
acaataaaactctaagacaggcatcagcaaactacatccctcggcccttatatgggacagagccacactcccttcgtctacatgctgtctctggctacctttccacagatgcacaactgggtctcccagagcctaaacctcccgggctcttcacagaaaagctcgctaactcctgttcagaaacatcaccaaaaccaaatt

SEQ ID NO: 9031 - DNA, 201 bp, Bos taurus
tggaagtatatagtaatgtgttaaaggaccataacttttactatttgaaaaaaaggagcaaattatgatcattctttatttttacaatgtaacggcctaagtcctcttggagttcaccattactcctaccatagagcctgttaatattccttagaggttgcaaactctagcactgggctccctcaggccaaactatacaga

SEQ ID NO: 9032 - DNA, 201 bp, Bos taurus
aaacacaccttagaacagatcatggggtctttattctaacaaataaagaaagggcagactccacccctgataaggcaaaataactgcagaacaaaggggaagccctgctcaaaattcagtatagactctgttcaccaaatcatttcctatcaaggagataagtatcagcatacactgttgaaaaagatggcagacatccat

SEQ ID NO: 9033 - DNA, 201 bp, Bos taurus
agaaactgtggtctgttttaagtattgagtcttaaaaagactacttttaaacaaaataaagattctggtcactaattccaatatgtgtggggcaaggaaaggttcccatcaaaccgtcaaaccatcaagccattttccatcaccacctgagtgttcaataattcaactcaattttcatactatgtatcccaagacagtgtc

SEQ ID NO: 9034 - DNA, 201 bp, Bos taurus
ttaggttattttaataacatgtttttttagtccttgaggaatgcattaagctaagttttgtttgtgtattacctgagtttgtaattttgttgaaacttaacagcatgttacactatgtttcaggcttcccaggttgtcctagcggtaaacagcctgccttccaatgcaggagacataagagatgaaggttcgattccaggg

SEQ ID NO: 9035 - DNA, 201 bp, Bos taurus
atattcactcatgatataaactggaaaggagtcagtgatgagaaaagaatcataattattaagaataatgaaatggacagaaaagtatcaccaaaaactagtttatatcacccagaaagactcaactaggcaaaagcaatgctaatagctaagcaaagtatttatccagaaaggaactcaaagaaatcatgtattgataac

SEQ ID NO: 9036 - DNA, 201 bp, Bos taurus
ctcagggttatctctggccaatcattgtttttttaactttttattttatattagaatttagtcaattatacatttatggacatgaacttaagcaatctccaggagacagttaagacagggaggcctcacgtgctgcaatcctggggtcacaaaaagtcggacagaactttgtgactgaacaataacaacaaaaacatagtc

SEQ ID NO: 9037 - DNA, 201 bp, Bos taurus
gactatcctggccctgtggaggtagcaatgagcagagagcctgataaaaatgaaactaacaaagagcaaagcaggatagaggaagaaatgagccctaacctactttttgaggccctgtggttagccatagctgaatccagtctctctctcgacattttggatttgtaagccaacacattctctttcctgttttagtcactt

SEQ ID NO: 9038 - DNA, 201 bp, Bos taurus
tatgtatttttattatcttccaatctgtctcatcaaaatgacccgtctcttgggcataaatggtggtttcctactctgataagctcattaatcttacaacgttattgaccaaaatgctaattgttatcctttagaaggataaagaatatctacacttcagtaagagccttacagagccacttcaatccatacatatgaata

SEQ ID NO: 9039 - DNA, 201 bp, Bos taurus
caggcaattcagactttaaacaaagctcaagttgaaattatccagaattgaaacaaacctttaccagcagatatcagttttgaaaggcaaagaagtagctaaaactaagctatggctagttatgaattgttcacttaacatttttttacaggtgctgcaaaactgaaaacgttggtaagcagagctgaaagaactattttg

SEQ ID NO: 9040 - DNA, 201 bp, Bos taurus
ttctgatacagataatatcataatttcacccaaatcaaaatatgtcaactgggaaaagtgtctctaaatgaagaacatcttctttgcaatttctccctccacaaagtgtacacagtttaagggttagctttaaaaaaaaaatatatatatatatattcttacagatacatcaaattttatacttgagcaaacaaaatataa

SEQ ID NO: 9041 - DNA, 201 bp, Bos taurus
atttaaatacttctaggataggagggaccaaaatcctaactgatgattgaagccagggcaaattgctttattagaacacagtagttccaatagaggcccagggacacacaggcatcaagatctctggagtaaactactataaataaggcaaaatttgtctggtgacccagatcttacatgaagtttcctcagggttcatag

SEQ ID NO: 9042 - DNA, 201 bp, Bos taurus
cagtattaatgaacaagcatattaatacagttattaatgaatagaaaaccactttctctctattactattttaaaaatctgtggttacataatgagaattcttttaagagtcctaagttcttattcatagctcatacatgtttcctaaatgaaaattatttttctttttccagaaagttgggagtataattgatacatttt

SEQ ID NO: 9043 - DNA, 201 bp, Bos taurus
gagggactatcctaccacataacccactatatttaaacactgtacttctaaatgactcacaaatgaatgctgggaatatgactcacccatgaatcattttaaattggaaaacatagaaaaatgtaaaattacttcgatgaagaaaaatatggctacacaaagtatgcaaagagggaaatatcattttacatttcaatagca

SEQ ID NO: 9044 - DNA, 201 bp, Bos taurus
tgaactgtcttccccttgggcctacaaactccaaggctatttggctctaattaaaagctcaataaaggttgaacttctgattgtgggcagtttggaggcacggcctctataactcatcggtgtgtcttgttcagggtctcccacagtttttgcacacagtaggtgttcataattatatctcgagaattgaatctgctgctg

SEQ ID NO: 9045 - DNA, 201 bp, Bos taurus
tgggaaggcccattaaagagtgcccccacttaggcaaaaagttacatagttgcaaattccatccaatttgtaccctgttccaaggttagactgcagtttcggtctgcttatggccacttaccagtgtatttaaaaagctatgtcattggaaacattttgtgtagacattttaatttttatctgcaagagtctaagtctgtg

SEQ ID NO: 9046 - DNA, 201 bp, Bos taurus
gtaagctccgggagttggtgatagacagggaggcctggcgtgctgaagtccatggggtaccaaagagtcagacacaactgactgactgaactgaactgaacttgctatgaacattagcatagatcaatttgtctaaatctactgctgcatttggcaatttagaaagcaccaagaataatataaacaatataagacaatgca

SEQ ID NO: 9047 - DNA, 201 bp, Bos taurus
atatttgttaaaggaatgatgtacttaatatagacatatgtagatgcaatatctcagaaagcctcccgcatatttagggactgttctggaaatgcataaacatttttcttttcttcaagtgaaaatttttgattggcattactttctggatgctatcaatacagttaatatctataagtagttatcacattttgtcaactt

SEQ ID NO: 9048 - DNA, 201 bp, Bos taurus
aatcccagggacgaggggtcgcacagagtcggacacaactgaagcgacttagcagcagcagcagcatgtaaccttgagaagtaggtgccagtcagagtatcggcctgagaggcggataaattcagtcagtatacctaagctatttgtctgtgaccagatgatatcctgaaagggatgggatcctgagtcagaatgaaacca

SEQ ID NO: 9049 - DNA, 201 bp, Bos taurus
tggaaggactatcctgtcatcatgacccattcatgccgtgagtcctagaaactactcaggaggcagacttttgcatttttatgaggcttatctctaagcttccaggagacatgtatctcatcaagtcattcagggtttctgcatctttctttccaccagactcggtgttataaatgtcatagaccaacatgttgtggtgtg

SEQ ID NO: 9050 - DNA, 201 bp, Bos taurus
gcaggtacaattctcatttacaattcataactgaatactaattgcaagtacatggatcaaataattaatttttaatctttgttagtgtcctttagatagtcaaatataagaaaactactaaatgaccattggtaaattgaaaaagaacaaggtgcttaagtttctagtggaacattagaaaaaaatatgtaacaatccaga

SEQ ID NO: 9051 - DNA, 201 bp, Bos taurus
tctagtactgtcacacctgcaacaaaggagagataaaaagtgaatgaatcacgacacagtgaggttctcaaatcaaattaacaaaagctgttattcagcttttatgtcattcagaatggcctctatcagctaacaaatgatttcactgaggtcaaaactaatcactatggattgaaccatttcattcacatgaaaacataa

SEQ ID NO: 9052 - DNA, 201 bp, Bos taurus
ataatttactttccctctttcaaacaaacctgatataaagcatatatttttccaaaaaatatatgaattaggcaaaaataacagctcatggaataggacacagttacatttggaagattaaactgcagaaaagagttcgcctactatgaaggagatcttggttcaatccctgagctgataaagatgttctagagaggggaa

SEQ ID NO: 9053 - DNA, 201 bp, Bos taurus
aaaaaaaaaaaaaagtcacacaaactgctggatcaacttcatccaccagggacagagactaaaagcaagaagaactataacactctagtctgggaaaggaaatctcaaacacagtaggttagacaaaattgaaagaaataaaactattatgcagatgaagaaacaagataaaaagccacaaggccaaataagtgaagagaa

SEQ ID NO: 9054 - DNA, 201 bp, Bos taurus
actccaccaagctgcacagcccagcctattgccccctcaattgctggacatagactagcagggaacccagctagtggccctatgagaatacagactgcagccccacacaaccttgagaccacaacatagacagtgacttgccacacaacagaacacagtctgcagccccacccaactgtactcagtacaatacagttggag

SEQ ID NO: 9055 - DNA, 201 bp, Bos taurus
aaaccactttccaccagtcaccttttgttttagttaattcttactgaacattaaacactcagtgaaagatgtcactttcttatgggaacattctcagctcgatacaggatagatcacatttcttgctctgtgtttttatatctgcctctgcatctcattcataacactctggcagtatgtaattatacacctgtatcatca

SEQ ID NO: 9056 - DNA, 201 bp, Bos taurus
aagtaatgtctccgttttttaatatgctgtctagattggccacaacttttcttccaaggagcaagcatctttttatttcatggctgcaatcaccatctgcagtgatttttggggccaataaaataagttctgctactgtttctccatctatttgccatgaagtgaagggactgaatgccatgatctttgttttctgaatgt

SEQ ID NO: 9057 - DNA, 201 bp, Bos taurus
tagtgattttgtgcttggataaaggggctttttcacagtagctctgactaaagggtttaggatgaaaaacattgatttctgggatatcccactgacaactgctataaggtgaaaccaaaactgcagaatcatctaacccaaatgttaggaaaatatgtattgaatgacatttaatcaatggagaaattctttagaacaaaa

SEQ ID NO: 9058 - DNA, 201 bp, Bos taurus
tgatcctgatcaacttatttaacaaggtagttaacctatgacagtaaattattgtttaaagtgaaactgcaaatagcagagcataattaatatttattagaaacattgaaagtggaaagtggaggaacaagatggcagaggattaggtgcacatggaatacatctctctccatggatacatcaggaatacaccttcagaca

SEQ ID NO: 9059 - DNA, 201 bp, Bos taurus
acaaagataatcttctcttattgatcaatacttcaatctaacttgctttaaaaacatagcaccttgctattagagcactttttaaaaatggaagtacatttaaaaagtgaacataaacttttaagcatttttaagacaagtaatacacatttgtgcatatgaatggaagaaaatcacttgaattaaatacttcattggaac

SEQ ID NO: 9060 - DNA, 201 bp, Bos taurus
tgtactttacagacacaaagatgtggctaataaaatttatgttgtcctagaatataggctctttcttcttttccataattcagtgaacactcttgctccttctattcccagtccctctatgtacatctggcagtttatattttcataagccaatagagtgttttccttcatgtatttacgccttttgtctgtaatgtctct

SEQ ID NO: 9061 - DNA, 201 bp, Bos taurus
gtcttttagccactgtcattctggactcctgtttcctattctaactactaacaatatggttgctccatatattatcaattgtctaacccattttgtctctgtccagatcaacaaactacatgcagtgacagttcaacaaaggtatataaaaccacctgaccacagaaaatatccatccttagatggacaccactataagga

SEQ ID NO: 9062 - DNA, 201 bp, Bos taurus
aacccaggtctcctgcactgcaggtggattctttaccaactaaactactagttaaaactagccactacctgatggactttggccattatttctacctagacgagtttctcctgtttaattgcagagggaaagaagggcacaataacgcatacacaaacagcaggaatgggccagggctcagatatgagtctagagtgttaa

SEQ ID NO: 9063 - DNA, 201 bp, Bos taurus
tttgttttttcttctgatacttctgttcttagggcaggtcctgtttaggcagttgagatttaattctaaccttttcttttttttttttttaaatgctaaagaatttagatttgttagtaaagcaggaatgggttctatctgcatgtcatagaattttgtatgtgactctctttgaagaatcataaaacacaacttttgtag

SEQ ID NO: 9064 - DNA, 201 bp, Bos taurus
agaaagcttgttgtaaattgttctaataaatttgaaaagttgagcttccgaccaaagatagacatctttgcatttagtctttctaactattgacataatggctaatgtagcaatgtgagaaaattttccctttttcattaaatccaaaatttttcatcccatatagaagagagaaactttctccaaatatgttctacaatt

SEQ ID NO: 9065 - DNA, 201 bp, Bos taurus
agatgtgtaaaaattgcaggttgtattttcattttttaatcccaaatccccatttctcctgctttaaaggaactttcactttcaggactcattctgtttctccattttgaggccttatgtaatgccaaccaaaatgtcagagggagatattacctgtagcttcaattaaattatcactgaaacaccttttatctccatatt

SEQ ID NO: 9066 - DNA, 201 bp, Bos taurus
tagaataactcatgctttcctctagctgattagtgtatagaccaaatacgttaatatttagatagtacttaacaattttggtttaagctatgggtgtttacttatttatttggtgtaaaaaagattagcaagtgtcttcatataactttagtcattttgagttattcagacatttgttgaatatctgtagtgcgccttaca

SEQ ID NO: 9067 - DNA, 201 bp, Bos taurus
gcatataatatcagaaaccaacagtaattaaaagtaatcaaatttagtgaaatatgtacaaaataaagagatctgtacacattttaaggagttatcaatcaatatactgtttactatgtgaaatgagacaatgcttattactaaaataaaggctaagtctcttctttgcctcattttctgcttttgtaaaatgtattgctt

SEQ ID NO: 9068 - DNA, 201 bp, Bos taurus
aaacactcgacttggctaatattgaaaaagcatgttcaacagagtaaccacaaatatctcaccagttcagacagcttgtttctttaaagcagacatcaatcaagcaggacataacaagaaagatctgtttattttatggacatttattaacataccacatgaattgagaaaacagaaagatattttaaacactaaagctgt

SEQ ID NO: 9069 - DNA, 201 bp, Bos taurus
aaagcaattcactgatataataaatgccagaatcaaagtggcagtctggaggaaaaataccaggatttaggatccacagatatgagatccaatctagtctctaccattttaaattttctgggaataaatttgataaccaatctacaaaaccaaatctataaaaaaaggagattggattagagttgctctaatgttcttacc

SEQ ID NO: 9070 - DNA, 201 bp, Bos taurus
tctacatcacctaaatcgtcattgagttattacccagtgaaatcacattatggtgctccaatcatgattccacataactgccaaataacaccaacatccaacagtcccaaacagcttgatctgtcctatcctacttttgttaggtgtgaaaactcatagctaatacttcatacgattactgccagtcaaacttctccctgg

SEQ ID NO: 9071 - DNA, 201 bp, Bos taurus
gggtcaattaaactcactggtgtattcaaagcaccaagaagaatgcctgctacttatttagtgtgtaacaaatatgcattgaacagatgcacaaaacagacgaaaatcacaatcacttcatgcatgcacacatatacacatgtacattttgggggattctgttgagcagtaaatggagagtagtaacaatgtgaaattagg

SEQ ID NO: 9072 - DNA, 201 bp, Bos taurus
gatgtaagcagaggaaaaaattttttttcatttcatgtataagggaactgagacaataatagaccgacctttggatctagaccaatgcttctctacctatttctgtcacctgtataacgcatttctataaggtctaatagagccatgaaatgtgttctcagtgggtgcttggatgtgcttatgcgcttcaatgcatcatga

SEQ ID NO: 9073 - DNA, 201 bp, Bos taurus
aatgacataaagattactacttcaatccttgagcaggaaatcagactcttcttcactaatataattggtaatgtatcagaaataataatatagctctatgcttagtaaaaataaccacatctgaagtgtttttgaatgactgaatgaatgagagatatgcattgttatagtatattcatagttataaaatttaatatcaaa

SEQ ID NO: 9074 - DNA, 201 bp, Bos taurus
gacagttcctgttagcacatagtaaaagccatacaggtattagccatatgattgtaagtaactaaataaggaaagcagtccaagaaggccccacagagaaagttgttattgttcagtcggtaagtcgtgtccaactttttacagagaaaatagcattggcttaatggcctgagatagtgacatgagcactatctgggaagc

SEQ ID NO: 9075 - DNA, 201 bp, Bos taurus
aaagtagtcactcatcttactatttcataaccactaaaacgttttaaaaatctaatgtattcctcctctttctgtttctcctcagaaagagtttctttctcttctgtaggataacccaacatataatgctaaatttacttagttctttttctcagtcatcctccccaaaatagctactctgaaagactccactaacactat

SEQ ID NO: 9076 - DNA, 201 bp, Bos taurus
ccagtattcttgcctggaaaatcccatggatggaggaatccatggggtcagaaaagagtcagatatgactgagagacttcactgtgccaagaatggtgctaggcacttttcatgaattagctttttttcagtcttcatcacaaatcattttagatatatattatttgcctcctttagaaacaagaagactgaggctcagag

SEQ ID NO: 9077 - DNA, 201 bp, Bos taurus
gaaccgaactgaggtgcccacacttctgttctcagtcatcagtggcagtagcctacttcagtgtgtaataatgctagcttcctctacctgcctcactgttgaggatgaccttaagattatatccaagttcaggaaagaatgttgttagtgattagttatgtcccctaggctatgacagcataatcatgtctcatttaccaa

SEQ ID NO: 9078 - DNA, 201 bp, Bos taurus
cccacgttgggatcactactggtctctcagatgacaccccctgaccatgttgttttaaaggcactgtttctctcatcacccctcccccatgaacccaaacctttcattcattcatcttatttttccttctgcctctttcttagcatacccagtcactgagtcctgtggattctttttcctgcaaagtttcccttgcctaat

SEQ ID NO: 9079 - DNA, 201 bp, Bos taurus
acttctgcctcagcatacagtgggattgctcaccacaaatggccatggtaatggaaataacaagatgtcctcaggtcccaccacttggtgtgaaaaattcaaagggaatgtaaattacctaaatgatgaatcccaatcttttttacagctttcatgcttatgaaaagactgtggatttgtagcatgtaagagagggagatg

SEQ ID NO: 9080 - DNA, 201 bp, Bos taurus
aatgcaccacatagtacccttctcttgaaaatgtatgagatatgctattggattaaagaccaggaagtccaacagtatcaaaatatattggatgagatggttggatgacatcaccaactcgatggacatgaatttcagcaagctccaggagttggtgatggacagggaggtctggtatgctgcagtccatggggttgcaaa

SEQ ID NO: 9081 - DNA, 201 bp, Bos taurus
caagaacaaaataggattggcctgtaaggccgaaggcaagagagtcagtgactgaaaatgttccattggctcaaatggccccaagccactaagatgccccaaaataggagagctgagaaagtctagttcgctaccacctccaccagagaaatgggccaaagtaaatgaaacttccctaatatttcatttctcttcatcagc

SEQ ID NO: 9082 - DNA, 201 bp, Bos taurus
cagaagagagctcatatttttgagaacactcagtcttgaagatcctgactttcaaaaaaaaatccttctgatcaaaagaagatagtattctaattgatggttcacatgagaattagtggaaaattatcacatctacagacagtcatatacagcatcatgttcaattatctatccggaaagatgcaaatctcattatcacac

SEQ ID NO: 9083 - DNA, 201 bp, Bos taurus
atttcacaaagaaatagcaacagttcatcacttaagtagatgtagatgttgtatgattcattgagcttcttcctagctttcctatatgatttatttccatataacagtttcataatatttacataagaaaaattcaaggtagtttttacaacaggatttgtaactaaactcacaaccaaataagttagaaatgtctccagg

SEQ ID NO: 9084 - DNA, 201 bp, Bos taurus
ggcctcctggtagttcctgtacacaccaggccacacttgctgctgcctctgccctgagctctgtgcctggtgaatattctcacctctaatgtctgctcacccagtcaaggaggccttcctggatcaccttttgaaaaacagcaacttcttccccaccctgtcccacctcccttctctgatttatttctctccatatatcaa

SEQ ID NO: 9085 - DNA, 201 bp, Bos taurus
tggcagcctacagtccatagggtggtaaagagttggacatgactaaagcgacttggcacggcacagcatggagctggccttaagtcaaagagttttaggtgtatttacctgataacatagcaaggatgtgaaatggtagttcaaattctttgcatcctgactcatctctgctgtaagtggcatttgtgagacagctctggc

SEQ ID NO: 9086 - DNA, 201 bp, Bos taurus
ttagggccaaagaagtttgagctgttgtggagaacagtgggaagaggcagcagaagttaagtgacagccttggagttttcagtgtggaatggtgctaacaatggccagactagtgacttggactcataagacctcttaactttgctgtaggtcacctggagttctgtaaccagaaaagtgatgagctaagattgttgctat

SEQ ID NO: 9087 - DNA, 201 bp, Bos taurus
agcatactaagacttctttttttttttttccaatttaacaatatattgtggccatttttcatgacaacatgaaaaatttctttgtggcattggctagattgtgagtacattgccgaattttaatgttgagaacaactattctttattctcatttgtcattttaatatcatagtggttgctgcagacttctggaagctattt

SEQ ID NO: 9088 - DNA, 201 bp, Bos taurus
gattttcttcagtgttgtacaacacagaatttggctgggctttgtcccagctactgggagggaacttctaaatccttggactacctgagtgatggagtgtttttgttattcatggttggtctttcagatcacacctggtagtttatactaacaaggaaagtgatggcagactcgtggatagtttctctaatgagatagacc

SEQ ID NO: 9089 - DNA, 201 bp, Bos taurus
taaagaaatccctcccccaaatggctgattggagagataccaagtttagtctgtacagcagttgagtccaggaggagacacgcagaaataataagggggggtggggaggaataaaaacgaagggaaaattcagaaatttgtttgaacttgacaacagcttctattccattcctttgcactgacctgatctaattccagcag

SEQ ID NO: 9090 - DNA, 201 bp, Bos taurus
catcatcgttttcattattccttgtttagaaattaagtttataaaatgtattctagcagaggtttaaggaaatcaggctatcttgtggtcatcagaatttatggaactctgtccaaaatcctccactggattagattttagctctgcaaacagtcttatctcttaagagctaggacctgaaattaaattataaattgatac

SEQ ID NO: 9091 - DNA, 201 bp, Bos taurus
tttttttttttaatggtaatttgttgtggaatatgcacacccagtgtatttgggaggacaatgggaaggttgtgttttctgctttgagactgaatcaaccactgggatctggagaaggatgaagggctgtgaggttgcctgattttatcatccagtggcagcccacgttggaggagggaggagcgagctccggggttgggg

SEQ ID NO: 9092 - DNA, 201 bp, Bos taurus
cttggtttagcttgtttaagaaggttctttttccatttactttgctgtctaagagattgggagaggcagctgcttcgatgaaaattagaggaaaaccttttccacaaatagaagaagctaagaggaaaaaaataggaccatttcatgttgcaactgttactggtgcaaccagaagaggaaatggccttataagtacctgca

SEQ ID NO: 9093 - DNA, 201 bp, Bos taurus
acccctcaccatgtgcgccatggggagattagaaattaaggggatccttattggcacttcagtatgattcttctagaatgtataaacatctcttttggaaagatgtccttccctataaaataggataattctcactttggctgttcttcctaccttagatgagagagcagaagagcatcttttgccatagctctgtgtccc

SEQ ID NO: 9094 - DNA, 201 bp, Bos taurus
aaatttttgatataaaataaatatctaacatagcttcattacctacagagttaaacctaaaactgtaacaacatattcaagcctttccaggatctacccctaacccatctcaccagctctttcttctacttctcagagtagtagttcccagattttaatgtgcttatgaatcacccggggagctggtgaaaatgcagaatc

SEQ ID NO: 9095 - DNA, 201 bp, Bos taurus
catccaggagagaagagagggacgttgaggtaaaccccacattcactaccctttttagttttgataaataaaccaaacaaaaactacagcttcaagtttatggcagtcacactgggcttggagatgaattctcaaggcaacctggacttgggaagtcaaaatccaggagaaaagagaactatagagaagtaaaccaatgtt

SEQ ID NO: 9096 - DNA, 201 bp, Bos taurus
gtggaatctaaaatacaacacaaatataatataaatgaacatatctatgaaacagaaacagactcacaggtacagagaacgaacgtgtggtttccatgagagagggggagtaggcgagtgaaggattgggagtttgggattagcagatgcaaactatttatatagagaatggataaacagcaaagtcctactatatagcac

SEQ ID NO: 9097 - DNA, 201 bp, Bos taurus
gctgtgctccctcctggttagttgtttggcctgaagtaacccagtccaagagtctataagctctaaggtagggctactggcgatctccaaataggacttacgaccacacacgacgcccagaaccgctgctggctgtgcccccgtctccatggcaggccacggccgacccatgcctccgcagaagaccctcaaacactcacg

SEQ ID NO: 9098 - DNA, 201 bp, Bos taurus
aaaaatactcatgttttaaatcacaaaattatgatgaatttttttccatttcaaaagaaatttatgattctttcattaacacacacaggggctttggtcatctgaacaaagaatatttttttttaaggaaggttttttaggtctttgtttttcaagggaaatgaacacttgttacacgtttgattttgacctcaagtccta

SEQ ID NO: 9099 - DNA, 201 bp, Bos taurus
caagggtgggcagccgcaggcagtagacctgggctcctcacactagtgtgctaccaagcagaggatcaagaaagtggattcacgttacacacctgcgggtatgctgacagggtgtgaagtggactgaaaactcccagcagggagggtcagaagaggaaacaaaggtaagaggcagaaatgaagtttcctgcagtggtgcca

SEQ ID NO: 9100 - DNA, 201 bp, Bos taurus
tactcagtgtcagcagacactgtttaatgttgactagtttgtataagaatgattaacacatgtcaactatatgaagatcattattaactgttgcacattagttggtaaccacatgtcttggtaggtgtggtaagtagtaatttcttttattgcttactgtgctgtcaatctcttctcaggatattttgtcttactctaggt

SEQ ID NO: 9101 - DNA, 201 bp, Bos taurus
ggtcgcacagagtcggacacgactgaagcgacttagcagcagcagcagcagcaatacatagttaagtttattaatcttttgtggttttgtatcataagcacccttctcattcctagagtacaaaaatctctgtttttttaggttattttgtagatcttttatactttacaatcattgatctagttggaattaacttgcgct

SEQ ID NO: 9102 - DNA, 201 bp, Bos taurus
aaagtttgttctggtctttctataagatcgtttggaaaaacctgaatgaacttcttggccaacacaacatgatctcagttttgttcctgttgttcagtcactaagtcatatctgactcttttgtgaccctgtggactctacctgccagactcctctgtccctggagttctttaggcaagaatactggagtggattgccatt

SEQ ID NO: 9103 - DNA, 201 bp, Bos taurus
tgggtggtatgacattattagcaggagaggcagatggtgtcactaatttggactgtctcccaaatggtgccttttggacctgctcgttgggttctgatcacattccgtacgtactgggtggccagcagcctcttcaggcagtgccaagatcgaggcagactcagcagtgagccaacaatggaagccctgttgctatggaat

SEQ ID NO: 9104 - DNA, 201 bp, Bos taurus
gaagtaattgttggatgatgaaatattgacagtttaagaaaatctttaaggatcaaagtccttgggtcatttgagaagtatcaataatagcatggccttcgatactttctacttaacttttcaaatccaagttctttattacattgctgccaagtatgaactgaggaccagtggctctggatcacctgagaagtgtagaat

SEQ ID NO: 9105 - DNA, 201 bp, Bos taurus
tctggaggttagaagtctaagaccaagatggctaaagacccagggtctggtgagagcactcttcctagcttgcatatggccacctctcactgcatctccacgtggcagagaagagacggggtgatgcaagctctctcatggttttgaaggacaatcagcagctacagagtcaggcagaaaacgtcaggccaatgtgtgaca

SEQ ID NO: 9106 - DNA, 201 bp, Bos taurus
gccaccctttagtcagtgattccagatccaaaaattggctcaggtccaagaacagagcaaggaattatgacttactggattgactaccttcagcttcctgtccctcctcaggccctctcattatagaagttaaatggcacatccattttgtccctagacccccatactctattaagcctgctccacaacttctgaaaatgt

SEQ ID NO: 9107 - DNA, 201 bp, Bos taurus
tgttggaagggctgaaggagaaggagccaggggtgactggaactattggattcaagaaaacaccagcatcagaatcaagaagaccctgccatcaacccagctggggcaacaaccgtagctgtcttatgactctcacaggcaagcaaggtttcagctgctgtaactccctctcagcattcacaactctgagcccatgttctc

SEQ ID NO: 9108 - DNA, 201 bp, Bos taurus
acacattatgctacaaatttcagtgttagtctttcaattgcagaggatcaggtatgacctcttcaacatcccccagccttgctggggcctcttttccatgttctcacagcatcctactcatgtcccagccagtgcacatcctatggagattccataaaagcttacttggccataagtaacaaccagtagataatagagata

SEQ ID NO: 9109 - DNA, 201 bp, Bos taurus
ctgctctcccgtaatttgttttccgggccaaaaggcaaactcattagttaggagacctcagaactggaggaaacgggctgaaatggcagagggggacttcggggcaagttcccttctgagtggccgtcgcggtctcctccccgcttaccctgcccttcgaggccaggttgaaaaggcgtacaaggtgaggcctaagggaaa

SEQ ID NO: 9110 - DNA, 201 bp, Bos taurus
ctgatgcctgctgcagggagggcgtcttacccacgtggacgcagagaacttgctctcactgcctccatccagccaactcatgttaatagcataaaacattcctcattacttttgcctctaacctgctggacgtcttcagaatacgtcataagaaaacttggattttgcactatcaccacctagtggctaaaagcaggcaat

SEQ ID NO: 9111 - DNA, 201 bp, Bos taurus
tgtaagctggttcaggagagaatggtaggagtggatggagggatggacccacatgccatcgagtcctgttcatctaagttaaacagctgttaaaattttagtatctttgagcattcttctctttaaagtctataaaactcaaaggtatcagactctacaaaaggagttcttatgctattaatactcagtctgcaactctcc

SEQ ID NO: 9112 - DNA, 201 bp, Bos taurus
gacctcacaactgtctgctaaaacccatttcttggctaaagtttaaaagcatcaagtaacagaacatgaggattccaaaacgaagccacggggttcagaatactccctgctcatccttgctacctttgtttacttctcttgtcttgtctgtatgaatatcctcctcctccaaaagcacctcctcaaatgagccacaaagga

SEQ ID NO: 9113 - DNA, 201 bp, Bos taurus
acctaaattccagctccactttccccattaatatttagtatgaaatgtgactgaattcttaagcaaatcctcaataaagaatagttgctggccatgacttggaaaaaataatgtgaactaaaataatgttctgaacaagcactggaaggcaatttcataaacttaaggcttgtttcgtgagtacttcttgaaatacagtac

SEQ ID NO: 9114 - DNA, 201 bp, Bos taurus
ttggttagtagtagaaatattataattttagtattcaaaataaacaggcttattttctgagtttttacttatcagagttactgcttattcagagttgcacgaatctgataactgttgaacaaactattaaactctgtaaatctcactgctatgatcccatactttatatactcagtaataagacaaaagcagttgtagaat

SEQ ID NO: 9115 - DNA, 201 bp, Bos taurus
tcagactttgttttcttaaagttgttgaaaccctggactgttctagacccagacagggcaggccctggtcattttcagtgtccatgtttaagagaaagccgtgctctttgcttgatggaggatattggccgaaccctgagactttgctttctttaggatgtgttggttcctggtgtccattgttcgggctcttctccagga

SEQ ID NO: 9116 - DNA, 201 bp, Bos taurus
tgaggagtccagttatctgaagttcaaggcacacgaagacattgttctaacattgtcaggaatcacagatgtgaagcaattagttctatcttgggaagtaggaaaggctttgcagattgttgttgctgtttaggctttgcagagctgatatttacatcagttatttgaggataaatatgttttctacaggtgaagatagtg

SEQ ID NO: 9117 - DNA, 201 bp, Bos taurus
tgtagtctttggtctaatgatcacctgagtgatcttcatgagttttttttttttttgcatgtctgtgcaaatcctttattaaagcaacagccaaaatacaggatggctcacattatttttttttcttttcttgctactgtatcaactttaatactaatcatttgtttatacctttaaattatttttaaaaggtaaacattt

SEQ ID NO: 9118 - DNA, 201 bp, Bos taurus
aagtctcccacaagaaagtgtttaggccctaaggtaagtgtgaccttagcaattacagaaagattgccaggaggctggaattagtgaacatgaaacgatgtggttgaagaagcagacaagagataaactgtggttgtttcataatatattattaaaaatgtacatcatcaaatgaatggtgatatttcatcgaattcattt

SEQ ID NO: 9119 - DNA, 201 bp, Bos taurus
tgagttgaatcctctttactttgggaaagagcactaatgatcacctatttcagagtagcaataggacctcctagattccgtatgcttgtttatcaggccacggagaaattaatgctactgaagtccaccaagtaataacagtggatcagataagccacaagccatatgtcactactccaggggcctggcacaggtgggagc

SEQ ID NO: 9120 - DNA, 201 bp, Bos taurus
gaagagccatctgtgagaagagctgctggaaaggaggaagccacctaggcgaaggcttaggacagtgtacatccatctgggatgtctgaggaagagcagataggccaatgtggctgcaggcagaaggaacatgagggaagcggtagagatgagatcggaaaggagagaggggaaggcctgtggagggcatgtgggccacaa

SEQ ID NO: 9121 - DNA, 201 bp, Bos taurus
ttctttatattagtttcttacttcacttgcaagttcaagtcataaaatgaatagatgtggcttttattaagctttgaagatctgctgtgcttctatgtgaatatcacttcatctatagcatttgaattggaaaaaaatcttttgtgtgttttcaacaaccttttgtccacatagttaaatgcactgacagagccttttgac

SEQ ID NO: 9122 - DNA, 201 bp, Bos taurus
tgaaagccaaccaggctggggccagtcctgcttaccagaaatgaatcatttcaatctttgtgactccatgaactgcaacatgccagatagttggctccataacaacagaatggcccatacagcccacatagagagaactcctagagcatatagccctggtgaccagagaggagtgcattgctagaacccatagtaaggcta

SEQ ID NO: 9123 - DNA, 201 bp, Bos taurus
acttctgagccctgaggtaggaaggagcactgtgtgttggaggaactgaggccaggacagctagagagcagtgcgtgaggggtcgtccagggcagacgaggttggagacagagttgccttgttggccactgtaagaaatttcttcattatcctaagaatgaaaggcagtcacttatgtgtttcaagcaaggcagtgaataa

SEQ ID NO: 9124 - DNA, 201 bp, Bos taurus
cattctatgtataattgtttgcatctgctaatcccaaattcccaatccatccctcccctatatctcctcccctggcaaccacaactcttgaataagggttcctttaatggcccaaacagagatgagagttaagtgacacaaaattatgtctttctcaaattgactagatcattagattgattattctcttttgcttgtgaa

SEQ ID NO: 9125 - DNA, 201 bp, Bos taurus
tatttgtctgaatatgctttgcttgtccttcacaccaattcacacttcagacataaattttgtattaacttgtaatgtaacaagtgacaaaacctggcctgaaacaacatgaatttatttatcttacagttttgtaggtcagaagtctgaaacagttctcattgcactaaaatcaaggtgttggccaggctaggttccatt

SEQ ID NO: 9126 - DNA, 201 bp, Bos taurus
atacactccatttttagggagaagtagatggtggcttggagaagtttgttgtcctacacagagttgtggctgatacaataaataataaagttggtgctcttgatatattcattcattcactcaggagtacttttgaggttccctgctaagtggtgataaccatacgaaattaaaaaaaaaagtgactagttgtttttaagg

SEQ ID NO: 9127 - DNA, 201 bp, Bos taurus
ccctttggtcactggaatcagttacagctgcttccctgaggctggctaccttcgctttggctgctggcctcggaggtaaaacgtgcagcctgtagccctactctgcactcagccttgactcacgtgaggaaggctgtctcacctttggaaaagtgactcacactactgcctgctccaaatgaaaaagctgtctcttaaata

SEQ ID NO: 9128 - DNA, 201 bp, Bos taurus
tgtctgtcttctaggagctctttctcctcctggttagcaagatgctcccaccattttggtcatttagtattgcagctgcagataaccaaagggccaacaatgctatgagaccaccaagggctctgtgatggagaactctgccatccaaatagtccggctctgctgccaatgctgtccattctgtggttgcttaaggaagtc

SEQ ID NO: 9129 - DNA, 201 bp, Bos taurus
attaagtactaaatagatatcagttttactattttttcatctttatatacatttatagagattcaatgttttgataaaagtattaaagtttatagaacaatgtgatttttctcactgattattaagattgctttgcatggttttaggttcagtggtcatttttatggttctatacaacatggaaagtgaggattacctgta

SEQ ID NO: 9130 - DNA, 201 bp, Bos taurus
agatccaggtcattacctactgtcattcaaggtttgccttttcccatcttactgtgttcttccttgttcttgtctccttgtttaaacctatcatggtgtttttgtacctgtcatccccacaatcttgaatgggataaagggctgagaatattctgtctctcccacagatccctggagactatgcaataggaagatatgttg

SEQ ID NO: 9131 - DNA, 201 bp, Bos taurus
gcctatagcaatagcatacgaggaagctagattggccccatcaagaatacaccagctagtgcgtcctgcttcacgtcagacaacatcgcagatggttcacttagtgtgctggtgtgttttggaaagaatacaatgtcactagaagacttactgaaatgatggggaaaaaattgcataaagatagtgttttggttggtggct

SEQ ID NO: 9132 - DNA, 201 bp, Bos taurus
gaaaaatcaagtccccggccactactgtctaaaaactaattgtgtctttcttttcttccttggctccaaagagctgctcacagtaaatcataaattcactcagggaagcaggaactctgggctaaagaatctatggacagaaagggaaagacagcaagaaaaggattgcgttcagacacgaagcctttccatgacatgata

SEQ ID NO: 9133 - DNA, 201 bp, Bos taurus
tatatttagttttccctggtcactaattccacatgccctggaaccattccatacttggaccacagaaattgaaaaatatacctaactacttctgcttaagctacttgcttgtcttttcatagagcaacattctccttgtgaaactgaggatgatatggatgataccttcaaaccctatcagtgggccacactgtcctccaa

SEQ ID NO: 9134 - DNA, 201 bp, Bos taurus
taaatgcttaagatggtaaatttcatataccttctaccacaataaaacattataattattttacattaataactttgctatataccaatagtgtcacatacgatttttattcaattggcttcaagacagagaagaaaggaaaagaagcacttcaattatggaccacatcagatgaacatattggaatcaaccaaccatttt

SEQ ID NO: 9135 - DNA, 201 bp, Bos taurus
ccctggacttcccagcctccagaacagtgagaactcaatttctgttctttaggccacccagtctagtgtatgtttatttcggcagtctgaagagtggaggcgagcaggagcaacaatatccgtggcctcatggagcttacattctgggggtaaaggaagaaaataatcaaagtagcaaatattagtagttatataatgtcc

SEQ ID NO: 9136 - DNA, 201 bp, Bos taurus
gtgtgtgcacagagaactctctgtcatctctgcctcttcctgtagggacaccagtcctgttatattacggctttacccttataacctcaggtactcgtaactccctctctgaaggccctgtctctacataagtcacactggggggttaggactttaatctacaagtttcgaggcgagtgcagttcagtcagtaacaaatta

SEQ ID NO: 9137 - DNA, 201 bp, Bos taurus
tggcccagactctgagctgctccctagagtcaatgggaagggaaagtggagacactgcaagtgtgaaagtggcatctgagaatctcctctgggggcaccacctctggcctctttctaggttctgcttagaggccaagccccactctctctccccccatcacagagaacaagagtttattctcttctggaggacagagagct

SEQ ID NO: 9138 - DNA, 201 bp, Bos taurus
caacaaacaacctgaatgactagggatgtgtctggccccaaggacttcagagactaaaataatgttgggtctgctcttgtcgctctgctcgtctctgttcgttggccacattgcccctcttacagaagtgcttcctttgtttggtgaaagcaggaggtcatggccacaggctgtcttaggtcagcaacccccatggggaga

SEQ ID NO: 9139 - DNA, 201 bp, Bos taurus
ttgtacggagaaaatgtctagtttccctttactacagtgacccaatatgaagaaggaaaaaaaaagtggtatcactttgggaacaaaagtttcagtgcacatcgacagcaagactcactgaatgaaagcagatggctaaaacatagtttgggatcgatgcatctatcctatagaaaagcgaggcatagtctttatgttacc

SEQ ID NO: 9140 - DNA, 201 bp, Bos taurus
cattgagcattttcttttattgcctcttttcattctcttctgcagattttgtcccagcactggttagcctgtgtgatcatttattccagacatttattttgtctcatcccaatttgtcccctgataagctgtataagctctgataagaactttgaaaattctgaatttcaatgttctccaccagattttgaaaccatagaa

SEQ ID NO: 9141 - DNA, 201 bp, Bos taurus
gatttttacctggaaaatggaagggaggcttcaagtcttaagagtcaagagaacagtaaatgcacacatttctttctccccttctgcaatctgagtgcttcaagaaagcttctgaaactatctttgctctgaacagagtttcacttcagatagttttgaaatctggagaagaaatgacaccaatttttattccaagcattc

SEQ ID NO: 9142 - DNA, 201 bp, Bos taurus
ttcccttgttggttgaaggatgttcgtaggggctgttaattcttaggctattgtggctttggccagataaaatttacaggtaatgaaacgcaggtgtagacagctggaaatatagacaacagatattagaatggtaagtaaaaggggatttgagtgggcatcaagaccaattgtttctcacttcaaaatcttacagaaaag

SEQ ID NO: 9143 - DNA, 201 bp, Bos taurus
tgtaagaatcacttagaataccctgaatagtcaacaagagtccaaaatgcagttcttggatgcaatgtcaaaaatgacagaatgatctctgttggtttccaaggtaaacagtaatctaagtttatgacccaaccactaacactgaagaagcggaagttgaatggttctaggatgacataaaagacctgctagaactaacac

SEQ ID NO: 9144 - DNA, 201 bp, Bos taurus
ttttggaaacaaaaaggagattcaaagccagaaaaaacagtgacaggaatacaaaaagaacacttccgtagtcactggagggaatatggccttatgtgtgtgtgcgtgcgtgctcaatcgtgtccaactctttgcaagcctatggactgcagcctgccaggttcctctgcctgaaggaatatggcctttctgacatcttaa

SEQ ID NO: 9145 - DNA, 201 bp, Bos taurus
ctccaggcctctcatatatgcactgaaggccattcctgggagggcctagcacttcagggcttctcctttgtggagctgacaccagggcccagagagtacacgcacgcagagctgtggatgctgagagctgagattggactggaatgctcagaaatactacacgctgtgggagccttgataaggcacgtatggtggccatta

SEQ ID NO: 9146 - DNA, 201 bp, Bos taurus
atgccagtggtgctggtactgcagccagtacctcagatccctctgtattgccctggtccaagagagtccttctgcccaagttgcttcactaactgtcacagtcacatgaattcttggattaatttctactcattgtaacctaaagtgtctctctcagctttactcgcctggccctaaccacatagcaagtctttctctgga

SEQ ID NO: 9147 - DNA, 201 bp, Bos taurus
aaaaagaaatggaaaaaatgcatttctatcaatatgataaaattaagtgttgtacattgcgctatggactacagtggagtatcataacagattagtgtgcgtatttattactagttattttcccagacaaggatatcactcaaggacatattattaaatgccaaaaataggatcacagaaaaataaatgtcttgtatcatt

SEQ ID NO: 9148 - DNA, 201 bp, Bos taurus
aactcttaaaatacacagaaataactgtaaaataagtaggattgtggattagactttttaggtgacttgactttgatcaaaaaggagaaattgaacaaactgagacttgaatctaggccatcacaactaagcagcagcagagtctctatgcagaatctatgcttttgaccttcacacttcatcaacctatagtacgatgca

SEQ ID NO: 9149 - DNA, 201 bp, Bos taurus
tatttacaaaataatggcttggaaaactagacatcctcatacagtctttaatggaagtatatagattggtaagaatgtttaattttaatagatgtgacttttgaaaaaatatatacaaatgaatttaaagctttttctgagtttaacataagtattttttcaaaataggtggggagacaaattttcaagatatttactgca

SEQ ID NO: 9150 - DNA, 201 bp, Bos taurus
tgaagtgagccagagtaaaagtatgtgtcatgaatatgaagatgcacctggcataagaacacttttttcattagcagcatcttcagcttgtaaagaaaaaacgacacttcacggatatgattcatgggaattatttgagtattgacgtttctgaacatgctggagaggatgtgagtgaaagaatcttgttgcaaatatgta

SEQ ID NO: 9151 - DNA, 201 bp, Bos taurus
tttaaaaattaatttttaagtcctctttgatcccacaaggagagatataacttcaaaactcatcttataggttaatttttatgtggccaaattctgaattgttttagataaatagtaattaataggtaaagaatttttaacagaaatcacatttgtaagataaaatgattcatataacaaactgatatatactggcctgct

SEQ ID NO: 9152 - DNA, 201 bp, Bos taurus
cagtcattaattcttgagccaggcttttgtgattcaagagaggcctgggagactacaattttctacaaataaaaaccaggcagaggacatgggtaaggatgttttcccaaaaaggccccataggaccttgctaggttatagtatggcaataagcctattattattattattattatttttgtataagtaagtaagtatgct

SEQ ID NO: 9153 - DNA, 201 bp, Bos taurus
tggaaaggaatgtaggtatgttatccatagcaattgttaaaaacatatatgatgcatttttgttcaatctgatgtaataaataagtcaatgattctatatagactgcttatacctaactgtaaaagttcaatgagaattctcagcatggttttaaaaaataagatctgtgaaaaagatcaattatacacatggaatgtgct

SEQ ID NO: 9154 - DNA, 201 bp, Bos taurus
caatacattcttaattatttttaccaagggtcaaaactgtgaagaaaaatgtgtattgtaatggttgtgatacaacaaagtaattacatcatagctgtcaataaggagtttgcaaattagcctagtaggattgcaaaactatataaagacaagtttaaagtgacagaaagatatataatatatagaaaagattagtcgacc

SEQ ID NO: 9155 - DNA, 201 bp, Bos taurus
tagaaaatctgtcctgtcaaccgacagtgctgtaagaataccaaattgttatattaagccaatacattttgagataacttgccatacagaaagagcaaagtggcacacaatttgatgtgaagagagaagttctgctttaacaaaaataaataccacatggcattgactagcgccatgttgaggctgaaaatgtggaaggaa

SEQ ID NO: 9156 - DNA, 201 bp, Bos taurus
agctacagagctcatattttgttttctgtaatattatcgttttaacttaaaagtaatgagactgattcttctactcacagctacaagtatatttaacttactcatttaaagaaaactatgacctggaaaatatccatgagatgcactatgcagagcaaaggaaatcagtatattttgatttaagtactttggattataaat

SEQ ID NO: 9157 - DNA, 201 bp, Bos taurus
ccctaaataattgtgtaattcactactttagttcatgcaggtgtctgctgagatagtcatctcaccagagtgatttccttcctcactctatcacttcatagttctgtactctccttatcctaatttattatttttttccatatacagaccatatttaacaaaaatatgaagataatgattataaaaattagaagataatat

SEQ ID NO: 9158 - DNA, 201 bp, Bos taurus
ctccagaaatgttaaactgagtatgatggacacaatgtattagaaaataaaaataaatggagctaatatttataccatatttcataatggatatgaaatatctttcagatatctttggaactatgatgctttgtgagtaatgcttttcaactccccatatatagttcaaaacctctaaaaatagaattttattacattatc

SEQ ID NO: 9159 - DNA, 201 bp, Bos taurus
gtaaaagttgatgtgtttctctttgcattgttgtacaacagtctgcaaaaaaaagagccagcaactataagacaaaaattttaattagtttggtgtcacttaattaggagaaggaagaaatgagtctgtatctgaaaagtgatggcttatattacttcaatatgagagctataggaaatatatattcagagcatacttttg

SEQ ID NO: 9160 - DNA, 201 bp, Bos taurus
gatgtttggagcttgagtgaatggatatactatgtttctgaccaaattgagcatttccagggacttaaaagtcataattttcagtttgctaaaatgtggtatcctggacagcatcaactccatcttgggtttagaaagtcatttcagcatagttgataatctgaagagaggtttgcatatatacatatgaagaatggaata

SEQ ID NO: 9161 - DNA, 201 bp, Bos taurus
agttttgcacctaagtaaaattatttatgttcttgaaaaattgatgtctacacatgataagtgcatgtggtatgaatataggagatgggctaattacagagatatattaggtggcatgaatacaaaagggaattactcatgattcatatttaatagtttcactgttttatggaaaatgtacataaaattagtgtgctataa

SEQ ID NO: 9162 - DNA, 201 bp, Bos taurus
gctcttatcacatattattaggttagttacctaaatataccagaaatcagacgcactatggaatccttcaaaccggcacactggagtcatcaactctgtgtatttaagccatggtataagagaaccaaaagtaaagggaaaaaaaaaaaaaaacaacctttcatcccatggtaatgaaaaaggggttgattcaggggtttt

SEQ ID NO: 9163 - DNA, 201 bp, Bos taurus
ttttcaaaggaagttaccttttacagcagtcataatcttacagctttctcttccttcaggtttagttcttagctgattaacctttccttggtcctgtctccggtcccaccctttttcttggatcttttcaatgactgcttacatttactctctttttccttttcattaacctaccatccctgattttcctgcacaaacacc

SEQ ID NO: 9164 - DNA, 201 bp, Bos taurus
aacaagggttttcttataagacatctgccttagctgaagtaaaaatatttgtatctgcagtctgtgtataaactgagattatttttttaattattttggactccaagacttcaatattattctgtgtctatgcacaactggtcaaaaccacttatcacattatagattttgatgaatatttggtgaatacatataataaca

SEQ ID NO: 9165 - DNA, 201 bp, Bos taurus
cccaaatgtcactcagaggtagctgcctcttcaggcaacatggagttgggtgacagaggagctgttctcactctttggtcaattattacatagcatctattactatacttgtcttacatattgtctctcttctccagagaggaaaaactgccttacgacagtgaccagacttatttatctttctgtgctgcattttgcttg

SEQ ID NO: 9166 - DNA, 201 bp, Bos taurus
tcagaaaaatgttctcagttttaccaacactgctgataacactggtttcaaacatactggggagaaaatgtgatcagagaaagctcagttcactctgcaagataagcttaacattattcctaaaattcaacaggacttcaagttgaagccatgttgctttaacttgtcttatagttctttgtcctcatatgagcagtgagg

SEQ ID NO: 9167 - DNA, 201 bp, Bos taurus
agaatatattctgctttcagagtcctggagttcaatagtgagactgtttatgcttttcactgagattttatttaaaacacactcaagttctcttttcaaaacttgctgctgctaagtcgcttcagtcgtgtccgactctgtgcgaccccatagacgacagcccaccaggctccctagtccctgggattccccaggcaagaa

SEQ ID NO: 9168 - DNA, 201 bp, Bos taurus
aggagttttaaataggattgtctttaaacaaaactgtccatatatcctccatagtaaagtaacctcaattaactattaggttggtgtagaagtaataatggtttcataccctgaattttacatcataatagctaggctcaatcacatctttattaatcaaaataggaaccattacaatcaacacatttttttttgccaatg

SEQ ID NO: 9169 - DNA, 201 bp, Bos taurus
aaaagtaagatgatgtaagcattgatagagtgagaagagaaagggattatttggaagcacgggcaagagtgtgatctttgggcccaggcaaacttgaatttgaacacttttcatttctagggtaagttactcttaattcagttcagtttctcagtcgtgtctgactctgcgaccccatgaattgcagcacgccaggcctcc

SEQ ID NO: 9170 - DNA, 201 bp, Bos taurus
tactatggccagcaatatatagaaaaactggcatattttcaatatgagtgtaaaaaaaaaagcagaacactaaaattaaaaggtacatcagttcagatccgtcacttagttgtgttttactgttggtgaccccatggactgcagcacacaaggcttccctgcacatcactactttcgaagcttgctcaaacacatgtctat

SEQ ID NO: 9171 - DNA, 201 bp, Bos taurus
gtgtgtacaaccaacttcttagacttactttaacaccagacccaaaagaagttcagcagttaccatggagttaaggttatatgtgtacctctatcaacactgtcagttctgatgatatttatcttctaaaaattccttcatttaattattagtgtaatgtcttgtagggcttcccaggttgtgccagtggtttaaaagaaa

SEQ ID NO: 9172 - DNA, 201 bp, Bos taurus
cctctcttttactgtctcttcctcaacagcttctccaaatatggcttgggtataagagtgagaataaaaacttgaacaaatggattccaacagaagcatgactgggccagtgacacacacatcttttactacaatgatgcacaaaaataagtaaaatatgctttaccaacatctgtaacttgccaattttttgagctgagc

SEQ ID NO: 9173 - DNA, 201 bp, Bos taurus
tggacagggccatgatcagtaaatctttaacccaattgtctgctgacaggtggagctgtgcaccctttctattagttgtttggcctgaggcagcccactcatgaagtctacaggctttaaggtggggctaaaggcaacctccaagaggatgtatgccaacatgcccctcccaggactgctgtcaccagtgcccttcttcct

SEQ ID NO: 9174 - DNA, 201 bp, Bos taurus
cactgtgtgttagcatccatgcccaccactgttgtgaagggactcttgctaacattaatattgaggacatattgttgagtctaatcatacttctcttctttgttctcagttacttgaaatctctttacctttcaaaagaattgagagcatccacatcatcaggtcatctttttcattgacctcaatgacaatatccttttc

SEQ ID NO: 9175 - DNA, 201 bp, Bos taurus
caaaatggaaaattgaagtgttacttgaatatcatacaatcaattagagtaaatacaattacctttttaaattaataggatctagtagtacaagtatcgaatgtattgtgctgttttaaatataaattggtgtgatgttagacacaggagttaaacccagaactttcacttttctgaattcttttgctttctaaaatatta

SEQ ID NO: 9176 - DNA, 201 bp, Bos taurus
ggtttgtaatattttttagtaaacaaattcatatgggtataaaaaataatacaccaattcatggctgtttactctttaaaaatgcttcattaaatctattgatatattccttcttcttatatttcaagatgtttgttacaaactaggttactagcattttgccaactcgctcaaaatgttgaatattttttcaaatatttg

SEQ ID NO: 9177 - DNA, 201 bp, Bos taurus
gatcagtcctcagctgttctgtgtagttgaggttccagaacctcctcttagtgaacaagaaaaattatgccaatttggcccttttctaccatcagaatggcatcagggaatgggtagattagggatctgctgaggatgctaggggcagaaaggcaaggtgcaggttgacggacgctggtccaggaaagatgctggaagctt

SEQ ID NO: 9178 - DNA, 201 bp, Bos taurus
gtacagttgatataaaattatttttctcttgataacctctaactagttaaattcagaaatctccatcaataagcttcagttgcaccatgttccttctatatcagtaggaatattcagtacatatgatatcaaggcagaagcctaagatataatgcatgggagcttttcatcttatttttgtgatttaaattttctccttgg

SEQ ID NO: 9179 - DNA, 201 bp, Bos taurus
tgcatgtgtatctctttaatttgtgagaaatggattgtggcatatcctgaaatgaaatctcaagacatttattgtaagtaattattataatttcctcagagggcgaagggaaaaaaaggactacagcagtttcatcagtctatgtcaagccagactatgaaacaagttgagttcatgttgtttattaattattaaaattca

SEQ ID NO: 9180 - DNA, 201 bp, Bos taurus
gctcttactgtgtattagtctcccttttctgtttgctttgcttcgtttcatataatatacatgtggtgtgtcacagcagggattattattggcaatctttcttgaaatggttatttatttgcatatttctcattttctctactaatctaaaacacatttgaattactgaagtatcaaaaaatattcctcattgtagaattc

SEQ ID NO: 9181 - DNA, 201 bp, Bos taurus
atctagataaatgatatttacaaatgactctgatctccacagtaatctattgtgtgatttttacttggagcataaccaaaatttgaaacaagagtgagtaagcaaagatatccaaatccttgatcatagtgccctatttatttgaatatttatttatatatttataactacaagttgattaaatgactactgtaagtgtta

SEQ ID NO: 9182 - DNA, 201 bp, Bos taurus
agatcttcacatttttgatcaagaaatgccctcaggcagcatattcactgggaaggacttctttcaagaaatgctgttctcaaaggtttagttctttcatgtctcaagttttaagaaaataactctactacaaactcaattcaactaaacataagcctttgaagtagtttgacatgaaacctcatccacaaatgcctataa

SEQ ID NO: 9183 - DNA, 201 bp, Bos taurus
tcaatgaaagttaacagtataaaggaaaacaatgatgacggggatgctggagaaagctacataatttgccttaaaagctattttactcatattgacaagtcactcactttgactaacttctttttctttcacagcccttaaagattttatatcctgttccaaacatgaaaatccttacagtagttagtttgcattgaaaaa

SEQ ID NO: 9184 - DNA, 201 bp, Bos taurus
atatgggctagtagttgtgtcttttgtttttttaatcagcatgtgctggcctcaaaaaattatatggaaagtgtcctcctccaagagtttttgaagaatttgcataatttcttcttaaatctttgttaaattgtagtagtgaagtcagctgggctttcattcttttattatgaggaagtttctgatttttcagatgcagaa

SEQ ID NO: 9185 - DNA, 201 bp, Bos taurus
taatcaatcaatttactaatggctgcacagttgtagatatgctaataactccaactagaaagttagagattatcagcatcaataagtgaagacacaactacatactgtttatgagagagaaactataaatatgaagttacaaatattgataaattgcagttaaaatgctagaaaacatatataatgaaagtcataagaaac

SEQ ID NO: 9186 - DNA, 201 bp, Bos taurus
tacataagtattatgtattttattaaagatacatgtgcctggatattaggatttctaatgcctggggtatggcttggccttctgaatcttaatgtattatgtaataaccaaaaggtataaaatgtaatacagttacaagcagtgtattgaggttggccaaaaagtgttttttggtttttctctaacatcttacggaaaaac

SEQ ID NO: 9187 - DNA, 201 bp, Bos taurus
taaaattatctagggtagagagacataactgagaaatgtattttggcaagatttatttcaatatatttaagtatttattttgataaaaagcaacatcatagcttgatttattcatcctttatatattatttgtactctggtctcagtttttaaaaaagagaatttatatcataccaaaattatatttactgattttggaaa

SEQ ID NO: 9188 - DNA, 201 bp, Bos taurus
ttgggtatagaggacagccattttgggggacttttgctacctacacctcttagcatttccacattgctgggtcctccagcatccattctgggatgtaggaagcagaaagaaatccgtagaatgtaataccatgtttttttttttttcaggttacatgaaccctagctggcctgccctagaagaagaaaaaaagttcaaaca

SEQ ID NO: 9189 - DNA, 201 bp, Bos taurus
tctttctcaacaactaatccaagggagagttttagtatttccttcaaaaatgaaatagcttgctaaattgctttctaggcactaagtcaaaattcttttagatatgaattatgtgaaaagcataaaagctttttgaaaattgtgtgtgttgtaagcatttttataaaaggaagctttgattaatacaggaaagttaatgct

SEQ ID NO: 9190 - DNA, 201 bp, Bos taurus
agggaggcctggcatgctacagttcgtggggtcgcaaagagtcggacaagactgagcaactgatctgatctgatctgatctggtagagaaatgtggatgacgatattgatgactggccatgattagtaatttctgaaactagagaatttgctcagtccgtagtcatgtctgactctttgcaaccccatggactgcagcgcc

SEQ ID NO: 9191 - DNA, 201 bp, Bos taurus
tgtatggagagaaagataaaaactattgtttttctaaagcagtttgtctgttacagtgattcagaaaatgttttcattacatggccttcaaagattattgtatttagaaaactacttgctaaatccactgccagaaaattagaaagcattccctagttagttcttcagttatcccatatggcaagagatgaaagtgtcagt

SEQ ID NO: 9192 - DNA, 201 bp, Bos taurus
tctctgttttgtgtttgctgttctatactggagtagttacagatgtcagatgaaatgggtagccagaaatatgtagcagtgaatggcatctgtagtacactgcagccttgcttatcaccagatgtggatagaaagcaactgctaattttccatttcacatcagactaaatagtcactcaatactctgtaaaaatcctggta

SEQ ID NO: 9193 - DNA, 201 bp, Bos taurus
cctctttgctcacgagattccaaattccattactatataactgttaccagaagtggaggtttggctgctcacccctcaaaagtcaataagaagcaaggccggtggaaaggaaagtgaaagtcactcagtcatgtctgactctttgtgaccccatggactacatagtccatggaattctccaggccagaatactggagtggg

SEQ ID NO: 9194 - DNA, 201 bp, Bos taurus
ctatttcacttatgccttttatagtccttttcaactcagcagccagaatgttaaaatgttaaattaaattaattgagtggccctggagcacaagcttcccctgacttctcacatcaatcaggtaacagaaaatattttatggttgcctataaggccccacgtgaccatctacatctctaacctcacttccagtgacacatc

SEQ ID NO: 9195 - DNA, 201 bp, Bos taurus
atgacttaaaacatatctataaattagatagtcattaaaagaaatcatctaggcatgagagatatcctttcctaggtcccatggtgtgaaagaatcttgtctgctaggatgactgaaatctatagttatggtcagtaataacgtctggcccaatttcttacaatatccatacaagaccatttcaaaggattaataaagtaa

SEQ ID NO: 9196 - DNA, 201 bp, Bos taurus
aaaagatcgattttgtgctaaggcaagacctattaattaaagtaatagaagttacaaattggtcaggtagctaatgagtatgaaaatatttactttttcagttgtcagatcacatagttgaatatcttaataattaatgcaacttaatagaatttttataaggttgactttgattaaaacttgtctatatgatgatattgg

SEQ ID NO: 9197 - DNA, 201 bp, Bos taurus
gaagcagtattgtatctgatggacttaattactctggaagcatgggtcataccatactgaatgtagaggtgacaaaaatgcttggttattaaaagtataacggcagaattgtatttcacatgcagaaagggaaaatattactatttataagcagatatatttttagtagtttgagatttattttccagttgaattaaatgc

SEQ ID NO: 9198 - DNA, 201 bp, Bos taurus
caaatccttagtttcattgagagtgtactgatgcagatacagtattagaagctataaaatgtgctgtatccccagcctaaaagggagaatacatactaacacattggataaaaggagatggactaattatttttaacttaattaccagaaattcttgtatagctaatgttggtatcaatttagccctgaaaagcaaatatg

SEQ ID NO: 9199 - DNA, 201 bp, Bos taurus
agtaacaaaaagtgacagtcataaaatgttgcactgaagggattgcttgtgttcttgtccaatctcataaattacaaacaaggaacacaaaacccgaagtggttaaacgaaacactcacagtcatatattttgccaataacacaacagcaagagagagcatctactttctaacttccattctgtgtactttccagcatata

SEQ ID NO: 9200 - DNA, 201 bp, Bos taurus
tacttcatttacaaacaaacacacagaaagtttctcaaaaatacttgttgaaacttgagttggatacataagtaaaatctaattgtctttcagatttactaatgtgatcacttcagtggtggtgctggtggtttagtagctcagttgtgtacaactctttgagacccatgcagcctgccaatctcctctgggatttcctct

SEQ ID NO: 9201 - DNA, 201 bp, Bos taurus
aggaattaggagtgtgggaaaaccacaatggtaagagggtgagtaactgaaaataaggatgaagaactgataggtgctatattgcatagagagttggcctgtatgctgagtgggatggacattcactggaagattttgatagagaagtaatatggtttgatttgaatttttaaggttcactttgtttgtagggggctacac

SEQ ID NO: 9202 - DNA, 201 bp, Bos taurus
cagaatatatagcatttttaaagtgagggaaattgtcctgtaaaatgatgtaacataatcagtttgctcggggcatacagaaagactttcctgtgaccaacattataaatgtctgagcactattaagtctgaaaagcagacacaaaccagaatgggtgggaagagagactgcatttggcacaccttcaaaaacatcatttc

SEQ ID NO: 9203 - DNA, 201 bp, Bos taurus
ttaggggcatggactcctgcctgttgttatttgaacttccacctcaatccacattctgaggcaaatacaaggacaccaaggaaatgagctgaaaatcactgatcagcaacacgagtggtatgtccaatgtaaaaccttacatagagggtaagtttctaatattaaatctcaaggaagaatacagaccaagtaatagttctg

SEQ ID NO: 9204 - DNA, 201 bp, Bos taurus
tttgaaggttactggtgacaagatgtactttcctaaatgttccaaaagtctaacttaactcccacattcagttgcaagtcggactatattgacctggcccgttatggatcgtataggataaacttggaaattgagacatgtgcttaactcatttcctggacttgttttctattggtttctgaagttcttggtaaacgcctc

SEQ ID NO: 9205 - DNA, 201 bp, Bos taurus
tgtttatagaggtatatctgcagtctatcaattttgtaatctctagacagatttcaatagaaagttgtccaactggtataacattatccttcctaaggtcgaggtaggaaaaagtgaatgggctgcaaactgtggagtggcaggtatactctgctctctgaaagtctgtggataccatgtaacattctgtgctatttgaat

SEQ ID NO: 9206 - DNA, 201 bp, Bos taurus
tgactgaacaactaacactttcgctttcctttagaatgaaagcctttcctatataagcatataagctttaacgtgaagtgaaaaaaatgcatttagtaagaggtagttggctgtcactgtttgttcctctgtgagagattccattccagtaagaaagatgtcttggtgttttctctttttagtgtgagaagcagtgtgtaa

SEQ ID NO: 9207 - DNA, 201 bp, Bos taurus
agtgtttctaaacattgtttttattaacccctgtaaagaacctttttagatatatatgtttttccaaattcagtctccttccttgaaaatttaatgacacggatgtagtctttttatgtactgcagccctttggagggtcatgaatgactttaatatctaacattttctgtcctttttccctcaacaaacaactttgcctc

SEQ ID NO: 9208 - DNA, 201 bp, Bos taurus
gaatctttttgtaactttattagaagatatttcctcatttttcaaaattcttcaaagctacatgtctgtatgcattcatatgtggaatatgtttattcagtagatgtttattaaatggtgtcagctgatggtgattattattaagtgagcaaatacttattacaaaggcaccctttgggatggttatcaaggtgttcgact

SEQ ID NO: 9209 - DNA, 201 bp, Bos taurus
atccagcaccatgattcctccttctcagatctatatcgccaacctcaagtttccccatcgtttgaatttttaattggcattataccaatcttaacatgtccaaaatggaaattttaatttctgactcacaccacaaacatgatgtagccatagtcttacttatctgagttaatggcatcagtgcacatccaggtgctgagg

SEQ ID NO: 9210 - DNA, 201 bp, Bos taurus
tgtaaagagaagttttccacttctgatctcagttatgtgattatctttggggatgttgtgatctgaagcaaaatatagttaagcctttcatcttcatctacgggtagtaggatctatatatttaatatgaaggcagataaaaaaaaatgtgaatccatgctatgtggtagtgcctgaagattataaactatcaatgtccaa

SEQ ID NO: 9211 - DNA, 201 bp, Bos taurus
aaaagcgttgagatatgagctttaaaattggaattatctttaatggactcctctaaacccctgaacatgtaaagagattgatataacatgaatttcacaatcttgtgtcaactatgctttcctattgatagccatgttaatttgcctgacagtatttcagtgacttttattttggacgtttattatcctgtttttcttttt

SEQ ID NO: 9212 - DNA, 201 bp, Bos taurus
gagatgggaaggataaaggctttttcaccccagcactgagcacaatactactttgccaagggtagaaacccactagttggtggactgatggaagaatgatggaggctacattaaatacttgtcatgcttcttcctgacattactattttgaggctaataatatgaagcacacataaatagaagaagaaaatgatattgatt

SEQ ID NO: 9213 - DNA, 201 bp, Bos taurus
caattgtttttacattcccacaaataaccccgaatatagagcattccaacattccttgtctgccttccttcctaccttatcagaaagttcctcttatctactcttcaaagatgtcaatcaaaatctttaaatggtctacaaaattttcccattctcctctatacctaaatgatcttgtcataagcttccttccctaacaca

SEQ ID NO: 9214 - DNA, 201 bp, Bos taurus
attttataggcaccatgtttaaatggaggtcattatataaaatgttcaaaaattctactttaacaccattttctttgtttttactttgctatcagccttcttgttgtattaaaatggcaataggacaacatagggaattctgttttgatacttataggattgccttgttttgatatttaaagttaaatacattaattaact

SEQ ID NO: 9215 - DNA, 201 bp, Bos taurus
taaattgctactgattcataaaatttagcatctatactgcaactggcaggattcataatatactacccaaactgtggcatcctggcataaagaaatttgacaaatggcaggtacaggaaggattttctgatcttcccttgaaatagatcataaagccttcatgtgagaggtacccttcttattccccaggaaaggagcatc

SEQ ID NO: 9216 - DNA, 201 bp, Bos taurus
caccctcttgaattatgactttaacggtatactctaaaactacttcatgtactgaaattgacttcattgaattttatgacaggaaacaattttgacttccaatgaaaagattaatatcatctttgcaaattttgtctaaacgttgtcagtcagaattgcagagtgattctatctcctatcagacatctgaacatttctttc

SEQ ID NO: 9217 - DNA, 201 bp, Bos taurus
ctttcagagatactgcactggcttttaaaggcccagggaaaaacttcctacatttttcacatgtcaaacaaaggcattcatgggttaacccccttcaactgtttgtagccacatcacctctacccagcatgcaacatacagtcttttaggtctctaacaacccacaccttgcaagtatcttatatctttacctgaaacacc

SEQ ID NO: 9218 - DNA, 201 bp, Bos taurus
gctccagtggggatttccagtgagtgacttggtctcaacctcaagtcatatcacacaaaagtttcatttaaaatgatctttgttatcaagtaaaattaatgtttgtgctgaattatagataaactaaccagttagcaaaaacacagtgctagaatacgaaatctctcatatttaaaatacatgtagttagtatagtaccaa

SEQ ID NO: 9219 - DNA, 201 bp, Bos taurus
agagaactcgcactcacatcttatttgccaggttaattcacctgctttctgcagaattaattccgcaccccccccccgccccgtcatcagatccaaggcccttattggctcagacctagaaccctgaccaatccctagcaaggagaaggagattactgtgctgaagttagacacctggggctgcccgtagagtccaggtcc

SEQ ID NO: 9220 - DNA, 201 bp, Bos taurus
tgtcctaatagctgacatccacttgaacttctacccattgcataggagccatatcccaaccactcccttgaaagtgccctctaaaatctcagggtgtctgctggctaaaatctaattggttttcaaatttttttcttactttatttctctgcattctttggcactatagaccacacctttattttaaaatatttcttaact

SEQ ID NO: 9221 - DNA, 201 bp, Bos taurus
ataataggaattccttgtttatactggaatctttggacctcctagggaatggtaccatatgggaaaaaaggacttaattccttgttttgtgtttgctaattgattattttaaacttttcttacctctttgaaccccagtatccttatctgtaaaaaagggtaataatatagtgtggctcataatacttttttgtgaggatt

SEQ ID NO: 9222 - DNA, 201 bp, Bos taurus
atctcttgatgttctttaagaataacactgcatattcagtgaggattttcaattaaggtaaatgacgggttttatatacaaaaaaggacttgcaaatatggaggaaattattgaaagagattgcagaatacacaatgcaagaggaggtgtttcttgggacttattcagaggagagaaaatactaccatcaataaaactctg

SEQ ID NO: 9223 - DNA, 201 bp, Bos taurus
tgtaacaccaggtggcaacagaatgtcttcctcattacaatcactagcgatgagctgcggagacctcctgtacatgatggcctttctcgacgggcatccctgcttggtggtggggaaaaagagaaagggctgtatgaagccatttcagcaccatcctgagcttaatagtgctgtctttcattgcctcttaacaagctgcgc

SEQ ID NO: 9224 - DNA, 201 bp, Bos taurus
ggatcccgggtaaagctataggatgataatcaggaacatttggcgtctcggtgctcctagcatcagataaagacaccatcagaaacttatgaactgctcatgaaatcattggtttactcatttatttcccccattacactctaagcccttcaaaacggtgtcagaataatgttgagcattggaaaggtgttaaaaataagc

SEQ ID NO: 9225 - DNA, 201 bp, Bos taurus
cagactttagatccaactttacatcctgggggtagaaattagttggaagtgaacttgagccttgcttatttccagagctaaacacacaatcaaaggtcatgtgaagttttaaaaaatttttttagttataaaatgggatgcatgtttattgctggtattttagaaaacagaaatctacaaaagaaggatatttaagatgtc

SEQ ID NO: 9226 - DNA, 201 bp, Bos taurus
tctcaaatatgagattcaaattaaaaaaaaaaaaacttaaaaaaatgtagcagcatcctagttgggggatcatgtacttctagttgggttttcagattgataactgtgccagccaccagatgttccaatgtaaaacttattaatgcatttaattagtattgaatttccccagtatttatggaccagaggaatatggaagtg

SEQ ID NO: 9227 - DNA, 201 bp, Bos taurus
aaaaccactagaccattcaggtatgacctaaatcaaatcccttatgattatacagtggaagtgagaaatagatttaagggcctagatctggaatgaggttcgtgacattgtacaggagacagggatgaagaccattctcatagaaaagaaatgcaaaaaagcaaaatggctgtctggggaggccttacaaatagctgtgaa

SEQ ID NO: 9228 - DNA, 201 bp, Bos taurus
ttctcaactgttaaaaacaaaaatattcacaccaacctcataaagtgcttggagatcaataatatcattttaatatggctgttaggccatcatcgtttcacgagatgggggtggggttttcatgaattattttcatcagtgtatttctagcacctaatgtgtagcaggccctcaagattaatttctcaagtggtttaaagg

SEQ ID NO: 9229 - DNA, 201 bp, Bos taurus
gttaaaagtgatttaacttattaagattcctctttgtgtatattttagaataaaggtggctttcttccaagcatcttcccccattggctaaacagctaccgtagacatcagtctgaagacaaaactgtgactttgtgggggaaaactggggagttctcatcccttggtgcccaaagcactaaggctgtggtagaaactcta

SEQ ID NO: 9230 - DNA, 201 bp, Bos taurus
tctgtaaaaataaacaaaatatcttttttgaatcttaattccctctctagtcactaagttatttccttgtttgaaaatcaacttttggaggcttccctggtggctcagtgataaagaatctgcctgcgcattcagaagacatgggttctatccctggtccgggaagatcctacatgccacagagcaactaaacccatgcac

SEQ ID NO: 9231 - DNA, 201 bp, Bos taurus
taagtcatatttcttatgtttatttcataactctttgctcaccagatggcattctgagtcctcatatgagttgttcagcttctgtgatcaacaaggggggcgggcggggaactttcaacaaaggaagtgatccttactagctctggagaggtagaccactaccaccactcttatattttactaatacattgccattgcgat

SEQ ID NO: 9232 - DNA, 201 bp, Bos taurus
cagacttttaactgaagacccttatccccacattattcctcatctgtttctacccttattcaaaatacaaaatactggggcacccagaacaagaataaggttcattgttccttggtagtaatatagccctgaacttcaggagccatagaattttacctagcctgctgctatagcacactcagaaaattgccagagatagtc

SEQ ID NO: 9233 - DNA, 201 bp, Bos taurus
attcgagtctataaaagagtttgggaagcaggcgactaagtagtagatgaaaataaccaagcagaatgacagagtagggggcggaaggatgcgcccaggcgcagacaactcatttctgagagcagggtatgtcaccacccaagactgccaccaaagggcttttaaaaaaacattcagcctagggaaggtagaaatcctggc

SEQ ID NO: 9234 - DNA, 201 bp, Bos taurus
tcacaagtagagttcagaagttcctctttgagaaggggcattaactctggaaaaggagctgagcgttagctgttggtgtaggtctctgaaaacaatatcacgtgcagtaaaatcctgggagctccagataaggttagaagtttcccagagagagctccatgctccaggtctggcctcaggagcctgcctcaagtgtggagc

SEQ ID NO: 9235 - DNA, 201 bp, Bos taurus
agttttgtgtatatgtctacacgtttgcatattagcaagcagagcagcaaagtgttaaacgtgttggttgaaaaggcacctggaagttttgtttatgatatatatatatttaatttaattgatgaatttgtttatgttggactgggtcttcatcgctgcacatgggcttttctctagctgcagcgagcggggctgctcttc

SEQ ID NO: 9236 - DNA, 201 bp, Bos taurus
tttttggcttgttgcttgtgcaggatcaatccccctgatgttagatctgccaaatggaaacacaatggattttaagggtgggcatctagtcatgaaaacgtttctcctaaatttcacattgccaaaaggccattaaccatgccctctcacccaaagaactgtgttcatgctttccttccacccagaagagtcttctgccaa

SEQ ID NO: 9237 - DNA, 201 bp, Bos taurus
cgcatgaggtggccaaagtactggagtttcagctttagcatcattccttccaaagaaatcttgagcacttaatctggggaaacacactgcttccagggagcaatgaatattcataaaatgtggcctttgcttaaggggattttactgtctctataaacagcacactgttagtgcattgatggaccgtgaataaagaacaaa

SEQ ID NO: 9238 - DNA, 201 bp, Bos taurus
tcctggcctgggtctgctccctccatcctgcccacagtgatgccactccagacaagcagccttccctccctggtttgcaggtcccatgtcctgggtaatccagactcattctctggaccatcctgtcatccaacagcagcctctcctgaaatctgctcaggtctcttggcacacactgagcatctttggccctatacagcc

SEQ ID NO: 9239 - DNA, 201 bp, Bos taurus
tcaacctctataatcttcccattcgtgctatataagttatagtttcagtttaaatatcattttaaatgctaaaatcttaaatcattgctcatttgggatgcatggtattaagaaacacttgttacttaatttctgtataagtaagaagcatatatatctgttcctttactcaaatgacgtctctcctattctatttaacct

SEQ ID NO: 9240 - DNA, 201 bp, Bos taurus
ctgagagctggtttctgaaaagagggcagtcttggggaggaacatgcccttcacctgtgaggcttgggtcagctccagggagttggggccagacttcagcgttaagggggactcttccctagagcttatgatcacacattatcagctcacacctcaggaaacgttctgctggccgagaggtctgctcaccaactgcctccc

SEQ ID NO: 9241 - DNA, 201 bp, Bos taurus
aggccagctctctcccgataccacacacacacacacacacacacacagtaaagagcactgatgaaacacatgagattatgaagctctctttggtacagagaacatttaaggccttgttttctcttgttcacctaaagttagaactgagtgtcttggtatctatattacttgtaacagatttatcctcacatcttactggtt

SEQ ID NO: 9242 - DNA, 201 bp, Bos taurus
tgaatggatgggagggaaaatccaagggcaggtacaaaggcagagggaagagaagggaggaggtggggggtcaggcagggggaggactggctgtggggccgatggacactgattcatctcaccctcctccccacctctcagtcatgggctcactcaacagtcaggggactggtgatggagacacaacaagccttctcttgg

SEQ ID NO: 9243 - DNA, 201 bp, Bos taurus
tgttgggaaagttagacagccacacgtaaaccagtgtagttagaacaaaaacccttagaccatatgcaaaaataaatttgaaatggcctaaagactgaaacgagatatgacaccataaaactcttagaagagaacacaggcaaaatgttctctgacataaatcgtaccaatgtttccttaggccagtttcccaaggcaata

SEQ ID NO: 9244 - DNA, 201 bp, Bos taurus
gcgcgcgtccgcggaggtgaaggccaagccgctgcgggcgctgatgagcgcctggcccgcgcctgctgccctcagctcctttcgcacatggttggcctagtgtggggtaggagcgctttccattggcgctggactttttgcatggcttagtgccgccccaggcaggctgtgtggtcccagctggcgccctggtacactgtg

SEQ ID NO: 9245 - DNA, 201 bp, Bos taurus
agagttaacttatgggtaaaaacaaacaaacaaaaatgattatatgaatgccttccctttggccttagggaaaaatctggtctctttttcttcatcaggattatctccacaggtaacaaagaaagcagtcattaaaggtaagtttgtgcctttaacattccaggagaccaggcagtgatgaagcagtcactagcaaagccc

SEQ ID NO: 9246 - DNA, 201 bp, Bos taurus
acttcagcaggggccgtgggatgagcttgtagtgaaaactgaggagcccagaatcatgactcagtcaggggtgaggaaccagagcccccaggtggagacatggcccagagattcactcagagtagatgaaagctaattgaagggagcggaggaagatgcacttgggagacagccgagaggtttgtgatctggtcctgtcag

SEQ ID NO: 9247 - DNA, 201 bp, Bos taurus
gttctgttccttagctacaacaagctaggccaaggttggctttccaaagctggctggcctgctgtgtgcttagcacatggttcattagcccttataatcagaatcaattgcatgtttttgtatgacgtgtagagggacagggataggtgctgcctgatttcaggataaaacattctcagtaatgaggagagaaaacttcag

SEQ ID NO: 9248 - DNA, 201 bp, Bos taurus
ttcaatgcttaaatttgaaagatccacaatcccataaaaatattccaaagtagtatgagtaaagatttctagatagaaatttcaggcaatgtgaaggagacatggccagttcagttcagtcgctcagtcgtgtctgactctttgcaaccccatgaattgcagcatgccaggcctccctgtccatcaccaactcccagagtt

SEQ ID NO: 9249 - DNA, 201 bp, Bos taurus
ttcagccacgccctgggagccccgtgtcctctctcctcaccggttgccgggcgccgccatcttcttcaaaaaatcctaataaaagaagaaaaatgggggggaaaaatggccaagacatacgtgaaaagatgttccacataattagctgttgttgttgtcactaagtcatgtctgactctgcagccccatggatgcaccacg

SEQ ID NO: 9250 - DNA, 201 bp, Bos taurus
gagacccagaagcacacacagctcctgacctagggtggagtcttggaagactccagcaaactgatggaaaaccacgagaggcgtgatgcctgtggtaggaagtgatctggcagaactgatggcggcatgatcatttattgaactcttcatcttaacagcagccctcggaagcacggagaagtgtcccattttgaagatgaa

SEQ ID NO: 9251 - DNA, 201 bp, Bos taurus
aattgtgcaaggccccaagtggttcatgaataggtaattaattaaaatgttatatgcagtgtcatgcagtatgtgaaggtttttatggaaattattaacacttctttgaaaatttctctttgggcctatttataaatatatgtctaaagatatgatatctttgatatataaatattctctgtgtgtatgtgtgtgtgtatg

SEQ ID NO: 9252 - DNA, 201 bp, Bos taurus
aagagtaatcaatttgatccggcctccaaaacaggtgtcattttgataaatggtcctaattaagctgagacttcaggtaggaaaccgattgagttagtgcattggcacctatgtggccatggctggacaagtacagatgttacagtggggtaaaggcagcactttattaactactgagtcaagtctccaagttttgcattt

SEQ ID NO: 9253 - DNA, 201 bp, Bos taurus
tactgtcatgtctaaaatctgcagagttgatatatcagcttaagtccaaagctgaaagatgctatagattcaggaataacatatattcagtagggaggatgtcagacagcaaagtctgtcttaattgggtgatggtcagtattgtgttctattcagaccttcacctgattggatgagacccacccaaacaaggaagagcaa

SEQ ID NO: 9254 - DNA, 201 bp, Bos taurus
atttctcttagacttctcagcaatttaatactttgactagtcttttgctggtctcttcaacaaaactatgacttttgtcctgagtctgccctatatcttagcctgctttacgtgtaaccttcccagtccaaagggaggtgagcagactgtagaaactaagcttttacatactcagcttgggcatctttcttagacttttag

SEQ ID NO: 9255 - DNA, 201 bp, Bos taurus
ctgaaatgcgcaacggatcctgttttctgtaggatgttcaagagcattgcagtcaaaaagcttctggacgtcttgaccgcaaagaagccttgattggaaggttgtctttcatctgaagccaagtccctgtactgctgtgagagaagaaacacatccctgccatgtcgtcagatgctgggaccgcagtgaagtcaccactgt

SEQ ID NO: 9256 - DNA, 201 bp, Bos taurus
ctttggtctcctggttggcataaatcaagatcaccaggccacatcttggggcttttgtgacgacctggcaaaacaaggtaaccaaaagtactctacacaccgtgaaagccccagtgtcagggggagagagcggatcactgttaatttagtcttcatctgttgggccagggcaaacgtgttttactgagtgaagttttcttg

SEQ ID NO: 9257 - DNA, 201 bp, Bos taurus
ttgttcaaaggggtaattggcctttgtacatgtacaggcatatgaacaaggcattcggctggtgattacagaaagagagagaaaaggaaaagggtcaagcgaaaagcagtcctggccaccagaggcaggaaatggaagttctgacaaagggttccctggctttcaggcctagatggcttgataattaaactgactgcaccc

SEQ ID NO: 9258 - DNA, 201 bp, Bos taurus
ggccccaggtaggccaaggagagcactagagctgagcagcgcacctgtggacaggtgttcagcaaagccacgcctcccgagaggtgctgggcgccttctcagtctcctcctttgtcctttgaggcccatgatacttcttaaggaaggtgggaggggtccttgtcatgcaggggttggcagaagtcactccctcaataagcc

SEQ ID NO: 9259 - DNA, 201 bp, Bos taurus
catcaagaacggccagggcttcatcctagtctacagcctcgtcaaccagcagagcttccaggacatcaagcccatgcgggaccagatcatccgagtaaagcggtgagagggccgggggcgcgggcagggggcttcgccggtgggggcccctcagccctcctgttcggggatcagaactccctcccgcgtgctctcgggtgg

SEQ ID NO: 9260 - DNA, 201 bp, Bos taurus
gccacccaggttccaaagttcatttgttccaagtgaacaagttccctacaccgcaggatttctgactgctggagtcagggaggcgatacagatggaccccgcgggccctttgctcttcttcccaccagcattcacactacctggtctgtgtcctgtctggaatgctcttccccagacacctttttggcaaactccctccct

SEQ ID NO: 9261 - DNA, 201 bp, Bos taurus
agcctgtgttagtgcttccagctcacactgtggccactgcccccgtgtccctcttcctcaccatggactgtcttcacctgcccattcctccctgagaggaactgtaacttcactgccatggcctgacctggaagcagaccctgagcagcagcactgtggccaactgatggctttctcttaactcagggtctccagatgtta

SEQ ID NO: 9262 - DNA, 201 bp, Bos taurus
ctaaacgcgggggctcagtgcggagggaacaggagctcagtgtgggcccgccagatgccgtgcccaccctgggagcagcggtgtcaaggaagaattaggcgtttgtgcgcccaggagatgggccggcctccacgtttagctccattctccccgaatgaaagccttgtcctggctccacagactctggttttaccgtgtggt

SEQ ID NO: 9263 - DNA, 201 bp, Bos taurus
ggagccctgctgtgtgcggccccccacccttctgaaccttcctccgcagagcaccctgatcggccctcgctaggctgcagacttcctgaggacaggccagaaggaggcttcacctgccggggctgctggagaaacacgccgcgtgtatgcgggctccccatccagcccaatgccagatcgcactccacagatcggccttcc

SEQ ID NO: 9264 - DNA, 201 bp, Bos taurus
tagccctacatggcatttggggaggattaaataaagtgacattcttgagggttttatctcaggtccttctcattcctcattcactgacaggcccccgccacctctcacagacattccatgggtacctgcaggtggctgtcttcatcccagactgctatgctcaattcagaccctaatgcccagctgaccaccagccacctt

SEQ ID NO: 9265 - DNA, 201 bp, Bos taurus
cctttgagaatcgggaatgtccactgaactctaacaacctggagctgcttgaggaattcggggaaaccagcgccaatgggacggtggaggttttatgaagtgactctggccacgatcccagggcagggaccagacatcttgggtgctggtgaccttgtcacccgacgggaaaggcatggggctctctgtccagtggccctt

SEQ ID NO: 9266 - DNA, 201 bp, Bos taurus
ggagccccatggaggccagacacggacgactcgggatcctgtccgcatgcagcagagaccacgcacggtttcctatagaccagcacgcggctctgcaccagaccaagcaacaccggcctcctcccccgcctctctatgctcatttacttccaagacagtcccaggaagcattcttttacatgcaaatatatacagggtgct

SEQ ID NO: 9267 - DNA, 201 bp, Bos taurus
tttaaaaaagtctgttcatggtggacacctacagagactcctcccaaaaatttcctccaaaccaatgatttcctccaaacgatgccccaggccatcttgggaaacatgaagagacaattttttttttacagctcgattacagctcagagttttatgcggcaagcaaaggaaagtacacccctgaggtatgagggtgggcca

SEQ ID NO: 9268 - DNA, 201 bp, Bos taurus
cagcaccacaatcaatggtagaattcttcagtcttatttgttttctttcgtcatttgagctatccttccttgttaatcaaaaaacattaaaaaactaaaacagcaagcaaaatctgttactggttactatgctctgttagccattatgttgccaaagtatattcaaatttgatataaggtgactctggggaaggtaagaca

SEQ ID NO: 9269 - DNA, 201 bp, Bos taurus
tgtcgggggcgacctgtgctcagcatctccttgattccaaaccagattcagagtcgctggacaggaaactccagcagatggaagctgcggccagcgcccctgcccagtgccagcgccaggcgaggctctcgtgtcaccagctccaggttatgaatcgtgatttgccgaacagatgaatttgttcctgtcgctgggtgcaaa

SEQ ID NO: 9270 - DNA, 201 bp, Bos taurus
ttacacagcattcccgaaatagggtgaccgtccaagccctcccctgcctagtccaaaacacacaaaattcctcgtgttccacgaccagactggccatccacgatcacattattttcctatcactaaagtcaccatttcggtaaactgaagaagcatgccattcgcttagatttaatttctgattcagattttcatctgaat

SEQ ID NO: 9271 - DNA, 201 bp, Bos taurus
accgcactgcccaccccccaacttcagttttatacttcctgaggttattttcaatttgaggctctttttttaatatctgggcacatcctttatgggccttcctctttcctatctttcctctaattcttcctcacttgcttcttctcatttgtgaaatgaatgattgccatcatggctattaaatataagggtgctagtgtt

SEQ ID NO: 9272 - DNA, 201 bp, Bos taurus
cttgactagacggaccttttttggcaaagtaatttaggtttcattataatgagcttgaatggtaaattcatgaagtcaaaatagtctgagtaagaatattttgtcatatcacatctctattgaactttgatactgtaaaacagtggcatggcacatgggcagtttgtcaaaatattaaattagtattggtcgcacgtaagt

SEQ ID NO: 9273 - DNA, 201 bp, Bos taurus
tttagtgaggtttgtgggtatcaatttatattctaagattctaaaattctttgcttagaattgtattcttcgtttattttatgaagccctttttgaggccacatagaatacctggagagtgttatagaggtaatctttgcctctcatggttcactttgggcaattttctctgtgcggctggtgagccagttactgctgtcc

SEQ ID NO: 9274 - DNA, 201 bp, Bos taurus
aaggccttgaatagatgttgctccagtgaagaagcacaagtgggcaacaagcgtaggaagaggtgcttggcgtcttacttcatacatgtatctgcccttccttcctttttatggccaaataatattctattgcatgaagatgccatattttgtttattcatttatcagtcgatggacatgtgggttgtttggctattagga

SEQ ID NO: 9275 - DNA, 201 bp, Bos taurus
tgtcttctgtgttccagactatgatctctagcttgtgggggtttttactctctgtcagagaagacacaaaaaagagaacaggccagccaccaatcagcagcatccatactcataactagagagccttgaaagaaaagctgtacacaattcatgtggccaaatatattctgtttaaaatattgagttaaaattcacataaca

SEQ ID NO: 9276 - DNA, 201 bp, Bos taurus
aaaaattcactgaactttaattattaaatgggtctatttcttcacacccaaatcaataaagcctatttattttttgaaaggcctatcaaacatcagcattcgaacaaagcccttttatccatcatgattttacttgcttcttgtaaaacgttcgtaccctgtgaattataggccttgtcttctttgcccaagtgacttgcc

SEQ ID NO: 9277 - DNA, 201 bp, Bos taurus
ctgcccgacagtgactggttatgcgttccagggagcaaagttatagaattctgtaaacagtctcttgaagcttacatagtcacatacacattcacaacaacagccaccgtgtcctaagttactataccaaaacgttaggcactatttcctgttttccttcccagcaattctgcaaagtccgtgttatcactcccatttcac

SEQ ID NO: 9278 - DNA, 201 bp, Bos taurus
atgatcctggcagcaggcccccgccccagtgtgtcccaaagagtaaagagagaatggaggcaaacctgatcccccaaactccagcctcagtgtcttcccgcagaatagctggggccattgtcttgatgacgggaggcacagatgttgctctctggggaagtggaggtgaattcttgcttcactccacatggtccctgaagt

SEQ ID NO: 9279 - DNA, 201 bp, Bos taurus
atattcacccttgacctaccccttctgagtcattattaagactgctgaactgggcgttttcctcatagtaaatattacatttcacttggcttcatcagccaattactcagataacctttttgggcagtctatacctcaaaggcagatgagaaaacaggggtcagataagcgagttgctcaaagttatagagtcccctaaca

SEQ ID NO: 9280 - DNA, 201 bp, Bos taurus
atgacagtctgttctgggtttgtggaaagatgaatgtgagaggccaaggaagcctttataaagtcaacagaggtggcagctcttccttcctaccatctgcagaaaaccaaactggccagagagaccatgagcgttatgagggaacatcccaagttcaatgccatttatggctcagttgtccaactgcttgtgagcccatag

SEQ ID NO: 9281 - DNA, 201 bp, Bos taurus
caccagggaagtccccagtcttcgactggaaggcctttgcatatagcaaatgtggtgtctagtttaatgtatgtagtttgtccagcacttacttgatacacagattttagaattggaaggggccttagggatcgcttgtattttgttttagtggctcttgggcagaggtctgatttgctgcagacgtgttcagtgacaatg

SEQ ID NO: 9282 - DNA, 201 bp, Bos taurus
cctgattccaattctcctgggaggaaatgccttggttacattgtctgtgatgttaacaggcacatgctaacatgaacattgttaacattgtctgtgaattgttacaggccaacatttcattctccaagaaatagtattagtcccaaagtcctaaaatttcatagaacaatatgatacataaaaatatgtctaacttactca

SEQ ID NO: 9283 - DNA, 201 bp, Bos taurus
gtccaagggactctcaagattcttctccaacaccaccaaacacatcttggttagtatgcttattattgtttcttgctcagcatgcttattagcagtttccctgatggctcaatggtagagaatctgcctccggtgcaggagacataggagactagagttccatttctgggtcagaaagatctcctggaggaggaaatggca

SEQ ID NO: 9284 - DNA, 201 bp, Bos taurus
agattcctgagctcagatttgattgatattccgaccccaggttaagtcagctcagctttcggtaccaaaatgtaagcagatttcccagattccttatcacgccagttgtcttgtttccacataacattcatggcaaccaaatatctcttaattcatttgttaatttaatatctgactcatccaaatggactgtaattggta

SEQ ID NO: 9285 - DNA, 201 bp, Bos taurus
cccgcctttccttgaaagaaatgtcctgcctctcaaagcttccccatcacagaggagctggtcaagctccccttcttcctggccttttcctaaggcttaacgagccacagtatctgtcatcagtcatccgttcgctgaaacgttttggtttctgtataacatcttaacctctgtggccaaagaccatggagtgcagcatca

SEQ ID NO: 9286 - DNA, 201 bp, Bos taurus
gggtatgaactaaacccagtataagacaaagacatttaacaactttggggaaaagttgccttgttcctaagaaagacacagaaagaattggcctcttaaatcctctggaaactgctggtctgatttggaaactcttggtggcaatctttctatttacctcaaggtaaaaccaacaccaagaaaggcagagggaggggctcc

SEQ ID NO: 9287 - DNA, 201 bp, Bos taurus
caaaaggcaagcagagaattacattcatttcaaagatgagcattttttatgtttgcactgaattctgtgattccctttctctaataagaggactcaatggaatgtccatttgactgagtgaactgaggtgacagttctctgatctttgagaatcagctttgacagtgagaaggaaaagctgccaggttgcatggcttgtat

SEQ ID NO: 9288 - DNA, 201 bp, Bos taurus
agcaaactcagattgtgaaggacagggaaacctggggtgtggcagttcatggggtcacaaagagtctgatatgacttcatgactgagcaacaacagttcaactaaagcatggggcaagactggaattcttccttgagcaagttattgggttaaggttctagactcaagagacctctgtgatggtttaagtatctttttgta

SEQ ID NO: 9289 - DNA, 201 bp, Bos taurus
tccagcgaaagagcagagcataggatagatgctgatgttcagaagacagatcggtgggactcgtctccgacgtcatggccttggtccccagtgaaagtgagagtcgtgtctgactctctgtgaccccgtggactgtacagtccatggaattctccaggccagaatactggagaaggtagccgttcccttctccagggggtc

SEQ ID NO: 9290 - DNA, 201 bp, Bos taurus
acagcggcatcatccctagggcgagcagcgtggagcaggtggtcatgctgacgctggaaggaaacgggcaagttgacatggccacctgggctttccagggaagaggtggtttcctttctcaacccatgatcagaaagtcctgccaaagactctctccaaactgtgccacccgatctgatggatggaaatatacatgtcccg

SEQ ID NO: 9291 - DNA, 201 bp, Bos taurus
ctttatttttcagggccgaggcactgttctcaggcaccaatgagagggagccacccaaaccctcacttttcctttaaaattcagctcagagtaggattctcggtgacacctccctggcctgcatctgacttaggctcagctgggtgctcctggtctgtgctctcacatcactgctatgaattgtcaccagactgctctgcc

SEQ ID NO: 9292 - DNA, 201 bp, Bos taurus
gacagccagatccatctcccaaccttcctgttctttgttttcattcccaggcttaggacattaattaaagcctccttctcacctttattcacagagattccgtctgaaagttcagggctgtcagcagaaatgtgtcattgcggcagcggcagctccatccaagaaaataccaataagcacattaaacaaaagaggagttaa

SEQ ID NO: 9293 - DNA, 201 bp, Bos taurus
agcaaagatgtctcacaggtgagggtactgcaggaaggaggggcaaaaccactcagccctgatatttgtctgaactttccggcaagcattgtggacttggacagtttccccacagctgatgctccaggtggtgaagggcaggcttgccatctcttcttcctccccatttccttctgtcaccacagtggctctctggttcca

SEQ ID NO: 9294 - DNA, 201 bp, Bos taurus
gaagtgtccagctctgtgacccgtggactgcagcacgccaggcttccctgcctttcattatctccaagagtttgctcaaacaaatccatggagttggtgatgctttctaaccatctcatcctcggcagccctattctccctctgagttggcctcatttggggggctttgagggtaggggagtcatatcaatgtgtattttt

SEQ ID NO: 9295 - DNA, 201 bp, Bos taurus
cgggtgagccctatgatggttctgcttctagaagtatctccaggccatagcacagaaggggggtcaggggaacccttaggcattctcaagctgagaagacgggtctgggagtccagcaaggccaacgtggtcaacttagcacatataacaaaatacaagaaaaaatatttgaaaaaaaatccaacatctgttgcaaaccaa

SEQ ID NO: 9296 - DNA, 201 bp, Bos taurus
tatttataactaaacaaatatttattcttggaaagatcacaaactagttggtagagaatgcaagcatatgtgaaatgaaactaaatcttttcaaaataacgatttaaaaattagataattctatacatactgatgtatagatatacactatatttattgacacattgtaagtttaaatttgtaatgcaattttcaaaacag

SEQ ID NO: 9297 - DNA, 201 bp, Bos taurus
actggtttctcagttctcaggccttcagacttgactgagacttacgccatcacctccccaccctcattcttaagcctttgaactcggacttagacacacacccttggttctctagttctcaggccttcacactgggactgaattagccctctggcttcccttgttctccaccttgcaaacacagatcctagacttgtctgt

SEQ ID NO: 9298 - DNA, 201 bp, Bos taurus
tcattgaaatttctaccagggtagttggatccactggatttccattggtattgttttgtaattttatgaccatttgcccatatttattttatcctgaataatgcatgggagcaacatttctaaaaacttcatgtagtctgttatatgataaactggtggtaagatgtagaagctgtcatttaaaaatttaaaaaattttga

SEQ ID NO: 9299 - DNA, 201 bp, Bos taurus
gagctgcacatgactgaagcaacttagcatgcatacatgcatggacatgtaaaactcttccaagtgcattcagttccaattcacttctaatgttgttgccgggacttgtatatatgtttctataactcacacttattatccattgccctgcatgaaaatctcttatcatgccctaaatatcgacagtggccttttcaatgg

SEQ ID NO: 9300 - DNA, 201 bp, Bos taurus
aaactgtatcttttaaagtaaaattgcccaatgctgtgagcatcttcaggaaatgagaaatgtgaaatccataaaagtctaagttggctaaaccagatgtttaaatacctcctgtgtaataaataatatgaatagatttttgtgaccaatagaacataatttgatttgaatttgatctctcctcaggattcaagtttaaga

SEQ ID NO: 9301 - DNA, 201 bp, Bos taurus
acttatattttagttctgtttagagtttctgtgacttttcttctgttcctgattttaatagcaatttgagcctgagtttaaacttcacacatttctaaaattgtcaactcccagcttcaaaccaatttatattttttaataattttacactcaaaaataaaaatattgctatttcaaattgaatacatatatatataacat

SEQ ID NO: 9302 - DNA, 201 bp, Bos taurus
atccaaatgcaattacatgcaagcatctgattcaatgatgaaatgaccatttctttaggactgtgaagagtctttcgagagtagaagcattccaaacccctagatcccagctgggtgatctatcatcgcccacctatagtaaatgtgaatgcatgaagtggggaaaaaaatatcatgtcaaaaatgaataatcattagatt

SEQ ID NO: 9303 - DNA, 201 bp, Bos taurus
gtgggctacagtccatggggtcacaaggagtcagacacgactgggcgaattaacactaggcactgtcctcctctgagttttttctgtaactatctcctctcctcttctgtttagtatgaatcttgttcagagactagtgaatctttggggacacccttgcctctcactgaataaatattttactttcagaattggatattt

SEQ ID NO: 9304 - DNA, 201 bp, Bos taurus
acagtttgaagcaaatgggaacctgacacctggttaaattttgcccatgggtttctcagccaagtgcttggtcagtggctagggtccatggctgggccatccccaggactggagacatccccagggggtgagggtaagctagttatcagaatgaacagtattcacagggccgcatggtggtcgatgggccacactgccctt

SEQ ID NO: 9305 - DNA, 201 bp, Bos taurus
gtgttgtctgactgcaaagagagaaagattgtggaagggacaggccttgtgatgatgcctgtgacttccacacacgtcctgtgactgtgagagccacagcatctccagagctgtctgcggccccagaaagtcacagaggagaagtcgggatgtgaactcaccatgttgcatcagtcaccgtgtggatacacttaacacact

SEQ ID NO: 9306 - DNA, 201 bp, Bos taurus
tctcacaattcagtacgtcacaagttccatataggccccaacaattaagtcaaaggtatgggcaggctcgctcctcctggaagagagagcttgtgcacttactctcccagcttctcagggccacctgctccccgtgacgcccagcctcttcctccatcttgaaagtcagccatgttgagtctctcaccgcccttccgccat

SEQ ID NO: 9307 - DNA, 201 bp, Bos taurus
gcccaagaatcgcctggttgtgttcattacaatcctctaacctctacaagaatggaaacatcagtacttgcttaaattctcttcatgactttggccaatccggggaacaagcagcaagggtctttcttctccgtgtttaagtataagcttcctgcctttcctcccaggagcgtggtgggaagtgctctggagagaagaaag

SEQ ID NO: 9308 - DNA, 201 bp, Bos taurus
ggaggacctagcttcagaaagatggtgagttgcaacaaaaattaaggtcacacgcagaaacaactgaagttgtgcacggccgctgtgagccctggaccaatagtcaccgctacctctgcactgtgggtgctggcgactctggtggaagaagtactaagaagtccctgcttgctgtgtatgccaatggccaactgaggacat

SEQ ID NO: 9309 - DNA, 201 bp, Bos taurus
gctgctgcagaggagctaggtcaccctgaactttagaagccccagagcacaaaaagggtagttttcctcagctgggaaaagagagtggacttgtagacttgggatcagaagtggaataattatccaattttaaaaaattactattattataaggatgtagatttctactgtggccaagtcttttgtaatattaatatttcc

SEQ ID NO: 9310 - DNA, 201 bp, Bos taurus
tgctggatcaggctgagccccgggaggtgcagagatgagcagaagaaagcacaggaaccacgggcacagctgaaggtttgaacgtaccttttctctgagcgtggcccattgctgtacattgtgaacgttttctgctccacctccaaccccacccacccacagtccttgagtgtttggatcagcatatccagcctgcagcct

SEQ ID NO: 9311 - DNA, 201 bp, Bos taurus
cggcagtgcggcagctggcatcctcccgggtaccagcccaggcaggttccagcagcatccgcggcccgcgccacgcccttgctggccagctccccgccccagctcgctttggcagctgcagctagcctgagggggaactacatttctgtttccaagtgggccaccgtgctcgaggaggccagccgcctttaaccccgcaag

SEQ ID NO: 9312 - DNA, 201 bp, Bos taurus
ggatgtcttggaaagcagccttgacatcgatgattcgtatgacattctaatgtcttggaagtttccatctgaaatatttgcgtaggaataaaaaagcagatagatacattcctggatgaggatggctagctgtgctagacatgaaatctttgtgcttcctgcagagaacacgctgaaccgatttatcaatgtactcattgc

SEQ ID NO: 9313 - DNA, 201 bp, Bos taurus
ggcctgtggtcttagtcccttccctgagtgtgactaactgagaacattcttactggctgtactgtctgctgtttctctctcttggtgggggagtgggtggcgggtatttctgagttctggcctgtattagatggtgtggtgcctggggatgaaaaccattgtggatcttatagaacaaagtccctatttacttgtccctga

SEQ ID NO: 9314 - DNA, 201 bp, Bos taurus
tgagccaggagatgacccgattaactctgtacagactcttgaggcttggctgtgttggcagtatcagagcccagggcccagctttggggtgtgtatggtggtgatccctgaagtctgtaggatgttccagacagggtcctgacatctgatggcagattcgggattctggaggcctgtctgggggttctcggttccagcttc

SEQ ID NO: 9315 - DNA, 201 bp, Bos taurus
attatttgtgaacttagagtcccaactgtagagagagatgtcttgtagaatgcggtaaaggagcctaagaaagcgtgaagcttgggggccaggtgagatagcaaagatctctcccttgttcctctcttgtctggaccttgactagctcacctccattcatgaccgttcctgtctggcccttaaagggacagctctactaga

SEQ ID NO: 9316 - DNA, 201 bp, Bos taurus
taagaaaaaaaaaaaaagcccactaaacgcaaatatactctctgattctattgctttgcttactcagaaatcacccgtgtaaaactgctgccgctatgctgggcataacgtttttccctttctttttgatttctttaacacatggttcgtggcctttggtacatttcagcagagttaattaagttttcagctacaagtcta

SEQ ID NO: 9317 - DNA, 201 bp, Bos taurus
gagacaagaaaaggccccttccagtttccccagcccagatctttcattgaaattagaggaaacttctcctgtctgtcacctgaatctttgctcttgagaacgtggtttcaggtgggggctggcggcctcttgacccctgtggtctgaaaatatttacttaggaaggactgtgctcttgtcccaaagagtctggggtcttgt

SEQ ID NO: 9318 - DNA, 201 bp, Bos taurus
ggtgaagttggcagggagagaagacgggtactggagaggcctgctcagaggctggtaccctgggcgacaagaaagctatcacacaggaagaccgatagcacagcgagagcgtggggcccacttgggatgagagaaactgcatctggtaccatccaaactgcttaatggcatcaccgacccaatggacgtgagtctgagcaa

SEQ ID NO: 9319 - DNA, 201 bp, Bos taurus
tccagaaggctgtggatcagccctagagaaatcagcctaaagcgccgccagcctccaggggcctctcgtcttgacgcaaaagcctggggccgcgaggggcatggtttagccagcagagcaactccgcatccttcggggaagatgaccgaaaatgctgacgtcaccaccccagagacagctctatcagagataagcaaagag

SEQ ID NO: 9320 - DNA, 201 bp, Bos taurus
ttggcaagccactggttagggctccacaccacggcacgaggcccagtttccatcactggttgagactaaggtcctccaggccgtgcagtgcagcaaaagaggcatacataaataagaggaacagaaaaggaaaatatctttatgcgtttgagctgaagaaggccttttctgacagtgctttttaaaaacaaaagcctttta

SEQ ID NO: 9321 - DNA, 201 bp, Bos taurus
tctctgaatgtttgtcatcgggatcatgtgaggccccctctcatccattttcttgagagtttctgggttggcagccagtgtgtttactgaacagtgcttcatggccattgatagactcagggtaaaaactacagcatcacctagatgtcgacagacatgctgtctgtgtaatgtatatatttacacatgtgtattagaata

SEQ ID NO: 9322 - DNA, 201 bp, Bos taurus
tacagcgaagcatcgccatgtttgtgatcttattaacatacactcgtaacaccaagctccggtgacatgagtatgccgttgttaatgagaaaagagtcaggattacgtctgcaaacagttgtgctacatgctcagtcgtgtgcatcccctgcctgtcactaaagctaacagccaccaccaaccaaatcaggaagctgcttt

SEQ ID NO: 9323 - DNA, 201 bp, Bos taurus
gttgacctctcactgtttgctaagaattgaactctttcagttcagcggattcttggactggattatggattatttcgcctatttcctccagcaactcctacggggtagaatccctttaccaaagaggctaaatctgattgatgtggttggtacttagggaggagctggcacaggagaatgtggaccagtccgaggagtgag

SEQ ID NO: 9324 - DNA, 201 bp, Bos taurus
ggagtgggtagctgattccttctccagggcatcttcctgacccagggctcaaaaccgagtgtcctgcattggcaggcgggttctctaccactgagccacatggggaagcctaacgtcatctgtgatactctcacaatgcagatgtggtttctgagaatggatggcagaggaccaggtgtccattacctacaatcaaaccac

SEQ ID NO: 9325 - DNA, 201 bp, Bos taurus
cccacggcagctgcagcgccgggcgttgtgaggatatctgatgtaaacacaaaagtttccattttatctagctctgaaaaaaaccggttgataagcgctccggatgcagtggatcttggaaaccatgacctcctgtgtagcttctccaggtgccaccctcgaaggtggacctcagaatcctgatgctatttgtttccaaga

SEQ ID NO: 9326 - DNA, 201 bp, Bos taurus
ctgacccatcccattatggaaagggtgttctggttaatcttccaggaggtaattacatctagggcctcagattcccctgcaatttcacccgattctcccaccccaaattacagggttaacacggcagccccctaggaggtagtttgtacattcccaggtcgattaataatattttcttatcatatttttggtttgataaat

SEQ ID NO: 9327 - DNA, 201 bp, Bos taurus
attaggtctggtacttcctacattgtcttatatcatttactaatattttctagactattgcccatctctttcattttcatcatactttttgggaaattccctcaactttagactataattcctctggtaatttttttcagcaattatagtcccagtttccaagagttctttttcacttgtctgacaatttattttacatcc

SEQ ID NO: 9328 - DNA, 201 bp, Bos taurus
gatttgtagttacttttcagtcactcggttataatgcaaacacttccaagtagatcacagactcaaaaatttgttcacggccaactgattgccttttaaataaagaagtcagcaaaagaacaaaactgcttttttctatgaagcaaaactcagtgtaggcgtgggtctccctttggccacctgccctttgatttagatttt

SEQ ID NO: 9329 - DNA, 201 bp, Bos taurus
agctcaggggcgctatctcaggagcacgcacggcccgaaaggaacagtcgagtctgttttctcccatgtcaactgtaagacttgttggtctcggcagccaaaggggagaagaaagtgccacggcccatcagctgcctcttctgaacgcagtcaggaaagcccagaacaaatgcacaaggtgacctaaatcgggggcaaggt

SEQ ID NO: 9330 - DNA, 201 bp, Bos taurus
cctatctaccttgtcaaggagctgacacacaaacttatttttttcaaaacctgccaggcagaagctcaacgtatttagggagtctaaaagcctaaatgacgatttccaaatgaatattaggagagttaatctgtttccccttatctaccgtataaatctttctcttcgtgcccaagggcttcagattttaatagaaaatat

SEQ ID NO: 9331 - DNA, 201 bp, Bos taurus
tttctcttctctcgctggtctcggaccctcaagtctagctgccctggctgctttctgatgtcgctgaacagattttcttttgcagaggggtgcagaggtaggtgagaagtattgctttaggtgttgcttttctaattcttttctgatttcagaggatacagaaggtttgctttgctggtctggtccctcgtagctggaaac

SEQ ID NO: 9332 - DNA, 201 bp, Bos taurus
aattcagatagagccagaagaagattcaaaagaccagtgaaaaattataacttggaaaagtcttgttttacacatttggccaaaaccaaacatgctgttcatcactgtaaaggatgcagctgctcctccgctgtgagcttgcacttcacagagccgtggtcttcctggcgcggtggccgctccacgctgaccctccctgga

SEQ ID NO: 9333 - DNA, 201 bp, Bos taurus
agcaggactcttcagtgtccagactgagtcacgagggcaggccccatcctctacttctggttcagatcattctttgtatcatcccttctagttcagatactaccctgtttatgctttctgagagacagcatggttttgaggaatgagtcctgagtcgtcagaaagtttaggttgaaaacaggtttgttactttcaaacaga

SEQ ID NO: 9334 - DNA, 201 bp, Bos taurus
tgctttcttcctatttcagtttcctgaaaagagttttcctttagttttggaagcactgcaaacgtgagcgttttaatagctggccttacagagggctcagtgcagttcagagctgtgtaaattagacagacttcagggtgtggtggatgctgggccacatgaggcgtgtgtgtgttggtgagtgtgtgcgtgtccatgtgc

SEQ ID NO: 9335 - DNA, 201 bp, Bos taurus
tagaactgctgagtcatctggtcattgtatttttagttttctgagaaattcccatactgttttccatatgggccacatcaatctatatattcccaccaacgatgtataggggttcccatttctccacgtcctcaccaacatttgttatctgtagactttttgataacagccattctgaccactgtgaggtgatacctcact

SEQ ID NO: 9336 - DNA, 201 bp, Bos taurus
taggaatccgcccatcatccaaacagcgattccagagaacaggctcctcaactggaacgggccgctctcctgagtcgtcgcttcctcggggacctggggatgcgagcgatcagcaccgagatctttcgccccagctcaggcctgccctcacttgcctcttgtggaggctgagaaagaggttttcccttagaccccagaggc

SEQ ID NO: 9337 - DNA, 201 bp, Bos taurus
ggggaatggtgtcacaaccatgtaacatcgaggtgtccagagaactaaaaggagaaattcaattactttctaacccttcctacgtttctactttacacaacgcttcatcattagaaaagttcactagttcttagttccctttcattatagactgtctcatcaaggactccaactcaaactacccacccggccaccagattc

SEQ ID NO: 9338 - DNA, 201 bp, Bos taurus
attaagatttaaaaacatgcacattgcaaatgatatggattttgaaccattgttttttccttccgaacacaaaatccaagtaagtgttagatgttaacgataccatggctgaaattctgagtttgaaaactgatttttaaaataaaatagtgagaccgaattgtgtttttccattagcaccaatctggggctcaaaataag

SEQ ID NO: 9339 - DNA, 201 bp, Bos taurus
ggatgtggcagggtcggcagtgggggcccagcgcccgcctcagcctccgagctcctgcagcctaggcctggcttcccgggggccgcggatgagcgtttccgccaccagatccatttggctctatttaggaactaagtacaggaaggtagttattgtacaagattagtttcctgtaggccataaattggcagtagcagaaaa

SEQ ID NO: 9340 - DNA, 201 bp, Bos taurus
ttttcatctttaagcccaggaagttttgtaaagttcctcatatcatataacgttcaggaaaattccaggaaaaggtgatatgaagatgtaataaggaaaaaaaaaaacagaaatgaacttcatcttggttacttgcaaggatcttctgataaaaatcccatttgcagttagaacaaagaaaggggatacatgggaagaaat

SEQ ID NO: 9341 - DNA, 201 bp, Bos taurus
acatgactgccttccccgtctttccacatgcagaggatgagaagagtcagagaggtgttaaacaggaaaaagggctcctgcgtccacggccttcacgttccgtgagatccagcctctttcctaagagcctcctgagcccactcagtcccttctcaccgtcgaggctggtttgggcaaacagaccctacgtggccccgcatc

SEQ ID NO: 9342 - DNA, 201 bp, Bos taurus
gcacacacagaaccccagaatccagcagcccgtatggcgaaggaacagacgtgcccatcgccacctggtttagggcttctgtctcagtgctaacttctccgccacttttctaaaaccctcccgtccgtgagttctcaccaccatctcaccatccctctccttcagcccgtctttcaaagactccttttttctcacgcttac

SEQ ID NO: 9343 - DNA, 201 bp, Bos taurus
gacccacgcgtgtgcacacggccctccgtgagcgctgccgctgccgcctgcgcctggactcatggtcacccggggcgccggcactgacggcaggccccacatcctcacgagcaacaccagcggttaacacggggtcacctgatcccagcccagggacgggagcactgcagggacgggagcactgtgtcaccgggccctggg

SEQ ID NO: 9344 - DNA, 201 bp, Bos taurus
tcctcggagcgggacgctcctccaggaaaggacttcctctccccaccggctgcggggactgggcggctggctgatggctcggcccccactgacggagcttttccagttttggaaagtggcgtgtgcctccttgcccaggcagacggtaatttatgctgcgaattcaggcctgggcgtgacgactcagtcctttcaggcccc

SEQ ID NO: 9345 - DNA, 201 bp, Bos taurus
ttcctttggctgctcctgactttggcctgggctgtgacccggagaggaagtgtgttgtaggtgtgcctggcggccttggcctcagtctaaggagaagagccctctctgagtgccaggagtgccccacgtcactaggagggtggggcagggtggttcagaaatggactcagccccaggagcagagtggcctggcctcctgga

SEQ ID NO: 9346 - DNA, 201 bp, Bos taurus
ctcaccgggacgcccatcggggaagccggaggaagaggaggtaggcggcgcctccggctggcccaggtggggcggggaaggcccgccctggcctcctgcccgctcctccttttcgtcattaagtttagaacgagtgcgggtctgctccccggcgctgccccggggcccctgcccctagccctcccgctgcgcccgtgaaga

SEQ ID NO: 9347 - DNA, 201 bp, Bos taurus
tgctgaagctctagtctcccggggcttgtgagcgtgagcgcgcctggaggaggtctggggggacagcgagtgcagacgcggccttggggcagccctaagctaacatgacccgtgtccataggaagagggagagtcggacagacacagacagaggcaacgagaagatgcgggcagaaggtggtcacctgtgagccgaggggt

SEQ ID NO: 9348 - DNA, 201 bp, Bos taurus
aagaggaagccaagacagatccaggagtgtgtcaaacagctaagaaccaggatgtaaaatctgttccaatccccacatcacatgtggcctgtctctctaggacacagagagcaaagcacggtgttcaccccagaacacccccacgccttgaggacatggccactaacctgggctccaccgagctctcctggggtccggtga

SEQ ID NO: 9349 - DNA, 201 bp, Bos taurus
atcctcagaccactgactggcccatgtaggacacgaacccaccatgccacctgcaaacgcaagctctgttcacgtttaataaggctacagacgctgcaacgttcgcagcatcctccagggccactcctcaaggtggactgctgcccgcacgtccacattagctcccggtatcctcgagaaaaacagccagagtcctccagc

SEQ ID NO: 9350 - DNA, 201 bp, Bos taurus
tctgttatcttgttttgtgagtatgttatgcttcttctcgaacgtttgaaaccttggcctcggtcttcacaggctgacacctgacatggctttactatacacagcaccaggactgagtcctaactttccttctcagcccagcttgggaagcaaaaatcctccacccaccctgttttccagcattgtttttgcctgtgttct

SEQ ID NO: 9351 - DNA, 201 bp, Bos taurus
gggctccccgaccctgggcacagtggcgcgggcacgcggctctgacgggagggcggggcacgtggcatagaggctgcgtggaagcccaacacgtcctgtgcgcctgggccagggtcgactcaccttagccggcttcccttcctggaagatgactctgttaatctccacacccccagccctgcctgcacccgcgcggcgggg

SEQ ID NO: 9352 - DNA, 201 bp, Bos taurus
tgaaaactaaagtgttaaggtagctttaaacaaatgtatacacttgaattaaggactttgataaaggatacttctaaaattaaaagaaactattgtatccgatgtaatatttatataacattttaaagctatcatttacaccatctattatgtggcagacactttaaatatacaaagtatcattattgatcttgctggaaa

SEQ ID NO: 9353 - DNA, 201 bp, Bos taurus
gtgccccagagtgtggcagcttatcctgccttacccacacgtggcccacacagtcatccccactgtgacggacttacgtgctgagggatgcggcagaggtcggggcagcgtcagggccatgagtgggcgagggacagtcacgagtgggtgaagatgggccacatgtgagtgaggacaggtgcgtgtgggtgagggacagtc

SEQ ID NO: 9354 - DNA, 201 bp, Bos taurus
cccagagggatgccggaccttgcgctagaggccccaccgcggggccctgaagcagtgggaccgtgtgccaggccaggcctcacacagagaggggcttggagcctttgcactgcacccaggaagacactgccaagtagacacagaccatgtgtcctccagccacctcccagcatcctcgtgctaaaatgatccagaaaactg

SEQ ID NO: 9355 - DNA, 201 bp, Bos taurus
ggtgacgacatccacagggccagtgctacagggcggtagtctcaccccacccgcaggctgccccagggctgggaggcccggccagccctgggcatgatcttgctcagctcccagaagcagcagaaaccccttctagcttctttggagtccctcttgcacttcctctaaacggttttaaactcctttaaaatcgccaggcag

SEQ ID NO: 9356 - DNA, 201 bp, Bos taurus
gccacagaaactacttcaggaaaccgacattcttatattcaccaaactgggggtcctaacccagttagcggtagcaaagccagttcggccggcaggagcggtttcgggacagacagacctaaattgttaccaatcacactgaatcgggtgcaggtgaaaaagatgtagaagcctctacccaggcggctcggcctgcccctc

SEQ ID NO: 9357 - DNA, 201 bp, Bos taurus
gtgtggggcactgaggtgcgctcctccaagtggcttcactgagaagataccccctggagggaaggacattcagttccttctgccaagtgcagaggccactctctggtctcttgccttccggaagcttgggtgccatggagactgtcatgtgacccagcaaacacagtcgtccagggctgcaccggacgggcgtccactctc

SEQ ID NO: 9358 - DNA, 201 bp, Bos taurus
ccatgtaatactgttgtaatgataacgcaactgatgtaatactgtacatcaactatacttcgattaacaataagaaaaagtggctggagtgacacacgaggtcaccacgtgcctctgtacagcaggcacttctccaggcgtcagccgcacagtggtgagcagagcagaccagcccaacttcagaggcctcagtgctcttct

SEQ ID NO: 9359 - DNA, 201 bp, Bos taurus
gtgcatataaaatttcgatgtgcaattcagagcaacttccccctgaaactacacaaagacattcattgcagacttgtctccactcaaaataataataatagtagaaatgacctaaatatttgaaaatagactagaaataagatgtgttatgtttttattagaaaaacttgaaagaaaaaaaaattttttggaagtcttgtt

SEQ ID NO: 9360 - DNA, 201 bp, Bos taurus
ctgcatctctgactggttttgttggcagatttagctgtcatattcattagtctataacttgttatcttcatcagtaattgtaccttttcttgtgcataattttcctttatcctgttagcactttcaatcttaaattctccttctttacattgttattacaaaatttatgttctttttagttttgattaccttggagctacc

SEQ ID NO: 9361 - DNA, 201 bp, Bos taurus
caatgtatgagcattctagttttttcacattctcaccagtacttggtataattacactttttatttccagcaattcttgcaagtgtgctgtgctatcctactatagctttaatttgcctttctctaatgactaataatgttgagcatctttccacatgtttatttcatgcaccttctatgtgtcttctgtgatgaggtgtc

SEQ ID NO: 9362 - DNA, 201 bp, Bos taurus
tatttgttattaaagtatggttgatttattatgttagtttcaggtgtacagcatattgattcagtatttttatagatcataccccaggatatgtaatttattttatagttattcattttcacatttcatcattttagtgagatatgattgtcatataacattgtattagcatttattactgctttatatcagcacgagttg

SEQ ID NO: 9363 - DNA, 201 bp, Bos taurus
aatcttgtgaatctcaaaaggccataaaaatctgaaaacttcaacagcttatgcaatctgtttggaattctagtttgaggctcaggcgggcttgtgaacactgagagatctgggcctgtcttgacaaacttgaatttgctgtatgctctgtgactatcagccttgttttgattatatagaccaagtgctctgggcatagat

SEQ ID NO: 9364 - DNA, 201 bp, Bos taurus
cagagaggattgctggttttctgagccctagcagagtaggctctcttgctgagatcaggtgagcagagacatgaattaagggaaggggaaggattccaggaagagggtgcaataagagcaaagaccctgaaataggaacaagcttggcatgtttgaggaaccaactctgtgcgcagtgtggctacagcgaagtacagcaaa

SEQ ID NO: 9365 - DNA, 201 bp, Bos taurus
cctcggacagtgctcgtgtgtcatatgtgcaaacacgtgacacgaaaaggcattaccgaccctgcgttcaaatagaaaaggaaggcacaccgacctgtttctgttccgtctcctctattttaagtaatgaggttcttgcctcggttgtgtggttgctcagtcgtgtttgaccctttctgaccccagcctgccaggctgtct

SEQ ID NO: 9366 - DNA, 201 bp, Bos taurus
cttcctctggaagtgtatatactaagattttaatagtaattctctctggatgaagagttaggcatgttcagaaaaatttcagttttcttccctctctgctcttgtcatttcctattttttcttccataaacatatactacttttatattaatagaaaactttttcaacaaggaaaaagaaatactatcctctaatatttac

SEQ ID NO: 9367 - DNA, 201 bp, Bos taurus
tgatccccagtacatatcgagttggccataaagtttgagttttttttgtaaggtgtctcaaaaaatgcaaatgaactttttggccagtccaatacatatcctcatcaataaagatgagaaaaatgagtggcagacagttaagtgacttgctcaatatcatactgttgataagtggcagggccttatagcccagataagtct

SEQ ID NO: 9368 - DNA, 201 bp, Bos taurus
cactggcctagagaatggcaggagacagaaaagctgaagatgaggagaggttagtactggacatggtatgattgaaatctaagtagagaagttaaggaaatggtgagatatatccatttggaattgagagaagtcttctggaggaaaaaaagatttgaaaatcatatataatataaagatggaagaatgcctgagcattaa

SEQ ID NO: 9369 - DNA, 201 bp, Bos taurus
taagaaatgtaagaaatgtgatgcaattcatgacattactggcaaaacagaacaaaaagcctacttttataatttcctcattctgcgctctagcaagttcgataagaaagttcagcaagttcaataagaaagttcagaaaatttatctgaagaaagaatacacttcaaacggaagaaagcaggaatattttattttaagaa

SEQ ID NO: 9370 - DNA, 201 bp, Bos taurus
aggtaaatggaaaacatcagacaccacactgagatttcacttatgcctgagtgggacagtgtaaaaacccaacctggggaggaactggccatggtcttgcgtctgatcctcccatggtttgtcccctgaccctgagggtgcagctgtctgtgaaggtgacttgaccatcatggcagtgtgaccctcagggccctgtgggta

SEQ ID NO: 9371 - DNA, 201 bp, Bos taurus
aacagcttctgcaccgcaagcatgtgtcctccagcataatctgaatactgagatgacatgaaggcaggagataggacttctcacaatcaaagctgtaagcgtgcagtgatccctgggcagaccctatggagggcacagagccttggaggaggagacaggtggccactgtcctatctactaggacattttgaggtttgaagg

SEQ ID NO: 9372 - DNA, 201 bp, Bos taurus
aggaggggacttctgccaatattttccctctctcctttgtttctcccccaaagagaaagctggttaatccagctgggcatatattaatctttactgggcctatttcactagtgggccaagttactgtgtccccaaagcctcatctgtattttctctctttaacaacctgtttaaatgcagacacagacggtcctctcactt

SEQ ID NO: 9373 - DNA, 201 bp, Bos taurus
ggcctatggtggcaaacagtgtagaaacccctgaatctcacaacagtaaccaaacatcagaaacttacttgggactccctgtctagtctgtgggcagtgtatttaggaggccacaccactgcatcctataagtgtgatttttaccaggaagtgagcagtagtttattacaggctcatttttaaagttggaaaagcaggaag

SEQ ID NO: 9374 - DNA, 201 bp, Bos taurus
ggattctaatggaaatctatagaatgcacattcatcttgtttacctaagatgaaaacctgcagtcaaacagaatgtgttttgggattcgcctacaactgcagttgccatgacagcatctagcttagcatcactccaacaacaggatgacttagtgtattactctaggtgctcatgacagcatcctgttctacaatgatctg

SEQ ID NO: 9375 - DNA, 201 bp, Bos taurus
gagttattccaactagtttcgagaaggggcagaaatttttatgaattgggccaccaatcacttttattttacttattttttaatggttggcctcagaactatcaagtgctagtgagtgtgtcattaagcatgctaatatattcagttcagttcagttcagtcattcagtcatgtccgactctttgcgaccccatgaattgc

SEQ ID NO: 9376 - DNA, 201 bp, Bos taurus
gccctcaaatttggactggctgtgtgatttgctttggcctacaaagcagaggtgacatctgagcctaggctgcaaaaaaccattcacgctcttaaacttttctcagcccatgagggtgggcctggactagtctgctggagaactgagtttcccaatcagttaccagatatgcacctcagactgtctgaaaggcacctgaag

SEQ ID NO: 9377 - DNA, 201 bp, Bos taurus
gttataaatagaaggcagaattgaaatatttcagcacaaacttgtcactagtacttgagcatgtggcatattgataatacattattgttttgtttcatgttacagggttactgaagaatatagtttgtagaaaatcacaactgctaacatttaatttagcaattaataatctgtaagatactattcaagacctttaaaatt

SEQ ID NO: 9378 - DNA, 201 bp, Bos taurus
tccttggaggcctgggaaagatgcttggacgtgatgtgatgggagtccatggtgttatctataggaggactgatggagaggagtcaaaggggctgatccagaaggagaggagccagaggggctggccacagtgatccagacagcaagaaagagagcctttcacagggaagactgtcttccttgtatccatggtaaaccagg

SEQ ID NO: 9379 - DNA, 201 bp, Bos taurus
gcaaggtacagtcataatttcatgttctgggaactttggtggccttccaactggtttcattagaaccagaatccctggcaaatatggctggggctacattgtctgggcacattagtcaggccctacagaagtgacacctgatggccagcagtggcctctgtgtctctcatattccctccaccttctatgacagaggtcaga

SEQ ID NO: 9380 - DNA, 201 bp, Bos taurus
tgcaggcagggggctgtgccaggcccatgctgcccctcaccaccctgttgcttgctgctcacaggctctgtacgtggcgcaggctggtctcctaggaatgatggcctgggggttccactgaaaaggagaaattttggaaaatcattgaggttagtgtttaaagaaatgaagtcagttcttacctttccaagggagtgactg

SEQ ID NO: 9381 - DNA, 201 bp, Bos taurus
aacctgggcacagtaggcttggtgggaggcaagtgcccctgagaaagggtgaaggcaaatgcagtaacccagcaagtaacgcaaggccagggaggagcacaggagggaccaggcagggctggaggctggaggaaacgcacgcgctcctgcccttgtgtgggtggcctcagctttgaggctcatagtggctccaggacccca

SEQ ID NO: 9382 - DNA, 201 bp, Bos taurus
ctgctatcccatttattttcatcggaagccctggccatctttacacagacagacccattcttctcattctctggggattggagcagagggagatacatgacgtgggaatggggccaattggattccaccctggctgagagtgtaagtaactcagagagtgaggtgttgtatacctggatctactcctggagctgtggtggc

SEQ ID NO: 9383 - DNA, 201 bp, Bos taurus
taaaacgagacttttagcagatgaatagcctggatctcagtacttactgtaaccactgactcttatgaatgaatatttcttagggtcttcaaagcagacattggtacaatgcttgggatgcaagatatttgttagggtttgggaaaaaggagaagtcaatctaaaactgtgataaagccttagccaaccaggcatgggctc

SEQ ID NO: 9384 - DNA, 201 bp, Bos taurus
gtaaattcctcccagtgggccttgacttgaactttccgggcctggaatatctccctcacagctccctgacactcctgttaccccaagggtgagaggaagcgacgtgagtgaaaaggggccccatttccctggggttagcatgggacacacctcatagtcacttgtcactttgaaattcccctctcccaggagtgcatagaa

SEQ ID NO: 9385 - DNA, 201 bp, Bos taurus
gaattcactgggttcttgaatggcccagtaatcatcttggcttccaacattcattttctttttatcactggaaaataattagattatattctaactttttcctaaaaaagtcaaagttgttcattaatattgagaaaatggggcatttctctgttttgagtggacagaaacgtgatcttttccagaactgatattaaagac

SEQ ID NO: 9386 - DNA, 201 bp, Bos taurus
ctttggcaggtttaagagcctgacaggtgagtggtcctggcttctgagggccaggctgtaagcgagcaactggcaggccagtgctgctgacaaggagccgtgttctgaagcaacataatgcaacctaattgttaataacaagtgtcattactgatgccggggttctggctcaacgttgagcccactgtccagccctcggcc

SEQ ID NO: 9387 - DNA, 201 bp, Bos taurus
aatccctatggacagaggagtctgatgagctacagtccacggggtcacaaggagttggacacgactgagagattaagcacagcattacttacccatcactgtacaacaaattacctgaaaacagtggcataaaacaacaaacatgtattatagtttcgctgagtcagaaatctgacttaatctgggtgcttttgactcaga

SEQ ID NO: 9388 - DNA, 201 bp, Bos taurus
atttatttacattctattgagttttaacatccttggtttttactagccagttagctctgtaggactagaacttgaaagagatcagttaagcaatctgggcgatagcattttcatctacttgtagcaataataaaatattacttacagaaattatgtatagaaagtttctatacattttaggaatagaaaatatgtagtaaa

SEQ ID NO: 9389 - DNA, 201 bp, Bos taurus
taatttaccactaactttgtgatcttggttatatcctagacttgtacctcaatttcctcatatataaaataggaaattacatcttctacatttatagaatgtggtgtgggctctgaaagacaattaaaataaactgattagtaataacttttaatggagaataatatgtaaaattactgaatcattattctgtacacctga

SEQ ID NO: 9390 - DNA, 201 bp, Bos taurus
tgcaccccacccagagtggtctcacctgaagggggaagactgagacctgcccacgtggacagggacttcagcctaattctgacctgctctgtgaatggccgagcctggtttccactgacagagagggtgctcgggaagacagtcagaggtgctcacagtgaggagcggtcagtgcccaggggaagaggagaccaggagaca

SEQ ID NO: 9391 - DNA, 201 bp, Bos taurus
cttggcccttcaaatacatggcacagttttctatgtgttttctctttctctctggctagaagcaaatgaccccatgatggcagagccacaccatgaagagtctgggcctctgagtcagtgcttacaggatgagggggccaggaggtcctcttgccggggcagtggcatgtgagttaggtcacctcctgggcttacgtcact

SEQ ID NO: 9392 - DNA, 201 bp, Bos taurus
ccaacacacatctcatgtctagctcaaattcaagacgtggggaagtagattcccaccatttatgggagaagcttcaaagtcacaatgagcaggggcacattaaggcatgattccttggggccatttttcatattctgccacatcacccatgaatgcccccacatagcaccctctgcttgtccccccacggatagatgcagg

SEQ ID NO: 9393 - DNA, 201 bp, Bos taurus
aaattttgaaatagtcacacatgggatgaataatacgaatgacctacaaccaaacccaaaatctgaatggagttcagaaacttaacactgagaaaagaaaaacagaaaagatatacagtgtatgattacatttatagaaaatctaaaaataggcaaaaaaaaccaatactgtcagaaacaagtaaggtgttaccctgggga

SEQ ID NO: 9394 - DNA, 201 bp, Bos taurus
tcccagcctccaggctcaggctgatctccactccaggcccagtggatcaggagatccactccctggtcctaggggaaactcctgtccagcctgtcctgtagctgttgctctctgttcatttcttcgtacctctgacccgaccccctagaatggcatacttacaataccacagaaatccatctgtgctcccaagttttggag

SEQ ID NO: 9395 - DNA, 201 bp, Bos taurus
tgtttcttggcccaaatcctcgttggcaattcaacatgattaaagtgtctggagagcatcttcaagtagagcacctctggtgtcccattgtcatctggtccttgaatagatgtatttctcttggccctcttactcaaacttttgatcgtttataaaacactgccggttgagaaggtagcctcttggcggagattttgagag

SEQ ID NO: 9396 - DNA, 201 bp, Bos taurus
gaggtcaccatgagttcagtctctccattttatagataaggaactgaagcccagggctgtgactttgcttagggtcacatgattacatggtgggagagccgggaccagaagccatcctcctcttcttcctcatcatcattattaccatcatcatcctcagtgttttttcccacaactagcactcagaaacacatgtgccat

SEQ ID NO: 9397 - DNA, 201 bp, Bos taurus
gtggtacaggagtgcttggaaattctctgatagtctaaggggcgtgttgatctctcctaggtttacatttcaaagcctggccacccagctgtgagttgctataatagaatagccacacttcccggaggctgctgggttgacaagagtgattcattacatcttcggggcacaggttaatgaggttgacttgccttagggccc

SEQ ID NO: 9398 - DNA, 201 bp, Bos taurus
gcctgtggccagctggagggtcagctagagactcactggtcttgattgatttcacttgggaaacataggtcttttccatatgtctctcaaatcttttcaacaggccagtgtggacatgttctcatgatgcttgcagaaaaccaagagtagaaagttgctacttgtgtcacatatcctttcatgcgtcaactgaaccagtcc

SEQ ID NO: 9399 - DNA, 201 bp, Bos taurus
tactcttgacttcaaggcccatgcagtgctttttacagcttattgggtaagtacatatttattaaatatatacattttaaggctggttctcatcagattacagtaatgaggccaaagggcaaggtattgctttaaattatcctttttttaagaaaatagatagcatgggaaaaatcagacattcggcaaagtcagagccaa

SEQ ID NO: 9400 - DNA, 201 bp, Bos taurus
atgaatatgaatacccaaacatgaagaatccaaaaatcattagagctagagagaaaaaacgtgcttccaagtacgatccctcttggaggccctcaggaatgattttcttggaacacagtgaatgatgattttatgtatacttccaaagaacgtaaaatctggcccattctccggaatgcataccaatagtagctacagtat

SEQ ID NO: 9401 - DNA, 201 bp, Bos taurus
tgcccacattctcatcttcctttgagacacagaaggttctgactcacctctctattttgatcttccactgatcctaaatatacatccgaacactaagtcacgcatacatatgtataaatgctaagtcatcacaattcctattatctactcaaagctttaagtcagaatcatgacactgccaaacactgagcagctacagca

SEQ ID NO: 9402 - DNA, 201 bp, Bos taurus
gttgactgacatgcggacaaacgtttgccccaactgttccctggtgcttctatcaagaggatggagggaacttatgcacaaatgtccccaggagcaaagttcaatgactacaattcataaggtaagaatgacagagagaaaagatccctgcagacagaatttctagggggatcagaggaggtggtagagataggaagtgat

SEQ ID NO: 9403 - DNA, 201 bp, Bos taurus
gtctgggcctattttcttcccaaaaggcagtctgttgctcctagcagtgcacaaaaccagtctgagccatggcccctccgccaggatgagcagcccaggctcctgcttatctcttgctctgcccttgggccaccagaatgatggccaccagtaatgtccatccagatgaactgctatgcttgcggacactttggagaacac

SEQ ID NO: 9404 - DNA, 201 bp, Bos taurus
tggggttcttagggcatgagccacccatctccttgtatgaacctgtagtcaattcttctcttttccaatctctaatgtcttagtattgattggcctcaccgtgcttggggcacatggacttgtgatttggtaacagctgtgcttagagagatttagcccaccaacaggcccaaagctcaatctagagattgagatctagag

SEQ ID NO: 9405 - DNA, 201 bp, Bos taurus
gatgttattcccttaagaggatccccatctccatcagctaattgctcttgaggatcttatccatgcaaacacataaacacccgtttaaactctcggccttttaaaattaaagagggctgtgggaatccatgttacaggtcttgaagtgagctcctattcccgcgtgcctcttccccttgactttatttattggcctgtgtt

SEQ ID NO: 9406 - DNA, 201 bp, Bos taurus
gtgtgaacattagcccagaagcctggcaccaaaggcggaagccagctctgctcttcatgctcagccctggctggaattaacagccctttgaaggagatgggggtcatggaatgaatgccaagatgtttaccctaagagcctcctgtccgacttcctcagaaaaaccactcttgtccttgaactccaggttcagggttttgt

SEQ ID NO: 9407 - DNA, 201 bp, Bos taurus
ttgaaaactcatgatggttaggactgcgttaaacattcctaaaagatggtttctttgatgtccactctcacgtcatttcgccagggcctcgtgcaccaccattgtccaccactgagtcctttgtttgtggatctgggtcaggaaatcagcgcttggggtggcccagaagacagggtgcttcgggaacgccacaggacactg

SEQ ID NO: 9408 - DNA, 201 bp, Bos taurus
acacttgggccagcaccatctcggacctcaggattttcacctgtggaataaaggtctggctcttaatctcaagggaggccacaggcctgcctcccaagtctctgaggggattcttcaaacaatatttttttccaccttcctcctattggttgaaagtcaaggccataaggactcgagtccctgaggggagcaggagacatc

SEQ ID NO: 9409 - DNA, 201 bp, Bos taurus
tgagaacaagagatattcctgagactctatttctgctcgcattactccttaggtgcaaacctccacttcctgcctggacttccacgtgtcttgtgttttggactgacccagtcagactgttctctggtctcattctgttgaaccattctcttcagttttatctctaaccaagcaatagcatttaccctgcttgttagagtt

SEQ ID NO: 9410 - DNA, 201 bp, Bos taurus
aattcctgatctatagaaattaagataataactttgttatttttaagtttgggctatttgtcacacagcaatagctaactaattcaggaactatggccacaaactacatgaagcagagtgaggtgcctaccaacagagtgggtggggtctaccacattttctcaacacccaacctaccaagctgaagggtaggcctaaatg

SEQ ID NO: 9411 - DNA, 201 bp, Bos taurus
ttgtgcactggtgggagggtgcctatgggatgcagcaatacttatttctgtgtgaaacaacctagtgtctgtttttaaggcgtatcagtgagaaatcaaagaagtgccagctgatgaagaatatttagtttcttttccaaatgaatctccttgggtcttataaacagcatttttatagactacatgtgttacctttacaac

SEQ ID NO: 9412 - DNA, 201 bp, Bos taurus
catagagatgggcggtgactacatggttaggttcatcgtggatgaaactacaccctagttcctgataaagataaaatatttgctggccaccttctccaggggttggcttcaagtgagacgtcagtgaaacagaagtaaactgcccgcggattattgaccagtttcttctaccgtgaaccttgtatcataccagcttcctca

SEQ ID NO: 9413 - DNA, 201 bp, Bos taurus
ctttcctgctcctccttccttcaggtttatacctaaaattcacctttgtcagtacggtcttccatagcctccctacataaaatagcaacagctggccattccgtatttctctcctttccctatttgtctttatctgttcagttcagttgcacagttgtgtccaactctttgtgacccatggactgtagcacgtcaggcctc

SEQ ID NO: 9414 - DNA, 201 bp, Bos taurus
cacctgaccgtagctcagaagctcagcataggtgggaatttgaaccgtgtccttgtccttttaggccacccagcattgagtgtgcacgtttgactctgcagcatattgagcagttgttctcattttatgcgggcagaatctgaatgtcatagttttcttatgaacatcgactactttttaatggtgcttgacattgaaagt

SEQ ID NO: 9415 - DNA, 201 bp, Bos taurus
cctctcagaggctcagttccggctctgctgtctcgggcatcctcttccccgtgagactggtccctctgcgttcacaggatggggccagcggtcttgtcctgtctgttctgaagaatctctgcctccgcgctcccagttactttgaggacaatgatccttctgtctttctgtcctaaactgactggcctactcagttctgaa

SEQ ID NO: 9416 - DNA, 201 bp, Bos taurus
gactcagtggaaagaatggagtctttattttttttcagaatattttgattccataatatgactgacacatatccatatgtcccaaagcagcatcttgggcattatagaagttttgcctaacaattttcttcagaaagctcagaacacttagccaaatccttaatagattactctttaatagattttctaaggaaaaaaaat

SEQ ID NO: 9417 - DNA, 201 bp, Bos taurus
ccatgcccccggcatccctatgcagtcggagtcctgggtcccctttccttctgttatccaaacagcttcctacctcagaagcccttctgacaaaagactacgtgaagaaatgtacacagcctagaatggatgggaagtatccctaatgggcagattaagtaacaaggctcctgtttctctagtctcctcttagatcatgag

SEQ ID NO: 9418 - DNA, 201 bp, Bos taurus
gaatctattaccataatcaagttaatagtattttaaatgaatgtttacttcttattactttgtgtcacaaaatacagttagatgtttgtctacatacaaacggtttaagagtatttactctacaaatggctctgcatgaatcttttgtaagaaagagtttaacttctttagcatgtccaatgagtcagaattcaatagtat

SEQ ID NO: 9419 - DNA, 201 bp, Bos taurus
gaataatatcagttcttttcggtagtaacagttccctggaacattgacctgacgttctatccactcttgtacctctggtctccccagggccatggattcagggggcatggtacgcagagggagggtctcaaagtcaggatggaatggaggagggggaggagggacaagacagtggctctcggctccctacctggggccccc

SEQ ID NO: 9420 - DNA, 201 bp, Bos taurus
gaggctttccttccaccacacgtggaggggcccacactggtttgcattcagttttgaagagctgtgcttctgttcatttttctgtgtgttgtggatgatgctgtgatgcggccttgactaccccacacccagagctccgtgagatccaaagaacagatgtgccaatgaaatgcttagagatcttctgctgtagattgtaaa

SEQ ID NO: 9421 - DNA, 201 bp, Bos taurus
atcaagtcacgtgttccaaaagtcctttgaactccaagcagaataattcccaaaccatcatagtaaaattgctgaaagccagggataaacagaacatccaaaagcagtcatcaaacaatcggaccgatagctgacttttcagaagacatgatggaaataaaaagacaatacaaaagagtcactgccacccaagaactctaa

SEQ ID NO: 9422 - DNA, 201 bp, Bos taurus
taaaattgacactggacacagtaattgggaaaaaaagagacaaatcttaatttgtgtgtttagagacctcatagaaagtgcctaagatatggccaaagcaggcagcttttatgttttttttaaacaaagaaacaacacatttgagaggaattgacaggacaaaaaatttaggtttgggtgcttaattagtagagaattaaa

SEQ ID NO: 9423 - DNA, 201 bp, Bos taurus
ccctattttgccccaaattaaaactgggcctggggtgaggcgctgacgcagagaggagggacagatgagcagcatagcaaacatatcaggtcaaaacacgcaactattctcttccacgccgagaacactgggcatagatgctgcatgtctttgaggagccaactcattacttctctctcattgaacaggtctgcagataca

SEQ ID NO: 9424 - DNA, 201 bp, Bos taurus
agcctacccagagtcgaaggcgccaccatcaagcacaacgaagctggtacctgaatcctgggacaggaaatgggttccaagcggggagatgaatccacccatgtaaacacgctacatactcccaaagattcaaacagccccacaacactcaacagatgggaacgtgcttcttaaattgaagacaaccctaaacacctgtgt

SEQ ID NO: 9425 - DNA, 201 bp, Bos taurus
tggccccatccctggactcacagtgggggctggggtttgcaaggttctaggatgttctttacctgcatccctaagagctggtctcatctggcctccttcccctgtgatccatctgactgtgtattagcacgagagacttcaggtcttcaagaaatgaaacaggccataggctttgctttgtctcccccaatcctgggctga

SEQ ID NO: 9426 - DNA, 201 bp, Bos taurus
tctccagagctgtccaggaatttggtctcacacggttcaaaagcaacgtgacctagactatgaagggttttgaatacaccttggccaagctgcaaggtgcagtccctccaaaaacccttgttgaaacagccaacgaaacccaggagaaggcaaaggagacggcactggcagctacagagaaggccaaggaccttgccggca

SEQ ID NO: 9427 - DNA, 201 bp, Bos taurus
tgggctcagggataatgtaggtggaggcccccagctggcagaaggagggctgtgggtgatggggggacagaggggatcttacaatcctgcctggggtcctgcaaggcccaggactcacctaaaagattattttttctgcattttatggaatgtttgcaagacagctggtggccaacacatgacttgggatgtcaattccaa

SEQ ID NO: 9428 - DNA, 201 bp, Bos taurus
gtgttcaatctgactgactaatgttttaagatagatgcttaggacaaggggcatgtgagtcaatatgtaagccagtctaagcaaacagtgcggcggtgtctctggcttattgcctgccttcccacggaacatagaagtggtgtgctgggcttccctggtggctcagtggtgaagaatctgcctgccactgtaggagacatg

SEQ ID NO: 9429 - DNA, 201 bp, Bos taurus
gacttagcattggaggaatcacaaatcctcaaactacttgagatattttgaggactagcggaaaaagaaaaagcaggtaaccctcagtctcctgaataaggagtggccaaaataattatgacctcatggctatctggccaccttagttttgtctattcttccagcagtttctgtagatcaaaatgatgagagaaaaaagga

SEQ ID NO: 9430 - DNA, 201 bp, Bos taurus
atgtctggcccacagttagtggatcaaatcactgacgtaggtcagaaatagctggggcttccctgttggctcagaggttaagaatccttcttgaaatgcaggagacatgagttcaatctgtggcctgggaggatccctggtgcagcggagcaactaaccccgtgtgctgcacctactgaagcctacgtgccctagagcctg

SEQ ID NO: 9431 - DNA, 201 bp, Bos taurus
actgagaatcccgattgccagaactaaacccaactaatcccacctgccttctggaagcacgttcctcctctctcgtttttttggtgcttctccggccacttcttcctgactttggggatgggctcctcgccctctgctcacctctagatgccacgatcctcagggttctctcttcttgttccctacactcctcccaggcag

SEQ ID NO: 9432 - DNA, 201 bp, Bos taurus
agatcagaattaggtcttgtgttagtggaccaggccccggccccggtgacgttggggatatcacagatttggtcactgggtcagctggcaagaggtcagccgtttcctaggctgtggcctcagtgcagttagcacaaatcttttcgatctagttccctaaagaaggcagagcgccaccccagtgcctggttttcagcaaag

SEQ ID NO: 9433 - DNA, 201 bp, Bos taurus
ctctgctgctcagactgacctaaagctgacaactctttcacctaatgtgtttgtggaaagatctttcaagtgctaattacagaatctatcatgatgcattgtacctacgctttaatctcagcttcagtccaataaaatacttgtagaattacatgactttatgtccttctctagtatacatatgtctgtggtagtatgtaa

SEQ ID NO: 9434 - DNA, 201 bp, Bos taurus
caactggttggtgtaggaaagtgcactggagtcaggaccagggatcaagtcttgccgagggtgtcacccaccctcaaagcatgctttcagataaaggccttgcctattagaattcttgtgaagccacacagcacttgaggatcacacggagaatgtcagattcccgacagcacagacactaggcatggagatttagtacat

SEQ ID NO: 9435 - DNA, 201 bp, Bos taurus
gcttttatcacattttaagcaaaagccatggataggttgtcattttgtgacacattattttcagcctaaaggaacagggtgtgaagagccctacaattagaatacaatacgcctgcaccatcgcaggaacttctgcattagttaagcttttcaaaagtcatctaaaagaactcctgagccccgtgcacccacacctcccac

SEQ ID NO: 9436 - DNA, 201 bp, Bos taurus
acttcttctttaagctgcaagttttggcctctgggcccaaagaggaacatttctgagattacctctaattctttttggccccaaatgaaaaatctatcacatggactttctctgccctgtgtgaatcaggttaaaaacgtttattgttcaaattatcttggaggttctgccccacattcattactgttgcggtaaacacag

SEQ ID NO: 9437 - DNA, 201 bp, Bos taurus
tttgtcactaattctccacatctctatcacattggtaatatcctccaaaaagccactaccgtgtcagtaattcccaggccccgtccttggtgtttccgccctgtaatttggaatgttcatgtgtcaagcttgagcgtcctaaataacagggtgggaacaccaaggacagggcctgggaattacactcgggcttccctcata

SEQ ID NO: 9438 - DNA, 201 bp, Bos taurus
atgcttagatagtcgggatggagccttcgtgaatggagttagtgctgttaaaatagatcccagacagctgccttgccccttccgccaactatgaaccacaaagagggccctcaccaggatgggaccaggctggggctttgaatttggacttaccagcctctagggctgtgagaagtaaattcctgctgtttataagccact

SEQ ID NO: 9439 - DNA, 201 bp, Bos taurus
cagcaatgaaatgcctctgctcaaaataacacactccattgccatgcacactttttaaacaaagctcatcccatagctacacctcatgtgaagttcaggacacaagagggaatgcaaaagtacaaacctacatataatagaccaggaagaagtaaagcaggggtgaatggttgtaatgttcgctctgctacacagttgtga

SEQ ID NO: 9440 - DNA, 201 bp, Bos taurus
aaaacttggtcaaccaaacatggcaatagattttatgcaagaatgcattatgaatggcttaggagtaaatgcaaggttccagaagccaaagggccagggagtcaccggacgacacagcccactggacctttgcccaattgagcctgactctccacttctccccctggccctgtgtttactgatcctgtatattctacatat

SEQ ID NO: 9441 - DNA, 201 bp, Bos taurus
cctggagggttccaggcaagggtgattcagaagctggccacatctagtgcccgcacaggctgtgcttccgagtgccccattagcgtggagccagcctgcttgggctttagcacacacttggccctgtctcctttttccttctttcccccctccctgctacattcttgcttcctaggtgcactttatgcatttttgccaagg

SEQ ID NO: 9442 - DNA, 201 bp, Bos taurus
tgcattttcttctccaggagatcgccccaacccagggatggaaccaatgcctcctgctttataggcagattctttacccgctgagccaccagggaggcccatgaaccaatacagtattgattaaatcaaaatgaatctaattacaatacaaagcttcaaccacatgaggccaaggacctcttctctggaagagagattgac

SEQ ID NO: 9443 - DNA, 201 bp, Bos taurus
gattatctcaagctttctctcacattttcaattcaagctttttctcacattttcaattctgtttaacacctgttttggccatctgctctcccagggtctggtaccagggcaactgtgagcaggagttactcagagaagtgaaccgggtggccattcccaaggccctccttagctcatgactaaaagctagagaaggaagag

SEQ ID NO: 9444 - DNA, 201 bp, Bos taurus
tgttactcaattagatgactcaacaataacccatggctgtaaagtctgagcaagcaagtctttgagatgctggagaggtcagacagggcctgagaagttacgtaaatcaagctagtgatctggaattattggctaaactctaattcattagaggagaataagcaatatctataaacatgtgaggtttccaaggataattca

SEQ ID NO: 9445 - DNA, 201 bp, Bos taurus
caggaccaaagaacgtttccccagctaagagaaatgccatcaaccttctcttcaggaacagtactcagctaaagagaacctccttgcaagaagaggtcacatcccctgtcccaactctaaagggccacctaaggttcagagttcccttgcacacttggttgaagccattgtgaaaacgcccaacttccccctctgcctatt

SEQ ID NO: 9446 - DNA, 201 bp, Bos taurus
tattcagttttcttcaccactaggcaaaccacatgactggtcctggtcctcaccaggtgggtgatggcaggggtctcagataatggccccacagaagccactgatgttatgtaacaacaaacaggacacttgaactttgagtgattcatcgggtcatcttatgataatctttgggccctgtacttatgggttggttggttt

SEQ ID NO: 9447 - DNA, 201 bp, Bos taurus
caccagggaaatcctgggaatacatttgcaagccaaactaatcctacatttaagttaggttcagcctataggaagccaggctgtattgactcatctactcggtcttgacccgtttttgctgttttcttctaaaagcttctggagtgttccttcctcccctcccctcctctatgctgtgtccctcgttcttgtacccatcac

SEQ ID NO: 9448 - DNA, 201 bp, Bos taurus
aaactgctacctgatttggaaaaaggatctttgtggatacagtaaaggatcctgatcatcctgatctacccggtgggcccgaaatccaatgacaaatgttcttacaagagcagagggagatttaagacactcaggaggaggtgatgtgatcagggaggcataggtcagaatgacaggccatgaggccacaagtcaaggaat

SEQ ID NO: 9449 - DNA, 201 bp, Bos taurus
aagttcttatccacatcacttaactaggctggcctaagcgtgacagaaggggttaggagcagccacagagggaattgaagaatgtggactcagtcgtcgtaggggtgtaggctgaggccccgcttacccctgcagctcagttgactgcagtgtcatcacaggagcgttggatttgaatttaggggacctgcattcaaatat

SEQ ID NO: 9450 - DNA, 201 bp, Bos taurus
ggccagtgccacctggtgttcaacaccgatattcccccttctacagtcagcaaaccacagcgcagcaggaacaataccttcccactgacccagaaagtcaggaggcctaagcggccgtggcattgcgtcctattttcccaaatgctctggtttggctgggattactttctcttcccctcgatgttagaatactccatcagg

SEQ ID NO: 9451 - DNA, 201 bp, Bos taurus
ctggattggaacccacagcgggaccgggtcccattttgagtggaaatcacacgcagccagttcgttaggtctgcggctttcctctgaggcctttgcaccatgtatgttacattgtcctgttcacgtcacagggtttctgcgtcatccattcccttcccggtggttgtcctgttgggatgggtcatctcagcctgtttgaat

SEQ ID NO: 9452 - DNA, 201 bp, Bos taurus
ataaaatagaagcaggcagcacacacatctgactcacagcacagccaaatatggtcaatttcgccccgttagaccactgttctaaccactgagaaaaaaattagattttcatttcatgaaatatttactttaaattgaaatgttgaatctacagtatagtcaagaaagaagaaattcttgattgtcagtgttttcctgtgc

SEQ ID NO: 9453 - DNA, 201 bp, Bos taurus
ggatctcctcctcagcagttacacagggccttcccagaggatagagtaggttagcaattaactaggcggctttggagacagaggagtgctaggtgccctggtcgtgggtgtggcaggtaggggcccaggagtgcctcacatctttagatctgtcctgcgcatgttgataaagatacatattaacttgatactgacattttt

SEQ ID NO: 9454 - DNA, 201 bp, Bos taurus
aaatgccttccattaggaaactgtcatcaaggcctgtggatgatcaaaacagtcccacatttctaccacttcttccaccaaaggatggtgtctatgtcccattctcttgaatgcattggccagtgacacagttccatcaatagatatggctgtgttgatgttgtctatgctcccaggctgggctttgaaagacctgaggtt

SEQ ID NO: 9455 - DNA, 201 bp, Bos taurus
ctatgcagtcacacaggggcccgtgctcagtaggacgctgtgcctggattaaggctgtgttcctgccatcgtgaaattcttaactttacctttgaactgaggttttagaaatgaagtctgggccttcacgtctccttggccccttggcgtcctgctagactgcaggaggggtcaagagagggattctgagagtcaggagga

SEQ ID NO: 9456 - DNA, 201 bp, Bos taurus
agcacccagggcccctccagctcctgcctctttagagcccaaggctgtgcttgtcccacccggggcactcatgctggcctcgctaccaggcaggggcagtgggggatggttaaacctggagaagcactaggaccctcctctcagcctggcctaagcagagctgtgggctcctaacctaccctccttaacccgccccggaga

SEQ ID NO: 9457 - DNA, 201 bp, Bos taurus
ttaaccacaacacatgtcaaatccagcgagtcctaaaaaaaacccacaagccccacctgaagtcaaccttaaaactggttttcaaacactggcaaacaaacttctaattataggtagaaggactaaaagtttttagaccaaaggtatagacttataaccttaaagcaaacgtcattttatcaagaaaaaaaaggatgtcat

SEQ ID NO: 9458 - DNA, 201 bp, Bos taurus
ttcctgcctgaagagcatctcgggatctctgtccctgtgcctttactttccgctgcaccagctcaggctgactatgatgtcattgaatatgtcccactctgtttagactccgtcagcggctaaagtccacacatctcattctgtcctttgaggtccacctccatctaaatccaactgccatttctgctcttggctcccacc

SEQ ID NO: 9459 - DNA, 201 bp, Bos taurus
cctcacagcctcaagtcacccaatgccccacctcctgacaccattgctccaggcaggaaggtttcttcatatgaatgtgaatccaaacacttgtttgaaacggagtgtattgttgagagcaggcaggaagaagcgtgcccagagtgaggggtatggggggcaccccgggaggtgggggtggctactggcaaacctgaccct

SEQ ID NO: 9460 - DNA, 201 bp, Bos taurus
gagaagggaagcgtcctaaagggcaggaggccatctgcgagggtctggcagttctccgcactgaggggtaaagtgcacggggcagtggtcacagtgccccgacgtgtgatggccagagaccacgtcctggaagatcaggccagactggggaactcaggcccatcctgagggcaacagcagccacagaagctggctgatgtg

SEQ ID NO: 9461 - DNA, 201 bp, Bos taurus
ccaggcaccactcagctaatgttgatttgcatgcttacttattttttacttttatttattccgatacaacctcaaactcaccaggaagttgtaaagacagtacaaaggccttctgaataccttttacccatctttgccaactgtttacatctggccccattttatttttttcaaatgtatttatgtgctttgtcaggtctt

SEQ ID NO: 9462 - DNA, 201 bp, Bos taurus
ataaatagtcataaatccactagtgtccacaaaagcctcttggccattcggaactgacgaagatgttgcccactcaagggatcttctcccagagctgtggaggagtttgctgggagagggctggccggggtgggttcacgggaggtgctggtccactctcttctgaagctgagaaaagacactgttctcaatgttttcatt

SEQ ID NO: 9463 - DNA, 201 bp, Bos taurus
gcacagaggtaatccacactctccccacccaggtcagtgtgagctctcaggtccagacactcaagtccaacaagcttactaataaatgtgccaaaaaggcgcgtaaaaagaaaacagcagtctttacagagaaatcaaggctgacaattcaatggcatgaagatgttaatttactattgcccttccctggtggctcagtgg

SEQ ID NO: 9464 - DNA, 201 bp, Bos taurus
tcagatacagagggtgtggtactgagtcatacacagtaaaaattaccatcagttatgatggtagacacaatctgcaggcctcatgacaggacagaaagattatcatttccatcaattagtaaaagatggaatgggatgccagggaaaaagaaagtaaggatggccaagctgatttttatttaaaacatatatgactgtcat

SEQ ID NO: 9465 - DNA, 201 bp, Bos taurus
aagatgattttaaagggagttgtggacactgtgatatttgagccattttgaattttttttttccccatgaagactggaaactaaaatgggatgttcttttaagaaggattaagcagatagcttcagattttttcattttgtcttcgcaagtttagtctttttggtgaagatcacagtggttatactatggagaacagttgg

SEQ ID NO: 9466 - DNA, 201 bp, Bos taurus
tgacgctcatgcaggcctagggttatttctgctacgaggaattcagggttttgccctgtcttctgtcatctcttccccacatggatggcccagagaaggaatatttctgtctaactttaagtggcagtgagctgggtgttgcactagggggtcacccgggccttccaggagctcccggtcaaagagagcagtgatgggcag

SEQ ID NO: 9467 - DNA, 201 bp, Bos taurus
gaccatccccaccaactgaaaaccacggccacactcgccatccagccccagccattctcaaaggctcagagacacccaatgtgacccaggagcaaagccactgactactcctgggccaccgtgggggctgtgcttgtctgggggtcttgtgctaggtctcctcccccattctcgaggccactgcagctccttcacacacac

SEQ ID NO: 9468 - DNA, 201 bp, Bos taurus
gtttgagtaagccccgggagttggtgatggacaaagaggcctggcgtgctgcagtgcatggggtcgcaaagagtcagacacccagttcagagcaactgaatggaactgatttcaacaaaataatgaatctgcctgtttgtctctcctcacatttgtgtttgtttctagaagattactggggagaaaaacttaatttatgag

SEQ ID NO: 9469 - DNA, 201 bp, Bos taurus
tctgagcactggcctggagtccctccacattcttctcacccatttggaatttgggtcaagttgcttaaaattcttctttaattccttcagttgtgaaaccaaagctttggatgccgaggccattaatgctcagattgtctcagtgtctagtgaggaggctcggctcggtggtttgcgggagttgggacattcgtgggaggc

SEQ ID NO: 9470 - DNA, 201 bp, Bos taurus
aatttctgcctggagtggttttgcaggtgatgagcagtggctgcgccagggcagggctgtgcttgttcctgcctttgggagctgaagttacttcccgagtcggcctgtgactcaggagatggtccctagggagcaagccttttcatgctcaaggagctacatcaagttctttcgtttgctctggaagtgcccattttctct

SEQ ID NO: 9471 - DNA, 201 bp, Bos taurus
atggaatggggatggagtgcttctggtaccagctggtgctgtggcctggactgggctaagccgggggtatttggctccatccagggaatcggcaggttgaagttctcctggtttctgtggccagggtggcttatgttctcttgtgtatgtttttttattggttgccgtctttgattagtagttgttccatgtactaaacag

SEQ ID NO: 9472 - DNA, 201 bp, Bos taurus
aattggatttttgaagcatgtcctccacctggtgacacgcttctctaactggtggctactgtccttattcagccttttagtccatcagcttataattgttaaaactggccaaaaagagaaaacaaaacacgttttttaaaaatgtctaactaaaactaaaactcccttaatgcagtaaggtcttgaaccatgtccattaaa

SEQ ID NO: 9473 - DNA, 201 bp, Bos taurus
cttccctggtcttagccaatccaggccagaggattcagaggctgtcttgatgcagcagttccctgcattaccaaattgtccccaagatgaaataaatcccatttggggccactcaattaacctaaactctcactctaatctagtgatgatttataaagtttttatctgggatactgtctaagtcatgtagttaagagttat

SEQ ID NO: 9474 - DNA, 201 bp, Bos taurus
tccaagatgctggatgtcatattcaggtggtggccttaactgtgtagcagtgtggagagatcaacaaaggtttgtgagaaaaagtctaacaccttctgatctgtgattttggccacacgttgaaggacagattagcgagggaagagactggagacaaggacaccaatcaggagcttcatctgcttgtccaggggtgataag

SEQ ID NO: 9475 - DNA, 201 bp, Bos taurus
gagaggcaggtggcctagtgtccgccattgtccatatccagccaactgccagctgtgtgaatgaggctagtggaatgagccagcacagacacgtgacagagcccagcagagaccaccagggccaggcaggaacggctcagcagaacactgagctaattaaggggtgacttgctgtttaagccactgtgtttggaggtggtt

SEQ ID NO: 9476 - DNA, 201 bp, Bos taurus
aaatgccctttagtcctcagaatggctgacccacctctctgatttgtgtctggaaggcaaaatggactaggatgtggccacttagtattcagaccatgtcgggatgcaagtaaaaagcctatagagcagcgctggacgcacggtcgccaggccaaacacagccagcctctcaaatcacagttaaattataagcgagtgtgg

SEQ ID NO: 9477 - DNA, 201 bp, Bos taurus
tttttaaattggggtttaattgctttacagtgttgttttagtttttactgtaggtccaagtgaatcagctgtaggtgtacatatatcctctccctgttggcgctcctccccgcccccacattactatttaacctttaaacattaccctttaaaaataaatatctctacagaataactggtctagctttttcaacaagttgg

SEQ ID NO: 9478 - DNA, 201 bp, Bos taurus
ttgagaagcatttcaggattaagcaaatgagtaattgtaccaatgctgtttcagaactctagctacctgagctgtcatgtcctacacgtggccaccacactgctcacatatctgttattagttactgtgtctgtgtgtaggactgtgttagttgctcagtcatgtctgactctttgcgaccccacgaactgtagcctgcca

SEQ ID NO: 9479 - DNA, 201 bp, Bos taurus
cactgaggtactcttgttacactatgggctatgaggacctaacatgtagccccactacggtcaactttgtggtggccactatgaataaaacaagtgctattttctctacttttatcaatgaatcttgagacagatcagaaactagcatatacacttatcctgattctcagctttcaaaaataaacaaaatagggctatacc

SEQ ID NO: 9480 - DNA, 201 bp, Bos taurus
tgacgttgcctataattgagtgaataacagttttttcataaccttgacagtaaacatatctgaattcaccatttgattttctaaaacttgctgaaaaaaggcaaccaatagtaaagaagcattgtaagaagaaatttagtacacatgcacacacacaaacacatatatacctgtattcacatacatatgttgtctatataa

SEQ ID NO: 9481 - DNA, 201 bp, Bos taurus
atgtgggatcttagtttccctgaccagggactgaacccacagcttctgcattggaaacttggcatcgtaaccactggatggccaggaaagtccagtaaatgcacttggaaatgtcaccctcctgcttcattaggtaaagaagcatttggaaagcaattacgattaagctattcattgttagaaaggcctatgaaatacaca

SEQ ID NO: 9482 - DNA, 201 bp, Bos taurus
ccattcaattaggcaatcttgaacgtgcagtccaagaagagcttagcacacaaagtggctgggaattctcagaacaccagttcttccccaccgatgtctacatggccttccattcctctcctgccacttctttcctcttagccatctgttttctaaaatgtgagactgatccagaacttaaaagcttttctatgagattct

SEQ ID NO: 9483 - DNA, 201 bp, Bos taurus
tttaaatttcctttatttctgtttactgcgttagagttttgacatttctgtatagcctttctaaccacccacgcaagttctgattcatcacccactccagcgctccccatactgctctgtttatgtcaggctcttctatcttctttagttcaacctgaagtcacattccatctttctaggaatatttaaactattaaatat

SEQ ID NO: 9484 - DNA, 201 bp, Bos taurus
ggtcagataccactgtttcatttacttttttaatatttatttatttggccactccatgtctgagttgcaatacacgggagcgtcaatcttcatcacggcatgtgggatctttcagtgtggcctgtggaatcttctagctgctacaggagaactcttagctgtagtatgtgagatctagttccccaaccagggatcgaacca

SEQ ID NO: 9485 - DNA, 201 bp, Bos taurus
tgtttctcctctataaaatgggaacaataacaaacccctacctcatagggtgactttgagaattaaataaattacttcatgtaaagtgattagcagagggactgacacatagtaaaggctcagcaaatgctggtgatttgtattcctcatttcttatttatatcttatttgcctgtcctgttatagtagtggatacattat

SEQ ID NO: 9486 - DNA, 201 bp, Bos taurus
tctcacaagagttggacatgacctagcaactaaacaacaataacaaactacagatttaattctccaataacttactagaaattgcaatagagaatttgaaacaatgagggccatgatatgctaatgaaagctttattcagaccatgaaatgagataaaagttttacacttttaggggtttaaattcaacataattttgtgg

SEQ ID NO: 9487 - DNA, 201 bp, Bos taurus
cagcagcagcagcaagcttttgacatgttttattttagtttaaataaaagctatgtaagctacttggcatagaggaaaacatttcatagtacctattcttacctctatttaaaatatatgttattataattattgttggcatgtttctttcacccactattcagggacctccttaaatacagaatatttgtcctgctcttt

SEQ ID NO: 9488 - DNA, 201 bp, Bos taurus
caatctgctaaagggtagttcaacaaatctaggggccaaataatgaagatctgttcactaaatggacaagatgcctccatcagttgaaggtcatcagagagagtcttcaggtttatggcctgggtgatggggcaccattgacagaacaggaatagtctagaaggtaagggtcagttatccagaccagcaggggaaggcata

SEQ ID NO: 9489 - DNA, 201 bp, Bos taurus
atgtcccccagtacctcccacaccatgacttctcctgtcactcagcatcatagtgacggagactgagcagccagtctctcgctgtctgttatccccaccctcgggagcccacattcttccatgccattctccacattcaggatcaaggcagaaaaccgagaggacaggaagataacgccttattactttggagagcctgag

SEQ ID NO: 9490 - DNA, 201 bp, Bos taurus
atgatccaatcgaattagcccccaaagtagccacaattcctataagagaactcagggagactcggatgcaccgtggcgacacacacattagcatcggccagaggagcttggctgcgggctgccctgcggctacacagacaaaggctttgtttgtcctgaggcttagttgtctctgggtgactcatcacaatacagaccagt

SEQ ID NO: 9491 - DNA, 201 bp, Bos taurus
actgggccgaagtgcccagaaacactctccatagacgcgggactccaggggtcagccagcagccgccctcacagtgcggccgagtgacaccatctgtccccggcatctgctcccactcagagcacacctgaggacaatggaaagaaggacacctgtctcagcctcagccggtgtcccgtggtctgcccctggagtggccag

SEQ ID NO: 9492 - DNA, 201 bp, Bos taurus
agagttgccgaagtaagagacggaggagaaaagaaagacgtcctagaggccgaggctccattttcagcagcgccatttcgcttttcctttcgccgcgttttgtttggttttgtttgcagcgggtggacgggcgccaacgcgtttctgcagcttcagcagctttgctccggcagacggggaggcacgcagggcccgcgctgc

SEQ ID NO: 9493 - DNA, 201 bp, Bos taurus
agtttggcctaaggccaaaaggatttatgccagcatgctgtagctcccaggactgttgtattcagtgcccttgactgttgtattcagtgcccttgactgcgcagcaggccactgttgacccacgcctccgctggagactcctggacactcacagtcaactctggctcagttgcttatggggtcattgttcctttctcgtgg

SEQ ID NO: 9494 - DNA, 201 bp, Bos taurus
tagaggcagagatggggagggacagacagacgatgaaccatcacggccatgtcaaataccgtggctttccttcacatgcattcttgttttaggatttgggattctgaggcgatcaccccattggccgtaactgtctttcttggcactggttattgtcagagtagaccaagcaagcccctggagctagaacctgaagagatc

SEQ ID NO: 9495 - DNA, 201 bp, Bos taurus
ctcaggggaatttggcaatggcatatatttaaaaaaagaccaaagagatattttctgtgttttttttttccctctaagattatgtctctctgcagattctataccctgaatagtattcattctactatttaaaaatcagtaaaaatttctgtgtcatgattctaaaaaactttttttacctttgttatcttttcctgtagg

SEQ ID NO: 9496 - DNA, 201 bp, Bos taurus
ggagtgaatctccagactccagtactatgaaaggaaactaggcaaaacccagaaaaatccttgagttgggaagatagagttgggagttcagggcctccacagtgggtggtgtgcatagggcaagatatcagagagaaaacagctgcttggagggacagagagcactggagacctgaagaaggtccctctcaggccttttgc

SEQ ID NO: 9497 - DNA, 201 bp, Bos taurus
aatagccttctgctccattcaatccccgagggctcaggaagcatgatggtgattaaacagagcctacgtggaagctaaggaaatgcttcttctgtcctttggtcggtaatgcgttcatacctgtctcctctgagagcagcacaagccccttcttgctgggaacacagacctcctagcgcctgttcccctggaggaaaagag

SEQ ID NO: 9498 - DNA, 201 bp, Bos taurus
gcttccaccaccttctattcctatccaggctcagttcctgacgctaggactgaggacttctcctccttataagcatcaatcagaaaatgctgggttgacaagcactactatctataaaatagatggctggtggaaagctgctgtatagcacagggagctcagctgggtgctttgtgatgacttagttgggtgtggtggagt

SEQ ID NO: 9499 - DNA, 201 bp, Bos taurus
ggccaggtggctttccctgggggagtgtaggggttcatcagaacacctggggaaaccgagagaaaaggctgccctgaaagtcaccaggactaacgtgtgtgttgactgcatcgcactagaggcccattaaccatcatgatgccccgcccccaccccagtaacagccccgcatggccccctgccccctgaacccagaggtgg

SEQ ID NO: 9500 - DNA, 201 bp, Bos taurus
tggcacagaacggacattcgataaatcattgctcaataagtgaacaaacttcttatttaaatcttacatcaagctttcgcttacaactagtttgaaaggggaaaaaaaaattcttttcaatttaactcacttaaaatgcaaacacttaattccaaacaagttggtaatcaggctaggtccttatgtagccaactcaacatt

SEQ ID NO: 9501 - DNA, 201 bp, Bos taurus
gacctggtggcctatagtccaaggggtccttttttcttttttttagaggacccaggcaggctacagtctacagtgtcacacagagtcagacgcaactcaagtgacttggcctgcacacatatgctaagtatacctgacaactctgggcttggagcttctcttgatggacgaagtctctttcttagccaggttgataacaat

SEQ ID NO: 9502 - DNA, 201 bp, Bos taurus
gtctaaaccacacggtaagtagcagcagcaatcctgcaaaagcccaggtcaacacactttcggttactgacttactggatcaacttatcccgtgattcttttgcagcccaaatatttctttaggattaattacaatgaagacgtcttgacaaggtcttggatctcaaactagaaagttttttgatgatgagaccaataaat

SEQ ID NO: 9503 - DNA, 201 bp, Bos taurus
taaaccaataaataaaatacaaaaagataaataggcagttcacaaaagaggaaacacatgtgggcactaaccataaaagatgctcagtatcactgtcatcgggataatgcaaattaaaatgataatgagaccatttcaaatccatcagactggcaaaaataagtctgataacatccagtgttgaagtgttgatgaaaacag

SEQ ID NO: 9504 - DNA, 201 bp, Bos taurus
agttcaggatttctacagatgatgaactgttctatctatccaagatataatgagtttactaagagttatcccattccataatttactagccagtcctccagtagtttgaacttgacacagtctaaaatgtattttgacagattcttttccctaaatatttaaaggcaagtgcatttcaaataaaatataatactttcaact

SEQ ID NO: 9505 - DNA, 201 bp, Bos taurus
cctttggggaaaatattatttagagcagtagctctcaaactatagccttcatcagaatttatttaaagggcttgttaaaatacagatttctgggccataacccccagtgtttctgacatagtagatctggaggggacccaagaatttgcatttttaacaagttttgggatgatgttaatgctactggtttgggaaccactg

SEQ ID NO: 9506 - DNA, 201 bp, Bos taurus
aaactgaactgaactgttaatctcataaatttctacatcagatctccatctaaaacaagaaccagttaacacccaaatgtgcacagacagaatctcaggcctctcctgtccctgtctattgccttcctattggcaaagtctcagctaatactaatcacttcagcacaaatatatgtacatatatacacaaataggcattat

SEQ ID NO: 9507 - DNA, 201 bp, Bos taurus
cccttcgtccatcccggctgggctccctctccttcaaaatcgctcgagtgctcgggcgctttcccatctcccggcggtgaggacccttcagtcctctcctctattcactccccgaagctttcagagctttgccacttctctaagctctaatcccaacacacacgcgcgcacacggacacgcacgtttcctgcccctgtgtg

SEQ ID NO: 9508 - DNA, 201 bp, Bos taurus
gtataactgaggaggaaaatagatttgacaacttgctaggaaatatgagtcaccaaatttccaatgtatggtcagctagtaagataggccgtatatgagacgttttgactccacagttagtcacaccaagaaataatggagagcactcatcaagacattttcaaatgaaaacagatgtcaacttttagaaggacaaactaa

SEQ ID NO: 9509 - DNA, 201 bp, Bos taurus
ctgcagtggcagcttttggccacggggcggcagtgtgtccatagccagctcccaggttgtccaggaaagaactgccttaaacagtatttttgacactcttgttaagatctcatctgggttctggtatttcacaggaggacctctgattaaatctcacttaaaagaggcataataaaagtcactaaaagtgtaatatttagc

SEQ ID NO: 9510 - DNA, 201 bp, Bos taurus
ggaccacaccccatgagcagagctggtcctggggttccatctataactccttgttcagtccacaggtggcttcactcaaggcaacacggaagctctcagcagtgatgcgatcatctgaaaagcttgaccagaatgtggagttcttgagaccatcagagctggaaggactcggcagacagtgtttttgcctactaatcattc

SEQ ID NO: 9511 - DNA, 201 bp, Bos taurus
aggttaaaattgaccttgactctttaactcacagagtagttgggagtatcaacaaggtcatctatgtaaacgcagttcataaactgaaagtgtacataagcgcaagatgtaataaaatttaaagaaagaaagaaaaagtcataagtcaagtcaaaaaacataagtcaagtcaaagtcaagaaaacataagtcaaagctgga

SEQ ID NO: 9512 - DNA, 201 bp, Bos taurus
attttccatatgtggatctaaccaggcagaaacttattttacagacaccctgacagatgagtatagttcccccaagcacaatgatgcccctgttcaagcactgtttgtgagctgtatttagcccttccactccagtcctcttccccagttcttcgctaatctaatatctcaaactgattatattcaagataaggctattct

SEQ ID NO: 9513 - DNA, 201 bp, Bos taurus
atttttctctcaaagatcttataggaaaacagataggatagcatccattttaagactaagatgagctacaaagagaggattccagtatccaaaataccaagatagcattactacaaattgagaaaacacaatctgttgttttgtgccagcctccatcctgctcaagcaagcgatattcatcgatggtagagaatgtgccct

SEQ ID NO: 9514 - DNA, 201 bp, Bos taurus
agtaatgataagggctgtgaattgtgatgcagaattactggcaattactccttttagctggactggtctggaaaggcctttagaaaatacagcctttgtatagaaacttgaattatgagcaaggaggaaaccacatgaagatcattaagagaataaccatataaagagaagtaaacattggaggccctaatgtaggaatgg

SEQ ID NO: 9515 - DNA, 201 bp, Bos taurus
agtgtagctttccagaatgtttagttactgcagtgatggccgtggttttcttcatcattgactgcctcttgatttaatctgagtttgaagtcaagaaatatattcgacataccaacagggcctacatttctgtgctctagttattagaaaccaaaaacaaaaatgctttttcttctcctgacttgagaatatggtgttttc

SEQ ID NO: 9516 - DNA, 201 bp, Bos taurus
aaaagggcaaaggcagaaatgagtgtggtgtgtaaataaggaaaactgactaagcttattttacagtgaaaagccaggaggtggagggaaccattagctgtgtgataacaacagcccaagtctgcatcttgaaacctagacagggtttcaggacaaaaagaaaagggccaacggatgtcataaagtttaaagggatgaata

SEQ ID NO: 9517 - DNA, 201 bp, Bos taurus
tcagaagttagccgagagggttttgcccacagactagctctctgtgaggctgggagaaaggagttgtgtccattaacattgtccccggcctgttgccctaatgttgatacagctgctctttctcttcacagaacgactgtgaatactgtcagtatcacatccaggcccagtacaagaggcttagcgccaggcgagctgact

SEQ ID NO: 9518 - DNA, 201 bp, Bos taurus
agctgttttctctgtgctgcattgtgttacacatgcacacacaagtacagccttcttaacaacaggcaccctctttacctgggccacctaagccgcctcacctaacaccaggtccatcctggaacctccccatactcactggacaggagtgcaacggcggagagacagatcagaaacagctgtctccaggccatctttgga

SEQ ID NO: 9519 - DNA, 201 bp, Bos taurus
ccaggaattgaacccagggccacagcagtgaaagtcctgaccaccatggaagtccccatgtggagaactttgcatgttatcccattaattgtccctcaaaagtattattattcccactttgagaaatttgaggttttcatggagtaactcagtgacagaaccaggatccaaaccagggtctgttgtctccaaaactctctt

SEQ ID NO: 9520 - DNA, 201 bp, Bos taurus
gtagcttttatttttaagattcttggcaggtgggaggtttcggggggccaaagtgaaacgatctcatccttgagctattcgagggccagtttttaatctgtttacacatctgctttgggaccaatgtgatggtcccagcacacagagcccatgctactttcagaggcccacactgctgtgtggggagaggatgtagcttca

SEQ ID NO: 9521 - DNA, 201 bp, Bos taurus
acacaacctctgcagaaatcaaaatgctttcagattaacacaggtaaccaatcctactacgggcacggaatactggccaaacagataacttaagaaaagaatacaggagggctactcaggaggaaaagagggtgtggtgttgggcagaatgaaacatcattagagaaaaccctggcgccctcacaaataggccaggaaggc

SEQ ID NO: 9522 - DNA, 201 bp, Bos taurus
tggactgccaggaactggtccctccttaactgttgtctcctctccgacctcaacttttgtccctacattcagaaccaggccgccttcctgcggtgaaggcatccttgctcatgaaataatcccagctgccagcccctggcagggttttctggcttgtagcagaaagcaggaaggcctccgtttcattttgacacagaatat

SEQ ID NO: 9523 - DNA, 201 bp, Bos taurus
cagctcctctgaaggcaaaggtgcggctcaccctggtcctgcccctacttgaaagctggctcccattgtctcggtgccatggggcctagctgctgtaactgggtcagagtgttagggagactcctgcctgggctggaggggcagttgttgctacaaaagggccttcaggtgcccagaactgggtgccactccccgtttact

SEQ ID NO: 9524 - DNA, 201 bp, Bos taurus
atctcgactcaggtcctctggccctgcctgcacagggagcaatggtaggctctctgattagcaatcttgatgtcccctttcatttgtgagagggagactgagtggtgcagagggcaaggccccaggatgggagtcagatctggctggacagatacagtaacttactagccatgctggggagagagtttacttaaacatctt

SEQ ID NO: 9525 - DNA, 201 bp, Bos taurus
ggggcctctctttcctggtgccatgagagtgccaggactgagacaagacagtgagcccctccttgctgggggctgtttcccaggactttgatggccaggtacctttggatcctttctgaggacagcttgcaattaagaactggtgatgccagcctctcattttgcagatgagaaaactgtagcctgagagggagcctggca

SEQ ID NO: 9526 - DNA, 201 bp, Bos taurus
aagggaagctttagattttcctgcccttggtgcttcgtggtcttgctgctgctgctaagtcacttcagtcgtgtccgactctgtgcatattgcctggcccagtaatcatggggaatggggaggtagcaaacagttgttgacacaggtaatgttcacgtccccgatcgtagcggcatatggcagtgattgtaatggcctaac

SEQ ID NO: 9527 - DNA, 201 bp, Bos taurus
gttacagtgtgtcggctggatggaattttgaaatttttgtggcctgttctagctcctttagagaataccaagcatcattttgaagcaaattttcatgatagtatggacagaatcacatgagtggccactgtcagtcttgtcagcactcagtagcacttgaggggtgcttccctgggagaccctgatgtagacagaccagag

SEQ ID NO: 9528 - DNA, 201 bp, Bos taurus
tttccaccagtgacagggacagaagcacagtaattgggagaaggttgtgcagagactcagacaaattgtgctctactctattccatattttatcgggaacgcttacaactggacgaactctggaacagactatgcctcgttactttcaacaggctgtgccagaaagcctgtatcgctgagtgattcatcaccatttatacc

SEQ ID NO: 9529 - DNA, 201 bp, Bos taurus
aaatgatacactgaaggtcccccttcgaaatttctaggaggagcatcccaaagtacttcttcctctaagaacaggagagagtccggttttcaagggcctcacactccagtgctcccacagccctcacaggcagacaaatctctgccatgtttaacacagacatgaaaatagagattagggccaaaagaaattacaaagtga

SEQ ID NO: 9530 - DNA, 201 bp, Bos taurus
acctgtacctttatcagagcacagaagtgccaaaattttgccacacctacagtgagacatttaggtggtttccagttgtccctgatggaacacaaggaggtgagagacttcttcgaccatttatatctgtcctatccaagtatttctgttggcaacattctcagaagcagaactgctggctaagcatctgcatattctgga

SEQ ID NO: 9531 - DNA, 201 bp, Bos taurus
ataggatataaaaaggcgtgtacctccagtctttgtaataggagcaaagattacaaaagcacatatcacgattattactgtgcacatatattcattcattcactttggaatggttttcgagcactgactatgtaacagatggtggtgcttaatgtagggaatacaaaggtgaaaagatattcctgcttgcacagaggattg

SEQ ID NO: 9532 - DNA, 201 bp, Bos taurus
actcctagaacacaaggttgttacaatatatgaagatcaattaacatatatgccacattaacagaatgaggataaaattcatatgctcatctctctggatacagaaaaagcatttgacaatgttaactacactttcatgataaaaactcttaacaaactaggcatagaaggaatgtagttcaattagtcatggtcacgtat

SEQ ID NO: 9533 - DNA, 201 bp, Bos taurus
aaaatgaggtcactagggtgggccctagtccaacgtgactgatgtccttgtaagaggaaatcaggacacagacacagagggaagagccaatgaagatacaagtagaagatggccatttataagccaaggggagaagccgggaacaaattctcccttcgtggctctcagaagaaatcacccctgcagacaccttcatctcag

SEQ ID NO: 9534 - DNA, 201 bp, Bos taurus
atgtatttttaagagttattccatttacctagagggtgtttcaatacgtttgtagtagttgtggtgagtatgagcctggaaaggtcatcaggccgacaaatagaactcctaaagcatgtggtcagtccgcttcttccccaatgcaagaaaacataaaaacaactgtaagggccaaagaaactcagcaagcagctggggaca

SEQ ID NO: 9535 - DNA, 201 bp, Bos taurus
aagttacgtgttaactaggactggattctaaagtctccagatctgtctcggtctccaggatgaaaccaacacttaccaagaatgaaacttaacacccttgcggcctagctaggtaagaaatcaggtttggaatgcaatatattttccaagactgaattttataattacattcattataaatacaaaaagaagataagaata

SEQ ID NO: 9536 - DNA, 201 bp, Bos taurus
aggaggagcatgggcttgttaccaataggagcacgcaggctactgctccaaactttacagaagcatcaacagcactgtcaggcgctttccttagcaggccatccacttacgaaagtatgagttgaaaacatgaacaattctaaagaggtctaaataaatacaagtaagaaaggctaaccctcacactggtcagaatggcca

SEQ ID NO: 9537 - DNA, 201 bp, Bos taurus
tgtgctttttatcaaataaggcacccagcagattggtaaacatgcagtactctgcacacccatgaattctattttggtatgtgctcaaagtggtagaattgtagtgaatgtgtagagattacacaaaaatgccagtctggaattcagttctttcttatagcttatctttcagctgatgctaaaatatggctgtgatgttca

SEQ ID NO: 9538 - DNA, 201 bp, Bos taurus
ccaggctagaacactggggtgggaaaacgcacataaaatttgccatttaaacaattctcaagaattcaagtcagtggcattaagtacgttcatactgttgttcactcatactgttgtgccattctccatctccagaacactctcccctcccagagcctccacatccattaaacactaacgcccattcctctggtcccctga

SEQ ID NO: 9539 - DNA, 201 bp, Bos taurus
ataatcagccacagagggattcttactattacctgcatgtccccagaacctggacacttgtacagtttttgcttatgagttttcatcagcattgcatcctctgtgataagctgtagaaatcacactcactcctcaaacgtcatcttttctgaatacagtttctgatcttacccaaatagatgtgaccatgtctccatataa

SEQ ID NO: 9540 - DNA, 201 bp, Bos taurus
gagatcacaccaaggagcaaaggcctctgtactcattagcaaattgactgaattgagcagtcgccccagtttgtaggcacagatcactgtggctgcacaacgatgaatacttatgggggcctactctgggtttacccttaccggtattctactgctgacaccactattgtcagttcagttcagttcagtcgctcagttgtg

SEQ ID NO: 9541 - DNA, 201 bp, Bos taurus
accagcaaagtcccgattgctcttctgtccacagccaaccagtgtttttccatcccccgcagccacaggccaggatcctgaccacagtctacagggcctgtgtacgcaggctcctctcctctgtttctgctgtctcacttcatgccactctgcccttgcctactctgctcagccatcaaggcctccttgctgtctcttgaa

SEQ ID NO: 9542 - DNA, 201 bp, Bos taurus
tctcccagtgatgtgagcacttagcatcaggatgccccctagatccaaggacactcactggacatggatggctgctgacccctaggagttggccaccctgcaggagttctttgggtttggcaatccaaggtggtgatcatttgagagcttaatgcttttttattttgatagatagtttttgttttcagaacttttctgaat

SEQ ID NO: 9543 - DNA, 201 bp, Bos taurus
caggatcttaagacttccctggtctccctcagtgggaaagcccagagcccaaggcagcaggggtggatgtgggttgggtgggacagtcaactggccctacggggatatattacagaggaaaacatagctaagaaggcagttgctttacttagaaggcagttgctttacttgaagaaagagaggacagaagttatcgagaag

SEQ ID NO: 9544 - DNA, 201 bp, Bos taurus
ttaatgatgaagcaaatcagaccaccacttaagtaccttaaagataattgagtaatcattgatacgtctcacctgttagccatgtgtttgattttggatgactctgggcctgggaatgaatggcacaccctgcaaattttcctgctctggggaaaactatcatctccctgatccttccaggtcaggatcacagggagagcc

SEQ ID NO: 9545 - DNA, 201 bp, Bos taurus
taattaaattaagatgaggtcatactccatttgttggggttgagggggcctcatcctgcatgatcgacatccttacaggaagagaaaactgagatgcagatgcatccacaggagatggccttgtggagacagaggcagaaatgtacaagctgaggtaagtcaaggaccacgggccactccagaagctaagaacctttggag

SEQ ID NO: 9546 - DNA, 201 bp, Bos taurus
cccagcgcatttaacaatctctttctgtttttactagtgggcttctagtttgctttgtgtgggatggggtcacaggtcacagccagtcttttatcacttataacaataaagatggtcttctttcttaaactttaaatgcaggaagcttagattgttttctagtctgaaaacaaaatctttttaaaaatcttccctgtttcc

SEQ ID NO: 9547 - DNA, 201 bp, Bos taurus
gggacctgagtgaccagcccacttggcaacctcagtggaggctgcctgtggcagtggcagcccggggaccttggcacatgctcaagtgcagagcagggacgaggggcacctggggtgagggccagccattggaaggccctccagtcctcttaggtctcaccacacatttgtctttactcagggccaaagttggggggctcc

SEQ ID NO: 9548 - DNA, 201 bp, Bos taurus
agggagtgtgtccccctgtacactgtgggatctccccccaccccaaagtgctatgggagcagtagctgtaggcatggccaccgagctgagctgggactgtgctctgaccacgcttcaactctctgtgctgggtgagcaggtggatgtctctgctgaggggccgtgattttgccccttgaggctgggggtttggggactgat

SEQ ID NO: 9549 - DNA, 201 bp, Bos taurus
acttaataaatgtgttgacaagctgagtagcactttcttctctgggcaactcacagaaatggaaactcacagttgagaatgtggctgtgctctcagttaagtcgcttggcctgaacgttgggaaactacccaagaaatgccaatagaagtaaattgcctgctctgaaaatggaagcgttcagtttataatgttatgaaaga

SEQ ID NO: 9550 - DNA, 201 bp, Bos taurus
tagccagcagggaggtggcctgggggcccagaggggcccactgcagctttccccctccccggagccaccatgccaggccccctctctccagcttctcctgagtccctggggatgcacagtgatgttggggagccaggatgggttggtggctggctccaggcctgacacctgcatccatgtgtctgggttttaaaaggtctc

SEQ ID NO: 9551 - DNA, 201 bp, Bos taurus
ctggcccaagtactaacatgctattctagattctaaatccagatgatctggaccaaatgattctaaagcttacaaggagatacaagagcacagtctctggagtcagactgcttggtcctaatcacagcttcctctcttatcggttgtgttgccttgggcacattactcaatcttctcatgcctcagtttcctcatctctaa

SEQ ID NO: 9552 - DNA, 201 bp, Bos taurus
gtgtctttatggatttcaggagtttctttagtcacccttctttcagacccccaggaacactggttcaaagtgtctcctctggcctctgtctcccctcccccctccagaggggctgagagataaagtcatgacaggatgtaactggtgctcatggcaggtgtgtgccagcctggggtgttggcttcttgtggagtacggccc

SEQ ID NO: 9553 - DNA, 201 bp, Bos taurus
gtaggtcagagctgacctgtggaaagactccacccaacaaccagaaaaaagtctgtcccacatggacttgagatgtcatcattggcaaatgatgctctgtgttctttgtgattcctgatttaaaaaccagaatggctattcgtgaagtgcaggtgttcataggagaaggaaccctgaaggtggggatggaggaggcaaggg

SEQ ID NO: 9554 - DNA, 201 bp, Bos taurus
ggagaagacgggggatgtgacaggggcaggctgagcgctgctggagtgcctggtggggaaggcctttgggaggaggtgcataagagaggcctgaatgaccgtgaccaagaggcagagcgttctaggctgagtgacgtcaggagactaagatctccactcgtgcccgggtggtccgggtgggatcaacccagggaggatgca

SEQ ID NO: 9555 - DNA, 201 bp, Bos taurus
aactttgtgaaggggacttttagctgacgtgggaagggatggagtagaaaatggaagcaacgggccaataaagagttggccctcttcacccacgggctccacatcagggaattcaacctattgcagatccgcatatgtaggatctcatggatttcatgtatgtagagcaaaaaatatatgtgggcctgtaaatgttagctt

SEQ ID NO: 9556 - DNA, 201 bp, Bos taurus
ttcgcctgttgagcttctgacacttgctggcagtccttggcgttccttggcttgtggttgcttcagtccagtttctgcctctgacgcgtggccttcttccctgcttgagtgtgtatatctgtatgttctctccttctcttataaggaagaggagatggattgagggcccaccctaccctaatatgacctcattgtcactga

SEQ ID NO: 9557 - DNA, 201 bp, Bos taurus
taaagatgagtatattggtaatatcgattaacttctcatttggcctaaaattgtattttttccttctggtttcgaaaaaaattaagacatttttatgggtccctgaatgtactatgggccccgggtactgtccccactgaatacgttggctgtctgtcaattggtcatcacagctcacatgagttaccacgcgtccccaag

SEQ ID NO: 9558 - DNA, 201 bp, Bos taurus
ggccggagattctcaagagtagctgtgggctgactcagcccggctcctgggccacagtgaagttttgtctagtggaccgggtattcccctgtcccaggccggctttggctgactcatacagcaaatcagagtttcacatctaactgttctgggcattgtttatcaaggttggaacccaaaggcctggctgaaatgaggaga

SEQ ID NO: 9559 - DNA, 201 bp, Bos taurus
gatagataataatactacttcaacaagctaagtgtcataatagacacacacagggcgttccaggagttcagaggtctatgtgtgtgtttggggccagttgtgaataagaaaaggtctgaagaaggagatactggattaggttgtaggttacaaataggagtaagtcatgagatgcatgtgtgatgtcaatgggttgctgaa

SEQ ID NO: 9560 - DNA, 201 bp, Bos taurus
tcattctaaattaaatataccaaagatattaataatagttgttttcattttgctgtataatctctgctttcaacaaattacttttatctggtttttgttgttggtgatggtctcattttctcatgccagtgacagcctatgaagtctagtcattggcagatttctagttagctgcacttatttaagagaaggatgctaaaa

SEQ ID NO: 9561 - DNA, 201 bp, Bos taurus
taaatgtccaaatcagcttagtaaaaaatttcagctggaaaaatccacaaaaccatgcttccattagcagtgaagacatagcctacctttttctcagaataagaaaggatgaaaaagagcttagtgaatgccctctgtggacttcaaaaaaatgcacagtgtgagagttgtgactgagttttacttgggggaaaatgagga

SEQ ID NO: 9562 - DNA, 201 bp, Bos taurus
gtaggtatcctacatgttcaggaagagaaagattaaatggaatttagtgaacaagtaaagattaaacggaatttagtgaacaagtatcactgtcttttctgcagagattgaatttcattgtaacataggaaaagcctataagaataagttttcaattactccatgcattaaaatattaataatggttctctatgtcccagg

SEQ ID NO: 9563 - DNA, 201 bp, Bos taurus
gacactgggtgacagctgactgaagaggaggagccgctcgcatcaaaagtcaagaaagaaggatgtccgcaaggggagagtatggaggcaagtgcaggacgggaaaacacagcagctctagaggcctgtggggttgtcaggcaggaaccaaaggtccccgaggatgggggacggggtcccagagaatcttctggatgtaga

SEQ ID NO: 9564 - DNA, 201 bp, Bos taurus
gggtggagggggggcggtgtggctataaatgtatttgaaggaaagaggaacgaattaggaacttgtaataaatattcttgggcctgggtcaatggtcatcagtgctgtctaagcctcaagacacctgctttaaactacagatgtatagagctcactggggacttgttaaattgcttgagtaagggcccaggtgtctgcaac

SEQ ID NO: 9565 - DNA, 201 bp, Bos taurus
caaagctactgagcgtgtccacggaaggactgcaatgatctcggggacggtggagccactggggtggaaaggagtttggtgcttgacgaactgcatgagacggggaggccagccgctctccctctcttgtttctcatgagaccctctctggaacaggacatgagcaagacgtaagatgggccagaaaggaaagacattaca

SEQ ID NO: 9566 - DNA, 201 bp, Bos taurus
ggattatcaatgtgtggattatcaatgtgtagatttcttttcttcaatatctttgtctggtttgagtatcagattaatactggccttatagaatgagttggaagattctaactcccattcagttttctggaagaatgcttagaattggtgtcctgtgttaactgttgtgtagaattcaccagtgacgccatctgggcctgg

SEQ ID NO: 9567 - DNA, 201 bp, Bos taurus
caccatggccttgctgacacctgtgcgctggatctcgcaccacacacctcagggaggtcccagatcagaggcaggtgtggccacttttgctatttctcctggggctgccccagtgctgcggctcccaggctccatgataactgctgtcagagaaccgggaagtcactagactggaggccagttcatttatactctgtctta

SEQ ID NO: 9568 - DNA, 201 bp, Bos taurus
actcggagcagtcacttcctgagtttttggccttttttgactgtgaagaaccataatttcagccctgccggccacttgggaaccaggccacgctggggcctgtgttccaaatcaccaagtaggctggtaaccatttgtcttctgcctccaggcttaatccttcaggtcaggggggccagtttgctgtggttttactgccag

SEQ ID NO: 9569 - DNA, 201 bp, Bos taurus
aaatagaaataataaatcgtattttacgagcttgctgtgagaagtaaataaacacagaacatggcacttggtaagcatatcaaatacccagcattctgacatccaatttattttaaaagcttccatgtgacagactttagagaggaaaaaaatatccattttttgccaggctgaaagatgttctctgcaggggtcagagca

SEQ ID NO: 9570 - DNA, 201 bp, Bos taurus
agcataaaaacagtcagcctggctactgcatcctctgggagagaaaactctcttcccactagtctccagaaggagaatttggggcagcctgccatttgccacactgcatgctttcctgtgaaatgagaccaccagggaagaaactagctctggaactaataataagacccagttagcatttaatttacacacatgctgatt

SEQ ID NO: 9571 - DNA, 201 bp, Bos taurus
gtaaaatataaggaagtgagagaaaggaagagttgacagtctctagataagaaaaccttgtgttaaaatcaaacagatggactatcagtgataagggatggagtaagatagggtgtttttgtttttgttttttttaatcttagcagaaatgaacctctgagcagtaaagaactcaggaaatgagagtagctctgctccctt

SEQ ID NO: 9572 - DNA, 201 bp, Bos taurus
aggctttgagaggtgtttgtgtaagtccctcacttactacaggaggaaactgaggcccaggatgaaggtgaatggccagaggccacacaccaggttaaagaagagctagtcctggactcgggtcccaatcctgtgaaccccacaattcacaccacatgaccaaggcgcacatccggccaaatctggctccacttggggaag

SEQ ID NO: 9573 - DNA, 201 bp, Bos taurus
tagctcaccagttcccccccaaccccccagaactgatgtgttggtttgatttgattcccaagaactgatccaccccttctggctacatttctccctttccgtgggagtagcctggagttcctcatctctaagttggcaacacagagcaggagggcccttccttgaaggtgggaaagcctggaaaacccaggttctttctct

SEQ ID NO: 9574 - DNA, 201 bp, Bos taurus
ctgggagaaggaacaaagccatgatgtgcctaccaatggacatcacagggagctgtgacatgatggggagtgataccaagcgggtggtatctggcggcctgagtgggtgggtctccatcagctggcagcaccccacaactcccagcagctgaagatggcgacactggataaggtttactggagggccctgccttaccagtc

SEQ ID NO: 9575 - DNA, 201 bp, Bos taurus
ccagagagaggacagaagtgtccctgggggaacacctgggtgtttctcttttatctcaatctaaaccccccaaacacactcacacattgcatgatgatgggaaggtcaatcataaactgtgaaacacacataaaaaaatggtaaggtagaaattgctgataatctaaatatgccacttctttgttgaacaggagttctctt

SEQ ID NO: 9576 - DNA, 201 bp, Bos taurus
acacagccaccctccattgagggctcccaggagtcatgcttgcccagtcaaatcacagccgactgtgacccaaggactgtggcctaggtaaaggccatctggggatctggggtatccagatgacccatggagctgccttgtgtcattcaccaacattcacctccattgctttaggtaacatgaactttatatgagtgaagg

SEQ ID NO: 9577 - DNA, 201 bp, Bos taurus
tgccttcatgacccagctccacggggccctctcacccaccctggcccctcatcccatttttctgcaccctgtcccctcggccctgacccctcctccctcctggcaaactccaggtcctgctctgtctctggggaaccatcccagaatttccaacaccatgatcccaacacagtcaccacacctaaggccactcagcagtca

SEQ ID NO: 9578 - DNA, 201 bp, Bos taurus
catggagccaccttctccacctccccatctcctcactgcttctggatcatgggcctcctgcctccctccccagcctgagcaacctccctgccctctctccatccacaccccccgtcccaactcatgagtttaggttttctttatagactgcaagagagatgccctcaaaaacccttgattttcaacccaaacctccctgaa

SEQ ID NO: 9579 - DNA, 201 bp, Bos taurus
aaccagttcatgaaactccgtgttctggaaatggccgcggtcagtgaatttgtacaatttggcttccagcctgtcggccacttcttgttgttccttccaaggaaggaaagggtcatcggtggagccaaactgcacaatgtgagggcagttggctttgatcttctcccactgccagggccgactgaagtagcctgtgagaaa

SEQ ID NO: 9580 - DNA, 201 bp, Bos taurus
gtgcccaagaccacctccaaggagcccgggccggaagctctggactcaggtattggtgggtagggttgctgtgccccacggggtctgtccatggtgctgctaccccttgcaggccagcggctccctctgacctttgagcccaggccctcacagaggccagacggtctttctcagaagctctggtgtctctttggctgcagt

SEQ ID NO: 9581 - DNA, 201 bp, Bos taurus
tgcaggtcagaagtgggggcagggctgactgggttcctcgcttccatctcacaggcctgaagtgagggtgttggccagactgggctcttatctgggggcccgggaaagggtcagttcaattcctcatggtggtagcaccgaggtccccatagcctcactggttgtcagccaggccagctctctcagctcctggaagccagc

SEQ ID NO: 9582 - DNA, 201 bp, Bos taurus
tggaatcgttcctgctaactgatccccaagtagacaactcagaccaagccagcagagggacctagaaaacagcagatgtgcctcaaaaaagtcaggcaatatataattatgaatttttaagatcaaaagtgattctaaataactagaagtaatattgtccccctgtgtagcacagttgattaaggacatttttctcggaca

SEQ ID NO: 9583 - DNA, 201 bp, Bos taurus
gttggtctcatgtaggcagaacgatgcccctggcatcctgcctgcatcacttatcctcacatctttcgtacaacttccagcacctgtgtctaattatctaaggccatttactgggcaccagagtccatcttgggagaaggcaatggcaccccactccagtactcttgcctggaaaatcccatggatggaggagcctggtag

SEQ ID NO: 9584 - DNA, 201 bp, Bos taurus
catcgctttgaaatggcgacttttctggatcctccagggctggtcagacgcgtcctgcatggggaacagagttgccttgttctgttccagtgatgcttgcgtttctcctctgctcccacggtgactcctccctgacctgccatgtttacagaaaagaggcaaaagggaaaatgggtcttcagggctgatcagccctgccag

SEQ ID NO: 9585 - DNA, 201 bp, Bos taurus
ccaaccccacagcctaagtggcttgatcacttaggtcttcaatgtctgcattcctcccctgccccacttccccatgtcagagttccctttccctcccagcaaatgagctgccttgaatctttgtctcagattctccttctggggagtccaaattcagattgaatgactggtggctcagacagtaaagaatctgcctgtaat

SEQ ID NO: 9586 - DNA, 201 bp, Bos taurus
ctgagcacagggattgagtaagtagactttggatggatgttatcaggaaccaggagcctgcaggttcccaggtttaccctggttctttccctgccttgccgttggcccgtccctgtgcgtcaactcagggtgaagagtcgggcgtgagctttaatctagttccttcccactttgatgtgttgcagcgtggcaagatggggt

SEQ ID NO: 9587 - DNA, 201 bp, Bos taurus
aaatgcaaaagtcccgtcttccttggggcaagaggaagttggctgtggctctgtcttctccgctggggaaacttcccacagacagggaacagatgggcctagatttagataccatctgcttttcagttgtaattaacatcggatccaggggttggttggattttaccattgtgttggccttccccgttgaccgctggggag

SEQ ID NO: 9588 - DNA, 201 bp, Bos taurus
tctccccaagaggctgggaactgaagacaggcaaggctgaagatctcacaccactagttgccaaacctaaaattaggaactgtaggcctgccatcccctgctggagttggggtagccggcgggggggaagctcaaggaatagaaggaataatccatggaaaaaccaggaggagccaagtgcaggcagcggccctgcccagg

SEQ ID NO: 9589 - DNA, 201 bp, Bos taurus
gaatacagtcccctgtgctttacagtaggacttcattatttatccatcctgtgtataatagtttgcatctgctaatcccaatctcccaaaaggccctttttctgaactaacctaacaactccttctcttgtcaataggcaagacatagacctctctcaaaagagtcaaggcctcaagaaatctattttgggtctcatatcc

SEQ ID NO: 9590 - DNA, 201 bp, Bos taurus
cagaaccacagttcatggagtaaaatcagaccacctgggatatttgattgtgcagaaccacacagaagtgctgtgggtctttgctactcaaagtgtgggtcggccttcagtgggcagctttgactagaatgagagacttggggaaccctgtaaaatggcactgtccgctggaactttccacaggaatgtgactgtcctcca

SEQ ID NO: 9591 - DNA, 201 bp, Bos taurus
aaagaagacatggccagggcctgggcctgtcagtgtctaggcaaagagggttaggaggtgtctttacagggtttagaggtccatgcccaggctctttaagttgtgctttttcaggccgagaattggctgggtttcagcaaagtttgtggtcacttagtacataatacagttcagggtgggtggattcagcatgtcaagagt

SEQ ID NO: 9592 - DNA, 201 bp, Bos taurus
aacctttgttttccaaacagctgctggtccatctcctaagaactaccttccttccctttgaagccctcttttgtctttagctgaaggtgatatttaaaggttttggccattttggttcttttggctcccccctatgtgtacatgttattacactttgtttgactttctgctgttaacctgtttcatcctaatttaatttat

SEQ ID NO: 9593 - DNA, 201 bp, Bos taurus
gtctctgctttttaatatgctatctaggtttgtcatagctttccttcaaaggagcaagcatcttttaatttcatggttgcagtcaatgcctttgattttggagcccaagtgaaatgaaaactaatttcaaaattcagatgaaattgagaaggacctagcacagccaaagcaactatgggaagggaacaagctgtaggacta

SEQ ID NO: 9594 - DNA, 201 bp, Bos taurus
atacatcaggcgtgaagagcaaggacgcaccctcttccgtccatgacgagaacatgggaaggaagtgcaagtaggagtcacccggccagactgtcaaccacgtcagaacacccaggagtaccccaaaagcttcaaagcgcgactccgtctaaagggggtttcattacagagacgtcactatgtgagttttggagaattcca

SEQ ID NO: 9595 - DNA, 201 bp, Bos taurus
ttttccccactctctgactaccagaattcccagctctagagaactgtctgcaatgcataatcataaacatgttagatactatttaggtgaagacaacttctgtgtaaacatcaaactaacttgacttcaaatttcctgaaagatgtgtccatgtctcaatgtcagggatgcttcatttaaaaagttttccttttataaatc

SEQ ID NO: 9596 - DNA, 201 bp, Bos taurus
attgaaattcccttctgctcttcccatgactggactcactgggggatggaatggaaaggacattgccattgaagctttcctccccagagtggacaggccacgacgtccccagagctgcccaggtactagtgtctgcttactctgtgctggagagctcatcaaattgaaaggcgggggatccacctctgcctagtctgactc

SEQ ID NO: 9597 - DNA, 201 bp, Bos taurus
cacagggaggacttgttgagcctgcagagttggcatcctggttcgcctgtgagctcttggctgcttctccgcaagcgtaggcttcgtggccactgttggcgggagacttggcttcttggaggctagagcactggctagagtcaaagcctttgaaaggtctaacgacacgggacaggagagccaaggagaaccctcagtggc

SEQ ID NO: 9598 - DNA, 201 bp, Bos taurus
ttagcatgcacacacaggtactatttatttcatagatgttgaaatttactcatgcacacacatgcacacagcaagctgtattctctaaatggccacttcgctattacctgtcctacatgctcttctagaaccttgccactccctcatcaggaagtcggatctaatccactggcccttccgttttttaaaaaagattttttt

SEQ ID NO: 9599 - DNA, 201 bp, Bos taurus
acacgagtggtcttgtggatgaaagaataaaagtaacttcctcctctcgaaccttggggagtcgtttgaaattggagattgccctcgccctcacagtgtcgtggcggcctttagtcagacaacagattgactataatctgcgaaggagaacctagcttggctctcctcaccaccaccaccaaccaccccacgccccaggtt

SEQ ID NO: 9600 - DNA, 201 bp, Bos taurus
tgccccccaccccggccccggcctttgtgctgcggctcctcctccctccctccagactttgtgcgcctttaagtggcccccaggaagggaccacccagggtgctgcacaatgggggctgaagtagcccctgaaacataggtttcttgagacaggccgtgaaaagaaaagtactgtttaactatgtacatgtttgtcctttc

SEQ ID NO: 9601 - DNA, 201 bp, Bos taurus
ccctggccctttcagagtcctcacaaatacgcccatctttccacttagtcagctctgaacattctaggtcctctggtcaaccagctctgcttggatgtgctggtctccccatcctgggattcttgagtaccttctttctgggtgccgtcacgcacacccaggaggggactgtgtcctgggtcccctcttgtttgggtttgg

SEQ ID NO: 9602 - DNA, 201 bp, Bos taurus
ggttggagctccagtggcccaaagccccttcctgcgtttctgatccttgataagtagaatgatgggcagtcagaaggagcagcgagtgggatggagtctacagatggagatgctgaggccggccctgggctggtcccaccaggcaggtggcagaggtggagcccagggccttcgctcctgacacctcaactggtggaagga

SEQ ID NO: 9603 - DNA, 201 bp, Bos taurus
gttttcaaaccactgtccgcttccatgagttgaggatcactgggagggggacagtgaacaggggacaggcaggacagggaggggccagtccagtgatgaacgggtgactactgggggcacctggggctcagtcccatggtggaccctttgggagactgtgtaggacatacctcagatttttcctaactgaggggccaaggt

SEQ ID NO: 9604 - DNA, 201 bp, Bos taurus
gcctgccttggctccgggttttagaagacctgccgtagcctcctccagctgcactcctcccctcaggtggggggtctgagggccaaaatcccctgtccattctgctcagagcccatgactgatttttagacctactctgggtccagggtctggcaattccctgcccagtggcctttctttgtggtcaggtatcctatggct

SEQ ID NO: 9605 - DNA, 201 bp, Bos taurus
gaggtgttgattccctccgtaataaatggatcggccgtcagctggtgctaagcaatcagtgatctcacgaggctcactgctgcaataaacaggaacaaaacgagatggagcggcaggctggccagggggcaagggaggggcatgaaattctgcccagagtaagcaggactgctcggaatccatcttaacaaactcaaacat

SEQ ID NO: 9606 - DNA, 201 bp, Bos taurus
cgttaaagaggctgagtcacttgcccagaaactggtttgtcaaacccaggtctcagtagctctaagacccatgctcttcaccatcaggctccaggaaaccggctgactgcaccgtgtggaccaccttccatgtccttccccagccccacccaggcagatgccttctggtctgaatgcaaggctcagccctctggaaagcca

SEQ ID NO: 9607 - DNA, 201 bp, Bos taurus
gcattccatccactccctcctagggtcccaaccccacaaagcagagcaaacctctggtgcctggataggtgacattgtggacagtgtttatctttctaggaggcctccagctgatgttgtaaccagggcagagttgaagcgacagaaagtcctcttgatggaggcttgggttgagcatccacccgatgtcactcttcagag

SEQ ID NO: 9608 - DNA, 201 bp, Bos taurus
tcttcctctccttcatcctctttacccctaaatactttcctgtgtgtcccctaaaaacaagaagtttctcacgcaaaatttcaaaaattatcagaattagcaaattaagacctctacagtcatccccctgccccttatctgtggtttcactttttgtggctgcagttatccaagatcaaccgcagtctaaaaatattacat

SEQ ID NO: 9609 - DNA, 201 bp, Bos taurus
aggaagcaggctagggaagtcagactggaaagttgaggctttaagaagtcttgagaggatggtggggaaagtaacagaggccatgaacaggggagctgctgggtgatgctctaaggtcccagaagaggaagcagcccagagaaagcagggagaatgggccccagccttcctctcatcaattccaactattgtaatcaattc

SEQ ID NO: 9610 - DNA, 201 bp, Bos taurus
tctctgagtctgcttcatggacactcaggatgggcaggggaatcagacagatccgtggggcaagtattgagtatttgttccataaaacagctgctgctacgtatgctgctgtcagcaatgacacttctatttataccgatatccaagtctcactggccagaagattttatgaaggtccatggccctcaaaacttcaagctc

SEQ ID NO: 9611 - DNA, 201 bp, Bos taurus
aagcagggtaacaccctgccagtcctggaaccggctgcgtggggctgcagttcccaattttctctttgaagtcagtcctcaggggccacctgagaccatccggatcgctttagcctcctggagaagccttgcgggcagcacttagagccagtcacgtggtgaaggcttcctggccacaagtccagcagcccaaggagcaca

SEQ ID NO: 9612 - DNA, 201 bp, Bos taurus
caactgccccacgtaaaagttgtgatgcccgcactgccagctcagctctgtcccctgggggtgaagccttcttgtaggtcctgacctaggacacgaagcatgacctcctcatctcatcacagttcccatcttcttctgtatgtaagaggcgattagtcctctgcctctctctgctctgtccatcagctatgggaggatcgg

SEQ ID NO: 9613 - DNA, 201 bp, Bos taurus
ttgctgctggaccaatttagacaaacacctgctcacctgaatttctaaactttaatgaagcttctcctccttccctgccaggcccctggactttggaccaacccagcctgagcccattggaatgtgggcacccttcgccagcactccccttcaaggcacccggccaagaagtgggctgtcaggatacctccctgccttgcc

SEQ ID NO: 9614 - DNA, 201 bp, Bos taurus
ttaggagggcaggaaacccacacagctacctaagtgaacagcagtcccatgtggacagcccttctcgtgtccaggtggccaccaccagcaactgcaatcatgtagagctccacggtttctagaatgtttagcaaggacttctcaggtggtccagtggttaagacaggcttgatccctggccgaggaactaagatcttccat

SEQ ID NO: 9615 - DNA, 201 bp, Bos taurus
tgtctcagatgccggatcactgggcctctgggagaagccaagcagagagtggacagggtcctcagggctcagagttgctaggggagcaagaaccccccacggcaggaggtctgttttctaaggccagatctaagcagtcttgggctccccgggtggcgctagtggtaaagaacccacctgccaatgcagtagatgtaggaa

SEQ ID NO: 9616 - DNA, 201 bp, Bos taurus
agcagctcagtgtctgcagggcagccccaaggatctgagacgggggtgtggggatgcaggggaaccccatcagaagagcccttggaccagggtcactgggtagcccccagagctgactgcatggccttgggccctctcccgtgggcgccggcggaatgaccagggagcagagccacctctggagccacgtcaacctcgact

SEQ ID NO: 9617 - DNA, 201 bp, Bos taurus
ttcaactaaaaccgtcctgtactccttgccgtttcctaccacaggtagctgctatgtttacaacgaacaagtattgaaggaaacacagaagaaagcaacatggactccccttcactttgttacctttgctcttcaaactaaacgaaagagcacaagaaaacaaatcagcatctgtaaggcattcaccggagacccctgaag

SEQ ID NO: 9618 - DNA, 201 bp, Bos taurus
gtgaagtggtttatttgagaggccatccaggaagcacctggtggtcagaggggatttagagggggcagggaagtggccagtgcaggggagtcactgagcatgttgactgttgagggcatctggactccgtgtcccttgagcctcaaggagatggtgcaacacctgtgcaggattgggccgcctgcaggaggggagctgagt

SEQ ID NO: 9619 - DNA, 201 bp, Bos taurus
cactaataataaatcaactataattcaataaaaaatgtatagaaaaaattttcaccctaagattccttgtaatagctgtaattagaaaattttcaattctcaggcattgactaaatatgagaatgagttttgagttttaggaagacaccagctctgagactgtctgtgccaggggcaggaaggggacaggctggcaggatc

SEQ ID NO: 9620 - DNA, 201 bp, Bos taurus
ttctgaccaaggaacaccaaggctatcccagagggagaaccatctgccagcttgtttctcacgcatcccagaggacagagagtggtgtgctttcccttgcggtggggcttatccctgctccagaggctgcaaaagccctggtgggtctgggtgaggggaactctagaatgagtggaaaaaatatttcaactcactcaggac

SEQ ID NO: 9621 - DNA, 201 bp, Bos taurus
gtcccgggcctgcatcacctccggggtgttctattcacgcctgaaatctcttccccaaggtttagggctgtgtctgtctctcaccttctaatcaaactagaggttttctgtctgcagggccggtggattaggaccagaataatcacccacaaattggccagacagcccagacgagataactcaggtcagagtaatttaaac

SEQ ID NO: 9622 - DNA, 201 bp, Bos taurus
tcctactcagatgagcactctaagctccgagcagggtgccaccagctgcttcaggctgacagatggacagatgagacagaagtcgcatcccaaatgtggcattgtttgatgccgtgtcatgattctaattctgagtccattttaaagcatgacctttcaaaaatgttcacttgtcttaattatttcctggagagtctctct

SEQ ID NO: 9623 - DNA, 201 bp, Bos taurus
cagcagcacgctttgtgccgagaatctagattttgccattcccctcgatttccttgagaaaagtccccagcagccctggcagtcttgccaactgcctttgtgaacaataacccaccatccctgcccagggaacagccggtgcacagagcacacacccatctgtacatggccgggcagcagatacaacaaccacaatcatta

SEQ ID NO: 9624 - DNA, 201 bp, Bos taurus
ctaagatggtggtcctgccaagattgtgcttctctgctgctcaggaggtaagctctgtcccgggccggtgagggcagggctggtgtgtcactggaaggcagtgagccttgggaagcagccttgcttgtgcacggtgttgttgctctgattcacagagcatcacagcctctcaggatgaatcatctcccgggcacagacagg

SEQ ID NO: 9625 - DNA, 201 bp, Bos taurus
ctctggtctctacagtctgctggccaaaaataccaaggggtgacatgccctgagaagtccaggaccaaagacagcaggagttggagtataaacaccaccccaggtgttcggtgggataactcaggcctcccagaagcccccagctgagtctgcaccagttatcactaattgtgcatggtcagtcgcttcagttgtgtccga

SEQ ID NO: 9626 - DNA, 201 bp, Bos taurus
caagtccatacaaacatcacaatggtttgatatatctcttaggtgtaggattcctccatctttctctttgaattaattttactttgctgaacgaactcatttgtcttaacttcttgcagattgaactcaggctgactttcttggcaagactgcttaggtggtgggtgggcgccttgtctggaggtatggtggtctttatta

SEQ ID NO: 9627 - DNA, 201 bp, Bos taurus
atcctgtgagctgccatatagatcctagaacaccaggtggagaagttaaccacatgatgaccagaatatatccatgacataagctgccacacttctgaataatggcctcaagaaatgcaaacaaatgggtcctggaactgaagactaatgtacataaaacagtcaagatgacacgggtcagaccactgatgaccaatttga

SEQ ID NO: 9628 - DNA, 201 bp, Bos taurus
cggacaccattttcctggcaaactccaagtagtggagaatattgcacataaggatttctgcaatgagtctgctttgagggaggcagcggggtgctgcaccgccaccctttacagatcaagatggccctgctcaagtcatgggagaggtgagtgtgaataaaaacatacagaaatatccttccagtcttttggctcttccct

SEQ ID NO: 9629 - DNA, 201 bp, Bos taurus
tgcattatgtgattattttatgccatttggactgttttaacaaaatgccacaaatttggtgttttagaaacaatgaaaatttgcttctcacatttctgaagctggaggtctgaggtcagggtgcattcttggtcaggtgagggccctcctccaggcttcttcttgtattttaatgtagttaaggtgggaaggagagttctc

SEQ ID NO: 9630 - DNA, 201 bp, Bos taurus
gtatactataaatagtcacaactgactctgattcttttgttttcctacatttttttatggagctgtaaaaaaaacctagcacacctagagatgttactgcttacattaaaagggtataaaatgtctttatggaatcccaggaaatcctgaaactaaaattatactattgtattcattcattgactcaacaaatgtttattg

SEQ ID NO: 9631 - DNA, 201 bp, Bos taurus
aaggagggaccactcgttttatcaatgcaaatttgactctaaattactagcagtttaacctgatgaaagtaaggctcagaaacacctggaattaagacgacgactctccacgttgtcatctgcagaataactatttgtcctaccaaggaattcatgcacttcagctttatgagaggatttaattattttcagctgtggaaa

SEQ ID NO: 9632 - DNA, 201 bp, Bos taurus
caagcactgggactcagtgtgtcgggaacagcgatgcaccacggggagacaatggtgagaacatgggaagccgcctccagcgtgacttcaaggccaggctttgtgattcagagattgccttactttaactttgcagaaagctctagtgacaagtgtgtccttgcccttgattatgatgtgatggagggaagaagtggccag

SEQ ID NO: 9633 - DNA, 201 bp, Bos taurus
cactgcattttctcttgaggtgttttatgttgggtggtgatgtgcccccggcctgggcccactggctttgctccctggcctcgcctccgccggtgctgaactggggactgcgaccccgccgtgatgtcactgttcaggcagccacagcgcatggccctgtcatcaggagcagaacaatgatgccattttcctcttatgcta

SEQ ID NO: 9634 - DNA, 201 bp, Bos taurus
aaggggagacagtgagccccgcttggccgtggggaagggctgccctggccggagctcagcccacaccccctgcttccaggacaggacagggacgaagaccacagtgtggaggctaggtaggccaatgggaaaggccgcacagccgatcctcagtccagtcaactaacagggcacgcggcagtggaccgaggagaacaccaa

SEQ ID NO: 9635 - DNA, 201 bp, Bos taurus
ctcctgtctcagaagacaaatggcatggacagaaacgcagactgagcaacacagcatgctcattttcaaaaggcaaagtttaaaaccttcagaagcttttagatccggcctcatagtcaacaaccagtcagatccctggcagcagccgcggccgtgttgtgctgatgctcctgccctgatgggcgacacgagaggttttgt

SEQ ID NO: 9636 - DNA, 201 bp, Bos taurus
gtttgttagctagggtcttgttgctgcagagaagactgaccagggcctccagggatccattctttctcctccagcttcctaagccattcttctgtctttgtgccaccaaacaagggcggccacgtccccaaatctctaatgccacggctctgccctggctctgctcatgttcacagatttggttgcaaagctcccattttg

SEQ ID NO: 9637 - DNA, 201 bp, Bos taurus
actgttaattacaagcacaggcctctgctgttcacggggcatctgctccacacttccagggcacaccctgcgctgggggtggctcccataaaacagatgctgcaaggaagaaaggagcatggatttatctttaatgatggcaacgtccaacgcttttaagaaggacattctgagagctgaatcaaatatttgattttccac

SEQ ID NO: 9638 - DNA, 201 bp, Bos taurus
cactgggcaggtgtaaagattgctcccttgggtcccaccatgtttgtacttggctgttgccaagaacttccctgtattctgacgatggtttctccacacagacagcttttgtctctgcggctgctggtgtgtttcagggcggtctgtcagcctctgctgacaccctcacccgccatgtgacctacaaggcttgaaatatca

SEQ ID NO: 9639 - DNA, 201 bp, Bos taurus
gttgaacctgatacctccccaaatcatggcttgataaatcaataaactgattactgaactcataagttcccttatgtgagaagaagcttgaggaagtgagactattaaacctggtttggttttagtataaatatggattggacttagtataaattggatttagaaatatccaaaataatggtatctgaactgcatcattat

SEQ ID NO: 9640 - DNA, 201 bp, Bos taurus
aactctggccactccctgaaatgaggattcagcaggtttgtggcagagcccagggatctgaatagcttaaatgtctcatttgattctataaagggctttgtctgtatcctaccacaaggcctctagagagatcttgggagaattgagtgcttgtgggaatatttggagagaatagaaacgatgcagagtgaggtaggataa

SEQ ID NO: 9641 - DNA, 201 bp, Bos taurus
gctttagtctgcatttgttctaaagagattttctttcctaacctaaaatcagttatgaatttaaggacaaaattttttaagatcctttatagtgtattacgggaaaaaccagtagccagccatcaggtgcatacacgcatgcgcctgctgagccgaaggtgttaatggctgggctgatcaggactagcctatgaattacta

SEQ ID NO: 9642 - DNA, 201 bp, Bos taurus
ccaggggagtcgtgggcaccagagaagctgttactggaatggccatctcgaccatcactatccgagctctgtgccaagttcagagcttttccatggtgctgggaaagggtgacaaaggccttccatctttcataccttctttcagattcgttataggcattcagtaattcaagatatagaataattgaatcgttgcacacg

SEQ ID NO: 9643 - DNA, 201 bp, Bos taurus
ccacgggcccccacttctgccccacagacgggacgctcactgttgacatctgggcccctgccgaggaagatttccctgaggccttcatgccatgaacctaatccacacgagaggcagcttctgagctgagccagccttccatatcaagccagctcaggggccagatgcacatgaagacacctgcagatgactccagagctg

SEQ ID NO: 9644 - DNA, 201 bp, Bos taurus
gttgtgttttatttttctaaggcctttctttgcctgtagccccagatcctcctggaggctttctgccttggggatgtgtcatcatgatggggagagactcggggggatggggggtgcagctggccacagtccagtgaatccacatcccagaccacagagcacaggtgcttggggttcaccagtttcatgtgagatcagtgg

SEQ ID NO: 9645 - DNA, 201 bp, Bos taurus
aggcctcccccaccccatggggtaaatcagactgcaacaaaggagacccctcgctgggtggagtcctccaggctgttcactgggtgttaatgaagactgacttgggccccttatgctccgtgctgaggaggatgcgctgttgacactaaatactgaaatcctctggtttatctcccattatgacaatacagtggcatgtgt

SEQ ID NO: 9646 - DNA, 201 bp, Bos taurus
tgtggggtcggaacgtgcaaacagtgtctgtagagcgttcctctcagcagcatgtgtatcggaaaggccagggctgcctaccttgtctctgaaactctgtgcagttctcatcggccatcccagccctgattccagtcagcgcagtggccagagtcagctgctgctagtggtggtgccttccgtgtgtgagcagggtgatct

SEQ ID NO: 9647 - DNA, 201 bp, Bos taurus
cacagggaaattcttagcagtagagttttcgcatttcagataagatccacctgcccagcagggacaggagacaagatgaactctgagggcaggatgaggacgagaggccggctgccctgaagcaactagagaaacaacataatcttatacctgaagcaactagagaaagaaggacaaacaaaacccaaagttaataccaga

SEQ ID NO: 9648 - DNA, 201 bp, Bos taurus
attgaaaaatgcatttctcaaggagaaaaaaactgtgaaaccaggtacaaaatttattattagagacaaaatacaacaaatgggagagcacacagagaaacagtttgctaatttcagacagaagcagggcagaaatatacatgggagagtgagcctgtgggcagctccctaaggaggaggagcccagtaaagagatggtta

SEQ ID NO: 9649 - DNA, 201 bp, Bos taurus
caggcatacataaatacatacttaaaccatataatctgatgagattcagaatgctttagaaagactaaactttttacagtgtttgtaaatgtgttaagaccaggacgaacaacttccagaatcactatcgtttaacatgcttagaacatttatctttgacccaatcttaatatttttggcttttcctcattgtcagaaaat

SEQ ID NO: 9650 - DNA, 201 bp, Bos taurus
gaagaaaaggatgccatttagccactagaaaatagcaatattaatttacccagctacagactgaaaagcaaaaaatcatctcaatagattcagaaaaaaaccccacaaataataaattcaacaaccattttatgaaaacagtctacagaccctcacaataatcccatcagagggatgagggaacaaggcgatttatagtcc

SEQ ID NO: 9651 - DNA, 201 bp, Bos taurus
catgatacccacaagtgccaccccgataacaatcttggctgcaaagaaggtctgagtcttggtcatatcctcatcctcatccagagggaggtcataatcatcataactgaagttgaaggggagggaggaggcatgttcttggggtatactgaagttggctggaaaactagcatttccattctgggctgccatggtgaagct

SEQ ID NO: 9652 - DNA, 201 bp, Bos taurus
gggattcagtcaagcttttatgagttagggcaggcggatttgtgtgtggaagtgctggtcagcaggttttgattacagggctttggggtttggccaggtacggtgagtagacagagcagtttcagcaccagatcttccttgaacagtggaccctccacttctgagaggcctctggggtccaggttctagtcacacgggggt

SEQ ID NO: 9653 - DNA, 201 bp, Bos taurus
attatttcaaactgaaaacaatcaacatggctcaaaagacctgagaagaaactttccctctaattgccttgaaaattttttgatagagggcttattctggaactagagctatctctggagatctctgcaaagaatatggacagggtgttgtaggggaacagggctttgagatcagagtccactctgtctattgtctctgcc

SEQ ID NO: 9654 - DNA, 201 bp, Bos taurus
tgtgctaagtcaggccttagtgcctcggctacactctcctcgcgtgtactcttgtgtccctagtcagcaccagtccactccagagattaaagaattgaacttgtcagttagctgatggacttgagctccctgcctcatagatacgtgttgcctttgtcttttgttactgggctcaaagaaggcataccgtaaacaggatgg

SEQ ID NO: 9655 - DNA, 201 bp, Bos taurus
cataaggaagaggaaagtacgggcccttgcttctttctttcctaccatacccctccctccagctcctgtttgtttgaaatgaagtggaaaacgactgtgttagtggaggtgtcagagatggccagcatcatctgtggtcctctcttggttttcagtgccctctgtcatggcacacctccagatgatggctgatcctttccc

SEQ ID NO: 9656 - DNA, 201 bp, Bos taurus
gccaagaatggggaaaggactctggaaagattaagtaagatacttaacatagaggaccgggaataaggtcacggctctgttggaagaccggaggcgtgagggtgatcccgagggccaaggatgggatcctgggggctaagtcctcagtggaaagatccgagaggagataacgagggagaagattgagaatccagagaacca

SEQ ID NO: 9657 - DNA, 201 bp, Bos taurus
tacacaggcagctgggagatcaaattggggtaggtaaggcagcagtgggctggtgtgggagtggcaaagctatttccagctaggtcctggccttgaggtcctggcttgacatcccctcatttctgcaggtgtgtgtttctgctctgctgtgtgtgttgactgctaagtccctgagcaaccaccctggatccagggaaaggg

SEQ ID NO: 9658 - DNA, 201 bp, Bos taurus
ctgactcagtccagcacagcctgtgatgtaggtgtggcctggttcctagggcagtgatgatcggggtggacctgagagtcctcaaccagttatacctcttggcagccagtcagatgaggcctgttttggatttattctgtatgatatatacatctcaggtggcttctgctaagtaattatcagcctaaatcttatataatc

SEQ ID NO: 9659 - DNA, 201 bp, Bos taurus
atctcctctgtgcgctggggctatgttctgcttggctcccaccatgctcaggctttgttccactgtggctcctcttggcacaggcccctcacttggatggcaggctatctccttcttaggcagatctctatacatatgtaaacaacaaaaaaggaagcttagcactgagggacatgatgggcccagggcaggcagcaacca

SEQ ID NO: 9660 - DNA, 201 bp, Bos taurus
ttttggataaataggagaaacttttacagaaactctgagggatgaaggaaatgttgtatgtgatcggccctttaaaataacagatgacactgataaaattttaagtctgtggataagtcataaagatgatcattcacaactaatggttagttgcaattttactgctgataaccgaatggggaaaaagtaagatattttact

SEQ ID NO: 9661 - DNA, 201 bp, Bos taurus
atatccccctcttatcctataggctgcttttcccaggctcctctgactgctagcttcatgctgaatggggccagttggaaataactgaaggtgggaaggttgtgggaggaaagtctatttttctctcttctctattctttgagcagcatctctaggagtggctgtgtcttctccatggatgcaatttctgtcagatcactc

SEQ ID NO: 9662 - DNA, 201 bp, Bos taurus
atttcttacttgtttttctcctcaatggtggaactcaagatttgaaagtttgagtgaaatactgttacaagtcactaatgggaacaataggtgctcttctgagggctttctttcatcaggaatttgttctgggtttcacttagctaaactaaactgtcatttctacattctataagttttgtaataaagataaataaatat

SEQ ID NO: 9663 - DNA, 201 bp, Bos taurus
ccagaacctgagggctactgagaattataaataaatttggcttcacaagtctggagtcataaatgacatttctttaaatgatggaaggggggagaattgaattgtataggaaccttccgtttaactcccttcctcccaaatatgtccaaaatttaaagaaatctcctctaaatataatcctcagttaaaaagaagcttttg

SEQ ID NO: 9664 - DNA, 201 bp, Bos taurus
attgccaaccagggcccacgtgggtagtgaactaatttagcctcctggacacttgatgaatgaagaatttcctcttgggcctaaattatagggcttgtcatagttgctctttcgtgatctgttatttggaggtaattttccaaaagggctggaacacagggccgtgagctagaataggattcaccaagcacagctgccaca

SEQ ID NO: 9665 - DNA, 201 bp, Bos taurus
aaaatctagctcagtccttcaatgagcttacaatctcaatttttttaaactgtacaatgcagaacctttaaggacattttcagatataagattctgagtactgaaaatcatcttcatttatttaaaatgcttttgcatttataaggtattaacttttaacttatatagctgcttttttgatgggagtcttaattaccttta

SEQ ID NO: 9666 - DNA, 201 bp, Bos taurus
tccactggctaagtttatgaagtgctcagacatcctttggaaatgaaagtgctgtatagtggcaagagctctagggtgggaaggaaaggaaacacagccacggagcctaagtctcattagcccaacatattgcttttgcaatgaagttagacatattttaagataattaagaccaatccatcgcactgaaatgcacagagt

SEQ ID NO: 9667 - DNA, 201 bp, Bos taurus
aaatcttctagccaccatacacagatacaggtgccctgacatatagtccgtgtggctctagacctaaagttactaggaaaggcctaatgatatctggttcatcagtcaagtgtttccaaataaagtgtccttagatccagaaggaaaaaggccatgcacacattttttgtaaaacttttgttctgtcaaaggttggttttt

SEQ ID NO: 9668 - DNA, 201 bp, Bos taurus
attcctttgaaacctactggtgaagaggcaaccagctcattctcactgtgtgtagttgatccctcaccaatgtcctctatttgaaccgaggttatgcacatagacagatgccaaatgaatggagatatcactagtttccttgttttggccaaaattcttagttccagtcttgtactttaacctgccactatggtttagttt

SEQ ID NO: 9669 - DNA, 201 bp, Bos taurus
ttttgtcagctcctcagtacagcagattttgtttcttcctgcctcccggtgttaataagaaggtggtccagcaggttctctccgcctccttgcctttttttccccgtaattctgtggcaaagggtgttactgcatatttccctggcatgcgcccttgctttgatctgaattttcctgtgctctgttgtctggttgtgcagc

SEQ ID NO: 9670 - DNA, 201 bp, Bos taurus
ctatttagtggagaattattcactattctggaatgattgtgatttttttttttttttttagaattttggaaaatacaaaatcagcagaaccagactcaccccccagaatattgaaataagatattttacctgtgccattgtctcatctgttctattaactgcctgaaatcatcttaaagatattttctcatatctttctta

SEQ ID NO: 9671 - DNA, 201 bp, Bos taurus
gggaaacagaagcaggctctggtgcagctgtaagtcatatggtgggaaaatgcatttggcacaactgcacaggccagtcactcccctcctcggcctccaaggaggcaaattcttcactgagcacaggcacttgagctcaacaatcagtatggcatccacacagctactattacccagaagtgggaagcacctacaactggc

SEQ ID NO: 9672 - DNA, 201 bp, Bos taurus
agagcagaagctaggcagcctagccccaccttcttatctcttgcagaggtgggaaggtgaagagtgagagtcctgggcagctggaatatctactctgcttgtatctgctgtgtgacctggggcaggtgagtgccctttgagtatccaggggccttcctcctcataaaaccagaccacttgagcattcagggtggtacaggc

SEQ ID NO: 9673 - DNA, 201 bp, Bos taurus
tgtatctgtgggtagacaacatccctctgtcccggcccaagcgaaatctgtcccgggacttcagtgatggaggtgtgtgctccatcgtgtgtgagtgtgtccgcacgcacgcctgggtgtctcctgtatgtctttgtgtgtcaacgccttctgtcctgtatgtacgtgtgtacagggtctatgtgaatacatgtctcttgg

SEQ ID NO: 9674 - DNA, 201 bp, Bos taurus
gggccaaggaacagttttggctacttactttttttggaagcagggttactttgtggtattatagcacctagcccccaaaaaggtatgtgcacgtggtggcattttaggcctgccaagatgagagtctgcacgcggaggggccttccatccaggtcacagagaggtcttgtggaatggggtgttcagtttgggaggcttgac

SEQ ID NO: 9675 - DNA, 201 bp, Bos taurus
tgggcgcgtgcaggcctagactgagtatctggaggaggacagcctggcagctgaaagatggtgagctgggtaggggctggcctgagctccccactgtctctacagaccctccagaccctccaaagctgtctgctctcctggatgtggaccagggccacacagctgtgtttgtctgcactgtggacagtcgccctcctgccc

SEQ ID NO: 9676 - DNA, 201 bp, Bos taurus
aaaggcagagtaataacacatgtgaaagtttcaataaacagcttttgtgttgtaatttttaatcaagtttatttgacttgccaattataaatatttgtttgacttattaatattacttttggaatggagctgtggaaataaatcaacactaaaaaataaaactcaagcaaatacttaatcagacacacatttatctttcct

SEQ ID NO: 9677 - DNA, 201 bp, Bos taurus
ggtatcgattttctacctcacatctaggggaaaaaatgaagattattttctattgttatctacattcaatagtgaatctacattcactttaaaatcaagcaggtccttttatataaactatacttttttgagtcagtacaattacattcttcactgttgcccaaatcagatggactaacaagagtctgcattcattttcaa

SEQ ID NO: 9678 - DNA, 201 bp, Bos taurus
attccctcggaagcagctgaatcctgccaaaccctgagttctttgcatttgtttttttctctgcctataatgctcttctcttactctcttcctaggaaaccctttggaggcagagtggttaggaatatgggccttgtagaaagagttagaatcaaaacttagttctaatagtgctagtatttgcttagtgggaaatgcatg

SEQ ID NO: 9679 - DNA, 201 bp, Bos taurus
tcaatgaggaaaaagataataaaatggaggatagagaatggaaaatggtgatatcaaaagtgaaggttatgtaatagtgtgtgtttatgtgtcacggagtgtgacacagagtgacaagcaaccagacatttaccaactgccacctccttagtaggaaaaacaaggaacaaagtgagtgggtggagtttctctgtggaaact

SEQ ID NO: 9680 - DNA, 201 bp, Bos taurus
ggggctgttgcaggaggggtcctggggacttgactcccctccccggagctctgagccactgctgccatgaatacaattcataagaggccactttggcctggggtgggtactctctgagagttccagatcccaaggaggacctcgagaagccagcttgtgcgtacaggggtcctggggccccagaaataagttctcccacct

SEQ ID NO: 9681 - DNA, 201 bp, Bos taurus
gctacaacgtgctgccccaaatcattgaagccaagtacttggatgccatggatgctgaacactgacgccctgactagcaggtcctggccaccccccattcacccatttctccaggtcttgccaggctggctgtgtagctgtgtgtgggcatccgggaatgctgctctgtgctgcaccccctcacagctgtcccaagtggcc

SEQ ID NO: 9682 - DNA, 201 bp, Bos taurus
agatggcatctgaagcttgatggaagagcagaactggagagacccgaggaagggtccaggccctgtattcagtcagagtcatggctgggagtggaggagcgggaggaggtatgtcgcctgccatgcttatggtgtttctgctgctttttatgatcgttcttcattttcttctgcatcctttgtctgtcaccattcctggtg

SEQ ID NO: 9683 - DNA, 201 bp, Bos taurus
tgttacactggataaagtatttttcagaacaaggaaaattatcagaaacaaaaaggaataatacataatgactaaaaggccaaaatagacataaaattctcaatgtgtatgctccagaaaacagcttcaaaatacaagaagcaaaaattggcctaattgaaaacagagaaagacaaatcaataaccccctctcagtaactg

SEQ ID NO: 9684 - DNA, 201 bp, Bos taurus
tgatgtgagaatagttgaatcaccctttgggcacctgggggcaccttggcccattcttggtataaacagctgtgttggaggagtgtgatctgctagatagggagctagattttgaatgctggccttaagctagactctctgagcctggttttgttgagaataaaatcggagctataataacagctcacaaatggctaccag

SEQ ID NO: 9685 - DNA, 201 bp, Bos taurus
tctttctgcttaacctggaggttggctgcctaagtgaggtggtaggtcagccattcccaggcctggccgctctgcatccatggccccatggaatgtggtcgctgttggctcctgcagatgatccacaagagagcagagcatagagaggtaacagcaaagtgagctggaccctgatcagcagctgggtgtgtggcatgggtc

SEQ ID NO: 9686 - DNA, 201 bp, Bos taurus
tacccaacatgggggtaaatggatacaactgatagacacactggtgaccgattccaggtgatgtgcgatgccagatgtgggcctcttcctgccgcagacctaaaggaggtctttaagggagccctcctcttgtcatcaagcagtgacgctcagcagtgcttcaggttttggggatcagaggggatttgaaacatggcctcc

SEQ ID NO: 9687 - DNA, 201 bp, Bos taurus
agggaggcctggtgtgctgtgattcatggggtcgcaaagaatcggacagaactgagtgactgaactgaactgaactgaaagcatgtaccagtggagatgagtgggccaaactgtgatgtcagaaacacaccaaatataggaatcacttgtcctgcttagtgcccatgctttgcacctatttactgtcttttgggtgccctg

SEQ ID NO: 9688 - DNA, 201 bp, Bos taurus
aaaatagaggtaaattggtcctctttgaggtgtaaagacctccctctgccccctgggcagtctttttagccacttagcctgattctgaggtcttcttcttggcaacttgtaattccagatagcagcaagaaatataactgcacctgagcctggagggtttgtgccagggctggagaggtaggggggcatgttcctagaagc

SEQ ID NO: 9689 - DNA, 201 bp, Bos taurus
gactgggcaggattgtcaggaagcagattccaggcaattcaaggcctggaacaaaaatcagggggaaggagcaggttggggctttgggggcaggtatgcgcttgggatgacgtgaggagcatctacctcggatggtctcggacaagttggcagtcccacggagaggagggcccccctgcagggtgacgtgggccacctcgc

SEQ ID NO: 9690 - DNA, 201 bp, Bos taurus
cagcaccttcagtgttctcctgggcccggcccctcctcctgggggcctttatcactgatgaccgagtattgtgtcgtcattcgtccagaatccagctcccggggggaagagggggcaacaggggcctgtttcccccaatgcccagctgcgggcctgccccagtcttgggccaggtggacaggtgaaggaagacaggacact

SEQ ID NO: 9691 - DNA, 201 bp, Bos taurus
ggactttggatataaggacagcccggatataagaaccattgccccccaccccacccccagtggcgctgcagcccaggaaccgccttccttgggaaggccccacagcacggtgactgacagcacgcccttaaccgcgtttcacagctaaggatactcagtgtcagagagcctagggacggcccaggagtgaccacggggtcc

SEQ ID NO: 9692 - DNA, 201 bp, Bos taurus
caagtctctgcaagattgagtgagcacacggagtttctctgtgtggtaagaagcctgacaccagcacaagaaggctcggcttcctaggcccaccataggcgccagacctgggggatgggaactgcccctgaacccagggacaaagacatgcgggcaaggccctactctggacaggacagttgggggaacttgcacagtcat

SEQ ID NO: 9693 - DNA, 201 bp, Bos taurus
gggctcggctgcactgggctggcgcaggggccccaggccaatttgctttgacacacacggttcctttgcagaaaactctgtacggtgcaaatgtcatcatctttgagggaatcatggcctttgctgacaagacgctgctggaggtgagaacaggctccaggtggacgacccgggtcctcctgcaggactggccttaagcac

SEQ ID NO: 9694 - DNA, 201 bp, Bos taurus
caggcgaacagagcacccccaccccctgggttcttcctgctgtgctggcacctctgcaccagaggcagcagtgccccattcctctgcagccaggggcctcctgctgggcagacccaggtaaaggtctggaaagagtgcagaagcacctcagggtgggagtcagtgctgacaccaacctgtctgctgcccttgagcacagta

SEQ ID NO: 9695 - DNA, 201 bp, Bos taurus
gagccccagggcagcaaaagcgaccagggccggcactcagggctgctgtgcgctccccccgcccctccacgcgggtcctcaatccgccaggatggctgtcacatagggcccttcccagctgcagttccttgccctttgctggagtcgggagtggcccttctcccttgcatggggtgcaaactgcctccctcagcccaacat

SEQ ID NO: 9696 - DNA, 201 bp, Bos taurus
ctggctctgaatctgctttgcccttgacctggaagtggtaaagaggggcccccaggcaggtccgcactggagggaaggggcagagacaagctttgaagcacgactgctgggcaatccaggcccccactcatccttcctggtgggttgctgcctccagcatctgcatcgatttaacgccttcaaggttggaccccagatggt

SEQ ID NO: 9697 - DNA, 201 bp, Bos taurus
cccctggactctccaggcaccaccgccctggcgcggccctggtgacgctgtatggagaccgagatgcgccctctgcttaaaggcggctgcatggaggagggctcctggggtgtcaggggagggcctagtttagccctggtgacaggccaaggcccctctccaccgaccccgcacaattctgggagaggtgacccggccccg

SEQ ID NO: 9698 - DNA, 201 bp, Bos taurus
gccacgaggaggcttactaattggtgagtgggtggacgagtagtaaatgaagaacagcccgatccctggaggaactggcaccccaagcctcggcctggcacgctcggttccccagctctctagacctccctgtttgtggtaccaagctcacccccacacccaccccagggcccagaagttacgtacgtaagacccggacac

SEQ ID NO: 9699 - DNA, 201 bp, Bos taurus
agggggtgtcctgagtggacatgacactctttcctggagtcaatgttgagagaggatcacagcctttcccagccatagaaacacccagtaaactgagttagaggcccactgctgtgacttcagaggtacatccacaaaatttagctacagtgggtcatagtatcccctgtacccacttcacacatgtctgcttgcgggaga

SEQ ID NO: 9700 - DNA, 201 bp, Bos taurus
atggatcagccaggaagtacggccgtcgcaagaaaggagactttctggggaaacatgtaacagaactccacggaagaatattcgggaaaaataacaccacaaggatagaagtaggccagtgacttccctcatcaagtggacttggataaataaagttaaaggctcatcagcgtcctcagaatcctattggttataattgtg

SEQ ID NO: 9701 - DNA, 201 bp, Bos taurus
catgctcccacttgtgcaacttcagcggcttcctgaaaccatgtggggtgtttctaaaaactacccacatggagcccattcccaggcacccaatgttttatagttctacacagagtaccgattgtctaaacacccatcacggcctgtaattctgtgtgtatatgtggtggtaattgaagatagctcagtttacaataaaat

SEQ ID NO: 9702 - DNA, 201 bp, Bos taurus
taagtccacgaaagaaagtaaaagtttacaatagttcatgaatcatgaaatgcttcagatgccgggagcaaacagcacagcgactcaggctgttcagtgatccctttgtctcctaacaggtggcgggtgcctgctgggacaagacttgggtttcttgaccctctggcagggacatccacgtgcacattttgaatcagttcc

SEQ ID NO: 9703 - DNA, 201 bp, Bos taurus
ctggcagcggacaacagcccagcaggtcagctggggtggtctatcaccctggagggtgcctggcctcagctgggggggctggccggtggacacaccagcattctggggatggttttgctgattaaagtgatggcatttgtgagtggtcccccaaatctgcaccatctactcgctgtgagggcccaagagatggcagagatt

SEQ ID NO: 9704 - DNA, 201 bp, Bos taurus
gagccctcaggtcatatttcccagccgaggccaagaatcatgcttcaaaggaaacttgaaggtgagtgaaattaacaaagtttgcggcatatttgaaatcgcaaggatggtcaggccacctgtctttatcctgccagctcctattaaaccatcaaaggcttatttgtgttcctttgatgtgggctgtaagtgtatttcctg

SEQ ID NO: 9705 - DNA, 201 bp, Bos taurus
tgaccgtgaaggatcttcactaaccagcctccaccctgaatgatggcttccattccagacaaataaccatagagctcggctctttcccagacagcctcccactgcaacgcgacaccggcacattaaagcccatgatgcatggcacccagcctgcttatagcttctttatggcctcgtcagctgtaactggacgattacaaa

SEQ ID NO: 9706 - DNA, 201 bp, Bos taurus
aggacacagcattttcaaccacgaggcccgctgacagtcatcctagggactttgaggattgacaggcaggtaactgctgcttacactttatcttctgtctgcacttcctttttctctctcaggaagtgagttttcaggattatttttaaaaacagactgaaaggaaagtcattcctggagttatcctctaaggaacacaga

SEQ ID NO: 9707 - DNA, 201 bp, Bos taurus
ttatctacacaatcttttttattatttgttttggatactttgcttgtttgtgtttgttcactattataaataatactttaatgatctcacacaatcatctttgcacacttttccaattattttcttagggtgaatcataaaagttggatgctagactaacttttaattgttagcttaggtctgtttattttgttgcgttac

SEQ ID NO: 9708 - DNA, 201 bp, Bos taurus
gacctcgggagtgtgtacgaggccaggcaaggatgaggcgtatgtaatcagggtagccagggagctctcccagacatgcagttgtttgattaaaccaagtcaccactggccagagcagacagaatcaattggccttgtttcagggcaaaaggccagggaggggaaggccggaccattctggcctcaaataatcaaatgctt

SEQ ID NO: 9709 - DNA, 201 bp, Bos taurus
tggcctgatctgcttcgctgtttgtacctcctcaggcctttttcccagcagactcgctgctcgctgatcagcagccaccgtggtggtcctgctcagcatcgtaagatgctgtcctgggccccatgtccactctcattcagctctctcctctccctctatgagacaaaggatgctgcgaggctgctagtcctgaacttgtcc

SEQ ID NO: 9710 - DNA, 201 bp, Bos taurus
ccatactgttttgtatgtgtaatcccacccaggtgcccgctttctcccagctctttaaaccattctgctttgaccttgtcattatcagtagttgtgccctaaatctcacttcagatgttgatcgtcccaccctgctttctagagtagtcccaggctgtttactccactactgtctgctatgcttgttaaccctcttgtcct

SEQ ID NO: 9711 - DNA, 201 bp, Bos taurus
tatagaaggtacatgccaacttaacagtaacgcttctgcactacaggaaagacaccactgaatattactgagtcttgaactagtagagtcttcaaatcatccatttgtactggcatctgacttcttaataggaataagcatttctgtgattctaaaaggatgattcttcttaatgaggtacagagaagtccttcaagccca

SEQ ID NO: 9712 - DNA, 201 bp, Bos taurus
cattaagtgaggcctgacagtgtgcttgcttctaacacatgtaatgagccaagtcaggaaatcgggtgatgcacaaactccaggtaattggctgagcatcactgaccagcatggccctcggccctggaaacatgaaccccatcgtgcaccgagacctgaaatgacccccctgctgcctcagatgcccatttcagagcccga

SEQ ID NO: 9713 - DNA, 201 bp, Bos taurus
tgcatttatttagagaaaggcagtgtccctaagcagaactcacagtgccaggaaggcgccagaacccaaaggattattcaaatccctttgtcccctctacctttggggccagtctcactcacaggccatctgtacccaagtgcataaattcatgtgctcccgagcacccactgactccataccacctagctccccatctga

SEQ ID NO: 9714 - DNA, 201 bp, Bos taurus
aaaggcactgccaactcttttctggctgtaaagcagggaaaagtccctacctcctttctttacaagatgtcacactgaccaatgagaggatgtatgggattgctcgagctgccttggagaaaggcaaggtatttattcaacctagaattctgcccaaacactcgttactgaatgggttggaccccaaagggttgaaagagg

SEQ ID NO: 9715 - DNA, 201 bp, Bos taurus
gccttgtaatacatagccccccccccaacaaggttaaaatacagaacaaaaatgggatgttaaatcacttaatttgacataaattagtttttcttaaacagttttaaaaaaacaatctcatgcatttgcaacagagttaagattggtttgggggagagtgcaaaaaaaccttagctattccaggagcccacagtagagagg

SEQ ID NO: 9716 - DNA, 201 bp, Bos taurus
agttagaccctgtgtgtctctggagggtctacggaccaggccaggggcttctgggcgggaatgtgcacttggcttttgctgcgactctctaggtcagcgctgtctgcctgtcggatggtctgtgggcctgagggtctgttttattttcgtttttactgttttggcctctaactaaattaagacattggctgtgaaacttgg

SEQ ID NO: 9717 - DNA, 201 bp, Bos taurus
cttgctaaaacgggctggagaaagagggagacagaggcagaggtgtgatgtggtttagccatgtttaattcaacttgcagtgaactcagaggggcccgagcagacattccttttgctccataaaacctgaaccaagtcgccccatcctttcaaaggggtggtctgttggaggcagggactgccccagctggagtggggcct

SEQ ID NO: 9718 - DNA, 201 bp, Bos taurus
gacttaggtgcacctctcagagggctggttgagaaaaatcacgcaggggagacccatggagccattcagatgtgtgtggccacgaaatgatctctaagacgctctataaagtagcgctcaggacagggaggggagtgtgtgctgctgcttgtaagaaaacacaagggctctgcacacacaggagcacacagagggcctctc

SEQ ID NO: 9719 - DNA, 201 bp, Bos taurus
ggtgatggggcttggaacatttaggactctaaaggctggagagtgctcagagagtggagaagcacagaaaactgacctaggtacccttcctttccttcccctttccccattatactataaatgttgagtgaaatgtgactaaaaggcaaaacagtacccaatcagcctgcattgtttgtgatgacaagcactgaggcaaga

SEQ ID NO: 9720 - DNA, 201 bp, Bos taurus
tcctgtcctgtttcccacctctttaacagtgatacctgtggttgggtcagcatgacgcacacatcttaaaagatgatctgcattcttacactgtttcctggaagatgctgagaggttatactgaaaataaaaaacctgagtgaccagaggtctgattaaaattattaacacagtgattcattttgacaaggtgttggctgt

SEQ ID NO: 9721 - DNA, 201 bp, Bos taurus
gaatcaagtacgttttgaattatgcggcccttgagtgattctgcctcacctctagagaaacgtggtttcctcatgttgtgttctagggatctcatggaagtttgcaaaccgctggccaccatgctggtgaagtccacacaagcccacatatatgtgggtctttatatggtgttttataaatggagccactattctagactc

SEQ ID NO: 9722 - DNA, 201 bp, Bos taurus
aaacacacagagacaatttgagttttctttctttcccttcaagtttcctctttttggccaactatgtggcttacagggccaaagaggcgctgcaaacttcgggacgtgcacactcccagccttctctagtgtggcgtggcttcatgtctgggtacaagtcctgcacatgtcactcggccagctgatcgggcctcagtttcc

SEQ ID NO: 9723 - DNA, 201 bp, Bos taurus
actgtcctccagtgctcacacaggcgggggacactcggaaggcctggcggctcctctggccaccagactgtccggcccaggtcatttctgagcagcccacgcacccctccctgaacagagatactgatggatgtctactttgacctctgttcctccgtctgccctggatccctctctgagggctcccgacggcccaggctg

SEQ ID NO: 9724 - DNA, 201 bp, Bos taurus
gggccaagtcaattcaaggcaacttgagttataaactagttctcaggagtcaatctgcctgtgaagcctggaagaccccatagataaagggcagtgatcgtggcattgagtgacaacaggcctcttccacacaaaatgaggctctcctttccaggaggataaaccaccatagatgctgatcagagataggctcagaggtcc

SEQ ID NO: 9725 - DNA, 201 bp, Bos taurus
aggtgctttcagtgccaggacctgagggttttgctctgcatggttctacccgccaaagggcacctcggcagccctctggtggcctggcaacggcttttgccccccctgggaacggaaggagacagagctctggaagcgacaggtgacctgtgttctggagtctgctgggcctcctccatggtttggcactgagatcccaca

SEQ ID NO: 9726 - DNA, 201 bp, Bos taurus
tggcatgtgtccctgctatgtcccatgattgctggcctctgtctcctcgaattctcactacggccccataactgggggcctctttgtgtccccatcttatcgaaggggaagctaagcctcacgaagatgggttcgcaggtcccaagtcactgctggcagaacccaagtcaacccaagctgtcaggccccatctcagcccaa

SEQ ID NO: 9727 - DNA, 201 bp, Bos taurus
agagatgcctgtccctgaatgtcagtagtgtggagctgagaactctagtgtaggcagagcggcctccccctaggccaccaggtctcccagcttgggcctcgcccagtcagtcagttatacccaatgtcaccctgaccttgccactccctgattcaaccacctcaatgattgctctttatgagtaaagcccggttcctctca

SEQ ID NO: 9728 - DNA, 201 bp, Bos taurus
ttaggtactggagattcatgttgccagctcttcgaccctctgcgagctgagtattttttaagaatgggagctacggcggcaacaggtccccaagggccgcgtcgtgtgccgtaaaatgctcggagcgtttatttaattaacggaagggggatgggggcacaattcacagccagaacgggctatcgcgattggaagacacac

SEQ ID NO: 9729 - DNA, 201 bp, Bos taurus
gctgctgaaaggggaagccagagatgtggtcatagtttgagtcaatttaagggtaaagaggactttttttttttaaggcagcacttaaggaagccggcctgttgactgatggaagggattcattagagagatgatgggagaaagggacaacgcagttcaggagtggggttggagtaccagggaggggagaggatgggatgc

SEQ ID NO: 9730 - DNA, 201 bp, Bos taurus
tgtgcccagagcagaggaagctgctgagaagcctaggagatgagatggagagctagctggtgcacctcacaggggtcttccaggccctcagacttatttttttattttttaacacagattgagatgaggagccatggaagggttgggagagacagtgccttgttcaaggctctcacaacatgaacaacaagagcgatattc

SEQ ID NO: 9731 - DNA, 201 bp, Bos taurus
ccgtcccctttgcagggtttcagcttatgttaattagcacatgtcagaacagagcatgaaaacacataacctgcatcactagaagagtctacaaaggcccctgggttcccctccagcccaggaactgagtgaggcagctgacttaactgttggcagccaccacagtgcagaccagccaggtgtctggccctaggtcaaagg

SEQ ID NO: 9732 - DNA, 201 bp, Bos taurus
aataccaagttagacccagggccaggctaatgaggctggcacagccgccacagcctgcaaagggaaagcagacagattctaggttcgaatcccagttccatggcttagcacatgtgatcatgggccctcaccatgcctgtccgagtctcagtttacttgtcacaacaccccagtggtcatgctttaggggtttcaaggagc

SEQ ID NO: 9733 - DNA, 201 bp, Bos taurus
ttttggccaaatcatttcactggtatggattcccagtgcttacactctgaaacaggctactgtgtgaattaagcctaacatggtatgcgagaggttctgtcacaggtgggcctcagcccatagtaactgccttcctccctcctatcattcagtttgcagaaactgaagatgaattttctagctgtgttttgcagtggcatt

SEQ ID NO: 9734 - DNA, 201 bp, Bos taurus
agaaggaggaagccaagatccgcagtaagaatctctccgcgggttagttgaccctcacctggctctctaggggaagccatcaggcccaccacctcgcttctgaggcagaggggactgctaagatgcacagcgacagcttactcatcacttagcacttgcaggccctgtgtgctctgtttttacgggcatactttcagtcct

SEQ ID NO: 9735 - DNA, 201 bp, Bos taurus
tccaatacaccatctgaagctcgtttaatgttcatgttccatctccctttttagtagcaatttgaacatccagttgacacaactgggaaaatattactcttaggatctctgaaagaatttcatagtctgttagtttccatagtgtgaaatttataaacttttagctatttggatgaatgacgtctgcagttctaatggaaa

SEQ ID NO: 9736 - DNA, 201 bp, Bos taurus
actgaagcccacaggcctaaagcctgtgctctgcagtaagagaagccaccataacgagaagcctgcacactgcaatgaagtgtagtgcccacttgctacaactagagaaggcccgcacatggcaatgacaactcagtgcagccaaaaattaaattaattaattagttaatcctttaaaaaagaatatttatgttgttgttg

SEQ ID NO: 9737 - DNA, 201 bp, Bos taurus
tgctccatgattgggtggtgtcactggctagattctctgcctgggtagggccacaagctgtgtttaacacttagataaggccataggctgggctgaactatagggcagaactgtaggctagactcagccttgggttgaattctaaggctgcccagggtcactgttcaggctctctggctatgaaggcccagaggcaaaagt

SEQ ID NO: 9738 - DNA, 201 bp, Bos taurus
ccctgggcaggctccaccacctctctgggcctcctcagtaggacactcggagatgatggagaaggggtctaacgtcaggatgtctgccacaggctccccagcagagcaggctcagggcctcccgcttgccacttctccaggcctctctctctcacctgcttcctcctctactggtgacacagggctaaccagcaaccttct

SEQ ID NO: 9739 - DNA, 201 bp, Bos taurus
gatttagggtgacagtccatttccaggaggagatgggctctgcccttgtctggccctgggcacctctcattcatctgcggcctcaaactgtaccctccagcgctatttactaccccctcaattttcaagctcctctgagctaccgggaaaccggccaggagtgagtcaggctggttcctgcgggcaaaaactttgcatgga

SEQ ID NO: 9740 - DNA, 201 bp, Bos taurus
cctgttttacagatcttataaaaactgatgcagggaggctaagaggtcttgtggttcttcattcttagagaacattattttattacatgtaacaattagaggaattatgaaaagtaacttctcacatttccatgtgcttacttaccaacagaacaattttttgtgaaagatcaatgaagaaacgtaacaactccgtgttta

SEQ ID NO: 9741 - DNA, 201 bp, Bos taurus
ccccaggatctaataagctcatctgagagaaggagtttgagacaaacgtgcaaccgcccgcaggaatgcatctggtttcagatttcaaatcccgtgtctctcaggcccctggattcagaactcaaggccacaaatcataggcatgaagcactttcttaagactccaccctaacgttggatggctccccatcgaatgcctgc

SEQ ID NO: 9742 - DNA, 201 bp, Bos taurus
ctggctctgtggcctgggcttgggtacactgaccgtatgacgaatgtatagagactcttgtatagaaacgtcccatgagagataccactgcaggccagcattggtacccaccctacaccctctgcagaaaaggaaacagtcccgggaggagaaggaacctggacaggggcctcggctggagcccaggagagtaggggtctg

SEQ ID NO: 9743 - DNA, 201 bp, Bos taurus
gccatctactttgggtaaggaaggcccatcacagaggggtaggcctctaggaagccaaagagaaagtcaacacagagcggggagtgagaccccggctgaccgctgcctccgggctgtgtggccttagagtggtagtttaactccctgggccgcagttgccttaactgtgaaatgggccacggcgcctccatcacaggactg

SEQ ID NO: 9744 - DNA, 201 bp, Bos taurus
agtgagggctgggggacagcctagaggctaggggagatgaagggcagcgagcagaagcccagaaggtggaaagaggggcagagctgggccgtgtgggctcggtggcttttgctcagacagtgatggggacccacagaagggtttgagcagagaatgaacatggtcaggtatacatttttaacatcacactttggcctctgt

SEQ ID NO: 9745 - DNA, 201 bp, Bos taurus
agtttgcatgtatgaaaggccagagcacgggcatcagtattagtaaggcaggtgtcattggctacaggtgaaaacgagggtagtaatgaactgccagccaatccccagcctccatggcccacagggcaggcctggtctcccacagcttccagctctgcactcggcaccatgacccagaccaggcttttccaccatgaacac

SEQ ID NO: 9746 - DNA, 201 bp, Bos taurus
actcagggcccccttcagcccagcgctttctcttcttccagatgtgccctgccattgatgcagtcctggtgtatgtgaacaagaagtgggccagcctgaatggtatgtagccctagccatgccttgctcccacatggggtcagcaggatggctagaatttttggatgtcccactccccattcaagtacctgctcctggccc

SEQ ID NO: 9747 - DNA, 201 bp, Bos taurus
gaagtacaaactttccccagagtgaggggccccgtccagcctccattcctggaggcacacaggtgacccagaaggcgagagggacccagggggctgggacgcgtccctgggggtctgaaaagggccctaaggaatgcggagggacagattggtgagaggataaagaggtgaggcttgagatatatacagtccttggttgga

SEQ ID NO: 9748 - DNA, 201 bp, Bos taurus
catcaaagtcacaggagaacttagaggtcatcattttaaccattttgcttaaaagtctagggagactgacccagagagggataagaactcatctctggccacatgtgacttgaatgctacttattttatactttctgtttgcatatgttcagttcagttcagttcagtctctcggtcatgtccgaccctttgtgaacccat

SEQ ID NO: 9749 - DNA, 201 bp, Bos taurus
tcacagagagggggatgaagggcagcagtgatgaggtcagggtgatttgaatgggaagattcattttgaggatccctaagaagtaggtcaaggcagaagggcaaggctgggtcatgaagcgctctgtatgtgtgtgttagccattcagttatgtccaactcttttcgacttcatggactatagcccaccaggctcctctgt

SEQ ID NO: 9750 - DNA, 201 bp, Bos taurus
agagcagtggagccttagagattggaggccaggtgtgcatcccagaatgcaccacagtctccccacctgcctgatttagggccagctggtttgctccccctacagcatgtctgatccttgagccctggcaactctgaccagcagggaatctgagactcagcatattcacctgctgccctcaccacaaggcagggccgtgcc

SEQ ID NO: 9751 - DNA, 201 bp, Bos taurus
gatccagatcccacacacctcagagcagccaagcccatgggccacatatggagttatgctgtagagcccaggagccacaagcactgagtcaccacactgagactcctgaagcccgtgggccctagagacggtactctgaaacaagagaagccgctgtgatgaaaagcccgcacactgcagctagagtagcccctgctgcct

SEQ ID NO: 9752 - DNA, 201 bp, Bos taurus
tacagcagaaaaaatcagttacatttatacatccactcttttttagattctcttcccatctaggttattacagagtattgagtagtttcctgtgctatactgtaggttcctgttagtcatctgttttatgtttgctactgctaagtcgcttcagtcatgtccgactctgtgcgaccccatagacggcagcccaccaggctc

SEQ ID NO: 9753 - DNA, 201 bp, Bos taurus
aacttgcctgccatctggtggggactgacccatcaggggaaaaaaaaagaaagctaagacgcaatcaagaatgagattcctaggccccatataaatatcacttcttccagggagcactcaggtattgaagttactggcttcctccattgtccaccccaacctctgttccagcactgagcgggcacactggatctctttatc

SEQ ID NO: 9754 - DNA, 201 bp, Bos taurus
ggcctgaggagggccttgaagtgtgtcagctggggcctgggaagtctgccaggcaaggggggacagctaggagtcagcgagctctcaccccacggggacatgggcctaccactgccagttctaaggcaagctgcatttcctactttccaagcgtaggcactaatactgccttgaaaatgtttctagaatctgaacacttct

SEQ ID NO: 9755 - DNA, 201 bp, Bos taurus
aagcaggtacatcataacatgcatgagcagtgctgtaagtggtctcacctgttacataactatgtctttacaaaacgtggagagcaaaaggccctggggcgagagagcctgaccaccgccatcttggctaacttgctttccctgcacgtggcacaagccaacctgcacaaccccaccggttgttttagtccctgctacctc

SEQ ID NO: 9756 - DNA, 201 bp, Bos taurus
tccatgggattttccaggcaagagtactggagtggggtgccattgccttctccaatagaatgggctattgttgactaatgccagcatgacggcctatatccacggtacttataattatgactgagcagggacagatcgtgcccagccaagctatgttaccagcagaggcccccacacagctagaaccagaactgggtcaat

SEQ ID NO: 9757 - DNA, 201 bp, Bos taurus
gaaagactggaaaggcacaagccagaattgtttattcaatggatattgctgcagaatccttgaggcccttctttctagtttccctaccatctgtacttgaatagagcctgtctttccacatatgtaaaatgaaaggagtagattagatcagtgttttcccaagaatgcttttgaaaccactaattactagacatattagca

SEQ ID NO: 9758 - DNA, 201 bp, Bos taurus
gctagtgactgctataacttccggtgtatctggtcaactctctgcaagagggtgagagcccaaggtttagacttggacttaggtgagggtgaaggccttcagaggcttttaggctaggttctgtgctccaacactgctggtcagaagcatgcaccagagcatcggcactggccaacctaattatagaagagtcccttatct

SEQ ID NO: 9759 - DNA, 201 bp, Bos taurus
ttaaggataccacagctggagtcactgctttcatcaccactgcatggtgccatcttaaagaaattctaccctgtgtcttacactatttgttcaagattcaaagtcctggtggaagcattcaaatggccatgcctggatcgtgttgcctttgccatagttacaagggggtgatggagagggaaactttaagcatctttggtt

SEQ ID NO: 9760 - DNA, 201 bp, Bos taurus
gcaatgaagaccctgaacagccaaaaataactaattatttttttaaatgggcacagaacttgaatagacgtttctccaacgatatacataaaggccaataagcataaaagaaatatgcttaacagcagtaatcactagagaaatacaaatcaaaactgtaaggaagtatcatctcatacccactatgatggccactaggat

SEQ ID NO: 9761 - DNA, 201 bp, Bos taurus
aaaaattgacagtcgactggagccgggcccgggatgagctaatgaggaaggagagccagtggcagatggagcaggaggtaagagaaacgggtgggaatagcgcgaggagtgcaggttgggcacggcctggtcagtgccagaaggaacgggctaccttcaggacctggatgggtactgagctgtagtttaagtctctggccg

SEQ ID NO: 9762 - DNA, 201 bp, Bos taurus
tgggtctgcacttggcatggagctggctctaaatttacaccacctgcatgatccaggggaccaggcatagaaattaatgcagatattgtccctgagctacgaaagtcaagtcgggcccttcctccccaacactgtcctcgaagggaggagaatcaggccaggattttattcagcaccagactgatcactatacaatttcct

SEQ ID NO: 9763 - DNA, 201 bp, Bos taurus
tggtcttcacagcggtctgcagggatgcgcctgaacgttggggcaggcaggtgcatctggaggggccagggaaggtggtctcactggggttgtaggaagatgattaatgtggctctgtgggcatagggcctgtgggcactcagtgagaggtgacccatctctgcctctccgtctggctgttgtcagagcagggagcccagg

SEQ ID NO: 9764 - DNA, 201 bp, Bos taurus
gaatgggagcaaaattccctctcccaagacccagttaccttgagagtggtgagtgcttttttctgggatacaaggcctttgacttcaggctcactctggttgtgggcttccccatccacagaaatggggtgaatcccatctgggaatagcagaaatgccccattagaaactggtgtggggcttcactggtgatctagtggt

SEQ ID NO: 9765 - DNA, 201 bp, Bos taurus
gtatttctgaacagctgcaacacttaggatgcttttagttacaagtaacaggaaacccagttcaatttgattttgcaataaaggggatgtgtgagtacgcattaatagggaagtctggggaaggtgtactgctccaggactgtcggttgtcttagcatgtcacctctcactgctgtttttacattaaacccttgtggtcag

SEQ ID NO: 9766 - DNA, 201 bp, Bos taurus
tccggccagtgcacgggcccaatggaggtctctgggcaggaagcactgggaacaaggaatcctctgtctgcagtcgcagcacagcttggacagaggaggtggattacgagttcctgggaggcggccttctgcgctttgcctgacatttgggcaaatgggtggggagaaggggaactgagtgtatgtgtgtatggtggagaa

SEQ ID NO: 9767 - DNA, 201 bp, Bos taurus
gggcctcagtcttcttgtctgtcaagtgggaataatgttctaggttttcttatgagtttgtcctaagattgcagttatgggaaaactttgaaaaattgcccatgagatggtacatctgggccacccactgggaagatggggcctctctgatcttttctcccacctgctcctctcaggcagcccctggaattttgccttcac

SEQ ID NO: 9768 - DNA, 201 bp, Bos taurus
cacacttaatttctcacagttctgggggctgggaagtccaaggtcaaggggccagccaatctggttcctggtgaaggccctcttctggtttgtagacagccatcttctctgtgttcttatgcagtggaaagcagagaagtcatctttctcatgtctcttacaaaagcacgcatcctgtttatgagcacctcctaaaggccc

SEQ ID NO: 9769 - DNA, 201 bp, Bos taurus
ccttctgggttcttagatctcaaatctcctgttttcctaggactttctccttccctcccacctgctaaagacaaacaccagcaatagcaaacccaattaagggccaaggaaagggggatccagaggctgaaggaaagttgtttgtgaacacactgtgggctcaggacccgggatcctggaatccagttgcctttttgcagg

SEQ ID NO: 9770 - DNA, 201 bp, Bos taurus
ttcagaatatccctgatgtgatattgttgcccccactgtacttatgaggaaactgaggctctgagaggcaaaaagaagttgccctggttcaaaagaaagtaaaagcttctctcccagttttgtccttatttcccacagatgtcttccatgctcatagtcattggaaaagaccctgatgctgggaaagattgagagcaggaa

SEQ ID NO: 9771 - DNA, 201 bp, Bos taurus
ccccagccctgtggggaagcgaggctgccagggtacagaggagccctgtccctgctggtcccactggacacctgtctcctgagacagacaccaggcccccatctcctctggggcgtgacgtcaatcattaagtggcttctgagatgagctgggattgcgtgggttctgaggtgcgtgtgtgtgcacatggccctaggtgca

SEQ ID NO: 9772 - DNA, 201 bp, Bos taurus
tggtcctgatttgacaagtcgtatttcaatgcgaatgacttcactcttcctacatatattgtattgtaaaatttgataagatcacctctctcctctttcactggtccactggagcagtccggtgtttttgtagcatcttccaagtctgttaaaagaattcaatgttgtgataggtgtaccttaatctataatttgaggatc

SEQ ID NO: 9773 - DNA, 201 bp, Bos taurus
atgcagaacctgctgggagtcaggaaacctgaattctggtcctgactctgcctccagtttgctgtgtgaccttgggtgaggaactcccttctctgggccagttcctcatccaaaaaagtgaggggtttgacaaaaaaggaccaacactgtgtgattccactgggaatacttagaacaggtaaattcatagggacagaacgt

SEQ ID NO: 9774 - DNA, 201 bp, Bos taurus
gccatagcagggctgcacgacatgatgaatccagcagacggaaaggggagcccaggtgaactgatgctacagtcagtgcccttcttaacccataagagtgggaatcaggccaagaagcccaggccagagaaggaggtcctcactggaataagcagccccttcagaggtcctgaaacacagcagggttccttctgggaaggc

SEQ ID NO: 9775 - DNA, 201 bp, Bos taurus
acttataaagtaatgtttgaaaaatcaaagtgctttaccttaatttagctgaacgtagtattctggtaagtgaaacgcaatttccttccatgatacccttcccaactgtgggaatgatgcttttgcggcaagcaacatacaacgaacacgccaaccagtgtataacctctccctggcaggcaaaagataaaacagcaaaat

SEQ ID NO: 9776 - DNA, 201 bp, Bos taurus
gactcctcaggtcgtggaactttccagacaagaatactggagtggattgccatttcctgctctatgagatcgtcccacgaactgaaccctcatctcctgtctctcttgcaccggcctaacactgtgccttctgggaagtctgccacgtgtcactaccacgtctgaaaacattttcttaaatgacaaaccagttctggttgc

SEQ ID NO: 9777 - DNA, 201 bp, Bos taurus
ttggtgaatcccttccacagtgctggtgtagttacgtgccctggtgagtattgagctagctcagaggctgaggcctgtgtgcggctgtacctgccggcctgttcatagtattactttgtccgtggagctgtcatttcttcatgtttctgccactgtctttgttgcatctccttggccacactgtcccaccttctgttgggt

SEQ ID NO: 9778 - DNA, 201 bp, Bos taurus
ccttctgtaaaagataatgacggtaccttctcacgtgactgaaggagtttcatgcatctgaaatcttggcctagtgcttggcatctatccaaactggcccgtagttacacacttggactcattgcctttacttccattaactgaaaataataggagacttccctggtggtccggtggttgggaccgtgcactcccagtaca

SEQ ID NO: 9779 - DNA, 201 bp, Bos taurus
cttccagctgccaccgatgctagtgacttcctttgaaggcaaacacggcagtgtcagatactgcatcaaagccaccctccaccggccctggtccctgcccgtcggacaaagaaggcgtttactgttattgagcctgtggacagcaacacaccggctctgctggcccctcaagccggagctcgggaaaagatcgcccaatcc

SEQ ID NO: 9780 - DNA, 201 bp, Bos taurus
cccagccctgaggcatctttcctgagcacatagttgagccctcgctcagtggcagacgaatgtccgtgtcccgtccccacagtgtccctgcaaggcagaagttctggccccattataccaaatagaggctcagaggagcaaaagcacagtggcttggctgcggacccagggcctcctgaatactgcaggcctgccctgccc

SEQ ID NO: 9781 - DNA, 201 bp, Bos taurus
gcagcgtgcgtcatcccaagcccctggcggcgtggggtcccgcctggctgctccctgctctcccttggaacctctcaagctttctttcctttctttctgcgtctggcctgagtctctgtgaatctctccaaagcaccttgctctcgcccctcctgttgcttttctgttgctgagggaatctgttggggaaactttcagggt

SEQ ID NO: 9782 - DNA, 201 bp, Bos taurus
tctacagtttggttcttcactagaggcctgggtctcatggactgacatcaccaaacggacacctgggatcttcctccttcgcttatgtgcacccatccccccttcacaggccagcttcctgccttcgagacttgacctcccaatggttcctgaatccttccagctctcttcaagttcactggcaacatgctagtccaagac

SEQ ID NO: 9783 - DNA, 201 bp, Bos taurus
acagctgtcgcaaacacttctggagcacaaaggacctcaatcccttgagcctcatgttgcccgcccctaatccaggccctagcatttctcaggccaaccaccagaccttcagaggcacctataacttgagttcaaggtcagaaaactaagggggtggagggtgcagacctcaattcagatagtggccttgccttggtcagc

SEQ ID NO: 9784 - DNA, 201 bp, Bos taurus
gtggcatttctcccagcgctggggcactgggggcctttccctcaccaggtatttatgcagcccacccccctccgcttcctcacacaccatgaagggcctctgggacacacatacgagtccctactgtggtccatgtgtccaaactctgtgcacaccttctgccatcctctgccccttgcttttctgtgctcctggaacaat

SEQ ID NO: 9785 - DNA, 201 bp, Bos taurus
aatttccctcatctgtaaaatgaagtggtgattcaatctgatgacttctaagcctctttcatatagtcttcaaggggatcccagataatgtttccagtttttagttaggaaaactgaggcccagagaagcaagtgatttgttcaagttagggatggagtcctatggttaggcaccgtagtccaagtctctgaccttcatgg

SEQ ID NO: 9786 - DNA, 201 bp, Bos taurus
attgttcttctataatcgagtacttaggtggtttccaggttttgttcttggagataatattgctgtgaacttctttattcaggtagcatttccccctcacgtctgctgtagtaattatcaaatgattgcatatgcctggagaggggatgctggaaatggatttggtttggttgttgaggaaaaggagaagatattggaatc

SEQ ID NO: 9787 - DNA, 201 bp, Bos taurus
ctctcaggcctgaagctcagcaccgcttcagccttcagtttctgttcctacacattgcaatctgcttcctttgcagttgtctgcccttgaacccttcactcagcactctggcctgttttctccctctgttgactcctggagaaagagacatgaatgtgtagttttcaaccctcaccgatggtgagtaaggcttgaagagct

SEQ ID NO: 9788 - DNA, 201 bp, Bos taurus
caggggtagggcagggaggacacgtggggccagcgccaaatgtcccagggccactcgagtcctcgtccagctttgcccctccctgggcctctcttcccccactcactgctgtctaacaaatatatgaacagcgccatggaaactgtaaagtcctctggattcggccgtgtaaatgacaatggttactagagtggaaactta

SEQ ID NO: 9789 - DNA, 201 bp, Bos taurus
tttggaattatccccctatacatatttatttcctgttataacaatcatgggtccccaagaccacttccaggttggtgactttctaggaggactcaccggatttagtgtgtagttgtgttcatggctgtgagttattacagtgaaaggatataaagcaaaatgagcagagggaaaagaggcaagggctgcagtccagaggag

SEQ ID NO: 9790 - DNA, 201 bp, Bos taurus
cccccctgagttccgggcacgtggggtgggccggggaacctgctgggcacggacagtgggctagcgccttcttcaggagcatctggatgtcctcgtgtctcgcctgggcctcctcccacaggtcccggcccaggccctcccggctcagcgaggccacctgcagccccatggctgtgagcttctcggcaggaaactcggacg

SEQ ID NO: 9791 - DNA, 201 bp, Bos taurus
ttcgagtgggacctaaagactctgtttacctctcacggtcagaggcttgtagcctgggaggccttggcttttacacattggctcagctggccgcacactcgaaccatatatggagcagccagtaaaaaggaagaatgttctaagttaacatgattctgagctcttggccagagcactacctgctacaggcctgaaccccag

SEQ ID NO: 9792 - DNA, 201 bp, Bos taurus
tgggctacagtccaccgggtcagaaagggtcagacatgactgagcacatgcattatagatactgaattattattcttggcttctaaacacattgatcaacaggtatctctgaggaccccaagttccataagttccataaagatctatccaggctacatgctcattgccttcaagacaccagagatcctaagtcctctcgtc

SEQ ID NO: 9793 - DNA, 201 bp, Bos taurus
aattgaagagcaggattcaaatgcagatttgtctgactttaaagcctagccacagagttcccaaggctgctctcatcataacttttgggctctcttaaaacggatgggataaaggaccaggctggaggggaatgagtctgcactgaccattgactgagtccttgtggggaccccaaggagactaactgatcatttcttcct

SEQ ID NO: 9794 - DNA, 201 bp, Bos taurus
tgttgggtgcaagtcctcagtgacctctggacttgaacagccctaggggctggcccaggcatatttgggctcaaggcccagagaggacaaatcaaggtcatggaactggtgtgcagcaaagctgagggcaagatgtaggtgtctggatgccgagtctattcagttagacagcaaatggttagatgcttggccaagggtcaa

SEQ ID NO: 9795 - DNA, 201 bp, Bos taurus
atgttaggcatgaaaaagagggaattatgggctctatgtcttaaaacactccctcctcctttgcccccaagaggaagagtaggaggaagttccttttgctctggtgaacttcatacctgggagctccagcaagaacaccccggagcttgattaatgtcacctagcgttggaaagcccaggtgacccgtgcccaaccccttc

SEQ ID NO: 9796 - DNA, 201 bp, Bos taurus
ggggcggagggtaaaggccacatttcaaaagaagggtgctgtaatggtgggacgtgagaaattcctggaacctgagtaggagctagaaacttgcagagaagaccttacttcgttcgcatcaaaaacaggcagagttccgactgagtcgtacggacgcaggtggaccgcctccacgcctgtattgcgatgagatacgagtat

SEQ ID NO: 9797 - DNA, 201 bp, Bos taurus
ttaacctatagtgaaaaaaacaaatcggcagtaacctagggaggggacaaaaaggagtagggggaagttttgggtttttttcctggggaagtgttataaaggttcatgagaagattaaggggtaatgaatatgtctaccgtcttgattgtggtaatagtttacaggtgtatacttagtccaaaatttatcaaattgtacac

SEQ ID NO: 9798 - DNA, 201 bp, Bos taurus
cccatcttgaggcaccagtacatgcagaaatggagtatttcctgccgtatcagtaaacaaggatgtcacagtcaccagcgattgcagccaccacagatgacgggccagtgagccctgagggagctcaggaaggaaagaacacctgccatctagcagccgtcagactgcagccactccctatactgagccttgaagaagtgc

SEQ ID NO: 9799 - DNA, 201 bp, Bos taurus
ctccaacgtggctgttggcaggaggcctcagcatctcatgatgaggtctttccaaggctgactaagttgtcctcacagcatggcagctccttctccagagcgagtggcccagggagcaagatggagcctgcagtgtctgctgtgacccagcctcgcagggcacatgccctcctatgatgacacttggcagtcggtcctatt

SEQ ID NO: 9800 - DNA, 201 bp, Bos taurus
gaggtggcacactgaaccaccaggggcgcgcggccactaatcagccctacatgtatgttgagcaacagtgtcatcattagaatgacaggcctgtctccctttgtggaaacagcagtgtgggcgaggtagtgaggagcactgcccctgtggttctcaaggtctggggcccagtctaggctctaccacgagcttcccccggga

SEQ ID NO: 9801 - DNA, 201 bp, Bos taurus
tctcttcttcacatgcctcatgaaatcatcctggcctatgcctgctacctctttttacatttttgctatggatttctaactgatatcctaacttcattctcgtggccccctaacctttttaaagttgattataaactatttaaagtatacagacaattgtagagggtgatagaatcattaatctactacctaaatttgaca

SEQ ID NO: 9802 - DNA, 201 bp, Bos taurus
ggggtgggagggactggcaactctgagggaggaggcagaaggaccctgaggctggggcagcaaggaggacccagctggtccccacagggccagcttggctttgccttcccaggcagtgacttcaaagcccttcatcagaagtgagtcaagatgtgtcggtccctggaggtgtccctagccctcggaaggcctctgccaggg

SEQ ID NO: 9803 - DNA, 201 bp, Bos taurus
ttaaattagccatatccctatttttggatatttaggtagcttgcatgttttcttcagtgttataaataatactggtatcttcaaacatatagcctttctatatttaggaattttactttgagtacattcttagaattaccaccgagttaaatacataaactcttttttatttgtctggaaatctattgcctagttttgttt

SEQ ID NO: 9804 - DNA, 201 bp, Bos taurus
gagtggtcctgggaggcaggaaggccgtggcaggtcctttcatttccatggggaagggacttccacatactctctgcagttgtctgcaagtctaagaaaggatggagggagggaagggctggggcctcaggctagagcatggtgctgatgaagttccagccggtccgatctgcggggagtttcagggccgcagttgcccag

SEQ ID NO: 9805 - DNA, 201 bp, Bos taurus
ttactgccatttcactcctgcctagctatcccagagaaaggacacgatactggacactacctttagcactgcatcaggctcagctgaaacagccaggcaggtgtctcttcggattagatgagggaaggtccaaaaaagctggcaaagtgaaagctttctcatttgaacatcccgtgttccttacaagcaagacgaaaaagt

SEQ ID NO: 9806 - DNA, 201 bp, Bos taurus
tattctagtggccagtcaaggtgtgtcctactgcattactagctgacctgagatataataaaaacgctgaaaatatcagcaactgtgatttgctcctttggatgcctttccattccccaaagcaggccagattctgcaagttccttataccttttcattggaaaagaccctgaagctgggaaagattaaaggcaaaaaaag

SEQ ID NO: 9807 - DNA, 201 bp, Bos taurus
cattctcttacactcctgaccttgaattccatttctagcctgggcttcccccaggttctgacctccatatctctgtccctggccaagcaccctgatcctggctcctaattgctccctttgcttaactgcctgatttaatatccagatcctgaattggccttgggctctgactaattgcagcctagggctcggcagcagggg

SEQ ID NO: 9808 - DNA, 201 bp, Bos taurus
ccgttctctagctgtgactgtgtcctgaaaaactctgaatctgggagaaagatgatttaaacccgctttgttttccacacaaagttctgaaggtatttacatatttggcccctggtccttcagcatctgcagtgactggcactgccggcgtgttttcttcctagatcatttttattgccagtgtccactgttgctggaaga

SEQ ID NO: 9809 - DNA, 201 bp, Bos taurus
gctttggcccaccagggagtggagaagtttgccaaagtgtgcacatcttgggtgctggggtaagcagcccatggtaaaatgccatgcccctggtggtgagcgccaccgggtgtcccctggcctccttcctctagagaagcaaagactcaataacagaaccaagatggaacagcccctttccagtccagtgtctctccagcg

SEQ ID NO: 9810 - DNA, 201 bp, Bos taurus
tgaaggacaatttcactcctggcctcttttctggagccctagggctccaagtcttccatgttgcctgtcatcaatccctgaatgaatgtgagaagacctggtggccatgggttcttggccggtctttccaggatcccatctcactcctcctcacctgcctgccttccctccgttggctgcccttgcctccccagccaggac

SEQ ID NO: 9811 - DNA, 201 bp, Bos taurus
gactaagccacactcttgctcccgggaagaggactgctgctgctgctgctaagtcgcttcagtcgtgtccgactctgtgaccacccgacagcaaaaaaggggagactttgagaagaggccctgcagaaggattgttccagaatgtgtgagaaatctttggtctaacttcacttccctgttcttcagccaggctgtgtctgg

SEQ ID NO: 9812 - DNA, 201 bp, Bos taurus
ttgtggaaaacagtttttccacaggccgagggtagtggtgatgcgggcagaagatggtttcagtttcacccgccactcacctcctacagtgagcctgtcttctaacaggccacaggccggtaccagtccatggccagtgttgaggacccttgtcatacaggatatctgctcgcttttgcctccctgaaccttggaactcct

SEQ ID NO: 9813 - DNA, 201 bp, Bos taurus
ggacaaaggagagcagcctcatcaacccctagaagcccaggaaacgctcgctcacagtgcactcctgaaagataaccacggtggagcggcaggccgggtgcgctgaaaggaaggaccacaggtaaggaaaaggatccagaacaggtggacacactcccccagctggactggccagggagagctgggaagtgggtggagaga

SEQ ID NO: 9814 - DNA, 201 bp, Bos taurus
tttcaaaagtttgtctaacaacaccctaaatattttaagtaataattcattcatttccagtcttgactagtcacagccatccagagttctctggccagccggtgaccccatcaaactggtataatttctgcctaaggcaaagctgagtgttttaggtaacttgggtggcctgatggcagcttgttgaaatattaaatatag

SEQ ID NO: 9815 - DNA, 201 bp, Bos taurus
ccccacctggccccatggcacagaaagtgggcaatgccacccaggcttgcagtggtatgaaggtgaaggaggggtagcagtgggaacatgagactgcccacagtccccttggccagcccccaggccagagcatccattggaggggatggcatccgaagggaagagcatccaatgagggggccccctgcagagctgggaggc

SEQ ID NO: 9816 - DNA, 201 bp, Bos taurus
tcctgccaacttttgaccttgtgtatctcttgtcgtttttaaacctgaccctcagagtggagtgaaaaatttgtggaaatccaggggagatagaaaagcagtgctgtgaaatatagtaagggaagtgctttttcagccctgttggtagtactaatttatacagtcagtgtgagaataaggatgcttttgatttctgccttc

SEQ ID NO: 9817 - DNA, 201 bp, Bos taurus
gggcccgggagggctcctttgaagctcgctaccagcagccctttgaggacttccgcatctcccaggagcatctcgcagaccattttgacggtcgggatcgcaggtgaggggtgggggcaaggtggcctggaggagtggtcctgagaggctgggggttggccggccgccctcggttcccctcgcccgtccccccaggcttca

SEQ ID NO: 9818 - DNA, 201 bp, Bos taurus
gagaaagggacctgtgcaggaaccctctgccagcagggtctctccacctgggaactgaccgtgtagaccaggtaactctctgttctgggggccgcactgcgtgacgtttaaccacatccctgacctttatccactaggtgccagtggcacttccccccctgcccccttgtgacaatcaaaaaaccaaaaagtctcccgaca

SEQ ID NO: 9819 - DNA, 201 bp, Bos taurus
aggccagatgggccacctcctagcactctctttctccactattcatggcttcattcaccacttcaacgcacttacgctgtccctgaccctcttgtatatactccatccctatataattcaaggcctgtcattaattgatctctcaacaatatttttacaaattgtttacttacttatttttggctgagctgggtctttact

SEQ ID NO: 9820 - DNA, 201 bp, Bos taurus
ggtctccatcctctcctccaattcatttgaaatttaaaatcatgtttcttacttcaggaaagtattttctttcacatttgattttttttttaatgcttgcattgtttttttttcttcctgttgctgttcagttgtggcttgaccctcccgtggttctgagtgaattgcaggctcttactcctggctgttggtttcctttgc

SEQ ID NO: 9821 - DNA, 201 bp, Bos taurus
ttaaggccatgagcactgcccaatgggaagaaagagagggaatgaaccactgccctggggaatctcaaagcaaagttcaaacgccaacacttgcggtcctcggggaagactagcactgtctggggccagagccaactgcaggtctgggggaagggatggcgagggaggcgcctggggatcccactcactcactgtgattat

SEQ ID NO: 9822 - DNA, 201 bp, Bos taurus
aacctaagtttggccaccatccacaagacatgaaaaactgcagaaagcctttatgtaaaataaacacgaaaaaagctgacggtagtggcctctgaagactgtatgtgagagactccgggcagctttcttttgtcagcagaaattctctctacagcattcctctggaggtgtgctttccatcaggccatgtactgttaccaa

SEQ ID NO: 9823 - DNA, 201 bp, Bos taurus
tcccgctttctctctcttctggccttgagcatgagtaagctgcctgtgcagaggcagaagtggagcgaaggtcctctgagccctgctcctaggttcccccagaggccacctccccgccttcccctttccaaccagtctgccagccatcgacacgtctacactcaatgggcctattttctcacttcctcttccctttggaat

SEQ ID NO: 9824 - DNA, 201 bp, Bos taurus
cctggaatctgggggcggtggcttagttgcatagttccaatttagggtttttcatgaggttgcaatcaggatgtcggcctaggctgtgatcatctgaacacgtaactgtggctgggtgaactgctttcaggatggcgttctcacatggctgttggcaggaggcctcagtttctcactgtgcgctactgatgaggcctcctc

SEQ ID NO: 9825 - DNA, 201 bp, Bos taurus
gtagtatcctggtttcacactgtcacttgcaaaccaggctcttcctttcgacacaaaatgcccctttgctttgaagcccttgctggggccatctggcaccgcctttgctgagatgacactctttcatgcaccattcaccatcctcacccaagctccatcctctgaagcctggctcccagtctgccctccactctgagcatc

SEQ ID NO: 9826 - DNA, 201 bp, Bos taurus
agcagggccatccctcgtgaagactcacgttaactgaggttaggatactgacattaaaaaccagtataggagttttctctccagggccaagtttacctgacaatgtcctggaagagtctgctttcagtccaagggagacattccttgatgtttgaggatgccaggctgagacatgttcactgtgccgtagggccggtctga

SEQ ID NO: 9827 - DNA, 201 bp, Bos taurus
ggatggaggcaattatggccagcacgcttccattagggccctgccagccccaggtacaggcaacctctgcggggctggttaattatgacacaggacagccatggggagaggcccatgtggcaggctgggctgcagaacctctgaggccaagcgcattgcagttggtctttactctgggcctgctctgggggactccgtgcc

SEQ ID NO: 9828 - DNA, 201 bp, Bos taurus
gcgagatttactgttattattttttttttttcctgctagttcagaaatctgaccatcttggagggcagaggcttagtcggagctggggatctcagcacaggggggattcagcaccctgaagaggttcatatctgcatttagcattgtctggaacatgccccttccccgtctttccctgaaacatgtttgcttttaggagct

SEQ ID NO: 9829 - DNA, 201 bp, Bos taurus
ctaacactctcacttcactcacaacgcacttcaacatcaatgggatggaattctgagcaaggcattcacttcaattgtggaggttccatgacttgggttcgctattttgttcgtttggtcactcggtccttcaatattcaatcaacaggtattaactgagcatctactactcggtataaggccctagagatacaaaagtgg

SEQ ID NO: 9830 - DNA, 201 bp, Bos taurus
ccactggtccatgaaatcttcttgtgctcaaatgacattgtctacctttgtggtttttgccagaatcattcattgactctgagctctcactgaaatcagcggagatggaaaccagaagagggggtgtcctatccaactgctcagaggagaagttttggaagtttaagaatcaccatctacaactgccctaccttcattcta

SEQ ID NO: 9831 - DNA, 201 bp, Bos taurus
ggccaccagatttgaaataaatgacccaggctaacatcctgggctgtactttatctgccttatgactacacgagacacagatccccatctgtatacagtgactctggaaggcctggaggagatctagaaccagggcaataaatactggaggctttgggggcaaggtggggagaagtggaggagcaagaaagagcaggaact

SEQ ID NO: 9832 - DNA, 201 bp, Bos taurus
gctccatccttctcctggccacacagcaagataaagttatgcactgagctataactatgcctgagctggtggaaggaatgtatcccactcttagggccagctcataaaacctcatgtattgggttgctcaaagagtttttccttttttttttttttaaagcccaaacaaactttttggccaacccaatagaatccattcct

SEQ ID NO: 9833 - DNA, 201 bp, Bos taurus
agcctgcatgctgtgttactgaagagcttagagaagatgctgatatactgacagagagataaaagatgctggaaaaaaataaacccttgcaactgctaggcgtggccgcctgagctggtccagccctcccagttcctgagggagcacacccactccctgactcaccgtcctcctccgtctgcaccaccagctcctcgctct

SEQ ID NO: 9834 - DNA, 201 bp, Bos taurus
aaagggccaaggctgagagctggaggccgggctggggctccagccaacagaaggaagtctgatttacttctggacggttattaaggagtatttaatatctataaggaggccctctggtcaccatcagtgttccatgcatgccacaggcacatctgaagacaaaaaaactggcacaaatgatcccacaggtgtgcacctgtg

SEQ ID NO: 9835 - DNA, 201 bp, Bos taurus
tccaggagcactaagatgctacctaagaattcgggctatccagaggccaccatgctggacagttcacggttggtgctctgaccagtccagcagtgccttccaatcatccctgcccaggggccagtgcagctgaacccatcttgaaccatcctggccctacagaccagctgcccctccagcagaacacccgagtggcctctg

SEQ ID NO: 9836 - DNA, 201 bp, Bos taurus
ttgtgcattttaaatatatagaccctttgatcaccattatctactctccagagttcccatcagtctccaatgaggccccaaaggtgatatttttgtagctatgtgatgacgctgcccaattccttagtaaaattattcacatacaggccctggacagaattaagaccagcagacttcaatactttaaggcttgaacaagtg

SEQ ID NO: 9837 - DNA, 201 bp, Bos taurus
ggatgcggccgcccaaaagggagaaccacagtgggagtgggaaatgtcatgagaaactgcttcacatgcagtcaatcagccacgcagaacacaagtaagaacaatgaacaaggagtcctggaggccagtgaggggtcagaagcatgcagaacagagacaagaggagaaactggactccaagtagtcaaggggctaactccc

SEQ ID NO: 9838 - DNA, 201 bp, Bos taurus
gattgatttttttcaatgtgcatacttatacacaaatgcacccaaatcgataatggacaaaattgttgagagctctagtgtgagtcaaggccacagtaaagccaaggtcctagaagcttctacgtcatttatagacatcactttccatcaaagagcatggctaaaatgataaatctcagaaaaacaaagaaagatggccat

SEQ ID NO: 9839 - DNA, 201 bp, Bos taurus
ccaactcagccctgaggaccctggaaagtgagagagggccccttgggggtagccctgcccctccactgcccagaccagagcaggctgttccaatgggccacgctaggagtagagcccaagaggcaataagaatacctcctgctccaaaacacacaggttcagttcagtcgctcagttgtgaccgactctttgcgaccccat

SEQ ID NO: 9840 - DNA, 201 bp, Bos taurus
tcaattaacttaccttcacatgggcccccatcttgggtctgtttctagggaacccaaccccaaacaggaaagttcacattaaataatctcttctttccagctcctcttgaaaactgcttctttcccacaaggaagcctcagctcacctcgaagacttgctgccccactgaaacagtcaccaagaactgccactggtttatc

SEQ ID NO: 9841 - DNA, 201 bp, Bos taurus
attaaactttcccttccatttataatagtgcatagggatgtgagttttggagcccgtataaatatgtgctttagaattaaactggttcagcgattcttgacaatgatttcccagaaattaagcccagacaatttgtttggctggagcagagcatctgaaacactgcgtgatggaaaggcggtgaacgttgcccggagccca

SEQ ID NO: 9842 - DNA, 201 bp, Bos taurus
gagagaagagcctaatgctgatcaattttgtgtcatctactgcataaacagcttcatccaacaacttcacggcaccttttggaggcatgaagtattggccccttttcagaaatgaagagaatgagctccagagagatttgaagtagtgtcagaaatggcaccactaatatgcggtggcatcagaactgaaggccaggatat

SEQ ID NO: 9843 - DNA, 201 bp, Bos taurus
caaagtccttccagattttgacaactgatcatctgatggccctagcttttatctacttctgtaattttgttcccttagcaatactttcattaatgcctctgttgcattctctttttataaagggccacatcaaaccattgacactaattgcgctcaggataaactaaagcccctgatttatttcccacaagtgatgctgag

SEQ ID NO: 9844 - DNA, 201 bp, Bos taurus
gagcaaggggcctcaccttgggcccccagcagcacagagagtcaggatcctctggggctgctaagaaaaattacattgtcagagcccaggaggcaccaacgccaggcagggccacctcctccctcctctccagagccccatgcccttggcaacacgtctcctttggtttccaaggtcttcggcttcgttcagaccctgaca

SEQ ID NO: 9845 - DNA, 201 bp, Bos taurus
attctgatttgatttacatcttaagagtgtccgctaagagacaagtgtcgaacgtgatgagagagaggcccaaattcccccaacttcccagagccaagagtaagagcgctaatcatcagaaatggaaatagtattgtcaaagtacacaacttgctatgagttgtgaaacacccaaaggttctatctgttctaagactgcaa

SEQ ID NO: 9846 - DNA, 201 bp, Bos taurus
agtaccggtggctgagggtcttgaatccagacctcgtcaaagggccatggaccaaagaggaggaccagaaggtaacacctgggcctgggcctgccacaccgtggcattcacgcaccccggggaaggggtcaggggacatcccactggtgggtgctagggtgggaaacggggtggagagggtcccgctggcctcacggcgtc

SEQ ID NO: 9847 - DNA, 201 bp, Bos taurus
ttaatagtaaagaaatagtaacccaaagggtatatatggccatggttcggcttgggaaggtacatcagtgaacgacatttgggaaactccggctcaccccccagggtcacacctctgggcctttgctcatgctggtcccgctgcctgctcttccatgcagacctcactaggctcccgtggccttagtccgggctgaagtca

SEQ ID NO: 9848 - DNA, 201 bp, Bos taurus
tacaacaaaaataaataaaaacttattttaaagttccagtaaccatgctatcatgatatcggcacaaagatagacacctagatcaataaaaatgatattcctttggggagcgaatatagaaagaaatatgaaagttaagtttcttcaaggaacacatgtcacagacccaggtcatgtgacagcagatattactcagggctc

SEQ ID NO: 9849 - DNA, 201 bp, Bos taurus
tgagtgtccttaataactatagattcatctctttaaaaacaacatttttcaagcctgagccaagatgaagctgggccatcttgtcaaaaccagaaagtaaggaagccataacctaccaaggactgctaaggtcatttcagaaggacacagaagccaattagaaaagctcccacaggccaaagatgggacaacttgagccta

SEQ ID NO: 9850 - DNA, 201 bp, Bos taurus
aatgaatgagaaagtggatgaatgaataaataaataaataaatggatacctggatgggtagataggtagatgctttgatgaaccaatgtgatggtctagtgcatggacagatggatggatgggcatgatatggagagacagatgaatgaatgggacaaatgaatacataacagggaatatgggcagatgggcaggtggatg

SEQ ID NO: 9851 - DNA, 201 bp, Bos taurus
ccacttggcgccctggtgggtgcgggctggcagccgtgggaggggtgtcacaggcggggtgggacccaggcaggggagcgctgctgggagctggccccccatccagggtggtgggtctaagaagaggagttttcttaccttgggacctctgttacatcccactaactctgggttccctttacactatctgtgtttttattt

SEQ ID NO: 9852 - DNA, 201 bp, Bos taurus
aaaaagactaacaaacaaaaaaaagagtcttctctaacaccacagttcaaaagcatcaataccacataactaatgagaggcccatataaagcaggcaaactgcactgtgagagccctgagaatgtatatttcacaacaggaggggctttggctcttttgctcatcgtgttacttcaaggcctgatgcataacgggtgctca

SEQ ID NO: 9853 - DNA, 201 bp, Bos taurus
ccttgcaagaacatcctctcagatcattctctctctcccgagaggcagccttctgctccagagcggaggggtcatgtcctgcctgtgccagctgtggtagaagaaatccagtcgtcccacagacagttactaaccagcttttccagttttatctgctctgcatcttggcttttggagattcccggttcctccaacccctga

SEQ ID NO: 9854 - DNA, 201 bp, Bos taurus
taaaggaaggaaagggttttcatgagtgctcctcatgcagcctcagggtgcccttcacagatagattgaacttgggccatgggtggccttgaatgtcaaggcgaggaatcaggcaatgggcagtcatgggaggttttagagcagagggcagccttgagggtaactgtcaattaggcaagagttaactgtcaggtatgaaga

SEQ ID NO: 9855 - DNA, 201 bp, Bos taurus
agtatcactggtaggtaaatatatcctgacctagggaaaggttcaaggtcacacaatgagtaacaaagggttaatgtcctattttgcctcccaccatgaagctggttccatggctgctgccccattagctcactggtcatggaagagctcagcctatggtgggatcctgggcccatcttgagagcagctgctcctcactga

SEQ ID NO: 9856 - DNA, 201 bp, Bos taurus
caaaggcctctctgatttcctaatgaggtgacatttgagcagaggcaatgacgtaaggaaccatctcatccagaaatctggttgaagggcactgcaggcaaagagaacagataaaagggcccagaagtgggagtgtgtttagagtgtttgaggaacagcagggaagcctatgtggctgaaacaggatgaagaggtagaaag

SEQ ID NO: 9857 - DNA, 201 bp, Bos taurus
cgggggccagaatggcaccgggggtgggggtggtgggaagctccaggtccccttgagtcttatgggagggacaattaaagcaggttaacttcccctggaaggtgagtcttaacactctcttcagtgactccccagatcagggtagcttcctcctggcattcccagagggcagttagcacttagcccagggaccacagagcc

SEQ ID NO: 9858 - DNA, 201 bp, Bos taurus
cttactcccctctttgtggcctgtcccaccatgcagctggggtgtgagaagctcagtcactctcagcttacctcaggagccctcctggaaggccttctgtttctctgcagcccttcttgtcctcctgggcactgtgatggctggcaccctagtgggtgaaaccagcaaccaggcccagggtaagtttcagctcacctctcc

SEQ ID NO: 9859 - DNA, 201 bp, Bos taurus
acacgactgaagcgacttaacagcagcaacagcagcagcagaatcaataatgtatcaaatgggttgtgacatgacagtatcttgtcctgaccaggccacttacacgcttgtgtgctggggcaagtcatctgtagtttcctcatctaaacaggggaaacaacgagtcttgaatagaaagtgtttattcatatgttatggcca

SEQ ID NO: 9860 - DNA, 201 bp, Bos taurus
ttgttcctgtctttcagtttctctaaagaggccttcagggaccagggagctttctaattaatgaccacacttccatgagcaaggagagggggagctggagcgagaactggcccattacgaggcttgtggatctgggggacctgtaattaggaccatagtgaggaagaccaggagaggaggacattgagagagaaagataga

SEQ ID NO: 9861 - DNA, 201 bp, Bos taurus
gatcctgggcctggttcctggtttcacctaccagctgcccaggaagataagaagggctgtggagaagcagagccagatcatctttgtggcattgcaggagaaattctgaggaaagatgggggccgactgagctttttgcacccccatctgagggctcaaaagggccaaaaaagaggagagtaatggaagggaggagctggg

SEQ ID NO: 9862 - DNA, 201 bp, Bos taurus
agtgttcccatctgaaaaatgggagcatgtgagtaggctcagattatgatgacagggcttctagggggtggcctttcaccaagctggtccatggaggacacgctcaatccacagatactgctgccacttctcttgggaaacagcgaggaaaaaaatcacttttttggaaaggtgtgtggccttctgagcgccaccactttc

SEQ ID NO: 9863 - DNA, 201 bp, Bos taurus
gaggggtaggatcaggccacgaggaggggagtgggcaaagggaggagctgggtcagtcctgtttattgtgtgatctccctacctaaccacgtctcctgctgctctctgaaggggccaaatgtcaaaaaacagcagttctcagaccttccaatgcctgtggggtctcatgtaaacatagatagtgacctgacaggtgaaatt

SEQ ID NO: 9864 - DNA, 201 bp, Bos taurus
tacagcttctctccctgaggcagagaaattaaatataacacctgacttttccaggcagagacaaaataccttcaggccccacgaactgtcaagggtgtgggcacaaagtgtctttggtccaggactgacctgtcagagcacaaaggtagacaacatccctggagtcgctgggatgaagcagggccaggtagacagagctca

SEQ ID NO: 9865 - DNA, 201 bp, Bos taurus
aggataggaccaactgagcttctaggactcagcttattttccaaactaatcttgaagttatgtttgtacatcttttcacagaagactaaaaggaagtgggtttttctggaaaactctgaatgggatgtggctgggagtgggttgctggcgaagactcatgaggggaaattgatggcctggaaggggtgattggtccacctc

SEQ ID NO: 9866 - DNA, 201 bp, Bos taurus
ctcacaggacgttcatgcaaatgttcccgcagaaggttgaacagcatatggtattttgtggacagtgctggaagtatgaacagtggttcccacaagtaaattccgtgggccgcttcgtacaggctttagctttgagatctaaaaagagcaggagcagaagcagggtcaatggaaccaggtttctcagagaactcctctcga

SEQ ID NO: 9867 - DNA, 201 bp, Bos taurus
gccctcttaataaggcttatgtgcttctgcacagttcacctgactgtgaaatgggtatgattgccccttttgtacagatggagaaactgaggctcagaaaagctaagggattgcccacaggtccacagttccccaggcttcccaatccactctccactcccaggtgtggagtggagtggagagtcttgcgccaggtcctca

SEQ ID NO: 9868 - DNA, 201 bp, Bos taurus
tggacattggtgacgccatgggggcacctggcgggggtggtggtgctggtgagggaatcagagggaagtggagagggaaactggccatgagctaccgctgtccctcccaggcaagctcaggggtcctagaacccacgcccaccatagtaaccatggggaaaccgagaggccaggggcagcggattaacctgccaagatcat

SEQ ID NO: 9869 - DNA, 201 bp, Bos taurus
cattgccatggtgaccgggctgcagcctgttaattaagcccccggttaccacggagatgatggtggttgacgtgtctgcagcgggccctatgtgtgtgtgtgggggtgtgtgctctgccccagactcatcaattcatggcaagagcttgggttccagaggaggggccctcccagtgggggagagaagggtgaagaacggag

SEQ ID NO: 9870 - DNA, 201 bp, Bos taurus
aattcctgggagtagaagtccctatctgccttcagaacctctcggccaaggcaggaaaaaaccatacagcttccattttcccaggtgccatgatgaattacgggaaggatctgaaggccaagcatacctgctgataggcatcagacacactctgtactattcataaggagaataactagacaatagagtgcatccctattt

SEQ ID NO: 9871 - DNA, 201 bp, Bos taurus
ctggatcacggccggtaaggggtttccatccttctttcctgtctctgcacagacctagggctccggatccagagcgagggcaccttgaatacagacaccacttgtgtatgtgtcgaaggccaacactgtaccagtcacacctgcgaaagttgcacgccccacagcttgtgtctccctggcttcggggtcaagcagatcggt

SEQ ID NO: 9872 - DNA, 201 bp, Bos taurus
ggagggcagtcatggggctgcttggcttcgacagaggcctgtaccaccctggacccgcaggccatggtcattggtggccttttcaatctgagcctctatctcatcatttggaaaaggacttcaaaatcagaagaggtgatgggctttggatataggaagagccaggtgccagcgtctgctttgtcacccacttgttgcctg

SEQ ID NO: 9873 - DNA, 201 bp, Bos taurus
ggggccgcttctccagtgggtggtggggatgtgatctggggtctaaaaagaagacaagggctggaagcagctggagacagatgccatgcttgattatccagggtgagaggcccagtcagagacctgtgggctccctcggacctggggctccaaccagactgagcctcacaggagaataagagcagaaagtgttcttcttgt

SEQ ID NO: 9874 - DNA, 201 bp, Bos taurus
aggggatgcgcccacccagaatccacacaccatctcccagaccacccactctggaccctagaattttcttccagggctgttcgagcttcctccccagggcaatcctcccacgagcagatggcatcagcaaggtccacatgttgcagccccagagaaagccaagcacaggggtcaggtcagagctggcacataggcactggc

SEQ ID NO: 9875 - DNA, 201 bp, Bos taurus
gtaaggtagtcctcagcagggccaggttttgttcagcggagtttgcgacgccagagatgccggctggcagcttcaagagtggaaagccgactctttctcccgttagctgcccaaagggcggggccagcaccaggggcccaggccccttccgtctcgttgctctgccagtcctagtactgctcttaccacacagaccgcttc

SEQ ID NO: 9876 - DNA, 201 bp, Bos taurus
acttctacttctaaacacagaaatctaatattggccataaataagtgctaactgtaaaatattactaataaatattattaataagttctaactagacggtgtttcctgctagagtctcctggcctgggatctgcttgctctgcattagaaagagatttcaaagacagattagttccaaaccaacactttgccattcacata

SEQ ID NO: 9877 - DNA, 201 bp, Bos taurus
aaagatggtcacttcaagccgtgggaaagcagcttagaaagacgtgtgcgttcaagcctggcttgggcattttctagttatgtcactttggacatgttctggcctgccccgatgccccagttacctccaacactgtcgagtagatgagatcatgataagtaaagaggctcttagcctcataaacccagaaacgccttgtag

SEQ ID NO: 9878 - DNA, 201 bp, Bos taurus
gctttgagatagggactgtacctttttgtaagcgtttaaaatcctcttttcaattatattcattttaagtccccccaaacatttggtgtttgaatgtggaagtttccagagttcaactctaaatccggttttctacctggaaattgagataaaattagtgtccttgggctttgcttgggacttaggtctccctcgtagagt

SEQ ID NO: 9879 - DNA, 201 bp, Bos taurus
gcgggttcttatccatggtgccaccagggaagtcccaggatagctttttctaattggataattgggaatggtttcaccaaaggtgacagtcatttgatcccgaaggatgactaaaagtgtttcagtattgtaggtaagagagggatagaggggacatctaaaaagaaatacgtgacttaagggttaaatacaaatagtagc

SEQ ID NO: 9880 - DNA, 201 bp, Bos taurus
tctcgggtggttttcctgaacgattgcacagctgcttttctacagcagcatgtgatggctacagtctgtacccctcaccagcactgctggcccggcccccaaagaggagagaacccacggtgtgaatgagcaagtgactggacaagtactgaacatgattgttcttgccagtctaatggccgacacagattcgtgttttaa

SEQ ID NO: 9881 - DNA, 201 bp, Bos taurus
tctgcggccccaggtcaagctgtcttgtgcaaagcggcctcctgggtcctcgtgcccccaggcagtcctcttgtctctctccaggttctgggccaggaacgggggaagcacgtgaggtgttgtcgtccacagaccccagcacacgtattttaaagttaaacgagattcctagctccttcttccaagtgttgcttgcgtgat

SEQ ID NO: 9882 - DNA, 201 bp, Bos taurus
taacctctgtagccatcagatcgtctcagcccacagatattctagaggccaccatgttttcactatcatagacaaagctgcagtgaacattacgaggtgtgggtcactgggcatttgtctaagactctctcaggtctctagattacagctggaaattgtaaaggtggggacttggggacagggaggcaattgtttccctcc

SEQ ID NO: 9883 - DNA, 201 bp, Bos taurus
tttggaaaagtagaggaaagggggttggaactgtgagaacaaagctggagtctgtaaaccagggtctgacttaaatctgtgtctgggccgtgccatctcttatctggaccactgcccaagtctcctaactgggctttgggcatccatcctactccctcactctgtgcatcccacttggcagccagggctctttagatacat

SEQ ID NO: 9884 - DNA, 201 bp, Bos taurus
agccacccaatgacttctgtgcagagaaaggtgaccaagccatcctggtttgcctgggactttctggctttagaaccaaaagtcttaaaacctgagaacctgctcaatccaaggcacaccaggactggtggtcttcagactagctgatgaactgattagagaaagcaaggaatcagggcattgaccagactgtcactcgtg

SEQ ID NO: 9885 - DNA, 201 bp, Bos taurus
catatggccacaggcacctaagcccacgtgccacaactactgatcccgctctgcaactactgaacctgcacgcctggagtctacactctacgacaagagacgccacagcaaaaagaaggccacgcaccgcaacagagtagcccccgcgtgctgcaactagagagccccacgcaaagcagcaaggaccaagcgcagccaaaa

SEQ ID NO: 9886 - DNA, 201 bp, Bos taurus
aattggaaccaaggtcagggttcacattggacttactgaataaggcatttaacgtgcttgctatttttggcccagttgggcccaaacagctgaatgccaacaatgcagtggaacacggtgatatttggtacaatgaaaaaaaaaatctctgacgacgacattgtggcaaaaagcagaagagctggcctagattagaggcaa

SEQ ID NO: 9887 - DNA, 201 bp, Bos taurus
gtgttggcaaggagactgggattaaacacggcaaacctccgttggatctcagttccaccagctgagtggcgtagggcaagacatgccgcctcaatgagccccatttcatggggacaatcaaaataacactggctgccctgcagacctgggatggggcggaaatgcttctaaagctgtcaagtgtccacatgaaaagactta

SEQ ID NO: 9888 - DNA, 201 bp, Bos taurus
agcctgacggtgagagccacggccactcaggagcggcgctcccgaagccccctggatttgtccccccgcccccgaaggacaggcaagccacactctagaaacaagcagtcagtctatgtgggccacagcaaggacaaatggacgtctctccacctgggtatgtgggtttctgatttggacgaaaagtcgctggaaaccact

SEQ ID NO: 9889 - DNA, 201 bp, Bos taurus
ctgttacctcttgtggcctcatctccttcctcctcctgtctgtgttttaaaaggatgattctgacccctgtgggggacagcagatggaaatgggtcagagggcagcggggaggccccctgcagtgatgtgggcaggaaaggatactgtctggaccagggtggtggcgacagggagaggaacgagggatcatcatttcctct

SEQ ID NO: 9890 - DNA, 201 bp, Bos taurus
gggcctggggtccagaggagtgaggaaaatttcacttttcactgtacctttcggactttgaacttggtacctcctccaggggtgctcaattgaagggcttctgtccctcaggagacatctggccatgtctagagacattttttggctgtcacagctgaggagagggtgtccttggaatccagtgggtggaggccagggatg

SEQ ID NO: 9891 - DNA, 201 bp, Bos taurus
ggcctgactcaaactggctaatcaagtttcgttctgggattgcttctgaaattattgggaaataatttcatcagagactgctgagttgacaggatatccacgtataggggccagagagtaatttttggccctctggaaagaatttgcccaagaatacagccagtgtagagggactccatgctaagagacaaaggcaggttt

SEQ ID NO: 9892 - DNA, 201 bp, Bos taurus
cgggctgtcggtctcttgccactattgcctgaaagagcgcttgatttgtctacgcagagcagggcctggcaggccgtcagcatctgactgtggcccagtgccgctcctgcatagagcacacaggtgctggtagatgtcgtttcctgtgggtgtctctgtgggcacgtgtgcaccctcgtgcctgccctgctgaggccctca

SEQ ID NO: 9893 - DNA, 201 bp, Bos taurus
acccgctgacagggagccacgtgccagcttggggagcagcaggtcaagctggcggaaggtgtggaagacgtcggctgagtggacacggtcctgggcctggctctcctgggtgtgtggcggtgcctcaacgccgtactgggtcaggtagccggctctgggggcggcaagcagagggtcagcaggccgtctctgaatggtccc

SEQ ID NO: 9894 - DNA, 201 bp, Bos taurus
tccagggtggtagggaaacaagagggccttgtgaccctggcagggatgaatggctggctcctggggacacaccctgacccagatgaggcctccgcagctcaggaaaccacctcacactgagctgcattcaggagctgagatctcctctttcggctcctcttaccgtggatagaccagaccccccttcacatgtggccctga

SEQ ID NO: 9895 - DNA, 201 bp, Bos taurus
tgtggttgtgcagtaccccagtacttgtgccttgtggacccgcacaagtttggtcttcaatgtcatcttaaagtgggttgttcctgggcccgtctggcctcgtaactcggtagatgtggcatcccagcttgtgaaggacagttctggctgcgtgggcacttgatgccccatactcaggggctctgtctctgccacggccca

SEQ ID NO: 9896 - DNA, 201 bp, Bos taurus
gcctgacatcggaacaagaaaaagaaatggtgaaatggaagcattggctctcttgggctgctgcctacacaccaagttactggttagtgaaaagatggcccacatggctagttaaaaataatcctcttgctgccagcaggtcaagcagaatcaatccagaggactggggatgggccagacgaggcgcaaatttgcattcag

SEQ ID NO: 9897 - DNA, 201 bp, Bos taurus
gcgtggggggcgtggggccggcatgtgaaaagcaggtgatgagggcgtggtttggggggtgacctggtggggcacggggtcacctacttcctgaggcggcggggccatgggggacaggagaggaaaatgaggatctgtctgggaaacacggccgcagctgtgtcccatatgggaccccttccaccccatggccagctgcgg

SEQ ID NO: 9898 - DNA, 201 bp, Bos taurus
ccagccttctcctctgccttccaggtggcagggtggagaaggaaagacagtgagtagagggcaaacaatagctgaatctctaggaaggtttccagaaactgctacacatactcccaatcacagcctgggagtcggagcttggttgtatggctgcacccagctacaggggaagcgggagaaaactgtctttattctgcacgg

SEQ ID NO: 9899 - DNA, 201 bp, Bos taurus
gtggccctggcttgggacctccttctttcttctgatccaagcttcggacgagtggggacctgtgggaggcaggcgatgtcccagcgtggagtgctgtcccctgcttgggcctttgtgaacaccgatcaggttagaggtcccagagaggctggtctccctggtggctgtccagagagaaacacttcgtttctgatgaaatca

SEQ ID NO: 9900 - DNA, 201 bp, Bos taurus
ggtttgggttcatggacgtggacgtggagaaccccagtgggacagggaggccactggccgtgggcagctggtttggtgccctggcctggaaaagcatcttgttttacctgatctgttctgggatagccccagctgcagccaaatccatccactgaggtcctccccaaactctaccgttgctgccacaagccgcccttggcc

SEQ ID NO: 9901 - DNA, 201 bp, Bos taurus
cccaccctcaacccctatactgcacaagtctcactagtacttcatgtaggactcacaagaccaggctaaattcttcctattaggcagagtaatttcaaagtaaatgtgagatggcttaaatgcaggtaagacatgttctcaacgccaccttttctgattaggtaatctgcagcatattggatgtccacagaatttataatc

SEQ ID NO: 9902 - DNA, 201 bp, Bos taurus
ggtggtcccgagaacgcactgtgagaagcagctttatgtggtgggtcacgccctgccttcctctcacttctgaaaattggcatttatatcttttttcctcgctcatcatctgtctccatcgagagctagaccccatgctccatcagggtcaggattatgtgctgtccccctagtatctcccacactgtctggcacaaatag

SEQ ID NO: 9903 - DNA, 201 bp, Bos taurus
tggggtgagccgtgcagcgggcacaagtcatggcaggtccctgcagctcagaggaaggttgttaactttattctgagcaaagtggagccacaggagggcctgagccgggaggagcaggacccgtctggctgctgtgtggtcaagggggaggtggtaagaggtgctggtgtcggggttccgggggccgccgtgcaggtgggc

SEQ ID NO: 9904 - DNA, 201 bp, Bos taurus
tctgaggtgttaagagaagctgaaaatccagattcttctgtgaaatttctgaatttttaaattgttgaaccgagtccattaaacagtagacaatggactggaggccgccgtcttgtaacttctattctctaagtttagatttaggaggttgatgagagccagggcaggagttttgtttgttatttccctgctcccacgggg

SEQ ID NO: 9905 - DNA, 201 bp, Bos taurus
cccacaccccacaggagacacacacacaccacagtgaagaatccgcgcagccaaaacagagacagatggcagctacccaggtgcgactagggccgtccccactcgcttctgttggcaataatctccagcagaagagggaagctgaagcccgctccctacagacccacacccagcctgtgtgtccagacctgggagggcctg

SEQ ID NO: 9906 - DNA, 201 bp, Bos taurus
tgccaggaaggacccttctcccagacaagaaaccaacctgggccttactcgttcaggtaagtaaatcgagctctcagaggacacgtggacagtcggctgacgtcttctgggcgcctaccatggcccagcactttcagacccttgagctccttttacggcccaaataccaccaaacccccttttacagatggggaaaccaag

SEQ ID NO: 9907 - DNA, 201 bp, Bos taurus
cacttgctctgcagcaagcttgacttgcagcagcagctccacagagcccagcacggtgaccagctccctggagaaagcccgacaggcctcacattaaacagatccccttctaagccagcgcgcacggggcgtggcttaaagaccacactcagcactgagatcacgcccaccggcctcagttccaggaggccgactgtcaac

SEQ ID NO: 9908 - DNA, 201 bp, Bos taurus
gaaacaacacatctttctaagctgctgagtttgggggtgacctgttacacggccacagaaaatgcacgcaggcacccaccccccattccacacaagggacgggctccagaacgtgcttccagggcccgtttccacgtcccacgcggcacatacctcttcctccagccagtcattgtactgcacgatgcctgccatgaccac

SEQ ID NO: 9909 - DNA, 201 bp, Bos taurus
cgactctgatttaacttgcaaataaaaggctcctccacgcaccaaatggtgatccgcacacaccaggaaggcactggccactacgaggggctcggccagcgtttgcactgggtccggctgttaagcatccccacgttgcccatatggaaaagcttcccattgtacagtgtttatctccagcctcctccccataggcccttt

SEQ ID NO: 9910 - DNA, 201 bp, Bos taurus
aaagacatgagacagaataaggccacgtaaggccaaggcaggagatacaaagctctaagccaaggatgctggacccaacagaaggcagcaagcaggctgcatgggccacactcaccttggagcctccaagagaaaatgaccctgctgctcctcagcctcaggggtccagcctccaggagagtgcagacagacttgtcttgg

SEQ ID NO: 9911 - DNA, 201 bp, Bos taurus
tacagacaggcggcagacacacaggtaaatacatgccgtgcagggaacagatgattacagagtgaccggaggcagaggccacctgagttcatgggttcatgagtccagagctgctgatgcgcggaggaagaatgcttcacaaacagccagggccctgaggctggaatgagcttggacaagttgaagatcagaaatgaggcc

SEQ ID NO: 9912 - DNA, 201 bp, Bos taurus
ggccatatctggggacgtttcgggtggtcacgactggggagatgcgaccagcatttagtgggcgtagaagccaggaacattgccagcagcctacggtgccggaagtggcccctcagcaagggccagctggcccaaacgccgagagtgctgaggttgaggcacacggcttacgggaaggcacgtaggtgacagttttctgtt

SEQ ID NO: 9913 - DNA, 201 bp, Bos taurus
agaagctccagtttcctttactcacagcctggagtcatttccgttgcctgtgctttaactaaagctgaggggtcagagacgcagaggcctgggacttacctgtgtgggagcgcaggtgcacggtgagctggctggagttgcggctggcgtaggggcagagctggcacttgtagggccgctcgtccgagtggatgcgcaggt

SEQ ID NO: 9914 - DNA, 201 bp, Bos taurus
gcctccgactcactggctggccccacaggtggacgttcctgaaggtaaaggaacgttttcccagaacaagcgttctgaacgtctagctgtgcggctgggtgtggcaggcctggactcctcagttatcctacctgctcgtgagaaaaacgcgtttcctgttcctttccggtgacactgaaatcacccagcccactgtcatcc

SEQ ID NO: 9915 - DNA, 201 bp, Bos taurus
ggccttttgttacacagcgtcactgtgacattagatagctgatacatgtatcagcgtccagaagcacagcgctgccttaacaggaaactgaaatacgtagcgctgactgtgggcctgggcggcaggcagaagcagggaacagtggcaatggccagcaccgaacggcgaacgtttggtaaaactgccgcctgttgtgactca

SEQ ID NO: 9916 - DNA, 201 bp, Bos taurus
gcacgtgaggcgcgggcccctgtgcgttcactccacacacaaccactgccgggaatatgatgctgcgggtcaaatgcagcccctgacctcgtggcgcttacgcttcagcagtgggacaggccttaaatttgttctgcaaacaatcatttaattacggggacctgatctgagagaacaatgcccatgtgtgtggtctcagag

SEQ ID NO: 9917 - DNA, 201 bp, Bos taurus
aattacacggaaaaaggcaagtcagcctgacaagtactgaggctcaactaatgttagctctcatgatttactacttctatatgcacaggccctgaattcatattctctaactttgatttcttacaaccatcatgtactctgaggcaaaaaatcttcaaagtgaaatcactccttatgaatggaatcaagtaaggccaaagt

SEQ ID NO: 9918 - DNA, 201 bp, Bos taurus
tcccagaaggcacctctgtgtgtctcattggtcaggattggccacatgaccagcacttgccacaaaggaggctgggaaggtgattccttggtcttttcagtctctgggtgggaggtgggtcaggccattgggaacaggcacacagagccacagtgttcctgtatctggtgcatctcacccttttaaaatattttgtagcag

SEQ ID NO: 9919 - DNA, 201 bp, Bos taurus
gtctttctatatttccctgccagattttcagtggaggaggagagagtgttttataattattagtattattttatcgtcacatatatatctcagttaatgccgacatgattgttcttgctgttgtaatctgaattaggaattttcacggctgggtgttgatcattcatgtaattgtacgacgcagggaaaacaattccctct

SEQ ID NO: 9920 - DNA, 201 bp, Bos taurus
gggactcctgaggctcgatcccgcctttgcgtatgtcgagcctccttcctcatgacctttgccacgggccgagtgcctcactctggcccccaacaagggaggagtgaggaaacaaaactgagcagagacagagggggagtcgcgaggcaggtgtgtgacgtcttggccaaccccagtaggcacaggtggcatgtgtattgc

SEQ ID NO: 9921 - DNA, 201 bp, Bos taurus
aaggaagctagcccacatgaaagaaatgttgaaatggcatgggttcttggacgatgttgttgaggaaattaataaatccagacgtgaccatgcctctagatttcgagttatagaaaaacatcatttcccttatttcaagtcacagggggttaatgttgtgcttgcagtgaatgcagctcctgtaagcggtgtgtcctggcc

SEQ ID NO: 9922 - DNA, 201 bp, Bos taurus
agtggtcagcagggactacttaattgcagttaagcctgtgctgttcattgtggcattgaaaatagagcagcgtgtaatgtggttaaactttctgcctctccgggcccagatgggtgggtggaactcattttttttttttttttggaaacttttaacctggtagcacttatactgaattaagttttactggctatcagcttt

SEQ ID NO: 9923 - DNA, 201 bp, Bos taurus
ctttgctcactcattttcctctgagagaaaccatttccctttttatataaataatgtaaaaatttggagataaagtacgtggggcatagggaaggtgaaatgcagcctttacaatgtaaagtgctttctccctggccctagttcattagtgaaatctagtgatttgagttacccagctaacctcttccgccactgtaggat

SEQ ID NO: 9924 - DNA, 201 bp, Bos taurus
tcctgctaagtgcagattccctagacttgtgacggggaatagaaagaagcagcaaaaaattatagtacagccaggaagaaatttgagttccagtttggctacctagagtctgagtgtctgtaggcaggttaagcaggccctctgagtgttcccttggcagaaagacagacaataaggacgtctcagaaaattctcgatgct

SEQ ID NO: 9925 - DNA, 201 bp, Bos taurus
agaggagcctggtgggccattgttacaaaaaaacaaccataccaatatatatatttttttaaacaaatggatgtgtctgtcttccaatagaatgttatttataaaaccagctggtgggccagcatgctgtagttttccaaccccttatcgacatcatgaaaatcagaaaacactaaaaatcagaacttcttttcaggttgt

SEQ ID NO: 9926 - DNA, 201 bp, Bos taurus
cagggtgttccccctaggcagcaaccaggttacccagcctgggtagaccatgcaaggggtttggaccgtcctttttgtgcagtgagagagcatagatgcgcttcaggcaggcaaagcctcaaggccgttctgcatggagactgaaacaccccctctgtgttttcggcaagtcacccaaacccctcctggccttagttccct

SEQ ID NO: 9927 - DNA, 201 bp, Bos taurus
gtcacaaaccccattctcactgaagcccccctgccccagagtggaggcagtcaaagagatatgtaattattctggccttctgcttaaattattttatgcctcgggtatgtatttatttgcctgcagcgatttcagaagcatggacaatgcacagatttcactaagagtcactggtgttttcaaatcatggccagcaacttc

SEQ ID NO: 9928 - DNA, 201 bp, Bos taurus
tttcaccatcatcacatcatcacccctacatctagaatgtgatttcttcatgagaatatatgccagctctcttcttaatctctgcattcttcttgcacagtgcagagtaactgctcaggaaacatttatagaacaaatgaatgatggaaaggaaagtttaaagagccggcagaatagaatacacttatcattgcgtggtta

SEQ ID NO: 9929 - DNA, 201 bp, Bos taurus
aaaatgtgttactggcagattcctctcttgctttcttaagcatggtttgtccagctcacactatattgaaagaaaagctgaaatacatctattgaacgtacgtgtgagcttgggctttcatgacacctgtttatttgctatacaatgttttacattttatgtaacttgctattatgctttcctggtccttccaaaaaaaaa

SEQ ID NO: 9930 - DNA, 201 bp, Bos taurus
tcatgggcccagaatccagtaaaaagcagttttattggcaggaatgctaacatccacttacactgtagcccgaggaatcatgagcggcccatagaagtgaaacatacccttcccttctcgctgaagcctgggtatttggaatccatggaaatgagagtctcagggctgtaagtatacaggaccaactcttagcagatttgc

SEQ ID NO: 9931 - DNA, 201 bp, Bos taurus
ctgttgtaacaattatttactctgaacttcagagatcttgaagaagtgggaagtaaccttaagcaggtaattgacagatttgacagacacttaaaaaactatttggaaaacattattttgcactttgaaggatcctaaatctgctctatgacatcgtattccatttttctctttcagacctctctttcctaaactgcatct

SEQ ID NO: 9932 - DNA, 201 bp, Bos taurus
gggtttcaccaggtgcttttattaagggccctgtgttttttataaagagaaatgataggattcggacaggaagggaaaacgggacacagaagctgatgtttatcgaggccacttctttctagactccaggggtgggtgcttaacttcagttgtcctccatttcatgatttatttgggaaattcctgaagtgagagcgaagg

SEQ ID NO: 9933 - DNA, 201 bp, Bos taurus
ctgtcaccgcttttaaaatctgagttccacgtgagcaaggatgtagcctgttctgttcactgccgtgtctgcagtgcagcgcctggcacttcagcaggcattgaatgaacgtttgttgaacggctacataaatgatccagggggcatagtgccctgaagtgcctgaaagcattcagagggctgctacggccttgcctagtc

SEQ ID NO: 9934 - DNA, 201 bp, Bos taurus
aacataattaaataaaataagaaccgaagctctcaggccagtggcctggaagcactaaatcatgctaacaccagtggacccagaatcaggtccttcacctaaggccactgatgccttggctgcagccgcatgaggggtgccgagccagaggctcccagacaagtggtcactcccgatcgtaggatcggtgctgttctcagc

SEQ ID NO: 9935 - DNA, 201 bp, Bos taurus
agatgctatgtgtctaacacactacttcatacgctgtaaatattttaaaacatacacagaccagctaggcatccagacccagacaaagagcccaggccacgcgggctcgttaattttaaaggcagcgcaaggtgtcctggacaaacgattttcaaagtacatcctgccctgccagaatgcacaatcagcacctcggagcat

SEQ ID NO: 9936 - DNA, 201 bp, Bos taurus
attttcctttgaatgagaattggggaatttaacacatggaatgtaagtacgataattaaaggtgtggattttgcatgaaaaggtttgtgtttacatctcaacaccaaagcttcctagctctgagaccttgacctgtctttcctgttccggaaacaagagcaacattactaactgcccgtgggggttctgcgagaagtcatt

SEQ ID NO: 9937 - DNA, 201 bp, Bos taurus
ggccgggtgtgcaagtggagacaccctgagcagcgtccgcgggtggggaggagctgctgtgctgaggagcagaggagactggtttccccaccggagtccgagaatccgtgggcctggggactcccagggactgccgtgcaacgtggacaatcctagatcttcagacccgtggggagcctctgagacttttttttaagttag

SEQ ID NO: 9938 - DNA, 201 bp, Bos taurus
tggatgactgttccacaaatgctggaagcctcagcctcataaatccttggcccacaaagaccttttatgaagacgcaccgcccacggatggctcggcagtacttcctgcggtgttccccaggcctgctcgcggtgtgtctcccactgctcctcccctatcatttcctgctgtgtatacctctctacttcccttattgcaga

SEQ ID NO: 9939 - DNA, 201 bp, Bos taurus
acgaagcgctgacagtggtgttatttgcctgaagaaacggccaccgcctgtcccgtgactgtcttcaggtgactgacacctgtgtgagccggtcagtagccgagagccacagggccctcagagtcctcacgctcagaccctgccccgccgctctgccaggctagtcatccagttccccgttttgcagtaggttatgaaatc

SEQ ID NO: 9940 - DNA, 201 bp, Bos taurus
gaaaggaaaaatggaggttggcccaaaatataaatgaaagtggtaccgacagtttggggctgcaaagagtctgtatcttagaacgtctgtgtttttctacagcaggccttcacctggtatttttaatctggcatgttcaccacttctcgtggtttctttagaagggcttttatatttcctctgaatgatggatgtgtcaaa

SEQ ID NO: 9941 - DNA, 201 bp, Bos taurus
ttgtgcatgaaaagtttggccagttttaggtggtcatgatcgtctctaggcatctttgtgaaatttatcttacacggccgtctcttcctaagtttaagaatattcagtgtgatttcactcgtggtggtggtagtggtggtggtttactttctaactcttgtctgactcttttgtgaccccatggactgtagcctgccaagg

SEQ ID NO: 9942 - DNA, 201 bp, Bos taurus
taaatagagtagtatagcaggtatagtagtataacataataaacgtaacagtttagtggtgggataagtataggataataagtatagtgacggccgcatcactgattcctgctcgtcccccccgtctccctcttcaggggtcttagccgcatccctgattcctgctcgttcccccccgtctctcttcaggggtcttagtaa

SEQ ID NO: 9943 - DNA, 201 bp, Bos taurus
tggctgccttttatcgtttacatctcagctttgccacgagaaaccttcactgactgccccgcctaaaatcccctcaccgcgctggtcactgtcccccaccctgactggccttctccccgggaagcacagtggccactcgcgtgtttcctgtctgccttgctgactgcggggtgctctccttggaggtgaggtcacgctccc

SEQ ID NO: 9944 - DNA, 201 bp, Bos taurus
cccctaacggggatagtggttcattctactgcctctggaagggaagcttgaccagtatccttgcaatgtatggacagccaaggtggcctggatgccatccggggtcttgctccctgtgaaagcccagctgtgtgcacggctggcaacaagctgcccagcggccgttcccatgttcatcatgagggtagatatgcttctact

SEQ ID NO: 9945 - DNA, 201 bp, Bos taurus
aaaaattgtaatgacttgagatggagtgataactccacatattagtctgcttgttgtctgtatgtttaaccacccaaggccacattgaaggaaaacagccgaacagtccaaaaggctgataaggagacagacacacgactccctgcttggagaggctgctttattttctcagaggccagaggatggaaagatgttagatgg

SEQ ID NO: 9946 - DNA, 201 bp, Bos taurus
agtcatttgaggcagtattttcctggagaaggagcttaaggcctgggtccctttggaaattcttatttcacaggaatgtaaactaccaaggaatgaagacctgagaaatgaaaggcctttggaatcctgatacaagaatacacagcaaacacttgactgaaccccttgaattgctgtgcgcacactcggagcacagaatac

SEQ ID NO: 9947 - DNA, 201 bp, Bos taurus
aggccccagtcggtttgcaagctaccacggggcaccctgctgacttctgagcaaaattaattgcatgaatccggcaaggctccaaacattggccatgcccgccttcattacagcaatctctgctgtcacttcttaatcaacactgcctccatgatctgatagatggtactttgcttgcatttagagagggattggtgcaaa

SEQ ID NO: 9948 - DNA, 201 bp, Bos taurus
cagaacaaagaacaccctcaaggtctgggcctgagccacagaaaggggaagtcgccgtttactgagaaggggatatctgggggagggttttgggaaatccgagctcagattggccatgttcagtccgagaggcctaatgatgtcttgaaggcaattggtcatatagatctggaactctggaaactagagcttgggaaaaaa

SEQ ID NO: 9949 - DNA, 201 bp, Bos taurus
ctacagtaaataagtaaacaaatcctaaaaaaaaagactacattcccagaaaaggtttaaactgcagttaagtcaggtattaaacccagattcaggattatggcctttaccaccactgatgccattttgagcctgtggtcttctctttaacaacacactggcttctcccttccgccctccagttttctatgagtgcctccc

SEQ ID NO: 9950 - DNA, 201 bp, Bos taurus
tcctgggtcttcaacatgcagattgtagtccatgggacttctcttagcctccataatcacatgagccaattcctatggtaattcaatctctctctatagatagattttttcctgattgtcaggaaaaccctggctactagtagaaatgttgagaaacagaattttaaagatgagatttcttattatttattgaagtgtagt

SEQ ID NO: 9951 - DNA, 201 bp, Bos taurus
tcactctctgtgcacctgctggcactacgggcatttgtggttgtgagcctgggtgggcagcattcctgggacttggaccttcttgccaagccttgctccatggccgtcatgaactagatcctcccctaaaggctagtccaacgcccccaacctgtttgtaacttgcttctgcttcctcctttttggatgcctgatcattca

SEQ ID NO: 9952 - DNA, 201 bp, Bos taurus
agagctcagtcactgtttcagccagtgggaacaggacaaggtgagaccctgaagacccacaggttccttctgcctgtggaccacaggccacatctcacagtatcgcccttggaaacatcacctttgcttggatgggcaagtgtcaggtaaaattccactctgaaaaggacagggagaatgaaaacgcagtgaggaagatga

SEQ ID NO: 9953 - DNA, 201 bp, Bos taurus
ttcttataaatgtggataagcaaaagcgtgtgctaactgtgctgttacaggaaatgtagatgaggtggtgtcaggcactgctgggtccaggctctcaccctagggcttggtcctttatactgccttcatttctaagcaggtgtcatcctcaaggagccagtgtatcccccagcatcccaggctttgttctgaggagcaggt

SEQ ID NO: 9954 - DNA, 201 bp, Bos taurus
tcctcgaaaataactttcaagcatggcttttcccctgggaacacttacagctcagaatcctaatcccaggctggaaatagccacaaagtgatttgggtttgcccagagaagaggcactgtgaccatttggggaccatgcaggcccctggctgttaacagtctgtttgctcagtgggtctaaggctcagtgaggattatgga

SEQ ID NO: 9955 - DNA, 201 bp, Bos taurus
tgtagcagccacatttggggcattaccccaccccaccccctgcacctttcaaagcttcatgaggaagcctctgcccccatggccggtctctggcccttaacgtcttgtccatgcgagctgccctgtgtctggaagggcagaggataattagaagggacccagaggcgctggcctggcactgcgggcagcagcctggcctct

SEQ ID NO: 9956 - DNA, 201 bp, Bos taurus
tggcagcaaaggggtatttggatgcagaagagcaggagaggtgaccttggaggcagagttgtggagtgaggcagcctcaagccagggagtgctggccactagacacagcaaagaacaaactctcccccggaccctccggaaggaactatctgttattttagcccataagacttagtttggacttctggcctttagagctgg

SEQ ID NO: 9957 - DNA, 201 bp, Bos taurus
gggggctgtgccctgggggccaggggccaggcttccccttctttggagaaacagcacctggagcagcaggtagatggcctggccactcacctggagaagcgtgatttcccggaacgtcctctggaaggagacagaaacatgagtgtgggtatggaggaagaaggaaggccctgtccggagaggatgcgaaaggacagacgc

SEQ ID NO: 9958 - DNA, 201 bp, Bos taurus
ccccccaccaggccatggccctgcacatgcgtgttaaatgccttccgagctccttgtgcatgctgccccagggtaccccatttgggaggctgagcagggagggctgatcgggaggggccgtgttgcaactgccctcttgtgcttgctttttaatgctgcacgcaagatgaggagcttgaagtcctcctgcgccctggagac

SEQ ID NO: 9959 - DNA, 201 bp, Bos taurus
tgagtgggacaggaggggcccccacactcttcagggcctgccgcggccccctcgggctgctccctctggagacaggccttccacttgggccggagatcgcgggtgtttgcacgtgacccttggctgagcgttttctctcctggatcgtcagtgccgcagctcaggcctggccaagcagagcaggcacagggtccagtcccc

SEQ ID NO: 9960 - DNA, 201 bp, Bos taurus
acgttcacctggagggaagggacggtgattccacaggggacccccaccccccacctggaagcccggggcagccggcgaagttccgaacagaggaggttgtcgccatgtgggaccaggaaaggctccacagaggggacatccctcaagggacaacccaggccacatggcccaggaggagctgagaggtgggaggtgccttcc

SEQ ID NO: 9961 - DNA, 201 bp, Bos taurus
gggactatttccctggaccaagaggccggtaaggtaggtgcggtccagagactttggctactcgtggggcctggtccagaatcagcagactgagtggcccgtgagtgaagtctttgacagacctgggagtaagcattcccggcaccgaggggcaaaatggtcacgaaatgcccccaaaccgtggccaacctgtggctgtga

SEQ ID NO: 9962 - DNA, 201 bp, Bos taurus
ggggacccggagcacctcccctcctgagcctcggcccagggcggagcaccccccacggggaggggctgacatgtgaacaccatggcctggagccctgctcggtggacgtggctgctctcagcacctcagtacttccctctggaccttgggtcctgcagaggccttccaggcgccagcgctggggatcctcgtccttggctt

SEQ ID NO: 9963 - DNA, 201 bp, Bos taurus
ccaggaaaggataatggttaccgtggtcactccacccctcctgctaacgtggaagctttcctgtctcctgcacctcttgccatctgcatcctgagttggttctctgcagagaagaggacctcagaccctctcaataccaccagcaagccaccgggcagcctggagagctggggttttgattaagacttttctgcctcagaa

SEQ ID NO: 9964 - DNA, 201 bp, Bos taurus
cagagagcttgggaggccctggcccgcactaaggcagttcgtctacctgtagcctcctgtgacccaccacccactctgggccgctctgtgatgggactcatgtgtcgtcttatacaataacagagtgcaccttagcaatgtccgttcttgatggtgtgcggccatcgccacctgattccagaactttttcacactggcaca

SEQ ID NO: 9965 - DNA, 201 bp, Bos taurus
ctggaatcaggccccaggcaaagccacctcaggacaaagaggactgaaagcgtgagggtctgttgccaagggactttgacaagaagagcctctgaagggcggactgcaggatggccccaggaggaaggtgtgtgacacgggcggtgagccaggaagccggtcgatacaggactgatggtgaaaccgtttcatatcaagcaa

SEQ ID NO: 9966 - DNA, 201 bp, Bos taurus
gtggggcttcgtcctcattcactgctccctcgctttcctgccaagatgggtgaacctcttccgagccagctgccccggacttcatgggccaagagtggccgcagtgctcagacaggactcagatcctgaccatcaccccccagggctccaagcggtgtgacttcacaggggtcgcgagtgacgggccggggctccggtggg

SEQ ID NO: 9967 - DNA, 201 bp, Bos taurus
cctcagacgggagacaaacgatgatgtaggaagcatgtaggtggcggtcaggactgggctccggtctgggctccgctaggccttgtcccgttcctcagcatgatttaatcagcttctctgtccctcggtgtcctcacccgtgaaaacagggttgcggccatgagtcctgtctggtccacctaatgccgctacttcgaggac

SEQ ID NO: 9968 - DNA, 201 bp, Bos taurus
ggcagacccctcagctccccaaaccccagtccaggagccgcccttgtcctggtgggagttcccatggctccttccatgtcagcacacccctaaagccgcttggtcggccaagaggtttccaacagtgaagtctgcccaagctttagaaggttccggaactctgccatggagggagcagagtcctctagcctcgggcttcgt

SEQ ID NO: 9969 - DNA, 201 bp, Bos taurus
acaggaagccaccctcaggggccatggctcagagtcgttaggtgggcagacacacagatgtagcttcagggagggaaagagcccagagctggacagtggcagagcaggaactgtcccagccagaagggtctctgggactctggacctggggcggagtggtgaggagtcgcctggggggactgctaacaatgcgtctcgttg

SEQ ID NO: 9970 - DNA, 201 bp, Bos taurus
tgtgtgtgtggctgacacatggtaatacataattggggaaaaggtagatcacttactaagtagtacaggaagtgtgggcagtgtttgcagaaataaaatcagcttcccactctccactgtattagctaaattaactccagaggaattcagtacctcagtgagaacggtgaaacgatcaagctggtttttaaaatgcagaat

SEQ ID NO: 9971 - DNA, 201 bp, Bos taurus
ccccttcccaccccttcccagcagccttccaggtcagcctcacacaccttcattccttcccattgtctgctgcctcaggcccacccactgtgtgcaaacttcagggcggggagcacccaacagagctaccactctctcacttggcgacccggctggggccacctctgagccagcgaggctgcctgtcccaacagggctact

SEQ ID NO: 9972 - DNA, 201 bp, Bos taurus
ttatgtatcagaaaaaaagttttcttttatgaaaagagcaaaataattttgacacctgaagactgtagggttcctttttcctctctgttttatgctttttcgaaaagtttgaattgaactatacttggatttttttttaatgtgcttaaaacctttgaccaaaatatgattttatgtggatgtgtgtgtaaaacactacca

SEQ ID NO: 9973 - DNA, 201 bp, Bos taurus
gctcatgggtacagagttctccagggcagctgtcacatttggggtgtgaaggcagattgactaactgccccttcatcccctggcactttgtaccgtaactgtctccactctgggcttgggcagacgtagtgatgcccgcaggtccaggagttggatggtgagcaggacagacagtccctgcaggatggaacccgaggatga

SEQ ID NO: 9974 - DNA, 201 bp, Bos taurus
ccttccccgcccccagaggcgtcgaccacggtcaaggtagagtccttcctgctcctgtgtgaacctgtaacagctgttgggcttcgtagaggactggtttccttgaacctttaaagtttcctgagtcccccttttgcttttctaaaggtaaactttattaccccaccagacttttaaagccatcgttctttgtgtgagggg

SEQ ID NO: 9975 - DNA, 201 bp, Bos taurus
cccacgggaggggcgaggccacttctaccggggagttgtgatgagcgaacaaacactccatgaatgtttaactcacataacaaatactcaactgagtgccgtctctgggcctgccaagtgctggatcacagggtgtaatgacatggtccttctctcatgggatttataatctgtacacacagccctctgattcaaataacg

SEQ ID NO: 9976 - DNA, 201 bp, Bos taurus
ggggcacaggcagaccatctaaggcccagagcattaataccgactcgtcagtcccttcaagggcaatgcagttggacagaaacgagccctgggagctcttcgggccgagtggcaagagagaccctgcgtccccgatgcggcacctattaagccatcagggagggagctggtccctcactcagaggccccactgcaagaact

SEQ ID NO: 9977 - DNA, 201 bp, Bos taurus
cgtgagcgggcacacgaatccacgtgccctgtgctcacgtgattggtcacctgttgggcttgtgcacattctgtgtgcttgtggcatgacaatgattgtgagcatctaatagcataaaattacttacggagcttacgtaatagctaatacctgtatggcccttactagacgccagcaccgttctgagcaatttacatagat

SEQ ID NO: 9978 - DNA, 201 bp, Bos taurus
tgtgattgttaagtttatcactgtctttaagtctatgatattctcttttctgtctgttccaactgttctttgttccattttcctattttactgccttcttcctttggacttgttaagtatttttataattccatttttaaaaatagcctttattctttacaatagttttgggctcacagcagccttgagtggacagtacag

SEQ ID NO: 9979 - DNA, 201 bp, Bos taurus
aggcagttctgttccagagaggaagggacgggccccccggattccaggacccacccagcatcggattcgaagcctggccctgggcgcactggctccgtacgggtcccagcttcccttctgaaaggagacggtttggatagacgagccctggaaggcctggaagctgcacagctataacaaacagccccaaatttcaggggc

SEQ ID NO: 9980 - DNA, 201 bp, Bos taurus
ctccgtgagtgcactggcccagcttgtcaggacaccatgagatgtctgcccccaggcctggggacaccagtgtccccagctggtgaccctctattggctcgagcaccttcccagccatgctccttcctggagtcttggtcctgagcaaggagggggcctggctggggaacagctgcttaaaggtggggcccgccctgtgca

SEQ ID NO: 9981 - DNA, 201 bp, Bos taurus
gcgagcactcaggacacagggtctgtgcaccacatgtatgcccacgctgcggggatcgcacgttctcgtagctcaacaatattgtgtagttcctaagccgcgtccaactctttgcgatcccatggactgtagcccaccaggctcctctgtccatgggatttcccaggcaagaatcctgaagtgggttgccctttcctcctt

SEQ ID NO: 9982 - DNA, 201 bp, Bos taurus
tttaattttttggatagacaattcatttacataattcaaaattcaagaggcacaaaagaggactcagtgaagtttctttctcactcctgtccccatctatacagtccccagccacacagacaaccaatttagcctgttttttttttttttttaatatatacacctttctaaagataacgcatttaaattttctaaggcaaa

SEQ ID NO: 9983 - DNA, 201 bp, Bos taurus
tctccaagcctccatcctgttgagtagggcctccagtccttcagagctgaactggaggtggttaagcacacagtcccctggaagagtctgagatcgattgtgaggccacacccacttccaccccgtggttactggactcatgggttcttcctattgggaggcagcgtgcagagagttctacttgatgtgaactctgaaccc

SEQ ID NO: 9984 - DNA, 201 bp, Bos taurus
tagatggtgtgcagaggtgacctccagaggaccacacagcctggaacctgaggcttgcaggcccggccctgaagggcatctgtgctgaggcctccagccctgtccacggagcctctgggactggaacccctggggtgattgtttgacagtacagcttctcaggtcctgcccctgcacatcccagaccagcagacccaggtt

SEQ ID NO: 9985 - DNA, 201 bp, Bos taurus
cacacccctgaagacgtactgttccctccactgggtagacaaggaaccagaggctacaggaaattccttaaatcacccagagtcacactctcatagatggcgggactggggttaaaacatacattggtttgaacccagagcccactcacttacctaccatcctgggatgtgcctggaactcaggtatttatcattttaacg

SEQ ID NO: 9986 - DNA, 201 bp, Bos taurus
cacctggcccagcatcagtacctggtcccaagcagcccacgtgaagtgcaagccctgtcttcagcgcccaacgacaaccttcagagggaaggtcacaaaaagggccaccgagtccccagagctcagcacagtgctcaccacagtggcacacccttgctaagtatgcatcacgtttattagcaggtaacagtagaacagaaa

SEQ ID NO: 9987 - DNA, 201 bp, Bos taurus
ggcatttaggatacggcctcagctgggctcccaacttccctttacgtgtctctggcatccaccagcggctcctctgccctgcccattcctggggtcactgtggccgggcctctgcctacccacagctgtccttggcacactgcctggcactgttcccctctcccgccacatcgtgcctgacttctgtgctttctccttgga

SEQ ID NO: 9988 - DNA, 201 bp, Bos taurus
acagatacttcccagatcacagtggaaggcgtcccttcatgcgagattagagctcaggctctggattcagactagtttggagccctgactctaccctgtgcttgggttagaggcctgagccatcattaactctcagctctttcctaatctataaagaggggtgggggtagggggcatggaatctgctgtaggcctcaacaa

SEQ ID NO: 9989 - DNA, 201 bp, Bos taurus
aaataccggctgacagaggcgggtgctaggaccaggtcagcccaggggcagtcatccagcctggtggctcagagtctgtgagcacccagctgaccactcctgccagcatttcttcatcctggcagcctgggttcaaagtggttcttcgtcttggcagaccagaagctagattttgaagaggttccccctcccaggggatgg

SEQ ID NO: 9990 - DNA, 201 bp, Bos taurus
gggccctgcccctatcccaggccacttgggccctgacccctctcagtcccctttttctataaattcagagtcactgtgacaccctcaccctcctcccaacacacacacttcagtgtggacagaacaggcactcagcactggtggtgatcacaccccactttgtgatctctttgctaattgcaccaaagctcgccactgacc

SEQ ID NO: 9991 - DNA, 201 bp, Bos taurus
accatctgccgtcctcccagaggtcagactggccccaggccccccagcaaggacactgttaactgcatggcccaaggccctgggcaaacaaaggcactcttatcagggagggcattccaaggacttagtacatctctccagagcagccggggccagacctgtcttgggaatgtgcagggttgggacaaccaaggcctctcc

SEQ ID NO: 9992 - DNA, 201 bp, Bos taurus
accctcacggcctccctccggaggccaccatccttgtccatcgagtggggaggataggacagagaacacatttccaggatgacagccacaaccacacaacggtggggcctgcaggtcagagctctcatctaatggctgagcctgagggctggtattctccccagaagggccttcacttgctcttgaaaacaggagattaaa

SEQ ID NO: 9993 - DNA, 201 bp, Bos taurus
tctagatggctgcacactgatttcaggagcaattctcaagggaggttttagcatcacaagtgaaattggccagctgggccaaggctctttcccatggcctcccacctctgatgtggttggacaggcactgtgtgtgcccaggtcaggaaatttgaatcaagagcctgctgcgtgtgactcatcacaccagggcaggggttt

SEQ ID NO: 9994 - DNA, 201 bp, Bos taurus
tgaacttcagcgtgtttctttcctggaagggtctttgagtgcacctcgggtcagaggagtagacataagacagtccttagctgctgtgtttttgttcccatcagttgtcaaatgttgctcaaaagcaattttaaatgtacttcatcatgttctcattttaagcttttaatggcacacacatacacacacataaagcagttt

SEQ ID NO: 9995 - DNA, 201 bp, Bos taurus
agcatctctattacatcctgggggtagacttcaggctttgaaacatgacccaggcagtcagcttcttttggatccatttaggcctgagcaggatcaaaacagaggagcatgccaggtgatgtcaggggcgcaagggctctgaatgtccaccctgtccagtggttctcagtgtggatgggatgattgtgtcccccaggggaa

SEQ ID NO: 9996 - DNA, 201 bp, Bos taurus
tcacacacgtgcacgcgcacatgcacacacacacacatgtacttgcacagccacgtgtggttatatttgcaggaaagatgaagcagtccccccaaagtcattgtgttctggtttgaatgcaatcagccaataagcagggcagtgcacacttattttcctgacgccctggcttctgtctttggtctgagatgtgtgctggcc

SEQ ID NO: 9997 - DNA, 201 bp, Bos taurus
tttctgactcagctcagacagaccagtgttctctgtgttgggaacatggaggaggaatgcatttggggaacaaagttttaggggcttatggcatgtttctacttgctaaacaagactgatgccaagactcagctcccccagaaacctcctctgatccctacacacacttcagccccaggctacatgatgtaccctctgctc

SEQ ID NO: 9998 - DNA, 201 bp, Bos taurus
ttgcttaaatgtgcatcatgcatttggaataattcttattcagggaagctggctttatattcatgacaagcattttcaattttaatatgtttgcttacataagatgcagattgtaatttaatggcagactgtttaattatgccttcatttgtataaattgtaatgttgctgctgcataaatgaagtaaaaatctctttaat

SEQ ID NO: 9999 - DNA, 201 bp, Bos taurus
tgaggcccatcttccaggatcctacaatctgctatggaagagggacactgatagattatagtctaccaagtgttaagagaaaggaaaacaaaattctatggggactccacatggcctggtttgaggggtaaaatgtctactctaggaatctcccatggttgttttgtggatctgatgaggtcatatgtacagaagtactag

SEQ ID NO: 10000 - DNA, 201 bp, Bos taurus
ccagggatcaaacccgggtctcccacattgcaggcagatgctttaccgtctgagtcaccagggaagccccaacagagcctatagttactaataatgtattgtacacttagagatttgctaatagtgtggatctcagttgatctcttcacacacacacgtggtaataatagatgaagagggtggaaggaaacttttggaggt

SEQ ID NO: 10001 - DNA, 201 bp, Bos taurus
ccaggtagtatgtgggaagtttcacatgcaaagttaaccaggaacattttaacaaatgacataaattacaaaagtagaatgtgactggagcacaagggccgggacaatgaaataatgacagagacaaattagcatgcaggatatattaactccatcatttcccatagtctcccttgagggtcttcccttccatgacatggc

SEQ ID NO: 10002 - DNA, 201 bp, Bos taurus
acctgggaagcccatttttacatgtggccagttcattcatctgtggccaattcatggttcaatcagtgactacaaccgaaggataattaagaaaatgagactgtgtcaggaaaatgtcaccagaaagttctaggaaagttttaaccacctgagaaagaatggacccttagatgcattcctggagattctctcaaaggcatc

SEQ ID NO: 10003 - DNA, 201 bp, Bos taurus
ggaagccatggagtgatgatgctttaatagagcaaagactacaaaacataattaaggaaagtacagataccacatctgttttaccaagtagcctgggcttcgtatgtgcaaccctgactaccaataagatgtactttgatccatataatattagtatccaagagcagaaatctgaaaattatggggcaggtaaaaacatta

SEQ ID NO: 10004 - DNA, 201 bp, Bos taurus
aaggcatctaaatcaggtggaatttccttacatattgccatacatcttttaacggggtttttaaaaagtaggggtcaggaaaacatgagatgttttctttgtaggtttatttgcaggagtacttgaagcacaaagcaatagaatgaatgatgccctatacctcctctctttacctaagttacctggaaacccagagctcag

SEQ ID NO: 10005 - DNA, 201 bp, Bos taurus
ttaggagaaaattacaggcatccagataagagaaaatgatgacttagaccaggtgcattcatgacggaaaaaaataatgggatggattgaggagataaactacaaaattgcttgagcgattggttgagagatgaaaagggatgatgacattgtgtctgtttgcctaactggatgggtggaggtgggtccttagacatggaa

SEQ ID NO: 10006 - DNA, 201 bp, Bos taurus
tcttgaatcagattctgttctaaaaatgtcagttccccttacacagcaaccccatgaatagctactactattattttcttttgttctataagtggaaaataaagctgagtaaggctcaatgatctgcccaagactgcaaggtgtaagtgatgaagccaagatgtggaattaggctgactccagagcccacaaataaaactg

SEQ ID NO: 10007 - DNA, 201 bp, Bos taurus
ttagaagttggcagctcctctttattgcaaacaccagtagcttttagccttcttggtggaataatcattggagtgtccagttaggtgagtggagagctacacttttattcttgcctgaggggaaattggattttctacacaagcatattttgcaggcttaaaaatgaaagaaaaaggaaagaaactctgaaatatggctcc

SEQ ID NO: 10008 - DNA, 201 bp, Bos taurus
tggtaaataaatctaacatgggtcagctttgaaatgttcttaatttttttaacgtgataactgcaggcctctggctccaccctggcctggtttggtatagtcgccaaagtgaaagtgcaagttgcccagtcgtggactcattgagaccccatagactatatagtccatggaattctccaggccagaatactggagtgggta

SEQ ID NO: 10009 - DNA, 201 bp, Bos taurus
cattgacaacacctaggagcctgttggaaacgctgaatctcgggctttacaccaggcatgtaaatcagaaccggcattttcctaagacctccaggtgatttgtaggcatatcaatgtttaggaggatctgctctaactcagcagtccatcatctgtaaaagggactcacagcgtcaacttcccagggtggttttcaggaat

SEQ ID NO: 10010 - DNA, 201 bp, Bos taurus
gagtacacaaacatattctcagggtcccaaaagttctaattttcaattgttttaaaaatttcaatattaacaaaaatattactaaaagaatattctggatcacttgagtgatgacttacataagtaagtgctaccacatactttggggaccaacttctgagttcctgtttccaggcttgtagaaaatcaagaaaaatcaat

SEQ ID NO: 10011 - DNA, 201 bp, Bos taurus
tgtagtgaggagaagggccaagatgggaggtgctgtggcacagcagggttgcttattaaggtctgttacctatttagcacctatgttaaacaagtctccctagggccctttgggatatggcccatggcacacagaggatcaaacgagatggactggggttagggttggggggatgagggtctggccacactccctgctcgt

SEQ ID NO: 10012 - DNA, 201 bp, Bos taurus
aaaaaggagattaatccattaggccagaatatgtggtacatgtgggatatagtgcaataaatgaatgctaatctgatgaaaaatctttctcaaatatatcagcatttcttctgatatggaaacagatacccagagatattggtgtcacaattgtttaagtcatagagctatttgatataggatttggtacaagaagttaca

SEQ ID NO: 10013 - DNA, 201 bp, Bos taurus
aagtgacaggtggtggcttgtcattttctagtatttttgcattggggcaacagtagagtacctatctactagtagcctaattttggtcccaggtagcaagttagtgatttcaggggtaacaacaacaataatacctgatatttttgaatgtttagtatgtgcaagaaaacgttataagtagttttcttggaattaattcta

SEQ ID NO: 10014 - DNA, 201 bp, Bos taurus
gaataaaaaaacatatgaatgaactacaacaaacaattccttttttttcccctcaactttaagccacaaattaatcctggaataagtaagcattagacaacaaaaggcaatattgtgaattacagtatttcccaaaatgtgggacagaaattacttctgtctacaaatgcatatttgtagttcacaagataaatctaggtg

SEQ ID NO: 10015 - DNA, 201 bp, Bos taurus
agtctgtttatctccaaagtacataggttttcttaatagagcattcttctaatactaattgattctctgctaatatttataaatatattcatatcagccagtaaagagaggaagtcattgctagagagatgaaggaagtgaggaaaggaagtgcatttgtctggagtcataaagtagaaaggaagaaaaatgatataaata

SEQ ID NO: 10016 - DNA, 201 bp, Bos taurus
tccctgcctgtacatggaagaagcatgttcttggagagtgatgtgacaaaccttcccatgtccaccttgttcttaaaatcctgcagtggcctcacagtggtacctgaagatgaagttcatcctcaggaaaacacagcggaagaggctcttgtggcagggaccctggttagttttcaagtcttaactttgcttttcccttat

SEQ ID NO: 10017 - DNA, 201 bp, Bos taurus
gactcatgcttctgttttcctgattcatccacatagatgacaagaacaggaagaatttgataaaccatcaaagttggtaataaaagcactgaaagaagcacctcacatttatccactccttctgtgcatcaagatacattaaagaggtgaccatttaatattcacaataacatgatgaggaaaagatgctctcttagcagg

SEQ ID NO: 10018 - DNA, 201 bp, Bos taurus
gacttcatttaaatggatattataaacccctatttgtttaaaccatttttagtcatgttttttggttacttgcaaccaaaaccaccgattgagagtaattgcatatttactgtaaattaaaatctaatatactgtttaaaaatctctctttcagcataaagcatttgcaaagaagatcatatgcatttcccagtatcatct

SEQ ID NO: 10019 - DNA, 201 bp, Bos taurus
gtgccctggctcccacccagccttcaagacttcctctgctctgggaaaggtttaaggcttcagggatcttgcaagctctgagatattcctgtgaattagaattcacatataaacaaaagctgctcatattttagactactcttcatatgctaagcattttacaagtatagccgttttaagactcacagcctgatgaggtaa

SEQ ID NO: 10020 - DNA, 201 bp, Bos taurus
ccaggctcctctgtccatgggattctccaggcaagaatactggagtgggttgtcattcccttctccaggagatcttcccgaccagggatcaaacacaggtctcctacagtacaggagattctttgccatctaatccacgtggaagtcccctgaacctgaagacaggtgagtagatgttacccaacatacaacacaaagaga

SEQ ID NO: 10021 - DNA, 201 bp, Bos taurus
gatccaggggtaactgatcccagcttgccagccagcctcctaggctcagctgagtgactctgcactgtatttatgtcccaaatggccttgtgtttgctctgtcttccctgaagactatggggcagccacttctcttggagaccacgtagctccgagggaaggtttcaggacctaatttctcagctgtcctggtaaggccca

SEQ ID NO: 10022 - DNA, 201 bp, Bos taurus
ttgggaaagatcggtcagaggatgaaatgatttttctaaggctccattagcgaggatcaggtgaccaacaggaccggcttttgctttcatgcccaccagcatgggttgcccacacagtattgcaaattattagtcgccgtttgagaagtcttaattatctggatccattggaaaccgtgtcagttatttgaaaccaagagg

SEQ ID NO: 10023 - DNA, 201 bp, Bos taurus
gccggcagcctccccaggggtctggccttgggagggggatgagcacagcgtagcactttgtctagggatttggtcctgcatcgttaggcgggaacaccacatgaggctacactagagatctgagggcgtgctggtgtttagaaaccgtgtgtgatctcccagcccacctgtgggtgggtgtgtcccctcccagctcctgcc

SEQ ID NO: 10024 - DNA, 201 bp, Bos taurus
ctgaaaagggggacttctctgggcttttctcctcccactctccttttggggcccactttaccatgtagctgcggcagtaagaaagccccacggggctacccatcttggctgaggctcttgccaaccatgcagaaaccccgataagaacgacgtgagccaaagagagcagaagctcgtctgctcctgcctgagtcctaagtg

SEQ ID NO: 10025 - DNA, 201 bp, Bos taurus
tgtatggagctgtgtagtcacgtacatgaatcctgtgagaaaacgtgtcttctcaaaacaacggtgaacttttgtcagtgcacacagtgccctgtgcacagcttcctaagtgtctctgtggttttgtcccttggcgtctgtgtatcacgacactagccttcccacaaacctcagcgctcactgctaccctgttccagttta

SEQ ID NO: 10026 - DNA, 201 bp, Bos taurus
cagggctgtccttttcctgccatgctcccccatggcagcatgccccattgtgtacacacacagacgcacctgtgaccagcactcagcgtttgttaggtcattggtcttttgcttgtctgtttcccgtggcttcagcgggcagtgacccttcccacctctatacccagcacctagcatgagtcttgacaagtaacaggtgct

SEQ ID NO: 10027 - DNA, 201 bp, Bos taurus
caaattctttctccatgactcttggcagctttcaacacttaacaaatcggctaagcaaagcaacatccttgcccctcatcttgttccaagttccaaggactgactttcacctacgaggcccaggccctggctgggagagtgagggtccctgcttaggctggccaccctgcactggagccttcgtccagcagcaggtctgtg

SEQ ID NO: 10028 - DNA, 201 bp, Bos taurus
ttcagtgtcccccaagttaatctgtaatggaaagaacactggctttgggctggaaggaccagaagtcaagcctcagctctgtactagaatgagaataagttgggtgacccttaggcaaggcactgtatgaccttgactttccacacttagacctgtggatatttcttcctccctcttaggtttctgtgcaaattgaactag

SEQ ID NO: 10029 - DNA, 201 bp, Bos taurus
agagtactgagtggggtgccattgccttctccttcatgagtttagctttaggattttcttcaatgttgtttcagtggcatcctttatttgactggaatagcactcaatgtttgggcttcccagatggctcagtgagaaatcaggagacctgagttcaatccctggctcaggaaggtcccctggagaaggaaatggcaactc

SEQ ID NO: 10030 - DNA, 201 bp, Bos taurus
ctgcaaggcctgagctgggagagacatcaggtcacacaccatcactgagtcactctttcaatcagtcccttgtttgcataggaaacccaacaatgtacacgaagcaggatgaggaccaaagaggcctgaatgaaaatatggaagaaatctgtttccagccacaaccaggggactgacttcccagggggtcctgggcctctc

SEQ ID NO: 10031 - DNA, 201 bp, Bos taurus
ctcctctgcttccacagggtcacttttctaaagaaaccacacaaacacatgctcagatcaggttctgtggtgggagaaagtctaaggccaaagaaaacttgcaaatgatgatgaacaggtgctcctgagtcagtgtattattatcttccattgaaaagatcttctggggtacttgtcatcattcaaaggcctggttattgc

SEQ ID NO: 10032 - DNA, 201 bp, Bos taurus
ttttttaagttcagcgttcacacatgtacctgtagtgaggacaggaaatgggatgttagtaacttgcgtcagtaccctgaaactcctgtgtgcctcgaaaccctgtccagtgtgccctttcgtgatacaaagagcagttccaaggagagagagctctgcttccaagacactcggtaaagagtggttattcacttctcactg

SEQ ID NO: 10033 - DNA, 201 bp, Bos taurus
gcccccagggcattaccgttcttgttcgttttttttgctgatctgatggccgcaaaaaaatatctctttattttcattcccttgtctaagagcaaagttagtatcttttcacatttctgttggttttctttctttcatttttatttgtttgattgttcatccccttaacccacatttcttttgatttgttcatttgttctc

SEQ ID NO: 10034 - DNA, 201 bp, Bos taurus
cactgtacgccttccctcgcttagttgataaatgcacagtataacccctgccagagtaatctcactcaagtggaatgtgtctacacttgtttctttggtgtggggcccagttactatttctttggccacagagacccagtactatcttgaggttccgtttatactataaaattagtaattctagggtctgaatgtttgtgc

SEQ ID NO: 10035 - DNA, 201 bp, Bos taurus
attgatggattcttagtgggaacattgaatccttccaggtgactcacatagcagcaggtatttgccggttgggatgccctccgaccaggttcaacggctaggtcaacaggactcacaagtaagttcttgcaatctccatgtccattgaattttgagtacatgatgttttgcctcagtttacaattaacttgattatgcctc

SEQ ID NO: 10036 - DNA, 201 bp, Bos taurus
ctgcgctgtctgtgcacgtgtcctggtgtgcccgtccacgagagcctctggggtggatgcccctggcgagcgcttggcagggccataggcatgtcttcagttttacaaggtgaagcccaaccactctccacggtggttgtgccaggttatgccagcagcaggggtgcccggcccagatcctctgctgctctgtgtcggggc

SEQ ID NO: 10037 - DNA, 201 bp, Bos taurus
taggtctgggtggactccgggagttggtgttggacagggaggcctggtgtgctgtggttcatggggtcacagagttggacaggactgagtgactgaattgcatttgaatagttgtaggaaggtgagtctgataccagttgggccatcatacctggaagttcagaggtaataatttaagtacctgttttgccaccgtatgcc

SEQ ID NO: 10038 - DNA, 201 bp, Bos taurus
agaggagtatcattcagcttgtttgttcacacagcttagcctgccctccttcctaatttcaccgtgatttccatctgtctgtctccacgtgaccatatgtaagatggcttgaacttgaggggtattattttttgacaccatcaaacaactacagattaggttggaatcctggttctcctgttcatgatctgggaagtgctg

SEQ ID NO: 10039 - DNA, 201 bp, Bos taurus
tttttaaaaattcatgtttttctttttgtatcatttatgttttttactgtggagacttttttgtgtgttgtcaaatttatcacactttcagggattatgggttttataccatacttaggccttctgtatattgagattttaaatgtatatttttttctagtaattgcttgactaaaaaaaataagtctttagatcatctga

SEQ ID NO: 10040 - DNA, 201 bp, Bos taurus
ttagccctgcgatggttttgtcaaacggtcaaactttattctactatagctagtgatgtagaccttgtattcatctgtgaagataatagatcagtgtagagtaatatatctacaattgcttcaatacacttctaggagcataacatttggaaagaatcattcttttgtgtgccaagacagaacttaaagggaattacaaac

SEQ ID NO: 10041 - DNA, 201 bp, Bos taurus
agtcttatttttaaactctccatcatccaggaaagaaaagccaaatggatctgttgtgtataaagcctatttcacatctcactacctgccaatcaggcatgagccagacttcaaaggtgtgtttaagcaaaatacactgtaatccatcaagtggaaggcaatcatatataaccgacaaatcacataatcaataatcaacat

SEQ ID NO: 10042 - DNA, 201 bp, Bos taurus
ggctggcttagtttcttattttaaaactttaccctctctggaagccttctgtgaaataactttgaaacaggcagccaatgaaatcgcctgttggactttgcggtcactttcatcaggctcatgaaagaacaaaattgctgaaacaagggcaggaaccaaactgagccctgggcttggggactggtgtctgcagccctcacc

SEQ ID NO: 10043 - DNA, 201 bp, Bos taurus
ggggctggctgctttccagaaatccctggatggaaggccaccctgctgtctctgtttagatggtgattgaccactgaatagctgcccaaattgagacgccctgcccagagcccggcctgacagaacaatcaggttgcactgccctggagacagccggggcaggagctggtaattgacagagagctcattatggaagcgaga

SEQ ID NO: 10044 - DNA, 201 bp, Bos taurus
ctccgcagagctggtagtggaggaatcggcctcctgaccttttcatttaacttcttattttcccttttgtttcagctcctctgcagcgtctggctctcatcaccagacagatgacgtttgggccccaggttccttgacctctcaaggaccctgcacatctatcggacttatcagagctctgtgttccaagccagatgaatg

SEQ ID NO: 10045 - DNA, 201 bp, Bos taurus
aaggaagagttacttcaaaggccctgaggcaggtttctctccatctcccagctttgtgttgctcaccaggcttcctccttgggcacattgccctgaataatggtaaaatggccttctgtagctgggagcccacatactattcactcagcagctccagagaagagaagagcctctttccagctagccagtgtgctgactctc

SEQ ID NO: 10046 - DNA, 201 bp, Bos taurus
cttactaatctccatgtctggctgaaaggaaagcagctgagttctcagtctgctgtcgcctcggtctgtgctggaatcccacactgcctgtctctgggaagcagaggcaacagtcagttcctgagacagtgagaatgaaaaagcgagtggtgtcttgccatgaaaatggttttgccctcatggacaccctggaaggggctc

SEQ ID NO: 10047 - DNA, 201 bp, Bos taurus
ggagggcctggggactaaggcagtgctcttctggtttataaatggggacgctgaggctcagcgactgaagtaacttcaggaccctgagttcctcgggcacatggctccattaccaggctccaggcctaagctgtctgccctccctgaggacatccccatgagagaaacagtgtttctttccaaaatatgctccagccccag

SEQ ID NO: 10048 - DNA, 201 bp, Bos taurus
atgaaactgaccatctctcttgtctctccatagaccatcaccggcctcctgcaggagtttgatgttcaggcaagtagaagatgtggcttcccttctccctcgccttttctgtcttctcctttcccctttcttccatgggttagatccgtgttcagacgttagggctaaggggagagatggaagccgattccctgcactcag

SEQ ID NO: 10049 - DNA, 201 bp, Bos taurus
tgtgtttgttgtttgtctgcagccggcgggacctggagatcgagcggccgatgcctggagcccacacggtcaccctgcagtgagttgccctcccccctgcgctgtctcttcagctttgctggccagtgccagcagcatcttagccctgagcttggcaggacggcctgcctgctgctaggacagcccagtgggcaagacctg

SEQ ID NO: 10050 - DNA, 201 bp, Bos taurus
ttctatgcctgtgggtctatttgttttgttaataagttcatttgtatcttatttacagcttccacatacagacgacatgcatatgtacagccaggattcggccagccgacctgtcatcctattattatcattattaattcctttcccctctgagcaccgggaaggggctgcagggggcggcggtggcagcgggtgtccagc

SEQ ID NO: 10051 - DNA, 201 bp, Bos taurus
acctgcaagtgaagttgtatggtatttgtcttcctcctcttccttcttcccttccttacttgtcctgtctgcctgggagagtctggggagggccatgtctcccccgccaggactcagtttccttatttctgaagacaaggggaggagggagatgcagctccagtgtgaggtccaggcccctcggcccctgtgcagtcctgg

SEQ ID NO: 10052 - DNA, 201 bp, Bos taurus
ctgttcacggacggtggatgagcgccccacctacaggtggttgccatgattcttgaatgtgacagctcatgcaacgtgtctatctgagcttggcacatggtgggtgcaaaataaacgataaagcaaatactactcccacgacacctgaacacctagcagctcagctaaaaatgaaagaggaagggagtcctggaagcagtc

SEQ ID NO: 10053 - DNA, 201 bp, Bos taurus
tccttcagcagacatgtggggtgaagcaccctattccagggatgatcttagccactgatgaaaaccctgctaccttagtgagttcctggtctaagaacacggtggtgggggcaacacatgcttgtcaagcgtccttcatgcgcccggagctgtgctaaggctctgtaggcatcataccgctcatccccacagaagcctatg

SEQ ID NO: 10054 - DNA, 201 bp, Bos taurus
tgccctgtgccatcaaaccacaggccaatgcggcacttacacatgcagctaaagaaagcaagctgcagacacacagcgccacgcgatacccatcagcccacgggcttctcttgcctcggacaggccagtggctctgtcttcgaagtgacgactgcaattctcccttctttgtgcatctggccctcgttgccacagctcagc

SEQ ID NO: 10055 - DNA, 201 bp, Bos taurus
taagtctccagcaggtgggttctttaccactaggtgccacttgggaagccctagccttctacaccgaacctgtattccccaaactcatgccctatggctactacgaatagaagtctactgctgtgtttcagggttagagcaaatgtcatcttcttcataaagcttcaccaagtagaatttattttgtatcagttttaccac

SEQ ID NO: 10056 - DNA, 201 bp, Bos taurus
cccttacactaccaccgtttgtgcccctcccttctccttcctcacgtggcactgcagatgagggcaaactctgcgccacactgaccatgcactcacccactgcctctgaggacagtctccccgctgtgacgccttttcctttctcaactccaacccactcttcaaggatcagctcttcaaatcccacccatcatatgaaaa

SEQ ID NO: 10057 - DNA, 201 bp, Bos taurus
cattttctgaagactcactttgcttcaagtcctctatttgctgctggagatcatggagatgagtaaggcactgttctcgctgccaagaatgcaagcttttgttaagactttattacaggcctttcactaacgaatcagtctctctctatcttcctcctctacaaactccccaccccccagtttctcagtctgcttcttgtc

SEQ ID NO: 10058 - DNA, 201 bp, Bos taurus
gtttggcctagaacagtaaccccctgttccaggcacctaggaagctctgtatatttttccttatagagatttttggggtttttttgttttctaatcagtttggcccattgtccttgatttaatttaatctaggaaacccttacaaaacaaatcttaacttttcttctaccagttagcatttagaggttatacagtttagca

SEQ ID NO: 10059 - DNA, 201 bp, Bos taurus
ttatctaacatgacttgaaaatattgagccattccaggccttctgtactaatggaaaatcactcagcactatcactctatatatctccccactccttcccattcctaaaaccccagcttccactttatctcaccccatgcctatcaatttcagatgcttccccacctatagtgaggttagtccaggaaatgaaaccttaga

SEQ ID NO: 10060 - DNA, 201 bp, Bos taurus
cgcaccaggactggaagaggtttgcaaaaaagttttccaagctctcagaatgacattgggtctttgttgttgttgctgttctggcaagatcgcttctgacggctttgcactccctcagccggctgaagcctccaggtcccagtgctgccgtgtgtgacccccaggagccaggaaccgtgtgcaccgccagaattctgactc

SEQ ID NO: 10061 - DNA, 201 bp, Bos taurus
ctggaaacccagggaattaatctccagagcccttcctcccttcaaccatggtgcttcattttgaggtaatatgaagtagatattgtgataggaaagacacgaatagcatccaactcttagatttctttgtggataaaactttaggaaaaaaaaggatgcctcagattattgtaggaatgaaatgatttcacacacgtaatg

SEQ ID NO: 10062 - DNA, 201 bp, Bos taurus
tttggttttacactcaacccctttaatgcccacattaagctcttcctgtccctcaaaggcattccttatgggtgtgtgatcactcttgcccagtctatggactgtttcagtggccatgggagaggactctacagaaattttaataccatggggaaatatttctgtcatagagttagaaagggaaagatcaggttatcatat

SEQ ID NO: 10063 - DNA, 201 bp, Bos taurus
acatagttaacttaagcctaaacacatcacattcataggagatactccatggggtcatcctttctgtttctctttattaaagaattgctgaagatccagccagactgggtctacaggctcagattgtgctgccaggaatccctttgtttccctatgtctcagctctgcttttctcccttggagattccattctctgctgga

SEQ ID NO: 10064 - DNA, 201 bp, Bos taurus
tggtttgattggcaggtactcatccccatgtccattcatctgggagcaagggccaggcttctggtgcatgtggagtgatgctgagcccagaagtaaggcaagagagaggaaataaggttgcagggccaccttctgcaattgcagtggttgtgcccaacacatagctgcctgccagacaggcaactaggggctgaaacccca

SEQ ID NO: 10065 - DNA, 201 bp, Bos taurus
tttctgtctggttcagcctccaggtaggaagacccaggcctggcgtcattgctggggctggtgatctggggtgggagctggtcagagaccatcatcgctgcgtttcttcagatgcccaagtccagcgccttctaacatccccaaacccacttctccaatgtgctttcttttcagagacagccagcaaggaagagctgctga

SEQ ID NO: 10066 - DNA, 201 bp, Bos taurus
tcacacagcatccccatcactacctgccaacagcagggtaaggctctgccgtcacaggggtcagtgtgacggagctgcaggccagctgcaaggtggcatgaggtatagatcacagtggaactaagctgtttttaagttctaaactagacattctcctctgaatacggtatatataattttaacaatgggattacatcatat

SEQ ID NO: 10067 - DNA, 201 bp, Bos taurus
taggtatttattattagaactgacaggcaacaaagattctgtacacagggaatgttgcctgccattcgcatcctacaaggtcaagccatcagccactgccgtttcccacaatggtacgccctaagggggattcaggatggggagaaatgggaagcattctattaattagacactggccccacagccaaggtgcatattcca

SEQ ID NO: 10068 - DNA, 201 bp, Bos taurus
taaatgttaattagttttccttcctccccagggtgtgatggctccttcaggttctagggagggggcatatgtatagtctttagttgaaactattggtcctttctctgtccattcaaccacctgtaatatggatgtgagagttgggctgtgaagaaggctgagcgccgaagaattgatgcttttgaactgtggtgttggaga

SEQ ID NO: 10069 - DNA, 201 bp, Bos taurus
tttcagctgatttctagagatcagtaatctgcccaatcactcctgcctctgaggttttgttcctggaagattcttggcctctgaactagagttttccttcttgtgtttgttctttactctctgcctgtgctgacatggatctcccaggtgtgtatctggccacactgtttcactggtggactttggaagctgaaggctgtt

SEQ ID NO: 10070 - DNA, 201 bp, Bos taurus
gaaagatctggtaggtggtacctctatatcagaaacagtatgtgattgctttttatttttccatttttttttttttgctacaacccagaaaaaagtttcattgttagccccaatgttgagtgttgcctatgaattaatgatttaccgaaattggaaatggccaaaaaataacagcctttcttagtgggaagtcccaagtct

SEQ ID NO: 10071 - DNA, 201 bp, Bos taurus
gactctaaattttggagacagacacagctcatttggcttagagaagacaaagtaggaatcaacagttgaagatatgaaaggaaaggaaaatggaggaaaaacaatatgtgttaagtatcgcatataaacatatacaggatgtgatgtaggatatgtatatgatattatcatcagaaagataaatatagtaaattaaagagc

SEQ ID NO: 10072 - DNA, 201 bp, Bos taurus
ggcctgtgacctgaattaaggacctgcagttccctctgcctcatggtgcatcctatagtgtatacattggttcgagctacttctgaagagtcacactgataatgaattggaatttggccagaaccagagcaacatgtgggatctttgtttcctgaccaggaatccatgccccctgcaatgggatggtaaagaatctgcctg

SEQ ID NO: 10073 - DNA, 201 bp, Bos taurus
tccccgtgggaaaaattttttcctcttgtcttaaataatttaatttcacataagtatttattatacaactcagtgatctcacaaccaccttttttaaaaaaggtgacttggggttgctgaacaaaaccccaaatctgcaaatagcagcccttctgttcccatcagaggttgactgtcttaagatgctgacaacgtttctgt

SEQ ID NO: 10074 - DNA, 201 bp, Bos taurus
ttaagagcccagatgctggttttcagcattatcttaactctaccctcagtagctcacagaccaccctaagcatacttccagtcctcaccctggtttcccacgacccagagcaagatactatgaccagggttgcagttattctaaaaacacaagttcacaaagtagccaagttagggcatcctggcaacaaatttaaagatg

SEQ ID NO: 10075 - DNA, 201 bp, Bos taurus
gattcttgccatgaaagaaaaactaactcctatttgcttaagtttctttatttgggttttgcgattatttgtagccaaaagcatttctcatttgtagaggtatctaacctagacctagaaagccagggaaagcctcttcttgaagaagaggacatccatgctaagagcagaaggatgcggagaatgaattcaaagagagag

SEQ ID NO: 10076 - DNA, 201 bp, Bos taurus
agcataggtgcaagcaagcttggaagtactgcctgcctagaggactgccctgctttctttctctcctccaggacaagcatttgcataaaatgagggtgctaactccctcattgttttcaccttgacttccccctccgggtgtgctgtagcaatagatgcccctgaagccattttgctgactggaatagagccagttagatg

SEQ ID NO: 10077 - DNA, 201 bp, Bos taurus
cattctgtgtttcttgcagggtgatgcccatggccatccagttttccatcctgatcatgctgcactcagctctggtcctcatcactacggcagaggattacaagtgtttgcccctggtcctccggaaaacctgctgttggattaacgagacctatttggccaggaacgtcatcatctttgcatccatcttgattaatttcc

SEQ ID NO: 10078 - DNA, 201 bp, Bos taurus
ccagagaattgtgacatgaaaaaagggttctgttagtatgtccctgtgcacagcactgtggtgactatgactgagtgaatgaatgaatcctagccgctaagattctggatggcaatatatgacttacagtccagctgtaactgtacagctcaaccagatctgagcactctctcctgctgagtctgcgtgtggcctaagact

SEQ ID NO: 10079 - DNA, 201 bp, Bos taurus
catcaaatgcctgacacactgaactacagagcaggaccccacccagggtgcccctttaagtgcctgactcactgaacaaagagaaggctcccaggcaatcgagccctctaagtgcctgaatgggcagaactattgaaaaactggccaaagaggccttctgattgccagctacaagaggctggaaaaaagaccctgataggg

SEQ ID NO: 10080 - DNA, 201 bp, Bos taurus
tatttagaaattcagaagttacagtaaaaacatgtgtggaaattccaacatgtcatcatttacttctgaggctaatgagtactttggggataatcatttcatataaagaaaatcaccatcttaccttcagcaataaatcatggactgcgtacacaggggtaacccttagtttgcctggtctgccgaggactgagagctcct

SEQ ID NO: 10081 - DNA, 201 bp, Bos taurus
gccatgtgatgctgtgtcactgggggtagggagtgccaaccgagcgccaccaggaagagaaaagcctgctctcggtggcaatggaagcatcagcttgactctgttggctgctttgggatttctctagatgacatcataataatagctctgctcttataatcataaaaatgacaataatcgatagctattaggtacattcct

SEQ ID NO: 10082 - DNA, 201 bp, Bos taurus
ggtcttggattgctggcaaaagcggagtcgatctcctgtctcgccctgggttgtagcctggtcctgtctgttgactgatgtaaaagagctgggaactcacttccaccagattctaagcttcttcagagaagatgcctttctaaatggttccagtctggattccaagcagccaaaaaaggctagtattttctcctctgaatt

SEQ ID NO: 10083 - DNA, 201 bp, Bos taurus
caaaggaggttcaagatgactttgggtttgaaagtgaagtgccagctccaagctggactcctgacgaatgtggcccagatgtttctgagcgatttatttgtgttaatggaaagtggctgagctaataacctcacaaggcattcctgtagggagagctgaggtctgctctgcttctctgctccttgtatttgcttgtggctt

SEQ ID NO: 10084 - DNA, 201 bp, Bos taurus
cccgcctgcaagctcaggctccaaagccagggatttcccatgtgcggatgagaaatcactggttggtcccttggcagcaggacaaacagaaaaggaacagattcacccaaggggccaggaagagcagttttcatgacgaaggacgattccatcagccctcccacaagctattcctcacaatggtaattataagtataataa

SEQ ID NO: 10085 - DNA, 201 bp, Bos taurus
tgaatgctctgaatgtaagatctcagtatctgaaagcctttgtgtttcacctgcagttcactcttttgtgtttcctgtctgctgtgggtttgttgttgttgttgttctgtctcgtagaaatctacggattatttttcttatcttcacttgatatctagtgccagggaggagacagttttgggtagagaagaaaagggggag

SEQ ID NO: 10086 - DNA, 201 bp, Bos taurus
attcctcagtccccagcaggaagggatgggccccgggaggtaggcagggagccacggcatcggcgtcacatgccacctcctccccgagccttctgataccgcagagggccccacctcattgacgtggggatagcggtgacaggtacttgctatcgagtcagaaagccctaggctcctaacccagctttgctggggctcctt

SEQ ID NO: 10087 - DNA, 201 bp, Bos taurus
tcgatggctctgcagccaggccctgcttcttccagggcccagataacgcaccagaggcaaagactgcattcaccaacaagggcttgaatgctggaatgttggtgaccctgtggaactggaggccccgtggtaacagtgccgcatggtgtgggaccagtgggaattgagccattaggtgtagagacccagcctcacggggca

SEQ ID NO: 10088 - DNA, 201 bp, Bos taurus
aggcaaagagagcagcagatgcctgttttctgaccagggaaatgaagacagaacctgtctgctgagtggcatcaccttgtcctcccagtacatggtgagccatgtcttaaattgccttgacaaggttcttcctaagtaaaagtttgttgtaaaacatgtcccgtaatgtgtgataaagatgttcaaggaaggcaaggaaaa

SEQ ID NO: 10089 - DNA, 201 bp, Bos taurus
atttttccctgtgcatggttgttatcgtgaccttctatggccagatgctgagaaatggttttgtcttccgccttccgtgttttctgtaaatcagtcactcgaattaagggcaattgttcggcctctctaaatgccatcttacagattctggcattggccttgacagcccgtggagctgtcgtgacaaatgcacggtggctg

SEQ ID NO: 10090 - DNA, 201 bp, Bos taurus
tctttttggctggtttggcttttcctgtccttttaaatgcaattaggatagacgaggggtggagtcagttcttaggccatcagaggacagcagaggataacgaagtaataaaaggggctcttggcagatacgagtttggcactgggatgctgtgctgtttgggtcctcagggcccctggggttccctgagcacagtcacag

SEQ ID NO: 10091 - DNA, 201 bp, Bos taurus
aagtttcaagccagaggtgatttgaagatgctatcttgggagggtctacagccagttgaggggaagttcctcttctctgtgcatctagccatataaggactgggctcgcacactcaggacatgctgaactgaactgcctggacagtctgagccaggctttgtagacaaggtgacagtttgaattttaaaggccactgctcg

SEQ ID NO: 10092 - DNA, 201 bp, Bos taurus
ggtactcgttttcaccttaaatattttaattgctatgctaggactagacatttttagagtgcacagtctttttcatcatagtatctcctagggtatctcttttagtggtatatacataaacagactttgtgataaatgtttggtgttgggttttatcttttttcaacctgtgtatacagttggacctactctaatttctgg

SEQ ID NO: 10093 - DNA, 201 bp, Bos taurus
accatactggatgacacagtggtatatttttgaagtcctttcttacctgctgacgtcctacatcctctcaataccttgtgtgcgtgcgtgtctcagtatctcacacgtgaggaaacgaacatcacagatgtgagatgaaggctagcccaggtccctcggctagcagttacagaggtcccttgatgacatcatgcatatcgc

SEQ ID NO: 10094 - DNA, 201 bp, Bos taurus
ctttaatccaaatttaggattttaaaggtaagctctttgcctgctttctccaaaagatatgctttctctgtgctctacgggtcttaagagtcatgtaggagcaccagtgcaagggaaagggagggacagacacctacatttggatccccaacttgttaactcactagcactgctaccttgactctaaacctccttgagctg

SEQ ID NO: 10095 - DNA, 201 bp, Bos taurus
gcagcagcagcacactgtatttgtacgttatctcttttcaccctggtggtgaccagataagctaggtaccatcatcatcccattttacagatgagaagatggagactctgataggttaaatgaccccataaataaaatcggaaatcttgatgaaagaagactggggatttgagctttggcttcagtacttactagctattg

SEQ ID NO: 10096 - DNA, 201 bp, Bos taurus
attcaagctaagacaaatcaggaggcaggcacttattgcctttcttcacccaaggttcctctcataccagacccattttatttacacaatatttcttcacacacattcagaactttgactttcactggattttcttacagtttacaggacaattgattaaatcaccaagatcttccttctgtctctcccctgagagatgag

SEQ ID NO: 10097 - DNA, 201 bp, Bos taurus
tgggctacaattaatggggatttttcagtcaacagaggagccctaagctcctcctgtaaatgttagtgaagggagagtcaaggttgaggatacggggtttccttaaatttgggattgggaaaatctttaaacttttgttatcacccatcaagttgttctgctcattttcagttctctctcctcatttttccttgttaagtt

SEQ ID NO: 10098 - DNA, 201 bp, Bos taurus
cttgaacgtggagtagctcctttcagccaagatacttcaaataccatttcttagaaatgaccacgattttattcttgaagcttttagtgtgaacaacatttccaagttttccagtgtttccattcactttaaccttttcctgcagaaactgttgaaaatttccagaatcaaaaattctatcttctactggatgagtaagat

SEQ ID NO: 10099 - DNA, 201 bp, Bos taurus
aggtcacagtcggacatgacttagtgactgaggaaaaacgaagcagagtatgtgcagtagattgctgggactaattttgcatagcacttgaaaatcactttgcatttttccctcatactgttagcaccatattgactagggatatattaaggctacagacattcatttctacaaaaatcccctggtcaataatgtgaaaat

SEQ ID NO: 10100 - DNA, 201 bp, Bos taurus
ctccagtattcttgcctggaaaaatttcatagacagaggagcctgccaggccactgtccgtgggatcgcaaagagtcagacatgactgagcacccacacagcacaatatattaaaagagtacaggcccttcacacaccctaagcttatcggcaaccacatccttgaactgattgctgtgaaacccttcatcaaatcctcct

SEQ ID NO: 10101 - DNA, 201 bp, Bos taurus
atgtgacggtcagaaaaaccaagaaaagactgagcaactcatgcaggttgaaggagatcagagaaatgtgacaactcagaacgatatataacactagattggaccctttgatcataaagaatattattgggacaactggtaaaacatcaacaggatatctgggtaaatgaagatatatcaattctttgcactaatcttaca

SEQ ID NO: 10102 - DNA, 201 bp, Bos taurus
tcagggtgtcctaggacattgacatcagatctggcctgacaatccaggtctcctggttccagtctctttgtgccttctttcacctaacctcttaggaaagctagaaaaggccaggtggtgctctaatcatgagcataagtcccagagtcaaccaggcataaattataatccaggcaactctcttttgaagtctatgatctt

SEQ ID NO: 10103 - DNA, 201 bp, Bos taurus
gccaacctcatacattattttcaagtcctcttatccacacatatcattttgtcgtgtctgagatgtaatcttgttactgaaacccaacttgtgtgccaacgcacagaaaggccaaacaataccaaaacattagagtctggaacagagaaaggtgtattgaggacgctgcaaggagatagtggctcatgtcttaaaatcccc

SEQ ID NO: 10104 - DNA, 201 bp, Bos taurus
ggatgacatcaccaagaaaaggcccttgttcccccagggcccagcctccctggaagatgacaagggttagggagagagaaagcccgggccacttgtcggatttggcaggcagcagccaacagctggtcaggcgggttaatgagccctgcactctgctctcgtccagcctgtactggcaaaggcagaggcaagcggctccgg

SEQ ID NO: 10105 - DNA, 201 bp, Bos taurus
ctatgaaaatgtgctctccttcttcctgaaagcagtggagagcaatgagggaaaaggaggatagcaacataatcataattagactttaaaatgagtctatttctggagtatcacaatttgttgaaaagagtcaagaataaagtagagactagattggaggctctggcagcaatttaagaaagagttatggcaatttgatct

SEQ ID NO: 10106 - DNA, 201 bp, Bos taurus
cattaactgcagatcccaaacctttgatgactttctgtgtcatcacggcctttcctcatttgctgtataagagatatttaaaatgcatttccagaaaaattacagagaatagtcactctggccttgttacaatagaattgctcatctgtgacaatagatgacttggccaggacactctgacccagatgccaaaccattgtt

SEQ ID NO: 10107 - DNA, 201 bp, Bos taurus
gtgtaattgatggtgcgaacaagtacatttatacatgaagacaagattcaatttactcaatggagtctgcttcatagtttcataaggccaggaactgtgtcggatatattagaggggaaagtacatctaataataaaacataacgttggcatttgaaaacaaaatgaatacaaagctattagctagttttggccccacaca

SEQ ID NO: 10108 - DNA, 201 bp, Bos taurus
ggaagcactggccccattttgtgccctggtgagctccggagagccccaaagcatggtgcttgctgctctagcatacctaagattatattaaagaaagatgcgttttcttaattaatatctggtaagtgttacaatagacatatgaatagaaaaagatggggtcatggagatgggaatgatttggctgcacgggaaataagc

SEQ ID NO: 10109 - DNA, 201 bp, Bos taurus
ttttaaaagcagtctacagaactgagcaaacagtatggttaaggtatcgtattttttccaaatgtcttttacactgtcctgatatcctcttacatacatacgtactgatgtgcgtgtttgtgtgtagtgtatgagttttttttccccaccaggatccaatcaaggtcattgagtttggaggctgctgaagtcaagagctca

SEQ ID NO: 10110 - DNA, 201 bp, Bos taurus
tacatgtgtgtgtgtatatatatatatatatatatatgcaattcatcttaatgtagaggctcagatgggtgatgggaagtcaaaaacatcaagaagagccggaagactgaagaaaaagaaaaaggcatatttatgagctccagttaaatataaacaatcttcagtcaatagtatttatgaaaggcatgaatgttttcagag

SEQ ID NO: 10111 - DNA, 201 bp, Bos taurus
tgtctgtcttcatgaaggccctgaatgataatctatttttgaccttataaaggtagacattactcatacctgaattgtgaaacaacatatcccatatacctggctatcagaggccaagcttttctattttagacgttcaaaaaatggctttccctcatttttgttgcctatgcttttgatgtcctgttttttgggccaacc

SEQ ID NO: 10112 - DNA, 201 bp, Bos taurus
atgctcttagcgaacacgattatggatcagttgcatgctgggctcaatttgacaccatccacatgcaattcttactcagtgacacagcatccaggccacacgtattgacttgcatctgatcttggcttgaaaggaaaatcgctgctgcaggaattcaggttctacagaccctcaggtcactggcctcaaatatttaaaaat

SEQ ID NO: 10113 - DNA, 201 bp, Bos taurus
ccatgatttggtttacccttttattatttttttttccctgaatgtctgcggcatgtgggatcttagttcctccagggaactagggatcgaaaccacggccgctggaaggtgaagtcttaaccattggaccaccggggaaatctgttttacccttttaaaagagtccccctgactgctgagggcaaaggcggggtaggtaga

SEQ ID NO: 10114 - DNA, 201 bp, Bos taurus
ctccatctgaggggttgtgctgctggaggtactctggcccaggccatgcatgccacactgccccctggggagggctctgcagggcctgaagacacaacacgcgtacaagtggctgcacgccgagtctaagtcacaatggacacaccaccacagctaggtacgagctcatcaaaaaagcatctctacaggcactaccaggcc

SEQ ID NO: 10115 - DNA, 201 bp, Bos taurus
cgctctcactcatgctctgcatttccacggctgctagttctttaggcgattccatctgccctgctctcctggagcccaggttccccccaagacccactcttctcccactgtgtgcttccaggctctggcaacacaggctcttgcccacggcggatgctcaataaccatacacccccaacactttccaaatggaaatcggac

SEQ ID NO: 10116 - DNA, 201 bp, Bos taurus
cgccacccccatcatggctaacaatatctggagtttattaaacacctgcactaggaaatttgcatgcatgatttatgcaagcacaacccttcgatgggccgtcctggctatctctattttacagaggagtaaactgacccttagacttttattttttaagattttttttttttttttggttgttgtaggccatttttaaag

SEQ ID NO: 10117 - DNA, 201 bp, Bos taurus
atgtgctgaagggggtgaggaccaattgttctcattagcctggaagcaggggcctgatctctgacccaataacggagactgtgaaggagacaaaattcagatgttctgtggtagagaaggaagaagagggctgttgcatcaaacacacgggacaaggaagatgcttgtcttcctctgtctggcctacttcacttggtatga

SEQ ID NO: 10118 - DNA, 201 bp, Bos taurus
gtgtgacgctgaggtttacctgtgcagaatcctgagctatcacagtgggactgtgtgatcccatggcctcaacaggtgaaatatagttccaggacctggacagagagcatcacttgacaggagctgtcaccttggtgtgagggatgtggccagcacttaacccaataccctgacttcactgtctcctccttctgatctctt

SEQ ID NO: 10119 - DNA, 201 bp, Bos taurus
caaagaccacagctcatatcaggctcaggatgtcagaaatctcacttctgttgctcctaaaagccagtcactcaattcttgtcaaaaaatgattttcacccgctatctgatttcttatctctttgttctccgtgaagccctaggattggtgggctgaagttgtatgttgcaagggagggtgggaaatatgtggaaaattct

SEQ ID NO: 10120 - DNA, 201 bp, Bos taurus
aacaattctcgtattcctgcaatgacctgagtgttgtgttaggtgatggacattccatcctagacctgcaagtgttaaattccaaatttggtgttgacagcacccggagttactttccaggttcatcctgtaactctaagcaactctaaaacctttacatgcaaacagctcctatctgtctccatcagtttttaagttgaa

SEQ ID NO: 10121 - DNA, 201 bp, Bos taurus
cgcctactcccatgttcccaacccagaagcccagtcccttccaattctctcccagtgccccctgcaatgtgtcattttaacgcagaagctcctctggtctatggaatggttagggagttgaagctcaaaccctgacttttaaccccatatttgctttagctggattctctttggagctgcagctgggagtttggtccttaa

SEQ ID NO: 10122 - DNA, 201 bp, Bos taurus
tttttcatctttttcacaattcaggtttccaaaagtgggaggccacctccccaaagtcactactcctgttgcaaaggacacaagcaaataaccctctggtgtaacacagaagactagactttggcctgtataatcatgaggatgatatcagctaaaagggaattatgttaacttgatcatttctcatctttgaaattcaaa

SEQ ID NO: 10123 - DNA, 201 bp, Bos taurus
atggcgacagggatgagaagagaggctcctctgcattgtgactaggctaggatatgcctgatattttacagttctagcagctctcttactggggcggcccggacggttctccatgctccagccatggttccaccaaggatgtgtatctggacctctgtgacatcctccatggccactgacagcaaatcagctctgaatata

SEQ ID NO: 10124 - DNA, 201 bp, Bos taurus
gggttgggacaatgaggagcctcagaagagcaggaatctggagacaggagggaaagtcagtttgccccctgccttccgtaaagtcatttctggtggactaaggtcgtgacttttctcagaaacctttttcaacaacctcttccccattttggttcctgttccttctttctactaactttcctactggcttaggcgtggcct

SEQ ID NO: 10125 - DNA, 201 bp, Bos taurus
attctatataactaagagaagtacaacttcctccccaagatttctgaaaattcttaccattctccaaagtactccattaaaaggctgttcttgcctttaatggccttgtttttaaaaataatggcaagtggttactgcaaagaacaaaagacatccattaaagtaactatctgatgtcactttctaatttccttagctatt

SEQ ID NO: 10126 - DNA, 201 bp, Bos taurus
gtgtcttctttatttgatcagtctgattagaggtttatccattttatagataaaacctgcattgagcacataagataacacaagggcaagcagatgagatagttttaagagtttgccttgtaatcccaagaggctcttcaaacaagcaattgctgaagtatgaaggaacactagtaaaacaattggtttcaaagatgaacc

SEQ ID NO: 10127 - DNA, 201 bp, Bos taurus
gataggttaagacagttttctggagcctgctcctggcttacctttacccgcacaatccctctgaatcctacttgaccttctaagggcaggagttggaaagagggctgcgaggactggaaatggattgcaagccttctttaaattctggcccttcatcctaccttgttaaatgagaaggacgagcacagagagaggagactc

SEQ ID NO: 10128 - DNA, 201 bp, Bos taurus
gtaaattttgcggaaagtgcactatctaaaatgttgtggggggaaaatcaatttcagttatctctattaaagagaaaaaccaaaattaagggtgttacttagactactacgaaatgtccttggtatttcacacggtctgcttcatttaatggaaaacaaaatctacgaggaaattgttgtcaatattcccatttatacttc

SEQ ID NO: 10129 - DNA, 201 bp, Bos taurus
gtccacatttacatattttgagaccatgttgtttgatggctacaaatttaggattgttgtgtactctttttgggttgccctactgactactgtgaaatatttttttgatagtgatctttcttacctcagggtcttctttgtcacattataatatggctacattagtggttagttttacttagtatttcacaatgtatattt

SEQ ID NO: 10130 - DNA, 201 bp, Bos taurus
actactacccttgagacacaggtcaaggcccactgcaaataggggaaaggagcataaaacaaaaataaaaacaaacaggaaaaaaaccattcctactttgaaagaggcaggaatatgttctgaggcccaaccattaaagagggagaggcagattcataacctatctcttcctgagtggtagataaagataaaaagaaggtc

SEQ ID NO: 10131 - DNA, 201 bp, Bos taurus
tgcttgcataatgtggaggtcaagagaacactgtacaggggcaaacagaaagaggagataaatggttggaaaataccattaatcagaagagaaagttggcgttctgcattatgaatctattagcagtttagctaagtcatctccaggattctgtaattaagtgggatttacccagcactttgcttttggaaggcttccctg

SEQ ID NO: 10132 - DNA, 201 bp, Bos taurus
ttaggtgtaactgctaataagagggagagaaattcacatgcatctattgtcattcacttgcagaattatccaaattaaaaataccatcagatttaaatagttgagaaacattcatacctgttcccacaaatacaaattggaaagagccaattaagattactttctcctatgccctagcaagcattctactcaagaggattt

SEQ ID NO: 10133 - DNA, 201 bp, Bos taurus
actggggcaactctaccagagtctccacatcttagtccttactggtagactaccttgggttcacgtattcattaaccagtgactcattgagtttcctctacacctggaagtgtgggtaatggcttacctgtccagttcacatgcatgactaatttttgatatcagtgatctccctctcctgagagagcaaagttcaatgat

SEQ ID NO: 10134 - DNA, 201 bp, Bos taurus
cactgcagaagctggccagatgctcaccaatcccatttcctcttttcctaagcacaggaccatttctcttagcctcccttgcagttaggtagtggagttctggccaatggggtggtcattacagaaccctttgagccatcaccacgttttttttcccttgcgcagggacatcagtggctaagctgacagcaccccaagatg

SEQ ID NO: 10135 - DNA, 201 bp, Bos taurus
taacccacaagcaaggaagggaaggaccagtgcccctgccttgcagcctggtcagccaaaggtctctggcaggcgtgggggcctccctgcatgacaacacgacccagggcatcagaacagcaaggctcagccagcagcatccttgcaaattcctggccggacgctctgagccttcgccagcacttccaggtctccctcgtc

SEQ ID NO: 10136 - DNA, 201 bp, Bos taurus
gctggtccattcttctctcaatcttggctggctatactcagtgttcacagtcagttgggcagctctgattccggggtttggctggccatggccagggtgatagagaaacaaagtctgtgtcccttgtcacccaccaggcaagcccaagattattcacacagtgggcctgagactccaaaagctacagaatacaagctgcag

SEQ ID NO: 10137 - DNA, 201 bp, Bos taurus
gtccacaaggtgataaatgcctggccccacgtccccagctcaggacagctctgaagggtcctccatcttcagagctccctgcagcttctgctgaggccatgtcctcccagcctgactttttcctctgcccagtcctccttccctcctctcccttccaggggtgccggaccccagagcactccctgacaggcttcttcatcc

SEQ ID NO: 10138 - DNA, 201 bp, Bos taurus
aattttgggacgcggatttacccacagcatgcaaaacttggagtttggggccacgtcagtctgccatatggacaatagtctgaagaaacagttgagcatcgcattccggggagaaataatgaaggctttctggttcacagctccaggcccttcctgaaacctgaccacattcctccctccagattccatgggacattgctg

SEQ ID NO: 10139 - DNA, 201 bp, Bos taurus
agctagaggatcagactgggctggagcacaggatgaagaggacagtagaaaagatgagggtggagagatggagtccagcccaaatcatgaaaggccaggaggcacaggtaaaggagcacagagcttgctctaagcacagggaatccaggggagagtttccagcaggaggagtaagagatatgaatgttgaaatcccagggt

SEQ ID NO: 10140 - DNA, 201 bp, Bos taurus
gcttccaaagctctaaattttcacatgtggcatttttattccatcttcacaataaccctgtgggactaatattgttttctcagttttcccatttaatagatgaaacggtaagagctcaaatgacatgcccaggctatatatgcggtacctggctggtctgggagttggacccaggatcttatttaaaaacactatttcagc

SEQ ID NO: 10141 - DNA, 201 bp, Bos taurus
aagctctgatgtaaagagctctgatggacacacttcaaactcaaagtagtggttactctggagaggaggaagaaagagacagatgtaggaaaacaggggacgttagctataccagcaatgctcaagctgaaagaagagagagaattttaagtttttaagtataacatatataattgaaattatttttcagttaaactttat

SEQ ID NO: 10142 - DNA, 201 bp, Bos taurus
tcaggctcccatgggagtggagcccaggcatgggtgttttaaaattccgccacggcatgtcgattgccaagtttgagaaccacgccaggcccttgtgcagctcatgcacccaaggctaggactcacatctggggagggaagggaattgcagtgtgaggcattacagggtaataggcccatgggttaggaactcccaagagg

SEQ ID NO: 10143 - DNA, 201 bp, Bos taurus
gactgagatgactttttacagaaaaggccacaagcagtgctttactgaggaattttgtctggaaagcctgtttaagccctctcttcttttggctgatgggcggccctggaatttgttcgttttccagtgttaggccatttaagggcatgatggttgaaccagtaagcaaactcacattgtgctattataagtgcctcatgg

SEQ ID NO: 10144 - DNA, 201 bp, Bos taurus
gctgagtggtggttaccaagggacagggggacaggaataggggagtcgttcaatgcatataaagttacatttatatgagatgggtaagtttctgggatcttccgtacaacataaagcctatagctaacaataagatgtcatgtgcttaaaatttgttaagaaggtagatttcatgttaggtcatcttaccaaaagccaaaa

SEQ ID NO: 10145 - DNA, 201 bp, Bos taurus
attctaaaaatagtatttattgacacctgctatatgccaggaactcttcatcataacattttggggtgtttttactactcccaccccccagaagaagaaatgaaggttcagagacacagtcaaggtcccatagcagccaaatgacaagtgagggttgagccaggtctggttctgcctgggggcacagtcttatgagatacc

SEQ ID NO: 10146 - DNA, 201 bp, Bos taurus
gactagcaaagtaggtctcctttatattgatagagaaataaagccataaaagtcaaataactttcccaaggtcccataggcaattagctaaccaactgcaatttgaaccaaactctgtaagattccaaagttcatgctctttcctttatagcaggctgccttccgattgccagataattggactaaaatttttacgggacc

SEQ ID NO: 10147 - DNA, 201 bp, Bos taurus
aaaaattatactagaattctatcctttaaaaataactgaaagttcttgcaaaaaaagatgtttatacagtaatgcttattgtagcaccatttatagtagcaaaataaatcagaacaaaaatatcaggggctagttaaatattacatgatacatatcacataactaaacagtggggtcaaccattagttaccactgtagaaa

SEQ ID NO: 10148 - DNA, 201 bp, Bos taurus
gcccaaggaattgacaatccactctgctctctggaagggggctgatgtttgtttcacaaacatacaaggttgtttgcctggaaccctgagtcagtcctcagggatactcccagcatgatgcccagtgtgaaaaggcttcttgatgaaagttgatttctcctcctcagccacatgacatccacagtagagagaggacacagc

SEQ ID NO: 10149 - DNA, 201 bp, Bos taurus
atcaatcttttctctccaagatgacccctccatgggcttctccattctgggagagaacaataccctctcccagtttctcgggcccaaagcctcagacacttgtcttggctctttctctcacacctccttctgtctgttccaagactatccagagccacacggcgcctcacccccacagctctgcctctggtcctggccgtc

SEQ ID NO: 10150 - DNA, 201 bp, Bos taurus
atgtttcataggctcgaggcaacctgttatggtagataaaacacagcacaacaaaaaggcaaggaaatttccgttctagtcctacttttaatccttgtaatagcagtgttgacaagtcacttagtttcatgtcacagtctgtgaaacatttcctgcctatgctcaaagaattctttaaggatcaaataaaaaaaataccac

SEQ ID NO: 10151 - DNA, 201 bp, Bos taurus
gcatcattttcagttgactattgccgtgtaataccctacctcaaaacttattggcttaaaacgaaactgatttcctgtttttcacaatcttgtgagttgattgggctctgctggacagttcttctgcttcatatggtgtagccaaggtcactcatgtttgcattcagttgcagttgaatcctggaatatcctcatctgata

SEQ ID NO: 10152 - DNA, 201 bp, Bos taurus
ggctgcccctagcgccctcctgtgttccagctcttttcttcctcatcttgtctctgttcctaatacgttccaggggcctgctgctaccatttcttgatcactgacttatggagtctcttttttttccccctaaagattctggttctgaaatcagagctggatcaccctgggcctcagttttctcatctgtaaaacagggat

SEQ ID NO: 10153 - DNA, 201 bp, Bos taurus
caaacagatgaaactaaatgcagtgacatttgcctcatctaagatgaatctcctcttctctggttttcaaaagtaggccatgtctagaatttatgggaaagctagactgttaagaaaatcttaaagtaagacaagttgtgtcacagagtaaaatgaacataaatattaagactcaaacaggcctggctttgagtattctta

SEQ ID NO: 10154 - DNA, 201 bp, Bos taurus
attttatatattagttctccgtgtaaaattgtacacattggacttctgtgtaaaagtaaatggatgcttacttccatggtaaagttgatgtggccacagagagaagagagcatgaggcttggaggaagttcattttgctcacaggtcccaaagagcagggtcactacaagccgtgcagggccacaagggaagtgcccaggt

SEQ ID NO: 10155 - DNA, 201 bp, Bos taurus
tctatcactactttataggccttggtcatcttccacatggcagatggagcttcctagaacaagagaactctttcctgaacattcaaatacctcattatttttctcttttcctgctgtggcctctgaatagattggtatcttagagcaagttttctatttgaagactccctctatccagaacattgatggcacaaatgactt

SEQ ID NO: 10156 - DNA, 201 bp, Bos taurus
agaagttttatctcaagtcaatagtaaatccagaagtcatcaaaattaaaggcaccaaaaatttcctacccctttcttccctaaaactacaaagatagcagaagatatctttagttttcagtgaaagtggggtgtgtataggttagatcacagtacatgattccacagaatttgaaagggtgaatgggaaatgaccaagca

SEQ ID NO: 10157 - DNA, 201 bp, Bos taurus
atccccagaaaagggaggagcagcaagagagggcttagtcagagggcaggatccagaaagagggactcctcccttaggcccaaaggccgagcagaggtcacgaggtggagaccaaatcgacatggtaaattggatagatgaaggcaatctgcctgccaaaataaggccagagaatcagaagagggagacaagacaaggcag

SEQ ID NO: 10158 - DNA, 201 bp, Bos taurus
ttctacaatctaatgattaggtctcaatattttagagggccagtgcccttggactgtgaatttcacacttgcttttcaatttcccctcattctcaggtgggcaggatgacaagagtgggccagagtttggcatttccctccccacacatgaaacgttgaagttggctggggtcgggtattttctttccccagttcagttgg

SEQ ID NO: 10159 - DNA, 201 bp, Bos taurus
tcctattgcacagctttcactgtacttggactcacccattgtgagctgctatagccctgctcccagaaggtgcatgtaggagccctttgacctctccttgaccaataaatggcccacccttgaagacctttgctgctggctgtctcccaaacagctgccccacaaggcttcactcctctaatccacttggctggaccagga

SEQ ID NO: 10160 - DNA, 201 bp, Bos taurus
aactgaactgaactcaactgagttggtatctggcttcctgtacacttcatcaactgacttcactgtcttacttccccacctcactgtaagtatatttctttccatcacctctcctagaaattgcttgaggcatgatacctttcatgcttgaggcatgaaacactccaaagctgaacttgttttcaaaggtatatggaaggt

SEQ ID NO: 10161 - DNA, 201 bp, Bos taurus
tactagaatctctagtaaaggaggaactcatggttaaaaagctcattttaggcactaaaatattttggctaaatttatggaatatagatctctaatggacaaaacaaaaatcacatatttgtagaattttcctaaaaagcttttgatgtgcgagtctgctaagactttgatatgatataatttgtcaaaatatatcttctt

SEQ ID NO: 10162 - DNA, 201 bp, Bos taurus
catctcatgaaggtcatccatgtccaggtgcaaagaaggccccaaaaggatgtaggaacttctattaaggaaccactgccagtttttccttggaatatcttcccttgaaaatgagagaccggcccccagacactcattgctagtcagccaactggcatatttgaaatttcctattccatttttggacagtctaaacttgtc

SEQ ID NO: 10163 - DNA, 201 bp, Bos taurus
tgtacctaattatgtatgacgcactcccagttgactcctgtttgaaatggggatgctgaaaatttccatctcagatggtggttgtgcggattaagtagaacaaggaacataaaatgcataatatactaaatgctggctttcagttgagttcttggaaatactggaggcttgccttgcaatcacaagtcttgctttcatgtc

SEQ ID NO: 10164 - DNA, 201 bp, Bos taurus
cctatttcctccttttggagacccctggcctttctgcctgttaccctgtcattagaatgtcaactttgtggacacttgcctacccctatgctccttcttggaggccatgagacagaggaagtaggagataaattctctcctcactggatgcccagggaagaacttcacagttaggaaataggtagaaaatagtaaagatat

SEQ ID NO: 10165 - DNA, 201 bp, Bos taurus
taccttctctcacatggagttgggaaggaagaggactcacatcctgagcctggggtgcccctgtttcttcttgtagatatgaaatgagctctaaggcctcatccttgagattttgatctagacggtttacagtgggaaccctgtgtctggacctttcaaactgcccatgtaattctgataacaactcactcatattcccat

SEQ ID NO: 10166 - DNA, 201 bp, Bos taurus
ttcacatggagcccacccagggctaacaaagaggactgaagaactctgcctgcattaaccaagtcccttactgctatcccagccagagcttactgtaaaggggagaaggccgtggaaatgctgtgcctgctacacctgtgtctctggtccctgcctgagatgacgactgcagctgagcattttgtctgttttctgacctca

SEQ ID NO: 10167 - DNA, 201 bp, Bos taurus
tcaggaagggtaaggatttccacagaccagccgaaggtggcagtgcatctgaacactccttgcccctccacctctggcccagctgcagggctgtgggcagaagccagtgagcgacagccacgaggctgctgctcgcgtcctgagagcacactcaggcttcacacccaggacttcatgagaggccacagccccacctgcaca

SEQ ID NO: 10168 - DNA, 201 bp, Bos taurus
tctagaaatggcagaaatcagatgtggtgatgtgtaaaggtgtgtgggccaagagtgatgggagaaaaggctcaaggtaggactcggagacacacctgcacgaggtgacctgtgcctggcggcctgcagacacggggcccggaggaaggccccccaggccagtcccacgacagctctgcaacagtcttgatgggggcttct

SEQ ID NO: 10169 - DNA, 201 bp, Bos taurus
ggctctaacgacataattagagtggaggaagaaatagaccaacattgggctgatgagctcagaaacaggttcatgagtgaatgtttcctggagaaagctcgctctgacttgaacaaaggaagaaatatactttggtgacggctacctgtagatcctgggttgtccaggctagtcaatgtcgtgagctatgatcctccttaa

SEQ ID NO: 10170 - DNA, 201 bp, Bos taurus
cattatggtatgagtgtggccaacagcccaatgatcagaccaccttacaaagtgagctgccatcagtaaacagaaacttagttcagattcctggtccaaactacaacacttggccctattgttcacaacaggagcacaaagttaccatgtttaatatattctggcatgaaaacttaatgtcttcaggccatcaaggaaaga

SEQ ID NO: 10171 - DNA, 201 bp, Bos taurus
gcactctcagtgagaattaaatcatgggtccaggtgtctccatcctgtcttgtgtctggttctgatccagaagagtagggggatgtgaacttcactgtggttgacccagggttattgctccaggtagaagacattgccagagatccaaaattatttagaacttttattcctgtttgattttcacatttacagaaggctaca

SEQ ID NO: 10172 - DNA, 201 bp, Bos taurus
acccagcttcccagccactcaggcatcccactcccttataagggatgctcccgacacactggccattgtccagctccttttcttggccaggtttcccacagtgtgatctttctgcctcaagtatcattcacatcgaccactaacccttcctcgcaggacatcttcctctgcttcttcccaatgcctgacttcttttattca

SEQ ID NO: 10173 - DNA, 201 bp, Bos taurus
ttccctgccagacggtttgtttcctattatggcatgtgaatttgcacacaggtgggccctcttttgcctctcagggtttaggagctttgggtaccatcgatagacatatcccagcatggtgctgccaagtcataatcgtgaccatttctgccttcttgttgcagaagtgtttcccttttgcttctgctgtcataactgaaa

SEQ ID NO: 10174 - DNA, 201 bp, Bos taurus
aaattacaggaactgtgtgaccgtggatgcaggcagaggtgctggctctgagggtggaagaaggggtcatgagagagggaacagagcagttctgtaggctggacaatgcagagaagtggtttctttccgaagtcccagaggggaaggcaggctgctggcatcttgacttttgctccatccagcaggcccataacataatac

SEQ ID NO: 10175 - DNA, 201 bp, Bos taurus
ttgatgaagatgtaaatgaattggatctcccttacattagttatgggaatggaaagttgtaaagccacatgggaaaacagtttggcagtttctttaaaaacaaataaataagcatgagctcaccactccacccagcaattgaccctctgggcatttatcgcccaggaattttttttttttcttttggtctggccctgtggc

SEQ ID NO: 10176 - DNA, 201 bp, Bos taurus
ggctccccaagaaatggtgagttgggatctgaaaggtgagacagggcaatcaaccccactagccaccagccttgtgctgacaggagccctgtggctgctggaaaatgagatgtggctggtggaaaatgagatgcacggaaaggataaaaatcatatgagatctcaatatctcaaatatttagcatgtaaaacatctcagga

SEQ ID NO: 10177 - DNA, 201 bp, Bos taurus
cggataggccacagaggagttcctcctatgcaaactatcctctctcctcctctctccttccctcctcacctccccccacccctgcccatcataagcacaggatgaagaggccacactgagcggtctgcaagtccctcaggtgaccagcttagaacagccacctgaactgatgcggtccccatgttctggagtaaccatggt

SEQ ID NO: 10178 - DNA, 201 bp, Bos taurus
caggccacaactactgagcctgtgttctagggcccaggagtgacaactaccgagcctacacactgtaggctcagcccacacacagtaagctcagcccacacgccctagggcccgtaatctgcaactagagaagcctgcacactgcagcaaagagcagcccccacgtgccacaactagagaaaccccatgcagcaacaaaga

SEQ ID NO: 10179 - DNA, 201 bp, Bos taurus
agaattccatggactacagttcatggggttgcaaagagtcagacacgactgagcaactttcactttccagtcagtcctgtttgctggtgagcacaccctcagttcttctagacagctggccccaggctggtttaactcattgctctctttctctttcacccccttgagcctcgtgcccaacttaaagggggacctgcacac

SEQ ID NO: 10180 - DNA, 201 bp, Bos taurus
ccagccaggactcacaccgcagctcagagtctgagtctagggctgatcgcttgtgttgtcagagtaccaatgccattttctttctcaaccaagacattacagtaagaacagaagacacggaggttaaggtgctcgtgtgcccactagtccatgtcagtgtcctcactgcgttttgttcttccacagtctatgctccagtga

SEQ ID NO: 10181 - DNA, 201 bp, Bos taurus
aaaggtattcaaccacattagtaagcaagaaaatatatgttaaaaccatggactatctaaaaacttaaaggacaaaaatatgtccatgagtatgtggaatgacggagtttatttagcatgtaaactggaattaactgaatgtgaaacttacttcaagagctcataattcttttcatttaacctcgcagcattctctctcca

SEQ ID NO: 10182 - DNA, 201 bp, Bos taurus
ttgaagaagaacttcacatagaatgcctcaattcatatcaactcattttgtatgaaaatctcaaggtctttataaaagggacagttcacctagacacactgctcagtgtcaagactgctagtattcaccttttagtcagcactttcccccaccagtcgtagtttctcaagtcctgaactacatggccaagccatttatttt

SEQ ID NO: 10183 - DNA, 201 bp, Bos taurus
ctgttgttttccctgtttcatagatgagcaactgagctgagttccgatgcagtttaacagcttcccctggtcatgcggttcccacatgtcgggcccaggcgtaaagccaggcattctctgactttacgttttggaccggtgcttattgatcatagtgcactgcccatccccggctgggccagaccagtgacttttaattct

SEQ ID NO: 10184 - DNA, 201 bp, Bos taurus
agataaaccctcccacaagctgctcacttgtcagtcagactcttggaatgtggacaaggaaaacctcagtgattggctgaaacggctcttaaattacgaccgaaagtttcactttccaggctctactgggaccagtaaccagactgcatcatttgtagcagcccatagtaatgccatcattcattctaaaaatatttgttt

SEQ ID NO: 10185 - DNA, 201 bp, Bos taurus
ccttctccagttgagggtattagaaggatgcaaacccagtgtgacatacaggtcaccatgggacccttggcttatgggttggagaaatgggccatgaccaaccatggggacctccagcactgactccactagactcatgtgagcagcaagtcatctccagcctcaccgcgtagacagaggtgggagagacagggaaacaga

SEQ ID NO: 10186 - DNA, 201 bp, Bos taurus
caccagctccaggcactttgttcatcaaaataactcactcatgccttcctgaaaatacatctccaaatagtaagaaaatttggaaaggaaaagttaacagcaggcctgcaatctactttttttccccttaacctggaaaatgaaagagatgccccagttaaacccctgcctccatgctaacaattagacctggaaaaaaaa

SEQ ID NO: 10187 - DNA, 201 bp, Bos taurus
cttttgtgtaattgtttctcccttttcaggctttcctctctataaaagagagatgcgattttctctcaaataatgagaagctgcctgacatgatcacaacgaacttactaaagagtaatattgatgaaggatgttgtcctttgatgatatcaatgcaagttgatcaatgaaccctttgaacacacaccttaaagtggattt

SEQ ID NO: 10188 - DNA, 201 bp, Bos taurus
gcgtaagcactgggccctacagatgattctttttaatatgcaaaagacatactgcccacagcccgaacaatttagaaatgcctcctgcctgttgaaaatcaagcagcatctttacatggcctcccctccccccaagaatcggggcacatttctgtgccctgggcttctgtgcgtctctgctccttctcaaggtccccatgt

SEQ ID NO: 10189 - DNA, 201 bp, Bos taurus
acaagaaaggcaagacatttccctcactgtgttataagaaagtcagccatgttccactgggttaccccgctgccatatgcaataggaagtggctttcttttgttacgaacagcatgtcttccgttttgtctcttgcctgagctggctggaaacaaaaaccgattacagaaacaggcttgtttgccatgccctgtatgacga

SEQ ID NO: 10190 - DNA, 201 bp, Bos taurus
agtgaagttcccagtagaagagaatgccctgcttctggccacagtgaaccgagtcatggaggaaacacggaaagcagcttgtctgggagcagaagcacagaccagccagctcagggtaagactggcctagattttttggtgtttgcctttttttaatttccgttattaatttaagagctctattagagaccattagatata

SEQ ID NO: 10191 - DNA, 201 bp, Bos taurus
ttctttggttcttttgatgatgaactgcctgaaaaatgtatgctatttaaattgtttgttatcttccagctaaataagttcaataattcctggtttgtttgtctgtctatggaatattgtatcaaatattcacatcaagtttaaaagttcaaataatcattggaatgaatgactacttgtgaaaaacagtaaataaataaa

SEQ ID NO: 10192 - DNA, 201 bp, Bos taurus
aaaggtaactgataaattcatgacattatcacaattgcaacacatataaaacacttagtccaagggaatttacctttgagacatcagttcttcaaaatacgtattttggcaacaactgctaccatcgttgaatgtttgaattatataagtaatgagcatgaaaacattttatgttgacaagaatctttccaacttgcaggg

SEQ ID NO: 10193 - DNA, 201 bp, Bos taurus
gaatcttagtccagcggctggagctagtggttagtaggaagcaactgtacattctctggaacggaagtgatactgtgctcttggaagtattaactggcaccggattccactataaataaaagaggaaatagtcatcaagaccagattggatgattttttaggggcctgcttttgccaacatgctcattattgggttatacc

SEQ ID NO: 10194 - DNA, 201 bp, Bos taurus
gggttgatgacacgtggatcttagagaagtttctataagtgctacctatctgtgtctaactcctcccattatgactcagcacccgggaccttgctatccatatgtatccagtcctcagggagtcattgatgatggtcactagtcataacatagaggtacttggagctcagaactcttctctggccattgtaatagtttctc

SEQ ID NO: 10195 - DNA, 201 bp, Bos taurus
cttcctcatgtcatgtgttaaaaggatgtcttgtgtgcatctgtcatccagggaacttaaaatggtttcagaatacagataacccaggcccatggtctctggatggttccccaaagacacagcatcatcctatgaaacatgaatatgcaaatgaacaatggccaggatgtatatatacatacacacacacacagacacaca

SEQ ID NO: 10196 - DNA, 201 bp, Bos taurus
tagttgggaaccaagggaactagaatacagtatactgcaggcccttttcgtggatgactcacattctaaatgactgctttttaatgccacagtttaaataatactgacacgttgtaggaacataacaacaaacccaacgccaggttacagttagatcatgcatgcctatttcgggtcccttcagctgaggattgtatacag

SEQ ID NO: 10197 - DNA, 201 bp, Bos taurus
ttttctgataatttttttttttctgtaagccttctaaaaaagaaaaggatagttctcttttctcctttcccagtagaaaggagacatagaaaagcaggccgaggtagagaattcaacatccccacacatatatcttacatactttattttgattttatgcagagaaaggacatttacttataatttttgaatgaattgcca

SEQ ID NO: 10198 - DNA, 201 bp, Bos taurus
gtaagctactcattacccctacatttaagtagattatttactctagagtcctttgtctgtgttcttttttacagaaaaagtcactgaacttttataaagttgacttcagtctgcaacagttctttccttaaattattgttctccctccaacaaaggacacaaacaaaaggaagggaaaacaaaaaccaaaattatcattat

SEQ ID NO: 10199 - DNA, 201 bp, Bos taurus
cattttatctcacaaaaatcaaattggattaaaatggattaaagacttgaatgtaagacctggagccgtaaaactcctagaagaaaggcaattagttcctggataccaatctaggcaatgatttttcaatttgaccccaaaagcaaaggcaacagaagcaaaaacaagcaagtagaacaacatcaaattgaaaggcttctg

SEQ ID NO: 10200 - DNA, 201 bp, Bos taurus
ttacacaagtcacagcgtgagagtctctttttgagaggctcaccccgactgctgaagctaaggtccctccttctccagccactctctggcccccagtctcgtggtattttcttcagctcattcctaagggaaattgtgtatgtgttgttgttgttattataagcgtgtttctccaggttgagcaggtcactgttgcaagga

SEQ ID NO: 10201 - DNA, 201 bp, Bos taurus
gaacggtgatgatgtgaacacaggaatgaaacctagtatcaggcttgccaggaagatggtagagaaaaacagaatgaactgggtggccaacctcctgatactggcaaagattgagggcaggaggagaagggagggggcaacagaggatgagatggttggatggcatcactgactccatggacatgagtttgagcaaactcc

SEQ ID NO: 10202 - DNA, 201 bp, Bos taurus
tgcagagaagagcttgagagtatagggtcaagagctccacgtcaggctgtcactggttcctccatcccatcccaggctgtgacgtaacctgtaaatgcccgtctgctcacttgttatatagaaacagtactagtctccaggcatagggttgctggagggtcagatgggacataacgcctgcaacaagtaagtgtgtgatgt

SEQ ID NO: 10203 - DNA, 201 bp, Bos taurus
tgagacagcccctgagcaagccaggggaggggccaggccaacccatggcactaaagttgcatgggacctggagagcaaggctccatcacagcataacaacccctctgtatcctggccctcggtcaccccacggggcccaggctcctcctgaagtgtgaagcctgaccctgctgggggctaagagccacacccagagggcag

SEQ ID NO: 10204 - DNA, 201 bp, Bos taurus
tgatacttattgcttggcctataagatatttattttgtgtgtgaaaataatttttacttataatggctgaaaaatgcacgcaagttgtagtgttgaatcatgtaatctaagataaatgcttaaagggaaatttcacaacagttgcttaaagaatcttttagaaaatgtttgaggatatagaatgtgtggtagccaacttct

SEQ ID NO: 10205 - DNA, 201 bp, Bos taurus
agaacgagatggtctaggaagtcccttctcatacccctgagtttctgaacgccttagccggggaccccttcctgggatgggggccaccagtcagcaccagcgaagtgaagggtctctaactgaaggggcttctgaaccaacaagttcaaccctttgtttaagagaagtgaggtcatggagggttcaccatggggctgcttg

SEQ ID NO: 10206 - DNA, 201 bp, Bos taurus
tcaccagcagctgattcctcgagctgggattaaccccgggcattggcaacagagaatctgagtcttcaaagttgatggcaagattggcctgcccttgctttgcatccttgtcctgtggatgcctccatggaaacctcttgtgaaagctgtaaaaatgcagacacctgacctgcttcctgagaaatctgtgtgcaggccaag

SEQ ID NO: 10207 - DNA, 201 bp, Bos taurus
taggtagaaccaaactccttacattaaacaacaggcatattgtacttattttccaaactcatttgcccctaattattgccaacaaaatgagagtccttttaaaatgccactctctgaaatgaccacatggacagcatgccgtgtataggtaaagggacaagcccactccttgtaagtgttgtgcttgcctgaaaagaaagc

SEQ ID NO: 10208 - DNA, 201 bp, Bos taurus
gcaatttgcaagaactctatcactgttacttagaaagtagagtcttcacagtgatttttcacaaatggaccactttaccaggcctacctagaagtggttttaagttctaactcatcaactgctaacagcaggcaacacaatggtagtcagattttatctctataaacacaactgaaagctctggccacctcttaagatatc

SEQ ID NO: 10209 - DNA, 201 bp, Bos taurus
taccacctagaacatttctcacacttatgtaaatgagaaaatcacctccttggtgctttggaagcattaattcctcctcctagaaaagccaattgacccataagaaaaactgcattcacatttcttttctgtggatatagaaaaccaagatctgtggaagtataggtttttcttacctagtccctgtattttccaaactgc

SEQ ID NO: 10210 - DNA, 201 bp, Bos taurus
aaaacatcattgggtgtctgtcaaggacatatacagattcctttattcagaggggctgcctggcgggacaatcctgagccaatccccttgtagggtctgatgcccacaaacaatcccggtgcttgcaggcactgggatgctcacaggaatggtgcatcaaaattcaaggatcacacgttaagttctccaaataaattttga

SEQ ID NO: 10211 - DNA, 201 bp, Bos taurus
ctggtctccagaaaagaggttgtaagacggagagttgtttcctatactcactcatggtgtcttcaggttccttgccaaagtttctcttaattttgaacccctttggaaagaggcggttctatagatctgcaggagtcttcagtataaatgaatctattgatcaaaagttatcttctctgtttggcccaagtattgttggtt

SEQ ID NO: 10212 - DNA, 201 bp, Bos taurus
ggtaggaaatatattaatttatggactagtttggagacagtttatgtttttaccatataaagattagctattcatacacataagatgttttcttttattctagcttttaaaatgctcttcagtaaagttttacataaggtcttgtgcttttacattatttttgtattttatggattttgttgctattgtaaacaggttttt

SEQ ID NO: 10213 - DNA, 201 bp, Bos taurus
aagttgcctgtttcagtgatgcattcctttcctagaggtgttggatttgaaactggaggggctagtgtgttgtggtggtttcaagacatatgaaacatgtccttattgattattaacagtgtattttctgttgattttgagaaccttaaaaccagaactgtctgtattttatgaaagagctgtcctatgaagtcaaatgac

SEQ ID NO: 10214 - DNA, 201 bp, Bos taurus
atatttttcttttgcttacaagaaatgtcctcataagaaactgaaattctcatttccttgtgcttgaagctcacaatactaacatatgtatgtttagatatgtagtatttctgaaccccgccctgccacacactttccaataaagctcaacaagaattctttgttgagagatgtaatatttggaggggaggataggggaat

SEQ ID NO: 10215 - DNA, 201 bp, Bos taurus
ttgtgctcccagtgctgggggccaggttttgatccctggtcagggaactagatcccacatgctgtagctatgtcattaggagtaaaactaaagactgaatcgatatttggtgattgctggccttaggctctttccaactgtattggcagctttcaccttcacagactgtgtctaggacgtttctagaagcttaccacgtca

SEQ ID NO: 10216 - DNA, 201 bp, Bos taurus
cccccaactccccccaatacctagatgtagagctaaaagctcacagtctccaatgacccatctgttgctccagttgtaccagttgtattgtgagcggcctcccaccctcttttgagagcaagggaatcacagacttaatacagtaaaatgcagtgggtcccattctatggtacagggtgttggagcttggtggtcccgact

SEQ ID NO: 10217 - DNA, 201 bp, Bos taurus
ttcgccagacaggccagcaagatatggagaccaccatggagggggctggaggaaggggccagaggagaaggatagacaagtgactttgataccagatgcagtatgggaagtcccataagagaattccagcatcaaactctggggtccagcagagaaaggaataggaaaaggcttaatcaaaacaccaatttttgaaaagat

SEQ ID NO: 10218 - DNA, 201 bp, Bos taurus
aacctgcacaccctgcagaagaggcatggagtcccagtctctagaccaccagggaagtccctaatcacttattttttactggtgagaaacttcatgggacgttccaggaagggaatcccaagaggcctcagtttaggtcccagatctctggtgcttccttatctgtagggacagtgaccattcccgtgctcagctcacaga

SEQ ID NO: 10219 - DNA, 201 bp, Bos taurus
cacaggaactagctttttagttgtgaggttgtggtgcatgtggtgggtccttttagaaaggagatggtgttggaacagtggctaagaatttggcaaactgagaaagaattttaaaatggcagaattgaaaagataaggcaaaggcaaggaatacaaaatgcccaggtgttgggaaaatgctgtaattttagtttggctggc

SEQ ID NO: 10220 - DNA, 201 bp, Bos taurus
cctctaatgtaattatttaaccatagtaacggtgacaacaaaaacaacttaaaaaaaaaatcaaagcccaacagaggaatctggatattgcttggaacatgtcatagaaaagtggtcctaatatgagtctgatttaagagagtgatgaaggttcatctttgctgcttgttccttccactaagatgagtgttcatgtgtcag

SEQ ID NO: 10221 - DNA, 201 bp, Bos taurus
aagggcatgagattgtgcagctttatttgcaaatgtgtagcttggctagatcaggttagcttttgagggacggtggccaagaatgtgatgggacaggtggagactggcatatagagagtcagggaaatggaagacccagtgcagctttcagggagactcaggcaagcactgtgggccattcagttggggagaatctgttca

SEQ ID NO: 10222 - DNA, 201 bp, Bos taurus
ctgttgaaaattgattctgtattaatgatgtcatcacttatttggtacttatgaaatcaagcttactgtcatttttccccttgcatatatattctgttcaatcatttttatcatataaatactggtggttcctcaaagattagcgttgtgaaaacatgaatgatttgtttatacgtgaataatatatattgacattttcat

SEQ ID NO: 10223 - DNA, 201 bp, Bos taurus
aagtatttccgtggagttatagggacgcactttttatgattattattattgattgcaataagtttcagtcccattctaatcctggtatccagggtcttttcgaggctggagaatgtacctgcaaccttggacctggctgtatgttttcccaccatttgtccttgaagtgtgaactgcaggaagtttgttctattttatata

SEQ ID NO: 10224 - DNA, 201 bp, Bos taurus
tatttaatgcttccagtgcctgtgcaaaattgtatacacaatggagaagtttttattttcaaaaattccactatgaactccttttattgcaaaagctttcggacctcctgaaacattggagttgataactggtttgtgactaaatgatccagagttgatcatggtttcatttctgggtgactccagcagtccgaccttttt

SEQ ID NO: 10225 - DNA, 201 bp, Bos taurus
atttacaaggttttagacatgaaagaaaggcagcagattgaaagtgagaatgggagagcactggagaatgaggggtccacagagggtcatgctggcctcccggcaatgctggtccctaccttcaggtgcatcatttgttgccatggcaacttcatggaaataaggaaggtgggcggagcttggcccaggtcctgagttttc

SEQ ID NO: 10226 - DNA, 201 bp, Bos taurus
atgtggtcgcacagagtcggacacgactgaagtgacagcagcagcaactccctgtccacacactctgagctgtcacgtttacctgctgtggtttctacagattgcagcttgctccacagtctttccaggcaatccgaaccaggggtggacaaaagcatctcaactctgttctctgtcaacatcctcaacatcttcccagcc

SEQ ID NO: 10227 - DNA, 201 bp, Bos taurus
gtcccatcaatctttgtcaagaaggaagtttcaggggagggtcgagaagggggtcttccgatcctgttttattctttcctcttttgcttcagggcccatgactgacgactctccttgaataatataaattctgcctgatcttcacatgtccatatctgtaaatatggggccacaagataattaaaacctcttaagaaagtg

SEQ ID NO: 10228 - DNA, 201 bp, Bos taurus
gctaataagaacagtctgtctatggcccatcaaacatgtactgtacctctgctttaatcattaagaaaagaatgcattatctagaagttaaagaaaagtctgctctgaagatagggataaatggccgcccttcctatgatgcccatgctagtggtccttccaagataaggttcccttgccagacattaaggtcatgctgac

SEQ ID NO: 10229 - DNA, 201 bp, Bos taurus
gtgttcttgcctggagaatctcaggggcgagggagcctgatgggcttccgtctatggggtcacacagagtcggacacgactgaagtgacttagcagcagcagcggcatagtaaactggtttaacagtgtgtagaagtcttctgagtcctgtgagtccttccagcagatcatggagcataaggatggtcttcaggaacctca

SEQ ID NO: 10230 - DNA, 201 bp, Bos taurus
gagaagcttgcagcctaagacagggaagagttgttactccattggtggtgttgttactccattgtttctccatgaaccttcctatgacataggaagtgacactgaaataaatcagaagaattgcatctagcctttccaggatggaaaaggaactaaatcctcagatctttctagccaagtgtctgtggaggaagatactat

SEQ ID NO: 10231 - DNA, 201 bp, Bos taurus
cagaaccgggacaccatttgggaatatcaggctcccatatcaattcttcactttgaaaacagactcatcttcccagtatattctaacctgatctcctcttcgcctcactcttgtcccaatctgcccccttagccatgtccagatgccctgtcccttgaaacccttgtatccacttcttttttcttatcgtgatgatgattt

SEQ ID NO: 10232 - DNA, 201 bp, Bos taurus
gtccttttgaaatgaggaagtctcttttagcacatatgactgaagcagaggtggacgtgtcttaacaacctatgtaagggctggtgcactggtcatagcagacaccctcttccacaacacaagagaagactctacacacggacatcagcagatggtcaacaccgaaatcagattgattacattttttgcagccaaagatgg

SEQ ID NO: 10233 - DNA, 201 bp, Bos taurus
gtgacatggaccatagtccatgaggcagcctctgagtaagatgaggcaagtaagtggactccccctagaactttcagaaggaatgtggcctgatagccaagttttcactctgacacccagagctataatataataaatgtgtgttgttttacaccactatcattatggtgatttgttacaactgtgataggaaaccaatac

SEQ ID NO: 10234 - DNA, 201 bp, Bos taurus
ctacgattggcagcatctggatttctcaaggtttaactctagaattaaaacatggcattttcttctgagcaatacatccattggatatatcatagaaaattaatcaacaggacttcatttagggataatctagtcaattaactataggacaagatcaattaaatctcacccatcttccttttcggccgacagaatcatttc

SEQ ID NO: 10235 - DNA, 201 bp, Bos taurus
aagttccaggtagtaattagagtattttaaattgtgatgtgtgaaagttatgaatgatgatgattcttttgctttttcattgttttttttccccaaaggtttgtttggggttagtatcaagaacatcttattcttgtaaaaattaaaagactgtgctaaatgtgcaatttttaaacacttgtctcactgtatggaaattca

SEQ ID NO: 10236 - DNA, 201 bp, Bos taurus
gcgccagagcgccctctgctgcccgaaagaggcatgacatcacttacaaaagccagatggcactgagctgcaataagcggtgaaaatattaagctcttagcagcatttaatctgtgaaatttgaaaactctcatcatattgtatgaagggacaacctgattttgatttcgagtactcctcggataattttcttcattctgg

SEQ ID NO: 10237 - DNA, 201 bp, Bos taurus
caaagcctcactctgttccttgcgggcttttccctggataaaatctctctcacattccagtggatttaccctaggttgtccacaagagcctcttcagtgcgagctcgctgaagctgctggtacaggggatgagacaggacatgctggaggtcaaggtgcccttcccagccgcctcctgggcttgcagagctccttcatcaa

SEQ ID NO: 10238 - DNA, 201 bp, Bos taurus
tggcagccaagttcatgaccagccactcatgtcttgaagggagacaatcacctccctctagtacatcttctcagtgcatcttctctcctcggggttacaacttccggctcatcacttagacagatgactgggattagggtaatagaagccacatgctggagacatgtgtggtattggagggttcaagttattctgtgggca

SEQ ID NO: 10239 - DNA, 201 bp, Bos taurus
ggaaagaataattacttgagcgctgcaagctataaagccactcaagcttgaacatgatagtcccgatggccagagtgcagagacttccttgaacaccaagtgcactcagtaaagcttccgtcaagatcatgacctaggagtttagtaccaaacttcaccatgaggaaaggctattcaagacctgcctaaaaaagaaaaaga

SEQ ID NO: 10240 - DNA, 201 bp, Bos taurus
aattagtgaaacaggacggtcactgtgattacaggacacagaatctagaatcaggaatgtaatgttcaccacagaactgtctggtgaggccacagagacaggaggagtgcctgaccatgagaggatgatgaatcagtttcctgagccactcttccgtggtgagcccacaggaagagaggactgtgatgcaaggccccatca

SEQ ID NO: 10241 - DNA, 201 bp, Bos taurus
aaggctgcatggagggacagctgtgtagacgcgatcagagtcctttctaggaggacaggcctgagtgggggcctgggaggggaagagacactggtcaccagagggcagagagaaagagaacaggaagagagaagaagaaaaacagaaggcggggaagtgggagggaggctccgccactgaggtggcctttactgtcctcac

SEQ ID NO: 10242 - DNA, 201 bp, Bos taurus
aaaacaagactctatcaattggcatttgaactttaaaaacttttaagtctcacaatgagaaatgacaagcataatgcctcacggagtcaagtaaaaatcccgcaaatatgggatcgctgtctcaaccgccactaggggtcagcactggactctcaatgtgattctgttatgagagacattctcagattatcactagcagat

SEQ ID NO: 10243 - DNA, 201 bp, Bos taurus
agaggaaatgcagacaagaactcttaaaatattgtgaatagtcatgatcagtccatacttaagagggataaaaatttattgatatccttaaaccagcatcgtgaatcctcaggtcccatgctgtcattcttctctgtctcattcatgaaggatgtagactatctctcagagtcttcttcctgtcacatctgagactttgcc

SEQ ID NO: 10244 - DNA, 201 bp, Bos taurus
cccccccctttttttttttcgcagcctgtgctttggctgggatacaaactgagcagtggctactaaagataagtttttggagatataggacagtacctacagtattagtttatttaattcagacttcctgcttgtgcaaggattcacccttttgcaaaactgtattcttctcttacatgagtgagttctgacaatagcaca

SEQ ID NO: 10245 - DNA, 201 bp, Bos taurus
attatctgggtgggtcctaactagaatcacaggtgcctttataagagaaaagcagagagagattcgactacagagagaagaaggtgacgtggtgatgaaagcagtgtttgaagatgaaggaaggaccatagccaaggaagacaggttgccaccaaaagctgaaaaaggcaaaagaagttttttcttagagttttcagaagg

SEQ ID NO: 10246 - DNA, 201 bp, Bos taurus
atatataattttattcttgaaataccaaaaggtatatcccagagagaatagagtgagcataaaatttttttaattacatactttaaggaaatcataaaaatgaactgatgaatataaccaaaaggaatagaggaagtttctagaaaattctggaggtgactcttctttttttttttaattattaatttatttacttggctg

SEQ ID NO: 10247 - DNA, 201 bp, Bos taurus
ctttcctctcattcttagaacttgcttcccttccatttggctggtttcaggcagagggaagaaaatctgttaataagccaatatctataatatgagccccgggtatccctcccttcccaggtggtgctagcggtaaagagctcgcctgccaaagcaggagatgcaagacacctgggtttgatgcctgagttgggaagatct

SEQ ID NO: 10248 - DNA, 201 bp, Bos taurus
ctcaagttatgggatttgcttcatgagaaagatagccaaaaaaaaaaaaatcaataaccatctcttataagtgtctgaaagataaggctaatccaaaactatattaaacactctagaaatacaaataataagatgtcagtgtgaacggttctcatttggtatcagctggtaacttcaggatggtcttgagaattctgcctc

SEQ ID NO: 10249 - DNA, 201 bp, Bos taurus
gcccaggtttgtcagtttttgaccatcagcaaatgtgctccagtatgagagcacattgagctcctgaaccactaacctgctgaccatgaatagaaacagcagccaccaggacccaaaatacattataagtgattactagccatagtacaatcctgcttgcttaaatctaatgagtatttatatatatatttcaaagtagac

SEQ ID NO: 10250 - DNA, 201 bp, Bos taurus
gggaccagaggagcaggccaatgtggtgaagaaccacactctcctgcaagtgactgctccaagcgtaggtgtggggccagtagggcaaccagaatccttccctgggcttgtatgaatggaagcatggagagaaaaccacctttccttttgcatcagcaagttggaatgttaaaagtctggtactacctgaggccacgctcc

SEQ ID NO: 10251 - DNA, 201 bp, Bos taurus
catcctaggttttccttaagctagtctatccatgtgacagcaggcctggggccacccagaatcctgccctcagatcaagtttaaccgtgagaactgggcctatcttcttgtgcataatagttttaaaaatgtggagcccactcatgggaaccattcactgttgaattactgctctaagtatatccacaaaaccatctcaga

SEQ ID NO: 10252 - DNA, 201 bp, Bos taurus
cacaggcaaatgatttctttagcttagtgttctaaggcagtatttcaacatcaagagtcgcaactattagggcaaaaacacatttgggccctggacaattaaattttatataaggttaagtttctaattaatacgggtctctttttggtattaaacatacaacctaaattaaagggtttaatttaaaaatttacttgcatt

SEQ ID NO: 10253 - DNA, 201 bp, Bos taurus
acaagcacaacctagctaagacagtgggcagcaaatgtggtaaaagggaaagcctgagaaggctcccttaatttctgcctcgatctaaaagaaactatttcttttttacctttaagaaaacgaagcggtgagcaagcagagaatgcattcttatatatatggtaccatcatttttagaaaaaagccatatttatgcctctt

SEQ ID NO: 10254 - DNA, 201 bp, Bos taurus
agtcgcgttaagtcctgaacccgtattctgattggaactagcatgaaaactcctctctggtagatttgcaactgcatttaataaggtgactaaaacgtccaccctggccgggacgtttctcacgtggagacagagtgcaattttatcttgggaaagcactgaggacacacttcttgaacacatacaatactgaggacattt

SEQ ID NO: 10255 - DNA, 201 bp, Bos taurus
acaaaccgtcttggtgggcatgggcacaacataagactgacttacataaatgagacaattacagagcagccaagacaatgtatgaacataaaatactgcacaacaaaacgaaaaagtctggaaagcagaagcccacataggctaaaggagcaaggaaaacatggaacagacgttttagaactgggcttgaagaatgaataa

SEQ ID NO: 10256 - DNA, 201 bp, Bos taurus
cataaaaccagagacagtgagccacttggcagagcagttctccttggttcctttaccttcctgctctctgtttgggccttccttcccaataaggtctcttgctttgtcaacaagtgtgtctcttcgcacaagtcattactgagtgttagacaagagcccccttttgggtcctggaagggggccccttcctgcaacattact

SEQ ID NO: 10257 - DNA, 201 bp, Bos taurus
agacataaaaataggccaacaatcaacaatagatgagggaaatgctatgacagaagtgaatatacaagaagaatgctgtaagaggataagagcagacagaagactccatccaagtcagaggccagggaagcctggaggaggagttgataactaagtcaacacttaaaagatgggtgtgaatgaccgacagtcagatggaga

SEQ ID NO: 10258 - DNA, 201 bp, Bos taurus
aataatgatgaactttatagtatttcagtaacaggacatcaaaggtgaaatagaaacattccccaagaacctggccttctcttgtggggaagaggttggtatgttttcagttgtatgaaggatagctgcattgtggtatgtagagttatgactttgttattccttttatttggaaactgtgatttttaagagatgggtgtt

SEQ ID NO: 10259 - DNA, 201 bp, Bos taurus
attcagatcagaaccttagtcccaggccttttcttaataaaaattatgaaaacgaggagctataagagtaagtgctttaaacatcagacctgggacaggagtccacacgtcaaaggcccaagaaaggactgtggcattcacatcgcagagctcaacaccaaagagtcctctggcccatctcaactacaacatactaggagt

SEQ ID NO: 10260 - DNA, 201 bp, Bos taurus
taggcgaagaaaggtgacttgctcaaggccatccaactgtttaatagaatgaaatctgagtgtcagtctaggggttatttttatttttaaatttttgctacgccaattggcccaaaagatttttttaatgatggtgacataataagtcagtgtatctcaaactgtacacccatccctacaagcttaagagtacgtgtggta

SEQ ID NO: 10261 - DNA, 201 bp, Bos taurus
aatactgcctggctaaaaaagtatgtagaatattttaaaagttgtatctacttaatacttaatacggtggaaaaaagtgcttgatttacctttaatttctgactagagctgtctctgggctggctcaaaatgttgtgacatattaaatagcagtgccaatggactttttaaaaaggaaaaaagggagaaaaacctaactct

SEQ ID NO: 10262 - DNA, 201 bp, Bos taurus
ggtgcacattactatgtataaacagcaaggacctaatgtatagcacaaggaactatattcagtatcttgttataaacttaatggaatagactcaaaagaaaaatatatagatatatacatacttgtataaaggaatcacatttgttgtacacctgaatgaactacaattgaaaaaaataaattaatttcttattctagctc

SEQ ID NO: 10263 - DNA, 201 bp, Bos taurus
gagtctacagcctctagcccagggctgtcaccgttgcacttccctgcaggtaggtaggctaggatacagttaagacggtggccttcagaaccacactttccaggtctacatactggctccactactcaccaactgccccaaagagcttgactttcgatggccgtttcctcatctatcaatcaaggatgataagagaatctg

SEQ ID NO: 10264 - DNA, 201 bp, Bos taurus
cttttgattcaaatatttttgctcttacataaggacgggctaagtccttagatattttccctattgatctggcctattggctaaccctggttcttccacagttcggcttattttgaaagtgaaagtgttatttactcagttgtgtctgactctttgtgaccccatggactgtagcctgtcaggctcctctgcccatggaat

SEQ ID NO: 10265 - DNA, 201 bp, Bos taurus
gagctaccttggaagcaggccctctgtccccagtcacaccttcagatgactgcagcaccacctaacatcttgagtgccaacccctgaggttctctgcgtcagaggttagtcggctgtgctggcctgaatttctgacccacagcactgtgagagaaagaaatatttactgttgtttgaagccatcgcatttcaggtaatttg

SEQ ID NO: 10266 - DNA, 201 bp, Bos taurus
gcatggcttctggagaagggtgaaggatcttggacctgctcaccacctccatggccgcctctatggccaccagcctgtccaagccatcatggcctcccactggggtgacagcaacagctcctaagtagtctccctgtttcttctgcttgccaagtcagtgctcagttgcttagtcgtgtctgactctttgtggccccacaa

SEQ ID NO: 10267 - DNA, 201 bp, Bos taurus
ctttctcctcagaagtaatccccaccctgacttttgtggtcttctttctcttactttgctgcattgttttcccacatttatattttaaaacatactgtttttttattgcatcattttgaagctacataatgtgaaattaggtggcgctagtggtacagaatccacctgccattgcaggagatgcgagagatgtgggttcag

SEQ ID NO: 10268 - DNA, 201 bp, Bos taurus
tgttttttgcttgttccctacatagttccagaaaatccatcctttattttgagcctaggccttattaaaataagcaaataagggccaggggaacatctaaacaaattgtaaatcaccataattaactgatattggatgatgttagccaaaacatgtggccagaaaaaggatagcagtgctttgaaattcattattcactca

SEQ ID NO: 10269 - DNA, 201 bp, Bos taurus
ataaggatgtagctatgaaactgtgctggtagtgcaaaggctacttagaaaagtacccttgttgctattagagaacattggatatggtcacagcaaataacaataaggatttttctcttctatggaaggaaaaaagataatattatatgggtctgggaaatcaaatatgctccttaaaacaacccaaaagtaactgctatg

SEQ ID NO: 10270 - DNA, 201 bp, Bos taurus
ccaatgatttctgtggtccttctctgagctccagatccatatagacatcctcctactggagagaaccttctggactgcccaaatgcagtctttctgaaaccaatgcactctcatcccttttcctactctatttctggactttgcctcttagtgaccaacatcctggtcttcacagtgaagcaagcaggatattccaggacc

SEQ ID NO: 10271 - DNA, 201 bp, Bos taurus
agtgatgttgcttttactgatgataaaaatggcccctaatattctggtgtttggcttccaataataaggatgccatccaagagttcaaacttccctgcaggttcagagtcttcctgaaagaaggaaacttttattccatctgaggttggtacaagaagctcttcatattgttttcctcacattacattcattctgtttcct

SEQ ID NO: 10272 - DNA, 201 bp, Bos taurus
acccagatttatccatttgatgtatttagaattgttcatacgtggtactcttgaaaccagagacatctttactgctaaatggcctctcggtgatcaatcgaaagaccactctatacctgccctattctctgacctgtttgtgtctttctcagagcagcaactcaccctttacaacatcgcccccaagcggcctttcggcct

SEQ ID NO: 10273 - DNA, 201 bp, Bos taurus
cccctcccttttggacttctccccactcagctcgccacagtgtattaagtagagtttcttgtgctatacggtatgttctcattagtatttttatgtatatctggggctgtttctgagctctctatgctgtttcactggtacttttcaatctaccccatattaccatcacatgccttagttaccaaggaaggcttcataaca

SEQ ID NO: 10274 - DNA, 201 bp, Bos taurus
agccttgagccacggactgatccaaacttgggctaacacacatgactgtatcagcaggatgccagtttgctatgcttcttcctggccatttcccaggcagtctcaagaaggttgaaactctgggttgtgtcatgcagtcagtcaactgagatttataaagcacaggccatgtatcagaagtgggggtagaaggattaggaa

SEQ ID NO: 10275 - DNA, 201 bp, Bos taurus
ctggactaaaaaggagggatttatttttgaccaaatagagacttggaggattctggaattcctcacagcattgttagggctcatgaaaaggccagttctcctcctgacactcacctatctagctgtgttcactgtctgtcctgttcatcaggtgactgtcagggcctggcctagcactggcacaaaaggctgctgcccaca

SEQ ID NO: 10276 - DNA, 201 bp, Bos taurus
gggaaagaaagtatccacacaggcaagtcaaagaagagtatagaggattcgtccaaggcaatccagggcaaggctgcttcagcctttcgtgggtcatagaccactacaggcatctgatgagagctatcttcagatgtgtgtaacacatgcatgatacatgcatgaatatatttatgtgtgtatttgtgggcaattcccttg

SEQ ID NO: 10277 - DNA, 201 bp, Bos taurus
ttgcacagagaaatcccatggacagaggagcctggcaggctacagtccatggggtcgcaaagagtcggacacggctaaagtgacttagcatgcaccaggcgctgaggtttgtcaatcccctggcattattttatcccttccttcagatggagccagtaattagaaatctaagtcagttctgaattaggtattcatgataac

SEQ ID NO: 10278 - DNA, 201 bp, Bos taurus
ggtcacttaattcattcccacaacaccttgtgttaagtaggtatgaaggcaaaaattcagattatttataaaacactgtggaaacttgaatatggcctatgtattagataacaaaacagaattcgtcatttttgcaggcaggcggctgcgactggcgcgctaagcgcaggtgagaggagccaccccacgtccgacgtcagg

SEQ ID NO: 10279 - DNA, 201 bp, Bos taurus
taattctttgtatgtcatgaaatttgataatatgaaagtgaaatgcatctcaaagactgaagtgggttaatgaacttataaaactacacttaagtcttttaaagcctgaataaacagacaaagggacttattagctcaaaccataccaagaaaatacagcagttctcatgcttaactctgcaatcaatgagagagatatat

SEQ ID NO: 10280 - DNA, 201 bp, Bos taurus
atctgagccaccagggtggaaggcataaataaatttattaatgcaatctgtgactaaaccaaagaccacagattaccatgaacactaatcctaccttcaggaatcaggcttcaaacactatacaatagttggatttaaaataaagatttgtaagcaagaagcaaaaatgtactggcatttctgctgtgtcataaaataatg

SEQ ID NO: 10281 - DNA, 201 bp, Bos taurus
gaggagtctggtgagctacagtccatgcggccacaaagagacacaacggagcacacatgcacactggtttccggagctgcaccttctcctgccaggaagtggggccccctccctgaagtctgatctcctgaaaatgatgcccgccacagagcccgccaaggcggcccgagcatgcgcagagctccccactgaagtcaaaac

SEQ ID NO: 10282 - DNA, 201 bp, Bos taurus
ccgtaactttgacaagttacgttggtaaaatcgctgtaacaacaggatctgcacactcagcaaaacagaggcctaccctgctttttgagacagattgtttctatacttaataaaatgtcctaaactctctgggacttgatcttcaaaatatgccaaaataatacagatgacagttttcaatcaacaggcaaagaatacttg

SEQ ID NO: 10283 - DNA, 201 bp, Bos taurus
tttttccagccaacaaccttaactatctagggacagaatcctcattttctccatcctgaatccattgggggtggagaaggggacggctgcagtggctgacagcttgatggctgttttctgatacagcaggtgacattctatgtccacagtttaatagtgaggcgtgtgtgcctggctaagtcacttcagtcatgtccaact

SEQ ID NO: 10284 - DNA, 201 bp, Bos taurus
aatcttgcatgccttgtatccagcttagttccttgtatgtagtaggtgctcaatttatgctgtttgtataaatcaaaataatatgataggattttcaaaatacacaatcgggacagatggtctggtaaagtatgtttttcttattagtaggtgtatttatatagattcctcttaaaattttatttttttctgttggtcatg

SEQ ID NO: 10285 - DNA, 201 bp, Bos taurus
ttgtattgtctgaattttcctcttgtaaatcaagcaaactaataccaatttatatgggaagcttgactaaccctatggataaatgctgaaagccaaaagagaagttatcacatttaacaaattcagtagtgataacattaacacatatttagtatcaggatactgatatatcaatgttaaaaaaatgcttactaaacagtg

SEQ ID NO: 10286 - DNA, 201 bp, Bos taurus
cagagcccataaggccacgctttctaccctggaaacacccgcaggtgaatgtgcagagtatacatccctattcctggtccagtattggccagcccgatgatgtttcttgtcaagggtcacacaggtctacttttccttgaggaatcaagagctggcatggcctgtgctctgtgtcataggtctgcctagtccaactttccc

SEQ ID NO: 10287 - DNA, 201 bp, Bos taurus
cttgctaggctgtctactggccttgtgaccttcttatgccttggtttcccacatgctcagtgttgctatggggatgagaggagacgactgatgacaaggtcgcggcacgggtccaggctccaggtaactggccaaaaggtagcaccccaactgctatcctcacaccaaaaggggaagggcgtttgcactgatgtgtgatat

SEQ ID NO: 10288 - DNA, 201 bp, Bos taurus
ttcttgcctctattatccacacactcccacatatatgttgatgttgactggagcattggttacaaatgaggtgatgactcagagagaacactaagaagtcggtagagttgaactgagctggggaccagaactgatactgctggcgaagagccagaagacagaagagcccaattccatctggaaatagggattcaaagaatg

SEQ ID NO: 10289 - DNA, 201 bp, Bos taurus
atcctcgattggcttcttggatccttctctttttaaaggaaaactgcattctgttcaaactagctgaaatatcctctgcaggtcaaatggtatattccgtgcaggaatacaaatttggtttgggtcctcaggaggatgctctgtgtatgatcctgacaaagtctcatattaactcccagagcaaactgcacagcacattgc

SEQ ID NO: 10290 - DNA, 201 bp, Bos taurus
ctggcgggctatagtccttggggttgcaaagacatgactgaagtgacttagcacagcacacaccaatattggtttcagtttattatgtatcttgaggagcgtcatttacttgagacatgcagtcagagcccaaggattctgagctgtcaagagtttgctgttatgggaggatgtggattctcttttggcagtatagaatga

SEQ ID NO: 10291 - DNA, 201 bp, Bos taurus
gcttcactatggatcctgtcagacatttgaggaagaaataataccagtagtgtaaatatccttccagaagtttttaaaaaaagagaaagtttcccaatacattccacaattttagcattattctgacattgaaactagacaaagacattacaaggaaaaaattgcataccaatattcctcatggataaaacaaatgttaag

SEQ ID NO: 10292 - DNA, 201 bp, Bos taurus
taatggactgagaaaatagtagccattgcttgaaagtaatgaagtttgaggctttgtcaaatggaagttgtaaatatttagcatcttctataaactctagttttgacatgttctcggtttttagtatgtttaaaatttaaagtgacacaagcagtgtgtatgtattaaatactattttattatcaaattttaaacttggtt

SEQ ID NO: 10293 - DNA, 201 bp, Bos taurus
gttaaactgatggattcctttacagaattgtatttgagttgtgtaggcatactcataatgttcctggttatggtaggtaagtttgcttttaaaatgtggcagaaacgattttcatcgttatcatgttttgttggttttttttcctgtcctgtagtctaagcagcatcacttccgtggtccgttaggacttccctaccaagt

SEQ ID NO: 10294 - DNA, 201 bp, Bos taurus
ccattttccttccgtttgatgacccactttattttcccaacacaaccacctgaatgtctcctggcatccattattcataaatggctatgtcaacagaatataattgcagtgggtttgcttcaacaaggtataatgtatcccagtttaaatttctcttattcattcatcagccagccataaaaaaaaagagagagagagatc

SEQ ID NO: 10295 - DNA, 201 bp, Bos taurus
gacgaggtgcagaaagcacacaatctaaagttaccctcttgacttagctctttctcttttctttcaacagatagatgcagacaaacctttgataactgtgctccctgaattcattcccctaacatcattcctaaaggcaacctctagtctaagctgctatatatcactctcatgcatgttttataacttctttattattgt

SEQ ID NO: 10296 - DNA, 201 bp, Bos taurus
aagcataatttgttcacaaaatctcagtttggggaagaacaaagacttgtgaatcattacagaaaagaatcatttcattctctcactaaattgtagcctttctgagattacagtaaaagaagtctctcaaaactggccttttaatttttgacttttatgttggcacctaagtgaaagaaaatgatcatgaaatatcagcat

SEQ ID NO: 10297 - DNA, 201 bp, Bos taurus
ggcagtgaaagggaaaaatgggtgtattgatagtataaaaaataaatagaaaaaataaatagaaaaaatagaaaatcttaatgtgatatttgggatccctgcatactttgttgttatttttgttcagtcactaaggcgtgtccgactgtttgcagtcccatggagtgcagcatgccaggctattatgtcttctgctatctc

SEQ ID NO: 10298 - DNA, 201 bp, Bos taurus
gccactgggtcagggaggctgtcccacttttaaaccttagtgcctctgaacatgtttacatcccaaaaagccagtccagctttctataaagaaacaagagactataaaccaatacctccactgaaagagaactaatattcctatgacgttgaaccctatgaaaaacctcctaaaacaaaaataccattttgattttctact

SEQ ID NO: 10299 - DNA, 201 bp, Bos taurus
gccaaagatcaaggttttatgaaaaatctatcctgtggggtgctaaaaccttgagaaatacttgttcataagaaagacaatgccattgaaaatattatctgatcttgttagtgcaataaaacctattccagtcactaatgtatcttgaccttgacttttatatattaaaataactagttcttatccttaaggaagtgtcta

SEQ ID NO: 10300 - DNA, 201 bp, Bos taurus
atgttcattaattggccattcatgacctcccagatttctattgaagccccatacttttcctttgtatagactggggagtaattgatggctctggtctcttaggaatgaggagtaattgccaagttactggcccttttggaggctgtgtctgcttggttatttccgttcagtaactccatattccctttctgatgatcccta

SEQ ID NO: 10301 - DNA, 201 bp, Bos taurus
accatattctcatataccattttccctattgctaatgttttgttacatgatatagtcaatcacaagtgataaaccaacattcatccactgcaactgaactccatactttattcaggttttattataattttttctagagtccttttttctgatctaggatattatccaagataccacataccatttagtcatcatggctca

SEQ ID NO: 10302 - DNA, 201 bp, Bos taurus
ggttggacaatattatcacctaacattgctatcatctttatatgtagtcaccaagtccaatctacagatgaattagctgttcttaaattaaggactattaccagtcagtaatgatatgacattcttttttatgactatagcttgggttataatgtgacaagaaaaaaaatgtaatgtttccaaaatgacagttttttagat

SEQ ID NO: 10303 - DNA, 201 bp, Bos taurus
gaccaagaaacatgtacaatttatggatgctcaccaaactaattggtgatgtatacctgaccatacaggcttgtccttccatctctgatagaggaagtgtctatgattggcctagggcatcctctgtctgcaagttatcttactagaacctcagctctggtcttttcaaccacactatcagcaaggcaagtctgatgtggc

SEQ ID NO: 10304 - DNA, 201 bp, Bos taurus
gcaggcatgttcagtgaaaggggtgcctctgaatccccctgtaccactcagctcaccccctgaggggaaacgccacgtgcattcaaatcaaacgttttctatcaagttctcaactaatggctttcctaggagacccaagcctgtcagtcacctatttcctatttaggcatgttaaaacagaatttgttgtttatttgtatt

SEQ ID NO: 10305 - DNA, 201 bp, Bos taurus
taataatggatgttaaagaactattttaaacatgtcctcattgcagtttcaagtcagtgctacttgtcagtgtcctaaatagcagtagaaagaaaaaaaaaacagtcattaattttagtaaatattccttttgcactatattaagatatgttcatatgctgtactctcgttttaagagcatgcccagatcagattttcttt

SEQ ID NO: 10306 - DNA, 201 bp, Bos taurus
acacttttacaagtggtttaaaggtgaaaaacatagtcttataactcatggtctctggggtgatacaaaagatgtgtaaacaatgagtgggagaatggaaccttcatattctgtatactctgtaactgtttaaccctggaagatgaatttcactttaatatttggctttgaaattatctatgtaagactattacttcacta

SEQ ID NO: 10307 - DNA, 201 bp, Bos taurus
gcagtgagttattctaacatttgcagtttgcgagcaacagctgtgtttcttaatgctgcaacccccctccacttttgtcggaggccatagtttggcctctcgagccttctaagcctcggtgagacataatgggaaatttgagccggctatgagattaaagctccgaatcgatggccaaccagcaattgtcattttagaaaa

SEQ ID NO: 10308 - DNA, 201 bp, Bos taurus
ccatcgtgaaggacgtaccctcttacaaggaggcagaagagatggccgagaagcaagacaagccaaagcaagaatgtgtaagtgaaggcgaagggctcaaggaaagcaaagaccttggaaagaagccgaagtcctcggaaccatccatcccgccaccccgcatcgcttcaggggcccgaggaaacgcagccaaagccttac

SEQ ID NO: 10309 - DNA, 201 bp, Bos taurus
ccaattctccaacctctgacctttaatagtataacacttattcattaaaatgctgcagaacagagaataatattcatcttgttggaggtttatagcatcaatgttaccagacctatgtggacagtggcatgaacaaaagattccagcagtaagcagtttgcaacaactagccacagtccctcctttttaacttgggtaaga

SEQ ID NO: 10310 - DNA, 201 bp, Bos taurus
gagcatctggggaagaatcaggtttttttttttattcagattgttgaccagattcagttgcttgctatggtagtattgaggcccctggtttccttgccagctattagctgagggatgttcccagcttctagaagccattcacattccttgggttgtggccctcctgctctatcttcagtcacctgtcgtaggttgagatcc

SEQ ID NO: 10311 - DNA, 201 bp, Bos taurus
ttggagtgtgtccaaataatggggctgaggacagggttgttcactcttctgtaaatattatttcacatcatcttcctaattttaattatgtcctctctcttttctcagctgagcatactccccagtccaaaacctcattgattttttccatttagtactttttcttaatttttgatgtttgaggaatgggtttttgtattg

SEQ ID NO: 10312 - DNA, 201 bp, Bos taurus
taccaaaccacatcagtatgaactatctctctattctctgtaaaatttgttcatatctcaacaatagcctgttctcatgtgtatcattgtaatttatttacatattatctataaagacaactgtatgcattagtcttatatacatttttattcacagggcaatataaggaactgaacagataattaacaattaatgaaaat

SEQ ID NO: 10313 - DNA, 201 bp, Bos taurus
atctccttgaacttgactgctttagcaccaacatctgcaacattaaagcatctaaacaatatttggtaacatttgatgcttttttatttgtgctcacagaatgcctaatgtccaggtaactcttaggtgacttgaatcattgttattctttataaatgacttcatagtggatgactcattctccatttcttctttaaaaac

SEQ ID NO: 10314 - DNA, 201 bp, Bos taurus
attgaggggcaaggattaactgagctaaagtgaatttgaaaataccaaattagcttgttcaacaattatttccttagatccagctttgcctctaacactgatcttatgtttaaatggtgaacacaataacaatccttgccctcaaaaaggttacattctagaagggagtcagataacaaaaaaagaaaaaaaatgttcaat

SEQ ID NO: 10315 - DNA, 201 bp, Bos taurus
gcctccttctatacagcagctctaatatgatgtagaaagttaccaagtttggaacttttgcaaaacccttagagttccctgctctcagatgttatagtactttcccactgatattaattagaaattaaatttggaatatgaggaatctttaaattttcctttgcctgacttaatctattagctgtgttgagaaaatttcct

SEQ ID NO: 10316 - DNA, 201 bp, Bos taurus
caaaaatgcatttgattttaatctgcacccaatatcaattattgggttcaaatgaaaatttttattttgcttttgttttagctcatcatattcaattagcggctgttattatttgtttcattactgttattgctttagttctcccattgtgattttatgcatggcttccactgagctgtgactgttttattccaggtagta

SEQ ID NO: 10317 - DNA, 201 bp, Bos taurus
gtaaacattcatttggaaaacatttactaaatattacatgcttgtcctcctattctaagagcttgtgatatgaacatgtttaagacgttgaacatgcttatagaaaataacatgcatgtgtgtggtgtttacaataaaattggaaccctttgaaaatcttctgattctacctgaaggatcaaggaaatacaaatccagcaa

SEQ ID NO: 10318 - DNA, 201 bp, Bos taurus
taggtgtttcccaatgagtcggcacttcgttgatttttttttacataaataaaaaatgacacttctctggccttctctttgcacttttagtcagtcattggctggatctgcatgcatgcttccaaaataattgcaaatactgcagacttaataacaagtcaactatctactgtgctatttgtgaaaaaaaaattttaataa

SEQ ID NO: 10319 - DNA, 201 bp, Bos taurus
ctgcactcttgcccattttgagtgttattaaaaacattgaggataatcaagtggaaataaaattttccctaaagattgatgtcacatttgcttgtttatgctttctcttgtgtaaattgttagtttacaaacttcagtgttcacaagcaagatactatttcctctggggagaaagtatatcagacctgtgagtatgaagca

SEQ ID NO: 10320 - DNA, 201 bp, Bos taurus
atgatcttgcctgaaaaaccgcatggacagaggagcctggagggctaccatccatggagtcacagagcgggacacgactgaagcaacttagcacacacatccacattaggcttaaactattttagtctatcactattacctattattattattattttcaagatacactcaattattaattgcctaagactttagaaacag

SEQ ID NO: 10321 - DNA, 201 bp, Bos taurus
gaaatatgaaagaaaagacactttcattttatttcctgtacacttattatttcagctgctattctttcatttctaatattttaagtagattttggtagcattatctttctgtctgaaataattatttaagcaattacttgagagtatgtctactgaccaaaaaattctctaagattttctacacttgagaatgattttatg

SEQ ID NO: 10322 - DNA, 201 bp, Bos taurus
ttttctcttcctgacccagggattgaacccatgtctcctgcatctcctgcattgcaggcagattctttactgctgagccacctgagaattcccttaaacatagatacgaattgcttaatgataacagttgtcagttttccacatttcagatcataagtatttcttgtgagtttttactattttggcagggcgttgaggggg

SEQ ID NO: 10323 - DNA, 201 bp, Bos taurus
aagtctgctaacttagcatggtgtagattttttatgttccatgctactcattttgtttaactagaaatgtgaaaatttcaggttttcaactgatgtgcaacaggtgtaaacttttcaaatttaccctttgtcagttttaagcatcctgtgctgacatattgatatcataaattcatagaaatgtttttcagcagataagag

SEQ ID NO: 10324 - DNA, 201 bp, Bos taurus
actctccattcatgtctgccgcctccctaccgccagcctttgctggagccccggggtgtgtctccagccttgaactgctgatactttccttggccactttgcttggtttccctaggtaaccgtttttccatttctgcagcatcttttatgggaagggtgccgagagcatctcccgaggaagtgtcactggccagttttaga

SEQ ID NO: 10325 - DNA, 201 bp, Bos taurus
cccactccagtatttttgtctggagaatcccatgaacacagcagcttggcatgcagcagtccatgaggtcaagagttagctgcaactgagcacgcgtggtgtgctcacagtgctcccatttttggagaaattcaggctgactccagggactacaaacaaagtatgtctctttctcctctcaaagtcgctttgtcatgtctg

SEQ ID NO: 10326 - DNA, 201 bp, Bos taurus
ctataggaccttgttgttcatctaaaaataaactttccttttaaaaacaatttcaggttttcaagaaaactagaaaaaaaggacaaagttcacatatatccctccctcttgatctagtttcctaatgatgtcttgcattagtggcagctttgttacagcccatgaatcaatattgttacattattattgacttaatttcat

SEQ ID NO: 10327 - DNA, 201 bp, Bos taurus
ctttctatttctatctttctcctctcatgggtcactttgacctcaggtgtcctcggctgtagcttgaagcagggttttggttctaggccagagatttaaatcacgccacagcagtgagagcatggaattctagtcaccagaccaccaggaaccagtggtcggtgactaggccctggcccatgagtggtgtagaaatgaatt

SEQ ID NO: 10328 - DNA, 201 bp, Bos taurus
gtaaaatccgtgacttgcctgcaaaacttgagccaaactaagtccatctaaggagcccaaaaaggggctgctcatttacacatggccatacacacacctaaagatcatttggtatcttttctataatcattcatacatttatctatttatccttgtagttggagaaatggaagcaacgataaataaaatatggcctttgtt

SEQ ID NO: 10329 - DNA, 201 bp, Bos taurus
tatattaagtccttcttatgatcaaagtaaattcatgtcccaaaaagttcaattataaaattatcaataagacttactaatttcaataagtcactttgcttctgggtaaattattctaattactaacatgtataagtcccattcggacataaaaagaaatcataggtacaaaaaaggagataataattaactaagcattct

SEQ ID NO: 10330 - DNA, 201 bp, Bos taurus
ccctctctcccttccctgccccctcctctttcacacacacacacacacacacttctagcagaagttccaagagacaatgatgcctgaacctgcagcattctaacacatgtaggtcttctagacatagatccagactagttcaagtaaaatctgctgctttgagggtagttaaaaccaaaggtctcagacactgaattttaa

SEQ ID NO: 10331 - DNA, 201 bp, Bos taurus
gaggagcctggtggactacagtccatggggtcacaaagactcggacacaacttaggaacataacaacagcagtaacagtggcaccatagggccatcaaggatccacactcctatctccctgctccaacattcttaacccaggagcttccatcttcaaggtcagctcaaaatccattatgatgtgaaggtctagccatcagg

SEQ ID NO: 10332 - DNA, 201 bp, Bos taurus
gtgaggaaaccatcctggaagaagccatgaaccgtcagttaatccacaggggctttagccactatagacatccttactttgatgtcctcggtgaggccctctctctggcaatttgctgatgagtgcaggtgactgagaacaaacaggtgttgcgaatggtgtgcaggagggccagactccaaccacagcctcaaaaagaca

SEQ ID NO: 10333 - DNA, 201 bp, Bos taurus
ttatctgtgtaaatctctggtttctcattagatcaaatgctccctaagatttgtcactgtgtttacatctgcatcctttcagggccaaagcagcaggaacgcaaatgtatgtcaacaaattaacaagacacttgctgacaaaagccaccacctcatcgacagtctagatgctccattctcttggctttagctgctgtgtgg

SEQ ID NO: 10334 - DNA, 201 bp, Bos taurus
cagtgtcctctactgctacacatgcagctagactccatttcccagcctgccttgcacttagatggggccatatgactaagctctggccgcatgaaagtgacgtctatcaacgtgaggggcaaagaaagactgctgagagccaccgagacatggaggccctttctgcaggcaaaatttaacaggaagctgaatgacaaaaag

SEQ ID NO: 10335 - DNA, 201 bp, Bos taurus
gagccttggaacctcaaactaacccctagcccctccttagtgctctcctgtggacacccccaggcgtctgctgagtcatgacccaccctcctcatggaacggggtggaaaagtaaagtaactgtttgttgaactggcaaaaactgcaagttttaaatgccccagaagaggtttatttcctacacagctggttctaagcaga

SEQ ID NO: 10336 - DNA, 201 bp, Bos taurus
tgaaaaactgaagtttccagtttaactcaaagtcaagttttttttaaaaaattgaaatgaaattgaaggattgactcaatgcttcactttccaccacatacctggtttcagccaacctaactcagtatctcaaacacccatgaaacatacatgactttaagaacatcaatgccaatgactgttatcaagttaacactgagt

SEQ ID NO: 10337 - DNA, 201 bp, Bos taurus
ggcccttctcattgttgctgtctacttcctgggccttgttactgttttcagtagcagctgagaagacttgcagcttcagatgacacacagccaagctgaggtgggaggccggatgaagggcctgcaccttcctgtgcgtcctcatcagagaagctccacttttattccagccaggacacaatcttctttttttaaaaaaaa

SEQ ID NO: 10338 - DNA, 201 bp, Bos taurus
gtgggccgaagaatgtgcatctgttctatttctgtccccacttcctctccaggaaagggcgagccgagtcgctaccggctgccgagtgctactaatagacacgcaggcctggggaacatcgtgtgtcctacacggggataaatcaggatcagcccctggtgtgtaagaacggagtgagaattacgagaaaaacggagcact

SEQ ID NO: 10339 - DNA, 201 bp, Bos taurus
cgctctatttctaaacgatattgtggaggcaatgtggcaaattacggtgcgtccccgccacgacctggctcaagcctcccgccccggtgaatatgggctctgtgctctaataaccggcctatgagctcaggtggaaatcctgggtgggaaccaactgaagtcccttccagcgctttctgccttgtctgtcaaagaacttct

SEQ ID NO: 10340 - DNA, 201 bp, Bos taurus
cttggccgtattcttagcttggcgccctagccagttactaaaagttcaaggaacttgacagacagaggctgtttgtctggtgaagcgatgtgaactggccgggctgagcctgccatctcacgccggcaccttctgtctccttccagggaagtgtatttccgaccaggctctcaaggctgttctctgtgtgagaagaccttt

SEQ ID NO: 10341 - DNA, 201 bp, Bos taurus
cattgggccctgctgggctatacagcagtcatcactgagcagccctaggggaaatgttgatttgtgttgtgaatgcccaggctaaagaaatagaatgatacaactgctaaggcatcttctttgcccttcaggtttaattcttaatgaaggagaatggaagagcagaggaccactcaacattcatgcataagaagatcatgt

SEQ ID NO: 10342 - DNA, 201 bp, Bos taurus
tgctgatctcctaaagttttaaaaatgcttttagcatctttcattagcatatacagtataaaagataagcaatatcttcattccaaacccggtttccccttgtaccttacctcccttctccatcctaaaccatatcctatccatgactttaacttcttaatacctctttcactaaatattttctggattaatacattgatt

SEQ ID NO: 10343 - DNA, 201 bp, Bos taurus
agccaggcagaggcactgcttgggcagatcgagactcgagctctgcgcaccctgcatgttcaggctttcccctgtcgctctcataggccttttccaggtcggagattggctccgctcgccccgctccaggtcgggctcgccccgggccagcgccacagcgcaggttttatagcgcgctcctgggacgcgcacaagccggtt

SEQ ID NO: 10344 - DNA, 201 bp, Bos taurus
catacggagctgcctgggctggaacacaggcctgccatttactcagttgggaatggaacctccctgtgtgcttctgttaaatggagataaaaaacaggaccggcctcatggattcttgggaggactggcaaaggtaaataaaatacatgcaccgagaaaagtgcctggcatgttgtaaatgctcaaaaaactattgttgtg

SEQ ID NO: 10345 - DNA, 201 bp, Bos taurus
ctggaaaaaccaaggaagttggatttttatagaaaagctatgataaagtcacaagactggtttcctcttgccacatattaaatataccttttatctttacagttacatcacaaaccaaaccctaataagattcctcttcctaagggattgttacataaacagcatttgatcactgagcattgattatgctgctcattcagg

SEQ ID NO: 10346 - DNA, 201 bp, Bos taurus
ttcaccaaagctcagatggacccaagatgtttaccttgtacactgctccatgtactcttttatttgaaagtggttgcttctctgtgataatgatgtactgtttcttttgagaaggtacccattaataacgtgttggtatatattcctcctcacacacatttttgagtagagtccaaagtagaagagccagattacttagaa

SEQ ID NO: 10347 - DNA, 201 bp, Bos taurus
gaggtgctgaccgctggattcaatgtgcagcggtgttcctccttgattttcaaagtcctgaactgccaacgctccttctcatgtgggagcgcacagaacttcaacagggacctctgccttcccaccttggtggaacaagggcccacatcacagagctcatgcccgctgccaggaacccactgagaatcatcaccatgcttc

SEQ ID NO: 10348 - DNA, 201 bp, Bos taurus
tatagcctccaggtctccacagtgcctgacactaaatgtgtgtttgctgagtcaaaggagctacgatgagatttgctggggtgtttgtataatgtaccagcagtttccatggatattccaacaaaatgtagcttactgtcagagatttcacatgctcatgtcagctttgatctctttcaaaatacaaatataatgccctac

SEQ ID NO: 10349 - DNA, 201 bp, Bos taurus
ccaatcacagaactacgaagtggtagagctgagatatatatacaatttctttgactttagggccagtcctagctctaacattcaaaactgttttctataacatcactttggaatattaagaaaaggcccctttcttcctcaggaaagtgaactctgctttagaattaatgaaataggaaaaatcaaataaaaagcaacccg

SEQ ID NO: 10350 - DNA, 201 bp, Bos taurus
taggactctgggccttcaagatggtctgtttcccccagttttatagacaaaaggtttctacaaccctggacttgcaccaggacccagcacctttgttgcctaaggccatcctaccacttcatccttaagctgttccgaaagcagtggctgccgccactagaatacatcccgtttgcctctaaaaggaaggctttttttggc

SEQ ID NO: 10351 - DNA, 201 bp, Bos taurus
gacttagcaattaaacagaaacaacaatccaatatccagtgggaaatcttaagaagaaatatgacttggggaacaatggggaacttggaaaaatcccctctacttagtctctgtggcctcaactcattctcattaacacaggatgaaccagaagctctttcttctctgtctgttccttctctctaataacagtgactctgt

SEQ ID NO: 10352 - DNA, 201 bp, Bos taurus
tcaaagcagtcagatggaaaaggggttctcttacccaagagggtcagttttgttattctgttcaactttgtttctttgttgttccggcctttagccaataggttggtggaactgaccatttacatcaggaggacaatctgctttactcagtttactgactcaaatgttaatctcatcgaaaacaccctcatagaaacaacc

SEQ ID NO: 10353 - DNA, 201 bp, Bos taurus
tgcattaggtttctcataatagtggaacgatgtatctgctataaaggaagtagttaataataggtaatgcttttgagaattttctaatatgcaggggacattgttaaatacttcttatgcattaatgattataaagagagttatccttctctttatatatgggcaaaatggacagggagggtccaactctctcaagctcat

SEQ ID NO: 10354 - DNA, 201 bp, Bos taurus
cagtcttcaggggtgatctcgctcatcctaacacgagccctctcccttctcctctcactctgttctttctaccttcctcctgtgccagctttgtaatcctagggatgaaagaagggagaaaataaagctatcatccattcatccatgtctcaagttccacaatcgttagcaccaacactcgcctggactactagggggctg

SEQ ID NO: 10355 - DNA, 201 bp, Bos taurus
ccctggagaaggacacagcaatccagtccagttattcttagcctggagaatccttaagacagaggagcctggcaggctacagtctgtgaatctgcagagtcggacatggctgaagtgacttggaataatgctagttatttttattcctgccagcctgatctaggctctcctgcaggccttgggtagattctcttttcatct

SEQ ID NO: 10356 - DNA, 201 bp, Bos taurus
agtccatcagaccctatcgattagcgagcaggtggcaataatgtatttggcacaatggcagacgtgaatgtcatggaaggccctgctctcggagagcatggaaatcagtctggaaatacacgcaatccaagtgaaacagagagtcacaaaaggcatcaaaatccattggttaaaacctatacctggcctaaagcaagtgct

SEQ ID NO: 10357 - DNA, 201 bp, Bos taurus
acaacgtgccctcacactgtgtgagttcaccgcacgcagagaactatggaatttcaccccgtattaatatgttgtcttaaggtcctatcatcagatggcaatctataaagatggctcctgaaccaagtgctcgcacaactattcattcttcatttacttattccattctaaggatgggaatgctgacggacactgcaaaat

SEQ ID NO: 10358 - DNA, 201 bp, Bos taurus
aaaagtgatggagggagggggtgatggaccgagtccaactggacatctacactgtgatctgcgttcagtttccttcctttaatggctgaaaaatttagaggtcagtgctccttcctcccccagccaagaacagtttcatttttcgctttagttctgtccaccctatcttttcttgcctctatttgccaatttattcaataa

SEQ ID NO: 10359 - DNA, 201 bp, Bos taurus
tgccaggtggcctaagggccaatggcaaagtccacacgggaacacgagatgttaataattaaaaagccccaggtctcccgctcccctggatggatgcctggtgctgagacaagtttcaggcctgcttctggtcctcctgccacggctcagctctttgtattgacaaagctttttgtctgcttgccttatgatcccaagtta

SEQ ID NO: 10360 - DNA, 201 bp, Bos taurus
gaaggggcaagggagctcttgggcctctttacaggggcattcatctcattcctgagggacttccctggtggtctggtggtttaagaatctgcctgccaatatggggacactggttctatccctggcccaagaattaggatcccacatgcagtggggtagctaagcccgtgcaccagaactactgagcatgcgtgcagcagc

SEQ ID NO: 10361 - DNA, 201 bp, Bos taurus
cccacaatcctgtttgacccttacttatcctttagcccccagtttaatcccttcctcctgactaggtcaagttcctctttcatgtcctcccttaggaccattagtctctccttggaacgctcaccacagcagttgattttattatggttaattatttaatatcagtctcccaaaagagactgtcagttccataagataaag

SEQ ID NO: 10362 - DNA, 201 bp, Bos taurus
caacattagtttgattatccatgaagggaagatgttaccaagccatccaggcccttattccaaaagcaaccagcaagtgtaaacccggcctcttttccctgcaaaccacggaccatgcgacattcgggcagcacatgcttagctatggatgtactttctcctctctcagtccaggccttctagatacctttgcctacatct

SEQ ID NO: 10363 - DNA, 201 bp, Bos taurus
tattgtgcagattcagatagtaaaatttagataatgaggaacttctgtattatcactatcttcactctatagatgattaaagtgcagcttggagaagttcagtgactttaaggcaacacagcaagtaaatattctcccctaatccatgctccttatgcaaaggagtggataaaatgggggttaagagtgaatctgtttccc

SEQ ID NO: 10364 - DNA, 201 bp, Bos taurus
ctctttgcctttgcttggacctctcttgaaatggtggtctgtcctcccatctgtgctcccatctgatctgctttactaggttataaagtctttaaagccagtggtgacccttaggcagagttggtatctaatgacttgaattgatgctgaagatcctggcctgtgttcagcagttgagtcacacaggcagtgggacagcag

SEQ ID NO: 10365 - DNA, 201 bp, Bos taurus
tattctgcttggcctgtgaggctgtgagagctttgaaggtggccaccaagtcttttgtgtctttataatgagcgtctaagaacagtgttgacacataagcgtttgtcaaatggatgtcccacacaacaagggaatgttgggctgattctgaatcacgtctcacagactgtaagaatttagaacaaaaccatcaatccgtaa

SEQ ID NO: 10366 - DNA, 201 bp, Bos taurus
agtctccccacgtccttggcagagggcgccggtagactttcatgttcatgttggaagttgtctgcagtccaagacccaaggactgcagttcagcgtgtgcgagatcaaacacaggtgcagctgagctgctgctgtgcggttcagccagtcaccctggagagagagccgagcggaagattgtggggggaaagcttttcatat

SEQ ID NO: 10367 - DNA, 201 bp, Bos taurus
tttcaatttcaatcagatatcatgcaagaaagtgaataattatgatggttcctagagctatgaacaagaagatgtgctcaatagtaactacttaggagcaaggggaagggcaccactatacatagtgtgagcttagctgtgaagatgtaaatcatggaaaagagtgagggaaagtatattctcagcaaaaaagaagcagta

SEQ ID NO: 10368 - DNA, 201 bp, Bos taurus
ttacatatgcagtataactctgcttaatggcctttctacagttaggacctttcaccagcaatcagaaagtattccaattccgtaggttcagaggcccattcgcagtggacacgctgatgcttatggtctcctttaattccttcttcctatctgccctgtaccctgtggccagttctttctctaaacacagctctatgacct

SEQ ID NO: 10369 - DNA, 201 bp, Bos taurus
ccccagcctgtagagagagtttaattcattgaactggttctcatcacagggttttaaactttctctctgataattagtcctttagggggtacacttattcgtgttgattgtctttagccaatctgctttttccattactcaggtgaatactgttactggtagcttttctcttggtcattgtagagaactggctgtagcagg

SEQ ID NO: 10370 - DNA, 201 bp, Bos taurus
ccaactcgtagcgaccccatggactgcagcctaccaggctcctccgtccatgggatttttcaggcaagagtactggagtgggttgccattgccttctcctggggaagacctcaattctggccactctcattacatcacagggtggcccccgggttttgtttacatataaggccccatgtttaatatgctgagctctgtgta

SEQ ID NO: 10371 - DNA, 201 bp, Bos taurus
cacagtcaatcttgacttcagtcagagttgatgaagtgttgtaggaaccacagtaatcattaagtataatgtgtcgaggccattgcctgctgaacagccttggtgacagaggagtgaagatgcagtgaaggaacacaggctctgaggaaggactcaataaatggccaggccattctcccagtcaaattcttggctctcttg

SEQ ID NO: 10372 - DNA, 201 bp, Bos taurus
gactattgggttccaccccaggctcccgaaatcaaaacctgaattataatgagattcccaggtgatttttctgaatgtttaagcactaaagaatactgggcttaagaatgatgttagcataggtgattgaaaagttcatgtagcaacttttgaaaataatgttgtttttttactatatttcctatcatttatttgatgaat

SEQ ID NO: 10373 - DNA, 201 bp, Bos taurus
tgagtcagaagagggtttcctctaatttcagctaagaagataaggcacatttcctaaagaaagagtaattttctgctgggcctttgctaaatatcccattcctagccttatttacataaggaagcaaactcttcctcagcgagtaaatcaattacattgagcaaacatttattgaatttccatggccttcaggataaaagg

SEQ ID NO: 10374 - DNA, 201 bp, Bos taurus
atctctccctttctgcttattaactaggtggagtccactatgtgaccagaggttagcaaaaagcaagaaagtcaactctgaacacactagttctttatcagtgtaaattactaattccacttcatctacttccccaaatcttgtcattcttcatacttgttcagctttataagaaattgtcaaactcaagtggctcaactc

SEQ ID NO: 10375 - DNA, 201 bp, Bos taurus
cacagccttgagagcaaagcactgttgaaactatctggatggtaagcatgactgaatgctttaaggtctctacataaacatgattctggccagtgagtgaagagatctatttatcttgcagccaatcaagatgagccttgtaaataagttcccttgcttattaaagcggccacctaccaatctggaagattctgcctcttt

SEQ ID NO: 10376 - DNA, 201 bp, Bos taurus
gaaaatgatatctaacattattatgacagagcctaatacagaattccatgattaaagtaaaaaccattcattctatagttgtatgttgcagataacactttattgtgtgaaacacgataagtttttagcaatgcaaatatttataaaattaaattaaacatttatttttcaagtaaaaaaatgtccttaggaagcaatatt

SEQ ID NO: 10377 - DNA, 201 bp, Bos taurus
ctgaacagagtaaaacaacaccaaagaccaaaatttacccctgagaattcagtgtcaaaagcccattccacagaaacacgctgtccagtttgggatatctatgcttttaagccttttcttgactgattgtaaatttttagtgctcacagagaacatgcaaaaagttaatttaaatgttttgtggacaaacagcttaaattc

SEQ ID NO: 10378 - DNA, 201 bp, Bos taurus
acattgatgaaaaaaatcaaggaagatctaaaaagagagagaattataccatattcattgaaagaatgaatatctaaaatgtcaattccttccaatttaatctttacattcaatgcaacctcagtcaaaatcctacaaatctattgtatcaatatcaataaaaatattttaaagtctacatgcaaagagaaaatacctaga

SEQ ID NO: 10379 - DNA, 201 bp, Bos taurus
acagtcatcttttacgcacaaggcatgttaaaattaaagccattaaatatattctggagcataggaatattttttaccttcaaatttctgctttcatttgaaactttactgaaacttattatccttaaagtacagaatcaagtaaatattttaaaggctcagacatatgagtttgaggcccctggcccctgggtggaactt

SEQ ID NO: 10380 - DNA, 201 bp, Bos taurus
aatacagtcaataatattgcaatacttttatatatggatggatggttactagacttattgtggtgaccgtttcataaaatatataggtgtcaagtcactacgtaatacacctgaaaactaacatagtattgtatgccaagtctatttcaataataaattttatccaatttatctattttgctctgtgcagtttttaagttt

SEQ ID NO: 10381 - DNA, 201 bp, Bos taurus
cctatgctgtgaaacaggccacgaagctgtgaacaatgtttatatgtcaagatgcagagaaggagttcacaatcacaagtgttctaaggaaatgctcttatgggagtcatggcctggagccaagaggaagcctgtctgaagtttagtcaggctgagagaatcattaaggttgccttggtccacttctcgatttatatcaca

SEQ ID NO: 10382 - DNA, 201 bp, Bos taurus
aagaagctaagcaggatgtgactttaggtgatagttcaaacccacttaatcccttgagaagaactggaatataaagtacagttggccctcagcatccacatgtacaccattcatgaaatcaatcaatcaccatagaacttgaccctgtgaatacagagagctcagctgcactacaggtacttgagcagcctcagaatctgc

SEQ ID NO: 10383 - DNA, 201 bp, Bos taurus
aagttatagtttgctgctagaatgaagaaataaaagtatgtatgtaaatatgtatatggggcttcctaggtggcactagtgctaaagacaccacgtgtcagtgcagaggatgtaagagacgtgggtttgatccctgggccaggaagaacacctggagaaggaacggcaacccattccagtattctctcctggagaatccca

SEQ ID NO: 10384 - DNA, 201 bp, Bos taurus
tctgtaggtgatttcctaaaatgctccatctgtcccagaaatctcagtgtccatttccccatcatatgtaaccctcattaaaaaacacataagataaataaagattaaagaagatgaggcttccctgatggtccagtggttgagaaactgcctgccaatataggtttgatccttggtctgggaactaacccacatgctaca

SEQ ID NO: 10385 - DNA, 201 bp, Bos taurus
caaagaacttatgcagttcaatacctaaaaaacaataatttaaaaatgggcaaaggacttggatagacatttctgtaaaaaagacaaacgaatggcctacagctatatgctgaatatcactcatcatcagaaagctgcaaattcaaaccacaaggtctattcatagctataggatggccattaccaatatctatatctctt

SEQ ID NO: 10386 - DNA, 201 bp, Bos taurus
gaggactagataaatgatatgggaaagacctggggagaataatttgatttaaattaataagatttttatttctttcttgagtgtccaaacactctgttcaacaacttactatgatagcttcccactgtaatgaaagctgaattttatgccttgcttccatatttctctgtcatcaaaattcattgataaaataaggataaa

SEQ ID NO: 10387 - DNA, 201 bp, Bos taurus
aagacagacttacactttcatctccttttgctagtaaaaatgttttactcctgaaagtttttatttagaatatgcatgttatattggctgttatttgtggccatgcaatattctcaaattatttttaacaaaattggtgatagaataggctcatattccagggggtgggaggtatttgtgggatagcagtgactgtggtgg

SEQ ID NO: 10388 - DNA, 201 bp, Bos taurus
ggctgctgttgttacactttctgcctaagaagccatcattcattgggaccagaaacctccagagaaaaggccactgataatcttgagaaactgagtaatcgctacagaagaaaatattttggctccagagcaaaatgtccagatataaaatggagtcaaatgtagttatcaagagggagggatacccaactcagagtgaag

SEQ ID NO: 10389 - DNA, 201 bp, Bos taurus
aaatagaggataagtacactgcacacttgaaggattttaaaataattattaagtgataattattaatagaacatgaatttattaaatttatttaatcttggttaacttcaagggattatgtaggcacagaaaactccaaggtagttttcattaaaataatactcttccttcctctatagacagttacaaaaatttgtcctt

SEQ ID NO: 10390 - DNA, 201 bp, Bos taurus
ttgtacatgtgtgatcccttatggatcatagcctaattcattatcattcctgtcagaccattcttctggagcaaaacccatctcaatctaaacatattgctttgaactaactatatcagccatgtctattgaatagcatgactgatgatcagcagttggaaagttcatcatggtattcatgcaccatagtttgtgcctagc

SEQ ID NO: 10391 - DNA, 201 bp, Bos taurus
agctctatcagatttgagacccactatccttctgccttcatttcctaccactcttactagcttcatttctatcactggccctctcaaaggtcctgggcccatagaactcacttctgcctcagggagcttgaatctgcttccagtgttccttctccagatagcctcatggctgatttactcacttctttcagtccttgttct

SEQ ID NO: 10392 - DNA, 201 bp, Bos taurus
aaatgtacattaagccaaagacaagaggtgaatggtgctaatcacctgaatttcctagtcatgagggagaatacaatgcaatattttttccacaagctaattggagttggcattttgtctctggtttaaccgcaatatacatatatatatatacatatatatatatatatatatatatttctgtcctctatactactggtg

SEQ ID NO: 10393 - DNA, 201 bp, Bos taurus
tgcaattatatatttgtgacaaattgctccaaagtagtaagctccttaaggatgaggaatatgtaataaaattcttcatatccttatgttctagcagaatgtctaacatatagaaaatgaatgcatattttggaaaattcatatttttctggtaacattttaaacattacacaattttatgtgatctttgaactgaaataa

SEQ ID NO: 10394 - DNA, 201 bp, Bos taurus
ttttttcagcaagaatactgaagtgggttgccatttcatcctccaacattctagagggtgaggataaaatatacagaatagttaacaaatactataacatttgtgcagcaaataaatatacatccgaaaaatgaaaaggggaaaataatagtatttagagagcatagtgtgggggggtggggtgggggcgaaaatccctca

SEQ ID NO: 10395 - DNA, 201 bp, Bos taurus
tggagaagcaaaatatacttacataacaaagaaaacagtaaaataaaaggttcaattacaaactataaagagtcattaaaatactgtaaaaattaaaaatacagtttaggattagattttagtttgagacaaacctgagtgtgaatcttatgtctgcacgtagttgacacatcattatgtaaaatttttctataagtttca

SEQ ID NO: 10396 - DNA, 201 bp, Bos taurus
aggtgtacacatgttccccatcctggaccacctcccacctccctccccataccatctctctgggtcatcccagtgcaccagcctcaagcttcctgtatcctgtaaatttcttttaggtagtcaaggaagctctatttcctatttatggcaatctatgtgggataccataaccaaggcccttttcatttttctgtcaatata

SEQ ID NO: 10397 - DNA, 201 bp, Bos taurus
ggttccatctttttgagcttttacaatgagtataaagtgccttatttacaaacatttcaaatttgtattcttaatctagaagctcagtaactagaaaagtagttacatttggaatttgttgtttgataccacattacattttgtacttcctagatatagcaacattagttatttttgcttacatattgatataatagtttt

SEQ ID NO: 10398 - DNA, 201 bp, Bos taurus
ttttaaattcgaaattaatgttttatagaaatagttatgcttggactctactaagaaactttctttaagatttttcttgtttcctgaggcagaactaccactatgacccagtgattgcaatcctgggtacaaaaacaaaaggctctaacatgaaaatatacatattcccaaatattaatagcaaaacataaataaaaaacc

SEQ ID NO: 10399 - DNA, 201 bp, Bos taurus
acatgtggtgtatcctttcgacctttcccgaactcttccatttggtggaggcttattagttcctgttccttaccaggacctcctgtcaaaaaaattcatgtgaatggttgctatagtatctgaccagggtgagtggtttcaatcagtgtgcttcccctaacaactcccaaaggaaatcaaccctgaatgttcattggaagg

SEQ ID NO: 10400 - DNA, 201 bp, Bos taurus
gtattgattttgaatagtcacccaatgtcattcattgagcttcagctacattctgaaatccatctctgtatttccaaatcttcaagtgttggtagtatgttaaataatgaatatcatgtattccttgactcataactttccatcacaatgtgtttcctaaataaagttgaatatataatgtcatttttcacgataacttca

SEQ ID NO: 10401 - DNA, 201 bp, Bos taurus
tacagagcttagacacagggttggaagataactacagtgtgaaccggcgcttagcaatagaaaagagaggccctagaaatataacaagggacctgaatctgaagagaacaattaggttttgaaaaatcatctcctctgggaaatgtatgatgcagttctagccagattttgtaaatccaaactggatttacagttatttcc

SEQ ID NO: 10402 - DNA, 201 bp, Bos taurus
gggccatttactcctttcttgtcaccatatgcacctttgtggctgaccaccttccccctgttgcttctcattaggctaactttagagcagtgtctagtgtaatagagatttcctttatattgtgattggaagagaacttttaagaatacaatgtatttccagttcttctgaagactcacaataattgcattttatctaaca

SEQ ID NO: 10403 - DNA, 201 bp, Bos taurus
attcctgtagcctagaacaccctttcctccctcatcttctgcatattgcttctattttttttccttcaaaatggaatttcatatctatctctttcaggaagacttttctaatcccctcctccagtttcataggataccaaatctctgggcttccataatatgtaggacttttcatactatattgtaattgctttagtttcc

SEQ ID NO: 10404 - DNA, 201 bp, Bos taurus
gggcaagggctttctccctctatgaggttgtatgcacagtccagtaaactctgggttggtttctcacattcatggactggtctcgttgtctaagttaaggggcgaggtcatggagtgacctaagctaaacccagtaggttatcaggtgattcttgagattttaggattactccaggtcagaatgacgctagaaaggatcac

SEQ ID NO: 10405 - DNA, 201 bp, Bos taurus
atctgtgtagttggcccaacagctgctaaacggaattgttgtattcccactaagtccactgatttggttattattggagtcctttagtacggccttcaaagccagtgcagtaatcccaactgatacacaattaccctaaagaaaaaaagagtagagaattacaacaattggcctgttaccatgcttttttttttcctaaaa

SEQ ID NO: 10406 - DNA, 201 bp, Bos taurus
tgtagaatctataaacgtcagattctggagccaccaaaaatccactgaaacgtgcaacaaatgtgtcttgttccatgggccaaacataggaagctgaatccacccaaatggcacccaagtaccctggagttttttcactgtattggagtatctcttcaagacgtactggccggctattattccacacctcaagcgttaggc

SEQ ID NO: 10407 - DNA, 201 bp, Bos taurus
cgccaaagcccaactttgatataagaagctgtctaggagggataaattcttaaagctgtgcccttcacaaataattttaaaatacaaaggtataaaataactggaaggcccttattatcacttaattctcgtgatcccaggcagaaagccaaagcatttatagatgtgatgagtaccagctccagtatcaaaactgtttta

SEQ ID NO: 10408 - DNA, 201 bp, Bos taurus
atgaaatagtaaatgttaaatcaccattttttcccttctgtttaatatatagtttttctttttttgtctcatatttcttggcaggctatgtccaagcatcgaagagagacaaaaaattttttgcctgtgctccaaattactcctatgcagccctttgcgagtgccttcgacgagttttcatctaccgtcagcccacgccca

SEQ ID NO: 10409 - DNA, 201 bp, Bos taurus
gtctttcctgaaaacaaatgtatccttttgaagacgagtgaagggaacagccatggccaaggccagccacaccagcacatccagcctgtgatcatgtgttacaaagtgcctaaacagacgaccaagaacccacttgaactcttcaaattctggtctacctgaaaataaagaaaaatatttctgatcagtattaatattttc

SEQ ID NO: 10410 - DNA, 201 bp, Bos taurus
gtcgtgacaggtttgcctcctctaaagagtctgccaaactctacggttccttcaacttcaggatgaaaacaagcactaacgaaaacaccctggaactgtcgctggtggaggaagatgctctcgctgtacagagttaattctggttgtgaacttcttgagagtctgccttggtattttatatgaacaaaacaaagcaaaaca

SEQ ID NO: 10411 - DNA, 201 bp, Bos taurus
tcactttttaggccccttctatctacaaagtatgtaatttcaccagaaaaagttttgcaatcttaaattgctaggcatggcctattgttgctatttgttcattgatgtattctactttgaaagaggtaatgcattctccatgtggcacataaggccatccaatcagagatttggagaggacgaattttaccttcactgatc

SEQ ID NO: 10412 - DNA, 201 bp, Bos taurus
ttcctatggatatcaagtttcatagtgtctattttaaagaaaacacagagcaacctgctccacagacgtgcttggctttatggccctgtccccttgccacctctattgcatccacatatggacctggtttcagatggtcttgctcagagcataaaatggcctggattaatccaggacatgtagctggcggtctccaccatg

SEQ ID NO: 10413 - DNA, 201 bp, Bos taurus
ctttggaaaacattagtttttatttttttaaaaagaaggtttaccataatctacaagcctaaaagtgtaagcagctggtaaaatttggagttgaccaaacaacttcaagttaatacttctcaactgtttgtcaaattctgtagtctttatgtagagacccatttcattcaacagatctctcacgttgtaaccctttgaaaa

SEQ ID NO: 10414 - DNA, 201 bp, Bos taurus
agccctcacagctgctggtgcacctgcagctgcgaccgcagcccctccgcctgccctggttccaccactgtgtgtgtttgcagctggccccgccacagccgagtgtgtgttcacaacaggctccagccactactgctgcctgccttggtccctagcctctgaactggggctcacctctgagaaccccaactgcccttgtgg

SEQ ID NO: 10415 - DNA, 201 bp, Bos taurus
ggaagaacaaggccttcaaaatctaagaccaggactgttgcagctacattacattgcctctatctttattccatagtttataccaatctttaccgaacaagaagtcagaacttggccaccttaaaaaggcattaggtctgtaagatggcaagtaagctaattatgacacattttgcacaagaattacggattctaaattgt

SEQ ID NO: 10416 - DNA, 201 bp, Bos taurus
acatctgcccctattggtaatactaatttttatcacttgtggagataatttctctattttgaaataaatatttaccccattataacaaataagcaggctacaggaacacattttaagaccatgtaaatatctttcttctcagcaaaatattctcctggattttgccttcactaactgttctttcctggttcaatctttact

SEQ ID NO: 10417 - DNA, 201 bp, Bos taurus
ttctaccacagaaggtaataattcatccaaagtaatcttgactttgatgagactcttcaagatataatagggtttcaatagaaaactgccaaaaagaaaccgtgaagttgctgatgtctacatggttatcccgtttctctgtttttttttttttttttacctgctccgtgtgggaatataattatgtttattcctactatt

SEQ ID NO: 10418 - DNA, 201 bp, Bos taurus
ggtagaaaatcagcatctcttccaaccctttaactttgtgaaatgatcacaaaagagagatgagaaaaaatatgaactttatttgtgacatgggcatggtgatacagcatagtgagtaatcaagtttcataacattatagggtattagaaagacattactggaatcttttagatttctgctgtgctttcttaccacagagc

SEQ ID NO: 10419 - DNA, 201 bp, Bos taurus
atggctgcccagtgttttccagtcatgtttagcatcaaatcctgcctagggatacattatgctcaggtactgtgcagtcttagatggggaataatgtggccattacattcatttttttttttctgcaattgcccaaagacagtttttattagctaatcatattactgatgaactaacctcttcattagccttcttggaact

SEQ ID NO: 10420 - DNA, 201 bp, Bos taurus
gtaagtctagaaattatacttgacagtataacattattttggtatatatctatgtaatataaatgcacatcaacttcaggataatggttaattttggtgcgagtttggagggggtgtttttagataacattttatttcataataaaaaaaacaaattcaaagcaaatatgtcaaaatatgacatctgctaagttttaatgg

SEQ ID NO: 10421 - DNA, 201 bp, Bos taurus
tttctaatttctccttttttattggccttttggccttaaataaaatctattaggttctcatagataaatatctagtactgtaatgttagacacttaactacacaggacagaatttagactctattaaagattagttcagagtgctgagaagaatttcaggagcgttcccattttaaaactatttcttttgcagtggaggag

SEQ ID NO: 10422 - DNA, 201 bp, Bos taurus
tgattattgttggttggatttgagtggacagcggggaaggtaaacgtacaggacagggcactgtacagcggtaatgggcagggacagagacaatggaaaacggagggagagtcactgctctgacttagcaggttgctgtcaaaagctcagtgaagatccggcgttgtcagatcttggatttccctgccagtagacaaacac

SEQ ID NO: 10423 - DNA, 201 bp, Bos taurus
gcccagtaagtgttgtgactggctgatgaaataatgaatgacctaatagtaactgtgaatattttcaaaggcacagccagaagaaagaagttggggaatacaatttcaacatgaggtgcagaactattgcacagcaggttccaagttcagcctgaacagcacaacaggcggactatgaaccaattctgggcgagtttctgg

SEQ ID NO: 10424 - DNA, 201 bp, Bos taurus
taggatttcatcagggctcaatcctagcccacttctaggggccaaccatatatagaggagagcaataagcaagcccactttagatgagttttctggcataatttggttttcttcagggtgtggttcatctctcagcctttcccatagattggggtctgcatgatgaatgaagtttccattttatacctaaagctttactta

SEQ ID NO: 10425 - DNA, 201 bp, Bos taurus
aactaaattaaaaaacaataaaaataagagagtacaacagtgtcgccagagacaaaatcaatatacaaaaaccaatggcattttctgtaacagcaaaaacaaactaaaaaaatataagaaaatgtatctttccaatagcaacaacaatttaaggtaactgggaattacctttatcaagatcacacaaaatttcatgttttt

SEQ ID NO: 10426 - DNA, 201 bp, Bos taurus
tgagctgtgtaatcagagagcaagctgagagaggccagagaaagtcccaaccccaaaagggcgattttctgtccaatctctacagtctagaatacagatgtctaggccctcatgtcaacccttcagattctgtaactctgtaaaagacgctagaaaaggttactggattctgattcaaaaacagagttaatctattctcag

SEQ ID NO: 10427 - DNA, 201 bp, Bos taurus
tggccacctgtgcggaagacttcgtgggagtccagcctttctgaggggagagtctggcacaccacagaagcaagatggagatagatgagtttggatgatacgagaggaaggaatgggccaagatgccctctccccagggcaacactggaaatggctgggcttttggctgcagaggtcttccccggtggctcaaacagtaaa

SEQ ID NO: 10428 - DNA, 201 bp, Bos taurus
aatgtttgactggctctgtagacctcagaggccttggctgcaggttttgatacgtatatgctgacctttaactctgggccagctctgtcctttactgcaggtgcaacatggactatgttcgtgaagttccttatttagtcactttgttagagtgtgataggcagggtcactctgtaggtcaactcctgtttccttgggcca

SEQ ID NO: 10429 - DNA, 201 bp, Bos taurus
aagtagcaaaaggggcttaaggttgtagatggaatacatatgtgggtgaaatgaattaaggctgctactcagttggccttgagatggaaaattaacctgatgggtccaatgtaatcacaagggtcctcctaagtggaagtgggagacagaaggctcagggcctgtgtgattccacgttagaaagacatgactgattgttgc

SEQ ID NO: 10430 - DNA, 201 bp, Bos taurus
agagaacaataataaaattaggggaaagagcataagacatatgtacaaaatttgatggaaactttgtaaaccagagttggcaagcttccatagcatgttacgaacattaccaatctatacggggtatcaaacaaatgtctttttcttctttctgagtatacctactactgcttagtaaactttagttaaaattgtataaac

SEQ ID NO: 10431 - DNA, 201 bp, Bos taurus
aaccattatataacatcagtacagggtcttccaagacaactcagtattcagtctttacattgtaagttctatacattgtacatggcccagttgtttaagataccaagatccaaccagattttggaaaaccatttgcctgtcttaggatcagcataataaaaaattttcaaagagaggcctttgtcaaccacctcatcagtc

SEQ ID NO: 10432 - DNA, 201 bp, Bos taurus
atggtgatttaccaatgccataagttcaaaaaagaaagaaagtcacaagaaaatagctcaaacctctcttagtctgatgtggcaagaatgtccaagagaccatggtgtattccatatctcattttttttcttattcttgtgaacagatgggagctgtactatttgaggaagagtaaatcctggtatttggccattatccaa

SEQ ID NO: 10433 - DNA, 201 bp, Bos taurus
ttttttaacagtagatgcaaacatctacttgtaaatggccatttttacaactgccaccgctagggcgctgccacagacactttcgcttggcccacccaccatttattttcaaccctctcttcctgacctctttctgggctgtcatgaaatagtagcagggtcctatagtaagattcttggaaaacttctgttttcctgatc

SEQ ID NO: 10434 - DNA, 201 bp, Bos taurus
ctcccaatcgattattccaagtgtttgcactgccaagaatgggatttctcccagggactctgaagagtggtgcttaattattcatcatgaaatttaattttagagcttgtaatcatgtaactgtttaaaatggaatttgtcactgaaacacgatgcaagaaaatagaggattatttaacttctactcatctcacttcaaga

SEQ ID NO: 10435 - DNA, 201 bp, Bos taurus
tacatcttaacgagacagaaagaatttacagtgttaagttttctaaagtgaatgctctaaggaaagacaggtcagggcctcgaatcagaaagttaaacctatctaaagtttaccaaagctatagcaaagttaagctctcttattcaatggtaaattagccaaggccttcaggaaataaaagatccaaattagaagaccctc

SEQ ID NO: 10436 - DNA, 201 bp, Bos taurus
aaaattcttttcaagtatgtaccagtcttgagatttacttcctttagtctcctttaatctcagagctctgtattaaacatccatagaagtcccatgtcatgtaacactaaaaaaaatttaaaataagagaactttattactcaatatatggggtatccgacttgaaaaatatttctcctggacaagggcattggtgtcata

SEQ ID NO: 10437 - DNA, 201 bp, Bos taurus
tggaggggtagagaacacaaagacagtgcttcttatatatatttataatgaagaacttttctagttccagagcctggagtctccagttcattttaatataataagttttatattaactaggtgcataaaaaggacaacctcttcctgtactggtttgtcatcatgttacatttatccagtactgttttgaacctactcata

SEQ ID NO: 10438 - DNA, 201 bp, Bos taurus
gtttgttttccagattgcccccctccagtccccacggctttaaaaccacagatacgcgttatgttcgcgatcattgtatccgcatctggttattcaaatcgctgtaaatagctgctctgctgtaacaacagaggccaaatttcatttgtggtaaaataggcttctctgatatgaattacatttattagtatttttactatt

SEQ ID NO: 10439 - DNA, 201 bp, Bos taurus
aagggccatcattagaaagtcaacaaataacttctggagtggagaaaagggaacatgtctagactgttggtgggggtgcaacatggtgcagccactgtggtaaacagtacgggggccctcagaaaaccgtaagtactattaccatatggtccagcaatcccactcctgggcacatatccagacaaaactctagtttggaaa

SEQ ID NO: 10440 - DNA, 201 bp, Bos taurus
aggatgcctccattttctcattcctggccaggctttcatgtgaatcatccaaagctcaggtgatggagctctgtgttcctgaacttgctccagtatataaatcaggccacatttagtcaaatagatgataagcataagtcataatgtatcagtaatgccttaaatttttatgaaataagctgaaatcacttccactctctg

SEQ ID NO: 10441 - DNA, 201 bp, Bos taurus
cacgtgctgatccatcaggagtgccaaacaatctattgcaattttcagctgaagctccctttcaaactgtgaacaaggctaaaatagcatgcagccattcatatgagtaaaattccattttcatacaatcatcgccactaagactgagaactagtaggtaactattttgtgtcacatattgtatactgataatctcacaaa

SEQ ID NO: 10442 - DNA, 201 bp, Bos taurus
aggaaatgaggttgaatttaaaaatttttttcattcattcgtccattcattcagctaatattctttgagtgtttgctatgtgccaggtactcttgcagcaactagaggtatagaagtgaacaagaccaggttctgttcactaagcttagattctagtgagaaatcaatttaataaaaaagtatatatactaagaaatcaat

SEQ ID NO: 10443 - DNA, 201 bp, Bos taurus
atcttgttcttgatattggaggaaagcttttaacctttcaccattgagtatgatgctatttgggggcttgtcatatatggactttattatgttaaggtgtgttccttctatattcaatttctggagtgtttataataaaagaatactgaattttgtcaaattttttttctgtttctattgagatgttcatataattttagt

SEQ ID NO: 10444 - DNA, 201 bp, Bos taurus
gttcctctcgatttgtccctaaaggccaattaattccaagtttcctgcaactggcattttaacttcaaaaatgtacctcaacagcacctgcttaataaaacgctgtgagatgatactcaggtttattctgctccttggtgtcagttcttttctgaagtcaatagcactttccatcttcaaagttggctatgcacacagtca

SEQ ID NO: 10445 - DNA, 201 bp, Bos taurus
gagcttacattcaagcaaagccacaggattggttcatgacagcgagccctgctccaccccatctctctgaccactagtcttggaggttcccagagccccagacactccctaaagctctgtagggataacacagtgcaaggccttcaaaatctctgcaactactttcagagatagtacctgctaattcctccatcatttttc

SEQ ID NO: 10446 - DNA, 201 bp, Bos taurus
aaatggtggctggaggcagaggcatctccagggcctcttcattcacatgtctggtggttgttgctgacttattgtttgggatcttgataaacactgtcaactaggcctatctacatgatccaggcttcctcagagtatggtgctggattcctaagcgagtgtctcaagagagaaaatcaggccttttcctagaaacctggc

SEQ ID NO: 10447 - DNA, 201 bp, Bos taurus
ttacaaaagaaaccagttattcctgaaacacagctatcagatatttttacaaatacatatatgtttattaacaattagtgagcaagccatgcttttaacagttactataattttaaagtggttttgagtgtaagtagttactctagatatctactaaaactgaaatgtaatatgaaattttctatgatttctactggtgac

SEQ ID NO: 10448 - DNA, 201 bp, Bos taurus
agtcagacgtactgtaataacacttgtgaaggtattccaacatgcaattgttaggggcagcggaggtccagaataaactagcgtgagagattattccatcactggcatgtaacttctcacaggtgaccaagcagtgtcacaccattcacatggtgaccgcgtcagccaatccgagggcaggtccacggggagtacagagtg

SEQ ID NO: 10449 - DNA, 201 bp, Bos taurus
caagtcatgttcttaaggatctttaacagtctgactaggagctttgcttatggaagcccactaggaggccaaataggaaagaagcagagtcaagaccgcagatgtgacagacgtacaaactgccatctgcagaggacaggaggaaggagctcctgctcacagacggggtgggatttgagacgggcttaaaaattgggcaga

SEQ ID NO: 10450 - DNA, 201 bp, Bos taurus
atgtaatttggaaaagagatcgctggtttggaacatgatgctgatgtaagaatatctgtctcctctaggtcatataatagagaaactaaaaatgtgtgctacctaccatatacacatatccagcagtcagttatgctttacttaataaatattatttttactgaagaatggggtataattgagagaaactgaactttcaga

SEQ ID NO: 10451 - DNA, 201 bp, Bos taurus
tgaaaatattttatgacttcttttcaatgtcccctttggtctttgtataaattttacatcaggttaaaaatatccatttttttatcctcatacatcaaactctatcttaaccaattcctcattaagtggccaaaaaatcttataaccagcatgtctcaatgactattcttagaactgactctagccaaaaggtagcaaaag

SEQ ID NO: 10452 - DNA, 201 bp, Bos taurus
atcagcaattataactgaaaacgtaagcagtcatctcagaaactgctaaaacaagtagacaaaaacacacaatagaaaaaaaaaaacacaatagagagaacgaaaaaggagggagagaggaatacagatgatgatgatagatagatagatagatagaatgtaactaataagccagagctatcccatggatggaggaacctt

SEQ ID NO: 10453 - DNA, 201 bp, Bos taurus
cctacctctcacctgcctagagataatgccagcatataaaattcaatgtgcataagctggtatcacagggacacctgatttcttataggattggataaagcagaagtgtatttcctttttacatttctttactacaaacaactacatgtgtttttcctattaaagggaatgcttagcagtggaggtatcttaaaatcatct

SEQ ID NO: 10454 - DNA, 201 bp, Bos taurus
gcccttcctcttgggagctgccatagtatcctacaggcatcaaaatgtactgcagtgatttgttttcatgtacatgtcctttaagattgcgctcctccttgtggccttcttctggggggttcttaggagaattgaaagtaaattaatttaaaagcatgcaaggcatttgcaatgttgtgagtgttccataaacattagcag

SEQ ID NO: 10455 - DNA, 201 bp, Bos taurus
aaatggaaacatgttaacaagtgtggctgtgactttggatctagcacctatcttcataactggctggcagctgcttttcatctaccaggactgagacaaatgggactcaggtcaacttgagctctttattttgacattgatttatctggagtagaagcattatttttgaggggggggtgggaaacatacaacacatcatgt

SEQ ID NO: 10456 - DNA, 201 bp, Bos taurus
gacaacattacccagtccgggggggagggtaattctgcgcctattcttctcagtgatcacgtgctgacgtcaagtgagcaacagacgggcctcccaagtcgtcaccatcttggacagagatgtgtgtgcccccaacccccacgccagggaggccctctgcccagatgcagagagtgcagccatcaaacagcctcaagctgt

SEQ ID NO: 10457 - DNA, 201 bp, Bos taurus
tcccttggccagttatcctgccactgggttcaagaaggaggcaaaatctgtgacaacacatccctggtgagaaccacccgcacacaaggtagatgtctgtacacaacttgcctctttccaaggccaccctgtaaactgctagacttcttgctgaagacctgagctattcacttttatgaacctcttaaatccctcaaagag

SEQ ID NO: 10458 - DNA, 201 bp, Bos taurus
agactgtttctgtagtcaatactgtgacagtctctccaaattccctttcaagtctgaaggatttctattctcagctgttgagcgggctgcaggcaggcagcgctcggctatcagcccacctcaaaattgccgcagctgaagagcctcattactcaaggtcatacccttttcactggggcatctgaatccagagatgagtca

SEQ ID NO: 10459 - DNA, 201 bp, Bos taurus
tatactagcagggcatttccaaaacataccagagtaacacaagaaagaaagaaatgtgcaggtaaagaaattatccattggaagtttttgatttttaaaaatttttggaggtttttattacagtaggtgactgtgagatgaaatcatttagtcatgtccagctctttgtaaccccctggactgtacctctattcatggaat

SEQ ID NO: 10460 - DNA, 201 bp, Bos taurus
gagagcacggtttgcaccatgtgaaaatgagagtgaaacccccgagggcggctcgctgaaatatgtgcaaaatgaaagaagccctccccaaggcctgcagcgtttctcccttctcctcttcgatctgcaaaacaccggatttcactgctgccagagaaaataccggggtcagcgccccgggccctgggcccttccaaatgg

SEQ ID NO: 10461 - DNA, 201 bp, Bos taurus
aagtacgagggtccagataaaagggaaagagccttgaagaaataaagggggagatttaagaaatagtgggaaaagtcccaaggaggtgggtttctgggcccggaactgatgaaggggctggcatcaccttgcagacttgtttgaccacagcagaccatggtcagtgatggctgggtcttcccttggccgtagactctttac

SEQ ID NO: 10462 - DNA, 201 bp, Bos taurus
tgggctcacacctccttcctgctccaggcctctgctggtcggcagaagagccagtgcttacgggggcagccacgaggtgctggcagagggcagtccgcgcccctggccccagttctgttttgttctttggagggagagggtctggttctcagcctccccgttctgacaacaggacttttctgtgtgttcagcgacagagct

SEQ ID NO: 10463 - DNA, 201 bp, Bos taurus
gagatgaagcattttagcaaagaaagcaaatttccctgaagatattagaatgagggaggctggagtctgagacacacaggatgagttagaaaaacaaagaggggtagtactcctctgtggacaaatggtgaagtctttcaagagtgattccatccaattctgaaggtagattgtgttaataggaatgtggcctgttctctt

SEQ ID NO: 10464 - DNA, 201 bp, Bos taurus
gaagggagaaaaggtaagaacatctagctcagcagtgtttgataattatctcttggtgacagaattagcatattttcttttgtgttttggtagtttgccaacttgtacattcctttatgatggggaaggtaggaagagaaaaacacattctttaaattaaggcataatactaattacacactataacaacaaaatattgta

SEQ ID NO: 10465 - DNA, 201 bp, Bos taurus
gctcttcatttactccctcttcatcccaaggaatctagagtcacctctagctttcatcaagcatctaggagaccctactagaaggccctcaggtgacctcccaccagtcctcacacagccccctgtccactttgtcactggaaatatgcaagcgttctttgcactgatgagctctgggagtgcaggcccatctgcttccag

SEQ ID NO: 10466 - DNA, 201 bp, Bos taurus
ctctggctaagaaatccttttgaatttcagacaagagttgcagtaactgagtccggtttattcaggaagagtggagccagaatgggtctgctgtgaataaaatgacaggcctgctttcttcacaggcgacttcttccctatgaccgaattctttgatgttaatgtaattctcattaattgctaacgccaaagcaacagagc

SEQ ID NO: 10467 - DNA, 201 bp, Bos taurus
gagggttctttaccactagtgtcacctggaatggaccccatggattttgaagtaagactcacttagagtcatgttggttgctgccacttactagctgtctcatcataaggccatcatttcaagactctaaatctcaatttcagcatcagtaaaatggggataataggtgcctcatggaattgtcatgaggatggaatgaca

SEQ ID NO: 10468 - DNA, 201 bp, Bos taurus
ataattaagtatccatccatatgttttcaaatagagacaaatactgattgttcagataattgattccctgcaatgacttcccattcagtcatgtttttaaagccaaaacatctaataaagtcaatgtttttttagaaaaaaagaatagagtgtagatgacttctcagcaattttgtagtaagttcttggagtatcatgtag

SEQ ID NO: 10469 - DNA, 201 bp, Bos taurus
attcaatttaactaataattatttagagtctaccaagattctgttcaggccatgtggggtttcattgtgtattcttctacatgaggctaactataatgtacacaaaaaactaagggattgggccaggctaattttgccttttcaacggtaatttaaaatttagagggaaaaaaattgatttattatgagatgaatagaggt

SEQ ID NO: 10470 - DNA, 201 bp, Bos taurus
tctaggacatcaagccaagagatatgagtgagtggttgcccattgggagcattgagatatggacagcaaaaactctagggcagtcgtctatggggacagatgactttcgctgctggggacaatttgcttttattacgctggtcttggtacagccccttccctcccctgcatcacatgttgtcagttcttccagggggtctg

SEQ ID NO: 10471 - DNA, 201 bp, Bos taurus
ttctttggcagtgacccacttcagtggccatggaaagactgaatggtcacttacttggggtagagtaataatagtgacacatggcagtggtgatagctgtactgagggcctactatgggccagaaaccatgccacacgttctacatgcattctctcctctaataactacagtggccgtgtgtgtgtgtgtgtgctcaattg

SEQ ID NO: 10472 - DNA, 201 bp, Bos taurus
caaagggacaaaaacaatgaaaaataaacaaaagatcaaggatgaaaaaagaatttcttcctcaaatgacagaggataatgctttatacaaaaaacaagggcaaagaaattgtgacacccttggggcacactgccttcatttgtacagcaaaattgctattttcttaatctagaatcaaattatgagggcttgatgagtat

SEQ ID NO: 10473 - DNA, 201 bp, Bos taurus
tttattgaatatgtactacatggtaggagtacaacagtgaataaatagacatgtctcaataccatggagattaccttctggttgggtatttctaagaaggaaacatttaagctgagccctaaagaactaggaagaggcagtcttacacaagagaaggggggttccatggagagaaaatggcatgcacaaacccctggggtt

SEQ ID NO: 10474 - DNA, 201 bp, Bos taurus
tcaaagagtaactagaaagtagacagagcacatagaatcatattacaaatatcacaagagggtagagcagatctcaagtctccaagatcgcaaagaactttgtcgggttgagccactgaaagaccagtgaggcaggagcacagcaagagagaagagtagcaagaggccagacacggttttgtgagccatgatgagagttcg

SEQ ID NO: 10475 - DNA, 201 bp, Bos taurus
agatgctaggtcactggccacttcgcagggtcccaccatcctgccaacgtcttggccatccctctagtgcacggctgtgtgcctccggccctggagcccacgtgtccactctcactgggctctctgtggactctgggacaggctccatgtggggctgcccggcaggcaggctggcattacctaattgccggccaaggtctt

SEQ ID NO: 10476 - DNA, 201 bp, Bos taurus
ggatcttctctacctctggatggctaccgtaaggaagaaattaattttcttccctgaggctggccattccaggagatatttgcaagattaatggcctttttactttaccacctcacctcacccctatctgttctataaaagatcctggcatccagacttcaataagatggttatttggagacattagtctgccatcttctt

SEQ ID NO: 10477 - DNA, 201 bp, Bos taurus
gaaacggtcctttgctgacacttttataattaggagttcaagagaattcattcttttctccttgggagaaaagcattgagctgttggtttatggggtgactcatggcaggcaagagcctggatggggggccttctttccagggaagagcccagaaggtacaaaccttgtccaagaggacctgagatcagctggcaggaaat

SEQ ID NO: 10478 - DNA, 201 bp, Bos taurus
aacacacaagtacataagtatcttcgtaattcaagaaacaggttttattcttatttcatttctaattcagttgtagactgggcaactttgcatcagcagtacctgcactgtttcacaaactaagtaggataagcatagcctaagtgtctagcacaggatctgacacataggtggtgctgaataaatgctacaagaaaaagt

SEQ ID NO: 10479 - DNA, 201 bp, Bos taurus
aactcttagggcccttagcacacatccctgtctcaacctgctctagaaattgctccagcgctgtctcacatatgtttctcccaatcatattttaaactccttgagggcagggccatgtctggagccgctccacagggtgagctcatgttgattcccataagcccttgctcctttcatggacttggagctaaggtcctcctg

SEQ ID NO: 10480 - DNA, 201 bp, Bos taurus
ctggagaatcccaaggacagaggagcctggtgggctacagtccacagggttgcactgagtcggaccagactgaagcgacttagcacgacaacacacatacgaggcctgacataaagggagtagtcgtcactgttactgtctgttaccaaacagccctggagtgcctgtctgaccgacccagcgaacagtcagtcccactct

SEQ ID NO: 10481 - DNA, 201 bp, Bos taurus
taaggaaggacatgtccacaccttgacctggttctgaaaggaggggaagaaacgaaacctcattacattagaaaacaactcgccctcgggcagcggcctcgattaggttacctgttaatactgtcatttgctaactggattccacagtctatttgcaacactgttttataatccacgtaagctttctgatactgctctaca

SEQ ID NO: 10482 - DNA, 201 bp, Bos taurus
tgccaggactatcagcagtgtagcaactacccatctgtcctcgtagataaacagttctgaattctttgtccaggggttgctaaagctgggccattcattgtccctttgcccactcagtgccaccagtcaacctaagaaaaggatacagaggaagtgcattccctgtaattatgtacatattaaagagatggtagtattagc

SEQ ID NO: 10483 - DNA, 201 bp, Bos taurus
catgccagcctcgaatttcctctttcttaagggtctatttcctctacgaagccctttcctttatgaatccataatgattgttctctctccttcagtcctataggatatacttgatcttttatctggtacttagcatttgctgttttctgttactattttctcttaattcttacactctcttaattagattgtaggattctt

SEQ ID NO: 10484 - DNA, 201 bp, Bos taurus
taggatctttcaataaattgctttttctacttttaattcctttggtttctacaaatagtttagtatctcttttgttaaaaaaatactcttattcttttgtgatcatttttaatttcctagttttaatatttctggcattctatttgacagctgcctccttttcagtttctttagtttcacaagcatgttcatttaaccttt

SEQ ID NO: 10485 - DNA, 201 bp, Bos taurus
agagtgaaaagagtgacaatttatacttatagaacaatggtggtataccaaacattttgcattacttcccttgcttttcaccataggcctataaaaacaggtaccactggtcttccccattctacagagaaggaaactgagttaaagaggtaaagagacttatctaggtcatgtggttaacaaatggtggggccaagcttc

SEQ ID NO: 10486 - DNA, 201 bp, Bos taurus
ttaaaatatattgtacaacttaaaaatattttatttacttggaattactcaggaaaacaatgcatccctaaaacagaatatctatggccacacaaaggaattgaatagctctcataaatcacactgtagaaagactattacaaaatatcctcacagaaaaaaaaaaaaaaggggatactttaaaaatgaatgtaacagggc

SEQ ID NO: 10487 - DNA, 201 bp, Bos taurus
tggccatgaagggagccagctacacactgaagatggaagaagagggaagtagaaagaactgggctctggaaaatcttgtcactccaattaatcacacatcgttgggccctaccttgagacttcttgttaggtcagaaaataaatcccctatattttaagcccctttaagtcgggttttctgtttcttgcaatagaaagcat

SEQ ID NO: 10488 - DNA, 201 bp, Bos taurus
ctgttggatagggatgaactgatgaggagttcacacaaagaaagctggtcagtcacgctctgcgtcaagagttttccacatggccacagaagtcggggaacccaggatgcagaaacagaaatggaggatgccttatattctcccaagggaccctactcccacagggccatctggtcacccaagtgcagtttctccaagcga

SEQ ID NO: 10489 - DNA, 201 bp, Bos taurus
gattcttaggcgttatggccaaactaaaactttgtgtgttgcttaaaatgataagtaacactgagctagtgttttgaaggaagctctctttgcttcctctccagcctttgataatcaatgtgtggtttaaaagaaagacgtcagtatatctaaataattgtacagttagctaacttgcccacggctttgactctgtcacct

SEQ ID NO: 10490 - DNA, 201 bp, Bos taurus
agacactctggtttcccaggaccccaacttgctgccagggaggcactgtagcaatggggggcatggcaaccaggtggggtgaggttggcactagcagacctgttggtagtactgaacaagacaggagggggaaaaccctaccaggggtgtctgtttcacaggggctccaataattcataaccattcccacaacagagcagg

SEQ ID NO: 10491 - DNA, 201 bp, Bos taurus
ctcaaacctcccactcacattcctcctcaggccaagttgcctttcccagttgagtttgtctatcccacttctgaaaagaatccaggccatttgccaagaggataaaaggcactgagcagtaaagatgtctcaactatgctgagcgtgttgcccagtctttctctttctgggccgttgggctttcctgccagcctgactttg

SEQ ID NO: 10492 - DNA, 201 bp, Bos taurus
tgggaacacagccacagacagtacaaaaatgatggctgtagtcctgttccaataaaatgttatttacaaaaacagtcagtgggtgtatttggcctttgggctgatcttgttctcaagttcacttgttctcagactttggtgtgcatcagaatgacctgagccacttgtgacaacacaagctgtccagaccccagattctga

SEQ ID NO: 10493 - DNA, 201 bp, Bos taurus
ggtagcttagacaagatttctcacagttctggagactggaagtccaagattaggggactggttttcttcctggcttccagatggccacttccttgctgtgtcctcacatggtggagagatagccagtgaactctctgatgtcttataaagatactaatcctgtcagattagggccccacccttatgacttcatttaacctt

SEQ ID NO: 10494 - DNA, 201 bp, Bos taurus
tgtcttctaatcctggtagtacttgtccatgaaatgcctgtgtaacctctggaaatcatcatccatgataatgtcggccgaatatccaaccgcagcatcaaattctgcgtcagaggcggaggaggatggcgtggagcgctcttcctttggagcgtcctcttgctgacgcagtcacctcagcgcggccctggcgcagcctcc

SEQ ID NO: 10495 - DNA, 201 bp, Bos taurus
cggtccagctcacacaagccaccctttgttcagccctcccctggcacgctctcctccaacactgaggctattataacacaggcctcctgagcagcgcacatatccccagccaccaaggtcaggcatatgcagccaacgttccccagctgtggtctggccatctcccagcgcatctgtgggttcggtgttcaacagagtggg

SEQ ID NO: 10496 - DNA, 201 bp, Bos taurus
tgcacacacgttgtgtgctgttgctgttattattgtcattgctgtgggagtgtcattcaaagtccatcctccatcagaatgaatgatcagcttctggtccgtgactgtgctccttaggcctgaaggctgtgattcatgatggtcaagggcacctgcttgggggatcagacaaaactaaacacaaacctcacctctgctttt

SEQ ID NO: 10497 - DNA, 201 bp, Bos taurus
ggcctgaaggctgcatgtggcatcagactccccacaaagcctttgctgggaggggaccgttgtcaccaaccgtggtcatcggattggctccttcgctgggcgtcactaaaacccctcagctcaggccatggagttcttcttataattaacctttcttttgtagctaatggttcttatagataagactctagtgtagggcag

SEQ ID NO: 10498 - DNA, 201 bp, Bos taurus
tggagaattccatggactgtatagtccgtggggtcacaaagagtcggacacgactgagcgactttcactttctcactctcgtgaggctttcatcttgttttgttatggatcagaacctcagggaatcttcacacctcctagtcatccttcagaacctactgggcccactctgcggattctttcgcctcaggcctaattatt

SEQ ID NO: 10499 - DNA, 201 bp, Bos taurus
ggggagcacaccccacccctgacaggccagggatagctacagggcagagaaagttccacctcacacatggcacaggttttacaccctccagcaccaaccacgctccctatcaaggtgacaggggccagcacaccctgaggaaagatgtggctggtgtctacatcaaaatcagccctcatgccaaagacactggatcaaaca

SEQ ID NO: 10500 - DNA, 201 bp, Bos taurus
ttagagaatgtgctgaagtgctgcaatccactgcatgatcatctaacacattgtaagagttctgaacgtgccctcaggagaccatcagggtcagagcggctgggcccccggtgtgctcagtgcctctgaaacacagtctgtagacctctccatgttcctagtagagtcaaaggcagacctaaaaagtattgatctagttga

SEQ ID NO: 10501 - DNA, 201 bp, Bos taurus
tcataaagaactcaagtcaggctgggcaaagaaactgagtaggtctcatgggtctgcttggcagcaatgggtacagaaggagtgatgggagagaggaggagggaagggacatttttaagtagcatcagaagaacaggccaaaacagaaaaagatgccagtagccctatctaaaattacatctgtgctatatttgatgattt

SEQ ID NO: 10502 - DNA, 201 bp, Bos taurus
ggacagaagagcctgtcaggctacagtccatggagttgcaaaagagaaggacatgactcagcaactaaacaacaaaaggcctagctaagctggagaaggcgatggcaccccactccagtactcttgcctgggaaatcccatggagagaggggcctggtaggctgcagtccatggggtcgctaagagtcggacacgactgag

SEQ ID NO: 10503 - DNA, 201 bp, Bos taurus
aaatcccttatcagaaccaagtgtgcagataaactcttaggtgtcctttctttggacaaacaagtattcgagacacataaacaggagcaggccattttcacacacggggtggggggcttcatgggattcatcatttaaaaggcaaaagaaaccaaattggaagcaaaaattccaggctgtgagtggctcaaatattagcac

SEQ ID NO: 10504 - DNA, 201 bp, Bos taurus
ctgtggcttggtgcatgttgttcccatgcctgaaggcctttcctcctaatcctttcccacgagataaattcaagcatattcttcaaacccagtaacacccgccttgaagccagggccctggcaattcatctgtgcccccagataattttctatcactttttcagtacttcaaagagtagttctcaatggtggctgtacagc

SEQ ID NO: 10505 - DNA, 201 bp, Bos taurus
agtggcaaagatgttttaacagtcaaggactggattaggacaagtgggaaaggttgaggcaatgagtccagtgtatgatgccaactttttgtttttttttcctttggccaaccctattacacccctttggggaagtttcacaaccctggccatcttcgcagcagcatacaagaagttgtgtgtacaccactagtctaaact

SEQ ID NO: 10506 - DNA, 201 bp, Bos taurus
cagaacctaattcgggacaagggattagcactgccacgtggcccgggtctaaagccatctgctccactgagcttgaaccaggaagaagtcagctgatgttgtacactcttctttcccgcattttcaaaaccagactggagatggggcatgatgttcactgacccactaaagtatcagttgagatcaggtagttcctctgct

SEQ ID NO: 10507 - DNA, 201 bp, Bos taurus
cacacagcaggggcctgtcacggggcactcaggaaaggcccggtgcctttttgcaccgtgtacctctaatctacatcataaatcaagtgacgggctcacgatctgtcctaggcccaccgtaactaggtgctggaggttaaagagtgagtaagacacactgctggctcttgaggctctcacagtcccttagggaagtgcatt

SEQ ID NO: 10508 - DNA, 201 bp, Bos taurus
agaaatatcgggagcaggaaaatgctggttttctcagcattaatctgagatgcaggtttcagatgttttaaggggaattattaacaaaaggatgctcccataaggacagcgagatttgcaggcatccagatggttggcccttccctcaggctctctgctagggatttctcatgggtttcttcattaatttccttagagaca

SEQ ID NO: 10509 - DNA, 201 bp, Bos taurus
ggtttccagtctctaaagactgccctggggtgggtggatactggtgaataagaaggaagacacagataggcccggtgttcacgacgggacaggtgtggtcgccctgcttcgcgggtatccctgcagcatgagccagacccagaagcttttggaataccacttggaaacttcttggcaaagcctaacaatggaaaagcataa

SEQ ID NO: 10510 - DNA, 201 bp, Bos taurus
ttcatataggtcaaagaaacctgggccacttgagtgttagaacatatcattaatctactctagtgatgacaacatgttaatcagaccaaatgactaaaagcgtcaattatatcagagtactgataaaatatgcggactccggaggacaagaggtaaaccttgggagattcaaggcctagtggcccagtggtctagaacacg

SEQ ID NO: 10511 - DNA, 201 bp, Bos taurus
ggaccacgtggaacatttaagggcctgctgggaatggagggcaccatctctgtccacgtgctggttagccagcgctcaattacataaccgtgcttagctgcggcccttgggagtgctgggtgatgcactctggttgcctggttggaaagcaaatgaaagcagtttgtgagcacatagcattatctctgccccaaatgacca

SEQ ID NO: 10512 - DNA, 201 bp, Bos taurus
ctcacaagaccagtttctcagggttgtatgaattcctgtgcctcagaatagttcatttggagaggccatttaatctcttaaatctcttaaaagtcaaatcgttgcctccgtgggcactaacgttccccatcttttggtttgggaatgcatggggcatgtatagagacgaaatgggtcctgtgtcatctcctggctctgcaa

SEQ ID NO: 10513 - DNA, 201 bp, Bos taurus
atgatcattgcctggaatttcttggactcctataatttcttgactctctaaaagctaatagcacccctgaaatctagcagtggcctccatgacctttcttctggcattcttctggtggttttcagaagaaaaaccgctcagtcatgtgtgactgtatgtgaccccatggactgcagcacgccaggcctccctgtccatcac

SEQ ID NO: 10514 - DNA, 201 bp, Bos taurus
cccagtgcaccaggcatttgggggctagaagcccagcgttctcctgcctgtgaccctcagcagaggcagggcaggaagcagatgacccgggcctggcagcgtctgagactctttcctgagcattcttgtaaaaaagcaaccacattgccacatgtgcctggaatttgatttccaggccaagtgtcagcttttccatgctaa

SEQ ID NO: 10515 - DNA, 201 bp, Bos taurus
aaatggaataaaacaggtacagaaattaaacttgttaaattttttgtaatcgttgtaataggaagtgacatctcataaacttgtctaggaagaaaatcctgacctcctgtaataaagtcaatatgtgcagagaaatggcatgagggtcaaattaagcgttgatctgccttccctggaagaaataccaggccacctttggtc

SEQ ID NO: 10516 - DNA, 201 bp, Bos taurus
ggatggaagggagagggaggaaatgaggggaaaacagggacagagaaagaaggagagatagtaagaataacagaccctgtttatggttctggacttctagggactacacgcttacaggccaacgtctaacagaagaaaatggagcagtactttattaaaagcagagcaagcacagttctctggcaaactaggctagaatcc

SEQ ID NO: 10517 - DNA, 201 bp, Bos taurus
cccacctttgacaattcttactattaacagactttttactctttgccgttctgattgctgttcaatgacaagcattcttggccatttacatatcttccttcatgatttacctatccacttcacacattctttctgatgtactctcttctttttctgaataatttccttaacttgaccaaagggcctgggctcttggcgact

SEQ ID NO: 10518 - DNA, 201 bp, Bos taurus
tctcccctttctccttttctggggctggcatatgatgcgatggggagccaccttgggatacaacaccctgaggacagcagagcagcaaggtcaaagacacctgacccctcgaatgactctgcagagcaaggccaacaagccagccagactttcagagagagaaacaaactgctatactctttatgcccctgttacctgggg

SEQ ID NO: 10519 - DNA, 201 bp, Bos taurus
aaagcctacaatggctaagatgcctctgagggtcacatgattctctacttggaagtcagcgcacttggtaaactacatttaccctgtcctagaattatttgcaaacttggctatgagtttaggtaaaatgggtcactaccttttacaaaggctctagaaaaatctacagatccaaaatacctccctctttccccttggtca

SEQ ID NO: 10520 - DNA, 201 bp, Bos taurus
ctgctgttggtgtcaaaatcacaggtgttgttacttctagtgtatgttgttgcctagattcatcattgaaggagattcttcatttcagttagaggttagtgagaataaacggtctaatttttttttcctatccaaggtcacaaaccccatgaatttgacccacagaccatcaaggggtccaagggccctggattaagaggc

SEQ ID NO: 10521 - DNA, 201 bp, Bos taurus
gtggaacctggcagccacaacccctggagcccacagaaaccagctcggtgagaagtccgctcacggcaacaaagaatggccccgactcactgcaactaggaagagcctgctcagcgaagacccagcaaaaatcaatcaaccaatcatttctttttttttttaaagaaagatttgagaaagggaaaacaaaagagaatagct

SEQ ID NO: 10522 - DNA, 201 bp, Bos taurus
cattggtggcaagtttctcatttggtaaaaaggtgtctattatacatttcaatcagaaacaataagaggagagatttcctgggggccttaagacactgtaggggtctattccactgcagggggtgcagtttgacctgtggtcaggtaactagggggcttcccaggtggcgctggtggtgaagaacccacctgccaaggccg

SEQ ID NO: 10523 - DNA, 201 bp, Bos taurus
ggtattaagatggtgctgtagcttctctttttattcatcttagcagtgaattcggtggagccgtgcaccagagaggttggctgcatgtttgagggcccgcagtgcagaaggctgtgctgtcggttacctaaccctgggctcggttagcccctgcttcctgcacttccccccatctgtctgcagaggaggaagggtaagggg

SEQ ID NO: 10524 - DNA, 201 bp, Bos taurus
gggaagtaatgaacaagaccttacaaacatcctgtaaattcatgagctagagaaaaggatgcaaactctttaagtattagcagtggccttgaaagtaacagaaatgagagaagaggaccaggtgaagaagagagaactggggaagcgttggcagttgacactttggccttggcacaagggagaaagccaggagacttagtt

SEQ ID NO: 10525 - DNA, 201 bp, Bos taurus
tgacatcccaggatcgtgtgaccaggaagaggaaaggctgaggtttgacctggccttcctaacgctgaatcccctatccgttctttctgcccttgcagggatcatcaaggcaaatgctctgggggccaggtagctaatctaaatgagagaagctgactggagtagaagacattagggagtagtcaggactctggggagtca

SEQ ID NO: 10526 - DNA, 201 bp, Bos taurus
cttgggtgagaagggggtgtggtatcctctgagacttgctaagatgtcccctgggaaaagtcattgctgtcgttcaggatgaagattgcatttccagtacctcttcccttctttcataaaaaggcaaaatataccccagcaacaactcgacttcctgtttgtttgtcaaaggaactctctggaaaggagagtggggtcccc

SEQ ID NO: 10527 - DNA, 201 bp, Bos taurus
tggtgcacacgtggtgatggagttcagagcccggcagcatgttgtcatttaagatccctgttgttagaagttgttggcaagcttcgttgtcatggccaccatgatcacaaacaagacagttagttgtatttctcaagtctccctttcagactcaaaggcttctactgtatgactgtgaaggaacttttggaaagctttgtc

SEQ ID NO: 10528 - DNA, 201 bp, Bos taurus
acaacaggggttcaaggcttctccatctatgattcaacccgagttcctcccgttccatgccagggtggcaagaccccacctcttcatctccaagtgggcctctctgtcattggggctacaaacgagtggagggtctgtgtctgcttcccccggcagggtgggctatgggagcccccaggcacccccatgcagccccaggtc

SEQ ID NO: 10529 - DNA, 201 bp, Bos taurus
tgttccaaatttcagactcacagaagacagatactgcttggtataggatgggtcggggggcgaatcctaaattacccacccaggagagggccaaggtcactgaggtcagtaggaccacaggagccagaggagagagggtggtggtgagtcagacgtcctaggaggggtccgctgtagcatgatggtggcccacaggtagga

SEQ ID NO: 10530 - DNA, 201 bp, Bos taurus
tcgtccccttctcctcctgcccccagtccctcccagcagatttatacattaaaaaactagctgaggcggttgcggtgggagagcagcaggccaagagtgtaagttgctcaccccaggggctgcctgctgtcccgctgccctccgagtgcagccatgtccgaaggagaagccccaggagggagtgaagatggagaaggacca

SEQ ID NO: 10531 - DNA, 201 bp, Bos taurus
tgcaagaggcacaaatgcctccgagaccataactggtttaaatggtcatgttggtactggagaaagagaggaaagaaggctgaaccagtaggctggagttagagtctgaaggactttttactctagagtaggcattgggaaaaggagtacgtcaaagctgcatattgtcaccctgcttatttaacttctatgcagagtaca

SEQ ID NO: 10532 - DNA, 201 bp, Bos taurus
agaagactttaggcattccccagaggatttcaggcggtccccggaaaacttcaggcgccttgaggaggaacacttcaggcggcctcctgaggaggacttcaggcgctctcgggaggaggatttccggtacccaagggaggaggactggaggcggccacctgaggaggatttcaggcgacctcccaaggaagacttcaggag

SEQ ID NO: 10533 - DNA, 201 bp, Bos taurus
tttgattaaaatattataatgctttataaataaaggtatcagtgtatttaatgaaattggtctgagtgcaaaatggcctataaaagagtgagccagattgctgtttttcaaactgtgctgcaggaaacttttcagaagctgccaggggccttgggaggggtccaagtagtgtactaggattcttcttcaccccagcctctt

SEQ ID NO: 10534 - DNA, 201 bp, Bos taurus
tcgaggcgaaagcaaaaagatgacagtgaagacaaataagggacagaatgaacaataaatgagtaaaaagacagagagattgagaaaatacctgggccaggaaaagaaacagagaaccgtaaaaatagacctgagaaattactatgtgcgatggcacccactccagtcctctggcctggagaatcctgtggacggaggaac

SEQ ID NO: 10535 - DNA, 201 bp, Bos taurus
ctcggatctggatggatgagcaggatttcatcataggattggagagaagggcgtcccagaaagaatgatctggaacaagggccaggggaaacttgtgcattgtttaggcttggatgagcagccttgaggaggtggagaggctgcaggcgtggctggacacatgacctgggtcacgtgacctgggaaaggcctgttgagtct

SEQ ID NO: 10536 - DNA, 201 bp, Bos taurus
aaaatttttcccagttaaaatcacacataaccctacacaggcacaggaatacacacacacacacactttttaaccaaaaataaaatcatataaaaatggctttctaaccagtttatttccctcttaaaaataaattgtgaatatctgtacatgtcaatgtatagtaattcttattgtttttttctaatatcatagagcatt

SEQ ID NO: 10537 - DNA, 201 bp, Bos taurus
tttgcacagataattggaggaggaaatggcaacccattccagtattcttgcctgggaaatcccaaggacagaggagcctggcgagctattgtccaagggttgcaaagagtaggcctagactgagcacatgtacacacacatgggcagataatacaaggagctcttacatatcctttacccaacttcccctaagttcacgtc

SEQ ID NO: 10538 - DNA, 201 bp, Bos taurus
cataaaggtaaatctcctttatgctccctggccccgaggagcccacaacccagagagaatgacaaatataaaagcaagttattactacctagtgtgcccattgtgatcagtgctctaagagcagtaggaaaaaaggtgctcaggaggcactgaaaagaaattgatcagttttccaggagagtgagaagaaagtttgaaaga

SEQ ID NO: 10539 - DNA, 201 bp, Bos taurus
gttgttggttcagtatagttttgatgggctcaaggtttagccccagggattttgatgaagtcactccatggccagtgtttgagagccaccagctaagagttggacatgactgagcaacttcactttcacttttcactttcctgcattggagaaggaaatggcaacccactccagtcttcttgcctggagaatcccagagac

SEQ ID NO: 10540 - DNA, 201 bp, Bos taurus
agatttgaggaattactctacaagaacagggcaggttctatttttgacatttcagcaatgagaccacttgtatattacggcctgatttgatttactgtacgaaaataagagttctgtaatttgtaaaagacatttattacatgagtccaaaaattaggaaaaaaaaaaaacatgcttagtgtctctgtctatcccatctgg

SEQ ID NO: 10541 - DNA, 201 bp, Bos taurus
ttcatatatcaagttcgtagtggccatctgttccctccgaactgctgcgtctccctccatctgccctgtttttcttctgctaatcgggtggcaagggctcagatgatcgggaagtttctctctgacttttgatttgtcagtcatcatcaagccagctgtgcatttgtaacagactcctccgacgggtggtggtgaatttaa

SEQ ID NO: 10542 - DNA, 201 bp, Bos taurus
aatttccacaagtacttaacctggctcagaagtcatgacctcactaaaagtagacctctcctcctccccagatgaaattgcaaagcggttctttgccgctctcctcccctgaccatcattcttggctccacgtttttcatccttgaccctgaattccagataccttgctattcaatttatcagttaatgaattaacatgta

SEQ ID NO: 10543 - DNA, 201 bp, Bos taurus
gtattttttggattaaccacaaaaaaccttgtgccctatgctgggttgatttggagggaatggtgttgggggaggccccattgcagtagggatcaagtatacatttgagaggctgattctattattgtcatcattattttattgtttctatcactgaagaaattttgaaatccctattaagggaaataaaaaatctgattg

SEQ ID NO: 10544 - DNA, 201 bp, Bos taurus
gtgagatactggaagcatcacagggtggagtccaagtgggaaagcaggacctggagttgaggggtcacaggactcaggaagcctggccagttgcccacctaaggggtaggacagaggtttttatagtcccaggcagagggagcgtggtgagcagaggtttctgttagacttctaactgtcttagtaggacacagggccttc

SEQ ID NO: 10545 - DNA, 201 bp, Bos taurus
agtttattggtttttaattttggctatatttgttaattcactaattctatctcttttctttagggtagatgacccttaaaagctgaatttggcctttttgctttatggctatatctctaacatatccaacatataataaaatattgaataaaatatttgataaagaatgagtgagtggattttctttgtttcattttacta

SEQ ID NO: 10546 - DNA, 201 bp, Bos taurus
tcaacaaatggcatgcagcctcatacagcaagagagccaattcaaacagagacaatgtttcagtaaaaacctagcataagcaatcccttggtttcacaggggaaggcagtatgtgctgtgattcagaatagtatgatgatggtagcctccaatacacctcaccttaaatcccagcacactgaatctcaatctctttatcta

SEQ ID NO: 10547 - DNA, 201 bp, Bos taurus
aagtcatgagattaaaatggtaaacaaacatgcttttcaacaacataggttgcataaggcatttccctaatcaaaatcaattttctcagtagttttccctcggcaaacataaacattttattcctgcaactcatttttaagtgagctcctatgactttcatttgtaccttttttgtttgtttgtttgttttgtttgtttaa

SEQ ID NO: 10548 - DNA, 201 bp, Bos taurus
tgctggtctgcgtgctggccgccgtgtgcttcgcttccctggccctggtccgccgctacctgcagcacctcctgctctgggccgagagcctcgactcgctgctgggggtcctgctcttcgtcgtgggcttcatcgtggtctcgttcccctgcggctggggctacatcgtgctcaacgtggcggccggctacctgtacggct

SEQ ID NO: 10549 - DNA, 201 bp, Bos taurus
acaaaggtctgaagattatccactatggcccccagcgttctggcaagaggctttctcactaccattctcctatttgtcctagaggccccgctttgggtttatgaaggctttgggatttggatatattgttggaaccatgtaaagtcctcattcctggtgaccatgtaaggccaccatctaaacaatatctttagtatggtc

SEQ ID NO: 10550 - DNA, 201 bp, Bos taurus
agaaaggaagctacagcccttaatcacggtaatgacatacatcacttttgctttttctatttgtcaggaactgttaccagatccagcccacacttgagaggaggataatacacaaggataagaatcagtaggagccaccttggggactgcatatctaccagggatatagaacaatttttttctgtgcatgtgacttggtgt

SEQ ID NO: 10551 - DNA, 201 bp, Bos taurus
ggataggctgagccggaagaaacactttcactttaccagcgtccttaagctcattttgttcagagtgaagaaacaacattcatttgctggcctactgacaggtgtatccctttcattatgggaattagttctgtgatacctaaagtgtatacaacttgagcatattcttgagtgtggccatgtatcttggattcataaaga

SEQ ID NO: 10552 - DNA, 201 bp, Bos taurus
gaaggcttcctctgagggctgggaggaagaatttattccttgtctctcccctagcttctggcagttgctggcaatccttgctggccctgggcttgttgacgcatcagctgatcctgccttcactgtacctggcattctccctgttcatgtgtgtctgtctctacatttctccttttccaaggacactattagagtagtggc

SEQ ID NO: 10553 - DNA, 201 bp, Bos taurus
atttctgatagttgtaacagcctattttaagctgataatgacaacttcaattgcataaggaactgttttacttctgctctattttattcaagattgacaatttatgtctttttaaattgtatacccattaccaagttattgtaactatagcttttttttagtacttttgtcttttaaagtttatacttgtactaaaagtaa

SEQ ID NO: 10554 - DNA, 201 bp, Bos taurus
aaacatcccttccctcagagatgcttgccttgatttccaggacaccatctgtggctagcataagttctttcagtataaccatcccccaaacttgtatcgcgtttcatttcattcatccctcttactcagggcctctcagtgacgccaacatgcaccttcttagtacagagacgctgcccgaatgattcagcacatggtcac

SEQ ID NO: 10555 - DNA, 201 bp, Bos taurus
ttttataaactctgtagactcaaatttgttgaggtttttcattacatttaatcttgtatttttcctacactagccagctaccttcatctgcatgactcccacctcgccatcccaactgtaacccttgggaattcatatgccttcatttgacagactctccagatccgttctcttcccaatcttacatttaaaattcaaaga

SEQ ID NO: 10556 - DNA, 201 bp, Bos taurus
gctggagacagaatcagccaggtttttggagagcactcagtactcacccttgcgcattcagtaaaagcagccatatcagaacactctgatatctgccatgggtacacattccagggccaaatttgaccaagtatcctgatgagatctggcaattgctcgacagtgtgcaaagagcacagttggcaggaaggctcattccgt

SEQ ID NO: 10557 - DNA, 201 bp, Bos taurus
cagggaggcctggcgtgctgcagtctatggggtctcaaagagtcggacacgaccgagtgattgaactgaactgtactagtagacccaacagtcaggcctgcagaactagcatatttctcttcagtaagatgtttcaaaatttagattcagagagaagttggagaatctactttggcctcaaggtttagactgaatttctca

SEQ ID NO: 10558 - DNA, 201 bp, Bos taurus
aaaggtttgtgcgcccgatgcacagtggggccagaaaaactgagacactggagtctggaccagggaaaggctgattgcagcgccaagcaaggaaaacaggcggcctgtgctcaaaacccctgaactccctgatggtttggggggagaaggttttataggcaaaatttggactcagagttgcagggtatgtgactttcttct

SEQ ID NO: 10559 - DNA, 201 bp, Bos taurus
aggaagaactgtgtggggaggaaggggataggtggaatagagggatatttttattataagcctttctcaaccagtctatggcctggatgtagtaatcatagctgtatattaatctaaattatatgtacatgatagacagctcatcctttgtgggcattcattctcagcttatcagctaagacaactgaaggggcccaaagt

SEQ ID NO: 10560 - DNA, 201 bp, Bos taurus
tctctttttcactctttgtgaccttgatgaagtcagaattaagtggcactgttgaccaaacttgcaagagcgcacactgagaagagcagtcaaaaagttttatttgcaaatgactcaagcggttcaaacgactacaagggtgaggagacagaagtgcaggaagtgactgtcgtggggttaccgggcggggcaccgctagaa

SEQ ID NO: 10561 - DNA, 201 bp, Bos taurus
gacttcccaagttggggagcagcaagtgttctgtggctcagcagttacaggaaacgggggatggggtacaggcttccgtggcccaagtaattcgaatttgcaaactctctttgaagattggaaatgcacactagaaaataaggactctggatagtccttcagtaaggaaacggccttatctttgtttacccactttctccc

SEQ ID NO: 10562 - DNA, 201 bp, Bos taurus
gaaggtcgaacagcccggtgctgcagaagcctcttggagacagacatgtgaggagtgttgcgggggaagacagagagttctgtagtaggaggggcagcccggagtaaggttaatgcccctttttcccaagagcatcaccatccatgtgagttgaaggaggtctgcactaagaccaggggaccatcagggctcaagccgaaa

SEQ ID NO: 10563 - DNA, 201 bp, Bos taurus
tgtaaggcagcaatgctccaagtattggccacgaacctggtgccctggtgccgatttgagcataaactcatggagcttcagcatccctcagtcacacgagcgccttccaaaggcctggggaggccttatcaatgtgcttagaaggttgcatgtttgcataaaagttgccaaagtattttagctgcatttggttaaaatgat

SEQ ID NO: 10564 - DNA, 201 bp, Bos taurus
attgcaggcctgtctcccacatctgtatctgagcctctgctccatcctctaagaaatgggagaggacacagtaaacgctctgctggctagacctctggtctctctggccccatacgggacacagagcgggccaggccactgcgggttaatatttgttaaccaactgttccttacttatggaataatttgatatgttatttt

SEQ ID NO: 10565 - DNA, 201 bp, Bos taurus
tgttccatttacagaccacagacagagtagactgagcaaaattcttaagatgcccaggatttttggaatagtacatgagctttggcttcaacttaaagtagccagctgcattagccgctgacaagagggtcagcttgtcctctgaagctttgaagtcaggcattgatgtcagctcttgctatgaaagtcctaaatgacttc

SEQ ID NO: 10566 - DNA, 201 bp, Bos taurus
ggaatcaccaaatacgtactcttagaactgtgcatgtacaagtgactgcaattcatttccaaaaactaaacttcactgtaggccaagtgagtttcaagtactctgacctcatagcccctgaactctgtgccatagaactacaggctcctacgctacatctatgctaattaaatcctatcctcagggcctctctgcttggtt

SEQ ID NO: 10567 - DNA, 201 bp, Bos taurus
ttagttcagatgaacttactagatgtataaagaacattccatccaaaaaggaagaacagacatcccatttgaatttatatgaaacattctccaaggaagaccacaggccagactacaaaacaagtctcaataaatttgaccagactgaaatcatgttaagtaccttttctgaccacaaggtaagtgaattcagaagacatg

SEQ ID NO: 10568 - DNA, 201 bp, Bos taurus
atatgagatgccactcaaaatcaggaaaatcaatctttcttcaccttcagttgctctcacatttctgctctgatctacagtgtgccaatcacactttttttcccctggaaatttgcttgtcacaaagatcagaggcattattggcatagacgggcccgtgtgtgtgtgtgtgtgtgttgggagggggtcggttcctgggag

SEQ ID NO: 10569 - DNA, 201 bp, Bos taurus
gaacaagcaatatttaatgaaaacctaatacgactaaaggctcttagcatgatctttacaaaattcaaagcacaactactgtatctgttcccacttgaaaccttatgaatatcttccatcccatcagggtttcaatctcatttggaaatatcacacattgcagtctgcgttctgtaccagccttaagacagttaccccacc

SEQ ID NO: 10570 - DNA, 201 bp, Bos taurus
cttgctttcgatagaagatgtgtttacaatcaatagaatatggcagaagcagtgggatgccagttttttgattaggttactgcatatggcagagtctcacgatcttaattgttacgttatataagactttgttctagctgaccaaagggacagaagttcttctgctaaccctgaagcaaatgagattcaaagcggattctt

SEQ ID NO: 10571 - DNA, 201 bp, Bos taurus
ctttctttgaatctcctccccatttaggttagcgccgagcactgggcagaatcccctgtgctctccggtaggttctcagcagctgtctgccctgcacctcgtagcacacgcgtgtcaatcccaatttcccgattcatccaactcccttttagccgcctttggggtccatatggttattctctacttctgtatctctatttc

SEQ ID NO: 10572 - DNA, 201 bp, Bos taurus
agtttagtacaaaaaaacaaataaatgaaagaggcctcatccagcccacagattgggttgcacagtaaatattgcatttcttaattttgtttaaataatttatatttaacccagaggccacatttggctggactgacaggaaaattcaactcaggcattcagttcagttcagttgctcagttgtgtccaactctttgcgac

SEQ ID NO: 10573 - DNA, 201 bp, Bos taurus
aatcatttcttggtctaattgctaaaattgttcaaagtctagaagcactccatttaaattgctagcaaataatttgttggcattttaggccttttattttggggggaagggacatgccttcaaagtacctccttcatttggaacatttgtgaaacaatgacagcaagtttcatctccaaaacaaggaacacaaaagcaggc

SEQ ID NO: 10574 - DNA, 201 bp, Bos taurus
aacaatatgatacagtctgtctgttaatactaatcagtctacatctgtgctgataatccacatgatttgtaatgaaaaatatcttcttactgatgccgttattataatgttgtgggctttgggaagtgaagaggtggtctcatcttacaggtatctcctaatatcacaactgaaagtgtagactttagaatactctctttt

SEQ ID NO: 10575 - DNA, 201 bp, Bos taurus
gccagttttgtgagagagggattccagaggggaaatgatgcatttgtgtgtggaagcctttgctctgagtcttatggtggagctactgttgatcggcaggaacagaagtaacgagaaaaccagacatggagtattgcagaataaggcttccctggtggctcagatggtaaagcatctgcctacaatgtgagagacccgggt

SEQ ID NO: 10576 - DNA, 201 bp, Bos taurus
ggaggtacttaaaccagagggtggagttctggtctctcagattccagagagattcctagtcgctttcatcatgtgaagacagaaagaaggcatcagaaacgaaccaggcaaatggccctagtctaacgacactggcaacacgagcaggaattccagtctccaaaactgtgagaaatgaatgtctattgtttgttagatacc

SEQ ID NO: 10577 - DNA, 201 bp, Bos taurus
tttctctccatcatacatagctatgtgcctcttttcatacatgttgatgaagatattttactaagtatatcatttttctaaggtcaagttcacttgtcttgctggccagtcaacttccataagttctacactagcaggacttcccctcaactgcacaaaatatttctcttcttggttcactctctagactttatatacaag

SEQ ID NO: 10578 - DNA, 201 bp, Bos taurus
tacagttttttctgtttcctctattgtattactatttacctgtttccataatttatttttagagaaacactttaagggagttgaaataagctctaacttattgagaaaagagtatcagaacatttggggcatatgttaacaataccacagttagctattagtagtacttcagaggagaacctctgggattatgcaaataat

SEQ ID NO: 10579 - DNA, 201 bp, Bos taurus
acggagtagacaacgctagaaagacagaaattagcgtaattgttgcttaacagcgagagtaatggtgggaaaaaatggaaagtaactgcaaggggtatgacctttcttttttggaggacaaaaatgttctaaaattagattgattgatgatggctgcataaccctgtggatgaagatactaaaaaagcactgaattgtgta

SEQ ID NO: 10580 - DNA, 201 bp, Bos taurus
tagtaactgcattcaagtctgaaactgctatttatttctgcctgctcttcctcattgcaagtttcctcctgtatttctgtgatatccttcatgtcagtttattttcctgggaaattcacccatgggaattttttgagtcttgcatgaaagtgtaatcttccagagaggatttttatttgcctctatcaactataaaagcca

SEQ ID NO: 10581 - DNA, 201 bp, Bos taurus
acctttctaatcccaacgaagcacctacagcagtggttttcaatgatggaaaactgacattcttgtgtagagagagtcatgaaagagaggtgaattctaggtggctttctgaaatgtttacataccttatacatgatgtaatctgttagaaaattcagtcatactcctaaatagcatatacaagaaaatcttctttcagct

SEQ ID NO: 10582 - DNA, 201 bp, Bos taurus
tagtgggttcccctagaatctagagaaaagtcaagtttcctggttaaatgggaaaaggggacaaaatataagccaagaggtagtgtgtaacctgctggtgtgaaatacttgactgtccatattgaatgtccctgcagttaagggaaactaatttgtgtaatgcacattttcttggccccgtgagttaattagttggtaaat

SEQ ID NO: 10583 - DNA, 201 bp, Bos taurus
ggaggctggaagtctgagatcagggtgctctcacgcttgagctcttgttgaaggcagtcttccggttttgtagacggccattttctaattgctcctctcatggtggagagagagggggggagttactctgtctcaaagaacactaatcccactcacgagggccccaccctcccaaacctaagtatctcccaaagaccgcac

SEQ ID NO: 10584 - DNA, 201 bp, Bos taurus
gaaatgtactgctaaactgattcactaatatattatttactgttttgtcctgacattagtaacaaaaaaaactagttgagtagctttcctcttctattctttgaaatagaggcatattgtttttgaaggtttagtaatggttgttacagccttcagatttgttgccttttgtagggggagagttttgaatactaattaatc

SEQ ID NO: 10585 - DNA, 201 bp, Bos taurus
cttactaaataggaaaagctgtcctcatccagcaactagagactccaggaagaaaaataattaggagcacataaatagctggccagccctgcgcggctgcgctgggagagatggaggcggggtgcggggtggggggcgctgtgcccagtgctcgcttcacccggcctgtgaccggtggtgtcagactgtaatgctgtgtta

SEQ ID NO: 10586 - DNA, 201 bp, Bos taurus
ctggcccaggagaattatctggggagcactgcaaacccccagggctcccacagcacagctgctgcagggcgagcgagggagggacttatcagggcagacacgctctcagactcaaggaggcccgagctgccgacaggcatcatcagcatgaaagaagggacatccatgtcccgcggggatggaccagagccgtcaggacgt

SEQ ID NO: 10587 - DNA, 201 bp, Bos taurus
tggaagtccagctcttctagtggtctctgtggatagcacatgcagggtgagatggggggtttgtcactgtctgtaagggacagttatctcctccctctttgatctttcccccatcaccccggctgtgtgatgggatcagagtaaacgtaggccccagttacagtcaggaagggtggggtcttgcttccacttgacctgggt

SEQ ID NO: 10588 - DNA, 201 bp, Bos taurus
tggaaagcatagtttagtaaggtactgagagtttagtagagtgctggaaatgagctaaaaatacaagatagaatattagaaacacaagaagagatttctgccaacactgaccaaggctttgtctccgcaggcttgctaataagccactaattccttaattcccagcgtgtgatcctgtaaaggtccctaagcatatgggag

SEQ ID NO: 10589 - DNA, 201 bp, Bos taurus
ctcttcaggttgccatggttcagttcactgatgaccccaggacagaatttaaactaaactcttacaaaaccaaagagactcttcttgatgcaattaagcatatctcatacaaagggggaaatacaaaaacaggtaagacccccaaaagcccagctaaaacccaaagtaattgttactaattatataaatgattttttgaag

SEQ ID NO: 10590 - DNA, 201 bp, Bos taurus
actatgttccagggcctggtctaagtacctaaaaaatgttgtttcatctaattcttacagcaatcttaggatgcaggtacaattactacacccatttcacagatgagaagacagataataatggccacaaagtcagtaaatggtgggacaagtattcaaacccaggcagtctgattctagagcctggacgcaactacttta

SEQ ID NO: 10591 - DNA, 201 bp, Bos taurus
agtgcgtcgtcgtggagaagccctcctccagccccaggcgcgagagccgagatcaaagcgcaaagcacaaatgctgctctgatcaaaacacagctttcggcgtttgatgtggcccagcctctattgaggtaaggacaatggagtagtgtggccaggggactttggcaataagtataaagcaaggtgcactccatcaaataa

SEQ ID NO: 10592 - DNA, 201 bp, Bos taurus
catacacccccagggagagaggcctctcctggttcacagaggttctttctgctcccatgctgcgtgcttgcagaccacagcagctgcagtgagcccggcttcttcttggcctcgtagggttagtggctggggccgtgtggcagcacagtgggatgcttcagtggtgaattagccaaggaggccagatggctttactctgca

SEQ ID NO: 10593 - DNA, 201 bp, Bos taurus
tttttgagacatattagagcccattccagcttgcccggccctttgcatgaaaaaaaaaaaatgctttaactaaagtaatttctttaaagttacataaaaagatagacaaggccaaagattctcacaaaatacaccatcaaaatgcaattgggttaaggtataaatttcatatccctagggaaacagctagacaaatagtta

SEQ ID NO: 10594 - DNA, 201 bp, Bos taurus
ttagtgtctggatttacccaggaggcctgagagttctgcagtatttattgtactatgatactcgttccaccttaatgcaagaggaccggtctttcacccctaatccaatcatttattggccggtggtggaccctgggatggtgagaataatccccagtgaagcagttccaattttctctggtgcaaatgtacagaaacaat

SEQ ID NO: 10595 - DNA, 201 bp, Bos taurus
gatggcctatgacctctctgtggccatctgtaagactcttcactacatgaccatcatgaggcctcagatgtgctgccttttgctgggaggggcctgggtcagggggatttttccatgccatagtacaacttcatgtatcaagtacccttctgtggttcccaatacaatagaccactttatgtgtgatttgttcccactgtt

SEQ ID NO: 10596 - DNA, 201 bp, Bos taurus
actgctgtctccacttcagggccccagggcagcctcttctccccaggtctctatttctttgatttccctgaaaaacaagggatctggggccatagttcccgccttctttttccaactatccccatgtgtcctcaatggcaagaactgtttagtctgtgagatctgggaaatccatgttggcactagggctgctacttcagg

SEQ ID NO: 10597 - DNA, 201 bp, Bos taurus
cagtggcatgttcagaaaacagcaagcagcccagcacaggaggcgtgctggtgaggctgggactgggagggagaggatttgagagcagccagtggctgtgtagggcctcacatgtcatggtaaaatgtttgcaggaagtggtagaggagtccaggacaacttctggactttagtcctgtggcttgagtgactaaagtcagt

SEQ ID NO: 10598 - DNA, 201 bp, Bos taurus
tgcctggggggatcacacaggttgttgcctatattaaatacttgacggagcagaagcagtgattcttattacagtctttgaccccttgtttggcctctacataaggtaggtaatcttgggctgcatgcataggactgggagtcagaaaagcctccagtttctcagcagaagtgctagaaggcagacgagcagtgctggttg

SEQ ID NO: 10599 - DNA, 201 bp, Bos taurus
tctagggttgccttagttaatattattcatgttctgtccaaattgaatagcaaatatttatttagtacttgatccttgccaagtactaaatgataggccctggcaaatatcggtaaccaagttaatcaggaatctgcttttatgaagcttaacttgtagtaatggaattcatattcctgtctttttactaacaaaaatttt

SEQ ID NO: 10600 - DNA, 201 bp, Bos taurus
tctatggcatctttttcttccttgtccacaaattcttgtactgcttcacccattcccctttctgttagaagtgagagctgtacgttctgtaagagacagaaaacagtattttctgatgcagaaaacagtattttccctacaaaacaattctatacaagtaaggaaaattacagaatcaaggaaaaagacaaaaaagttatc

SEQ ID NO: 10601 - DNA, 201 bp, Bos taurus
ccttagcaattaataaacagtagaatgcccactgcctctttcttttggaaatcctcttaggtatcttttcaagatacttcggccctttttccacagcatctcacacgcccacaggaactcagacatctttgtcacctacaaagttgaagcacagctggcccaatcactgattctttcctctttaccctgctactaggtcta

SEQ ID NO: 10602 - DNA, 201 bp, Bos taurus
gtccaggctgctctcaaattactgattttgccctgcattcttgtgtgtgaggttttgtgtgcacccttgaagagtgacttttctattagcttcagtcatgtggagctcctgcaattaatccttactggccttcagaatcaaatgctctgggggcttgtccagattcccaagctgcagagcctggtgtggggctcagaactc

SEQ ID NO: 10603 - DNA, 201 bp, Bos taurus
gcaaggctgggaaagtttccaggcccctgtcagggctctgatttgcggagcgagcactctcttccaggttgccctatatcctgtcaggtgcagccgtggcggtggccgagtctgcggcgcgccccctcctcctggatgacctcctgggaactcagccttcctggattctcccaaggggctgttccaaagggagaggatggg

SEQ ID NO: 10604 - DNA, 201 bp, Bos taurus
cagggcattaaaacccacagatcaaaggggaggccccatcaatagccaagggagacttttgtccccaaaataccagttgaactccttatctaagagacactggcatgggcctctggatcagcccacccaccaggaggaagacaccagaagcaaaaggaactgtggacctgcagtctgcagaaaggagaccacaaacacagt

SEQ ID NO: 10605 - DNA, 201 bp, Bos taurus
cagggaagccccagtcttgtcctagtcattgttaactctattccatacaggggacttccttgccagtgtgatacgcagtctcaggtctaccctattgtattgcattactactgttcattctgggcttccaaggtggctcagtggtaaagaacccacctgccattgcaaagtcacagaagacgtaagttagactccttggtc

SEQ ID NO: 10606 - DNA, 201 bp, Bos taurus
ttaaaggtctccctgcctctggttcccagatagattaaagtaagaattttcatttctcttttacagtctaagactcttgaagtaagtctgaaagtcacaataagtttagtacaattcgctcaccatgcactctctgcagttcttgcagctctttctcaaccacggttcacacttgtgacttccttgtcacaacatgtttag

SEQ ID NO: 10607 - DNA, 201 bp, Bos taurus
gcaagacttaaactatatgactgagatcactggggctgactgtgaccctgtgtacaaggtagccacatgggagaagcagatctacacatgttgttgagatggtcttgtgcgatgcagtcagctctcagacctctgaccccttgggaagaggaatcccagtcaatgaaaaatgattgactctgatcaacagtgagcaggaac

SEQ ID NO: 10608 - DNA, 201 bp, Bos taurus
acaataggtattcagcaaattcaaggaatctgaaatactgagtgttaatgtaaatattttctgattatctactacatgcagtaccttcattttagaacttcgagtatataatagaaaagaatatgaggacaacttcactaataaaaaaggtaaaagatgagggagaagaaaaaatgaagactgaatgttacctgaaaaagc

SEQ ID NO: 10609 - DNA, 201 bp, Bos taurus
gactggtaataagcccctgttcccctagatgatttgtcttagattcaggaaaagaggcttctcgggcctcctaaccataatatggccccagaggagcccataagatctctccagagcactcaattcatttcagttcagtccctcagtcatgtccgacattttgcaaccccatgaattgcagcatgccaggcctccctgtcc

SEQ ID NO: 10610 - DNA, 201 bp, Bos taurus
cttccactatcccacttgcctttacggttattggtttagtcattcagttctgtactttgccaccttattttttggactttctgcctttcagttggtatatgctgtttaactctgtttgaccctggactctactgtgtccatgtctgtatttatttgctgttgattcagggctggtctcttgggcccctgacttatgccttt

SEQ ID NO: 10611 - DNA, 201 bp, Bos taurus
acccaggcaatttgaaattccactcaactttcttcctgcggcctctctctaattctcatggggaggtgataatcagccttttactgtttgtgcctgtgatccaccatagacaggccttcatccatgagacatccctttaagcattgccttcaaataatatctgggcctatctattttctttttacttacccacttgcttgc

SEQ ID NO: 10612 - DNA, 201 bp, Bos taurus
aaagaagacatatggatggtcagcaaacacattaaaagatactcaacatcattaatcatcagaaaattcaaataaaaaatagaatgaagtattacctcacacttgtcaagatggccatcatcaacaagtctacaaagaataactactggagagcgtgtggcaaaaagggaacccttctacactattgattgggaatgtaaa

SEQ ID NO: 10613 - DNA, 201 bp, Bos taurus
tccagcatttctaaatataactaatttctccaaactaatttttccccttttgtgaaggagaagcaaataaaatataatgcaaatctatcaagttatgtacgttaaaaagggtcttatctaattggtgaattccttcattttctggtgcatttatttgttgcacatgatatataagcatcacatgcagcaaaaaatcacatg

SEQ ID NO: 10614 - DNA, 201 bp, Bos taurus
ttagacaaaaagtctatgttgcttgaaacgtcacattttcttacatataaaggagtgttccagctgcatacctaggtataattttacaaaatccattaaacaaatttggagtcaaaatattcccaaatccagggacaattaaatcttttttttaagatagcaattgcttgaaattaacatactatcataattttataaatc

SEQ ID NO: 10615 - DNA, 201 bp, Bos taurus
tgttacctgtgtccttcagggaataattaaagattctgtgactatataagactgacttgctatttaaattgttatctgttctcctggcccaactgctattgttttcttattgcatgttcacattatttcaatacttagctctttaggaggcttttgtgactcagaggaggcctggcagaccaagcatttcttcaaataaga

SEQ ID NO: 10616 - DNA, 201 bp, Bos taurus
accacagtttaacctcttctttaatttcctatttaatgtttaaatctccatacctcactttgtcatttgtaacagatttaaagcttttgtctcaaggacagattgcattaaatataaaaggcaaaaaataaaggattgagaaaaaaatcataggagaaaattttaatgatcttgggatagcaaaagcttccttaaataata

SEQ ID NO: 10617 - DNA, 201 bp, Bos taurus
ttgcttactgaaaagaatcccacttacgggccagaggaggaggaggtggggaaggcgcaggaaatggaggaggcgccgacttcccctcccatgagccctcgcagttgtctgcgctctgctctgtaccagtttggggaagttgcccgagccctgtgtctcccagatgtgcgacctcattgagccacagccagacgagaagac

SEQ ID NO: 10618 - DNA, 201 bp, Bos taurus
ttttgatttgaagagagagacactcatataggaagctagtccagcaaggaatatgcaggacaacttcctatctgaaagaaagagaaaacacagaaggctgagcaggaggaagcccttgtgattacagataagcagagggacagagcgtgtgaagtccacagatatgatttgtgatggttgtgagcagcgggaatcctcgta

SEQ ID NO: 10619 - DNA, 201 bp, Bos taurus
ggtttttaccagtggttttacctatgggctgttggttgaagttgtccctcagtttctctccacctgggtcactttatagggcagctgtctttcatcagagggagcaaaagcaagaataagagatgatcaagacataatctagggtaagtttattcctgaagttacatttcatcacttttgtcacagaaaattagttaaagc

SEQ ID NO: 10620 - DNA, 201 bp, Bos taurus
tcctactgaaatgaaaaagatggtggatgtgtcccttgatacttatgaaagaactttttattatgtgttaaatttgtctcgggctcagttttgtctttgatgatagtgtaatgtatatttacttgcctcttccccacacaagatgggggctttctgtgaacaagagtgtacatgtatttttttttttttgtattgtgtgac

SEQ ID NO: 10621 - DNA, 201 bp, Bos taurus
aaccatcaatgatgttaagatttttctcaaatgacatatctaatcaatttaataactatacctacttaaaaaaaatacaaaacctgaccttttcttatcttctctatttctacatatctgatgcaaaatggaaccatttttcttcaggatttttgtaatttgtttcaatccattttcttattcatcctctattgtgttctg

SEQ ID NO: 10622 - DNA, 201 bp, Bos taurus
gagtgattgaagatctagcaacttcaccttaatatgtttactgagggcctttaagtttgagaacatctcacctcaacacttacaatttgctttttgctaccgcctctaaccttttatcagagaaggtgatggcaccccattccagtactcttgcctggaaaatcccatggacagaggagctgcagtccagggggtcgtgaa

SEQ ID NO: 10623 - DNA, 201 bp, Bos taurus
atagcttagatgtagcattttaaattcaatacccttgagtacttcaagaagaaaaaaatgaaatagaaaagaaaaatatttcttaatgccagatttgctagtattccaaaaagttatcatttctctttacttgtgttttgtcaaagccacattgtcaagtctggattaaatgctcatgtattattttccttttctctagga

SEQ ID NO: 10624 - DNA, 201 bp, Bos taurus
gaaggaccctgaaacactcctaagagggaaggagatcaaaataacaatgtagactctagtgagcttaagacaaaacagactgtgcttataatcataggccggtagtacctgactccaggtcctcctgtagaaaaattgatcaggaaatgcatggttctcagctaaagctccaatactttggccacctgatgtgaacagtgg

SEQ ID NO: 10625 - DNA, 201 bp, Bos taurus
aaactgagcacccaccatcacaagtgtttgcacgagctgcaaatagcacagaagcaaactagacacaggctctgccagaaaggaacccagtgtactcactccttcatttgaatatagccaagaggctgttgttagcacaatgtgagggaagcacagaagaaaagaaaaaactgactaattctgtggaggaaagagatgtct

SEQ ID NO: 10626 - DNA, 201 bp, Bos taurus
cttccagcttcctcctcacgcttcgcctacccagggttcagtgaacagtgtgaagagtgagacaaaatgaaacccctcctttgtagacagtgtttggcctacttcttttatgtactgtgctgaccttgtaggcatcttaagtgactctgtgtctaagggtattatgaatatgtctagtggccttgaagaaaggatagttat

SEQ ID NO: 10627 - DNA, 201 bp, Bos taurus
taacactgtctctgtcagccgccttcagcccagggagtgtgttgtgtgcatgtgagccagtcatggtaactccactgcgaatggagtaggcctgagaatgtgcccagtaagacggagggaaggaggaaatgccagcttgggggtgggcatcggggttccagaaaggcttctggtttcttaaaaagaggtgcccatggagag

SEQ ID NO: 10628 - DNA, 201 bp, Bos taurus
gctgccctattatggctagcttaagtcaacatgttcggactagttatggctgttgagagccaaaaataatagagaactcacccttgaaggctgcggtcataatttcttgacaatccctgaaacaagagatgatcatgttgattagtcttgacttggagccattagggagaaagtctaaaacaggtttatttgctttggtgt

SEQ ID NO: 10629 - DNA, 201 bp, Bos taurus
catccgtcttgcctctgctgcactgatctactctgagcctttgattcctagtttcatgtgtgtcccctcagcgtactttcacgtgtgtcgcctccgtgtcgaatgtcagctccaggagagctgaagccatgtctgtctctccttatcttcagggccggtaagcacttgttagtacagccaaatgagtctctgaaccactct

SEQ ID NO: 10630 - DNA, 201 bp, Bos taurus
tagggagagcaatctactttgcattctatcaagctaaatgataaactcaaccaaaaacattctcacagaaacacccagaattgaagaaatatctgggcaatttgcagcctagttaagttgacacaaaattaatcatcaaaatagtcaaaattagcttcaagttcgttaaagattgaaggggaaaagaagacacaaaagaac

SEQ ID NO: 10631 - DNA, 201 bp, Bos taurus
acagagacattgtttttacctctcactatcttattaggtcttaaatctctcaaaagcacggacagtgtatccatctttgtattcctgggatctggccagtatctggatcatgttatcttattgctcaaagtgttataattcacaagcacaaggtttggaatgagaagatcaattaaaggccttatgcttctttaatatttt

SEQ ID NO: 10632 - DNA, 201 bp, Bos taurus
caacaatggccaccacagacccccccagagtccagctcaggaccgagtcccctctgcctcctaaggcatagtcttttcctaggtcctggtcacctcagatccagggccacactgtggcacggagcgtgtggggccagagatttgattggctcgggccggggtgtacaatgaagcagtcatgggaagcccagcagctgctcg

SEQ ID NO: 10633 - DNA, 201 bp, Bos taurus
ttgagaggtgaggtctgtgtcctcttgcccttgacaccctaaccaatacaatgagggggagtggcactgtgtaagttgtcagatctaggccttaacaacttcacatctttcatgtcctctttcctggggtatacactgctagaaccaatatatcatgttgtgaggtagccaagcagtacatacagagaggcccaagtggag

SEQ ID NO: 10634 - DNA, 201 bp, Bos taurus
tcatgaagagttggatacaattgaagccacgcagcagcagcagctccataacttggttacaggaatgattctgctgttctgtcaaactactaagaaaagaagtaatttagtagcataaattcttcctggtttgggaagatcccctggaggagggcatggcaacccactccagtattctttcctgaagaacccccatggact

SEQ ID NO: 10635 - DNA, 201 bp, Bos taurus
atgtttttcttctgagttaggtgggaagggatcataggaaaataaccattgccatcaccattcataaaataggaaaatgtccttccttttgttagaagaccttattttccagctagagttggactggcctaaaataaggaagtctttttccagaagccaacccttatttgaccatatctaaaatccccatcctggaggaga

SEQ ID NO: 10636 - DNA, 201 bp, Bos taurus
tcactctttctcattcatctcattctccctaaaagacaaaaaaattactcttcctttaatagagagaaaagacaactaaaaaatgtaacataaatatcaataaaaagaaggaaaatcatcaaccactatctagcctaatacacatcaaccaattaaataggaagacaatctttagaaatggaataatactcaagccaggaa

SEQ ID NO: 10637 - DNA, 201 bp, Bos taurus
ctaaatggaaacagtgaccaccaggaggaaaaccaccatgagccagattctaaccatgaaaaggctttcagccacttaacatgtgaatttagaaaatcactcaacctctgaaaaatagaaatggtcaagaaaaatcccaataatatctaaaagtaaatgagagatcagtggaaatcaatattccattcagtcactacttta

SEQ ID NO: 10638 - DNA, 201 bp, Bos taurus
agaagtgtagaatgaagtttcttctgttgatactagctctgcaggtcgctgcttctggagctgccccactgactgactatccaagccctgaagaaaatgatgtggcattcgctcaagtaagaactggcactatagaatttatctagcctgatttttgtctttaagatttatttcactgacctgttttatcctgaaagtact

SEQ ID NO: 10639 - DNA, 201 bp, Bos taurus
ctgcagaccggtgagctcccaagacctggggaaattgggctaagggtgcaggggggggacggagatgaagttagggaagcggcagggacgacaggtggtggacggtcttgtgggcctttgtacaggctttagagtccagaggtttaagaggagaaacatcacttgacttgcgtttaaaagaatcacaggctactctgagga

SEQ ID NO: 10640 - DNA, 201 bp, Bos taurus
cccaacttctgaaatttgacacatagctgtgaaagttgaattgaactgggttgaagtttaactgaatctttgaatcagtcagtcaacacattcttcttgaatgtttagcacagagctggacactgttgagaaatgcaaaggcaacttcagatatggtctctgccctcatggaatggttactctctttgggaaatgcccctc

SEQ ID NO: 10641 - DNA, 201 bp, Bos taurus
gagttgttagtataatatatgttatcagttaatctgtagtaaaaccatcttttcaagtgagctttatcaacaagtcttcaacaacaaaccatgtcattctgtagagctgatggtttttagaggtatcatctcccaatttttgttactacaacaaagtccttttggtttttcttttgagtcttatatgtacaagagtgaatt

SEQ ID NO: 10642 - DNA, 201 bp, Bos taurus
agcatggtatatcccttcagctagccttctttaatatttttgtttgttttcagtatgaagatatttctcatcttttgttgtttattcttaagtatttcatatgttgatgttattttaaatactatttaagtttagattttaattgttaatagtatttttaaattccttgtttagttatttcttgtcagtatgtagaaataa

SEQ ID NO: 10643 - DNA, 201 bp, Bos taurus
ggcaggcagaatgagcgatttcccctctctgaccatagcttcctgacacagttcccacttcccagttcttagtgcttcaagtacccaacccttcataattcactcaggggctaagttttagggcccatggttaatttttcctaatgagcactctattgtcatgtactttatgatacccagaaaggtctctattgtttttaa

SEQ ID NO: 10644 - DNA, 201 bp, Bos taurus
aaactctgcttagttcttctcattcttctaaaattcaatctaatcttctcattgatcatttatcctttgtcactgtttaaggttgccaaactgccagcttctacctgataatttacaatacacatctatttgacctaaaataagtctgacttaaaaacattcaataaattgaggcgagagctaattctaatattggcttat

SEQ ID NO: 10645 - DNA, 201 bp, Bos taurus
ttcagttggcaagcttttattgaacttctcttacatgtactatacatgacacaggtaccataaagatttaaacatctctgcttttgaggggtctatactttagagcagtgacctctaaagtgttgtggcagaacaccaggaggatatgcaaaacaaatcactgttgcacaagaagaacatgttaaaatttcattttctatt

SEQ ID NO: 10646 - DNA, 201 bp, Bos taurus
agattccatatatatgcaataatataaatttttttttccctctaacttcactctgtataacaggctctagattcacccacctcatgaactgactcaattttcccccccaaactccttaaatgctggccagaaactgaaactatcaatatattttagccaaatacactggaaaagtaatgttggactgacaaccatctggag

SEQ ID NO: 10647 - DNA, 201 bp, Bos taurus
gctttttgggtcctgggcatttcttgccagcacaggacctctcttggggcactctgtgcccagctctcaatcttcctacctctccctctttcacaagtgagccaagcctcatggtctggaagctttttctgccgtctgctcacccttcccattatctttcagaggcatgattctgaacacatttcatatttctgacactgt

SEQ ID NO: 10648 - DNA, 201 bp, Bos taurus
ctacacacatgtgaaataagctctgttaatctgaactccctccttatgaaaaacaaaacaaaacaaaacacattaaacccttggcactgggcctggttcagaatgttattttttaaatctgtggtgaatgctgaaaatgagagttctctagtaaacattgggtaacatggaggccccctttccaggggcagcaggccctat

SEQ ID NO: 10649 - DNA, 201 bp, Bos taurus
aaagaaatttggctttcttttaacctctgttgacaaatctattaattattgacttagttaaattttcttccctgttttaccttgttaaaagcatcaaggaacagccaacacaggaaatttttactctttccaaatacttcccttgaagctttaggcctagtaagctctcatcctgccttccaatttatcacaggcaactga

SEQ ID NO: 10650 - DNA, 201 bp, Bos taurus
gacctttgggacaacatcaagtgtaataacttttgcattatagggatcccagatggagaatagagaaagaatgggataaaggtcatattggaaaacatacgagctgacaatttcctgaaatttagaaaattaaaatacatccaggtacaaaaatcatacaaaatcccaagtaggaccaacccaacgaggaatacacccaga

SEQ ID NO: 10651 - DNA, 201 bp, Bos taurus
aatcttatttccgaatcaaaatgaactggccagcaatacagtaaaaactgcaaactctaatctaagttggagtctctcctctgcgcttgctcagcactgcctggggcctgaagcctgtagggaagaaagaacaaggtcacctccttctcaccctgctcactctcgggagaaccattagagctacttttgaccttttcaggg

SEQ ID NO: 10652 - DNA, 201 bp, Bos taurus
attcccctagtgacctctcaccttccaaaatgaatccacttggttctcttcacatctctgctctgcttaggttgtaagcttttcaggaacagaaatcactacttcttaatgcttataaagcccctaacaactggtatagttgtagtttccctggtaaatagcgggtgaatcctcttgacatttagctttccttgtgttgat

SEQ ID NO: 10653 - DNA, 201 bp, Bos taurus
ttctgcccctcctgaattctcttggttggtcttggccgcagcagcatgctctttatcaggaacatctgttgtaagacagctcatgcaggtggttatcatcatgcctggccagcatgggtggttttggttaatagttccctaataactagatactctattctttgattctttatggaataaaaatccaatagaactcaacat

SEQ ID NO: 10654 - DNA, 201 bp, Bos taurus
aataaagcaagggttatggagatccttcttcctttcactgttaactgaagaaagtgtttaggactttgtggcagcttaggtatatgatggccaccaaaaaactttctttcctcttgcacatgcaggtcatgaagcctgttctttaaacctccttgaatctgggttggcctgtgattgattacaggcatactctggagatac

SEQ ID NO: 10655 - DNA, 201 bp, Bos taurus
aaggcacttataaccaatcccgcctcaccacttatccttcttacacactagaactgtctcggcatatagtaggtactcactaaacaataaataaaatcaggatctaaaacataaccccacataccaagaacttgcttcaacaagtttactaagtgagaagtaatagtaaatgtcatttttataataggatggatgcataaa

SEQ ID NO: 10656 - DNA, 201 bp, Bos taurus
acttctaataaaaatcagcttccttaactttcaaatgtacataatgtatggctttaaactcattttcactgacagttaaagatagaagctgtctttcttggtttccccaacaactcccctcaatctgaaaacaaagcatgacaaggtttctcaattaacttcctttgactactcttacaaacacaacacagtgagcaatgg

SEQ ID NO: 10657 - DNA, 201 bp, Bos taurus
attggtatgaggattactcatctgtgggctgagtgaggcatcaagatcctgggaagagtttggctgactgagttaagggttaaattttgctccaggccaccgagaagggtttgaacaaatgagctgagccctccagttttctgagctgggagggcatatgatttttaagtagaaaatcagcagccctcacaatctccatta

SEQ ID NO: 10658 - DNA, 201 bp, Bos taurus
tcagatttttccatatgacatgggcaaatgagcattttggccaacccaaagatcatcaacatttatctgtcatgatctgagtgagaagtctttgacatgtaacatactaatcaccaggcccatgtaaccttaaaaaaaatttgttttcaattgttttcttcaaataataatcaagacagtgaaatatttagaggggaactt

SEQ ID NO: 10659 - DNA, 201 bp, Bos taurus
atgtgttgggggaggtggtggtaaaggccctaaatctaatttaaagaaaatatgtccctattagaatcatatggaacatgacatatgcatctgggatgacggggagaatgaaaaattaaaggcctatattatgggtcacagtctaaagagtacctgggtcagtcataacagtaagagacttaggcacctgggaactaaagc

SEQ ID NO: 10660 - DNA, 201 bp, Bos taurus
tatgtgtcctgtttgattttaacctgggctatcatttcatatcatagaaaaataaaacaagatccactgtaacattcagaaaataaaaaatcaaacattattagagggtaatatattgaaaacaaaatgagttccaagttctgacagctcaagtaaaacccaggatccataaatgaaactaaggcaataaaaggatcttta

SEQ ID NO: 10661 - DNA, 201 bp, Bos taurus
catttccttttccagggtatcttcctgacccagggatcgaacctgtgtctcttatgtcttttgcaatggcaggcaggttctttaccagctgagtcagcagcgaagccgaaatatagacagatgctagactataatgaaggacaaattactcttcaggcaagtagaagttttccctattgggaaaataactctacatagcaa

SEQ ID NO: 10662 - DNA, 201 bp, Bos taurus
catacacacaatatgtaatattaactatggaatttattcttctgagaagttagtacccaaaagtcttgtggagagaaaagtggttacagtatggtgaacaataacaagtttttagtcaggcatgctaaactgaaataaaatctaatatcaaaatttcaggatgtactgatagtaaatgttattttagggcgtagtatacaa

SEQ ID NO: 10663 - DNA, 201 bp, Bos taurus
ccataaaattgtgaagtatactgtgtttacacaaaagcactggaataaattaatcattgtttataactaacaatttcctagaaagtgaatacattttctatgagactgagtgatgatttttcctaattcttttttacatcttccactaaataccctacattagaggaaatttactgcaaactcttacaaccagaactcaat

SEQ ID NO: 10664 - DNA, 201 bp, Bos taurus
tcacaatcatccacccctcactttgcaagtctctaagacataaggttaatccctttggagttagaccaaatgtcagttcaaagggttaatggccaaggttcattgtaatcaccagccaaactgctctgaattctgtccactgagggatacaaaggtgctacaacaggaagagggtctgggtcatttggagaatctacatac

SEQ ID NO: 10665 - DNA, 201 bp, Bos taurus
tcctgttgagctatttcaaaacctaaaagatgatgccatgaaagtgttgcactgaatataccaacacatttggaaaactcagcagtggccacaggactggaaagcgtcagttcattccaatcccaatgaaaggcaatgcaaaagaatgctcaagctactgctcaattgcacttatctcacatgctagtaaagtaatcctca

SEQ ID NO: 10666 - DNA, 201 bp, Bos taurus
ccccatggactgcagcatgccaggcctccctgtccctcaccatctcctagagtttgcccaagttcatgtcctttgcatcagtgatgccatctagccatctcatattctgtggcctcttctccttctgcctattatatttctatatgtaatagtattgaaagtaacaccatgcttagaaatcgtctttaaaaaagaattgca

SEQ ID NO: 10667 - DNA, 201 bp, Bos taurus
gagatgtttagatagcatcaccaactcagtggatatgaatttgtgcaaactctgggaaataatggaagacagagaagtgtggcatgctacaatccatgggttctcaaacagtataatatgattcttgacagaacaacaacaattattcagccataaaaaaaaaaaaattgccacttgtaacaatatgaatagatctggagg

SEQ ID NO: 10668 - DNA, 201 bp, Bos taurus
aagaatgtaggaagtacttaggaaagatgataattcttataaaattcaagtaatctaaaaaggaagtattcacacacttccttcacaggcctactttttggaagtgtttaagtcttcactatggcagtgtgaactctttatggagagctggggcattcatttcaatagaaatatggatttctccatgtattttcagtgaaa

SEQ ID NO: 10669 - DNA, 201 bp, Bos taurus
ataaatattttattttaagcagtgtctttgtgaatatgattaaataaagaattgctcaatcaagagattaccttgaattattcaagtaggccctaatgtgtccttataagagggatgttgaagaagattagatacacatccaaagagcagaaagagatttgaagatgctggccttggagattagaatgatgcagccacaag

SEQ ID NO: 10670 - DNA, 201 bp, Bos taurus
acacagagaccttaataacctacttgtcatttgtcttgaagagtctttacttcactttttgtcattgcttttcagtatcaatataatttacatattcaagtgaaatattgatgctcaatgggaatatgagtgacaaattatgcaagtaccaagattttgagctgaatgtcacaaggagatgaatgttcaaaacaagggagt

SEQ ID NO: 10671 - DNA, 201 bp, Bos taurus
gtggtggcctctaccccaatgtgactcctaccaaggttttctgatcagaataaccccttggagggcactcccttccgcatgttctctccttctgtctcaacagtctcacccttctcaccctcagcagatactgatcaagcacaatctttttaaaaaaataatggttcaattgatctcaaatagttgataggatgtcttctg

SEQ ID NO: 10672 - DNA, 201 bp, Bos taurus
attttttaatataaatttatttattttaattggaggctaattactttacaatattgtattggttttgtcatacatcgacatgaatttttgtgtatttagtacatatttttgttttctggttactgtaatagtcacatatatcattcaatgtatgtaatagtatatcttatgctgatagcaacttaaaattgaacatattta

SEQ ID NO: 10673 - DNA, 201 bp, Bos taurus
tgggaattaagtatcacagcagttttcactcaaagtccatttctagacagcaacaagaatgcctacattttggctaagcagcttgtgtggccaacttatacagaagtagcaaaatcatttttagtaaaaaaaaaaaagaatcagttcttggcagttgacatattggaagatataaattcaggcactggattcttgaatcta

SEQ ID NO: 10674 - DNA, 201 bp, Bos taurus
caaaactacatctacacatagaacaattctcattgaaaactaactggaacctggcagaaggactccagtacaatcaacacgtgtaagaaagatacacatataacccagtgggaagggaagaaaaaggattgagaaaaaaaagtaaaagtaaagttcaggaatggacacctatcttgtggactgagcaggctgagcacagat

SEQ ID NO: 10675 - DNA, 201 bp, Bos taurus
gagcctggtgagctggcaggccacctctgggtcccgcaagcctctggcgcaggtgaatgaactgagtggacacacccacgggcaaaacattatccttctcgcatcaagtccttgctgtctggcctgtgtccttgccatcttcccaacctgccagtggagtcagcattctaaaataggatgtctgtcacctgcctcagcccc

SEQ ID NO: 10676 - DNA, 201 bp, Bos taurus
ttaagttgaatttttgaaaacttgattctatgctaatgtcaccgcagatgtttgctacttaagtgaccctaacaataaatgttttgggggaaaaaaaaaaccacagctctactcacaaaccttttcagagcatattgttaaaatcgggggcatctacagggagtgatttttaaagagtctgaagtgtttccatagcatttc

SEQ ID NO: 10677 - DNA, 201 bp, Bos taurus
actatttttagaacatgtgtaacatgtcaggcaccataccagatgcttttacatgtatcatctcatttaattctcacattccgatgtgtatgtgtgtggtcatgtaggaagcagagggttatgtaggaagcagagggaagagtggctacattttataggagttcaaagctgttagatgactgctctaaattcactaagaaa

SEQ ID NO: 10678 - DNA, 201 bp, Bos taurus
ctacctttaaaaattgtgaatcaccatgttgtatacctgtaacttaactgtacagtacagcaagtacatgtcacttaaaaaatgaaaaggttgtatgcttatattcacaaaagaactctaaagaaatactgtaagatgattgagaaaaagatgtggtatacacacatacatacgtacacaatggaatattatacacctgct

SEQ ID NO: 10679 - DNA, 201 bp, Bos taurus
gcaaatttgaaaacactgcacactgtaggattccaaacagatgacattcaggaaaggagacaataaaaagatctgggttgaggagggaaggttgaatggacggagcacagaaaatttttaaggcaatgaaaatactttgtatgatattataatactgggtacatgttattatacatttttccaaactcacaggatatgcaa

SEQ ID NO: 10680 - DNA, 201 bp, Bos taurus
tgatccctttgcagcataacagattggtctcacgtgggagatggccaccaggtaatggagtccttgcttcatgggagagactagaaaaaggcaggtctgttgaatctaaaacatttggcaaactgaagtctagagataatgtgaaaagaagagagaattcaagtgaatgtacaagagaggacagaaaagcaggagtaagaa

SEQ ID NO: 10681 - DNA, 201 bp, Bos taurus
ttggtatataaggtagacagtatcacaaacagatggatagtatcaaccaagaagtggaaatcataggaaagactcaaatggaaatgctaacaatgataaagatggtaacagacgtgaagactgcctttgatgggctcatcagtctaatgaccttgaagacaggtctttagaaattaccaaactgaagcacaaagggaaaag

SEQ ID NO: 10682 - DNA, 201 bp, Bos taurus
gttacaacactgggcccagatcctccatgccttcccatttcacttaaagtgcgagttaatgtccttacaacacccttcagggcctgttaagccctgggccctggagccctctgatttcacttcctaccaccagaacctggcaccccagctttgaccataggactccagtcactctagtctcctggctgtttctcaagtgct

SEQ ID NO: 10683 - DNA, 201 bp, Bos taurus
ttgatctcaagatgactgtggttctaatgtcatttgttcaagaatcatctgaaaatctaaataaaatcagttataacagcttcccccatcatcatgcttacgaaactccatgaaacaaccactatgtcttagtaggttctcactttctgaaggaacagccaagtgtgagtgtaactaaaatctctgactcgtgtatggaaa

SEQ ID NO: 10684 - DNA, 201 bp, Bos taurus
gggtgctggagactctggtctctgcagctggtgccagactcctagaggcataagagtggtccaaccttaccacctcacccaggtttatgggggccctgcaggtcctagcagcgtctctggggaacgcggtcagagtctcactgacgttgggaggaatcaagggggcgccataaaggtcaccggccgcaataccctccagcg

SEQ ID NO: 10685 - DNA, 201 bp, Bos taurus
ggactaagtgtttctatttgagaaaagcaattgggccgcagtctatgaggcaaagagaaagaaccagagcaggatgaactgccgcagctctaattacaaaccaagaataagatacagacgtgggccccgcagcaaagagctgtcatttatacacagatctttacagccaaatccgtgcaggggaaaacagcagagttactg

SEQ ID NO: 10686 - DNA, 201 bp, Bos taurus
ccctgcagaacactctaggtggaaggaagatcctgtgcaaaaccccccaaatagcagagagcttgacagcctgcaaagcagcaaggaggcctgtgtggatcggggacagtgagccaagaagagtcagactgaggtcagatgagagagagaaggaggacacagggcctcgagaaggagtctgaactttataagaggagaact

SEQ ID NO: 10687 - DNA, 201 bp, Bos taurus
acagtgaggcagcgcaccagccccctgggccaggagcatggctcgacttcattattggatcacacaaccaactttggggcccttttctcatcacaggtcccgtgggcagcagagcccaccagccacccagcattcctgggctgggttcccacccaaaccctgaagtcagccagggccaatatttggacccaattatgtatt

SEQ ID NO: 10688 - DNA, 201 bp, Bos taurus
acactacaaagatttcgacttttctctgagtaagacatgaagttaccagatagttttgaacagaagacagatctggtgcgacttctttttagaagcagtggtcagtagtctggccactgcacagaatggacaggtaaaggttgagtgacctgcagaggaaactgtaagatgcagtgtccaggctggagatattggttgcct

SEQ ID NO: 10689 - DNA, 201 bp, Bos taurus
gactgcagcccaccaggcccctctctccatgggattttccaggcaagagtaccagagtgggttgccagtgccttctccatattttcctcctactgaatccatattccagaggccgcctccctgggagccccttcttttgtggcacttgggctgagccctcacctgcctccaggcccagcggacagcccagctcctatgcac

SEQ ID NO: 10690 - DNA, 201 bp, Bos taurus
ctggattgttttcatattttggctattattaataatgttacaatgaacatttgaatacaagagtttgttgcatatatttctattctcttaggccaattcctaggagaggaattgctatgtggtaagttaagtatatggcttagtttttaaagaaattgccacactgtttacccaagaggccatgccatttcacatttcacg

SEQ ID NO: 10691 - DNA, 201 bp, Bos taurus
agggaagcacacagcagccaagagctgaattttggggaaagaggccctgggagaggactcatctaactatgcagaaacagcccagatatcctgggttttggtaaggtggggcagtgatggccatggtcaacatgctcaggagacacccactgagagaccttgctccacatcacagcatagtgctagatctggggcagaaag

SEQ ID NO: 10692 - DNA, 201 bp, Bos taurus
gggggttagcaaaagacattgagtttttaagggaaaatggtaaatggccactcttccgcagtgagagttctttggtggaaatgtattttagtgtttagtataaaacttttgctgactcacactgcatcatctctctgttcttatcatataatcttaatttccattttctagcatcagacaatggatcttgaagtgaagatt

SEQ ID NO: 10693 - DNA, 201 bp, Bos taurus
ctcctaaaaagctttgccttccaaagaggactcatatatggctgcccaagaggttttattttagaagtatgaagaagctgaagagtataaagggaaggtaatagtggataatgcttctaacaacaataaaaaaaaattggaaggataaagggtaatgcttatatgatgtgaggaaggaacacaatttgttcaccatttaag

SEQ ID NO: 10694 - DNA, 201 bp, Bos taurus
tgttaaccccatgggtacttctatttcaacaagggcttgtgccagctatttttagtcaagtccaggatgtgcttatattgtaaacacttcaaaaagtgagggtggtatctttatagtctgtatagataatacttacggaaaatcatgctttgagaaacataaaattattacttccagtgatgtggcataattgacactgtg

SEQ ID NO: 10695 - DNA, 201 bp, Bos taurus
gctgcagtatccagcatgttgaactagcaaaattagtaacaagggaagaaaattttaaagataagcaaactaaaaggtattgcttttaactgttagaactcggtccccaaataggccttagaatgttctttaaccttccaaaagtttttctaaaaggttttctccacctgctacattaaaatttaatacagatgataaagt

SEQ ID NO: 10696 - DNA, 201 bp, Bos taurus
tgatgggcagggctatgctcagtaaatctgtaatccaattttctgttaatgggtaactccttgtagttccctccctgaggccaaactgtggtaggtgtaatggcagtgatggctacctccttcaaggacttaagccaacacaccacccacgctcccaggactgttgtattcagtgccccagacccacagcaggccactgtc

SEQ ID NO: 10697 - DNA, 201 bp, Bos taurus
gcggacgcagggccgcacgccattggctgacagggcgcacgcgcgtttccctcagatgagcgctgtgtttggggaagcgagtcttgggagcggagagcgtgcgtgtttggccagcgtgggcagacggtgccccggcgccagtccgccttagtgcttcctttggaaacgtacgctgtgcgatcattccaggtttgatccgga

SEQ ID NO: 10698 - DNA, 201 bp, Bos taurus
aatcagagttggccagtttgtcttactaattccagatatactggaaataggattggatttgtaaaggggctgaaaccttggaattgatgatatgatgtaactaatgttacattacagggaaaggctaagatctttacattagatttctgttgtgccacattccagaatatttttgctattaggaagggtttccaaatctct

SEQ ID NO: 10699 - DNA, 201 bp, Bos taurus
tgtatttgggcctagtcatttgctagatcagattggagttaggtgatttaatatggtctcacacactatctgggtcttcagcttggattgttggaacatctgtggtggcctggcttctctctccacatacactttcagttagagtttctctgcagtgtgtgggtttcaaagtatgagagatatagacagagagagagaaat

SEQ ID NO: 10700 - DNA, 201 bp, Bos taurus
attcattgataaatttatttccaatgagctataaatggctgatgagcataaaactcacctttcaacaaggaaaaagagaatgtattcctttttaggcatggttatgtagtaaggctggtgatttttaaagacaagataaggtctcttcctctgaattcctaaaattacctccatcagcacatctcaaaaaggaaatatgaa

SEQ ID NO: 10701 - DNA, 201 bp, Bos taurus
ttccccttggaaagtaaacccaggtctcttcggataagatccctgcagttttgctgagcactgtggcagggattctcctccgggaggagggcccacaggagcctgaacccttctactaccctcccctttctcctctcttggggcagctaattattctagggagctgagagaagtgaccctgactctctgtgacctctcgga

SEQ ID NO: 10702 - DNA, 201 bp, Bos taurus
ctctcttgaaattactttagtggcaatgaatacagatacatgtaaactaaaaccacattgttttaaataagagaaggtattcacaagtaaattcacactgcactagaattttgacagtagtaattgcttctgctgtgcgtaatgatagcaccaatacaatctccctgtattgttcagttttgctatatcttggtttctttg

SEQ ID NO: 10703 - DNA, 201 bp, Bos taurus
attatgttgtggggggaaaatgagaaaataaagaagaaaatacatatgaacagatagaattctgtgttacctagtaagtgttcagtaaatgttacttattattaattttcctaagcttctgtagatgctgaccctgggcaaaccagatgcaaataagtcaggatccatacgtctgcacctctggggtctcttgtgccaccg

SEQ ID NO: 10704 - DNA, 201 bp, Bos taurus
aacatcttggatctacagaaagttcatcacccaaccctctaaacctgctgggcttcatcatcaaggaaggggcaccttagacctcacagacatataaggagggggtacactggggccatgggtattgtcaggcctggctaatactgatttctatactcaccttacagtttgaggaggtcagttggtgaagtggaatatgag

SEQ ID NO: 10705 - DNA, 201 bp, Bos taurus
tgggtaatattccattgtatatatgtaccacaacttttttacccattcaactattcagagacatctatgttgtttctgtggcctagcttttgtaaataggtctgtgatgaacattggggtacatgtatcttttttgattatagtttcctcagggtatatgcccaatagtagattgctgggccatatggtacttttattctt

SEQ ID NO: 10706 - DNA, 201 bp, Bos taurus
ggaaatgaaccttccacacaaatggaacagcaagttcaaaggcctgaggtggtaatatatttggtgagttcaaagagttcaaggaaatatatttggctgatgtgttggagggggcaggcctgtaggcgacaaagttggggtggcaggaaggagccccattactgtgaaagacttgatgagaactttggatttcattctgat

SEQ ID NO: 10707 - DNA, 201 bp, Bos taurus
tgacagctgcgtaactcctgtgaataatactaaaagctatcacatcgtacacttcaaatggctgtgtggtatgcaaattgtatctcaacaaagctactagaaaaaaaaagactaaactttatgatgatacaaatcagaaagatatctcacatttggaatgaaaaactgggaagagacacacgagggggttccctgagggca

SEQ ID NO: 10708 - DNA, 201 bp, Bos taurus
acggaaatggcacaaatataaagtgaaaatgtatcaatatctagcaaaattatatacagccatcccatttctgaaaagtacaagtttatcactggagtatcatttatagcaaaagactgagaacaaagtaatcatacatttgtcagtaagggactgtctgaataaactatggaacatgtaagcaatggattaccaggaaga

SEQ ID NO: 10709 - DNA, 201 bp, Bos taurus
gttcagtcataaactgacaacattggtgtgaggagttctttttaaaataaagaaagattggttcatgcataacttatatgttctttttccttagaacaattactgtattagaaggggagttctctacctctcccatatttgctatgtaggctttatctactgaggatcatcagggaggaattaatgattctgaatgctgtc

SEQ ID NO: 10710 - DNA, 201 bp, Bos taurus
gcaaaggtagatcctatcctagaactggccaggactgagtgacagtgtgactatggaacctaagggagggaggagtcagaggtgatgcctagacttggattccagatggcctggggaatggtctttccatcagtgaacacaaaggacagacacagaagacacttgtaagaggaaggagagttggtttatgaaacagaaacc

SEQ ID NO: 10711 - DNA, 201 bp, Bos taurus
gtatgtgaaatctaacataggagagagctaggtgtattcaagggactgggagaagaggcaagagtttcgagcctggtatggaatgaggctggagaaatggaaggagttgcaattgtagtgtgcaaagtaaaagcatgtcaggacctgaatctgttctttagtcttgtttagactgtcaagatgagtatgaagattaagaag

SEQ ID NO: 10712 - DNA, 201 bp, Bos taurus
atatagattgtgctacttattaatacagaatgttatgtaaagattaatgattatctgttttcaataaatgaagtacttgaccaacccatttagtgaacctgtttgaagcagcaccctctggtgggatttggggtcagaagaatcagggctccaagcctgttttcatgaagaagtgtggacttacactcggagatgcctggc

SEQ ID NO: 10713 - DNA, 201 bp, Bos taurus
cggccaccgcccctggtaggcctgacctaatcaggaagtggattctgctctacccagttagctcagaagataagatggcagcctcagctgacaccttgtgagaccctgagtagaaggcccagttaaattgtgtccagattcctaagccacagaaactgtaaaatgataagatgttgagctgttaaactagtggtgattttt

SEQ ID NO: 10714 - DNA, 201 bp, Bos taurus
gaagctaagacctgaggcttagtaaacttggccacacatagaggagggaagagaattcagtgcagagggagggaagaaagttctcagcagataaatgagcatgtgcaaaaggcccctgagtcaacaataaaataatgcatttgagacaatgaaagaacatgagggccctgagaacccttggggaatggggagagacaggtg

SEQ ID NO: 10715 - DNA, 201 bp, Bos taurus
tcgtgcttctattgcattggcttcaaacttgattcctctaaatgatgggccaaggatactccaatgagttttgtgccactgtctttgaaagacttgcataactgctctaaaccctgttttagaatctgggatagttggtctattgttccaggtctttgaagccagaaaaagggcattttaagcatctgttacatgaccaac

SEQ ID NO: 10716 - DNA, 201 bp, Bos taurus
catgcctttctctttcccgcctgcctctgtctttgctcatgccaagtctaatatacaagacccttctccctcctcctaacctatccacgtcagtctgaatcgagcttaagtcccaccccttcccacaaagttttcatcaacaaaccaaaacacactcttccccctcccttaatccctcacaagtgaatgtctatttctctc

SEQ ID NO: 10717 - DNA, 201 bp, Bos taurus
ttctagacaatgacaccactggcattagaaagtcagtgcctcttacctcccgccagtgtcacagtatatcagaagcaggcaggcccagccaggtaccatacggcagctcccaggctggggtgagaaagttgacatcccttgagaatttactcaaaatgcgtgtgccctgacagagcatgttctctgagacatcacagggac

SEQ ID NO: 10718 - DNA, 201 bp, Bos taurus
tggactgcagcccaccaggctcctccgtccatgggattttccaggcaagagtactggagtggggtgccatgcagttaacactatttcaagcaaaaagagtggccatatcttcacatttttaaccagctatactccaatataaagtaaaaagttcaaaaaaaaaagagtgaccatatggtctgaaggaccaatccattgccc

SEQ ID NO: 10719 - DNA, 201 bp, Bos taurus
atttcaggtaaaagctaactttctagtacatagaacccatttactgttgcttttcctaaagaaagtgttcttaacatataaaaagaaaaattgtgaagtttaaggtgggtgagtatgagtgtggtaatttggtgtaactggaagtattacagataagaggagtgaggggaacagcaaggtattaatgagaaaagttcctgt

SEQ ID NO: 10720 - DNA, 201 bp, Bos taurus
tcatgcgttatgaggctacaggtctttatgcccttaatttttgtttggttaattagattgcaccttattccgcagatgattgaaatagctttaaatgaaaataatacaaaagcaatcattctaaaacagaaacaagaataaagaactgaatcagaatacctataaaacagctgtggaaagtgaaagaagagaacacaaata

SEQ ID NO: 10721 - DNA, 201 bp, Bos taurus
atcccatcccaggattttcagctcttcctggaagttggttctgctcttctccggtctagtaaataatcgaacagaagagaaacagtgagatgcggagcagcgtatctgcctggactgcagggcctgtctgcatctggctgtacaaggcgcacatgcagagcagacacaggcaaggagtgagcgtgactgactgaccggccc

SEQ ID NO: 10722 - DNA, 201 bp, Bos taurus
aatatcaggccaaatatgttgctacaaagatattttaagattagattaacatttaaatcagtagattctgagtaaagcagactacccttcataatgtggacgggcctcacccaattagttgatgaccttaataaaaaaacaagtattctctcaccccctcctccccaccaggaagagagaattctgtctccagactgcctg

SEQ ID NO: 10723 - DNA, 201 bp, Bos taurus
tgtttccctgtcattactcatgatcaaagtattgcacacctctgaaggtcaccaatcacattatagtctcagtgactgagccacaggtgtcttttgagccaaacaaccaatatttaaatttttaaaattttatttggccgcatcaggtcttagttgcagcactcaggatcttcactatgtcacgcaggatccttctttgta

SEQ ID NO: 10724 - DNA, 201 bp, Bos taurus
ctggccttgcttgcctgtctacctgtcttagaactggactccttgctctctccactccagccatagggtcttgttgctgtttctcagataagctgatctcattcccaccttggccttggtacttaaggttcctcagcctggaatgctacctctgcaaatcttctcctctccgattttattcaagtctccccccaaacgtat

SEQ ID NO: 10725 - DNA, 201 bp, Bos taurus
caaccagcctgaaaggtaaacagtgcctccaagcacagataggataccagcactggctcacttatggcagagcgcaggagaaagatggggccactgtacaaacagataggaattcagctaagattttaataaattgtaaaaggctgggcagagactaggaaccctgggggccacaaatgcaagaagagtttgcacctgctt

SEQ ID NO: 10726 - DNA, 201 bp, Bos taurus
tataggactgtgacactttttaaagttttggtgagaaaagtgtaatcagtaatgtctgccatgggcttaggacttagtcctcatgcagtatatttgctacccctgtaattagaccagggcaaatctcaacctgccttgcaatgctaccttttgaacagctccagaataacacaaaatggaggcattttattttgggagaaa

SEQ ID NO: 10727 - DNA, 201 bp, Bos taurus
agtctcccttcttcctcagggcattaggggccctccaggctctaaggaggaggcatatgtagtgagtcattagtggatatgactggtcttatgtctgtccgtattataatctgcaataaaaggggggttaggtatataagcccaataagtataattaatcaagtcagcctgagagggggaagcaaaagcaagcagagcaag

SEQ ID NO: 10728 - DNA, 201 bp, Bos taurus
ggtaccctccggcacgcacccttggtggccttggtagttcagtgtggaaatttggtgtgagatgggctgtccaggtgagagattttttttttcccctatagctcctggcctcagatcattaagaccgggaggttgaacagtgtctgggggcctcaaaggatgtccctgctgtcagtggcttattctcgtttcccaggcgtt

SEQ ID NO: 10729 - DNA, 201 bp, Bos taurus
acacgtaccctccccaggctgtctcctgaggcctgctccttggtttctgtgacccagttgcactgaccttgcagttccccaagttcactaatttcatggactagatagaccagagggccctgggaagcagaccagtccaccagacaaattcctggtccctgtctgcctgtttgctttctggtcccttggaccctgggaaaa

SEQ ID NO: 10730 - DNA, 201 bp, Bos taurus
tactgggaggtttccctgtttacacttcctgaactgggcaacaggctgtcctctgtaggatgacgttcctactctgccaatgaagaacccaccactctaattgaggttttcatgccaatctctgtctgtccatgtgatgtaatctcattatttgaaatgtaaggaatttagttatttcaagtagtgtttttcttacttctg

SEQ ID NO: 10731 - DNA, 201 bp, Bos taurus
atgcagttgggatgtggtcaaggtggagctggcgaccgtggcctggggtggtcagggggttttcaggaaggaatatgacaggacctgctctcaggtcaaatgcacgtgagactggtgggtggagaggaagggggagctatcccaggtggccagggccagtataagcaaggacccggatgtgggagtttattcagggaccgg

SEQ ID NO: 10732 - DNA, 201 bp, Bos taurus
gtgcaaattgagaccataattcagattgttcatatcatcaccagcctccccatttccattaagccctgctgtccatctcccctgggcccagctctgtccagcagctaatggaaggggtcaagctagcactaaattaacaaaccactctggaggggtgggccccccagcccagcccttccagcccagaggccatggttaacc

SEQ ID NO: 10733 - DNA, 201 bp, Bos taurus
tgagcagcagccacgtggggcaagtatgaattgtggggtgagggagggtttggcactggcaaggggtccatggaacatggacagaatgaagctctgggagtgaggggcagaagcacatgaggaggtcaagcttcaggcccttcaccttgacacaatgggaaaactgagtaatgaatgattcttctgacaaaaggaaattgt

SEQ ID NO: 10734 - DNA, 201 bp, Bos taurus
ttctgctagagcgactcattgtcagtccccacgggaagcagctgcaggctcttaagtgctcaagaaacttcagattacaggcaaagacacaaagctggccctggactcttaaaataagagctacttacctcaaacagggctccctgggctgctgagctgctccacatgcaggcctggggcgagtgcctccttcccaggctg

SEQ ID NO: 10735 - DNA, 201 bp, Bos taurus
ttagttctctacatttttctcaagtgagggccctgatggctggaagctcagggctgcttgagaccctcacgctgctgtaacaccccaggtcatggttgtccatctcgtagggccggattgagttctctttgttccaccttggggtggccctgaaggagaaccacagaaggcagtagcagatgcccctagtgctctcaaagc

SEQ ID NO: 10736 - DNA, 201 bp, Bos taurus
tctttgatggagcagaacggccaatgccttaggatcggtgaacaggaatctgaaggaagaatggaagcctgggaaaggccctgctgagtaagaagtcccaccagacagaactttgggggcttttcgggggcttcagtactgcgtgccctggactggggaggaggcagagatggagaattccgaaggccatgccactcactc

SEQ ID NO: 10737 - DNA, 201 bp, Bos taurus
cccacacttgagtcagcaacctgacttgtttcggcccataccatgtggcagaagtgtccgttttgagcctaggcaccaggaggccttcgtacttccacttcgcattcttagaactttgataccacatgtgaacataccaggttagcttctggaagatgagagaacatgtgaaggaaagcccacttgttccaaccaaggcca

SEQ ID NO: 10738 - DNA, 201 bp, Bos taurus
ggagccaggaagggaggcgtccgggccttgaccacaggcagcccaatgccagcagtcacatggtagactgttatgctgtgctgccttccctgcccgtgctgatgggaccaaagccccatgggcccacaacacacagagcctgtcatttctacttcatgtttatgcacggtgctcagccaccttcagtttaacctttgcttt

SEQ ID NO: 10739 - DNA, 201 bp, Bos taurus
atcagggccccacagggttgagggaagccaagtgccaggatatatgctttaagggagtgctcactctccggttcccaccctggacttccaccaactggaaagtggtgcctccttaaatttggggccctggacacctcacccttctcaccccagtgctttccttgttccttatatagctgatacctagaattgtcaggttag

SEQ ID NO: 10740 - DNA, 201 bp, Bos taurus
gacagcccttctctccttcagtgccacccaccgtccaggccagacagagcatcgtgaatgccaccgccaacctcggccagtccgtcaccctcgtgtgcaacgccgaaggcttcccagagcccaccgtgagctggacgaagtaaggaactggctggagcctttcccaccagctagtggaggaggagagctggcagggcctac

SEQ ID NO: 10741 - DNA, 201 bp, Bos taurus
aagcccacactatacctcactgagacagtgcatctcacttcaaggggttgtggtcaagtaaactgatttgggttttgatggttaggaagagaaagaggtaatgtcgaccctcagataacctggcccagggcagctgactccccgccccctccccagaccccggctctgctggaaccccaaactctgccatccttttgttct

SEQ ID NO: 10742 - DNA, 201 bp, Bos taurus
ccgaggcttatattttaaataaatttgaacatgtagatgcagattacctgtttctggttacccgtcacaaggtcaggtccaaacttctggctgggccagcccgtcaagatcaaagtcaagagtttgtgtcctctatccctggtggcttgtctgctgctccccctggtctcttgcacaccggatcccttatcagcagtcagt

SEQ ID NO: 10743 - DNA, 201 bp, Bos taurus
ggtgaagggaggaggcgaggccgacatggaccagaaccgcccagctctcatctgatctgccccctgtcttccggttccccaggtcagtgaggagatctgccaggagctaacaggctcttgagaatcccttggactgcaaggagatccaaccagtccatcctaaaggagatcagtcctgagtgttcattggaaggactgatg

SEQ ID NO: 10744 - DNA, 201 bp, Bos taurus
actgtttcttaaaaatctaactttctctttagctctcatcacccactctcccccctaaacaacctggatataaaccagccttcccatcctgctcccttattataaatgctgacttcctttcttgccgggagtgggggggcccgatagaccgtctccttttccccatcactgctgtgccctgtccaagacagctggagctct

SEQ ID NO: 10745 - DNA, 201 bp, Bos taurus
aagcaaatgagcagactgccagatgggatcactgagcaattgggcagtgggctccaaagggcagcaccataacctgacagaaacatgctggagtccaacttggccttgtgtatcttcgctttttgtgtccattttgttaggttttcctgggtctctggctggtggactgaaactcagagcatatgctgagaagcaccatcc

SEQ ID NO: 10746 - DNA, 201 bp, Bos taurus
tccctccagaccgagtccacaagcctttcccctgatacatgtttatacagagaacaggggccttagaccaatctagcttcagcaggtcagcccaaggtacgtgtgaggccaaattcttatgagatcctgagctccctttgtttccactggtaggagggaaaaaacaggctttctttcaagttcagactctcctacatcact

SEQ ID NO: 10747 - DNA, 201 bp, Bos taurus
tttattggatagaaaatgcaaatgggttttaagcacagggaaaaaataactccaccgatgatgagatctacaaaataaaattatgctgagatatcatttgtcacctattaaattggcaattatcaaaatgttagaaattgctaaattattctccatagaggtgataccaatttacacttcttctaacaatgcacgataaca

SEQ ID NO: 10748 - DNA, 201 bp, Bos taurus
ttctggataggaagtccaagatcaaagtgtggcagggcttggtttctggtgagcacactcttcctggcttaccgatggcctccttttattgtgtcctcaagggcagagagagaaagagagcaagttctctatatctctcataagggcactaatcccaccataaaggccccaccttcatggccttgtctcaccctaattact

SEQ ID NO: 10749 - DNA, 201 bp, Bos taurus
aggcatacaccaggtaggaaagcgcttcttggtacctgagaaagttatcgatgaaaaacagctcagtgctcctttcccaaacccagggcttagtccccatcgctctctaatacaagaatggaaccggctacagggatggaaaagtcttaagcatggaggcagcatggtgcaggtggaaaagagggccaaagaccacagcca

SEQ ID NO: 10750 - DNA, 201 bp, Bos taurus
attccctgcctggagtcccatgcccttaaggggctgtaactctttcacttttgtaagctaacctttattggcaagggctagatggcctcaaggccagccctgaagagatggagacattgtggagttggggagagggtggataaataaatggtctctgcctcaggggtaaaagctaagggcagaaattaaatggggctttca

SEQ ID NO: 10751 - DNA, 201 bp, Bos taurus
aattgatgttgagggtttggggcgttctgtttcagatttacttttatgtctgaagagtatatttttattatccaaaatagtcttggtctttagaagcccacggagagagtcccttggatccatcatagctacaggcacctgagtgtcattttggtgttagggttttacatctagtcctacaaagtctgtatagacgtggag

SEQ ID NO: 10752 - DNA, 201 bp, Bos taurus
cccgatttcacgctccatcgaagctcagccacctggatgtagctagctgccttttctgctcgaaccccatctcgggccttcatctcccactgcgatcttcggcgagtgttttcagcagaaatagggaagttgacacatgtgccagtgttggccccttatgcaaaaacattctgcggccgaggtcctgccagtcatcctcct

SEQ ID NO: 10753 - DNA, 201 bp, Bos taurus
catttcgtacctgacttgagagatctgggttccccatgagtggggtagtcatccatgtatgttggtttgtgtgtttcagagtcaaggggccagagaaggaaaagttgagccgggcagtcgagcaggtcctgaagtgtaacatgactcagagctggctgctgagggccatctgcctgcccctggccgactgcctgctaagca

SEQ ID NO: 10754 - DNA, 201 bp, Bos taurus
tggcaaactgtggcctagaggtcaagtgtagttcacccctctttttgtagggcccatcagctaaaagtggactttgcactttttaatcattggccaaaaaggtccaaagaagagtgaaactatatgaaattcaaaattccacgtccataaatgaggttttattggaacagccagatctttcattcatgtgttgtcttggcc

SEQ ID NO: 10755 - DNA, 201 bp, Bos taurus
ggacacagcatcacggcctgtccactgtacagagcacattggtcgtggcagaggatctggagcccacacctaggttcctttatgtcaccctaaccccaaccctgcggagaaggccatggcaccccactccagtactcttgcctggaaaatcccatgggcggaggagcctggtgggctgcagttcatgaggtcgctaaaagt

SEQ ID NO: 10756 - DNA, 201 bp, Bos taurus
tgaacctatttgcaaggcaggaacaaagatgcagacatagagaacagacttacggacagagcaggggcagaagagggtgggacaaattgagaaagtagcattgaaatacataattaccgtatgtagaacagataactaatgggcaattggtgcataacatagagagctcaacctggcactctgtgataaccgagggggtgg

SEQ ID NO: 10757 - DNA, 201 bp, Bos taurus
gaagggagagagtttcactttgtagtctggcatcatctttctccagcagaagagacaagcacgcccccctgagagccacctcagggatacgcggccctttacatgctgttgtgcaggcttccaagtcaagagggtgcgccaattggatttattacaattggaaggaaagaaattgtaatctttaaaagccaacgacatggc

SEQ ID NO: 10758 - DNA, 201 bp, Bos taurus
gcaggacaacacccttctgttgctgcccatagaaagtgccctgaggcaccctgggcgactcattcctcaaacatgtgacactcaaccaaactgcacacagggggagagaaggccagctcaccacagagagctgacccccacacgccacagtgcagaacgcagacaagtcacccattgtagagcacatgggctctcagtctc

SEQ ID NO: 10759 - DNA, 201 bp, Bos taurus
ccaagacactgggtttaggatggtaaaatccaggccattcctctgggtgtgggtcgagttctcatgtgcccctgggtgaagtcagcttctacccagaagaatagagtagaagagtctgggcctgcagagtaaaggtcctcagggcatacatctgaatggaatggagaccctgcggggactgagagatgcagcagaaggcga

SEQ ID NO: 10760 - DNA, 201 bp, Bos taurus
taggagagtagaagcaatatattcctcccctggagctatttttgagctacttgaggactcacagcccctgctgaggccccggggaagccgaggtacgtgtcgctgatcttctgtactcctgatggtggtgggtgtcaggttgagttgcttatcacggccccctgcctgctgcacatcttcgagagctcaaaagtgacccgc

SEQ ID NO: 10761 - DNA, 201 bp, Bos taurus
cacggttagccgggagacagaggtggtggcctccgcagctcagccccattagctgggctggtgggaggcggctggcgcgtttgagggctcagacaagcccagtgattgaagggccggtctttggagctgctgccagactaatctcaggccggcagcccgtgcttttcctttagtttcagcccactcgctggctctgccctg

SEQ ID NO: 10762 - DNA, 201 bp, Bos taurus
ggaagtgagaagggtcacagtaaatggtggagaatacaagttgatgtttctgttatggaaacagttcttatttaatggacccaaactgcgtgggaagagaaaagatattcttcctctagttatacacagggataactagttatacgtagggatatgttactgacctcaagccattctgattctttttgaatgggatttttt

SEQ ID NO: 10763 - DNA, 201 bp, Bos taurus
ccctggggagaaggaggagctgagcctcaggatggactagaaagttgtccagtgcctaagcaggctttgtgctggatgtccggcctcacttctctctgtgcgtctgccttagccttctctactttctttcagattggcttttcctgcctcacatgtacatggccaaatgtggctatcagcttcttgacaacccagctcacc

SEQ ID NO: 10764 - DNA, 201 bp, Bos taurus
ccataacaggcacttactatacattcattgtggggctgctgatgagggtgacagaagttactgccatatttcctgagtaggaataagaaatgaatctcttgggctttattttaaagtaagggccaggaaaatgaaagtggttttgttggtcctacagggaataggtttggtaaaccaatgaaaaaaataaactcttgagag

SEQ ID NO: 10765 - DNA, 201 bp, Bos taurus
ctggtattttctatgaggaaatgaggggtggagagggtgttggtttcctcacaggcaggcctagacccccatgctgtctggagtcacctgctcccataatacatcctcagcatcttctccggtatctttccaggtgcgcaaggactaactttgccctaataaatgtttaactcttgcccaactcctggaaggtaatctctt

SEQ ID NO: 10766 - DNA, 201 bp, Bos taurus
tgggcaccagaggccagcgcccctctcagcaacctgggaagcaccgttagcattcctgtggctgctccagctgcttgtgggctgacactgtgacctcatcggagaggggcctggggcctaaagagcctccagatttttgacaagatgacacgtacaacgagaaagcagctacacggctccccctccaaacttgaacctgct

SEQ ID NO: 10767 - DNA, 201 bp, Bos taurus
agatttccttgcagtcctctgcccccagcatctttgatggcttttcatctatggaaagactgtctaggaggactctgtccccctcagtggccctttcagccagcacaagacagcctctccctcctgatggagccaccaccttccagaggctgggagctttccctccaggagaagggacatctgccttctccctaaaggagc

SEQ ID NO: 10768 - DNA, 201 bp, Bos taurus
ggaggctgcagttattgggaaactcaggtgaatgagccccttgataagaaccagtcatcccaagtctggccaaacgttgctgaggccttttctggcctgcatgtctaaagcctctcccgtgcctgctgggtagcggtcaggagggctgatgatactactacaccccagccccccatgctaacagcaccccgggaaggtctc

SEQ ID NO: 10769 - DNA, 201 bp, Bos taurus
ttctaacttgggctgtttgaaatctccctggtctctggaatcctccaggggaaaaattaaacagggccccagctcactgaaggcatgattggccaactgttgggtttttgtttttattgttcacatcattttatttcccactgaccccacttgaaaaatcctggaggcccctgactaatatcttttccagtgtttatagaa

SEQ ID NO: 10770 - DNA, 201 bp, Bos taurus
tcaggtgcacagggctctatcctgctctgcttgactccctaacaagtcaaaactcagactggcaagaactgtgaatgggagaataatgacaagcgaggggtgtccccaagagccttccttgttaaccagcatggagtctgcaattgccccggggctggggtgtctgcaggcaacagcaacagggtttgcaggaatttgtga

SEQ ID NO: 10771 - DNA, 201 bp, Bos taurus
aagcgggggtgaggaagatagagcaccaggcagagaagcagatggtgcaaaggccctgaggtgggagtgtgcctcttccatccacagaacaaagaaggccagagtggctgcagcagagagcggggcaggagagcagcgagagatgaggagggaaggaggtcaggttccagaggattttgggggccaccataaggttttggc

SEQ ID NO: 10772 - DNA, 201 bp, Bos taurus
ctttgaattcgtttcacgtttattctcaggatacaatattcactctctgcgggagaacgggatgccacaaaggcgggaaaagactaaaacaagttacaactcggcctgaacacactggagatactgcccaggggcgcgagcagcggcctgagagggctctgagcgcaggcagggtcagggtcaggggcgcggggccgccgg

SEQ ID NO: 10773 - DNA, 201 bp, Bos taurus
agtgccttagctcctcagtgttatagcaactctgattggtccaaggaagtaaacagacattgggaggctataataggaggaaagacaatgagaaatcaccgagggagaaggcctcgaagtgggcctcgagggggaactggagaccaggaagtgggtctgggtggagggaacggcccccactggtagccatagggtggaggt

SEQ ID NO: 10774 - DNA, 201 bp, Bos taurus
agaagcttctacctttggttgctcctcattggcccccattttggggggtggggcagggcatagcttcctctttcattccttgatgtcccttggtgttgttcccttgaaaggcctaaactccattctgggaaggaaagagcagatgtcaggtcatttgggactaaaggcttgaactggctgttctctggggttccctcctgg

SEQ ID NO: 10775 - DNA, 201 bp, Bos taurus
gagaagagaaggtgcaggcaggaagggcacagggagcgctcatcagcatctgaagggcacacagaagacagtgcgtttatactgcgctgctccagggcccggaatctggaataattagaagtaacaatttcaacgcaggaaaaatcttttcaattattagaactgatccaaagtactagattaaggtcctagggatttaag

SEQ ID NO: 10776 - DNA, 201 bp, Bos taurus
gacttctttgatagcttaatataatctgtcaataaggaaatctgatttctctacttctaaacaaacactgactgtaagctccctcttcctggcccagttgtgactggttacccagtcccagactcttcctctcttgcatcgctcgtgtttgctgcccttttcttccttcccaggtccagcaccaccacctgcatgcggaat

SEQ ID NO: 10777 - DNA, 201 bp, Bos taurus
ttaagatataccctctgtctcctgttttctgctgtacctgggggctccgggctctggagaataaacctcccaactcctgcctagataaggaaggggccaccacctggctgctaagcatgggagaaggcacccgggcgtccaccttttaactgatgcctagttctattctcttaacctcatctttgtcctctgaagtgcatg

SEQ ID NO: 10778 - DNA, 201 bp, Bos taurus
gagggctgtgctaccctgcctcagagtgtcccctggaaaatgggatgacaaccctcgcagcagggcagctgcaggccctccattcagtgcccgctgactccgagcctgaggcggggagggctgacgcctcttgtatctcatccaaaggaagctggttacccctggagtggggttaggctgaggcagctgcttcagggcttg

SEQ ID NO: 10779 - DNA, 201 bp, Bos taurus
tgggtgctgtggggtcaacagaaggagcggtggccattcatctgtgaacaagctgagaagctgccatcaggacccactacaccaggtccaggtgccctggagaaatgcaaggtaaggaggaggccgggctgaagaggggcagagagagataggaccagcctacagacctgagcaaggtcaaaggccacatgagggtgctgt

SEQ ID NO: 10780 - DNA, 201 bp, Bos taurus
cctggtgggcccccacctggggagcccccacctgccacttcccacacaagatcccctcagaccctctcagtgagtacaaagtgcagaaatctccctggagtggggctcagagagctgcagaggcctcccagggatctagaaagttctctccaccaaggcatggaagtgggaccccaccccaggggctgaaagggactttct

SEQ ID NO: 10781 - DNA, 201 bp, Bos taurus
ctgaatcttcaaactccactctgcctccttctcatgtgccgagtaattcattgagtcccagggacgcagcagagtggtgctgatgtcatgcacttgaatcggccagacctagattcaaacttaggctctcctctcatctgaattccagtttcctcacttaagttgtgaggatcaaaggagagagtgctttccacccgttta

SEQ ID NO: 10782 - DNA, 201 bp, Bos taurus
ccagagcttttctgtcatgtcttgtggtggcctctcttctctgccctacttgagccccttcttggtgctagggaagcagtgcccaaggtcaaaggaatgcgccagtcctcacctcccaggctgtgctggactgggccctgggcggtggggtccggtgagcccagctcaccccctgggccaggagagtttgggttaggaggg

SEQ ID NO: 10783 - DNA, 201 bp, Bos taurus
gcaaatcaatttctgacctaggaagccaagagaggaaggaaagggtctggttccttaggaaacaggaacagaaatggcctaagctctaactctctgccccaaggcctggcttttgggatctgaccagcttcctctgggagacagagatggctggttatcctccaaaacaagtgttcgctcctgcctgggaactgcccagga

SEQ ID NO: 10784 - DNA, 201 bp, Bos taurus
aatttttttttttttttggcttatttctataaaaacgctaaaggaaattaaaatcaaatggcttctaattatgcacataatgaattgcccctattgaaaacgataaaatgttatgaaacgacatcaaaaccagtgcaaataaaacatacaaatgttttgaagggaaaaggttccaagaaatcctagggtgactcatggttc

SEQ ID NO: 10785 - DNA, 201 bp, Bos taurus
aaggacctcaccaaaccactctatctaattttggatttatttctgtattcttgctttaagaaagactgcaaaaccattgaaacttcaggcccccagaaaatgtgggtctgctctggctcccaaataggactctttgctcatcagagagaggcaagcacccatcactccccagcctggtagcctccaccagctggcctcctc

SEQ ID NO: 10786 - DNA, 201 bp, Bos taurus
tgcactcaccaccacagcctggcctcgctctgtggctgggaacccaagcctccctccaagcgattgcgggccaaggccacctgagataagtagtgtatgtgtgtcaatgctgctctctcaattcatccttttccctttctttttgttaattgcaatgaggaaacagaggacaacagggcctaacccactcaagttcagttc

SEQ ID NO: 10787 - DNA, 201 bp, Bos taurus
attggaaggtggagggtggatgtaaacaagtaatcaccgtttttgtgacttttgacccagccctgaaaggatgaatagagaggagaagcagatgggtggaatgtggtatccacaggattgtttgtatacatttaatccctaagtcgtgtctttgcaaccccatggactgtagcccgccaggctcatctgtccatgggattt

SEQ ID NO: 10788 - DNA, 201 bp, Bos taurus
tctgtatgagatgtgcctatgtttgttgctaactgtcaggtccgattacagctgagtgatgtgtattcctgagcatccattcaggaaagaatatatatgcgggtgtgggttggaatttttgtgtatatcatgaattaattgaaggccaaaacaacaccttatttacttggccagatacacatgggcttcccaggtggctca

SEQ ID NO: 10789 - DNA, 201 bp, Bos taurus
gcacaagcaccactttatgctcatgctgaatgagaactagtcaaccagcctagagatttatgggaaatttttgtcatgtttaagtgctactttgttgttacaactagtagctcagtttcctctttgactttaataatcctctctatttaacctattttttttaaaggtatagcaaatagaacatgtcaacagataaatgca

SEQ ID NO: 10790 - DNA, 201 bp, Bos taurus
agaatctgaaagtcagcattctagtagtagttatatcactaaataactgagtgtgacattctacggatctgaagatgttgagaaaacacatgtaaaaaaatgattagtacttatttacatgttccttgcaggtgctgttggcagcagcagtctgtacaaaagcaggaaaagctattgtttctcgacagtttgtagagatga

SEQ ID NO: 10791 - DNA, 201 bp, Bos taurus
aaatcaaagatgttccatagacacttcattaactttccacctcccacaacagacttctgttgattctgtcttggaggataaagtatcacatttcctatctctagactctcttaactgtcacatctttgttgtttttgctatttagatgctcagttgcatcctactctcttgggagcccagggactgtagcccgccaggctc

SEQ ID NO: 10792 - DNA, 201 bp, Bos taurus
atttttgtggtgactttcaaggccagcccggtgtctgtcccctaactacccctcagctctcactatatcccttctaatgtcctgcgttccctcttgcctcgaggcctttgcacagactcttctttaagcctgtgtgcgtgctaagtcgcttcagtcatgtctgactctttgcaaccccatggactgtagcccacaaggctc

SEQ ID NO: 10793 - DNA, 201 bp, Bos taurus
ccagtgtctgcctctgaggacattggcagctcatagaatgccgggccggtgcccgggatggggggcaggtactccccactccctgcctccccttctgctcttcatccctccctccccctttattaccgttttttgtacttgatgccttctctgtgagcagtggctctgttggaaggagggagccaggagcctgctgggaag

SEQ ID NO: 10794 - DNA, 201 bp, Bos taurus
ggggccgaaccatcatctgcaccatccaccagcccagtgctaagctctttgagatgtttgacaaggtgaggatctctaggactcaaaggtgactgaccagtgatggggagcgggccagggatcagtcaaggtgtggtgggacctgcctgacccactcgtgctattttccttgcccttctttttctgcctcagctctatatc

SEQ ID NO: 10795 - DNA, 201 bp, Bos taurus
aggcacagcacctgcctccctgtcccacctggagaagcctcgccagcaacttgtgacagatggcagcactttgagtgactacttcaattttaactccttttgataatccagcgccagaaagccacatactttaaaactgtccccggatcatagatcaaccccaaaggccaagtccagctcagttaataacctctggaaaca

SEQ ID NO: 10796 - DNA, 201 bp, Bos taurus
gctcaagatttaaaactgccttggtgtcactgtttgggtcaccagattcatccacaggaaggttcacatttctgttcaaaacagtcataaagtttaacacgttgaacatctgaggcctttatttctcagtttggcctgcaaatctatgccaagaaagagaaggagcgtgggagggaggaggggcctggagtgagcgcacac

SEQ ID NO: 10797 - DNA, 201 bp, Bos taurus
gggccttggatcccccaggaaaccctcctcactgctgcagacgagactgggtgtgcctgttctccacagcatcccgcctccccctctgactcagtggccttagtgatttgcttaacatctcctccccccagcccactggttcacgagacgtccgctgtgcctccccagcagtgagcacagtggccgccgtggaaagaaggg

SEQ ID NO: 10798 - DNA, 201 bp, Bos taurus
cccaaggacttcgtgtggtcttttcaggggcagaagcgttaaactaaccaaggtctgttccagcgctaagctttgaagctgtgatgaaaaccaagctcatttctggcccttgatccaaagacaatgcaaagagagcagcatctttgttcctttgggaagctggccccgtcttcctggtagtcaggaagccatgtaatatgt

SEQ ID NO: 10799 - DNA, 201 bp, Bos taurus
ctcactcaccctttccaggggcagttttccccccaatatctccaagaagagtggtcccagacaccccccaaccccattccaggcctttagccacctggctcctctttgtccatggtcatggtggtccacccagagagccccaaagcccagaccagcacatctcccaaagctcaaagaccagcagttgcccatggccagcag

SEQ ID NO: 10800 - DNA, 201 bp, Bos taurus
tccatggacagaggagcctggtgggctacatcatccacggggtcacagagagtcggataggactaatgttttcactttcctgagtctggcctcaatcctcactgctactatttagcgtctttctgcctgttttgtcttcgggggagatgggctgtgactattggcaagcacaaggcctgtcgcgacccatgcctcactccg

SEQ ID NO: 10801 - DNA, 201 bp, Bos taurus
ccttccaagaccccagttccattgctcactaacagagagggcctctctagggcatcttcccaaacactggcattcaccatgtagtggctgctgggcatcctactgtaaattgttggccctttgacttattactgagttgctaagttgtgtcccactcttctgagaccccatgaactgtagcccaccaggctctcctgtcca

SEQ ID NO: 10802 - DNA, 201 bp, Bos taurus
gtgaggagggaggaaggatgaacggactgatgtgagagcggccagcgggatgctgctgaagcaggaggaagtgggcagtgccaaggagtgggattaagcatacagacaaagagccagatggcctgcattagagtcctgggctttgtactgcttggcattgtgaccttgtacaaattcttcaacttctatatttctctgggg

SEQ ID NO: 10803 - DNA, 201 bp, Bos taurus
cttttatgtctcctgcactggcaagcgggttctttaccactagtgctacattaaggttggtgggtgaccagcttaccctctggtattaagagcggcttatccagctcaaggcctgaagaagggacctggttttgcccttcaggttgagaatccttctcctcctccttctcccatcttccttaatttcatgaccagttgaga

SEQ ID NO: 10804 - DNA, 201 bp, Bos taurus
ttgataagttttgtcttgataactagggtcacagagtttctgtcctatactcgtcgaagccattaaagtcttgttagattgacttactctgtattgttcatctgtgatgtacccatctccaaagacaggttagcaaagtggtaccccgtgtttcacaatgagattattacagcttttagtgcttttgtcatctctacaact

SEQ ID NO: 10805 - DNA, 201 bp, Bos taurus
ctacctttcctttgagaaaccaatatatatgactctgtgatattcttgtgtgtgttttgcttacggggttagtgctctttatttttatatgggtttcatgtgctgccttgtgtttctccaggtagaatgcagttcattactaagaatatgattattgactttttttcccctctgttttctcttcccttctctctttatcct

SEQ ID NO: 10806 - DNA, 201 bp, Bos taurus
gcccagagtgggtgagggacttggatgagggtgacggcagaaagggggtgcacttgagtggcatttccaaggagcggcagacgtgctgacagcttgggcacgcagatgagggagcaggaagtgtcggagggaacttcgagatttccagcctcggttttctttcaggaacaagggagccaggaggggaggcaggtctgaagg

SEQ ID NO: 10807 - DNA, 201 bp, Bos taurus
tcatcccatcttccctcgaatgtttgttcgaggtaaaggaccagggccacgtgtatgaattagaggccatgagaccggaagcaggaaggtcagtgagggggcgcgtgttcactgtgagatgctgtgtctgaacttggcaacggctggagggatggagagttggaggtcatggtgtgaccttcgggatgagctccctctact

SEQ ID NO: 10808 - DNA, 201 bp, Bos taurus
gaatggccatttagttctacagactggcaagaccacatggaggacaggataagcctttgtcattggttctgctggagagggaagagttctgctggaggaagagaaggagcagcattgatggcccaagtctgtgtgtcaggaaatggtgatgcgggtgcacagccctcacacagacacaggagagcccactgcacatctgag

SEQ ID NO: 10809 - DNA, 201 bp, Bos taurus
ggcacctggctcatgcccacctgacaccctggccaggcggcaccactaacagggctatgggaccagcttgggctgtgctcacatgtgctgacaagaggcacgggacctggattcaaatcctggctctgctgttttctcgctgtgtgatcttaggtagctatgtaaccctcctgggcctcagattctttttctgtcattttg

SEQ ID NO: 10810 - DNA, 201 bp, Bos taurus
cacactcagcttgtctatatttaaattgtgattaagattattgtccttgaatgaagaggtttaggattaagtgaatgtgaagcttccagttaaaagatgctgtttaatcttggtgacttgttattttgacactgacagttgagcaccctcccacacagttttcattcttttgaactgccagttgtatgtatggaagatagc

SEQ ID NO: 10811 - DNA, 201 bp, Bos taurus
gtgacttctttccactttcccagcccagcagaagataggctgctttcctaatcttgattagagttaatatatgagaatttgaacatagctgcaaaggaaaaaaagaatgagaatcagccctcccaaatcatggtcttgggggaacttttctttgttgtctaaactttttgttttggccagggcatggggccagttttatct

SEQ ID NO: 10812 - DNA, 201 bp, Bos taurus
tgcactctctgcctacactctcagcatccccagggggatcttgctttgaattggagaagcacatctggtccagcaggtggactgagggactagtctcgcctaccttgctatcttgatccaggtgtggcatgaactagtgggcctttgtcacctggaatggtggccccgggggctctgggaaaagttaaaagtttgtctctt

SEQ ID NO: 10813 - DNA, 201 bp, Bos taurus
ctacaacagggactaattagaaagtcatgggcagcaaggaggaattgattaacggggtgaggggacactttccacggcctgcctttctatgtccctggatgtcctaagatgcccaagctgggaacagagtatatagctttccaatctctgacaggaagaccaagttcaggatgcttgaaggttctttcctttgggggcctg

SEQ ID NO: 10814 - DNA, 201 bp, Bos taurus
tcccccactttaagatcagcagcttcagagctaatgttcaattctcatttccagagtctaaggtataggttttcacaatcagattctgagttgaacacagcaacatttatttattaatttctacctgattgggcttccctagtggctcagacagtaaagaatccacctgtactgcaggagacggggttcaatccctgggtc

SEQ ID NO: 10815 - DNA, 201 bp, Bos taurus
tcctttttacagctggtaactgaggcataaagtgataagttaccctctgggtggatctgggacttgaacctggctctttgtttcactaaagggcagaggttctttgagggtggagcaatcacatgtgattcctgatccatccttctgggagggacatagcagaatactgcactgttaaaggtgctcagcaacatctctatc

SEQ ID NO: 10816 - DNA, 201 bp, Bos taurus
ctgagaatggtcccctctgaatttttaattatttcctacaatccagtctttggatgccttcaaatttaattcatccatctgcttaaggtaatgataacccgtaaaagcaaagtatcccaaaataaccagcttccacagcacttgtggacacactcaattttccaaatatcaactctatacacatctgttaattgaagtgta

SEQ ID NO: 10817 - DNA, 201 bp, Bos taurus
cgatgcttattctcaggtggtttttaaacaatatctgatgaatatcctattagtatacttgttggcctgcttattcctttggttttagaggagccagccataagatagtttttctctattatcttcattctttaaccattttaaaattggagtatagttaacttgcagtgttgtgttagtttcaaatatgcagcaaagtga

SEQ ID NO: 10818 - DNA, 201 bp, Bos taurus
actcagtaggaagctacaacaactgtggaagcttagtaacatcaaagacaaccatccgtcatcttcatgaccatggtagttctacctacactcagtgagtaatgcagaaaaggtacaatatcaaggcggacgacttccctagtgcttttgtcccactgcagggaaactgcatgagattgctgtgaaataaaaattaagtga

SEQ ID NO: 10819 - DNA, 201 bp, Bos taurus
gccatggctttgaccttatgcctgggagtggcgagcctttactttcatggtctctgggttcatcactgaagtgacagtctctaatgcctcgttctatgatgttcagggccaccctcacagcaacatgaaggagcgttagaatgactctctcctacaatcatcagatcagggttggccttggtggtgaccttaggacacaaa

SEQ ID NO: 10820 - DNA, 201 bp, Bos taurus
ctcccaccaggccatgccaaccctggcatctggtcctgctccctagcacttatgctcttttgattaaagggctgacatacacaaacaaaccataacttacacacgacatggttagtgaggagaggccaaatgtggacgagtactgactcataaggtaagaaggagtcagtttgcaaatttccagtcttgtttgtctctggt

SEQ ID NO: 10821 - DNA, 201 bp, Bos taurus
agtctatgtggatacactgaaggagcttgatatgggctctaaagttgcaggtgagtctctggttactctgagatggacttctcccagttgggccataggatagtgactgaaccctagagcagccagcctctctctgatgagaggtctgtggttctgctctacctgggagctgggcccccagggactgtgctctgctgtatc

SEQ ID NO: 10822 - DNA, 201 bp, Bos taurus
ggcggtcagcagcctgcatgctgcaactggagagtggcccccgattgccaccagagaacagcccaagaatcaacaaagacacagcatggccaaaagtttttaaaaatgataataataaccaccaaagacaattttgagtatggtagtttaaccccaggtcctatgttgaaatattttagaggccctacatatttttaaatg

SEQ ID NO: 10823 - DNA, 201 bp, Bos taurus
tttggccacaccacacagcttgtcaggtcatagttcctcaaccagggtcaaacacatgccccctgcaatgaaagcatggagtccaaacccctggatcatcggggaatttcttctggccatgtctgaggaggggcttcccaggtggcgcaagaacaaagaatccacctgccaatgcaggagacgcaagagacacaggagacg

SEQ ID NO: 10824 - DNA, 201 bp, Bos taurus
tggcattacaaaacttcccctctttgtataggtcataagttatttatgttgacattatgtattatgcatgatttggaaatacatctaacatcaatgtacatggcctcacaaagattcattaaaatgcattctatgaagttttaaacttccatttttaaacagaaatatccaaaaaaattgtatcttgtaatccctgaaacc

SEQ ID NO: 10825 - DNA, 201 bp, Bos taurus
ttcgtcactgggaaaatgaaagcacattgctgcatgtctcaccgtaggcctgtgctggacctatcctgcagaggattctgttaacatcatcaagaagcactagggggctttaggaggtggctcttgtttcttttcttccttcctaaacatttcatacaaatatttgaaactgattttttaggagaaagtctttcttttctg

SEQ ID NO: 10826 - DNA, 201 bp, Bos taurus
tcacagttgaaacagagtctccatgatgcctagttcttgggaaaattttttttttctaagatagtgtattcacactttcaggccactaaggtgccacttattgcatcacgagacaatgctgtgtcctggaaataacttgggccttagggagaaaataagcccttgagatccaatcagcaggaagcacaggacacaccagtg

SEQ ID NO: 10827 - DNA, 201 bp, Bos taurus
accgtcgttatctgaacagggagagagagaggaggaatctgaacctagacttgcatttgtagcacatctacaagatctaaataaatgagaggggtgtccttacgaagtgttagaagcaaaatgccaaccaatgcattgttatcggaagaaaaagtgtttgaggcaaagaagtgatcaaggagtcagaagagattttctgtc

SEQ ID NO: 10828 - DNA, 201 bp, Bos taurus
cttctgcacagtgtatcggccttccacattaacacacgatacagcctcattccccactcctttcctgacccggaaccctggccactccccctgcttcaaccctcttttacacatgtctcatttcagggcttcccaacatagtgtgcctgtcttcaggcctctctggcagaagaacagaatgacaggagcacttttattttt

SEQ ID NO: 10829 - DNA, 201 bp, Bos taurus
tggaaatcgcctttctgttaggacgtctccgaatcctcggtttagagattcttatatctggtaggtgtcgaaggggacagcaggaaccacaagcagaaccacgtggaaccactaacttttggggccaaggacagaattcttctttaggtctggtttggtttgcgaattcctggctgtcatagcaacccccaaagtaaagga

SEQ ID NO: 10830 - DNA, 201 bp, Bos taurus
tgggcagagaatagcatgtgcttgtctgaaagacactgattatgcgtcgttaattaggagcttgtctgggtgtgtaggatttgctgtgcatcctgagaggcagtgtctgcagcctttgtggggaggaatcgcttggcagtgttgttttcctgcagtgccaagtcagccagaggagttttgccagcttcttgagcactgctg

SEQ ID NO: 10831 - DNA, 201 bp, Bos taurus
gttttctaaaactggaaaatcaggagctgtgaaaggagcgtcttctaccccactctggagagagagatgatggggttgagctggggcccgactcccctcctcatgatagtgcaacttcattcagttctagaatgcagatgcacctgctgctctgacctctcccaagacctcgggagacacgctatgaatctgggcctctct

SEQ ID NO: 10832 - DNA, 201 bp, Bos taurus
acctcgttacctcactcctgctccggccatggctgtgacgggcccagccagctcctggttccgatgttctgtgtgaagctcaggggtcttgggcattgttgtctgttgtaactcgaggccctcagcaggcctgggagcccggattggagccttggctgctggcgagaagcaccttgcctgctaggagtttgatgccggacg

SEQ ID NO: 10833 - DNA, 201 bp, Bos taurus
tagaaagtaaaactttccagaaagaggtaataaatgacattatttgtagatatgaacaccctgaaatgacttggtctatcagatctagccagtcacttagcaaagccttgagagaatgggatgcaaaatgggttgctggggggaaagaggaaaacattccccagcacaacagacatctgggagagtagacctggagaggaa

SEQ ID NO: 10834 - DNA, 201 bp, Bos taurus
tagtgactgaacaacaacctctgttctctttagcagctgcttccttttggggctttctttccatacctgcctctatcttcagcattaggaagagactctccgaagtcagtttagcctgcttcagaagactaagaggcctttgaaaatttgaggagataagtcatttttttaaatgtatttttattttttagtttccctatt

SEQ ID NO: 10835 - DNA, 201 bp, Bos taurus
ccctctgccttcctcaccttcccctgccgacctctgttcctccttctggctcggtcaggttggctctcccaggggctctgtggtaaagggtctttctctgcatgtcacggccctctgtgtctcctcttccctggcactcagccccatgtgtggagttgtctatttacttgtctttccctggtggactgagagctcttggga

SEQ ID NO: 10836 - DNA, 201 bp, Bos taurus
cagaactggaggactcctgattaagcaaaggccaacgtgcgtgtgtgtgtatgctgggggagatgctgggaaatggaagtatttagttgaccaaggctttgctaggggccctttttctaaaatttctctacatattattgagcatctaaaaaggtacctgagctagcctccctgcttcaggaagaggcattttggggagaa

SEQ ID NO: 10837 - DNA, 201 bp, Bos taurus
cagtccagctttagctttccctgacttcctaggaagaatcaattgttccctcatctctgttctggtacactgcataaggggcctctcacccctggctatcgtgttagtcttctgtgtgtgtttccgtcgttgcctccacgcatagcctggacgtctcttgagagtcaaaactgcctctgtacttagaagagggcctggcgt

SEQ ID NO: 10838 - DNA, 201 bp, Bos taurus
tgtccaggggcacaaagaccgttaccggctgagaacatgaatgaggagaatgggcacaagggcaccaaagttccttttcagaggccagacagagtctcccttcccagcaggctgccagctgaaggcgcttgctatggaattcaacagcctgagtcctgcctagggggcagaactgtcatgggaacatgaaattcaaaaccc

SEQ ID NO: 10839 - DNA, 201 bp, Bos taurus
actgactggacacagactccgtcctggttctagtgagagaggaaggccaaatgggaaggattagtctgtctccctgctgatcccaacagagccctccaaggcagggatgtcagcacagtttgaggccaggggcaggctcctcacagtgtcagagacccaagggacattaggggtcctctaaccaaatgctctgatctgggg

SEQ ID NO: 10840 - DNA, 201 bp, Bos taurus
ctggggtccccggtgtctgactcaacccctgggttagcccctgtttctcttccccaggccccatgcgccccaaagggccccaggcctctgtgtttccaccgccctgctcttcctcatcacaagagtcattacctattaatgccctgagtgtgcaggcggggcgtgctgggcaaggccggggctggactttgtgccccattg

SEQ ID NO: 10841 - DNA, 201 bp, Bos taurus
atgggtgtggtttgtccaggaaagctgcttcctgcattccaacctggcctcccgggcactaacacacttgtcaaggtgcagctgtggggagcaggagcaaattctgttgccatggaaaccactggcctttccctctcaaggagctctttagatcctggcctgtgatgtgccaacacctgtggtggttactggggagtttgg

SEQ ID NO: 10842 - DNA, 201 bp, Bos taurus
cgtcaatcaatttacatcgatctaacctagttaaatttagttatttagttagatttagttatctaaattaatgtctgatttagattgtggacagtaaggaacatacttcggatttttctgttttagcttttccttatactgacctgatggacaaagtgggctacttttggccagacactgaggagaaaagacttggttgtt

SEQ ID NO: 10843 - DNA, 201 bp, Bos taurus
tgggccaggagtgtggatgggctcataggcattgcagttacgatctggatggtatccaaagtaaatattttgccattagctttctcatcaatttgataattgttgttggcttcaaggggccaatctgtagattttttttgaaagcgtatttgaatttttcagttctacatcttattgtgtagttccttctcatcaaaagca

SEQ ID NO: 10844 - DNA, 201 bp, Bos taurus
catttgcttctttctttatccaggtgtcctagaaacctaactgtctgtgagtttggtccttaggcaggttcatcttgatgttggcactttcggcttcaaacggtgctaacagtgctttcaggctacacatggagtagatgagtgtcggtcatctttctgagctgtggtagagttcagaatacttattttgtgataacgaat

SEQ ID NO: 10845 - DNA, 201 bp, Bos taurus
tggcattgtctctgaggtgtaaaataactgtggcttactaagtgataatgtgcttcatttgtctttttttttttttaataattatttatgttaaactcttgtaggatgaagcagcagcacagccgctgaatctctcatcccgacccaagacagttgagcctgtaaagtccccaacatctcccacccagagcctcttctcag

SEQ ID NO: 10846 - DNA, 201 bp, Bos taurus
tggaggcactgggtgtggggagacagcatttgtcatttgtttttctaaaccctggggatttgaagctaggtgaagaggaggtcaccaaggagggcagtctgcgggccctctaatcctgcaatcactcacgccaggggcactccctgtgccagggctccctccggcacttgacctcacttaatctcggtgactgacggccct

SEQ ID NO: 10847 - DNA, 201 bp, Bos taurus
atgatctttccccacccccatttcattatttcttctttgggtctggagtgatataaggaagatagacagagatctatctttctaaaccttagcagattgcattgactgaagcttctactgactccaagggagcaaattgtaatgggtaaatagttacaaagcaatcccagggaggaaacattcatagaaactttataaatg

SEQ ID NO: 10848 - DNA, 201 bp, Bos taurus
gacatgtagttaccggagacaccgtcctactttatagaaacagtcgaaggctcgctgtgcagggtgatgcaggcactggagagtcagagatacaaggttccgctactctgaggggcccattggcagaacctggagatcagtgaaacaaagtttaaaacaaggactttcaagcttttcctgaggagtctacaatccacggca

SEQ ID NO: 10849 - DNA, 201 bp, Bos taurus
gtgtctaaggcatctgagttttgtgttggctgtcagtggatcccaccttagaaacttctgctctttaatgtctgtagtctgttatgtaaataatgtggcctgtgtattcacctgtgctcttacacaaataattgctttggggaaagaatcactgaataaactgtttataatgattacctttgggcatatgggatgagggcc

SEQ ID NO: 10850 - DNA, 201 bp, Bos taurus
aatgaattcagtgcttttctgtgtataggaagatgcaataatctgggctcattaaaagtattcctttgatatgcaccttagctatctagggccagcattctgcttttttgcatcctaaatcccctcagggcaacaggggcaactgcaatggctcctgacttgatggccctaacattctttgctgattgatatggcaggtga

SEQ ID NO: 10851 - DNA, 201 bp, Bos taurus
ctaacagacaggcccagcattctttggcagcaccccagatgtagtgtatgtgacagtgccttctggtttctctagtgttttatggaatttcctttgcatttctgggtcttgtcctgggcccaactttcaagacaacaaaggacaaatagcctagtgatcctgtcctaccttggcatcaccttttctccctttcaaatccta

SEQ ID NO: 10852 - DNA, 201 bp, Bos taurus
tttgtttttggctgtgctgagcggcttgcaggatcttagttccctggccggggactgaactcaagcagagattaaacctgggccatagcagtgaaggcgctgagtggaattcccttgttgttttttcttttttttaaatcatgtctttaagaaagcagaaagttggccacttaggaaactacagtgaattacttgagtttt

SEQ ID NO: 10853 - DNA, 201 bp, Bos taurus
ttactttattttaaaacattccccattattgggccatagctcagctatttctagtctttataagcgaacacctctcttaatacgtcactgtagataattaggcatatttctgatagatagcttcccgttaacttgaactactgaagcaaagtaaatgaacatgttaaaaccactataaaactaccctcacatatgttggtc

SEQ ID NO: 10854 - DNA, 201 bp, Bos taurus
ttcagcatctccggcctggccgggagagtggaggtcggtagtctgctgccggtgcgacctttccctggggtttgtttcgctttccaccgggccttgaacaatatcttctcggtctaccagccaatttcgctcctcaggttccttcagtcgagtagattccgagcagtccagagagggccctagtggtctgtgtgggagaaa

SEQ ID NO: 10855 - DNA, 201 bp, Bos taurus
ttcaggatgagggaaaaggcaaaccaaaaaggaaggggtgagggctgctcagagctgccccagggactggagaggtgcgatcaccagtgaggctgtgtgtgccgctctcctcttcctgctcatcctggcccactgtgccaaggatcctgatgtgcagggaggcagtagggtgaagtgggaagagctggaggtgcaagtcgg

SEQ ID NO: 10856 - DNA, 201 bp, Bos taurus
tgctcaaggagtctccgcaccaacccagcaaccatggccatcctgaccatgtcctctgcctgctgccgaaaccacagggatttcttaattcccaagtttcgcctacatggcctgcatcatctagttttttcctttgatttttaatttcagaataatacatgctttttgtgggaaaatttagcatcacagaagcacagtgta

SEQ ID NO: 10857 - DNA, 201 bp, Bos taurus
taggaacctcttcagtcctgggcaaagtaggatggttgatcaccctataggagaaggacaagaaagatcaccatgaaatcctcatggaggtgcaatgaagggggtaagatgggagggggtaaggatgcattaatttcattcatgaagaaaccacatgtggatcaagacagttagcagtaaggaccaaaaggagggaatgaa

SEQ ID NO: 10858 - DNA, 201 bp, Bos taurus
ttgagacaagcccattttatagactaggaagttaaagcatagaagcattaaatgacttgctcagagttatccagttggttaagtggtagaaccaggatttagacccaggcaggctcactctacagatgctctaagtgaatttttctgtgaagatggaattgttccacagtctgctgtccaacatggtagccccttgccaga

SEQ ID NO: 10859 - DNA, 201 bp, Bos taurus
gccaacctacacacttctgaaggaaggggaacagagagtaagaggcagacaataaaggggctgtgcccatatcacctcaaattcctttgtgccctggtacatggccctggcactgatgagcctttgcttccagaggctggcacctgtggctcattcctgaaggaccagcctcagggcactggagtttctctgccaaacacg

SEQ ID NO: 10860 - DNA, 201 bp, Bos taurus
actggccagaagaagaagagttgaagccaagagcactagatttaagcctgaaggagatttttaaaaattaggtgtctgtggctataggagttattggcagtgaccaacacaggcctcaggcaaaatagagaagaaagcagattcctagcaacccctccagagaactgagcaagccctgtgatgctctgtggctgggttaag

SEQ ID NO: 10861 - DNA, 201 bp, Bos taurus
gatacagttagttaaaatgaggcataatggtattagggtgggccctggatccaatataacacatgtgttgttataagagggaaagttgaacacagacacagagagagagagaagatggccacataaatgtggagacaggaatggaagtcctgctgctgaaagtcaagcaatgcctggggctaccagaccctggaaaaagca

SEQ ID NO: 10862 - DNA, 201 bp, Bos taurus
gaaccaggccttgaatccagatctatctgattctaaaggcctttgccctttcccttataccagcctatttatctcagtcacaaagaaatggtggtttcttgaaaggggggaaagggacccatggccagataagtcccaggcagtgaagacaggcatgctctcagctgcctgataggacaggtctgaagaggactgcaatgg

SEQ ID NO: 10863 - DNA, 201 bp, Bos taurus
tcatctttaagtttgagctcacatggagaatagtcctggtttctgtactggcagtgacttaatgtctctgcctgaggttcacaactcagaatcccaggcctgataaggtcattcatgatatgcagattccctgcaaacaaccacagccaatttcagcatttattcaacttctgcctcctaataatgacagccggaagtgag

SEQ ID NO: 10864 - DNA, 201 bp, Bos taurus
ttagcccacacttgccacaactagagaaagcccacatagcaatgcagacccagggcagccatcactattaattaaaagaaagaaggccaggactaatgtgcatgtctgctctgggtgaggggcatgttgacagcatatttatcccatatttgccatttctggcccagtggttcccaactcctatattccaccctggcttga

SEQ ID NO: 10865 - DNA, 201 bp, Bos taurus
aaaagaagatgtcaaatatggcatttgtgacctttggatgtagggcagtgcttttcaagcaggggcaattctgtggcccatgggacatttggcactgtctggagacacttgggattgtgacaagtggggaaagagtgtgtctagtgggcagaggccagggatgctgcgaaacctcctacaaggcacaggacagccctacac

SEQ ID NO: 10866 - DNA, 201 bp, Bos taurus
gggagtttgtgcagctggagaacaaagtgagagggttcctcagagactcacctggaatgggggccgtgactgctggctggatggggtaggcctgctgcacaaagggcttgacgctggagacagaggacagagagagtcagaaaccatggctgtagcagcagctacttcctaggtctggccgtggcctcccagggctaggga

SEQ ID NO: 10867 - DNA, 201 bp, Bos taurus
tcaggcccctagtagacatcgaggcaacagcattcccagactttttcaccagctgccttggctgtgtgaacttctctctcgataatcatcccttatcccacatcccagtgtggccctgcttcccctatcaagccctaactgatacactaggtaaatgagactgccactcctcatgggcctacagtggacctgtcattactt

SEQ ID NO: 10868 - DNA, 201 bp, Bos taurus
ccgcagctgggaggcaagctgcccttggcaaaggccagggacacactggcccagcctgtggtgcggccagcaggaaaggtctccttgtccactcctggcccgcagcctatcttgttcagcagcttgaaaagacaaactggtgctgaagacaagccaagctgaacaccaggccatgcagtgagctcacatcccgcccctcac

SEQ ID NO: 10869 - DNA, 201 bp, Bos taurus
ctgtcttctgctgggctcagtcaggcagctgtggccagttgctggttagctggttgagtcagcttctggaggtgggttgactgactgctggagtcatggtgcttctgggccgtgagtggtttctcatccagtaggctactccaggctgcttcacatgatgctggtgacagggattctaagggcagcaagaaacagcaagca

SEQ ID NO: 10870 - DNA, 201 bp, Bos taurus
tgaaaaagaaagtatctctttttagtcttttctacttctacactttccataacctttactcttttttgctgtaaaaagaatcaattctctttttttggccgcaccaggtcttagctgcagtgtgcaggctcttagctgtatcacatggcatctagtttcctgaccagggattgaacctgggccccctgcactgggagtgtg

SEQ ID NO: 10871 - DNA, 201 bp, Bos taurus
ctaataaaaaaagtatataaagtaccaaagtttgcaaattatttccttatttaaaaaattagagtggatgcaatattatcactataataacattcttagtaacttgcattcatatatgcttttttactttggaaagaaaggaatactaggaatcgcacatgaagactgtatcatctaagttgccattaagaatttctttgg

SEQ ID NO: 10872 - DNA, 201 bp, Bos taurus
caagaaaaataccacttagcacaaaatctaccaaagtgacttcccacctagatttttaaatcagtatttaaaattgttctacacggccctaggtctgatttagtgtcccccactcctccctctacccacactatttctctgatctagttttctgccactgactcttgctcattctgttcccacgcccttggcctcgttgag

SEQ ID NO: 10873 - DNA, 201 bp, Bos taurus
agtgggctaggtttgggggagaaagcctgccacagccaggaactgaggataaggactgtatgcagccaggcagctgtcaccaggagggcttgaggccacacgtctcgaggcaccgacacctagagccctcagcatgactggcgaacactttctgaggtggtaagtgatggcccaccactagagttgccagatttagcaaat

SEQ ID NO: 10874 - DNA, 201 bp, Bos taurus
tctccttcacccaggaggcaaaccgcccaagtggcctctgctacagggacactgaaaaccctcttagaaagcacaagtcccagggccaaggagccctgtccggcaattcctcttgggggcactggtcttggacttggtacaagtgtgaggcttcctgtgccacatacctggagtcagcagccccatctcttcccagctccc

SEQ ID NO: 10875 - DNA, 201 bp, Bos taurus
aagaccactgtgatacatttcccatgctgtggttgacttgcctgttgggaatacacccagtctataaagatgactgcagaaaggggaagggctattcaaatgaggagggattcagattaacaacaactctccgttctggatttctaaaagatgcaaagtaattttgatctaaatttatggaactggaaatatctaatagat

SEQ ID NO: 10876 - DNA, 201 bp, Bos taurus
gtgagaatgaaaacaaactgtcatggaattatctcctcatctctgagtcagccagctgaccctaaaactggcacactgccctcttgtaatatggagaatatagagtcttcttgagtggtgtctgtgcattatgacaagagaacccccaaaatgtcatgccaaaccagagacctacctggttctgcaaaccaggcaggaaag

SEQ ID NO: 10877 - DNA, 201 bp, Bos taurus
tcctggcttggcggctcgggattttgctagaacacccgtatcttcgaaagtgtgtttatgtgggtcggcgacgagggccatagggttttcccaaagtgccatggagtataagttgaaacatagctataaactttgccaaatgttggcatctatttttttccccctgggaacctggggttcgtttacttactgttgaaggcc

SEQ ID NO: 10878 - DNA, 201 bp, Bos taurus
aagtgaactattgtactttacttaaaggaagtgggtggtagtattaatattaagcaagatggactctttctgatggccagaactatatgtagattcaatttaattacttcatattagaaatttagttaagaataagtggtgtagtgtggaaggacaagaaaaagtctccaccatcaggcctcgttgagaactggatgaatg

SEQ ID NO: 10879 - DNA, 201 bp, Bos taurus
aacttgggagtctatgtttacaggtggttcatttccaaggaataattcttaaattctttatggaatcctgcctaattaaaacttttattctgacagtaaagatggctggtcaggtacacacagggatgtatataccaggagctttatacttcttgttataaattcccttataacacgcaaagatagtagcaaacaaagttt

SEQ ID NO: 10880 - DNA, 201 bp, Bos taurus
gtgagagcccacgtgcagcaatgaagacccagagcaaccaaaaataaataagtaaatttttaacaagtgtggtcccaaagcaataactttaggaattaaatacgataaaaactcttagaagaatgaaaaaaaaaatctgctatgaggaaacagtcaacagaacattagaactaatcactaaacacaaaaaggagcagcatt

SEQ ID NO: 10881 - DNA, 201 bp, Bos taurus
ggtgtatattaatataatccctaataactttttctaaatgcttgcttcagggactatatctggaactgaacatagccacagcgctgtggtatggccacccctgctctacactctggtctcttcaagaggtgaacatagcagtcattatcctggtaaggcatgtagattagtaatcaccattctgttacctgcagagaaata

SEQ ID NO: 10882 - DNA, 201 bp, Bos taurus
gccacatggcatggccacacacacgcgtggacgagacaaagctaccccaaaacaatatatgcaacaccaaagcactgatcaaggtaaggaaaaaaaggaactcagtgctggtagattataaaatggtacaaccatattggaaaactggcattacctgacatgcacttatctcataacctagcaatttccctcttatatatt

SEQ ID NO: 10883 - DNA, 201 bp, Bos taurus
ctaatacatgctgtcatgcttgaccacctacctaaattctccaagctttctttaacctcctttatgcactttttttttgtgcccattaaatacccttctttctcttgtctgcctaatgagttcaggcataagctcatctctgaagccttttctgatgaagactgagactgagttgttttgtgttccttgtgttcctctggt

SEQ ID NO: 10884 - DNA, 201 bp, Bos taurus
tagccattcatataccatatgtggcagttcaaataatgttagttaattcgtaaaagaggtaatcgtgtttgaataatgctccagatcaccttaaatcagtgtagcagttttacttgctaaatgaacaagtctaaatatgactttatctgctaagtagctttcagtcccatttgggatttttaagtgcatttttttaactgt

SEQ ID NO: 10885 - DNA, 201 bp, Bos taurus
cctgtagtacttcctaaggccaggtattattctgaatattttccttcccacagctggagaggcaaggggtcctgctggtggaatttgaggctccccttgcgacaggcccagagctgccagcccagcggcagagcgtggtcttagaggaagatgtcattcagttctcgccaaccatggaattctcactgcgacctggggaca

SEQ ID NO: 10886 - DNA, 201 bp, Bos taurus
taaaaataaaaaaaaaattgaaaaaggaagtgatatgtggaaaagcatgacctagaaaacttaaaggtcatctgggccaaccatctttcccagttgcctgccttagagaaacctggttatttggatcatgtggcatgaataagccccccttgcccttttaacggccacatagaatattataggcagaatacctaggaagaa

SEQ ID NO: 10887 - DNA, 201 bp, Bos taurus
gctggtggtgagtggctggccagcgagcaaagcttcatctgctgttccccatcgctcgcattactgcctgaaccatcctccatccctcttgacaaagagcttggggcctgctgctctagtagacattgctgtccactggttgaggtggaaggaaactaatggggtggggaattaataacgaacaggaaaagaattatgata

SEQ ID NO: 10888 - DNA, 201 bp, Bos taurus
gtcacattcctgatacaaggtagaatcggaaacgtgcagagaaatgcagtgagttctaccctctggtgagcattggagcccatgaggggcggggccttatcgatgacgtggtatgagtgaacgctgctgctctgtgatgaacctggaggtgcctggactccaggtcaacggagtcaggcctccttttgaccccgagttgcc

SEQ ID NO: 10889 - DNA, 201 bp, Bos taurus
gctcaaggccattccccagttttgcttccctgatgccaaggactggctccctgtgtcagagtacagcaggtgaggcccagtctggcagaatctcctccactctgtcatagcgggcggctggctgggcccactctagtcccagcctcttctcctgtagcagcctggtccttcaccccctccctgggatggcagccccttctt

SEQ ID NO: 10890 - DNA, 201 bp, Bos taurus
aaccactcactatttgtcgaagttgatcctgtgatgatgcatgccaccagcattacctcggcctcccgggtgtttccggtgtttgcctgcaggaacacatgactacatggctaaaatagccttctccagcccgtcaatactattgtagcaaaagcatttccccatacttctgggccttggctttatatctcttccagcaat

SEQ ID NO: 10891 - DNA, 201 bp, Bos taurus
atgccttgtgatgttgattagaagtcatcttgggatcttttctagaaaacactgcctaggagaactgggctttattttgtttgaactttcatatcttttaattcctaaaaaggagacttatgctaataatctttagggctttgcctgagtatataattgccttgtctgttttggcatctttggcagaattgaattgttact

SEQ ID NO: 10892 - DNA, 201 bp, Bos taurus
aggagagagacaccaccccattgatgttgctgtgtccttctttcgtctcccggggtcaggagaagtagagatcccaggtgaaagcatttgtggcctccaaccctccacacttggtcaggtggacgatcccatccctggctcttcccaggcagagctcaactaggagacagaggggacttttgaaataggcctaaagcctgg

SEQ ID NO: 10893 - DNA, 201 bp, Bos taurus
taatgaagcaaaatagattaaaggggaaagacaaggagttcagaaatttgtagagtagtatcacatcccctttttccatcttttttcatctgtgacatccctaggtcccacatccattcctcacgtgatgtagtcacaagtatgtaagttggccctcttagaaggcaaacagtagcaagtgtgagccagttagctcatgga

SEQ ID NO: 10894 - DNA, 201 bp, Bos taurus
gcatattctatgctctctggaaaaatgaaatgtatatggcatgactcttcactctgagaatttatagtctaggatgaatgttaggaagatacaactggtgaaaagtttattgcctagaaaaaagggagttggtgaaagccttctgggaaatcgtgtctagctgtggaggaggcctgatagggaacttgagtaagacacagc

SEQ ID NO: 10895 - DNA, 201 bp, Bos taurus
taaaattatggcaaagaaaagtggatttacatacattctgactatgctgagaggtctatgtgatgttactgctggactgaactttatttaaatttaataaatggtaaagactgtttgcatttcttggtatgaatatgcttaatttttgagttctgcaaatttgataatatagtagaacatctttatatattaatggtttta

SEQ ID NO: 10896 - DNA, 201 bp, Bos taurus
taatttgtccaagtattcaaaattatttggtggctggatgggattagaacacacgtttcttggacttcagagttcatgcttttggcccctgtgcttgcttaactgtatcttgcatgatagaaacacaggacccagaaatatgctcaaatcagtttatgggcccaagcatttctcttgtggccatgcactgagctgttgttg

SEQ ID NO: 10897 - DNA, 201 bp, Bos taurus
aattagtcttcttatgatttctcatcaatcactggaaatcacaaaaaattatgcttggttttcagggaataacagataggcagcaggccaaatacagaccctagattgctgacccccaggtgaggatgatgtctctctctctataatgaatctccagggacagagggtactcttgtaaaaatgcagattcaggcccagcag

SEQ ID NO: 10898 - DNA, 201 bp, Bos taurus
tgataaaagtcaagcatctattatggtaaaagtttttaacaaaccagatatagaagacgaatgtgtttgtctgatggtgggcctctaaaagcaaggctacagcactgatgtacttactggtgaaatgtgaaaggctacccaattaacataagaaataagacactttactgcttatattctatactgtacttcaggccttag

SEQ ID NO: 10899 - DNA, 201 bp, Bos taurus
ctaacttggcccagtgcattcattcattaaaccacgatatgctgtgaatctatgttctagggacgagtatggcactagagatgaaacacggctatagtttggtccctcctatctgagggcctctgctttgggtcttctatctgtatcccctttactaagcatgcgcttggccaataatgctcagaaatcaggtaattgaat

SEQ ID NO: 10900 - DNA, 201 bp, Bos taurus
ctcccaagagaggcccatatatactaaaaattccctcctacttgcaaagtttctctgttcaggctccagcttcacaagttatgcccattcttaaaatgtaacaagtttagtctcagtagatcaatggcagtgtaagcccagtatccaaaggaaactactacaagtcagagactgttacgttacactgattttctgcagtaa

SEQ ID NO: 10901 - DNA, 201 bp, Bos taurus
ccttcaagccatcgtcaagccctggccattctacctgctaaaccttccgcagagctatccacttctccccatgttcattgctgacactcatccaagactccatcagagccacaccctggcctggtgtgtcatgagggctgtcctaagataacttccccatctgtgtgatcctgtgtttacaaaggggcagcagcggtgatt

SEQ ID NO: 10902 - DNA, 201 bp, Bos taurus
atcagctcctgacgtttgtgggggagttgacaggagctggaggcttggcaagctaggaaatttgtcggggcgaccacagcaaaggtagcttcccatcgcagggacagcagcaggcggcgcgggtggcaaaaggctgacaggtgaaagatgcgctctggtacttgggttcccacacccaggtagcgaagcaacagctgccca

SEQ ID NO: 10903 - DNA, 201 bp, Bos taurus
atgacacttatcacattgtaggttatatatttacaagtctgattcccaccctagtctgagaacttgtaaaggacagggagtgtgtctgtttcagcattgtttctccagtaactgttttaagggccttgtccagagtgcccaggaaatttgattgcttgataggttgatcagctgattgaatggttcattcacctactcagt

SEQ ID NO: 10904 - DNA, 201 bp, Bos taurus
gggcctccaggaagagggactggccatccctttccaactggtgcccctccccgcagacagaggcagtgctgggggagtgccgggtgcgcttcctgtccttcctggccgtgggcagagatgtccacacgtttgcattcatcatggctgctggcccagcctccttctgctgccacatgttctggtgcgagcccaatgctgcca

SEQ ID NO: 10905 - DNA, 201 bp, Bos taurus
ccattttaaatagagaggtggcaaggtacatcgaaaaagtatggttttcatagtcagactgtcgaacttaattgctggtgaagggcaattctctttttctaggtctgttacgagtactagataaacttttccacatactcatttactcatttcatattgtgccagacgatggggatggatggtgtgttacacagaaatgga

SEQ ID NO: 10906 - DNA, 201 bp, Bos taurus
ttacagaaaagttccataatcaaataagcatgaaaaatgctgacactgtgagtcatgtacatggctatccaaaagagggctagagttttcagcctttctcgcacatttgtgaccatagatatttgtatccatgtttatataacttcttgatagcacatcaatttacactggtaaagtaatctagtgttcgatcagccacaa

SEQ ID NO: 10907 - DNA, 201 bp, Bos taurus
tggttggaagggtcaaaggaagaagaaccttctgaacggggattgggagacattgtattggaaggatttagtgtctgtctataatgtggaagacctggagtatcaaaattgagagttctagccattgggacctgttatcaagtctgttatcaagacctgttattgcagccaaacagtgatagaatagtaaataagtctttt

SEQ ID NO: 10908 - DNA, 201 bp, Bos taurus
caccttcagactgctcagattcccccagagaggcaggcagaggtcctctatgaatggttagggacataaacttcatcctgtcgacaagtcaacacacatcgagcacctatatggtgagacaagtagatctctgcacccatctataaagggcttaactggattaaattatatattctgtctaggtggtctcaagccacatta

SEQ ID NO: 10909 - DNA, 201 bp, Bos taurus
accaaaactcattaagtgtctaaactgcctcagatcctacagtaggtactggattaacaaaggcgaataaaatacaatccctaatttaaagggcagtttagcctaactagggagatatacaagaaatacagattcgaaatatgttgaaatgagaatataagaaatccagcttatttatcaaaagcttctgggatcatagaa

SEQ ID NO: 10910 - DNA, 201 bp, Bos taurus
attcaggtaatttttgtactaaccaagataatatgaaatggatgacaataaaataagtttatacaaccagaaatatgagcacagagttaacactttattattgagggaagagatatgaaatcatagggcagtcaacagaaaggggtcatgtagacctgatatctgataacccactagctcagaaagaagaaaacaaaattt

SEQ ID NO: 10911 - DNA, 201 bp, Bos taurus
gaaactgagagagaaacagtttatgttgtatttctctcactagctaagcacagtggctggttaagaaagatgctcgatctgtcttggttgaattgaatgtgttggaaaaatcagtataaatgtgtgggaagctttcattaatagattgggataaaacctgagtattgtagagtgcagaaagggagtcaatggtactaaata

SEQ ID NO: 10912 - DNA, 201 bp, Bos taurus
ccctgtgccagttggagtatttctgccaggtcccaccgtgaagttagggtgaatgagtatggagagtctagagaaactcatgtgtgtggccatggtctctcgagaggctttctccaaatttcccccagcctcatcaaactcaaccagaggaaaagcagtatatgttttcagggagaacccgtgaaactcatcacctgcctg

SEQ ID NO: 10913 - DNA, 201 bp, Bos taurus
agaaggaaggccccaggtttctctgtgcaacccttggaagaaactggctatttccagtacctgaataaagaggggacacagaagaaaaaaagtcaaagagatagggccatggcctccctttgactgtgaactaaactcatccaatcatccagacaagaggtgactactgtaatgaacagagctgagagctctgtggacatc

SEQ ID NO: 10914 - DNA, 201 bp, Bos taurus
agtccttaaccagaaaattgccttgagctgttttctaatattatgattttgtccctctgtttctgcactctcttggtcactttcccttcccagtttttctgtgtggctttcagagaaggccaggaatgttctccctgccatctttcattctaagttcttacttatgacatccactcttaaaacccaggcgccatggcctca

SEQ ID NO: 10915 - DNA, 201 bp, Bos taurus
acaggagacatcaaatttaaccccagcctgaggcccaatcacaaaatcaatgcagttaaggtcttgagcttttaataaggaaaagaactaaaaatccaccaaaaaatcttaaatcattcattgatttattcttcattattgatgtttaccttgtatacaactcaggtgctagacacacacacaaacacacaaaacaacaac

SEQ ID NO: 10916 - DNA, 201 bp, Bos taurus
tgtgtcagctgcaaaatggataagccgtcatactgggtatccaaagtataaagaataagcgtacccaggacgatgctagagacaaggggccatcctggctagagttgactcaccagccttcagtgccagaccaccagactccttagtgctccgttccaggcccatctcagttcctattacagtctttcacgcttgcaggct

SEQ ID NO: 10917 - DNA, 201 bp, Bos taurus
ccctctacccactcgtcctccatcctggcttcccaagcatcactctgccgtgctcagccctacccgggagacaaggggaaatcgtgacgctgaatagctccgttctgccaaaggcctcaggccccgtctgcccgccgcctgcctcccggggctgccggtcctctcctgccctgtcaccgccagcccacgccctggctcctg

SEQ ID NO: 10918 - DNA, 201 bp, Bos taurus
ccacaaaggggacaataatcctgtccatccttgggagagccccccagtcaagcgatggttcttttcctccagctactctcaagagaagatgaagaagccccaggagtttgtgtagaagcgagcggacaggcaacggttgactgtccaaggcaacaggcctgaggcacgtgctttctgccaacccagctcctcacttttacc

SEQ ID NO: 10919 - DNA, 201 bp, Bos taurus
actctgagctagtgggaaagctgggctgagacagagtgaggaatgatgggggcatgagtaacgcgggtggtttcagggggcctcacgggcccagtgccctgaccttgtccagctcctcctggttgccaaagagtgggtggtaacggcggtacttgccctcgcggtatttggcttcgaggtggcaccgccgggcactggggc

SEQ ID NO: 10920 - DNA, 201 bp, Bos taurus
ggaggcagagaagcttccagggggtactcatgagctgggccttgaaggataagcaggaaactgcacttctaagccaagggaactcaagtgtgcagggcccagggatgggaaaggacctggcagatgcagagatggggagagctcagtggggcagggacaggagacacaaaggacacccagggaggtggaggggtctgccct

SEQ ID NO: 10921 - DNA, 201 bp, Bos taurus
aggtgatccagcaacctaggtgattgacctaggtgaccagtagggaacagggagagggaaaggggctgaggagtcaggcctgggcctcacctctaccccaccctgaaactgatgagaaaagaggaaatgaccagggatggggtggaggggctgtattccagggtctgtaacagaaactaccaaactcaagaactttctgtt

SEQ ID NO: 10922 - DNA, 201 bp, Bos taurus
cactcagtgaaggttgcccatccacccctgagctagttacagggcctgaggagcccactcttgtctcattggcagacctaagtcacaggcctttcactcccagatcctcaaggctccagggaaagaaggagggaaggctgtcatcatgagaggggtctgggaattaggtgggagaaactacagaggagcagaaccatgatg

SEQ ID NO: 10923 - DNA, 201 bp, Bos taurus
actcgccctcctcagctgctccccctcccaaggccagggctacccacagggctcacctcctgtcctgccatgaggattaccggccacacggtgggcactcggcagatgcagcctccatcattcatggctcccctgcactcctgtatcacacaccttagccccggcccctgacccggagatgcagcgtatctgtaggtatcg

SEQ ID NO: 10924 - DNA, 201 bp, Bos taurus
ggcctgatgccggtctctgggggctgcccctgccccatgcccacctctcccaggccagggttccaaatcctcctcgacatgaggctcagtctcctcatgcttcagcttcccatgcctcagctctgcctctgagtctgcaccaccctgatctcctgacccacagcctagatcctgccttgacccacccctcagcactcacgg

SEQ ID NO: 10925 - DNA, 201 bp, Bos taurus
taagcaggggagtaaaatattcaggttagtgttttagaaagatcattactgctggtccacagaagaaggaatggacagagagagacaaacaggtaggacaatcgtcgagctatctggaacaggaacgagggcctgaatgaaagcagtggcaatggagtagagataagataatttattccagagataattaagtttgtagca

SEQ ID NO: 10926 - DNA, 201 bp, Bos taurus
gagcactcagtctggtttggggttttacctacctcagagaaaaaagacactggccacttccactactctgccttccaaaacaacatcactgtgtgtgtacatggctcagatatccttagtctacagcttagaaaaaccgccaaagacagccttgcatcctagtctctgaaaaaacacgtcattccttttaaacaaagctcc

SEQ ID NO: 10927 - DNA, 201 bp, Bos taurus
tgctgcttgacaggcagggagcaggttctgaccaggaaaataattcctgctgaaacccatcatcctgtgacacttcccactggcccgagccttggtccccttctgctgagaggcagcctcttgtagcttctgcagtcactggttttggattccaggcctggctcttcatttagaactctgtgaccttgggcaaggcactca

SEQ ID NO: 10928 - DNA, 201 bp, Bos taurus
cccagccctcctcggggatccaaggaggatgagttttgtgagcaccttggtgtctcaacagctctggtggctggagtctgcccttctcattccaggagtggctgtgtcaggagtgggtcaagggccagtgggcaggtgggaggctggcacgagggcagacgcaaggccactcacccacacagcggggacagcactgctgcg

SEQ ID NO: 10929 - DNA, 201 bp, Bos taurus
acactctcaatctgagctgagtgaacaccccaggccagcagtggatctagggcagtcaggttctaggaaaagaatccatttagggatgcagaggtggtgcggggggcctggtgggcaatggtggccactgctggcacttacacagaagcagcccaacttcctacagcttgagcagcgcttcagttcccacaagcacaacgc

SEQ ID NO: 10930 - DNA, 201 bp, Bos taurus
agttacacaaagctgtggtccatgtgatcagattggtttgttttccctgggggtagagagcttaaataggaagtgaaaatcacaaatcagaaaggaaaggatcatttataccaccatttacacaaaataaacttatgcatgacaaaagcagcaaagacaaaacttaaagacacaatctgggaaaagatattcactaagtat

SEQ ID NO: 10931 - DNA, 201 bp, Bos taurus
ccgagggacgcatggaagttggcccacagctgcacagccccccgcccaaggcagtaggatccattccttccatgttggccaactgaggctgttcagtcttatctaagaagctgtgagttttccccactgtatcatccagcagctatcatgtcatccttcctgcgctgccggagcgcacggcatgggcctctctttggtcct

SEQ ID NO: 10932 - DNA, 201 bp, Bos taurus
cacacccaaccagtctccctgacctggcccaagttcatacatcctggcttctctacccctgtctccttgccccagctttctctgcctgtctctggatgctccatccctggttctgcttacctattaagccggtccatactggtgtctccatgtgaagacttgttagaggctgagccatgacctattaaaccctcggttcct

SEQ ID NO: 10933 - DNA, 201 bp, Bos taurus
ctgccacaaacctcccctgaggtcagagaatccagagcccagtacctgctgggatagaagtagagaggaggaagggagaagcccacaggggaacaaacacacttgaactgattttggaataaatttccttacccgggcgagtctaggcttaagccagtcaacacctggaagcaaggtggaggaggcttggaacagggcact

SEQ ID NO: 10934 - DNA, 201 bp, Bos taurus
agatggagaacagcgtggggctgccttgtactgaaggggatggaggggcagatgatagctcttcaaaaggcaatctgagtgcaaataagggaagccccagatggggcctgccagctctgctgggcctcgcctcagtctgtggtgtccatcctttgttccctttttcctccactgggcgcacccctcccgacccgacagttt

SEQ ID NO: 10935 - DNA, 201 bp, Bos taurus
taagcattccttctggcccagtcaaggtagattgtggcaacagcagtagtacctcagagaaagagtgcaggctcccagctcccaccgcttgatcgtggacaagctgttctaatctttgggcctccttttcacaatatctaaaatgaggctgagaaaaaaaaaaaaagatcaaaaactaagatcatgggatccagtcccatc

SEQ ID NO: 10936 - DNA, 201 bp, Bos taurus
tataagccttgtgtggtaagagcctccaagatggcccacaataaccttgaccctctggaaggcatagctctgtgtagtcctctaccacactagagctgacccatgcaaccagtaggatactgtaaaaaagatggtgtgtgagtttcaaagtcaggtcacagaagacattgtggcttcatcttgatctctcttgaatcacct

SEQ ID NO: 10937 - DNA, 201 bp, Bos taurus
tgtgttctgttccctggaaggtggcaggaggtcacagtgggtccgaaactgggctgtgtggcgctactttcgagactactttcccattcaggtaaaaacttgcaggtgttatcttgggagggtgggaatggatgggaaatctgaagtcatgccttaacttacccatccacagcgatcatgtgtgcagggttgaacaaggtg

SEQ ID NO: 10938 - DNA, 201 bp, Bos taurus
ttagagttggtcccatcatgtatatgatgtaggtatttcaggtttgttttcatgaatggagtttatcctacatggaaggtatttaagtaataaaattgtcttgttaataacagttgtcctggtgctctggagtgactggtttacatgtaatattcatgtatttctactggaagaaatcaatctaagtattaaatggggaca

SEQ ID NO: 10939 - DNA, 201 bp, Bos taurus
tcttgttcttcatctctaatgtagcaaattacttaacatccttaaaagtgtatagagctttatagttgaaaatgcttttaaatacatttcaatacactgctgtgataggagacttcagtagcacctgggatggtgcagaggaaatagtgggtaggtgttgagctccaggctcctctgtttattcgtcatatgaacttgagg

SEQ ID NO: 10940 - DNA, 201 bp, Bos taurus
tgaccttaatatacccaggctccaggttcttcccctggaaagtgaagacgacatcaaactttgtcttggaagtaaactctccttggcctcactgggctgttgtgaggacgaaattaggtggcatatggcaggtgtctggcacaaggcttgtagcctgcgggccctcagcagtggataattccatcacccttcccattgaga

SEQ ID NO: 10941 - DNA, 201 bp, Bos taurus
tcttacttttttttttaacttagcatgttttagtcaaatatctctctaggcacttgaatttacagaccctgatttacatgttaaggatagaaggagccaacaaaagaacctatgaggaagcaacaccaagataggaaaaccagcagaacaaggtgttacagaaaactagagcggaacacgtcttgtttattaaatactatt

SEQ ID NO: 10942 - DNA, 201 bp, Bos taurus
ccctctcctactggccaattcaacgtggaacaagggatcatccaactttcctccccttcctggtcatctggcccagagaacctgtttgtcttagaggtggggacaggttcctttgccttatgccacctcagtttttcagactaggtgaggcagaataagcaatggaccaagaccttttatcctagatgaaaacaaccaccc

SEQ ID NO: 10943 - DNA, 201 bp, Bos taurus
ctgagggcagggcaatggacttcagatgaccaggttttgtggaccagaagtcaggatgtgagagtggggtgaggcatttgccattagcctgcctggcccacgccaggtgagttcacctccccaggagcctggcttgggtgcgggggcaggttggatccctgtggtgagccgtagggtgcctgggcccagaaggagtcagct

SEQ ID NO: 10944 - DNA, 201 bp, Bos taurus
caataattctcatctgtcagcactcttcctaacaagtgctgaataagggcaaaacagtaccctttctctgtatatctctgtatgcgtatgcactatacacggtcatgtaatcaccacttctcaatgtctattggaaaggaagactcgagagttgggtggagagccgagggccagataagccagcctggaacctcgggccca

SEQ ID NO: 10945 - DNA, 201 bp, Bos taurus
tgggaaatttgctgggcctctgggagcttatgggacggtgggggtagggagagagacagaaggaaggatggggcaagagaggaagaggcactcttgcacacggcctctgattctgcctcctccttacatccctgcagtggccccttccatgcagccgctgtccctatatctctctcctctgagccattgcacagcctggct

SEQ ID NO: 10946 - DNA, 201 bp, Bos taurus
ctgctggcattcagaagttgttttgtggaatttactcggcgtttaaatgttcttttgatgaatttgtgggggaaaaagtgttctccctgtcctactcctccgccatcttagctcctcctctgtcatttttttttttgacagataaaaagactatggtcttgaaaggggcagtgtcacccagcaaccaaaggaaaagccagg

SEQ ID NO: 10947 - DNA, 201 bp, Bos taurus
gtggtccctgtttccatttctatatctgtctttaggatttttcattatgttataaaatatgatgtttgagagaatatgggctttattctctgatttcaacatctcaccagaatacatttgctctgcatcttgtcaattacttatttttgtcaaaactctaataatacttcactgagttcttataatagttcaataacaatt

SEQ ID NO: 10948 - DNA, 201 bp, Bos taurus
gtgaatttctttactttaagaagcaatattaaaagaaaaaaacacttttcttttgtacttatttatttcctggctacacaaaatgccccattttcggaacgttctccctattccctagatttctatttaatagcatcacacagttgtaatagtaatggtaataataagaagcacatttataatattttatatagtttttac

SEQ ID NO: 10949 - DNA, 201 bp, Bos taurus
tatcatgtttattaaaattcacattccgtgggacacactgtgcaagtatgcagagagactgaatattaggatgcccttcaggtactttcaggttttgtttcgttctatctcagaatatgttaaggtgagcctgtttttttgcaaagccagagagtaataaatgtaattctttctgcagaagaaatgcttttttcccccaag

SEQ ID NO: 10950 - DNA, 201 bp, Bos taurus
gatatctttggatataaaaaaaaaagctaaattcccctactgggtggaattttatgagctctgtgggagaatttctttgtggtccttttctctactgtacataatatatgctgatgattgttgtgaaaaactattcttattgcatttttcaaaagcccaagtcttaacatcaacagtcttagaagtttagaaccatctaga

SEQ ID NO: 10951 - DNA, 201 bp, Bos taurus
aagaaataatgaggccccttctatatcatgcaagatgttaacccaggtaaaatgtcaaactcaaatccctaaagtacaaatgatgtaatagaaagaccttcgcaaattggttatccatatggccaaaaataaaattggatttctgcctgccccacaaaaatcaattccagatggattagagaactacatgtcaaaagtaaa

SEQ ID NO: 10952 - DNA, 201 bp, Bos taurus
atctgtgaaagccctatccctgaaaataaactgatcaggctaggggagggggtcccccttatttatttagtcccagccctaaggctaaactggtggcctggcagctcagagtgtttttctctgagctgaaaagccaactccaagtgctggggtgagcaggttaggaaacttgagaaccacacagacatcagggaaaattcc

SEQ ID NO: 10953 - DNA, 201 bp, Bos taurus
gaacgttctgttttgccctgtgcccaaggagtgctctcccctattgtgacagcatgacaaccagatggtgcttcctctgtgggtggccactccaggaaaccctgggagtttttgcaaactgatgcatttatcctgaaagcagcgttttggcatctttgtattctctctgttccaaaaggcaactttcacgcgaatgccctt

SEQ ID NO: 10954 - DNA, 201 bp, Bos taurus
ttcacctgctctccaacctgccaacctccaagctcctgctccctgccaggaatttacttcctgatgcctcacaggctatgtaaatcttcagatcagatcaaatcagtcgctcagttgtgtcacctcaattccctttagctctaaaatgatttttaccatttggagctcttgtaagcttttttgcctttagggtcagcaaat

SEQ ID NO: 10955 - DNA, 201 bp, Bos taurus
gctcctgtaagtgagtgtacaagccttgggtctgtgtgacaggaacaaaataaaagactgatgggaaaccaaggcactggcctctctgagccaagttaaaccacacgcatattgaaggtacccctatttgctgcacacatcctgttcaggtaagaggagaaataagaagctatgtacatatataactcagggcctccccaa

SEQ ID NO: 10956 - DNA, 201 bp, Bos taurus
aaaattgggaagggaagggatggacctggaatatagtagctactcagaaaattgttgaatggatgaaagcagaatggtgtgttatgagaggggcctaaagccaagctttttcttgaagcacaggctccagccatcaccaagatgtactctttgggcatcagcacagacttacgtgatgagcccaacatagtccaatcctgg

SEQ ID NO: 10957 - DNA, 201 bp, Bos taurus
ctttatcattgagctacctgtgaagcccttatgaaaaaagtaaataacactatgatgttctatgataatttattcattcactcaacaaaaatttatggaatacctattatatgccatacgaactgctgggggtatatgaagatgaataaggtgccagtccctgctttcaaggagttcatagtctagtggaggacatggaaa

SEQ ID NO: 10958 - DNA, 201 bp, Bos taurus
aaggaggccctggggtagaaaacacaaaaaaactaagatttgtgcatgagaagacaacgagctggtgggtgaggaagaggcatgcgctagagaaaagagagatggccatgaactcctgaagtagctctccctggccttagtagatgggttgtagatgagaaatcaaaagacagctcatgagcactgtggatcatcgttatt

SEQ ID NO: 10959 - DNA, 201 bp, Bos taurus
tcaagtcattctgggactccacagaaaagcatacacacttcaacttgcacttacttaatttctctgctttggggagagctgatggggccctacaaaacaagtcagttccaagagagccaatggaatgtgaaacagtcctaaaacacagactgggacgtggcctgatgatcctactctttggtccctgtcctctctctctga

SEQ ID NO: 10960 - DNA, 201 bp, Bos taurus
ttttcttcactttgcaatcaagtgagagctgaacaattttatttaagtaattttccttgcagaaaatatcattaggctagttaagatatgtggaatcttttcttgtggcagtggggaatctttgaagagttttaagatatggagtgatctggctaaatttccacttttttataggctacaatggctatatgttgggagaat

SEQ ID NO: 10961 - DNA, 201 bp, Bos taurus
agttgtagaagttatgtaagttaaatcagtgaataagaatgatgtctaaacaatcgtcaaagaccaactctatataatggtcagtaacaagattggaatagatttttggcactattttattatttcccactattctaagctccacgaaaataggaactctctctgcctcgttgtcatttaaaaaactgtttattgttgttg

SEQ ID NO: 10962 - DNA, 201 bp, Bos taurus
ctccagtgatcttggaagatgttccttatggcaggactgaagtgtatagtttcaagtgtagaaccagcctgtccagcaaaaacctaagttcgttactagtggaacgtggcctctgcaccaacttctccacatttctcccccttcggctttgcacatccctgctgttgtcctccactccttgttctaaactttgacctcgct

SEQ ID NO: 10963 - DNA, 201 bp, Bos taurus
gttttggccaatccaaatttcatgtgaaccagttacttatgactgtgtttaacataagactaaatatacttagagtaaagctctcaggaaatggaatcttatatctgcaacaaatgtattttgtaagtgtacattttgactccacaatgtctttctctagaaagtcaagtgctccttttgtgtattttatagcttatctca

SEQ ID NO: 10964 - DNA, 201 bp, Bos taurus
ttggtcctagaattagcattagtatatttggccaaatgtttaatgggtttgtgtgtatgtgtgtgcacatgagcacatgtaataattctagaattctgtttggtgctctttagcctttcattccctctgtaccatcctctgtaaaatttgccttctggaatgattctaatgccagtcatttccagcttaatgcaaatttaa

SEQ ID NO: 10965 - DNA, 201 bp, Bos taurus
acactcacggaaaagcgatataatctcttcctacaatcagggacgatagagcccatttgctctgttctccctttattcccttgattccttgactattgtccgctgttttcttaccacctctccctcaatgctgatgcattattcatcaaaccctgcgtttgaggagggttgcatcttgtaatcagagcagtgggtcctaag

SEQ ID NO: 10966 - DNA, 201 bp, Bos taurus
caaaatgaatttctcatttttggtttatatgtaacggtttaatggaggaaaattgagtggttagcactaatcttgggttatttatgtctcacaagatgttgctattaaatggtggtatcccaatagccagtgaaaccagaccctggtcaaaattgtcctttgaatatgataaagctgtggataaagtacacaggaaacata

SEQ ID NO: 10967 - DNA, 201 bp, Bos taurus
acgctaaaatgttaagatttacaattaacacgtaatactccaaaacattatttagaccacccttgcaatgtttggctgtaaccatgagagtttatgagagattccaagtcatccagatggaaaaaaccacatccagactcctagatcaatgcttttctagtatacactctgtctcccttaacagatgccagagaaattgat

SEQ ID NO: 10968 - DNA, 201 bp, Bos taurus
cactcatgttagtgacagcccacatacagatgactggttttcctgtggcatcattttgtactcaacctttctgatgttagtggtgcttatatgtatatatatggtttagtcactaagtcgtgtccgattcttatgaccctatgaactgcagcccaccaggctactctctccatgggattttccaggcaagaatactggaaa

SEQ ID NO: 10969 - DNA, 201 bp, Bos taurus
aagattgtaaagtaattatcctccaattaaaattaaaaaaaaaaaaatactgtctctctgagaaatagactttgcatccctgtttgctttcctacatttgcaccctagaagggactaagtccctgaaaatctaagggttgcactgatctttatatcttcttcctgtcagttttgtccagttttaatacatagtgtgcgacc

SEQ ID NO: 10970 - DNA, 201 bp, Bos taurus
cagcatgcgtctcagcctaagctgaacagccactcaggcccctgatacttcataatgtagctccacactaaggaaagggatgctgaggccaagggcagtgcttagttgtgagggagagagtcagtgcagacctgggacggcatcggatgtaggcaggggcagccatcactagcacttacggaggcagcacctctgaagcag

SEQ ID NO: 10971 - DNA, 201 bp, Bos taurus
aaaaatcttttgtagtttgtgagttcttacaacttcacagcttaactcttctctctgatcccatgtaggcactttatttttcacttgtttctccagtttgatgagcttctgacccatttcaccaatacacaaggaaggagattcacttagctcccaggaacaaagtcaactctctgtgccaaacactgtacaataggttcc

SEQ ID NO: 10972 - DNA, 201 bp, Bos taurus
tacaacaggcaggaaaaaaaaaaaaatacatgctaaaacaaaatacttctttgctcaagggaataaatcttaaatctgaaaatgtgcaatatgaggtagatagttgtaagttgttacaaaatggatataatttcacaatgaaaatacttaaaaatatctgttggatggacatcttaacattctttttgtgtcataaaggga

SEQ ID NO: 10973 - DNA, 201 bp, Bos taurus
gttactaacttagatctactctctcattacaggtctcaggggagttgcattttcaaagaagcacataatacagtatacaggtttacaagtatacacactgcgagcatatcaagatttcattccactagcaggaccttggcggtccaatccccaagcaaacacccagggctgatctccagagatgtttctgaatcttaatca

SEQ ID NO: 10974 - DNA, 201 bp, Bos taurus
tctggttctcaatgacaaagaatggcctctcaactatcattttggtaacatgggaaacttagaagctacagagtatccacaaccaggatttaatttccaacattttatttcagattaaacatcacaaagaacgggattaccttgcagaacactgaagaagtaggctgggaagtaagaatcaaacaatgggaaatttgaatc

SEQ ID NO: 10975 - DNA, 201 bp, Bos taurus
ctctaaaaggaactttgtgacttgaaataattgtttcttatttcagcctttcttttgactttggcactatcccattcttatctgggtttttaagatgtttgtgaatttcctttgcgtctagctctgaattcttgttatggtcaaggctaattttaggactccctactgtcaaaaagcatacatttttacattgcaagtatt

SEQ ID NO: 10976 - DNA, 201 bp, Bos taurus
ccagtattcttgcctgaagagtcccatggacagaggagccatggggtcacaaagagtcagacacgactaaagcgacttagcatgcaaagtgaacttcaggcctattgcggtgattttatctcttacgtggatttattgagtttaattagtgtttataattatcccttttagggaactgtctttggtgtatgaaaaaaggct

SEQ ID NO: 10977 - DNA, 201 bp, Bos taurus
tgggccaggtgctcagctttatcagtcaggggaggacaaaaaaaaaaaaaaaagccacagtgcccgaacaaaaccgcaggtaggagtagatcctcaaatcaaaaggcctggctgtgaacctggctctatcactgctagctgtgcaaagtaaacaagagatataaactctctaagcctcaactttctcctccgtaaaatggg

SEQ ID NO: 10978 - DNA, 201 bp, Bos taurus
gaggtgaaaagatggcacctgacagcctggtgaagatccaccttaaggtgggaaccacacctgaggtggctgagagtaagtttcagagaaaacagactgtgtggcctcagctagaaaaagagaaaccaggaaatatctgacttggttcctaaccaagtccctaagccatcctcagaaaacttacttgtaataacaatagct

SEQ ID NO: 10979 - DNA, 201 bp, Bos taurus
tccctggtcaggaaactagatacagaatgccacaactaaagatctcacattcttcaactaaaaatcatgcatgccacagggaagattccatgtgccataactaagacccagagcagccaaagaaagaaagaataagagaaattcctctgggtacgaatgagttaaatttccaaagactatataagtctatttgtttctacg

SEQ ID NO: 10980 - DNA, 201 bp, Bos taurus
ttcctgcttcctctttttttcttgccttccctttcccttcccttctcaagccatttggtcctaaatctgtaaggcggccataacaagatagatgtttcactggactggaagcggcagagctctagggaataaagacagtatctccaagggtgtgcaggggtgggcccatgtgctgtgaaggcccaggttggaaagagagtg

SEQ ID NO: 10981 - DNA, 201 bp, Bos taurus
tatctatactaatttcaatgaaaacatttgagaattaacatgatcttaaagagaaaaatagtctttgagactacagtagaacacacacagaccattgtttccatgggcactcctgttataacctctccccaaagaaagacatgttaagttcctatcccgtctactgagagaaagcaatagattaagtgctaactcaaattt

SEQ ID NO: 10982 - DNA, 201 bp, Bos taurus
ccttcccagaaaggtgcaccctctgccttgcatgactctgtgggagttttgcttcctcctgtggcttctttaaagaaatcccactgacttaggcctccaattgactttcatctgcactctcacattctactgtttctgtgcagctttactatcttctgcagaactctgagatgactacccagactgttcatattatctcct

SEQ ID NO: 10983 - DNA, 201 bp, Bos taurus
tttatagattaagtgggtcacagaaacctgtaggattttaattacccaaagtgctaagggaagaatttcattcagttgtttatttcagaagacatctgactatgttccacctggtcaacggcagctttccagaagccactcagaacacattctctttactactatcagagtgcgagtctgtctagatgctgacgttgaaca

SEQ ID NO: 10984 - DNA, 201 bp, Bos taurus
atgagtgggtggttctgatgatgagtaaagtttctgttaataagaaggacctgacaatcactgatacactctgtaaagcctcctgatttaatagttagctaaacaaacacttgcaaggttaaaatgagaaatgtgcaaatgtatggtgtgattatttctaatatattttattaaaaagctccatgtgggatatttttaatt

SEQ ID NO: 10985 - DNA, 201 bp, Bos taurus
ttaccttttcacttacagggagcactttatggcctctcttcagaattgccagcattgtttctcttgtgctttggagccgttaagtaaaataagggccacctgaacacaggcatggtgataccctcgatggtcagtctgagaaccaagagggttgctaagtgactcatgggccaggttcgctggacgaagggatgattcaca

SEQ ID NO: 10986 - DNA, 201 bp, Bos taurus
aagaggtggtttacatgaaaagcaaaacagagaggggctgtagaattcagcaaaaccaggaattcagatcagaggtaactggaaaacccgagtcacccccgagaaccatcctctgctctgtgtttcccctccagaagttgaacaaggcttcgagacaaaaaaatctcagaggccagcatgtccctggcagtctagatgatt

SEQ ID NO: 10987 - DNA, 201 bp, Bos taurus
ctttgtaatcagggttcatggaacggctgcatagtgatttcatccctggccaaagatgccataaaaaagagaaatattcagtgatcaccatttcacatcgctgtaaaagactgagaattggggcccagaaagctcggcttccagcaacattctgctttgacaggaccttaaaatgccttctggagtcaagacagggagaaa

SEQ ID NO: 10988 - DNA, 201 bp, Bos taurus
cagtgatagacacctttctgcgcgactttggtgcctgacttttcgaagtttgcgctcagaagctttttctttcttttctttttaaagaagtgaaaaggctgtcgaggccagctccttctcgtccacactcgttgtgggccgcccactcctctcccgcacgccgcatctgtaaacctgagcggggctccagcgctgggcaga

SEQ ID NO: 10989 - DNA, 201 bp, Bos taurus
aataggtttagaggagtgaaagacgcagatgttggttaagaattcctaaaagggagagtaacatatgcaaaagaaggaataattaattaaacgaaaaaaaattttctgagttgataatttagcatgagtgggagtaaaggacacatcagatgaaacaaggaagccatatgttggtaactgttgaaaccaaatgatgactac

SEQ ID NO: 10990 - DNA, 201 bp, Bos taurus
agggtctcctgcattgcagtcagattctttactgtctgagccaccagggaagccccatagactttttgtattgaacactaaaaaaaaagaaaaagaatttctaattgttagattattccaagttataatattggacctactcttttttaggatttctttttggttggaaataattcacagaatctgacatgtatatatcat

SEQ ID NO: 10991 - DNA, 201 bp, Bos taurus
tagctaaaattaaaaaatacatattttatctgacatataggtatgagtgggacagacacgctagacagagttctccatacacagggaactcagtgaactcagggttatcactctactgttttgaagatagattttatactaaggagtactgtgtggggctctcctggtggtccagtagttaagaatccaccttgcaatgca

SEQ ID NO: 10992 - DNA, 201 bp, Bos taurus
gagtagttgtttaatagcattgagaaagtaagcctttggcgattagccaaagaagactgcatctatgtataggcttgcagttcagaatgaggctgggatcatttgtatcgagggtgcaattagcctggcctgagctgcattttgaaggatgactttatgacagtctgtcatgacaacaagggaatattttatgtacagaat

SEQ ID NO: 10993 - DNA, 201 bp, Bos taurus
tggtataataggaaaattgctggtattttatgaaaaagtgaaatgtagcagccataattttccccattttgccctcatgcagagagtccaaggatgaggatttcatgttcctgacttttgggcttgagactctccaagacagagtaactagggaacaaagtcctggtaaaagtaaatgaatatttctgtgagatgtactca

SEQ ID NO: 10994 - DNA, 201 bp, Bos taurus
tttctgtttttcaaacaggaatcctaatttattctaatgaaaaaaaaatttttaagtggttggaaatatacccaaaaatgaacaatttatctgttcgtgtgatggaatgactgtttctttcaaagcttctaataacatggccattttatttttgtaattgaaaataattattccaagaaaaaataagcataatgtaatact

SEQ ID NO: 10995 - DNA, 201 bp, Bos taurus
acaggcaggctacagtccacggggccacagagaggcagacacaactgagtgactgaccatacacacacacacatacacacacatacacacatcactactttacaaatgaggaaacaggcccatagaaattaagctacttgacctagatcacacagccaaaggggcacatttgaacagttccagctcttggtctcaccccac

SEQ ID NO: 10996 - DNA, 201 bp, Bos taurus
tactaacaagatgaattaacctttgatggttaaaaaactacttttctcctcccactggaggacttggagaaccattagccagaacctggggagttgaaatgtcattaatgggaaactgggtcagatcgacaaaccctgaatctccaggctgctgttaggagccatgtcgaggaccacgatcagcctccccaacctgggcac

SEQ ID NO: 10997 - DNA, 201 bp, Bos taurus
accttcctaacctagagatgctgggtccatgcagtggcctcttagacatctttctgctgcacacacactattagttttgattggaggcttttatttatgatcaaaaggccatttctcaggtcatgtaattatgctaaaagccaagaccgtctggcgactacaacctctgagagcatgtcaaacaccatcatgatttcaagg

SEQ ID NO: 10998 - DNA, 201 bp, Bos taurus
tcaacaattaggcctgctccaagtaagactgactggttcttgagttcagggtgcagatggtgagacccacgtgtcagggttttcccaggtcctccaagtgttctcctggggcctgccgtctcacacactgcttcatagttgtctagttcttttctgctcttcctcttcgtctctgaactcctggagtcatgtttctcacat

SEQ ID NO: 10999 - DNA, 201 bp, Bos taurus
ggctggatgaggtcccagctttcaggcctctcagcaccatggctgtgatcagcagaaacactcatcagccttccaaaagtggggttctgttggccttgtcatgtctgtttcaacaaacagagccctctccatttataagggacacttgaccacactgagatttaggggaatacactatagcagacactgctggggccctgc

SEQ ID NO: 11000 - DNA, 201 bp, Bos taurus
aggcctggcatgctgcagttcatggggtcccaaagagtcggacatgactgaacaactgaactgaactgaagacataggtactgactaggcaggacagacaaacaatgaatggatgtggccattctcattcatacagttgaatatctccaggatgatcgactcaaggacattgaacacaacattgcatctctgggtccagcc

SEQ ID NO: 11001 - DNA, 201 bp, Bos taurus
ggtgatgagtgctagagctgagaggggccaaagcccaacttcggagcctcagcaacccacaatacatcagtccagggtcaacaagccccgctgcactccaaggccagaccttcctccatctgaatgcacagtcctcgccgtgtcaggccacctccccacaggcaaacaggccagggtcagggctcttcggccaccttgtca

SEQ ID NO: 11002 - DNA, 201 bp, Bos taurus
ctcagaggccgttcctcccacaaaatgaaaataataaaagctatgagacaggactgtcaaggggactgaatgttacaatgcacgaaacatatacaatagctcatggccattggtaagtgctcagtgtacgtgagttgctgctgcagcaaagcatagtctgagataaaggactattcttggggaggcttatttttcttaaat

SEQ ID NO: 11003 - DNA, 201 bp, Bos taurus
aactaacaaggccactatttgccaagaagagtctgagttatccattaaccaggggtgatctatcagtgcctggaagccacacaaaggacaagggttcggtgagcctgggagggcccacgatggggcccacgttaaagaaatgtcaacacagtgatgtaatatcctggcccccaacttccttcccttagaagcttccggttg

SEQ ID NO: 11004 - DNA, 201 bp, Bos taurus
gtaaattcaggcagtgttggggcccgtttcttaatacaaatcactgtagcttgcattcctccgaggtcagctctttaccagctgtaagtggagctcaccttctaatgcatttttctcacaatactctgcaaggttgatttaatcgactcatttgtttttatgggagtgaatattgaactctatgagggagatttgattgtc

SEQ ID NO: 11005 - DNA, 201 bp, Bos taurus
gatcaaatcagggccccagcagtgaaagcgctgagtcctaactactggaccaccagggaatcccgcaacctctttgtttttaaaggtcaccccgggagagtcctgggccaggcctcccagcagcttctagaatgttttgagtggctattgggagcgagtcctggcttggggtcgggaggcctgagctctgcactggtctga

SEQ ID NO: 11006 - DNA, 201 bp, Bos taurus
gggaggcgaggcacggcgtctggaggaggcacgaagaaatgtgtcagacaaagctcatcagcacctcagcacctggccaaatagtaattaccagtgcctcgtgccacccaggagagggagggcgatatctttatccccattttatagaacggtaagtggaggcccaaggaggttacacaactgcttttagccagtcagtca

SEQ ID NO: 11007 - DNA, 201 bp, Bos taurus
agacaaactgccagatttttcatttccaggattgcaaaggtcatggagctggctatcgggaaattaaagttagctgcgaattggagtgaatgggaatcaacgtgaagtgagactaagagatgcctagaacatagaatgaaattcaccttctttgttgaagcttttcagaccctttgatgtaagtccactggatagtctatt

SEQ ID NO: 11008 - DNA, 201 bp, Bos taurus
ctcctggggcctgaggaagcacacagcgatgaaggccgccaagggccccttctgcgcatgctcggagccaagcgtgttgcacgcgtggccgcatctggtctcttgacagtctgttgacaccaagactgctctgtccccacctccctggagacaatgtctcaaatccaggaagctgtcctaaagaaactgatgctggataca

SEQ ID NO: 11009 - DNA, 201 bp, Bos taurus
caaattccctttcccctcccatagaggggaggcctggtgagttaaagaaatccgcttagacacttagctcatgccaggccggtgtccacggagacccaagggagaaagttcatagtatttttccttgccaggagctgacactcacctaaattggaggaggggcgtctgtgagccagtaaagcaggcccttggccagggggg

SEQ ID NO: 11010 - DNA, 201 bp, Bos taurus
atatgatctcatttaactctatgaagtaggtaaatagcattgttaccatctttcccttgggaggaggaagtggagacttagtatgattaaacagtttgcccggatagcagaattggaacttgaacacagctcccaagcaatgacatttctattgcatgaacccttaagctgctagaggaagaatgtcctgaaatttaaaca

SEQ ID NO: 11011 - DNA, 201 bp, Bos taurus
agaggccactgctgccggtagtgtgagcccaatgcaatacatatgaaagtcaaccttagaaaaatggcaccagtaacttgctgaaggaaggcaatctccatatcaattaggccctttacataatctctgatttgtggttacacacattttaaaaacacaattagttatgggccagagctaaagaagtctttgatgcataat

SEQ ID NO: 11012 - DNA, 201 bp, Bos taurus
gtgttctcaataataggcactactaacatatcatcgtatctgtaagacaaaacatgctcctttttaaaacaaaagaattcatatataaaactgatcactttttcaaataataaactagacattctctttatatcggagaagccactccaaattatgaacaagatgttgcatgtcagtctgtgtatcctgcatgaacaacta

SEQ ID NO: 11013 - DNA, 201 bp, Bos taurus
aggagaaaattaaatttgttgacaacatttaaaaactaggaacttcagataaacattctaaatttttgtcttcctttgaaaattttaagttaggacctatatggtgacagacgattgagactgagtaatgactgttctcttcaggtaggaaattacatactttgtagttgaccattttctcttctgttacctctcagccag

SEQ ID NO: 11014 - DNA, 201 bp, Bos taurus
aggaagtcatttattaagggtctgctaatatctcccagggctaccctaagaagtcaggttcccttatggcacaggaataatgtggttgaatgtcaataccactctaccctcttctcttctcttctcctcaaagtcatgtcagtcatcatatgaggcaggaaggctcacaaacattaaatattccctagcaattagatttaa

SEQ ID NO: 11015 - DNA, 201 bp, Bos taurus
atgttgagttgtgtgagttctttgtatattttgggtattaactccttatttgatacctcatttgcaagtatctcatcctgttcagtagacggcctttcaggttgttgatcctttccttctttgtgcacaagctttttattttgtttcgtgctgtttgtttgggcttcccaggtggccaaagtggtgaagacccacctgcca

SEQ ID NO: 11016 - DNA, 201 bp, Bos taurus
tcagaggctccaggatggctttcctggccttagcctgccaggatggctcctccttggacaagttctcccttctccccatcaacctggatggttcttttcccttcacatggggcctgagaaagttgaccttcttctcttcggtccctttttgctctcaattcctgctgagcctccaaggctgtgagcagggtttggggggag

SEQ ID NO: 11017 - DNA, 201 bp, Bos taurus
cacaggtgcttttgacttgcatgtgatttactccaggagtttgatggagtgaatggagtgtcatgccccagctggaatggcctggtctgttgaaatttgtaggctggtcatcagatatctcaaaatgtcacagggacagcctgtggtctggcatcccagtcctcggccaacctgtcttcattctgccctgcctgacctgcg

SEQ ID NO: 11018 - DNA, 201 bp, Bos taurus
aatcctgtatgacccaaaacatatatgtctgtgggccacctatggtccacgggcatccgataccccaaatctgctgctatgggaagagcggagcttgggaggcagacaggcctccacccacttccaccttggccaccatctccgggatccttcaggcacaggggctgggaagctggggtggcaggggcacatgatgggaag

SEQ ID NO: 11019 - DNA, 201 bp, Bos taurus
gactcgtgaacccttggctattccttagatgataatgatcatggccacaatagcaaacactgatataaggccttaccacgggccaggcgctgttctaagaatgttacgtgtcatgatttcatttaatccttttgatagccccataggggtagaggctgctcctggccccattttccagatgaggacaattaagcacagaaa

SEQ ID NO: 11020 - DNA, 201 bp, Bos taurus
cgctctatgccagtttagcttcccatggcagttgggttttttttcttgaagattttataaagctgagtataaaatgggaatgttttcataaatgcttaagtatctttagcgaggctaatttatagaatttaaatgttcctcttaggcagtttaaacccaaattccccagcagcagagactggaggctgagaaacaggaaac

SEQ ID NO: 11021 - DNA, 201 bp, Bos taurus
gcccgtcgatgaggctgtgtgcagcaagtacaaataaacacaccttgttgcttttcgtcttcaaagagacggatgaaggctccctgctggggtgcgaggtgttttttcctgacagtccacttcggcctttacctttgtgataagtgacggagaggcacaggatgtgagccaggagcagagggagggcctccaagactggtc

SEQ ID NO: 11022 - DNA, 201 bp, Bos taurus
catcccatctgacctgtgtcccttctaaaagaggaaatttggacacagagagagaccagggatgcaggcatgcagaggaaagtccacgtgaggtggcagcgaggaggggccatgtgcaagccaaggagagaggtctcaggagaaactaagacttcccacaccttgatcttggacttctagttcccagaagtgtgagaaaat

SEQ ID NO: 11023 - DNA, 201 bp, Bos taurus
ttcagcctggcctttcctccccgtgtgaccccaggcagttcagttttgtgggctggggctcctgtttcctatcgtgaaattatcttccagtattcctgtcaacttggccggagttcaaggattctgtgatcatagggccgcagagtctgagacctggaaggaacctgcagttccctttgttggaggtgctgagagtccctc

SEQ ID NO: 11024 - DNA, 201 bp, Bos taurus
ttcacaaatctgagggtaaagactgcacggcaatgaggggcttttaaaaagggaaacttcacagtttgtcaggggtcctgagggcaggtgaggatgaaggctctcaaaagcaaaaccttcttttggcaaagatgactgtcactgcccagcaagatggaaggtgatggagaacggactcttctttattcatttttattcaaa

SEQ ID NO: 11025 - DNA, 201 bp, Bos taurus
cccctgagccttgaccactgtctacccccctgcccagagcctatacagttagtccaccgtacacacaccctgaaatttgccttaagcctggtaaatgctgcagaggccctgggagaaatagagtgaaacctgagttgtctggggtctttgcagagattttagtctgggtatatctgagtctttgacggggttcactctcag

SEQ ID NO: 11026 - DNA, 201 bp, Bos taurus
atttggcctttgtgctgagagcacggagggcgttgcagtattttaggtgagggatggcattaggtttccatttagaaaacatttgcagtggtgaggtggcggggtgggaggccaggagaggaggacggtgagatgggatatgaggaaagcactcaggaggcccctcgacacccccaccccacccatcacatccccctgctg

SEQ ID NO: 11027 - DNA, 201 bp, Bos taurus
gttccagttttttggccaaaagacctgtgggatcttagcttccagaccagggattgaacccacaccccttacattgggagatagagtctgttaaccactagactactagggaaggccactgcctcattcttctgatcacctttctagttccagcactgtttcagctcagtaactgatacaccgaggtctgtgcagtaaccc

SEQ ID NO: 11028 - DNA, 201 bp, Bos taurus
cgttccacatcagcatcagaagccaggacttcattatattttgctctttatttcgaaggagtttcatctggttatctgtcaaataacctggtattttattggaaatggcagaggagtacactgagtgattacgagaacaaatagaacttgtccttagagagcatctgttcttcccagacatcactgtgcttttcaaatatg

SEQ ID NO: 11029 - DNA, 201 bp, Bos taurus
catgtctccgcgagcctaggcaatgctctggcagggcaagcattcagggctttgagagcatcccctaaaggcacaagagctggcctctgacctcctctctccctcctctcctgtctcccactgctctagctgcactggtctcccagccgtttctgggacaggcctgctcttccctctgggcctttgctcttgctcttccct

SEQ ID NO: 11030 - DNA, 201 bp, Bos taurus
accagtggaaaaaccagagctcattagcctctctcttcccataagcctctccacatagcaaacttgggcttcctcacagcttggccatctcaggacagtccgaccagttagatggcagctggctttccctagagcaggcattctgagagagaatactgctactccttaaaggccaggtgaagcatcacttctgtctttttt

SEQ ID NO: 11031 - DNA, 201 bp, Bos taurus
cagggaataggaaccttgcacataaatacagtttgtggctttgggattccacagctgggagctctcaacagccactgtgtataaatatgcctatggagtttagttctaaataatgacagtcctacattcaggattcacatggcttccaggacctcagtcagttcagtctgactctttgggacccgatggactgcagcacac

SEQ ID NO: 11032 - DNA, 201 bp, Bos taurus
ccttaagggagctactggtagcaaatgcagggtctgtaggcacatgagtggtatcatacaaaaaggagagtcagagtgcctccagatggtcatctgtaatgtgttgcaggattttcaaggaggaaaggatcactcacaactgtgaagatcctagagggtttcttggaggaaggagcatttgaatgaaaccttaaaggatga

SEQ ID NO: 11033 - DNA, 201 bp, Bos taurus
ggtggcgttgtaaaatggctagcaatttgggggctttgaagggcccttaagtgatgctgtcttcagcacttcagatctatttggcatcttcaaaggatattcctgtccatccatctggcctgatgtgactaactccctgagcctcttcaaaagaaagggcatctagttcagtattgcttcccgctgtggagcgtcttctta

SEQ ID NO: 11034 - DNA, 201 bp, Bos taurus
gctcttggtttctgttactgacagagatggtttaatgttggccaccagctgtggccgtctgtcttgttcctaatccaatttagcaggccagcactatgactggggatgctcaccatcccagattagaagcttacacatgaacttattcagcttctgtacattttaattctccagagacaggccaaacctggcaatttttct

SEQ ID NO: 11035 - DNA, 201 bp, Bos taurus
aggatttagttgcagtgtgagagaactttgttgcatcttgtggggtctttttgctggagctgggctctctggttacgacacgtgggctccagcctgggcccgtgtagtagttgtggcatgcttagtttccccgaggcatgtgagatcttagttccctggtcagggattgaacatgcatctgttgcattgcaaggtggattc

SEQ ID NO: 11036 - DNA, 201 bp, Bos taurus
tatctttctgtttacattataatgagaggaacttaatactcaggagcatatctgcttgtgatctctagttgacactacaaaatgtagaaatcccttcttgcaaaaattaggatttcctcattctaaagttcttgaaagttgcaccagaaagatcaattagtttcattaatcagtggtcttttctcaaaatagattaggact

SEQ ID NO: 11037 - DNA, 201 bp, Bos taurus
aaatgttgactttcagattaggagatcaggagtccagcattctgggtttcactgtgtaattcagatgtagtcactacaacacattaataaattggccttcccatgaaagccattattctaagagtttatggttcatttcctgttgacatctatagcacagatgaaaagtgataatatcaggtgggatggaaacattcatga

SEQ ID NO: 11038 - DNA, 201 bp, Bos taurus
aaggaactggtaacgagttagattataattctgccgcatagcaaatcatcaaaggcccagcatatatagatagttaaagatagatatttatttatatatagtaggcccaatacacatccctaagttgtttttacaggaaatagattccttccagataaaaactgctgaccatgagaccatagatgctagactggttgaaac

SEQ ID NO: 11039 - DNA, 201 bp, Bos taurus
ctaaataataatagtttagtcataggcatagctaaggatatttagttccttttcatgagctatagataatattctgagccatatcctgtggactgtattacaggtactgacacaccccgaagcagaaaaagttaactacataatgacaagactgtagccgtgacttacgttcctcatcattctaagaattgacctcaagga

SEQ ID NO: 11040 - DNA, 201 bp, Bos taurus
cccttggctaagaggagactctgccttgggcccactggtgtaatagtaataaactgcactccactatctgcattgtcctgagtgagtttgtttcccagaatgtgtggccacaacagtttaacaggtcttaattgttggaccattcatttgctttcttcctttgtttaaaaacaagagtcaaggatgtgcactgaactccct

SEQ ID NO: 11041 - DNA, 201 bp, Bos taurus
atctgtggactaaaatcaaggtgttaagaggcctctaaccctttctgaggactccagggaagaatctttttccttgctctttccaggttacagaagctttccacattccttagctcatggcccttctcctcaatcttcaaattagcaaatatgagtcaggttcttacatcacattgacctaatctccccttctaaaccctc

SEQ ID NO: 11042 - DNA, 201 bp, Bos taurus
gtttccctttctttgcattataaaataacaaaaaaatgatgttcaaattttctatccaacagttatatggtctctagtttcaatctacttaactaagtctatatttctttttcccttccagttttattgagataattgaacatctctcattgtatacatgtaaggcgaagaacagaatttgacatatggacatacttcaaa

SEQ ID NO: 11043 - DNA, 201 bp, Bos taurus
agtcaccctctgtgttttttcagtcttttaagtttattgaggctttcacaggctaagtcaaagatctctcctggtaaatgttacactgcactcaaaaatatgtcggttattttcaaatatcttctgatattgatttttagcataattctacagtgataagagaacagactctgcatgatttcaacacctttagaccatgaa

SEQ ID NO: 11044 - DNA, 201 bp, Bos taurus
ttggaagaaactggcagcattccacaatttttacactgtttaaaagtatcaactgtggccttgccagaattccatcactgacatttgaagaggccacctcgggtctaggagaaccatgctttaccagctaaacatgagaagaaagaagtaagggtaagaacacattaacagaataaagacaacaaaggcctttctctgaga

SEQ ID NO: 11045 - DNA, 201 bp, Bos taurus
ttagttcacaatggagcccattttaattaatctctgattagagctgaggtggaacaattcaggaatagatactatttcaaatctatttagaacagtgtgtgtgcagaaatattagaaggatcagggattttttttttttttttttgtcttatagtacattcttatggactctgtgggagagggagagggtgggaagatttg

SEQ ID NO: 11046 - DNA, 201 bp, Bos taurus
agagtcaaaggtatttacttatttctacagccccattcattgtactgtaattatctagtgaaacatgaagccaaatctagaggtttaaacatatcaagaacaaaattctaacttttgaagagtactgtctcatctatttgagtttaagcaactcaaatatgattcataattctaatcaagaaactaacattttggtaaatt

SEQ ID NO: 11047 - DNA, 201 bp, Bos taurus
gttggtaatggacagggaaggccggcattctgcactccatggcgtcgcaaagagttggacaagattgagcaactgaactgaactgaactgaactgaacttttcaacccatgatattttcttctatatggagaaatttctacttgtgggatacatctggcccccattttaaccaattttcattacatctgagaagatgaata

SEQ ID NO: 11048 - DNA, 201 bp, Bos taurus
ctcagggacctgtccagttggaaagaagttgtgcactgcagccacagcctgtgtaggatcaagaggaggctgctggtgtgggagggcactttgtgttcctaaaggttcagacaaggccctcagatgtggccatggagggtctgtggtgcctggcctagtcttaccccctgccttgcaggacactggggctgcctggaggga

SEQ ID NO: 11049 - DNA, 201 bp, Bos taurus
aaaacttaccactcattatcaaatgaaggatgggggaatgttaataatgatttcccttgtttttgatatctaaaatctccctctggtcttttttcttatcgcatacaacctaataacaggacagattgtgtccatagccatacatctctgaatggataaatgaaaaaattgtgcatgaagaaaaacaagtatagtttttgt

SEQ ID NO: 11050 - DNA, 201 bp, Bos taurus
aagaaattcaaagcttttccagtaagatgagcaaccagcgaaggatatgctctctcaccattcctttctgacattgtacactaaacaatttgccctgtcatacaaacaattttagcgaaatcctggatgtaaacgtaagtctgactgcaaaggagtcttacttatcccaatatatactgttactttatagtaacaccctag

SEQ ID NO: 11051 - DNA, 201 bp, Bos taurus
taatcaaagaggcagtaatgtatttatgttgccaaaggatgaagctgtttgctttagctaaactacacattcattttatgtcaactaaagaaaaagagaaaaacatccagatctttatcaaattactgtataattagttttagacattttttgattgacacaatatgaaacataggataagttttgaaatatagcaagaac

SEQ ID NO: 11052 - DNA, 201 bp, Bos taurus
tctatacattaaggttcagatcacctgccatctataccacctacactgtgcatgaaacatttcaaaccagagctaaatatcagctacagaagtcatttcacgttctcaattctcctttgctgaacacaatattattttgaaatgaaagtctgattcactcacatatgtatctacttattttatcagcgacacaatgcctat

SEQ ID NO: 11053 - DNA, 201 bp, Bos taurus
taacagaaagtgctactggtttactttattctcataggacattcattatcctcagaaaataagcattacttaatttctgaattggactaggatatcctcaatgagctttttagttgccggtaagatggatagggtacagaaggctgaataatggcactatccaggatcttctctgtgcctaaccccatagccagataatgt

SEQ ID NO: 11054 - DNA, 201 bp, Bos taurus
cataatgctcccaaagtgtacttccaccctatttatttcagtgataaagttgagattccctgagaggaagggaaggtaaaaatggagagagactgggttcttatttcccaagtacttaatattccatgcgtgaattgttcatctgtccctattctcttttccctgaatcctaaattcattttacactcccaagacagagag

SEQ ID NO: 11055 - DNA, 201 bp, Bos taurus
gaggtatataacaaaaaccaagtatttcactttaagataggaaaaggagtagtttatttgatacgtgttatataaagggggcattatggctcaaaggccccataagtatatgggtcacatattgtgttatggctgtcctaaggtctggaatctattcagaattaccgcagcatcctagtcaaggaagtgatcatcaattca

SEQ ID NO: 11056 - DNA, 201 bp, Bos taurus
actcctgacggtctaataggcatcaccgcatcttcaggttcctgacactgcccacagcccacgtcttctgtttctggccttgccttatatagcatgaagcaccagaatgatcacactgcaaagtctgcacactacccctcccccatgacgtgacttgcctggcctctggcaaatgcccaaggagaagatgagggtccctct

SEQ ID NO: 11057 - DNA, 201 bp, Bos taurus
caattattaaaacaatttatttcttagcatgtaaatcatgttttactcagcacatttgctgatttcttcttgtcctctcctggtttctggtttctatatacaataatgcacaaataaaaatcttcattggaattcaacacttcctgctgttatcattctcctattgaagtttcagtcctgttcacatcataattggtttct

SEQ ID NO: 11058 - DNA, 201 bp, Bos taurus
atcctgttagaaatactgaggttgatggtcagtgctggaagctacaattctgctacgtcacagaactggaaccacaaagtttggacctcaggcccaaaccatcctagaggaagtgctggtgttcccccaaccatgaagcttatgagccccacagctcaaggctgagggccctttcaagtctgatgtcttactcagtggatc

SEQ ID NO: 11059 - DNA, 201 bp, Bos taurus
ccactccagtattctggcctggagaattccattgactgtatagtccatggggtcgcagagtcagacgcaactaagtgactttcattttcactttcaagccgttggccagcttctcagtccaagtcaagacagtgtttccaaaagccaccaccaaggtggtttcaaacttagtcacttgagatgaattttaataaactttct

SEQ ID NO: 11060 - DNA, 201 bp, Bos taurus
cctttcttctttagcagggcatgtgactgtaataaagtttataattcccagcctcccttgcagataagtaaattcatataaataagttttaggtaatgtgatatcaagggaggtgaaatgcaatttaagcaggtgttattatgacataaatttcattgcctttcttttttttttctgggaaaaaaaactgactgatagctg

SEQ ID NO: 11061 - DNA, 201 bp, Bos taurus
tctctctccaagaattggtaattctgatacattttgcaactcaaaagagatgttctttctttgtaattcacaaaacaaattaaactcatctttccaagcaggtaaccatcctgatttgaagcaattccatgctcatggttcttttcataaacttatttgaaaatgcttttcaaaggggcattagtgttttgcgtttacatc

SEQ ID NO: 11062 - DNA, 201 bp, Bos taurus
taaatggacctgaaatgaaaattctgtcttatttaagaatactattcacaagtacaaagatgtggccttgttttccattgcctggcccttgttctctttccgactcttcattcaattatgaagagcacattccaagtagcctacatataaaaggaatgtttttctgattaaatatcgaacattaagatggtcaggcctatg

SEQ ID NO: 11063 - DNA, 201 bp, Bos taurus
gcgtcttgaaaatgttcttctctctagtaaattgaatgtatggtttttatgcactagccacatttccctcctcatacttagaaatccttttatgttttgcagactctcaagcattttcaaaaaccatccattcaaactgggactgttctggcttgtcttgtgtttccaagaatatacagttattctagaaggctttgattt

SEQ ID NO: 11064 - DNA, 201 bp, Bos taurus
aaccgttcctggtaactctactcaacactgctcactttgttgacagcccatggtgttaattatacagaatgtgttaacacatttatctcttcatcagagggtctctgctgggctcctgtgcatattgccttattaacacatctgttaaattcctgtaagtcagggattttgccttatgtttcctctcggtctcccatggca

SEQ ID NO: 11065 - DNA, 201 bp, Bos taurus
aagtagaatcaaaagaaaaggcaaatcaagaaattagatcaaagagtcagcagaggaccagatggtgtagagcctcacaggtttaagaattttgtcttcactctgagagcaagtctttacaccactgaagaagtttccctatgaaggtaaattcatcttacttttttaataggatcatttcagctgcctgcttagaagatt

SEQ ID NO: 11066 - DNA, 201 bp, Bos taurus
acatgtatacgctccaacactaaggcaagctgtttaccaagtgtccacaatatactactcattctgaagaccatcagatttaaagcagcttattctagaggtctgcaggtggtgataactgataattccaggttccgtggtacgtgcaggggtggggagctgtcacgtctttgaatggtgagacttctaggtcctagagag

SEQ ID NO: 11067 - DNA, 201 bp, Bos taurus
tggtccacatcaaaatattatgctgctgtcattatcttatcctcaccatcatgcttatagttattattattgaaataatcaatggatttctgagtccccaatagcacttttttctcagaatcctcagtccaaaacaaatacttcataaatgttgtcagttttttattaaaaaaaaattgcacagcttgggaactcaaacag

SEQ ID NO: 11068 - DNA, 201 bp, Bos taurus
ccaggtgacataagagaaagaaaatcaggcttgtttcatggatagaccagctcaaaatactgatgtgagcaaaatggactgcattcagtctataccaccacttggcagctctggtgaggaagactctcccagtaagcagaacatggaggtggatctggccagctccttcctacagggaatagaccggcacacaaggatatg

SEQ ID NO: 11069 - DNA, 201 bp, Bos taurus
gagggaaaattgaacacacagcaagacctctgaacaagaagtaatagccgttaaattgaaacacgatgcaaggttttcctaaccatgagctcataatacgcgtgttcatagaaagtgatgtgcttgctgcctgcagcaaaaccagatgctctctgtttccagttgatcaatgttgctgtaaggtaggagtacatgtctgaa

SEQ ID NO: 11070 - DNA, 201 bp, Bos taurus
gtgtccttccaacagctgagttagagggaaccctcatggcaagacttcagatctccaagtcagggaatccagatgttgaggatctaccacagtgagactcgagaaggccatgagatgactccctgacatctcatgaaagataattaacctgagcttgaaagtaaagtgaagcgttagtcgctccatcagggctaaggatag

SEQ ID NO: 11071 - DNA, 201 bp, Bos taurus
tggcagcaatggctagacacatgagggcctcacgcagatgtggtcagattgaaaaggatttgccctgtggctcaatctggactgagacccagcagaaactcgctggccctaactctgccagaaactggcagggtattctcctgcctaaacttcaaactcttcattttcaaaataggtaatattggcatagtggatttccaa

SEQ ID NO: 11072 - DNA, 201 bp, Bos taurus
cttgcatttgagaccatcttaaagctcatctgaacccagtcacctttgcatttcaaggatcccacattctgatggccatcgttgtctcagtttaaacccttctagtgaagtgaggtaaagactgtcccaaagatgtcacttcatcgatggaaatgcctaattgtataggactggcctagtccccattccttctcaattctc

SEQ ID NO: 11073 - DNA, 201 bp, Bos taurus
aagtcagaggcctcacactttctgacttcaaactatactacaaagttgtagtaactagaacagtgtggtattgacattaaaaaaaaataaaaggatacatcaatggaatcgattaaagggcctagaattaaacactggcaaatttgctcaactagtatttgacaaaacagccaagaacatccaatggggaaagttgtccct

SEQ ID NO: 11074 - DNA, 201 bp, Bos taurus
tgagagacagagagaagatgaagggggtgggaattattatttcccaagcttatccaactagttgagaggttcagctgtttcttctttccgctttccagagcgccctgcaataggctcctccttgccacatccactcaggagacaaagaaggctgcctctcagcctaattaaaagtcctaaggcagcagaagagaagagggg

SEQ ID NO: 11075 - DNA, 201 bp, Bos taurus
tggttattagaagtaataagtactcagtacttttttttttaataagtatgaccccatgatgtaaacaatgggcagacattagcagagggccgtgaatggcgctgtgaggagacaatacggtacagcagaagttacaccccaggggagttaggagacagccatcctgcttcacatgagactttcctggtttagtactgaaag

SEQ ID NO: 11076 - DNA, 201 bp, Bos taurus
gaatatatccctaattgctgtttgcttggattattttgaaagcggtcagagggctttccactttgctgagtgctttatacatcacattcaaattttcactgactatttaaatgtttggtccacattcaagcgtttgacagctagttgtgttttttccaaacaaaaagaagataaagggctccacacttgccataaaatatt

SEQ ID NO: 11077 - DNA, 201 bp, Bos taurus
ttgtatgaacagtataaattacatatatgaaaatcagatgttttaaggtagataaactaaaaatgcaattaaaacgtctaaacatttagagatgcttcgaagtattttacgggttaaaagaattaaagaagtagttactgaaattatatatagaatttgttgtaagatctgcaatctgtacattctagctttgtcaccaat

SEQ ID NO: 11078 - DNA, 201 bp, Bos taurus
ttagaattctttaatttgaatttgactggctcataactttgtatttattgctaatagatttagtttgtataccatctggaacaaaatcaaaacagacgtcactttctcagattttttaagggatgattccctaatgtgtatatatgtgttggggatattagtttaattttaaagttatttttacctcaagcttagtattcc

SEQ ID NO: 11079 - DNA, 201 bp, Bos taurus
ctgtgcggggccccttctttggggctggaaggggatcaaacgttctgggctgagcgattctgaggaaaccacccagcatgggagaacctcaaggctctgcgggggccctgccttcctcccctgcagaaccctagcagggtctgcccaccgtgcccctaccattctttggcaccgagcctcactttgccctggcccacccag

SEQ ID NO: 11080 - DNA, 201 bp, Bos taurus
gagcggtagaggaaactttacttactcacctgctgatcatctgctgcatggccgagttccactgatggtctgtggccaggggttggggacccctattgtgcagcactgatgggaactctgtgttctgagccttgattaaagtcaggcctgaaacccccaggaaaatggagccctggtacagctggcttaatttcagctgac

SEQ ID NO: 11081 - DNA, 201 bp, Bos taurus
tcttttgtgggtcttatatttctacaagctttagcaactagatacacagctaatcatttgatgattacaaaggaggtgtctgcggagacagcagaggatcagcttggggtacccagttggcctggtctacagggaggtggtcagatgaggtctgtttgaggaagtgatgcttgaagtatgctctgcatcagaggttggcaa

SEQ ID NO: 11082 - DNA, 201 bp, Bos taurus
ttccagtgaggcctcttcaaaggggtgggaggcgcgagtgggtgggctggggaacagacgtggtcatttggctgcattgcttctcggggttggcatcagtactcacggggcaggccaaaggatgccttgtagataaaagggaggcggaccatgagtctccagagaagggactctcctcaggtggggctgaggacccaagga

SEQ ID NO: 11083 - DNA, 201 bp, Bos taurus
caagagctgataatctggaaggatcgacgctgagagccgggaaggcagttcacaccccagtcgtaggcgtgacttcgggccaataggttcctttttctgaacttcagaacccagagcaggcaagtgtcacaagcacacggaacacgtcaccagtcatctcagcggtcaaataaccagccctgacatggggcggcccagtcc

SEQ ID NO: 11084 - DNA, 201 bp, Bos taurus
gtctacccagagcctgcaccccaacccctcctctatcatgcttcaggtatctaaaaacctagatagcactgcctaaatggcccaagcatagttttaggatgtatatgagcaacttctccaggtccatccagggggacaacatgcccccctctgcacccctagagatgtgactagtggtagctgtaggcaagttgtgtagac

SEQ ID NO: 11085 - DNA, 201 bp, Bos taurus
ttttgacttacctttcttgggggtggggtgcctgttgtctccatctcctctcaggctaagatgtctggtcctgatgaattatccttgctgtttaccctaggttcaccttcagcaccagagatcactgtgatgttggcaagttgggttcctctcccccgggggcagtgtcccgacttctctgcatgagaagggggcctagga

SEQ ID NO: 11086 - DNA, 201 bp, Bos taurus
agggtcccatgactggctcatggagcgtggatgtgaatgagggaggagaaagagcacatgaaggcaggagcgtgtggataaagaagcaggaaagggtgcggcagcatccggccttccccccagtgggtgacacagaatgctcaccctgggctctaaagggctgtgaagcagagtgtgtattctgcctccctttctggagat

SEQ ID NO: 11087 - DNA, 201 bp, Bos taurus
tgagtctgtactacgtgtctcatccttcttagaccagcagctactgtggcttgaggtctgctccggcatttgaccagtgcccaggagggccctcccagccgtgcagggacagccatgctctgctctgacatcctactggtcaaagcaagtcactcactcaggcccgaagtcaaagggtgggcgatcactgcccatgtgaga

SEQ ID NO: 11088 - DNA, 201 bp, Bos taurus
gtggaggccagggagccgtgagaacatcagatatgctgggaccagcagaccctgggaggggcgacaggcagccttggggagacggggttcttgttcggaacggccatgcatgtgctgcgtgactgtggatgagaaactgcccctctctggactttccagattctttggtccgacagatgggaaagcgtggaccctaccggc

SEQ ID NO: 11089 - DNA, 201 bp, Bos taurus
ccaacatctcgttttccaaaagttccacctcaagggtgtaccccagggtggccccgccatctctccctgtctcactcccgagcaccttcctggcctctgaagtcacctgaggtggagcactggggctagccagtctcggagctgtcctgaagcccctctctgggtttctgtggccctgggttcccggggcagcccagggag

SEQ ID NO: 11090 - DNA, 201 bp, Bos taurus
ccaggtgcttgggcagagagaggaaaggacaccaaggaggaagccatgtattccttttgtgaaggattcaccaaggaaagggtgtcaggtgggccctgacggggttggaatttccaccagcagtaggatggcgttccagaaaggcgaacagcactggcagagacctgcaggtctcaaagcggcagggtgtgtaacacgtgg

SEQ ID NO: 11091 - DNA, 201 bp, Bos taurus
agaaactggtttgaggtggggaggctgcggtgagttgtctggtcccctttccctgggccccactgcccacgggtctcccacctgaggccggctggcagccaggcagctgtggacactctccgggacacttaaggattcgccccctgatttgtcggagctgctctcctcattgtgattgaacaggtacagaagtggaaccgc

SEQ ID NO: 11092 - DNA, 201 bp, Bos taurus
ggccagagaacgggtctttgccaaatgcagctgagccttgtggacttgtgtcctggggtgagttctaactgtgtcagtgccattgtgacttcagagtcaccctggcctggcattattcctctgccatctcacccatgatagccgaagccccactgagacttttattgtctgtgttatactgttgaacaggagccttagatg

SEQ ID NO: 11093 - DNA, 201 bp, Bos taurus
gctggctgggattttttgggaaagggtttaggccaagaacataacataacagttgtctgtgaaaataacctccaggctatggcaatgaacctttttgtgccgagtcccagatcggccataccagcaggctaattgttagctgtgaacccactccctccaaggcctggcttcaagccaagatacctgggttctagcccatgc

SEQ ID NO: 11094 - DNA, 201 bp, Bos taurus
tccatgggccacccagcctttaaatgacagagcccgatcggagtccaggtctctctgacaccaaaatcatgtggtgggagacacaacgcgtgtaagattttggcccctgccttctgagaaggtggggtctaagctagagaggctgtactgtccccgtgggcaggtgcctaccagcccagggcaggcaagggtcttgaagga

SEQ ID NO: 11095 - DNA, 201 bp, Bos taurus
gctgtcttagccctagccaggaggaaggggcatcgggggctgctgctgaaaggaggggagagcaagcctggaaggactgagcagagaaactgggacggccggagggcttagggccagagtcagtgcttgtctgacagcatctcagacggcaggatgattccctttgcctgcctttttgatgatgggtctcttccctaaggt

SEQ ID NO: 11096 - DNA, 201 bp, Bos taurus
acaacccggagaatgggtacaatgggccccactagggaggagctgagggaaggtgtccagacacatggaaactctgcctggagcaggagcaagctggcattagagcggaattcagggcagttcattcctggaggctcagctgcagaaaaaaacgcctccgtccctttgctccctggctctttccttcattcacccactcgc

SEQ ID NO: 11097 - DNA, 201 bp, Bos taurus
gtcccaggaggaacgctgctccatgtggggaagctgggcacacaggaatgctaagggcttccaaggagacgcagggaaggaggaaaggagccgggaaaagtggccaaggatgggactaagtgcccagacacaatctgacctaacccagagaggataacctgaacgctggtccacgggtgcccggctgggacagcactggtg

SEQ ID NO: 11098 - DNA, 201 bp, Bos taurus
gacaggccttaggaacattcagaacatattcaggaagtaatgcagaggaccctcagagttcataaaatgaaatatgtataaaataaaccaataatttcacgaaaagtcgcacaatctaaaggcctgaatgatctcttctgagaaacgtagtgctattttcaaaacacacagcaaactaaaaccaaattaaccttcataata

SEQ ID NO: 11099 - DNA, 201 bp, Bos taurus
cagcacacagggcacagcatacatggtagatacatctgttcacacctgtggaatgtagctccaagagtgaagcgtggctccaaacctggacttggggtgatgatgcgtccgtgggttcaatggctggagcagatgtgccggcggggtggggggctttgattacgggggagtctgtgcacgtgtgggggcagaaggcatttg

SEQ ID NO: 11100 - DNA, 201 bp, Bos taurus
caaggatgctgatgaaactggtgagcctccggacactgagcagcgtccactcagagcaagtgtttgccctgcgcctgcaggataagaagcttcccccgctgctctctgagatctgggacgtgcacgaatgacagttcctcctccgtgtcttctgttttcctgggctggatgactgaggctgggtggctgcctcctagaggt

SEQ ID NO: 11101 - DNA, 201 bp, Bos taurus
cccagccctccctgccccacggtcggcccccagcccaggcctggagctacctggtttcttccctggctcgggcatcttgagagaggtcacagcaggaaccaagcaggcacgggccacccaaagagactctgagcagggctccggtcccggactatataaggggccgccccctctccagaccttccttatctgcaccctgcc

SEQ ID NO: 11102 - DNA, 201 bp, Bos taurus
tgagtggcaaagtaaacctcgactggctgggactgaagggctgggccctgcccagctgtggtgcagtccccaaatgcctgactgctctcactcttgggctgggctgggctggtggagggccgcctaagcatgcaaggggtgcgcccagctgcagcggggactcctctaggctccagctgtccttccttgggccaaccctgc

SEQ ID NO: 11103 - DNA, 201 bp, Bos taurus
tctccaagccccactgacccctcttcccctccacatacacacacacctcgatgacgttggagaccagatacggcagcgtcttgttcactttgattttctcgctgttctctttgatcttgtccttcatggcctggagttcgtgggtgactcgcaacacttcgctcttcatgatctgggatgagggtgaatggaaggaaacat

SEQ ID NO: 11104 - DNA, 201 bp, Bos taurus
ggaaaggcggtcttgctgtgcggccgccgtcacttccaccttcagtctccgagaccttcgcagagactcaacagcgctgctacgtcgggagagagcgtccggagggtcctaacctctgcggcccatgggaagattttcccactttcgggggaaaacaagtggaggctgctagctatgaactttgtacgctggatctggatt

SEQ ID NO: 11105 - DNA, 201 bp, Bos taurus
aaaacttactcctgtgacagcttgggaatagctcttcatttcattcatggtggaaacctataacaggaagaaagcctttattagaacgagtgagaaaattcagctggtattaatagctaattgtcctccccgtatcaaaacagtctatttttgaattcaagttctttgacaacctgaaaattaatttacaggatgaaaaca

SEQ ID NO: 11106 - DNA, 201 bp, Bos taurus
cattttaaaaaatggcctgtaacaccaaagagatgaaacattgctttcaaataagtccataaaaacgacatgttaatgtagaatactagactttcgaaaccattatttagggacttccctgatggcctagtggctgggaatccgctgtgcaacgcaggggatgcaggtttgatcccacgtactgtggagcaaccgggcccg

SEQ ID NO: 11107 - DNA, 201 bp, Bos taurus
taagtttcttctgcgctcctggggtcattgagcaccatgtggagggaacccaggagcctggttccagagcactgtggtacagcagtgtccatagcggccatccagatcactgagctggctggtttattcacattctgtttctttaaaaaagacaactgcatgacccagtttagaaatcttggcctcagatatggtttgaca

SEQ ID NO: 11108 - DNA, 201 bp, Bos taurus
agtggtttcttctaggagtgatttggtaaaattctcaaaagatctgagggtttagtgatggtctctgcagtcataaactctattggtgatttccttatagtggtgacttgtgatagtccataatcatctgttgccagtgttcaaggaaggatgctttgtggtgtgagtggatgtcacatgactcctggtctcaggtgccct

SEQ ID NO: 11109 - DNA, 201 bp, Bos taurus
ggtctctgaatctctaaaaagaagttgaggcagagaagatctaagctgcactgtttaggttatttgtacctaataaaatatactagtaacagaataaagtatagtaaaataaaaggctgattattttgagtgaagaagttgtaaggatgctaactgattctttctctctctccaaagaactggaggtagacatgtagggct

SEQ ID NO: 11110 - DNA, 201 bp, Bos taurus
taaacaggaagaaaagcaaattatagttccctctgagatcaagccagacttttccttgaagttgaatcaacttaaagtagaaatgaattccctagcctctggtactactttttggacttcattttagtgaatttaattattttcctttatatattcacccacacattcaatatttatcatgcatatgatattgtgttatct

SEQ ID NO: 11111 - DNA, 201 bp, Bos taurus
taattttatggatcctacactctgagaaggcaggagccaaatctgtttttattagccactgaagacccaacaaatatccatgtgcctgtttcattatttcggctcaaaaatatttactgatgaatgaaggacagaggaataatggaacacatttattatgaaattgctttgtatgtagatgtagtcacagatttaaaaaaa

SEQ ID NO: 11112 - DNA, 201 bp, Bos taurus
tgcgccgagggctttaatgtccgttgctccaaatctttgttgtgacgagacaaagaaccaaggaacacacactcgagtgacatttatggtgccatgactcgggcttaacctggctgaaacaacctccgaggggaagaggccaagcacagcaggagcccaacccagtgaagctcccgagctagaagcggaaggcaaagaaac

SEQ ID NO: 11113 - DNA, 201 bp, Bos taurus
ccggccaaactgggttgtaaaatggaggaatattgggagttgatcaccccttttcctgaatcaacttgagctggagaaaggggatggatgaaggtcaaagacaaagcaaggccacaaaccaagggccccagggcattgtgcggctcctcagtgccgggcagggggatggctgggtgcagggatgtatcctttgtccctgtt

SEQ ID NO: 11114 - DNA, 201 bp, Bos taurus
atgatatcaccgattcaatggacatgaatctgaacaaactttatgagctggtgatggacagggaagacttgtgtgctgtgtttatggggtcacaatgagtcggacatgactagcgcctgaatagtaacaatccgagttttctgcctacatctccaaagtttaattaggatatggattcctggaacatgcagcaccccctca

SEQ ID NO: 11115 - DNA, 201 bp, Bos taurus
ctaagtctatggcatctaccatgactttgtcagcaacctaatgtaagtgatctttgaacttactcctttgcccctgggccacattcaaatcacgatatttatggtatgatgataaacaaaatggactctcctctcacaagtaaaagaaacaccgccaggaatagcacatttgttcaaaataatggtgatgatgatttgaca

SEQ ID NO: 11116 - DNA, 201 bp, Bos taurus
ttggctccatctctataactcttccctacctatccctattcaaatatttccctttcagccctggctagccttcagaagatccctgaaatcttggtcactggctgcaactgagcttgggacctgcattttctgctggggccagacttggttgccactaagtacatccgaaagtattaacacatccaaatgatggttgactag

SEQ ID NO: 11117 - DNA, 201 bp, Bos taurus
taggccaaccaatattgtgtgcatgggtcaggcacttaaaagccattagggtgcctgccacatgaagacacctgtgtgaggatgagggggacacagaaccgatcaggccacaagggcatccgcccccagcaagacaacttccgtgcaccatgtcaggtacatagtagttgaagcaaaacagatcattgtcccctggccacg

SEQ ID NO: 11118 - DNA, 201 bp, Bos taurus
ttctttttccagctggtggtttgatacttgggtaggggtgatgtggggagaatcagatgaaagtatataataataataataagatgagagcttgttgttatgtagagaagtgaatattcctctgattatacatgaggggccctctaatcatgaataaaccatcctgctctttaatcaatcacatgaagacccagacacata

SEQ ID NO: 11119 - DNA, 201 bp, Bos taurus
gacgtaccaggatgtgctgtacttcctcctggcctccaacgtcatcacgcccactgtgctcatcctggcttcctacgccttcatcattgctgccatcttgcgaattcgctccacccagggccgcctcaaagccttttccacctgttcctcccacctgatctctgtcaccttatactatggctccattctctacatctactc

SEQ ID NO: 11120 - DNA, 201 bp, Bos taurus
gaataaaggcttcactcctggtgacatggtggaaatggagtaagggggctgaacttggttgagtgttgcctgaggatgtgaataaaccaatgactgaaagatcaagcaaatgaatgaatgcacagtatagtattcatttagtgtattatttgcttgtgttattatgaccagtttttggtgcccattcaaagcctggccccg

SEQ ID NO: 11121 - DNA, 201 bp, Bos taurus
tttacaaagaaaattattctttacccatatatacttgataaacacttccataaaagtttatggacctctacaggtccatgagtccatcatggcagagaacggttactaagggtgaggtaagggataaaatgaaaatatggagataaaggggagcaaggtcggatagaactctgtggatatgtcaagaattcaaatatagtc

SEQ ID NO: 11122 - DNA, 201 bp, Bos taurus
gaggatgtggggatttgccgacggggtattgaatctaaaattctgaaggtatcgtatcgctggtggtagataaggccacaggttattctcaaaggttacagtatagatagtctacacacacacacacacacacacacacgtttaaatgtggaaaggagcctgcattagcccacctggccctcttgagcatttaaaaatagg

SEQ ID NO: 11123 - DNA, 201 bp, Bos taurus
aagtctggtgtgctgctgtccatggggtcgcaaagatgggacatgactgagcacctgaacagcagcaggcaggtgggagaatagaaaaccggccagtctccgaggtgaaaacagctcagggctggaagagccaggcgccctgagagaccctttctccttgccccatcatatgggggccccaggcatgacctcatggctcct

SEQ ID NO: 11124 - DNA, 201 bp, Bos taurus
ctttgagcctcgggcctgcactcttcccccaagaagtgtcaggccaatgttgcaaggtcccgagtcttaggaatccccctttccagccccaaagtaactacggagcttggatggccctaaagagcctcagtcatccatttgcataacagcacagccatggggggggtcctagaagacgctctcccctcccctgcgtttcat

SEQ ID NO: 11125 - DNA, 201 bp, Bos taurus
tcggagctggtgcaatggccccactttgatagaattctactcaaagagaggagctacctttctagttcctgcagagttaccttgctggactgaatccacaggagaggccagggcagtagataaatattaggaagtcagtaggatatttataataattggagcatcctatttgaaactgccctgagataattgagtgagtag

SEQ ID NO: 11126 - DNA, 201 bp, Bos taurus
cgcagatccccgcccaaagcaagatgtcctgtgcgtgtgcacgcttgcgtcgtctcagacgcgccgttgcagtggcagcccgcggttctgggttaggcggactggtaaacggggtagcaggtgcagtaagcaggcttgcgggattactcctaaaatgctggcaagtccaggtacattcttgaggtttaaaactggtgacag

SEQ ID NO: 11127 - DNA, 201 bp, Bos taurus
ctactacatgctctgacttttcatctaggtagggcctaccacacttgtacctaattgcctcctgtatatttttacagctgagtgaattaaagtaagttttcacaagtcttttcaccctaatgttctagtcctgaccttagttggtgtcctgtactgaaaatgtgctttattagttaaaggaatgtagaacataggaggaat

SEQ ID NO: 11128 - DNA, 201 bp, Bos taurus
ctccttctcgggtgtgactcacaggccccgagcctcaggcagagacctctccctacaagagataagccctctcggggagagagctagaaggggattgatccgggggaggtggtcagtggccactctctttcccttaccttgctggtcttttttttttttctcccttcttgtttccagttccctctgcagctgccctgaact

SEQ ID NO: 11129 - DNA, 201 bp, Bos taurus
cggttgccaacagagactaatgaaaatctacaggaaggctgcctggcttgctgatagccaaacggcccccaaagtgccgaggccaggcttccagcagggacgcagggaagtcccctctggggtgaccaccagccaggagaagaggctatcttggccccccatctccagaggtcagcacccctctaaactgccctttgctga

SEQ ID NO: 11130 - DNA, 201 bp, Bos taurus
ttccctctgcaggaggccgcgccaagaccttctccacgtgcacctcccacctcactgtgctgtcgctcttcttcgggaccctcatcttcatgtatctgggggatcactctggccggatcacagcggtgatccccatgttgaaccctcttacctacagcctgaggaacaaggaagtgctggaggctctaaggaaaattctca

SEQ ID NO: 11131 - DNA, 201 bp, Bos taurus
gatcctatggtatcaaggattataatctttatcttaagatagaagcaatgttatatttctggaaagggacatccggaatttcttctacccagttacagtcatgaagagtgaatacaatcagttttgtctgggaaggaactgctcaaagaaataaaagacaagaaagaattaaccttcaaacagcattcttggccacagaag

SEQ ID NO: 11132 - DNA, 201 bp, Bos taurus
acattgggcccacagaaagagagactgaaggtgattccaacatggatggaggcattcaggaagccacagacaccggggcctgtggacagaccagcacacacgcttgtcgtcatagttgcggtgtaacggaggggcgtgcacactgctgcatagcggtcataggccattgctgccaagagaaaattttccatagtggcaaag

SEQ ID NO: 11133 - DNA, 201 bp, Bos taurus
acagtatagtgagaacattttaggctatatacaacactgttcttgacacaatggaaagccaaaaaaagtaagctgaagtaaaattaatccaatttcatatgtattttactaagtttagtttagtttaaagaataatttttgtttttgttttggaaactttgaattgggagccagagctgttctagttagcaaccaatctga

SEQ ID NO: 11134 - DNA, 201 bp, Bos taurus
taatacaggagtgcctgaattcatcctgctgggactcaccagtgcccccggactgcaggtccccctctttataatattcctgctcatttatcttgtcaatgtggttgggactgatcctgctgattctcttggagtctcgtctccacattcccatgtacttttcccctacaaatctgtctctggtggacttttgctactcca

SEQ ID NO: 11135 - DNA, 201 bp, Bos taurus
ccccttatgagaacatccacagctcttcatctcgcttgtttagtagaaaagcaattaaacggtctgtggggagtgtgagcgcctgttgagtaagtgcaccgattcatttgcactacttggccttagaaaaatcattgtctggctgaggatgcataatttacatcaagttatagccacactttttaatgtatagctctaaca

SEQ ID NO: 11136 - DNA, 201 bp, Bos taurus
gaagataaataacttaactaaggctgacaccgtctgtaaatggtacactcagcctctgaacttgggtttgtctgatgtcaaggctacagttctggccactgtatcccaaacaacataggtcacaccactggatcacctttcttgccccagagccctcagccatccttgaaaactgggccttatttctgagatgtatttcac

SEQ ID NO: 11137 - DNA, 201 bp, Bos taurus
caaaccgtttggcacccggttctggtgttgtggaagacaatttttccatggtccagggagcacggggggatagtttcgagatgattcaagattgtgacatgtgtgtgcattttgtttctattgttgttgcatcagcttcacctcagatcatcaggtattagatcctagaggctgcagatccttgccctaaggagtctccat

SEQ ID NO: 11138 - DNA, 201 bp, Bos taurus
ccgatcgagagagagcccgccgcagcttcgaaggccccatgcagccaaaaaataaattaaaaaatttaaaagtaaaaaacaagaaagggagtcagtagggatgacaggcccttcagctcgacttggatgaagggtgattggaagctgaactcagaagagaggagttaggtaattccaaataaggaacaaaatgcaaaagga

SEQ ID NO: 11139 - DNA, 201 bp, Bos taurus
ttgcacccttatgtcaccctgatggctcccagctgcacccttacacgatgaaccagacgcaggactgagactgcaaaagccatgtttcaattcacaggccgcctgtctgcattctggaaagacaatttcaaggaattgaatcaccacaggattgtcactgaggcagctgacaggtgttttcagaaataatgaggccggttg

SEQ ID NO: 11140 - DNA, 201 bp, Bos taurus
gcctctggcaggcggattggggggaggggctggtccacagctagctagctctcctctggtgtttgctcagtccttatcctgtgagcaggccaggctcttgcggaaaagttctctctctgactctttttttccctctctctctctctctctggctatctcatgtttgctccctcagattgtcctcagggcattcaggcccag

SEQ ID NO: 11141 - DNA, 201 bp, Bos taurus
aatggggtcttaaggagttgacctgtctaccgagaaatgatcattacgttcttgtgactagatgcataacctctcacttctcttcattgtgaagttatccgatacttttctactctgaacccaaacaggaaattgctcaattgattccctgcgtctgtcttcatttgcactaaattgggaaaacaaggccccgtgatgaat

SEQ ID NO: 11142 - DNA, 201 bp, Bos taurus
ctcgtgcccagggtcgtgccagcctctttcccccaccttgacctgagtcctgcaagggtggtgccgggggctttgagtaaccacctcctggttttcgcacatgtcattctataggaactggccatgtgctgagtgggcatgggtgatgaaaacaggggctgctgtaagggaatgcgctttcccaccccttgactccattgt

SEQ ID NO: 11143 - DNA, 201 bp, Bos taurus
gcgaccccatggaccatggcccgccaggcttctccgtccatgggattctccaggcaagaggtctggagtgggctgccattcccttctcctctgcccctccgtctcatcctcatcctggcccgggcacccgcagactctgcaccccggcgaggccgcaccgcgcacgcgtctccgtgggcccctcgcgcagccgccggaagc

SEQ ID NO: 11144 - DNA, 201 bp, Bos taurus
aaaatctgtttggccacatgtaagtaccgggtttctatgagaatttcatcacaaatttacaattacattctaaatcctttagtgatttaccagagtatgcacttttcaagatgtggaggtggccttcgtcagtagcgcagtcttctgcgcatgcaccggccttcgtcagtagcgcactcttctgcgcatgcacctgctctc

SEQ ID NO: 11145 - DNA, 201 bp, Bos taurus
caacccactgcagtcacaagaatgcagctcagcaaacaccacctgggcttcctgaaaagcacagctggctgctagcctgagacccacccaatgcaccctcggggcccctctcccttacactgcagtccactgtctcaccggtacactaattcctgtgcgtctatcacgccagatgctgacgctgagaagctctgttccaca

SEQ ID NO: 11146 - DNA, 201 bp, Bos taurus
agagggggccttctccttatagtctccactgatggcgtcccgagtccatccctcggctcccaaagggcgctgcacggtgcgggcttatcattcaaaacgggcgtcttaaaatgcatttgggccagaaagtgtcttaatgtggcatctaataattggaaccaatgaaaaagcaggaatgcaaataaactcttgcttctgtaa

SEQ ID NO: 11147 - DNA, 201 bp, Bos taurus
cctgagactattcccccagaagacatagtgacctgatcacggggtgggtggtgaatggaggaggaatgactctgtgtctataacaaagagtggaatgtggtagctgtcctttggggcgaggccaccctgctctccactcttctttcttattatttacttcagaacccctgctgttctactccactgagatctattcctgaa

SEQ ID NO: 11148 - DNA, 201 bp, Bos taurus
attggtgatggacagagaggcctggtgtgctgcagtccatggggtcacaaagagtcggacacaactgagcaactgaactgaaccgactggagtttagaaatggtaaaggcccacgaggtgcagtatagcacccaagaatagtagcacatggtgctgccacttgagtacattttccaaggcatttccctgacttgataagta

SEQ ID NO: 11149 - DNA, 201 bp, Bos taurus
ctcttcttgagatgcgatgggcatctcttggagccctttgagtggcctaaagggagtcaagcctcctgtggagttttgagagaggactcggaattgttctgtaggccttgcaggaagagaagggactcaagtcgcgatgacgagcgaattgcgtggcttttctcgagctgcatcgttacgtgtggtatttctctcgagtta

SEQ ID NO: 11150 - DNA, 201 bp, Bos taurus
tgacgggggaatctcgtggtttttcttgagttgatgtgcaacttctggggtttctctccattatgacggggaaatcagggggtctctcatgtggccccagggaagtccactctccactcgagttgcgaggggagcgcggcattgctctggagtcacggcaggggaatcgggcctcaagacgcattgaagggggaatcttga

SEQ ID NO: 11151 - DNA, 201 bp, Bos taurus
tagtaaaaggcccgtggtttgtgcctaacaaatgtctatgtttatgtttaattagattaaaaacataagttggatcctaaacatgttaggatggcactgtttggtgggtcctggttgggttcctggtccctaagtaccatgcttctcaaggcagggattagcaccttttggtagctgcaaagaagttagaaggacaaagaa

SEQ ID NO: 11152 - DNA, 201 bp, Bos taurus
caaagctgctagggttcctctttgactgccttctgctgccacctgctgcctgcagaggggaaaagaccaaggcctgccaggagggaacttccagggttttggggcatggggggcgtgggtaaggaggttgagctatgcaggcggggacctcactctatccctggctctgctccccaacgggtgcaagtttgactccgatcc

SEQ ID NO: 11153 - DNA, 201 bp, Bos taurus
aaaggggagaagaaacggctggacctcaggaaagagagaagtcattggcttgactcgctccccgccctccccaggcaaccttctacccaggcccctcagagggtcataacttccccgtcagagttcccgcctctctggaagctgtgaggctccatttggaacccagagtctacagggtaaggttgtgggctttgaggtgtt

SEQ ID NO: 11154 - DNA, 201 bp, Bos taurus
ataaatactgctgaatgaatgaaaaagttcttgacccatttcaggggctattgatctttgctagactgcccctatctcttcccaaccccattctttgtcatgcttcattcagcaagctgtgagtcttctggttgagatgcaagaactttaaagtgagagaaaggatattctttttttttttttcttctaactttatgtctc

SEQ ID NO: 11155 - DNA, 201 bp, Bos taurus
tttctaaagttattgctgcaatctatctttaaatgaagattaaatgcctcatgccctgtgaccaggttctatcaaaaattgagttattgtgttaactgaacaatgacccaatacttaggaataaattctgtagtaaaattgtcataaaatatgactactcatgacatgcaatactgcttgcggctaaagcacaatgtacag

SEQ ID NO: 11156 - DNA, 201 bp, Bos taurus
cttagtcctgtattttctaagtctcttgtgatgacttaatgtcccctgtcattgaaatgacagaaccacaggccgttctaaaggaattggcagttttatgttactgccagcctctcttccagcctctcttctcctgaccctaggagacccctgtcccctgccttacccagttctgccaaaagagcccttagatagggggag

SEQ ID NO: 11157 - DNA, 201 bp, Bos taurus
gaagtagtgagtcactctcaagtcagagaccgctcgcttcaggaggaagcgcaccaaggggctgtccaggtagcattcatactttaaggcctgggtgggagacaggggacagggggctttgttgactgtccgtactctataccaagcaatatccctgaagaatacagtctgtcttggggtcccgggggcgggaccatcaga

SEQ ID NO: 11158 - DNA, 201 bp, Bos taurus
gtattcttgcaccactgacattttaggttggaaaattctttgctgggcggggggatgttctgtgtactagaggatgttgaacagcatctgtggcctctacactagatgcccgcagccagtagcactccctgcccaaccgattatgacaatcaaacatgtctccagacattggcaggtgtcgcttaaggagagaatggcccc

SEQ ID NO: 11159 - DNA, 201 bp, Bos taurus
ccgctgccgttttaactcctgagtggccggcggcccgctcccgacacagcccgcgggaggcggggccgggccggatgctatggctgggcctccggggctgtggagcccttggcgccttcagacgcagctctggtccgaaagaagaagggagatccgagaggggaaaggggccgttctcatattgcctcttactcccttgca

SEQ ID NO: 11160 - DNA, 201 bp, Bos taurus
aggggctgctgtggtgtcggaactgccctcaggaccggtcttgaaggacagcggagagggcaagtcctccagggacaggactttgcagtatgttttcaccgctcagatgaggcgagagggcctgaggtaagcaactaaagtgattcatgagcagtagcaagcggtctggcccgatagccagggatttgaaaggaactagac

SEQ ID NO: 11161 - DNA, 201 bp, Bos taurus
ccctctgacggggagcctagggtcagtgggggagcttctgtgggcctcaacctcatgagggaaagaaactgttgttgggggacacatggaaaagtgagaatgggacagaaaggcttggccctcagggtccacttggagtttgaattagggaataaactgggattgtggttttagagaatcccaggaccatctgcagggtcg

SEQ ID NO: 11162 - DNA, 201 bp, Bos taurus
caggcatcgtgcgggggacgggccccctgagcctggtttctgtagtttacagtcagagctctattttgttatggtttttaaaatttttaagtcctgctctgttgtactgggcaggtttatgttgatgtttacccactacagttttttaacaatggaagctcacatgccttctctgtgccaccacagtacccaccgccctgt

SEQ ID NO: 11163 - DNA, 201 bp, Bos taurus
gaatcccagcactgaagcccggccacgttcccaaccactgctctgccagagaatgggttggtggcaccattaaaagctcctgccacactcaagcctgggttttcttgaagccacgtcaggcctacgtgccttaccttccttggtgcctggcccttggttaagcccaagatgccaagccatgcccagaagtagactgcggtg

SEQ ID NO: 11164 - DNA, 201 bp, Bos taurus
ctttggccagatgagttttgcacacaagttgctggacctttaagatatggaagaaatatatttccctactaggcctaaaggcagcccagaaggactcttgtactgtaggttcctgttagataagaagaccaaacccaggctcccagccagaaatcctagggtcaggccgtgtttaaccagtttaattgttgtgcgaacaaa

SEQ ID NO: 11165 - DNA, 201 bp, Bos taurus
acagcagctcccttgctgggagcccccagtcccaccattcccttcaagagcacacagcaacacttagcctcagcccgcactggggccctggggctggagacggttccagctgaactgaaagcaaggggtgtgggatgcagactgggctcagccagagaaacgagaaggaaactagaactccagcagggccagtgtgctgcc

SEQ ID NO: 11166 - DNA, 201 bp, Bos taurus
aattaatatatgccacgtgctcagaacattcctggtacacagcaagggctagacaatttgactactgttcttatggcccatatccatgtgcccaaatgtatgaaaagcaggcttacagaagcacagtgtctacaggaatctcatgctacagatggtgactctgaggcccagagagggcaagggacctcctgaggtcacccg

SEQ ID NO: 11167 - DNA, 201 bp, Bos taurus
ggccttttgctccctgcattgtctcacaaacaggggaaggaaatgtgggattaggctgtgtgctcccccgaactggggattctgaaagctctgctgagtactgataggattggcccgttggagagacttctcatgaaagctgaagtactagcacatgaaacagtggaagttcgacttccctgatagccacagaaatcacaa

SEQ ID NO: 11168 - DNA, 201 bp, Bos taurus
acgcattgaggccacccaaggggagggggcctggggcttcttgctttgaaggttggagacttggggtgttacagggggacagtagagctctgaaaacccccgaggaaggctgcaggccacttttggggaggcctgagggcctttgagaggtttggggcagttgtggagacctggctcgcaggtccatccccaaccttaagt

SEQ ID NO: 11169 - DNA, 201 bp, Bos taurus
ggatattttttgcagagaactgtgttgggggaacactgacacaagaggaagaccatataaagcttcaactctgaccaaaagagggcttcggggaggccacgtgacagttggtggctacagtgaactggtgtctaactgcacccgtggggcttaaggtgaaaggcatcagggcagggagaggacggtgccctgagaatgaac

SEQ ID NO: 11170 - DNA, 201 bp, Bos taurus
tacgaaacttggggccctatatgcagagcagtaaaggggcaggggaaatgggcatttgtggaaaactaaggaaagtggttttagaggtgcgagagtggacgaactgacgtttgttaatggcctttatgcaaggcgccatgctaggaatgttccctgcctgatcttattaattctcatgtcaacctagtgtccatttgagga

SEQ ID NO: 11171 - DNA, 201 bp, Bos taurus
tttatttccaagaaatcaacattaaaccttcgttaggaaaatatattgaaagtaagtagagacacttccatatttccttaaacattcattcaaacttgtagaagaaacatttcattcattttggccaaaagattattgatatcataaacttacatttagtttttactggggtgtaatctcctgctgttcctcattaaccac

SEQ ID NO: 11172 - DNA, 201 bp, Bos taurus
agattacaagcaaaaaagaggaaggccatgtgagagaagtggagggaaggaagcaaagtcacagagaagatgctaggccactggctttgaatgcggagccaaggagctcggctctagatgctaggaaaggaaattgagagcctcgctgctgatgccgtttggcccagtaaaattggttttgcacatctgatctccaaaagt

SEQ ID NO: 11173 - DNA, 201 bp, Bos taurus
tcgtaactctggcccccggctctcgttgtggctgttagcaacatcctgaggtttttactctgctcgcgaccgatctggccatctagagggattccacgcccgtgtgctgctgcctcccctagagacattcaggttattggagaactaatctcatctcaaggggccagacaccaagtcccaaagcctgcagacctctttccg

SEQ ID NO: 11174 - DNA, 201 bp, Bos taurus
gaaagccagccccaccgcctcgcatcccacacagtgacgccgccccaggagccctcgtgttcctgctcacactgccagcccggtttgcccctctggccaccaggcagtgtcaaggacctagaggatcccccaggggcactggtgttacatacaaagcccaagcccttaagaagggtgatggtgccccgagccccgagccct

SEQ ID NO: 11175 - DNA, 201 bp, Bos taurus
caccctgggcccctgaggcaccacagaagggagcttggcatccctcaggggtcagagcttggtggtttttactcactgcctagatgggtgagaagaaagtgggggcatggaagaggcccaggcagacggctctgggccaatgagagcagaagagaaatccagattgatggagactggctaaatggagacagatatttacaa

SEQ ID NO: 11176 - DNA, 201 bp, Bos taurus
atcatcacaccactcacacatcacaatatacagtcttgcagaatgaaacaactgcagacaccacagagtgctgtatatttggtctgcttgctctaaacacactgttttcactcgtaagtgtcagtgggttatgaactggctcagatatcacttttccataaactttaccatttccatgaactcagggtttttaaacaacaa

SEQ ID NO: 11177 - DNA, 201 bp, Bos taurus
ccgtggcatgggcgccgcgggcccgatctgggttttcctgactcttctcgcgccgggggtcctcggtgagctgggaatgggatcatggaggtagggaagcttctgggaccgggatggcctctgtgccacgatgcaaaggaagcagtcaaaagtgagaaggtgggacaaccttgcctgcttctcgctcgtttggggcacctc

SEQ ID NO: 11178 - DNA, 201 bp, Bos taurus
cagtcacttacacatgtaaccctgggccagaaagaggagtgaagtacaacctcattggggagagcacaattcgttgtataagcaatgatcaagagacaggcatctggagtggccctgctcctctctgtaaactctccctccctgctgttcaatgctcgcatgtccatgttgcaaatggatacaagatatctggaaaggaag

SEQ ID NO: 11179 - DNA, 201 bp, Bos taurus
acaaagaaatgattaacaaacagcaaattgagtagtgacaagagcagagttcaaccatagtacaggaacagagaccagaaatctgagatgcatatcagaggatgttcaaactgaacccaaaatgatgtgaaagagatagtttagtgttatcaaattgccaacctccattggatcacagaaaaagcaagggaattccagaaa

SEQ ID NO: 11180 - DNA, 201 bp, Bos taurus
ttggcagaatctcagggcaggcaggtgggggatggtgtgtggggtgagaagggggaggaggtgagctgagaagaaggaaacatggccaaaagcgaaggactgtcacagactgagggaataaaaatgggtcaactcagactgaggctcaagccctagccataaaggcccccagataaagaatgcctccttatctgtgcttcc

SEQ ID NO: 11181 - DNA, 201 bp, Bos taurus
tggctataagaccttccagatgcgtttagagatgtgtgctaggaataaggtgcaaacttctcacataatcctatatatgatagtatctgcttctctctgatgcaggctactgactggtactcctaatgagttttgcctggaatgtttttctaaatagcataggttcttcaggagacagtagattcacatataaaaaccatt

SEQ ID NO: 11182 - DNA, 201 bp, Bos taurus
aaggtaaaagccatcacacaagagattcctcaggttctcaggcctggacctggtgagcacactaccacagccatggcacaagaagatacgtccttccaggattgaaaaatctcccttccctggaatccatctgctctcacttaatggtgactctgagcctcaactatcagtcctctttttgaagattgtagaaaaacttga

SEQ ID NO: 11183 - DNA, 201 bp, Bos taurus
gtcctaagaccctacaccactttgtagtcagctttcagaaagatgaagagaacatgggaaaagatacagttgttaaagttattggccgacgaaggagtatcacttttacttgtgtttcatacctagatctcactggggaatcagtgacacagtcataccatgacacagaggctgagaaagtcacctttggccaaagagtag

SEQ ID NO: 11184 - DNA, 201 bp, Bos taurus
attctgtgtcactcgggtgcttacaatcctggagaggactttcaatgtaaactccagcctctaaacttccatttatctctccagcctcatctttcacaaacctacccactggattgacgtggaacactagttctaagactacttcaacttctgaaattaaaagaatatttttggtttacgtttcttaaattcaaagcatat

SEQ ID NO: 11185 - DNA, 201 bp, Bos taurus
ccctacgtccagtgcccggccctggctgagggggcgggtctcagtgggcagcacctcagagccaagtctcagaccccatccaacttccatctctctcagtgcctggcactcaggacccagccaggcctcaggctgttcatttaagctgcagagacacacttgtagcaatttccaactgggttaatctttagttcacaacaa

SEQ ID NO: 11186 - DNA, 201 bp, Bos taurus
agaactgactcacttgaacagaccccgatgctgggaaagattgaaggcaggaggacaagaagatggcagaggatgaaatggatggagggcatcaccagcttgatggccatgagtatgagcaatctttgagagctggtgatggatagggaagcctggtgtgctgcagtccatggggtcacatagagtcggacatgactgctc

SEQ ID NO: 11187 - DNA, 201 bp, Bos taurus
agacttagggagaacctctgaggtgtgtgctgggatggctgaaccaagaggaacctccagactcagccatgctttgtgccagcatgctgtgtctgcagaatgacctgagcagatccttgcccagatgtattcttcctttcctggggagttttcctttgtgggctcttagtaactccatagagcagcatactttctctggaa

SEQ ID NO: 11188 - DNA, 201 bp, Bos taurus
cccaaatcagtgccttaaccaatttacaggtatttctgacaccatagcctattcttatctccctagaacatttgggctccaaaccatactttcctccatagcaacctcatctcactttccacaaacaatgtactttattgtttcctcatctctgctgagaatgttcttcatagttcatagtgctgaattaatacttctgag

SEQ ID NO: 11189 - DNA, 201 bp, Bos taurus
aatgtgatgttcagtaccccccccccttttttttccaccagaggtgcccctccctgctctagatggggtggagacagactttacactgaagctttccttccctggttgatcttagcctgtttccttaccgatgcaggcttcttatttgttcccttcagcacttgttctactatcaaggtggggtggagatgcaccaggggt

SEQ ID NO: 11190 - DNA, 201 bp, Bos taurus
cttgatcagaatatcttataggacactttgctaaatgtgcagaggtggaaatttgtatagatcaatatcagcatgagaattgaatatttggcctgttttcctcctaatgtttgtaaaataaatcttcattagtataaagaagagcatttcatagtaagtatgtacatttgttactacactaacaggatttacttttcagct

SEQ ID NO: 11191 - DNA, 201 bp, Bos taurus
cagcaagttagggcgggggtaggggaggggaaacagacttgcccaaagcagttcagcaaagcatttgttttgcttgtgatcatcaagtaggtaatttcttccatctggtgattttttttagcatctgtaacacagatactgttatctgggtacttcagagagaaaataaagcagaggatatgggggagggtctgtctccag

SEQ ID NO: 11192 - DNA, 201 bp, Bos taurus
aaatgtgttggattttagcctccactagttcagaaggtgaaattctttcaagaaaaggttttaccagggcaagtaagctaaagaagcctattaggccactctctaatccagaatgattggcatcttataaaaagggtaaattcatacatagagacagacacatgtaaaggaaagacagacatccacaagccaagaagagag

SEQ ID NO: 11193 - DNA, 201 bp, Bos taurus
tgattcgatctataccattacaagaactctcaaaactgaccagctaactatgtgctttaggatcagatagcacactgaaaaggaacttctggatgtggcatgaaaataagcaatgtagagaccaaaacgggaaaaaagaggggaaaggtccagataaaagtgaaggagggaagctggcccagaaaagcaaagtcaagccac

SEQ ID NO: 11194 - DNA, 201 bp, Bos taurus
tctgtgcaagttctgagaaagttttccaatcagtttgaccctgatactggcttgggaagtagacatgaacctggggattattcttcctgattttggaggatttaattattggtttaaaattgggagtgctattctgagtgtagtgatacatatctaggtacccattcccttttttgaggggtttaatacatgtccttggga

SEQ ID NO: 11195 - DNA, 201 bp, Bos taurus
tagggtagggtatagccgattaacaatgttgtggtaatttcaggtgaacagtgtagggtctgtccatctacgttttctgtaacagagatgttagctgcccctaaacacatgggagttgctgatttgcttctacttgcccatccaaactaggttcttcatgaaggggaggtaacagatatgagtggcaagctgagtccattt

SEQ ID NO: 11196 - DNA, 201 bp, Bos taurus
gaagaggttgattaaaataggaaaatattcctgatagactttgttatccaatatgattagaggtttataacagaagttgttgcacaaatttttaattttcgaaggatatttatacttatgaaactttatgctgtcaggatgaatggatctagagtcaaaccgatttaagtcacagtcaggaatgctctcttcctacatttt

SEQ ID NO: 11197 - DNA, 201 bp, Bos taurus
ccaggatccacggttatagctattgtaattatcaagtcttctgtgagactctgttctttataaaaagcaaactctgttagaggactgaattcaattctacctttccaaatagctgttatcaatcatgtggtattttttcccagtctttatttgccaaacaacgtttgcatgtccactgagtcagtggctgtccacactcac

SEQ ID NO: 11198 - DNA, 201 bp, Bos taurus
gcatttttttaatgaaaaaaaaagtaaacatttccttctgatgccaactgtagttattaggaaccatagaattctatttttccctcgccctaaaatgagattttagcactgtatacaattacatactgagcccccaaacctctgccctggtccctctatgggccctgaagactgagcactaactcttggatccaataactc

SEQ ID NO: 11199 - DNA, 201 bp, Bos taurus
atatagtacactttacttgctcacgttcttcttttgactaaaatggcttttttacatgaagcaacatgtaccaggacctctattattcactacaaagaaaatagtgaataatgctccatgtctcagaattcttgtgtataaaatgagaattatcaaatacttagctaagtaggagccaagatttggtaagttctaagttag

SEQ ID NO: 11200 - DNA, 201 bp, Bos taurus
tggtataggagtctggtttcctagaagtaaacatatctgacaagttgcaattatcatttggccagtttgatctccaactaacaataagtgaaaggagatacattattgtctggggcattcatcctaaattgcaatgtggatgttgggttctaaatacaaaatagggcaaagataatatatctggagtcaagtcaattccct

SEQ ID NO: 11201 - DNA, 201 bp, Bos taurus
ttacttctttcatctctgcaccataacagactggaattctatagtcagtgtcaatacatctttttttgtcatccagtgtattggattaaaaaatccaagctattggaagtgtaggtcagagaagaacagtagttacaccaggtttttactccctggctctgctgagatgcctgataaaggcatctctttctgcaattactt

SEQ ID NO: 11202 - DNA, 201 bp, Bos taurus
atgtcttagttttctatatacatttatatctcaaaaaatgtccacaattttgattacatataagtggaaagcactgtttattgttcatttccctaagccatttactttgacccttagaaagtctctgaaatttgtttggatataaaaactgtagaaattaataacacatcccaatgaaaacatctaggtagtggtgtatcc

SEQ ID NO: 11203 - DNA, 201 bp, Bos taurus
tgaagctattattgctctctataacattttgaactttatcccatggtgtgtttatttaaatggcatttttcacaaagatgcaatgtttccctgtgtgcgcgctcagtcgcttccatggtgtctgactgtttgcaaccccatggacggtagcctgccaggttgctctgtccatgggattctccaggcaagaatacatgaatg

SEQ ID NO: 11204 - DNA, 201 bp, Bos taurus
ggaatagctaacaaactgaaaatataagaaataagaaatatacagaatatgttaaactttttcacaggattcaagttctctgtgataagaactttgccttcgccatagaccttcacctatagaagtgcagatggtttaaaattaagctaaatcacatgtatgcaatggaatgcaatccagtataagactatgtgaaagaca

SEQ ID NO: 11205 - DNA, 201 bp, Bos taurus
cagcttctcaggtcagacctgtcccagccttagaggcactagttgtcccttcacacgttccccaggtcctgaatttacatcagtggcactataaacatgcagtttgcacagctctggggagagatttcagctctgagtcagatggcctctggggctcagctgtgattccaaccccaacttgtgtattagcaaacagttgga

SEQ ID NO: 11206 - DNA, 201 bp, Bos taurus
tcctgaataaatgattttctcatttcaaatattatttcagatgaagacattagccataacctgcatgattctgaatttcaatatttaattctggcaacttttttttttttcctttgtcccctgctgaacttttttttctatagtctgagtgtaaacgttccagctacaagaaaatatttgtgctttatttcattgtgagat

SEQ ID NO: 11207 - DNA, 201 bp, Bos taurus
attttgccttttaaatgagagagagtagcatgattgtcaaagacctgtctttagatattaactaacaaagccacaataataagcatcattacattacattgaaagagtaatgcaccaagattgctaaatctctgatctttagttaacaaagggaccattgtaaacttgccaaaggctgacctcagtgaagagtcaagacta

SEQ ID NO: 11208 - DNA, 201 bp, Bos taurus
ttcctttaatctaggctccaagtaagcttgactattccaaacactgagattttcccaaagttctgactctaagtggtgcttccaaccacatctgtattgtagtgagatacatttacagtttgataaattccatatctatccaaatagttacattctccaaagtatttagtgtggattacttctggttttgttttaatttat

SEQ ID NO: 11209 - DNA, 201 bp, Bos taurus
atacatcctcagcagtatctgtgaaaaatgaatcaagtatagaccattcatgacatgatgtcacaaataggatctgttaatattttctagctatcattataacaagaatctacttaattctccaacgttttttttttttttttccagtttggcaaatattttttcttcaaaaataaaataactttcatatctaaaaattta

SEQ ID NO: 11210 - DNA, 201 bp, Bos taurus
aactttgtagccatacgtcccaatggcgatacacctaatcagggtgaagatttcaagttctctgctacagacctcatcctaaccctgtcaaacatcacagcactggtaatcactccaaggtaacgtgcaatgatagcttcccaggtcggacatcatcctcgctggttcaaattcaggtttgcctcaggtatctccctgaac

SEQ ID NO: 11211 - DNA, 201 bp, Bos taurus
tttcacccacttgttggttgtttattgcatgcctagactctcctaggtttggcacagtgcaaaggatacagaatcaggtctggtgcctaagaagctgacaatctgatggggagatgatgaaaggaccgcaaggagttaagagggataaatgagtcagcccgtcacagaaaccaagacagtaagaaaatacctgatattaat

SEQ ID NO: 11212 - DNA, 201 bp, Bos taurus
taacagacaaaagtactggctggcctgctgggcaagtacaggtgaaacgccactgctccagccctgctgctcagaacccatggcatgtgagatggggagcggatgttcaccgaagctgcttcagaaaaacggactgccacagccaccatgtgcccagaggtcagatttttcccttgtgtgactctctcacattttgctcag

SEQ ID NO: 11213 - DNA, 201 bp, Bos taurus
ggcttatttcaaacctcttagaggactttgaggggatcaaaatttcaggggaggaaataactgcaaaagtagtgaaaatagcaacagaagcagaagtggtacctgaagatgtgactaaattgctgcaatctcatgataacactttaatgaatgaggagttactttttatgaatgagcaaagtgatgtctatagattggctt

SEQ ID NO: 11214 - DNA, 201 bp, Bos taurus
attgcaaatcagacagaggtgatttggctttcacagatctgtgggccaacagtgagcataatttagaaggaaaaggtcattcacccagtcactcagccatttgccccctaaatctcagaggccacttaaatttcatgttacttctaggaatgtgggtccgtgccagcatccacagctatgaaattggggcaagagacatca

SEQ ID NO: 11215 - DNA, 201 bp, Bos taurus
aagattagctttttttttccctgctaacttagttatgcctcttacctatctgccatctttacagtcttatgggtagaagaagagagggcagagatgacacgaaagaggtggatccaaaaataaaggcaagtaatcaccgagacgggctcttttccttctgacattttcctggaatacaaaagctccaggtggcattcctgg

SEQ ID NO: 11216 - DNA, 201 bp, Bos taurus
ggcaggccggtggggggccgattccacaaaagccaagatcgggcctgggcctagaagcaagggcttacacccagagcgacggcctgcactcattcatggcgctctatgatctgctcggcattctctctatgaccaacctgaaccaaatcaaggcggcctaaccaccagcagagcttactctcccaccgggacaactcggcg

SEQ ID NO: 11217 - DNA, 201 bp, Bos taurus
aaaaacaaaaaaagcaaaggagaaaacaaaccagaagcaccataaaaaataaatgttaaacaacagaaagctataacattatatgccaaatcttaaattcgtatctgtgtaagtcttaattaaatgtttaaaagacactaatttacacaatataataaaattaataagggttgtctgtatcactatcatatctaaaaggct

SEQ ID NO: 11218 - DNA, 201 bp, Bos taurus
aaagggggccaggcctttgcacacctatgatggccaatcatcagatgtgggctgatggggtggagaggctgaaagaaacttggttaaagcagcttcctcagctacgggcaattcctggaatggccgctgtggagcatgcgcagactacactgcccggaggtggcgggagccagtggtttggtttcgcgggacccggcacca

SEQ ID NO: 11219 - DNA, 201 bp, Bos taurus
aggtggcagaggggcacaaatataataaattataggctaatgctccttttcctcttgattggtttttcattctgtgttcccggaggtcttattttactcatacatgtcacagaaaccttcctgttctcagagcctctctgtgtctggatagcctggaatgtatgtgggagaggatgggggacagattatggaggatactgc

SEQ ID NO: 11220 - DNA, 201 bp, Bos taurus
gggggtgcagacattgctagggggtaactgggagaaggggggacgtgtgggcacagacataggtgcgtggttctgaagcaggacgcaaggtcaccggccacgagtgagtctgggaagtgacattataagtgtgggagagagggcagttctgaaatagtatccaggaatgtcccaggtgattagctccaggggcccagtctg

SEQ ID NO: 11221 - DNA, 201 bp, Bos taurus
cacagtttgtgagctgttaacaggcttagaagtgcagctttctctgtttcctgccctctaagtccctgctttgcctggtttttcaagactctgcagctcccccttaggcccggctgcgaaggaatttccctgtacaggggagctcctgtttcaggactccctccctcctggcacaagctcctgcccagaaattctccatct

SEQ ID NO: 11222 - DNA, 201 bp, Bos taurus
ggtgtcattcagtctgaggccactgaataagaccaggttgggttcagaagcaaaggaaggtttattctttgatcagagaatgaactggtgtgagctccattctagagaacaagctctctggacaggctgtgagtggggctaccttctagggatctctcagaagatgaggggtggtttctcttggggctggcacagttgccc

SEQ ID NO: 11223 - DNA, 201 bp, Bos taurus
ttggggtggtctaagggagccctgatacaccatgagatgggaggcacaggttgtggtagaaggtgaagttgcctgttccactgtgagtggtgaacaaggaaagggtcaggaggatgaattttattaaagaaagctgagggtatttgttttgactagctatttgatgaaagggaatgaggaaacttcagaataagacatttg

SEQ ID NO: 11224 - DNA, 201 bp, Bos taurus
tcggtttagttacagtctgaatcaaacacctgagatacaggaaaacaaatgatataaaatttcagtctaagtcagaggccaggagaatacagacacccaggttgaagacacacagagagaaagaatccttgtttaatcagcctgtaatattcaggccttctgtaaattggttgaggcccattcacataggagaaagcactc

SEQ ID NO: 11225 - DNA, 201 bp, Bos taurus
cgactcctatttctctaactttcgtccctgtcaatctcggggctgttttaacacagtagcctcttgtctcctactttcggtcttgttcacctaaaattatttccacacacagcaatcacaaatcgtagtttggatcatagccttaccccacttgtatgcttttgaagtgtaacatccaccggcaagtttcaattcggtcta

SEQ ID NO: 11226 - DNA, 201 bp, Bos taurus
attctttgtcccaatcctaaatcctgagaatgttattgattgggccaaatttagtcaagttacctcctaaaaaccatgtttaaggaaggtagtcattttgaagaagcatggctggccttaactttcccacctggcatatcactgtccgtatggaaggaggcattccagtatactaaggtaacaatgaacataatgtcagaa

SEQ ID NO: 11227 - DNA, 201 bp, Bos taurus
tccaaaaagtcatctcttgggccagccaggtgttcttgtaaatgtgtcttcacaggagacaaattgccttggaattcccactgaaacttgatgagaggtattggggcatcttccaattgcatggcccagagactgatacagagtctacacatcagcaggaccttcccaggaactgcagttcctaaaagctcttcatccaag

SEQ ID NO: 11228 - DNA, 201 bp, Bos taurus
tatcctttaactttctcaatattaatgatacatctttgggttttattcccattaagcaagttagaaaaacttgtaagacaaaatttccagtgtctatactgttcccttcttccctgaataatcttttctaatttttcatttactgaaattttaataatcctttaatatcttcaaatgtaacccactttcttaagatttaat

SEQ ID NO: 11229 - DNA, 201 bp, Bos taurus
cagaagcagataaatatccccaaatatcttgtcctcttaacagagaaaaaaccaaatcctagttttgtatcaacttacttttaatattaaaatgtatttattcaaatttattcttaattaatctgtcctgaccatacactgtttttcccattatttcttttccacaaaccttctataacttccttttttactttcagattc

SEQ ID NO: 11230 - DNA, 201 bp, Bos taurus
caattttgccttcaaaataaagattctggagctcctactctggttaagatgttgtactgtgctctgacggtgattcagtcataaataagaaatgactctgactctcaaatatgggtccattgggagaggtaaaacatgaacacaaataactcaaagacagttgaaactgattagagtctttagggagtcataaattaagtg

SEQ ID NO: 11231 - DNA, 201 bp, Bos taurus
atggcctgctcaccctacttggcctccgacacacaggggcaggtagcatcatctcagctctggggctccgtgcaggctaccttcttttattaacctattggatggccaagtgctctgctcctgtgctatactccacttgagttcttaactcctgtgctacgctccctctctagtgcaaagggttctgaacttcctggatac

SEQ ID NO: 11232 - DNA, 201 bp, Bos taurus
tgtcaccatctttcactatcatatagtttgatttgtgcacttctcattttctcttcatttctcagaagatgtcaattagggtcctttctaccgaagaaaccttgttgtttggccaggcttgttacttaaatacgttttgctcccttgtgtgtctgttagttgcttagttgtgtccagctctttgtgactccatgaactgta

SEQ ID NO: 11233 - DNA, 201 bp, Bos taurus
gaggagtctgttgagccacagtccaaggaggtcacaaaagagtcgaacatgactgagcaactgagcacacatataagatatagatagagacgagcacacgcgttctcaccaaagacactatcttgtaaatcacggggatagtttttaacactgacaattcttgatcatcgaaaagcagttttcacaaaggcccccttcctg

SEQ ID NO: 11234 - DNA, 201 bp, Bos taurus
ctgtgtctcctgcactgcagccagattctttaccactgagctgagggggaagccatcaattcatcccttaaatatttcagacaactatcttcagtttttagatattcttatgctgtttatgtgtctggttcatcaagttttatattacctctactttcttatggctaactattaacaggcatttattttttacaaagtgcg

SEQ ID NO: 11235 - DNA, 201 bp, Bos taurus
tccagtaatcagtacaaatcttttcaaaattctgagcgggaaatagttttcttcttaaatttgacatgcaaaattatcacctacgaactatgtgtgtgtgcgcatgcccagttgctcagttgtgtctaactctttgagcccccatgaacagcagcccaccagcctcctctgtccatgggatttccaggcaagaatactgga

SEQ ID NO: 11236 - DNA, 201 bp, Bos taurus
tggcagttagtggggtcacaacaagtcggacatcacttagcaaccaaatcacaacaacaaacagaacttgcctactacatataacctgcaaagctgcacccggtatcaactagccttaagataagtgagtatttgctagctataaagacttcaagtggctactgccctttggaactctctgacccagagaattctcaacct

SEQ ID NO: 11237 - DNA, 201 bp, Bos taurus
ttatctgacacctgtgctctctccctgacacatcacagtcttacctaggagcaccagacaagccctcagtttgggggccatttcaaagagcaaacccatcaaaaaaagggcacacaaatgcaagaactgtagcactaaatgtacctttaatggccacttatttacagcgtgagacctgaagcaagaagacagagcatgact

SEQ ID NO: 11238 - DNA, 201 bp, Bos taurus
cagagcttccagtgtagagggaagtccacgcaaaactcagtctgagacatcagatgctaactgacaaccttcagtcctcatttgaacctcctgccaggatcgggccctgggtttcagaaaccagtgctcgctccctttccagcagcctctggggcacccggccaggtgttctccatcaaggcaggatgcacccacctgctt

SEQ ID NO: 11239 - DNA, 201 bp, Bos taurus
atttgcaggataatgaccatcgtgcaaattcaggttctatcagaacatatatggtaacttgacaccgtaaaactataaattgaaccataaaactttaaaaggagtaacttctaatgaggaaagaaatgatcagttcataaattttatggttctgcaattaggttgtggttgatagagcagggtaaagtttaaaactatggg

SEQ ID NO: 11240 - DNA, 201 bp, Bos taurus
tttatctaattcttgcattctcagaaaccagcaggaacaaggaagagtatatactagggatttctctttttatttggctgagaggtaggattcttagttcggaattactgtatgaagtgagaaatgttgatgacgggagaacagtggtggtgttcagtcactaagccatgtactactctttgcaaccccatggactgcaac

SEQ ID NO: 11241 - DNA, 201 bp, Bos taurus
attgtggatattcttttaaaaattgcctgaaagtgtaaattttaaaaatctgtactatgtaagagataaagtattatgttaaccccaaatttatccacaagaatagttggaggatgcagcctggttaaatattcagttctgataagaaataattaatattatagtgaggtaaccattggaaggactgatgctgaagctgaa

SEQ ID NO: 11242 - DNA, 201 bp, Bos taurus
cctggactcctgagcgcggtcgatggaggatcaccctggtctctccccatcaaacagcctcctcctctgactttacttttcaggccaataaaacaggacagcctcaagggaagcatcatgaacgtaaggaatgagaggaagcacagaggtggagaaccactgtctgtgcaggtaaaactccacaagcaacttcaggaaacg

SEQ ID NO: 11243 - DNA, 201 bp, Bos taurus
ttggcctctctaaatctcagatccacactatttggaactcaaaaattctcaccctttgaaacagttgcaggacacccagcacatttggttcctgctttttgggcctccaactgaaaaaggagagatattccaataatgtgaaggccaaatttctcctattaaaagtaaccatgttttggtagagcaatctttttatactgt

SEQ ID NO: 11244 - DNA, 201 bp, Bos taurus
gacagaaggatcctgcttcgtgaggcccgtgtttatggcctaacttttttaaagaggaatttggaaaacttcccagacgctgcatctgcccctagcccgtgcacctcggagtctaaggccggcaagggaggccgcgcagacgactaaatttattaacggtggatgggccactctgtctttcacagcaacagcagtaggtga

SEQ ID NO: 11245 - DNA, 201 bp, Bos taurus
tcttgccctcagtctttcccagcatcagggtctttttcaataaattcgacaaatcctcattcaatctgtttccttgctacctctgacttgtctttattagcatgtccctgtgctctctgatctagctacactgccctcaagggcttcctggttggtggtagtggtaaagaatctgccttccagtggtgcaggagacacagg

SEQ ID NO: 11246 - DNA, 201 bp, Bos taurus
tttaaatatagatgcaactatcatcaaaatacacatggacctaaactttatgatccttcaaagcatcttttgcaattggtcaggcagtcatcagctggtcatagaagccccaagatcccatctcgtcgccctaacgtctgccagctggctcagttaacaaaccattattaatcttgaaaaaaataatgaatatagatttga

SEQ ID NO: 11247 - DNA, 201 bp, Bos taurus
aaccctagccctgtggccttagggctgtgttggctcattaccaggtggacaggtggatggaggtgggaggggggtgtgcctgtatgtaaggggaggatgggtatgtgtgtacaatgaggccgctattgtaaagagaagcacagcaccaaattaggccaaaaacgtaatcaagaagcagagctcaaaccaaacttaataaag

SEQ ID NO: 11248 - DNA, 201 bp, Bos taurus
ggggcatgaaatatttattgagtgcccactttcatcaggcattttttttttttttgcatgctattttattagatcattaaacttaacatactttaagtaagagcataaatttctttggcttccaaacccacagtctgtaccactgtatatcttacatcggaaaataaaatgcactattttaaaacttatacccaatacgat

SEQ ID NO: 11249 - DNA, 201 bp, Bos taurus
cagctagctgtgcaggcactgtctccattttcttgagagcaggaataaactcagtcaccagtgatcttgcaatgcaacatgaagctgggtttccggggcccgcacccactcagctgcgactcttctccgtgtcctccactccacgtggcatttggttaccctaccactgttcctcgcaggccttgagtcagaaaccatgct

SEQ ID NO: 11250 - DNA, 201 bp, Bos taurus
agacagagttgaacggagcaagaagagacagcaaagaaccatgccaggcaggacaaaccagacaactcaaaatagtgatgagcacagccttgtctagcaagagcacagtctcctttttcaaaatcactgtttactgttttgctcatttccaaaatatcatctttagcaggtcattaaggcaaggaactagaagtgtaaact

SEQ ID NO: 11251 - DNA, 201 bp, Bos taurus
tgaattcattccatgccctctggattcccttctagcatctgagaggaactgaaaaaagctctgataaaaccccagctctgcttctcattaccttcataacctggaataatataacttctcaatttcctcacacatgaaacaggaataataatacctatttccttgctttgagatgatgtttcttaaaattctctaggcttt

SEQ ID NO: 11252 - DNA, 201 bp, Bos taurus
aactgaaaataacaaaacatatttatatatacagatacagaattctaagtacactctaaacagagcttcctatacgactttacaggctccccaaatttcagaagtgcacacaaataacattatgaccaaggattatgatgatggggatcagaacaatagtgaccactgattaattgctaatcaggtgccaagcactgtgct

SEQ ID NO: 11253 - DNA, 201 bp, Bos taurus
tggctctgttccatacatttcctgccaggagctcaccttattcctacagtcaagcatggcagtgtctgagtactgaaggccatggtcatggtacctcctcggtggagttgcattgaggttcagttgaatcagtatatgggaagatgctctggacagtacctggtacacagcaagctcttcatgagtcatagctatgatact

SEQ ID NO: 11254 - DNA, 201 bp, Bos taurus
ctccgcaaagaaagcgggtgagaacctccttgcgggtcgagcatggaagtcaagtgggtgtttgcggcgtttctcgaagattctgggtgttcgtaccaggggaacgggccctaaggggacagaaaagatagacgtacggacagcatcccggtggctgttttcagcgcgaagttcacgtctattgttttctgcctcgggaaa

SEQ ID NO: 11255 - DNA, 201 bp, Bos taurus
accaagctttgcatctggtcttcatgaggcaggagagactgctgcaatgtggggtcagaatgtggctttgtgaagacctcagggatgtggccaaggtttctggactcattccccatccctcaggagtgactcactgacacaccattgaaagttactaaaacatagttatagctcaataagtacagttattatcttggtatt

SEQ ID NO: 11256 - DNA, 201 bp, Bos taurus
tccacgggattctccaggcaagaatactggagtgggttgccatttccttctccagctacacatataggttactgaatattgagtagcgttccttgtgctacacagtagggccttgttagttattttatatatagtagtgtgtatatgtcaatcccaaactcccgaaggcttgatttaaaagctttagtactttggtcctgg

SEQ ID NO: 11257 - DNA, 201 bp, Bos taurus
tcaggtgtgcaatgatcattcttaaatttcactgaaaggtgaagggaagtctgtgtgagagcagggggaacgcttgggaagtcaccacttctctgctttgagtattgattcatgtattccgtaaacactcctatagaataagacatgtttgaaatcttctgtgagtcacagacagggctcaagatgtcaatattgagacct

SEQ ID NO: 11258 - DNA, 201 bp, Bos taurus
acactatggggaaggctgagcaaactgaatccttgaacatctttggatctttagaagatcaaataaaaaacagctgcaattttatttgttgcatttccaaaaaaacacagtgacttgtatcatgatgtgaaaacaaatatgctctgtattaatgtaaataagaatattttttctaatttgatggaagaaggttgacatgaa

SEQ ID NO: 11259 - DNA, 201 bp, Bos taurus
aataaagtttcagaaatctgggaatttggttcattctataaaacacactctatgtttgcagctccaaacattgagctaaggtatcctgactggttggtactgtcagactccaacaagaaaagggtgctttcaatcgaaacacacaaaagatggtattgtcataatttaggtcactgtactttcatcttcagtaaatcccaa

SEQ ID NO: 11260 - DNA, 201 bp, Bos taurus
ttgaaagccagagggaatgtgggcccaggagagcccaagcttgtatgcgactgaaacactgagacgaccaggaagcaccattcaaggacaaaccagagatcgcgcttggccagagaaaccagacagcaagcaagagccccaggtgagagacagccagagagctacggaactgtgagcacacgagagagcaacagagatgga

SEQ ID NO: 11261 - DNA, 201 bp, Bos taurus
aacattatgcagccaaacaaaagaataaaaataggtataatttataatctcttagactttttttaaagtttaaaaatcacagtgcagattaactgatgctgtatttgtatagatgggtatgggaagaattggatatagggcacttcttgtgatatttgtctcttaaaacctgtgaatctattactattaaaaaaacaaagt

SEQ ID NO: 11262 - DNA, 201 bp, Bos taurus
ccacactatttgattccctttcctggcctgaagctgccccttattttcttgggctgccttgcacaactgagacccttctaggatcccaaacaggaggcaggaaaactacagttgtctttggcatcctgctcaatctgccaaacctcttctctgcctccaagactttttgccctggagttcagtcaggcacgggtcactcgg

SEQ ID NO: 11263 - DNA, 201 bp, Bos taurus
tagtctcaagacaggacttgcaaactctagtttgtaaaaaaaaatgtattattagtgatatcagctgatcaagtggtaagaagctaataaaaggaccaccggaataaaagttgatatactgttccaatcctgctaaaggtagtaataaagcatacctatgtatatcattttcccaaacgtatgtgtaatacaatgtaggaa

SEQ ID NO: 11264 - DNA, 201 bp, Bos taurus
atataattggattaatatctatgtatttatatctgttttccattcattaccttgttctttgttggttttttgttttggttttgccttccactctttctggctttgctagttttaatttagcatttatatgatttcatttttttctcctcttagcacatcaattctacttcttaaaaaaattttttttagtggttactctag

SEQ ID NO: 11265 - DNA, 201 bp, Bos taurus
ctctccaagccttgtagtcagtaagcagactcctcttaggccaaaggatagcaaatgcaatgaacagcttgttatatcaagtgctctcaattttccttccacaaaaccaaaggggccacaaaaatttcctccttttgcaacaaaatgtcagtctccattatcagctggtactagctgggggccactcttgtttcctattgc

SEQ ID NO: 11266 - DNA, 201 bp, Bos taurus
gagaggagatatcatctcagtagtttaagggttgcttgtctggatatttcttaaactattcatttggctttgtggttatatggagacacatacaaagctgcgaggtacatggggttgcagagtgtggattaaaatccacgtgtcttaacacagattacaacggaaatgcctatactactttccatttctttcactcacatt

SEQ ID NO: 11267 - DNA, 201 bp, Bos taurus
ctcacctggggtgattttgtgtcccacccaaggaagatcattggcaagatctggagacactgtgagttgttccagcagaggaggtattactggtatgtagaggataaggccgggggagctgctaaacattcgtcaatgaaccacacacgccccacattgtcctccattcactgttctcagttacagatttctttacactta

SEQ ID NO: 11268 - DNA, 201 bp, Bos taurus
ctcttgtccaaattaccagctaggtgttcctggtttaaaggaagagctcattgtggttgaccttgaacatggttggggttaagattggggaaaggatagctatggtggccatgagttcatcagctaaatcaagccatttggtgtcagggcatgtgtataaaaccttctgggaaaatcagaaagttcaggatgcagagtttt

SEQ ID NO: 11269 - DNA, 201 bp, Bos taurus
agatttctgggacattcaggggccattctaccctgttagacaagatctgtaaagagctaagttctagagctactttcatcaacttgtctctgggatgccttaggccagataatactactggttccccttcaatgagcacagaatacgtattcaggcagagttttaagcactttatgaatctcaactcatttaatcttcatg

SEQ ID NO: 11270 - DNA, 201 bp, Bos taurus
aagaaagcatgtatataggaaggcctcacagaaggcaagacaggaatactcaatcatatttacaaataagagctatcctccagatatgcagtgacacctggtaaaatgcttggcatcttataaaccccatgctgaacacagagatataaactgctttccttctgtggataaatttgcaggaagattcctaaaatctttgtt

SEQ ID NO: 11271 - DNA, 201 bp, Bos taurus
gtcattactttccttcctcctcttcctgtcacacatctggaaactcaccagcctttttcctatccaaccgctgaccaggcctatttagaaagtcagcaccaagcagcaattgtgaggaaacacccttctccctgatcttgaatttctccctttccccggccccagcacatgctctgctatcctccccagggcagcaatctt

SEQ ID NO: 11272 - DNA, 201 bp, Bos taurus
tatttctcatgattttgtgtgttggctgggctccgtcgggcagttctgttccacacagtgtcagttggggtcatccatgtgagtgcctagagttggaacacgcaacagggcggcacctatgtttggcacctcagctagggcagctggaaaggctgggggctgactgagcatctctctttttacatagtttctcataattca

SEQ ID NO: 11273 - DNA, 201 bp, Bos taurus
ttaagccactaaccaaataaccaaaaattggggttgctttttaattttgtcccttatggaaccatagaaaattattttattttttccttctattaaaagtgtaaaaaccactaggacaggtgttgtactggtaaatgtttaacactcaggtcttcagggggaaagcctagctttacacaaagtgacaatttctgtggtgta

SEQ ID NO: 11274 - DNA, 201 bp, Bos taurus
tcaatttttttatatttaataaaaattttagaaagagggcaatatactagaacaggagtgagcaaactacagccttgaggccaaacccaacccatcatagtcatgtaacctgatttccatgtttaaaagacaactttggaaactggtgagtgagatgtggaaggccaagagtggaggtagggaagtcagagatgagactgg

SEQ ID NO: 11275 - DNA, 201 bp, Bos taurus
attcacccagttgctcacacttaaaaactaagaaatctctgattcttccctttctctcttttctaatatccatcccttagcaagtgccaactacatctcccatctgtttactctctagcaccactgcctcctcctgagacaaaatcctccttctctcttgttccaacaaactctttgctggtctccttgctctcatttcat

SEQ ID NO: 11276 - DNA, 201 bp, Bos taurus
tccccagttcctggcacagagcttcctaaagctgctgtaatttcctaagtgataagaacatgtggtgcatcttttggtgcagttgggaaagaatccactagtcagtgtcagagccccaggagaggcaggttggctccctgggttgggaagatgccctggagtgcatgtgagccaagttgcttcagtcgtgtctgactctgt

SEQ ID NO: 11277 - DNA, 201 bp, Bos taurus
aattccacaaaaatccaagggcctgtctcctcggtgaaacttctaacagtttaatcatctgggatgtgtcgagataccttcttcagagtaaagaacaaattgctgcacctggcctccccaatttttaagaaagggaagccatggacatggaatgaaggcaacacatatacttcattttcattacaggcagtccaaaagctt

SEQ ID NO: 11278 - DNA, 201 bp, Bos taurus
aggatgtgaaacaacaggagctctcagctgctgatgggaatgcaaaatggtgcagccactttggagggtagtttgttggattcttataaaactaaacctattccactataccacccagcaatcatcttctttgatatttacccaagtgaattgaaaatttatgtccacacaaaagcttaatggtttatatacctttattca

SEQ ID NO: 11279 - DNA, 201 bp, Bos taurus
aggtcacaggaaggggctcagtgcagctctcaggtggggccggctccctcacccgcttcctgcccactggcctccccggctctaaggcctagggtgtctgtgagaccaggttccagccccacccatcaggagagtgaagggcaatggttgcactcatagcagaaggcacatccttggcaaaggccttcaattgccagagtc

SEQ ID NO: 11280 - DNA, 201 bp, Bos taurus
ctccccatatgagcttttctggaattctttatcttgaagaatgtcacctcccacccacactcagacagctacaccagagagctgggagtcaccatggacccctctccctcaatctcagtgatccatctgtctccacctcttgctaattgctgcctgtctatctctcctatccacagcctcgttgccaactttttttgtttt

SEQ ID NO: 11281 - DNA, 201 bp, Bos taurus
tcttctccacctctccttggcacagaggaaaggcttgcccatcccttgtcttggtagagagcacagccctgggagggaaaaacctgtggggccaagacaagaaaagaatactggtattgctaaaggagaatctttctaatgatgggagtaaagtcattgcacaagatggtgattcaaagtctttgtcttacactaaaatga

SEQ ID NO: 11282 - DNA, 201 bp, Bos taurus
gttggtttggtggctggccctagatagtattcagggcaaggtgaatgccttagaccggaacttctaaccccttttcaatagtaacagccacttcccaaggaactcagtgtgtgtcaaaggccacactcatgcagaccctgtcctgtgcattgcagggcagccttccaattgaaggggtaccctaaccccctcctcatttgt

SEQ ID NO: 11283 - DNA, 201 bp, Bos taurus
acatctatgcagaagaaaaagtcaaaggggccaataaattacagaaataataattactttgaataacttctattgtaaacgtccaaagatggacctttttaaataaaaggaagtgactgatggccacagtggcgtgggtagattgccaagggctggggctgtgcctctggctggagagccagtcattgggcttgtgggcag

SEQ ID NO: 11284 - DNA, 201 bp, Bos taurus
gataccaaattcagccctctccttttccagccttaattgaaactattgataattacccagaattgttttctggtggagaaggtctaaggcaaagtcataagcaaaagtccaaagtgaagtaggaggtggttatttaacaatctggggcttctcagaagtctcagcagtaaagaatctgtctgcaatgcaggagaccagagt

SEQ ID NO: 11285 - DNA, 201 bp, Bos taurus
gaactaatactgggagttattcatagaaattggaagtatgcactgtttagcactgagagccatacctgatttattatagtaggtgctcattaaatgtttctagagtttaaagaagacacacattagttgtcataggaaatgtcactgagggtggaagaataacttgtttgaagtcagtagacctgaattccaatcccatct

SEQ ID NO: 11286 - DNA, 201 bp, Bos taurus
aacccctgttctccctccctttctcctttctttcctccctcctcctccccttcctcccttgcgtagtattttttgaagagcgagtactattccagaagctgtaactgtttcccagctggacccagcagtgaaaagtctttgctattgtgttacctggtagggtacgtcccaggatcaacagtccatttcccttgagaggga

SEQ ID NO: 11287 - DNA, 201 bp, Bos taurus
gagaattaatctagtgggtaactgttcgaatctagactcgttcatgttgagacgtgacgggagctagttatttagcctctctgagccttggcctccgcatctgttaaatagaacaacagccacctcctagaagagttgtgcatacaagtcctatgtctttgaggtacctggcccatagtaagctctcaattcaatgaagtt

SEQ ID NO: 11288 - DNA, 201 bp, Bos taurus
aagagagacaccacagcctataaagtgggctgagagggaggaggaggagggccaggtggaccgtacaggtgacctgccgtcttggctctgcctggcctcatgctggctgcttttctccttcctgccctggacaggagaggctggggacagagcccagggggagcccgctctgatagggcagctgcgtctcttactggagtg

SEQ ID NO: 11289 - DNA, 201 bp, Bos taurus
tataatattgtaattaaactgtacttcaattttaaaaaagaaactatctaaaatgaagtacatggagaaaaaagactcaaataaaataatcagaaccatagtaatatataacaatatctatagatccaatgtatgtgtaattgacatctcaaagaaagaggggaaagattcaagaaaattacttgaaggaatagaggctat

SEQ ID NO: 11290 - DNA, 201 bp, Bos taurus
gaggaatcttaaacttttatgcattttaaaacttttatcttagttaaagcctggggtttgagaaaatgaggtatgtaaccacaaaaaagttcactccttattggctggaaacctactaaaaaatccatttttttttccagagatttcctaatctgttgcaaccatatatgtttttgtttcttcatgagtcatttcatttaa

SEQ ID NO: 11291 - DNA, 201 bp, Bos taurus
acgggggagcctggtgggctgccgtctatggggtcgcacagagtcggacacaactgaagtgacttaccattagcgtgacctgggaggcatggtgtccagagatgggccatcataatgtaagctctaggcaacactccccttagtgattgacttgtactaaagtataaaggttctctgttacaagaaagagtgaagacaact

SEQ ID NO: 11292 - DNA, 201 bp, Bos taurus
tagtttgatgtgtaatttgttgttgaatagggctagggaggtggatgggttgagtgcacaggcacacagaagtatgtttggggaaatgggacatgaagaaaaggttacttggcattgtccaagtatagagttcgaggggcgtgcgtggtcttgtggagggagatgggctcaggtacaggaggttgtatgtcatggtaggtt

SEQ ID NO: 11293 - DNA, 201 bp, Bos taurus
agagctatcacgcaattcgacgtatctgatgcctgtgatgcgcttgaggtgagtctcagagaaaatgtcggatcaccctttggcttgatactgtctacagcatctctggccatttgcctcaagctattcctcagctttctggggctggctgggcagggcctccggtggctgcagctcccaggctggtcgcctccggaattt

SEQ ID NO: 11294 - DNA, 201 bp, Bos taurus
accagaatttcaattctgtggagagctctgggctgggctcagtgttcagagatatttcagattcaggcatggggccaggtctttgtacctcagggaaccccgctctctaataatatttcctctggtcaaactggcctatgaggacagctaccgctgagctggatgatgctcaccagcgcgttccttactgctttggggata

SEQ ID NO: 11295 - DNA, 201 bp, Bos taurus
tgatttaacatttctcaatgatctaattttaaaggaatgaaagtcctatatgcatatgactttaaatacaatggtattaaaaaaacaaactgattttttttaagtaccatatttgcccatcaggaaaaactgtagaataaactggaatattatgtgaaaaaattttcatataagaattttatctcaagaatttgaaccttt

SEQ ID NO: 11296 - DNA, 201 bp, Bos taurus
agtgggaaacgccaataatagcccctgtgaaaggaaggaaaaccatagtaggccaaattagcggacactgttgtggccctagagatgggctctgctccagaaatctctcccttccattctgcatccacagggtgcaggggtggctggcctgaccccgggcacacagcacaaccagagggtggatggggacaagtgtcctgg

SEQ ID NO: 11297 - DNA, 201 bp, Bos taurus
gcaggtaatttgcaagccctggagagacccttacgggtaattgtggttgtaccctctctagagccagttgtccacataccactgaaaaggaacccacagaagggctgctgggatggccctctctactaatggtttcagagacctgagctgtaaaaagcttctgaaagccccttggtggggttattttatagctcttcagga

SEQ ID NO: 11298 - DNA, 201 bp, Bos taurus
aatggccaaccatgtctacatgaccgagctccaattaagatgctggacaccaagcctcggtgagcttctccggttgtcaatactcaacgtgtattgacacacactgttgctggggaacaggccctgtgtgtacagctcactgggagagaaatactaaaagctcatgcctggttcctcctggacctgtgtgcctctcttcct

SEQ ID NO: 11299 - DNA, 201 bp, Bos taurus
cgtgggttgccattcccttctccagggtttcctcttcagttccttaggcagatttcttttctggttttgtttgtttctcttaggcagatttctgattgtctggcctctttgcacagtgatgggcacagagtggccctcaattgcaagtagctggatccataaccacccttacctccaacctagtaccaagggtgcaccccc

SEQ ID NO: 11300 - DNA, 201 bp, Bos taurus
ctagccccgtgagttgaagggcctgacctgcactagctgatggtccagagatggctcctctgaggacaaagcagggtgggctagagggcagatgccacccataaagagaactgtggccagaaggggttttgcctggtaatccagtcctcagtccattttaattctcctgcctttcagagacctggaaccctggatctgctt

SEQ ID NO: 11301 - DNA, 201 bp, Bos taurus
caagacgacacagcaagaaaagtggccgaggtcagtcccacagtcctctcaccagcagtgtaggaaagacctcaggcttcagacaggaagaggcaacagacaggcctgggaggcctgagacctgtggcccttgctacgcaaggagatgcaaaggacaaaagactcaggtgacctgagatttctcgaacactctcctgcctg

SEQ ID NO: 11302 - DNA, 201 bp, Bos taurus
aggcccctctacctggatttggaagagtgactgtttgacctcttgcagacctcctgagctatatcattctaccattcttcttttctgcaaatcatacagacgccaaccttcactgttgcaggccaaggcaaagctagacattcctgaacttgcacgacatcagtgcctctgggtcccctcaccccctctctgcagcctcgg

SEQ ID NO: 11303 - DNA, 201 bp, Bos taurus
ttttcaagccccatccatgtggcagcattccaggagaggccttggtcactggcaggcatcctctcaaaccagttagaaccacaggtgagctggagcctcaaaggtcagtggatcatctggcctggcctgtaccagccagcctggttttacccagaccccaacgtggccgacccaaacaggctgtgccagaaggagactcca

SEQ ID NO: 11304 - DNA, 201 bp, Bos taurus
agtaagatacatagaaagggattaagaaacagcaacaaccaaagcttctttcagtctctcaaacatacagagccattcagcccaactctggcttccaacctgagaaaggggtcagaaatgagacgcagatcattccaatcttccagcattttcagcctcctgctcctcagagacctcgctgtctgctcctgtggtaactct

SEQ ID NO: 11305 - DNA, 201 bp, Bos taurus
aggacatggtcgtgatctttggtccgggaagattccacattccatcatggggcaactactgaagccctcgagttttagagtctgtgttctgcaataaaagacaactcaatgagaagccctcacacctcaactaaagagtagtccccgtccgtcacaactagagaaatcccgtgagcagcaacaaagacccagcacagccaa

SEQ ID NO: 11306 - DNA, 201 bp, Bos taurus
aatctgggccttaccttaaagaggaatggcaacttctgcctttatctcttggaatccagctgttgtctaagaagggtgagtactcagagagccatgctaacagaagtcaagccacatggcgaggccttggaagaggacaactgctaagggagaggggaggcataatgccaaggagcaccaaggcgtcacctcggaagggat

SEQ ID NO: 11307 - DNA, 201 bp, Bos taurus
gtgcagcccaggacaggtcctgagacccttgcaccctaggagaggacaccctactggctgtacacacctttgttctgttattgagtccctggtgacacctgggggacaaagtggtgggggttaggaagcgtcccttctagctagttctttctgtggctgggtcatgcctcactctgtgactggagaagggcacctctaata

SEQ ID NO: 11308 - DNA, 201 bp, Bos taurus
catatgtaccagagtcatctgctttccccataaaaatcctggataaacattgatgcagaatccaggaggtcaaacagcttgacgtgccagcatcatcaaataggcaacactccagttggcccaacccaagtccgagctgttgggatgttcctccttaattgtgccatctgtggttgggatgccagccctctaccggaggga

SEQ ID NO: 11309 - DNA, 201 bp, Bos taurus
ccagtgatgtcccaatttagctttcaatcagccatgctgggaggatttacaccacagaatttggcagatgctacagaagaggcccgaaattgaggaaattgaggaaattttctagactctacaaggtacagacatccctctccatgggctggaaatcaccgcagaatccaatgcctggcctatggaccagatacctaagag

SEQ ID NO: 11310 - DNA, 201 bp, Bos taurus
gttcttctgatcttctgtgcatcccatgctatctttattccacacttgtgtgactttttcacttgtatccaggcagtatctaggtttgtattagtaactgcagagattcctagtttctacatctgaaactgcaagcagtgaaggccataagtgggcagtctcatcaactttgtttggaagaggttgcttttcaaaaataat

SEQ ID NO: 11311 - DNA, 201 bp, Bos taurus
attcctgaggagaaaactgaatagagagaaaaaaaaagaagaaaaaagctgttttattgtctctgaactgatgaaagatttgagtttacagattgaaaatccttcctaattcaggcagagttgtcataaagacatatttggacataagctagaaaattcctgaactccaagcttcaaagacaagttataaaagaacagtga

SEQ ID NO: 11312 - DNA, 201 bp, Bos taurus
tcctgtaacacacatccagggatgacatcagcacgagattagccaaaaggaacaggttaacccaaagctcaaggctgtggaagttttacccaggccttctcccataacattcatccaaagctcaaaaaaagtatgtccttgaataaaagatactgctgcctacaaggcccagttgtctaaggcaaaagaatgtgaaaaaga

SEQ ID NO: 11313 - DNA, 201 bp, Bos taurus
aataacataaagaatataaagaatgtttcagatgtgaggtccaaatcaaagacaacaataaaaaatactggcctgcatggagcaaatccctttcaactggaaaattccatctacatgatggctatcaatttccagaacaaaacaggggtaatctactagtaataaaaagcaacatcaacatctccaaaaagttttcctttc

SEQ ID NO: 11314 - DNA, 201 bp, Bos taurus
ctgtggactgttactatgattgcaaatataagaacccacttaagaacctactcctacaacggtctacacacccaatgctgccagcttttagaagacaaccgaggagaacaaaggacaaaaagcttctgggaaagaattcaaaaacagtcagtcatttctatcttaacaacaacagaccttcctccttaggggaaagaggga

SEQ ID NO: 11315 - DNA, 201 bp, Bos taurus
agtagttcccagggaaaagtcagccaggttgcaaggcccctgaacggcctcagcaccctctctgaccagggagaaatgggtctccttagggaaaaggccatgtaaacagcaaagagctagagtaccaggaaagcagaggacagcaaaccacaccgtcctcggcacaaaaagggccagctgggcatgagccatgcactgaca

SEQ ID NO: 11316 - DNA, 201 bp, Bos taurus
ggggcggggatgaagcctgcaggcccaactggcaggggtcccctagaaaccagcggacacaacagaagcagggacggtacagactctgggcagcctggcactgaattcctggccccaggccgcctccctgacccccagggccaatggggtgagtcaccccactgttgcacatcagacgcccaccctcctccctgctcctat

SEQ ID NO: 11317 - DNA, 201 bp, Bos taurus
ataacgttttacgttactaagtgccggagacagggttaagaaagaatctgtcttaagaaatccccctcttcaccagcgtaagctgctgtcacttggcccaacaaggcagaaatcggagaattaaagtgatgccaaacgtgggacaaggggaaatgcgaaaagtccccgcaaatctgttttcctattgttatggacaaccct

SEQ ID NO: 11318 - DNA, 201 bp, Bos taurus
gccctcagctgcctcccaggcagctccctcctttcaaccatttacattcggcagatttcccccagcaccttgttctcccacctcctctgtcctactccccgcctggccgtggtcctggactctgtcctgttgtgtccctgacatcttgtctgtatggatcgtctcccctcactcccatgcatcttgctgctaccttaggcc

SEQ ID NO: 11319 - DNA, 201 bp, Bos taurus
cagcccaccaggctccccagtccctggtcatctttttcttcatctgcccatccttttcttttttatacctgttctgaagtggccgatgattcttgcctgacggttcacatttagcaatgaagaactagaataggatctgggagtgtgagtttgggatgggctggggagtggttcagttgacactccttgcctcctgtgcag

SEQ ID NO: 11320 - DNA, 201 bp, Bos taurus
cagaaattctaggacctgtttttttgtttaacagaataaagacttacttgggggctatttcttatggtatctgtaatgaaatatatcatgatgggattatcttatattacacatagaaaaacctccagtactgttttagaaataaaactgaaatcttccctagtccttatctttttcttcaaaagaagaaacaaagtagaa

SEQ ID NO: 11321 - DNA, 201 bp, Bos taurus
attgtatcataattttgtcaaatacatattacatcagtaataaagaaaaggaaaccaacactggtaaaattatgtcacaaactgcctctttgttagtcatacatgtgaatttttaataggaatattaatttgaagcttacaactgaaaaaagttattcataacattctgtcgataactgttctcaaacttatctttcccaa

SEQ ID NO: 11322 - DNA, 201 bp, Bos taurus
gtactagtcccacccataaggacttcaccctcatgacctatttacttcccaaaggccctacctcctaatatcatcacattgaaggttaggatttcaacatatgaattttagaaggaatacaaacatttggtccataacatttccatatagaaaaacaaaaggtcaatagtttaagtaactttccaaagctggtaaagttga

SEQ ID NO: 11323 - DNA, 201 bp, Bos taurus
atttctaaaagttactcttatattggttcttttggatttttcatttcccagcattatctattaacttcttacattggaagatgaggatttagtgctctctaaccttcacagttctccccctgtattgtatctcatatccactctctcttcaactctcattctacaatatagttgaaacaaattttatttttatatttagtg

SEQ ID NO: 11324 - DNA, 201 bp, Bos taurus
caggctcaaattcatgggaggatgcattgaacccacccctgaagtgctcagttctctgtctccctgcatttttctgtcaaataacatggccattcacagattctccttttgtcctatgggtcacaggtagagaatagtggcaggcagggaatttttgtgctaatgataaagatgagcgtgtaagaggctcccaaagttggg

SEQ ID NO: 11325 - DNA, 201 bp, Bos taurus
ccccagttccagcctcgagtccattccttctacctctggcccccacggctccagaaccaccaagatgccagaccaatgcttgcccaccatggccaccccaccccagattgtccttgagtccttctctgggtgcacacaccctgaaggcttctctgccccagagaaggcctgggtttggagtcactccctggtgacacagga

SEQ ID NO: 11326 - DNA, 201 bp, Bos taurus
gcaggatattttccttctttacacaaataattttttctctctgttcttttgcaaagaaatctgccttttcatgcattccaacattttctttcttttctctgtaattctgcattccagcctttatcctctcagtcaatccattaacacagaaacaaatttggtttgcaatcaacattttttttattaaagttggttttagag

SEQ ID NO: 11327 - DNA, 201 bp, Bos taurus
gaaagatcatttgtgtcactcaattcatctggaagtagattaatgtcatggctactactacagcaaattaacataacaagtcacagctggagcaacaggacctgcggctaaatggaggaaagtcatcttctagaaagaacacaatggttatctccccacactgctgcatcttagaacacgctgcaattcggagagtgaaaa

SEQ ID NO: 11328 - DNA, 201 bp, Bos taurus
aaaatcattcataaatcaataagagaactgggacctcccccctctttgtttcagtctctgtaaacagttgtcagcctcatatttctctgagagattttctgattcacaggttctcaacgttgtctacccattggaagcagctttaaaagaatactgatgcatgggtcccacccagagattctgttttatttggtttagagt

SEQ ID NO: 11329 - DNA, 201 bp, Bos taurus
cttggagtggctgtttttaagggccacgtgtaggctgagttaacagaagaaaccagttgaaagagaagtgagggtgatcaaaccaagcatttcctgagagagtagtaacctggtttcttgaattactgtttattaatttaaattcagtccttttcgatcctagatgtactttagatctgtgtgtgggattttacacgagct

SEQ ID NO: 11330 - DNA, 201 bp, Bos taurus
catcattccagcggtaaaactctgtgtgtggtgggaatgcaaaggaagaaacaagtaactgtaactgtgaggatcaggaatatcttcatgaaaaaagtggaatatgtgtggagtgaggctgatcactggagggaagggctctgtgtgtacccagcccttgaagccctgcagctgttgagctttattgtcatagaggggact

SEQ ID NO: 11331 - DNA, 201 bp, Bos taurus
tggccatgttgatagctgtggaaaactggaggtgagggatggagccctcccgggtggtttgacctactttctcgcatcctctcattttagcttctttgcacccctaagccccggccccctgtatagctaggtgaccatccctattttaaatgaccagaccagtgtacagggacgttgtccaaggtcagacagctagtcagt

SEQ ID NO: 11332 - DNA, 201 bp, Bos taurus
acacaggtcgtgagcctgtgtggaattccgtatgctggggtagaggtcacctttaggttctagacggatatctagtcatttggtaaataccaacagttccagtaagaacatgccattttccaacgtaactgtgacatagtagtattagaaataagtcaagatagaaatatggaggaaagagaataatcttctgtttcctcg

SEQ ID NO: 11333 - DNA, 201 bp, Bos taurus
tcccctgaaagactcgcattcaaaaggttttgctcatccccagccagacctgtatcaccatcactggttgtcagagtgatctgatcagctgacagatgacatatctcctcgggtgcaagtgagggccagtacctctggattcctgggcagcagccagtataagtagtcaaggctgtgggtccaagcctggattagtggaat

SEQ ID NO: 11334 - DNA, 201 bp, Bos taurus
gtaagtaatttaagctttcttccaaaacacaatgtactgcttcagatacatacggaattcaaatatcacttcaacagataaacatggttttgtacaaggaacttgaactatttcatttttaatgttgatgtaatataagctacagttctttgtcagtcaattcaagtagtaaaggtagataaattataccttatttcagtt

SEQ ID NO: 11335 - DNA, 201 bp, Bos taurus
aacaggtcaagtgacttctgccctgccatctcaagacaggagcatcttctgaacaaccagcacagttaggtccaactcacttagtgttctatacacatgtacgcaaaacagaaagcaaatacaatctatgtttaaaacaaaaaaaattgaaacttcttcctttggaaaaaaattttttttcttttagataaatttcatgag

SEQ ID NO: 11336 - DNA, 201 bp, Bos taurus
actcagtcctcattcacaaggcataaagtcttaactaaatttaactctttattagtcatatcaatagaaaagtaaagtcataattcataaatgtgacaaatgtgctcaggaaataataaatctcttgctacagaatatgtttaaactgtaactttaacatatatgaataaatgcttgggaattccttgacagttcaatggc

SEQ ID NO: 11337 - DNA, 201 bp, Bos taurus
atttgcaaactcttaaactattgttcaaaactctaaaacatgtaacagataaaagtggagcttctctgcttgaagttgaaaaagagagttccagcagtttaccctcctctgtgtttccgtattggagcctctatagcactgttggaaaaatcaatgatttaaaggaaatggtcagaattaagcctagacaaacagtgcctg

SEQ ID NO: 11338 - DNA, 201 bp, Bos taurus
ggtattgttatagtggcctatctccaggtaccaacatctgtactggttccctgtggcaactttaacaaactatcagaaactcagtggctaaaacaattcaatattttctcttacagttctaaaggccaaggaagaagggtggaggggagtggatattgagaagttagaaagctatgaacacattttgttttttctttctcc

SEQ ID NO: 11339 - DNA, 201 bp, Bos taurus
accatggcattgttccgaattgttacgactggtgtatctcccccacgacactctaaatgcctcacagaagaaagcgtaattcactcatttttgtgactttcacagggttctaactaaataactgtaggttgctgagttagtgacataagacacttacttacagaccaaaagccctcaggagaacatataaactcaagttta

SEQ ID NO: 11340 - DNA, 201 bp, Bos taurus
caaaactttatcaggtaccatgctattccctgtgttaggtgttgtacttagggttaaccctaaaattcacagatcctcagaggcccactgatagtttcactgcctcaaagagatcaatgaattttcctgagtttacagagcttgtgagagaggaggagcccacatttgacccaagattgtcaggccccaaagtccctaatc

SEQ ID NO: 11341 - DNA, 201 bp, Bos taurus
ggaggcttccagatagaaatcaggctggcatgtgaacttggggaggcagggagagaactgaacacagcagccactgacccgaaaggtctggccctcagctgcagtttgcatctgggtgttctttgactgctgtccatgtggcaccgtgctgccagctggggtcactggcctgcatgggtactacgggggaggaatgtaggg

SEQ ID NO: 11342 - DNA, 201 bp, Bos taurus
aaagtttctaaggtaaaaccaaatactttgattggacaagcttattctaggtttcactttgacttttaatcaagaggcagggagctttgagtacccaagatgactccggcttgcagagttgagttatggtggcttggggttctcaggctatattacaattcccgcttaaatagggtgtgaccttgagtgcacaaaggatga

SEQ ID NO: 11343 - DNA, 201 bp, Bos taurus
acttatacttttctttctccctaactagactgtttcatgtgactctgtatactcaactagcacttagaacatgtgcgaaaaagtattctgaatgaaatattggttgaataaacttttgttggttggatggatggatggaacatcaacttgtgatactaaccaaatccagattaaatttgaatttacactggtctgttctgc

SEQ ID NO: 11344 - DNA, 201 bp, Bos taurus
gatagcatcaatgattcaatggacatgagtttgagcaaactccttgagatagtggtggacagaggagcctggcctgctgcagtccgtggggtagcaaagagtcagacacaacactaagacacaacttagtgactaaacaacaacaaaggccagcaattaagtattgtggcctcaccagaatgagtcaggtaaggatttcat

SEQ ID NO: 11345 - DNA, 201 bp, Bos taurus
gacagggaagcctgggcactgcagtccatggggtcacaaagagttggacacagcttagtgatggaacaacaacaaacaagcttgagcaaaaagtgctacagtgggtacctcgacttttatcaaggctttccctggttatgctgactaggattatactgtgtgaccacagagtccaggccagaccccaggcagggccactgt

SEQ ID NO: 11346 - DNA, 201 bp, Bos taurus
cagtgattgattttgccatttatgtcggcaaagctggacttaagccatatcttaatgctttaaaatatctagtttgccattcttccaataatatcacactactttttagaaaactaggaatagaagaataaggaataaacagaacctgaagttagtagaaagagacaataaagactggagtataaatgaataaaatagagg

SEQ ID NO: 11347 - DNA, 201 bp, Bos taurus
attataaaaacaagcagtagacaagatttcgcccccaggccatattttgctgacccttggagtagctcataaaaggtagtagtaattctcacgacactgttttcatttagattggccacattaaggaaatttgtaccctgacacactgaacaggttctaaatgtgaccatcttaactttcttaaaaagtaaatgatatgat

SEQ ID NO: 11348 - DNA, 201 bp, Bos taurus
gataggtaggccatgtaaatgcaaaaccatgagtgcaaattttattccagaatgttaaaaggaaaataccagtgtggaagagaaaggtggattgaaaaagtcctggacttgggccctgtttgtctcccagcaccctacactagctctggaatgtggcaggtcactcactctgtgtgcctgagaagccgtctctttaggaaa

SEQ ID NO: 11349 - DNA, 201 bp, Bos taurus
attaagagtaatcccttattctcagaatggccaacattccataatatggcccacaacacccttcctctggtccctctccctctcttgccaaacacctaacataactgtagagtctatattctctcccaacttcacgtctttgcgtatgttgttccctctacttggggtgtctgcccctcccttctctactttgaggactcc

SEQ ID NO: 11350 - DNA, 201 bp, Bos taurus
tcggcgtacgcctgcgcagtcagcagctggagaggcctgcggttgagacccccagcacaactccttttcattgtctgtgctcggcgcctgcgcagtaggagttcgccgggactgggccggagcaggggtagggccgggctcctcgccctctccccaggcgcctgcgcactgagcggccgctccttgccgttaccgctatgt

SEQ ID NO: 11351 - DNA, 201 bp, Bos taurus
ttcaaagttctctgcacttctgacatttcagtgtttcatagagagggtgtaactgttgcctaggacaatggttttagctcaaagaaatataagaacctgccgaagccaaattgactaactatacctaagtcaaaatatcttttaaaaatgttgtgcacgtgcatatgtgtacatatatgtgtctgggtatatataacagat

SEQ ID NO: 11352 - DNA, 201 bp, Bos taurus
ggtttattttttatttattttgattcataactttgcttataatacagacagaacagagcctatgtttatctgcttgtacacatgccagaatttcacttccaggcccataactgtatgctagaatggtggattcttattgtatcagttagtataaactagcttgtgtgctgtggtaacaaacaacctccatactttgatgga

SEQ ID NO: 11353 - DNA, 201 bp, Bos taurus
tccagccttcacctgactgttgagttctttcaggagaaacaaaagagatggtacaaaaagtgcagacccagcggaggacaagctcctgtgtggacctggtatgcggaaaagcctggaagcatgagtgagcataaagatttgagagaagagaatggagtgtggctcagctggtaaagaatctgcctgcaatgcaggagaccc

SEQ ID NO: 11354 - DNA, 201 bp, Bos taurus
tcagttattcaataaatgtttattgatcatgtctgccatgccatgcatgtagatttaggcaagattgtagaactcaaagagctcaatttagtgaaaaagatcaaaaggtagaaaattcatgcatgatcagataatgaatttgcatgtccttgaaagggaaaaaatgtaagccttatgttactgtggaaataattttcatta

SEQ ID NO: 11355 - DNA, 201 bp, Bos taurus
ctcttgacatccatcctttaccagcttccatgctgtgaggtgagtctaaatatctacctgggacctaaaagcaccacacttccctgggcctcagggcctttctatgttttgcttcctttcttggacacagctttccttcttgtctctatttcttgggtttcatctaaggccacccctcctgcaggttttccctggcctcct

SEQ ID NO: 11356 - DNA, 201 bp, Bos taurus
ttgttttgcgcctctgattaatttgtctcacaaccctccccaagatgtgcatgtacccctctgccaagttggagtccagctcaaggtgtctgggagggaaacttgcaagatgtatggcctgatggccgtcccctgccttttgattcccaagaagtccttctgtgcatgtgtagtatctcccttgccccaaggacaaaaaat

SEQ ID NO: 11357 - DNA, 201 bp, Bos taurus
ggaggcagcttagattttggcctggtccagtagggtcccagaaagtcagacataactgagtgtctgagcagagaacactggcatgtctatgcccacaaagcccataggccctaaacctacacctgtctcagctatgggagcatttatctgttcaaatatctcacagttgctgagtttccaaagtcagcagtgggggtgtaa

SEQ ID NO: 11358 - DNA, 201 bp, Bos taurus
ttttatttccactacatgtgtcacaaacacatttccagctatgtacaagcaggtcttctcactttttcagcttcatataattctccagcgtacagatgacaagaaagcactcttacccctttattaatagtcctttgtctgttacactgaagttacactgtgacttccctgctggaggtccctgaagagccactgtattcc

SEQ ID NO: 11359 - DNA, 201 bp, Bos taurus
aatataaaatatgaaaccaagaacacagtttgaaaaccatttcattacattgtgttgtaacataatcacatgctgtctctttcctctgtgaaatgtatataatactttttagcaaaagagatagtctaaaattattatttaataaacataaaaatagcctatgtaatttattttattcatgaaataaataaatttatttat

SEQ ID NO: 11360 - DNA, 201 bp, Bos taurus
tcccggtgctccaggtatgccctgaatcttctgtaaaacccattaggaattttaagaaagtttaagaaacagagactcagagactcctctgcctggtacctcagtgcatttcagtgcatacaggtaaggtgaaagccaaccattccctatccctcataaagctacggtgggattccacaatgggattccaccatgagaagc

SEQ ID NO: 11361 - DNA, 201 bp, Bos taurus
atgccatttgcaagaataataggattaactgaagattgaactatatagttttcaaggaagatttaggttttttcttcttttttaactttcatatcatgagatataactttcatacagaatgacctcaaaccataagtatggtttacagaataattagaaaaagcaaacaccatttactgactctgatcaaaaaaagtagaa

SEQ ID NO: 11362 - DNA, 201 bp, Bos taurus
cttgcccatggtggagggagcaggatgctaaagtgtgggagagtggaccagggagaggactgctgttggtttcacagagatggcctgaagggacagaagtgaggagctccctagccgggaatgatcctggaggaagcagatctgccttggaaataaggcaccactgttgaaaggcatgcaagaggtggggccgccatcatg

SEQ ID NO: 11363 - DNA, 201 bp, Bos taurus
aaactgtgatcactattcccactacaggcttcatcatggagacggtggaatacaagaacatcagcttcactccgtgggacatgggtggccaggacaagatccggcatctatggtgccactacctttagaacacacaaagtcttatctttgtggttgacagtgtgagaggcctgcgaggctcacatgaggatgctggcagaa

SEQ ID NO: 11364 - DNA, 201 bp, Bos taurus
agttattgtttcaatgaatatggaagaattaatcagaaaagaaagggtcagtatctctcaaagggctaaacaaaagggaatgaattcagagagaggaaccgcttgaggtccattagcgatgtccagcatttgaactgttttagtattctgaggcaggggctgctttataataatggtgttgaacaccaagaatgtagctct

SEQ ID NO: 11365 - DNA, 201 bp, Bos taurus
gttgtgtacctgtaaatgcaggggtgtgtgtgtgtgtgtgtgacagcacagtaaaactttttcttcacagggaacaaaattgcctattttagtcttaaagcatcccgactgaataaatcaaggaaataatccccttgagcttaattattactattctattcctatactgattgaaattattggatatttgcccattctata

SEQ ID NO: 11366 - DNA, 201 bp, Bos taurus
gttttcattgagaatgccatatgcgttcttgtcagaagacccttagatctactacttccctctgtgtttgatgccctcctctggcccttacctttttactgctctggtgtctgctcattcattgcttcttcagacaggtctcctttggctagctctatgaagtagcctttcactcaccttgtgatgtgatcagattttatt

SEQ ID NO: 11367 - DNA, 201 bp, Bos taurus
agggtctgcacaaggctcagtgtctgaagctctgcctgctggtgtggggctgtgagatgagaaaggtcagtggagcagatagtgaagactctttgagacatttatggaacttgggttttaaatgacaggtagtgcggagccattcctcttatttaataaaaacttagagaagactttgtgccagatgttgttctaagtgca

SEQ ID NO: 11368 - DNA, 201 bp, Bos taurus
acccaaaacttctgcgctggcaagtggattctttaccactgggaaagcccagggatgggatgagggcactccaaaaatagcataaaaaatatgtattcccgatgataataagttaaatagccaaaaataaagtagagaagccacatggggagttcagggaaacacgtggcctgttgcaattttaagtatggtaggaaggaa

SEQ ID NO: 11369 - DNA, 201 bp, Bos taurus
atgaacattgaagatttaaacacacatacggtactcatattaaatagtacataatacatttctgtatatgccaggatactaaactaactatctcgaatacccttatgtgccaacatagtgagtcaaatctaattttttaacttaatttttaaaaattccttctttacttatccttgaaagatgctctgattgaatttataa

SEQ ID NO: 11370 - DNA, 201 bp, Bos taurus
ttatttttcatttatactttttaatgatttgacaagtatttattgagggctgacatgatccaaaaccagccttgtattggtgacaacacagtaattagtgttcaaacctagggaaatgttagtagggattggaagtgggtcataatgccagaaattagcaattaagagggtcagttagtccatatttttgtggggaaggtt

SEQ ID NO: 11371 - DNA, 201 bp, Bos taurus
gcaaagggacttacccatacatatacctgtatccattcttaaccttaacctccacttacatactccattcactgttgcttgtaagttttggtactgtattgattcctgtgctagatgtctctgcctggatgccttatctgctcttcacactcaacttaccccaaattaaatacattatttttcttccccagtcagcctttc

SEQ ID NO: 11372 - DNA, 201 bp, Bos taurus
aaaggaagcaacaagaaatctgacaaacagggcctcgagaatatgccaggacgtcagtaattcatgggaaaactggttaagcaattggaattggatgccctgggtcctatctctttaaggccctctccttctatttacccttattctaactttcagcccatgtttaatgtgtctttttttcaaaatttcttaaggatcctt

SEQ ID NO: 11373 - DNA, 201 bp, Bos taurus
gactgagcaactaaactgaactgaataatctctattccctttatactctttgctttggcaaaggacaccaattattttctaattggtcacagaatctctccatatgtgacttctctccattcccttattcctgaagctctcccttcacttagtccatgtggcagccagtccaggttctccttatgactcctcagccctctt

SEQ ID NO: 11374 - DNA, 201 bp, Bos taurus
gcaccagaaaagcctgaaaaggtaattcaaaaccatgggtccattaactctaaaatgaacaaaaccaagtacaagtcttttcccttccataaaattagttctgttgttttgtgttctatttttacaacatataaagaaaaggactcttgaagcttgtctttgcacaatttttaaaaatacgaacatttattttctttattc

SEQ ID NO: 11375 - DNA, 201 bp, Bos taurus
ataaaaattaatagctgatggccatcctcctcagacacactaaaaaaagatctccagccttctactctctaatgcaggtgttaggtgtaaagatttaagtgggccagttccctgacccacttctcccaggctagtggaagggataattgatctggtaatacttggtgagaagtcaggggtgagcctgacctaaccctttct

SEQ ID NO: 11376 - DNA, 201 bp, Bos taurus
atgaactacctctggaaagttgcaaaacagctttggtaacagagcacaaccaggactgataaggagatttgccatctcaggtcaaaccttgtctattgaccggaatttgcatggcaagttgttgactgacgctatgttgaatcaagcatgatgacccttattcaatgcttaatgctttgtgacttcatgaggtgaaaaaat

SEQ ID NO: 11377 - DNA, 201 bp, Bos taurus
gctcaactccggaggggaatttgtagacctctgtcagagaaaatcataagacagagcgcaggcagcaataccgtggcccacgaggagttacgatgcacagtccctgacaccagctcttaggacgtaacgtatgactctggagaacacgaacaagtgctcaacgaacatgtctaatgggcctaatatgtgccaggcctattc

SEQ ID NO: 11378 - DNA, 201 bp, Bos taurus
tccttttctcttaaaattttcaagccattcttttttcttacccttctcctcttattggggtaactaacaggcactttacccaaagtgtgtcctctgttttatcagaagatctgactctacttccccaatttagaatcttattctgtgcttcaacatatttttcaactgttgtttttatgacagttatataaatcaatgaac

SEQ ID NO: 11379 - DNA, 201 bp, Bos taurus
tgctttccttcgttctagctgattctttgatgctttggtgtctatgccagaaaaatacctcttataatcatcagaggccagtgttttcacagaggtcactgcaagctaattaagcaaatatgtgaaaaatagtttaaaattatctcaattagtagagtgtgtgtatacatgcatctggagtggggttaaggagatactgtt

SEQ ID NO: 11380 - DNA, 201 bp, Bos taurus
agcgaccccatggactgcagcctaccaggctcctctatccatgggattttccaggcaagagtactggagaggggtgccattgccttctctggataaccaccacagtgttggctaatagagccttcatgtacaaatttccctggaggcctctataatctgctcattttattttttatgttttaatttttttacaatgatttt

SEQ ID NO: 11381 - DNA, 201 bp, Bos taurus
tccaggacactttcttttcttctttcaaggcctctcttcctctcttcttcctgcctagctcctcctcattagtgaggttcttgtgcttaaatactgtgacccaatcctccataacacttcctacattcctatcaaaagtacacaggaaccagtgattctaaacccctcccttccttggtaggaaatgtatctgtgctgaaa

SEQ ID NO: 11382 - DNA, 201 bp, Bos taurus
ctcagtctgccagacaagacctggggccactctggaccagggtaattataccccttctcaacatatatctatcccaggccagacttgaactactctctggggggatgaagcaggacagtgttttccagtctgcctttaccgtaatgtgaggccacttttgcgagctcctaatcccaaacagtttttcgtgaaaatacaaca

SEQ ID NO: 11383 - DNA, 201 bp, Bos taurus
tcagagatgcctaaagcatcctaagcattcagagtagcaggatggaccacattactagtaccaacctttgcaatctatgtaacatcaatgtttgccacatgcccatccaaaattgtcctctatgcagttaccaggatgttatctgaaaggcagaactgctcctgtcacccactcccctgctgactcctgtgcactaaagga

SEQ ID NO: 11384 - DNA, 201 bp, Bos taurus
atgctctctttccctccatcctcactttcactccttgtattttccttcgagatgagtggggaaagcgattggaagtgtgagtctggttcatcaggctgagtatgtgacttgggcctgagcaactcgagctgtaaatctctgagtacttcaggggctctgtggtgccttgagtatgagggtgagggctaagacagtgatgtt

SEQ ID NO: 11385 - DNA, 201 bp, Bos taurus
tgtatggtttgagcttgtgatttttttcaaagaagaatgaaaaccagaatttgacattcgagatttgaaatccatttcaaaatcattttataacagacccaattgtgactcagcagttatttatcttactcttgtcttttcttttctgttcacccatagattataaaaaattgaacagagtcaagtgaattaccagagaac

SEQ ID NO: 11386 - DNA, 201 bp, Bos taurus
ttagatatagatgatacttatttggcttgaagatattctagccacatcatttatcttgtaacctcagtctgtcctgatctctgtattgtggaacctgcaacaataggttgctctgggggtcctataactctgaaaatattgcatgaaatacagaccataaatttgtattttccactatgaaataaccgatgtatttttttt

SEQ ID NO: 11387 - DNA, 201 bp, Bos taurus
aaatatatatatatagagagagagagagagagagagaggcacagggggcttcttgatgctttttgtgtgggggagttgaagagtaaggagttgtgactgttttaacttttttagagggagaaagaaaaaaattgcaatgggtggtccaatttacaactcggactaaaactgagtaaattctatgctctcttttaactttga

SEQ ID NO: 11388 - DNA, 201 bp, Bos taurus
ataccccaggcagaggatcaagtgcttgagttttcttcgagtctgatttctgacatttgactgatttatgcaatttactttgtagccctaaaatatttaacagacggtctgatttcaagaccttttcaaatgaaaagaacctaatgaaataatgtaaaatcaaaatatttctttacccattataaaacagcactactatct

SEQ ID NO: 11389 - DNA, 201 bp, Bos taurus
caggaaaaggaaggggtttgaaggaacggtataattattcatcatagtctgtataaatgtattctgtttaagtctgaattatttacttgctgctgtctgataaagctgcttagagatttactctatttaaatgcacagatcttttaaggacaaaaggacgttattttgttaatgctaaaaaatcaacattagccaaattgt

SEQ ID NO: 11390 - DNA, 201 bp, Bos taurus
agctatttggcttcattccagggacatctcaactttggaatttctctggtgggcatcatctttcagctgcttttctctacctcctcttctccagtgcatcattgcagggtcttgagcttctttgcaggaagcactgagaggaacagcttgttttttttaaccacagtttagcaactgtgccatttattggcctcttgggaa

SEQ ID NO: 11391 - DNA, 201 bp, Bos taurus
cctgaactgaagtttttccaggtaggcagcttataaggtcaaaagagtaaatgagttaaagttttaaagaaagataggctgaaataaaggattatgtaacatgaatggttttgattaatgtattagtcaggacattaggagaagttaactaacaataccagaatttcagtagcttaataacaatttaattcaccttgctat

SEQ ID NO: 11392 - DNA, 201 bp, Bos taurus
tgcattctttggcaagacatttaactaactgcctggccagtggagtgcagaatagtaaaattaggcattgacaaatgtttgcagttttgaggaagacttgttcctaaacttcttgggattggcctctgctcagtcctgtgtctcagcgaccatcctatgggatgtcatatggctacagtcaggaaacccttacaactcaga

SEQ ID NO: 11393 - DNA, 201 bp, Bos taurus
aatacggaggggagagaaagatttcagtttgatgaccttctaaatgaccagaggcaaagtctagcagttgccaacctggctgggcctggatgatgcattcggagactttatcttcacctccccatattccgggtgccacacagtcactgaggatgtcccagcattatttgactaagtgcctgagacacaggcctctagaat

SEQ ID NO: 11394 - DNA, 201 bp, Bos taurus
ggttggagcttcaactactgaacctaaaaaccaaaaatactgaggcctgaacaccctacagcctgtgctctgaaataagagaagccaccacaatgaagagcccatgtcctagagctagaaagtggcccccactctgtgcaactagagaaaaacccatgcaggaatgaagaacagcaaagacaaattttttttaaaaaagtc

SEQ ID NO: 11395 - DNA, 201 bp, Bos taurus
gccctctgctagctgtgagagaatgcacgtaagggggtcaggtcctagagggcagccttcatatcttttgctggaatcatcaaggccctgaaatgagggggaaaattatttttaattgcatgtttatgaactattgcaggagagggaagtgtaggagagggaaaagtgttcatccaccctcttaggttccctggctggcct

SEQ ID NO: 11396 - DNA, 201 bp, Bos taurus
aaatgaggtgtctggctacatactagacaccagttacagagaaaaattaatgtaatctgataggacaaatttgcctttaccatcattttaacccagaatccgatttcagaaccaaaattaagaaagatggaaagtgatggcaattttgcaacatatcagagttaatactggattcattagaaactcaagcctttacagtga

SEQ ID NO: 11397 - DNA, 201 bp, Bos taurus
tggagcctatctggatctaaacatagtccctgttctgagatcaagtgatctagatatcaaagctgaaattgagcaaagtgcagtttttctttggagactttatgtttcaaagttttagcaagtgaatgctgtcttcctgtgaggaggtttgagaaggagagcacaagagcaagtcatctatgtattttaacaaaggagaat

SEQ ID NO: 11398 - DNA, 201 bp, Bos taurus
ggccagatgtctccaagacagactcaggttggggaatgaacatgtctttccaacacacaggactgtgtccccttggccttcatctctgctgagaacaggttaagtaggggtagatcagcatggtggcaggagacatttctatcagtccagtgtttctaaaatctcagtcatttcatctctatttgggccatagtgacatac

SEQ ID NO: 11399 - DNA, 201 bp, Bos taurus
gccagggtgggtcagaggaggctcagcccattctctggttagtccccaggtttctcagcctctgccacctccagcctgcagcctgagcatcctccttcccgccctcaaaggaggcctcagctgagttacagccccattcatttcttgagcacattggtccaagggcttttatcttgggccttgctttcccccaaataaact

SEQ ID NO: 11400 - DNA, 201 bp, Bos taurus
aacactcgcctagtctgcttctcactgcctcctccaggccagaaaggagacagtgtccaaaccaccatgtcagggagtgtgcttccgtggggaggctatttgggccagatttcaaaaagtgaatcacattcggggagatgcacgtatacccatggaccaaaccaatgcatgtaatcacagttttttttatgagcagctaga

SEQ ID NO: 11401 - DNA, 201 bp, Bos taurus
ctggcctccgggctgcccttagctactgagaacatgatttgtgaggtgacaacaagccagaagtttctgtctgtgaagggctagtgagctgacagcccacactgcctggatcttgtgcacctggcccggtagtgagtctgtggtgtatattaactcactcacatggtcactggcctctcttttctcttacctttcaggaaa

SEQ ID NO: 11402 - DNA, 201 bp, Bos taurus
cttatttctcagttgctttctgggagttgtatcagctgtcatcctgggacttccttacaatggctttattcctttttcaaactttactgatagtctggttatatacagaataacaggttgaaaattattttttctcagccctttgaagatatttttttccactgctctctagcttctcttgttgttttgagaaggccgttg

SEQ ID NO: 11403 - DNA, 201 bp, Bos taurus
cacggcctagcgactgaacaacaacaacaggcgcagacgagctcgtctctcattcaagtgaaaacaagctcagaaggacagtgactgactgttttgttcacactctattcccaaggccagtgcctggcacacagtaactgcttagtaaatatttctccagtaaatggttttggctgcagcctagtctgcccagaagacagg

SEQ ID NO: 11404 - DNA, 201 bp, Bos taurus
ctcatcctctgcttccctgttctcctcttgccctccatctttcccagtaaaaacccaaagggaaatgatggtgattcagactgggaagcacctatgcagaaggtgagaagtggtcagagtctggatcccttttgcaggtagagacatcaggatttgccaaggggttggatgtgggatagagagaaagggaagtaaaagaag

SEQ ID NO: 11405 - DNA, 201 bp, Bos taurus
tgagttttcagtgacaggtgggagcgcggcccgcaatgaccatggtccgattcagtgggacccggttcttggcaggagaggcaggttttaccaggaacacagacaggcctctcactgagaagccatttccagataaaacaacacttgcttcacaaatgccaacttctttttctttagagagcctcagatttcagcaacacc

SEQ ID NO: 11406 - DNA, 201 bp, Bos taurus
aaataaatattttttaaaaagagtatggcctaacctagtaatgaagaattcaatgctgaggataaggtctgagggtgtgacaagtgtctgaagcctaagcagaagggcccacaggcaggatctgtatgcagcttcactctggctggcaggatgcccacggctttacagtggtacagttacccaggtaacaggagcaacatg

SEQ ID NO: 11407 - DNA, 201 bp, Bos taurus
agacagctgaggcctgcttcttgccccaagaacccagagccaggagaagacactcagagccaaatttccccttctcagggtggtcatggagcatgggaaccgaacgcttgcatgtctagggcccaagctggggagccccatggctattcatgctgcactctgagcttcctctgagcctcgccccagaggaagactcaagtg

SEQ ID NO: 11408 - DNA, 201 bp, Bos taurus
ctgtaggtggattgaccttccccaccatacctgaaagggcctctgaagtaactcaggttcttcttcaagaaaatccctagattcattcttcccacctctcttcagaatgacaatggcccagttttcacctctcaaactacccaagaagtgtctcaagtttagatattaaatacacattacattacatgcagcctggcatac

SEQ ID NO: 11409 - DNA, 201 bp, Bos taurus
cagatctgagctccttcaggaagagtgtacgatataaggaccactaagcatttcagtgtattaacaaaccaacaataggttgatgattcaccctggattcctgccagggtctgtgaaagaactcaataagcatgatatgcatttcaaaaactgctaatcataattaaaaattccccaaacccctcaatcctataaattata

SEQ ID NO: 11410 - DNA, 201 bp, Bos taurus
cctcccttggcctgaggcttctcgtgggccttccctctgcagaaggtgaaggaggaagccacatcccctcttaagagcaccaagcgccagcgggagaaggggacctcggatacagaagaggccgacaggaccagctccaagaagacaaaaacccaggttaggcttgaggctgaaccacattgactgcctccagcagctctt

SEQ ID NO: 11411 - DNA, 201 bp, Bos taurus
gagttggacatgactgaagtaacttagcacacacacacataggtatggccagaagcagacaactctttacaatttctttttacaaaaagctttttatatagtaaagcaaacatcaggcctggacaacagttctattggttctaaaacagaatccacgtgttgtcttggaaacaatgaaattgtgtcctgctacaacaggaa

SEQ ID NO: 11412 - DNA, 201 bp, Bos taurus
ataaaaataatctttttagacttttctatgtcaagtatgcattttacaatctatataagcacattaaaaaagaaaaacagagggtaaaacttctaaattgtgatgagaaaaatataataagtaccaaaaaagcctttcctttctccaggggatcttcccaacccaggtatccaacccaggtctcctgtattgcaggcagat

SEQ ID NO: 11413 - DNA, 201 bp, Bos taurus
caggcgcagcttccgagggtgcggacagatcaactatgcatattttgacaccccaaccgtctccgccgtggatctcagccaggaacccgaccaggctgccagggcaccgagtgccaacccccctccgccccaggcccaccggagactgaggaggtctcactcaggccccgcggggtccttcaacaagccggccatcaggat

SEQ ID NO: 11414 - DNA, 201 bp, Bos taurus
gtgagcgtgagagcaaaggagatgggaactctgacagacgcgccacctaccttcatcaagtctacaaaagaggaggcttgctaatgtcccccaaagcacctcacttggaggccactgcctcaacagtttcagtgaaaatgacaagtgctgctatacacacgacacgcacgatacgtacagattgagacattctagaaatgc

SEQ ID NO: 11415 - DNA, 201 bp, Bos taurus
ggctggggcctggcaggaagcttgtacctccctctcaatgcctggacagcaaactttggaaagacaggccattatgggcctcagcagctgttctgactccagcacagggcccaatgaaaacttctggttgagtaacccatgggatgttctcactgtctcccggccttgggcagagacctgctttgtttctggggaagaggc

SEQ ID NO: 11416 - DNA, 201 bp, Bos taurus
cattcccccccatctggtggccaacaggtcctccagaccatgtacagattgcttgttctccttcttcctacccgttggcagcttccagaaagatcctaaatagggcctagcaggatgtgattataattagaacaataaaatattcatcatctcaataatagccagtatttactcagcactcgctgtgtgccaggctctatc

SEQ ID NO: 11417 - DNA, 201 bp, Bos taurus
gcaacttctgactctgatgataaccatccatttaaatgctcttctctgctaagtgttgtgacatgaacccccatagttctctctcccccttctctctgaactgtgtttatccaaggatcatttttaaagctgagaaggacatgagacttcgagccatcaccctgcacaaccacataaatagaagtagggaacaattggctg

SEQ ID NO: 11418 - DNA, 201 bp, Bos taurus
tgttgtgtgtgtttcaaagagcgagcttcaccggccctcttaaacaatagatacacatgaaatccaggctttcatgggtctaacccgacctaccacgcaggcaagagggcagacaggccagactgcggtcaaaatgccagttcccagcccagctggggccacgtgcgtgaaacaagaggcatatctgactccagcacctgc

SEQ ID NO: 11419 - DNA, 201 bp, Bos taurus
tggagggtctcagggtatggggacctgaatttgaccagacaaggcaatgccgaggtagcaggacctcagaagtcgggtgggggcctgtgaggatcaagtgcgtaagccaggctcacggtgaccctgcttggcaaggagtgggaccgctcaaccccacagtcctctgctggcctgggcggagctgggtgagccacagtagcc

SEQ ID NO: 11420 - DNA, 201 bp, Bos taurus
gctggtgtccagcagtgtggggctcacaggtaggggtgaggggactcaacctccccaagcatctgagccagaggatgtggtgccaagcagtggggggccagaccaaagatgaaggctcagagctagggaccaggggagaaactggacccagaaatccgactgcccctgtatggcctctgtccccagggatgtccacatgta

SEQ ID NO: 11421 - DNA, 201 bp, Bos taurus
gcaggttcaatccctggtcggggaactaaaatcccacacgatgtggggcatagccaaaaagagagagagagaaagagaaagaaaaggccaggggtaacacagacagaagaggaaaagcctcagtatcaatagtttatcatgatggatacgctctgccaggcgcagaacacgttacaaggagctggcagaagggccaggcag

SEQ ID NO: 11422 - DNA, 201 bp, Bos taurus
tgaccggtggagctttggggggtcttcctgaggtgaggagggggccattagggtacccctcaagttccagtgtcacctcatactgtgattagcaaacaccgcaaggctgaattttgaaattgttttctttaatgaaccttaagctagttactacctttctgctttgggcatttcaaacgattgggtcttgaaattttaatg

SEQ ID NO: 11423 - DNA, 201 bp, Bos taurus
atgccaccgcggggccgctcgtgctgtacttcgctctgcaccgcctggtcatcagaccctacctcagggctcagaaggagaagtgagttctcagcactgccggggacggggccgaactgccctgtgcccagctcccccgtctgtgacgtggagagggtagcagccgccccacagggcgtgagggaaaccccctaagctgat

SEQ ID NO: 11424 - DNA, 201 bp, Bos taurus
gcggaggcctctcgctgctggccaatgcctggggcatcctcagcgtgggggccaagcagaagaagtggaagcccctagagttcctgctgtgcacactggcggctacccacatgctcaacgtggccgtgcccatcgccacctacgctgtggtgcagctgcggcgccagcgccccgactacgagtggaacgagggcctctgca

SEQ ID NO: 11425 - DNA, 201 bp, Bos taurus
ccagcagagcctttgagctgagggtcttcccagctgggaggctgggttggccttccctggatgtgccctgcaggactgcagaggccaggctagaaccttggtgagaaggtcagcttgcctccagactgtcatccatccatccacctatgtctggggtcttggtggagtgccagcagcgggagacagaggccagggctggcg

SEQ ID NO: 11426 - DNA, 201 bp, Bos taurus
tcttctcaaacctcccagctcccaccctcagagtcagctgctaacctggccttgttcttcatggaggaaaaaagaagccagcagactagaaccttcctgttgtcccactatgatctgtgacctggcctgtgcctccccttccccaaccgaggaccaggtgtcctggccctgatgggggcctgaatcctacacctctatcca

SEQ ID NO: 11427 - DNA, 201 bp, Bos taurus
gttggggaggagggaggtcctggtctgcgcctcctcctctcatccagctcccctgctgctttgtattttcattctcgtctggtccaggagtggtggcctttctgcttccagccccccttggctgggcgggtctgcgtctgtggtcagtttagccttcacagaagcctgaatgaggtatgggcctctgtgaggtgtagggat

SEQ ID NO: 11428 - DNA, 201 bp, Bos taurus
taaagtccccaggagcgctgtgagtgcttggctgctgcacctccagctgtgcccgagagggtcgcactagctttgtctggcccagcatccaggtgagggtgaaatgccctggtgggctggctggcatgtcagtgggtcccagtgtgtttctctcgggagtttgtcctgggcctggcagaaatctgaggctactggagggga

SEQ ID NO: 11429 - DNA, 201 bp, Bos taurus
gtccgagtccccatgcagtacctcctcctcctcattccacatctgtccaaaagggcgaggagactttgcaatcggatctcaggctggccgaagacccaggcgtaatgatgttcatgtttattctggagggagccctttccatcggcaaatattagctaatccttggcttcgctctgggagagacgtggagagttagacaaa

SEQ ID NO: 11430 - DNA, 201 bp, Bos taurus
agaggtggtgcagactacagatttcccagagggtccaaatgcaaaggcccccctcccaccataaaaactcccatagctgagagtctgggaggctggcccacgtgccaggttgccatggagagtgggattcctcacctgtgttagaacctcagggaccccactcctgtcactcctgcagccaccgtgacataccctgtagtg

SEQ ID NO: 11431 - DNA, 201 bp, Bos taurus
tgggcagattcctggggaccgggatggtgcacaatggaaggttacggggcgcccggcggctacattgtgtgtgtctgtctcagactgattatctcattttgctgggccccacgctgccagaacacagagcgctgtttactgcctctgtactcgatcaatcacttactcatacggttgaagattatggctgctcatttgcta

SEQ ID NO: 11432 - DNA, 201 bp, Bos taurus
attactttcatatacatctccgctatccatggccaatatccttagatctgagttttcacatccttagtttctcaatcaccatagagagtggcagcggcctcataattgccagaatgcaggcattgttctttctgggcatcctccaggctcagaaactcacttttggagggccaaaatagctgatggctgtgacatcctttt

SEQ ID NO: 11433 - DNA, 201 bp, Bos taurus
gtcggactgagcaactagcactctcactttttatcctgccctgccccctgtcccctccagaatctggagggtgacaccacttgcctcatgggatcaaaacacctcagtgaccttgtgccatcctcggtgtggcagaatagggagaaacggagcgagacaggtagatgtgtggcaaggttgtggtgaggcagttagatgagg

SEQ ID NO: 11434 - DNA, 201 bp, Bos taurus
gcaatatccacttttattcactcgtcccagtcaataggtacttcctgagtctaccacacataaacactataatttggatgcatttattatgatatacagcaatccctttattatattctttatttagttctctgaccaggggtcaaatctgtgacctctacagagaaattgcagagtcttaaaactgtaagagccccaggg

SEQ ID NO: 11435 - DNA, 201 bp, Bos taurus
tccgggtagaggtgtctgggggacagcagaagctcaggaaaggctgacattcaaatccgtgggcagtgagactgaacatcgtacagacaatggccagactgtggatgcaacagaactctgacctctgacccacaacttccagtccaggaagcccaccatgacctccatggcaataaggcccaaatggccaggacttgatca

SEQ ID NO: 11436 - DNA, 201 bp, Bos taurus
caagagtttgaatgaagtcagttgagagagacaaagaaatcagtcagttattatcagcagtaaaagctggaagaggagtgggctgttggccacagtgaggagccaccagctctacggggtgacggacccctcaccgatccccaccagcaccccaagcacagtgaacagaagcctcgggcacaccctgcggaccaggccctt

SEQ ID NO: 11437 - DNA, 201 bp, Bos taurus
cccaggaccctctgctcttctccgcctgtactcacttgcactcttcccaggacaccacgtccagcctcctctggaagcctcgccggccagcccgggcagagctccgtttacactggcagccaccgtcgggctctgtgtcatcgtccccactgctcagcactccccctgcatctgtcacttcacgtcctgggactggcacaa

SEQ ID NO: 11438 - DNA, 201 bp, Bos taurus
ttctacagagcacagaagggccactcgggaacagggcatgaagggctaggaggttgggctctcccggaaagctagcagaaccttcttgctggggcctgggaagccagctaagctgagatggggcattgcagtatgtcagtttcaggctgatttggtttatatttgtgacttgggctgggtcactggggtggcctccactct

SEQ ID NO: 11439 - DNA, 201 bp, Bos taurus
tgcctagaaaggggtcaggccctcagtagaccccgggctgtgatgccttgccaggtttggggaccctgcttgctccctcagaggaaggggactctcacagtaggtcacaagttctgccatggccccagcctagggagagaggaaattccacacaggccagggtctggtaccaggaggggaggagcctgccctcaagggcag

SEQ ID NO: 11440 - DNA, 201 bp, Bos taurus
gctcctgaagctgagcagccccgcctctccctgcaccggggccacttttcagcctggggggaccaggacacagagccaggtttgggagaaccccagtgacaactcaggacaggcccatccttagcgagagcctgactgagctctgagcactgccattcccccgagcgctcatgggagccaaggaaacagaaagttaccccg

SEQ ID NO: 11441 - DNA, 201 bp, Bos taurus
gaccctgaatccgggcgggctctctcatccgggctttcccacagggcagaccacgcgtcagccaccacccaaacaaacacctccctcctctgaggccagggcaaggtctctgctcacaagcagtcgtgttctgacccctccctgcacaggcatcacgtaaattcgtcaggaaggcaggttctcaggccctacgacgctgct

SEQ ID NO: 11442 - DNA, 201 bp, Bos taurus
gttaaacactttgacttttcgttctcgatacaattcttctttaacttatggagtaagtcaaaagatgagtgctacacttccggggaacagtgcattcccctcaaagctaataatacattaaggtgaaacaaaagtaacaatgacagcaaaaccaacaaacaaaaggctcccaaatgtacagcgttcaataaacaggttaca

SEQ ID NO: 11443 - DNA, 201 bp, Bos taurus
gctgctccagcctgagagcctaggccccaggtcagaagtggccaatggatgctgcccagtccaagcccctccttttacaaactaaatgttgcacagagagagggcacatctgcccaggggccctctctgtgtgtgctcatggagggcaggtggtccctgctgggccctctgcactatttggatggatggatggatccatcc

SEQ ID NO: 11444 - DNA, 201 bp, Bos taurus
gcgtggtcaacatctgggtgcccatggccgcctgcaggactggacatgggagcagaaaagccaattctctccctgggctgtgacctagaataggtgtgacccccagaggccacagtcctcagacttggggctcagtgggaggaggcagacacatcctaagagtgaaccccacagtgcccaggaccctgtggctggggcggc

SEQ ID NO: 11445 - DNA, 201 bp, Bos taurus
cacccgccccgtctctgcagagtgcctcccgggggtctttgaagttggctgcccgcacagctgcgggtgcctcaacggtggcctctgtgatccgcacaccgtccactgcctctgcccagccggctggaccggggacaagtgccagagctgtgagtgggtggctcggggacccatgggggaggccaggaggcccctcgggcc

SEQ ID NO: 11446 - DNA, 201 bp, Bos taurus
actaacatttatttatttttaaataaaaaatctggatccttcactattttattctgtatctcacagaagtgcagtcctggctggacctggcctcctggtgtttttttttttttttttttccccactgcccctcggctcccagacacatgaccatggaaccatgctctctgcaaggaaaggccaaaggaaggaccatctttc

SEQ ID NO: 11447 - DNA, 201 bp, Bos taurus
aggggagggtaaccgtccctgggaagagcccagtgactgcctggggctcagggtctcctgacattcaaggtcacctctcaggaggggcttcctgacttccagagtgggggccactctggggaggagagctttcggagctggctcatgaacctcaccactccactccgcctctctgcacacactagggctgcctctccgcta

SEQ ID NO: 11448 - DNA, 201 bp, Bos taurus
caactcggagctgtctccgtggcagctaaacacactttgatttcataaagacataactgatcccacatgcaaattattaattgtgagcccaggccacttagggcttgggacttcgctggaatttttttcaggaagaacttgcataaatagcgattgaattctagcacctgggtggctcctaggtgttgcggcctggggtcg

SEQ ID NO: 11449 - DNA, 201 bp, Bos taurus
cccacacctctgtgcaggccaccccttggacgtttacatgcctggtccggtgggaggtgagctcagactctctacggggactgcacaccatcactccctgggttgaacctctgggcaccactggcccacttgtggcttcccagctggtcacaatccgagcggcaaattacagccatcacaattttacaattacaaccagag

SEQ ID NO: 11450 - DNA, 201 bp, Bos taurus
attatcacatggtattaccactatgctctccagagggagtaaaccctgggttcacatcccaggtctgcaactttgtagccctggggcccacaagcaacttgccccacccctctttaactctcactctttgcaaaatgtgaaggataatggaaaccccaggtggccaacacggtgcccataaagcacttggtaaagcacctg

SEQ ID NO: 11451 - DNA, 201 bp, Bos taurus
attcttgtctggagaatcccatggacagagcagactgacgggctacggcccatagggtcacagagtgttggacatgactgaagcaacttagcacacaagcatatgtaaaactctagaagaatcaaaatggatctacagtgataggaatcagacccggggtggcctaaggtggagggtaaggaaggattgtctgcaaaggat

SEQ ID NO: 11452 - DNA, 201 bp, Bos taurus
atgcctgtgtgacccagattggcggtgggaggtcccaccttcctgagcggctctgtgctaggaggggcagcagttggagtgagggccagaggtccctgacccctcaggttgcccgattcctccccatgtggatactcagaagtcagatgtccattgagtgttgatcactgagcggggtcatggccccctctgcagaggagg

SEQ ID NO: 11453 - DNA, 201 bp, Bos taurus
cgaatgtggacatgctggttcaggacatctatggaggggcccacgagaccctggggctaagcggcaacctcatcgccagcagcttcgggaagtctgccactgcggaccaaggtactggccctgcgcctgctctcgctcaccgcggtgcacagcgcccacccggctgcctgcccagcgcactgcttccgtcccccagagttc

SEQ ID NO: 11454 - DNA, 201 bp, Bos taurus
tagaaaatgtaagtgaccccagcctagaagtcacaaactggaccaagaggtggctgaatcctgtgatgcagggaggcagggcctgagcaaaggtgcttcttgcctcagtcctcaagcgagaaccaagtgcctgtaaacatgatgctggcatgggaggtgtgagccccatcccgagaccccagcaggcccctggctctttgg

SEQ ID NO: 11455 - DNA, 201 bp, Bos taurus
gcccactgcctgccggccacaaagggcagcactccctagcagctgccccagcacactccatgtcaaagatccaggtccttgggggccccctaagcagtgacgcacaggctctggaccctggtctctccttcgtggcacctcccagccggatcaggcttcctgaaagcccccaactgcccctttctactgcagtggaggagg

SEQ ID NO: 11456 - DNA, 201 bp, Bos taurus
acagaccctcccacttccccagccagcggggtcatctccacccccctctcacactcatcattacatcacacacatgggaccacctccaggaggcctacagacaagtcaaccgctcttcacaccaacacctgtcctgtgctcaggtcatccaagaaccaagtggggagggagctagtcccctcagtgcacagcagcgtaccc

SEQ ID NO: 11457 - DNA, 201 bp, Bos taurus
gggcctgcgcttccagggctgtgggggaggaagtggtcagtcagctgccgggtcagcagggtcatcacaacaaaactcaagggacggaaccaactgggtgcaaggccgccagggcaacagagcccacacttctgggtgaatgcacgggccactcccaaccccacagccaaggctccctaactccactccaggaaacgcgga

SEQ ID NO: 11458 - DNA, 201 bp, Bos taurus
gaattcctacaactaatgattctttaatcaaagagttctatcttgagtgtttgcttgcttaaagtttaattaggaaggaaagtctgggaccaaaatgatatgtgtatggtgtgtatagatccttcttgaaacagatttttgatgcccgtttctttgctgtgtttccacttcttttctgtgatccccttctccctccccacc

SEQ ID NO: 11459 - DNA, 201 bp, Bos taurus
ctctgggagttggtgatggacggggaggcctggcgtgctgcggttcatggggtcgaaaagagtcggacacgactgagcgactgatctgatttgatgattccggccaaaatgaagtaacagggatcagaattactctttcacctgaagcaactaaaaaaccatacaaaatatgtgaaaacagttctaaatacattggctgca

SEQ ID NO: 11460 - DNA, 201 bp, Bos taurus
gggccaaacaaacggccagctgttctgccctgccacctgacccaccccctgaactgccttctctcatgtgcccagctgacgtcctcctgcccagaatcacccagggccacacatgcttctgtgcaccaaggcccagtgaattatcacacaaaccaatcccaaactgtttccctgccctgccctgccattcctgccggaacc

SEQ ID NO: 11461 - DNA, 201 bp, Bos taurus
cccttgagagaacctccttttggcgcccccaggactcctgcaggaggtggaccagcccccagagacttaaggtgggatcaggcccgttcatttgtttcccgtgaatcctcagctgagtgcttacacagggactggggttcagcgctcaccaccgccgtggccagtaactctttcagctgctcattcagacactcaggtggt

SEQ ID NO: 11462 - DNA, 201 bp, Bos taurus
cggggtaccgctggacattgggacctccaaccggcctggggcgaggtaaggccagcaggattcggggacacgtgtcgggcagcctggcggccaccgtgcatacaaaactcatggagaggcgctttcgctcacccagagtggagttggaagtcagtgtctggccccaaagtatcctctgggagcagggaagcatgtcgggtt

SEQ ID NO: 11463 - DNA, 201 bp, Bos taurus
cattccctctaaacagggtatttatctaggaagttccccaaggttgatccttgaacaccatcagtctatgcaaaagtttccaatgggccatagtgaaatatgaaaaagaaggacaatgttacgagtttttcatgaaatcctgtttatttagtatcaaggcctgctcttgactttgagatcatgtctgcccatcttcccccc

SEQ ID NO: 11464 - DNA, 201 bp, Bos taurus
tcccctggaggaggaaatggcaacccactccagtcttcttgcctgggaactcccacggacagaggagcctggcaggaggccatggagttgcaaagagtcgacataacttacaactaaacagcacttccactgccggggctcaggttcagcctctggtcagggaactaagctcagtggctcggcccctccaaaaaagtcatc

SEQ ID NO: 11465 - DNA, 201 bp, Bos taurus
ctgagatgcaaaacgatttcttgggggcctcagagtgtgcagctcagctgtctttcctctctgccctctgatctgtaagtgccaatcaggacccagctcagggtgggaaaaggggccgggcttttcagggatgcgccagactcagatggctgaggtgagatgtcacccgtagggcatagctcacctctaagcataggtcac

SEQ ID NO: 11466 - DNA, 201 bp, Bos taurus
gcatcctcggcctatgtcattctttcaaaggttgtaccctgactgcttccctcctgtttcagtccttccccacagacttcacctccagacttcctaattacagtgtgaaaggccaccattctcccagtgacttgggctggaaatttcagtgtccttgagccttctctcccctcctcaccccatttccaacccacacacata

SEQ ID NO: 11467 - DNA, 201 bp, Bos taurus
ggagtcttagccactggaccaccagggacgtccttctgcatcctcttttaggcagcccacctagcagtctctgtctttcaccatttcagctctcactgcatcctcgtttcctgcagaaaagcgtcctagtactgagatagtggaggtgatggttcttgtagctacttcgtaaggcatccccccatcaccctccaacctgct

SEQ ID NO: 11468 - DNA, 201 bp, Bos taurus
ccaggctggaaaaacaactccacagaaagagagaggcttgtccaagcttaggaactgcccctgccccctctagactagatcttgcaccacctggacccttccaggggcaaacaggggtgacaggtctgggactgcaatcacagagaacctcacaagactgaagcccatttacctgctctgggaccatctgcaggcacttcc

SEQ ID NO: 11469 - DNA, 201 bp, Bos taurus
aggtcactgagggtagggagcactatggagcccccactgaggagatgtggcaacttctctaatgccagaagaatgggcctttcttgaggtgtccatgtgtccacagggtaagacgtggcagccatatttgtcctcaatgacaccatccttaggccatagctgattggatcctaggtgaacatctgacccaagccatccagt

SEQ ID NO: 11470 - DNA, 201 bp, Bos taurus
atcgatttgtgtatgtgttagtatctgtcttcttcccccagggccagctgtatggatatgtaacctgtgtagtcacacagggccccgtgtttggcagggtctaatgcttggtttaacactctatggttacccgccttgaatttctgcttttgaataagggatcccctattttcatttttcactgggcctacaaatgatgtc

SEQ ID NO: 11471 - DNA, 201 bp, Bos taurus
actttgctccaataacctgacaaaaacccatcttttgtgcaatagtactctcaaagtcttatgtttcagaagcacttaattctgcctattctttcttcatcttcttccagagtaaataagtagggctccatccaccagggaaatggtttcagcactggtgtgtttgaaggacaactcataacacagccaccaagattctat

SEQ ID NO: 11472 - DNA, 201 bp, Bos taurus
cagtgtcctcttgcccctttccaaagagttggttgaatggtgagctgtgattcaggcctggccaattggcacaccccatccctggccaccatgatggatttgtggagggacacacgggctcacagtggtgcatctgggatgcctcagaagatgtaggcctggagatgctggcagccactcgctaccacatggagcctgaga

SEQ ID NO: 11473 - DNA, 201 bp, Bos taurus
tattacagggcaaacctaaatgtggccatgaccttgaccacattctaaacatccccaaatgaaagagctcatagccataaattactaagaaccttaaacatgcaaatccccttctgtaactggccctagctttgagagttgatcttcaaagctgaatggtttctgttctttcacgtgcttgtttacatttgagagaactga

SEQ ID NO: 11474 - DNA, 201 bp, Bos taurus
ttggttcctccgcccatcataatacctgtttatacattcttttattcaacaagcctttgttaatcatcacaacctaggtattatgctaagtattaaggatactaaaatgagttaaaagtcatagctcctatattcaaggagcttgcaatccaagagagataaaaatgttatcaattcagttgataagtattatggtaagtg

SEQ ID NO: 11475 - DNA, 201 bp, Bos taurus
aaataagctggtcctttctcagctaggggcacggtgcctgtgaaaactgtgacaacctatgtgaactaggctgagataaactcaccaggccatagttccccacagtcctcctgctctgaagcaggagggaggctaggaagagccaggtctggggttttccattagcccattacagaactcaggagcatggagttctaaggg

SEQ ID NO: 11476 - DNA, 201 bp, Bos taurus
catggcagcagcaatggggttatgaggacatgacctaatcagagacagcttccttaaagaggaaacattcatgttgagactagaatgctgtgaggaaccatccaggtgcagggacattgggagggaggactaggtgatgcagactgtaaagatggcatgtgttggcacagctgggaaggagcttcaagggtttgctgaagt

SEQ ID NO: 11477 - DNA, 201 bp, Bos taurus
tatatataatagtttgcatctaccaatcccaaactcccaatccttccctccatcacactccttgccttcagcaactataagtctgctggttctctaaattcgtgactgtttctgttttgtgaaaaattgaaattgagttgctcagtcctgtccaattctttgcaagaccatggactatacagtgcgtggaattctccaggc

SEQ ID NO: 11478 - DNA, 201 bp, Bos taurus
ttcactgttgctgccactgcaggtatctgctttgtgcacaaagatctcagtgtcatctctaggagacataaggccatgtctcctgatcttgtaaggccatcaaaaactaagcacatgggttactgagacctacaaaccctttctagtttacattttacccttgagttttggccctgggaattgcccctcttttcttgcaaa

SEQ ID NO: 11479 - DNA, 201 bp, Bos taurus
attcatgcaaatttgtcatcctactccatagtatgtttatttcaatatacattttaaataacctaatagtaaaatgagttaatgtctccctttgaaagattgtcaaataaaattgaaaccctaggaaaatgcccatgatcaacctgggctctatacacccacaccagagacctacagatccatgggaatacacactccaga

SEQ ID NO: 11480 - DNA, 201 bp, Bos taurus
ttgagtatatagaagtccacatccaaagcagccataaatataattaaaggtgaaaaataacaataaagtgaaaaacttgatgttcttagaagagggtagacgacttggtgcatctaaataaacaaaggccaaaaaaaattactttgttaccattttgaagtattagaaattaggttgatgatctgccaattaatatgaact

SEQ ID NO: 11481 - DNA, 201 bp, Bos taurus
tcatttgctgattgaatgaggtatgtatgcatcccctatacaggccttggagaagagtaagacaaatacctttccttacatggggtaagagggggacaggtcacgctactcaagagggctcaaaaattccacaacagttacaacatgctgggaagggtgataagggtctggttttttctgttcctacattccaacaccttt

SEQ ID NO: 11482 - DNA, 201 bp, Bos taurus
tgttctaattactgaactggtggttggaataaatttagttttgtatttatgccttccaccctcattatttattagatcaattaattaatccaattagatcacaaaacaattggaaacacaatcggggagcatgagttacatattttcttaaacaccttacagatggcgtctgtgctctaatagtgtttattacctcatagg

SEQ ID NO: 11483 - DNA, 201 bp, Bos taurus
atcacattgaggtggaccagccctttggtttttatctgtaagttttcttaattgtttctcatgcttatacatcatttattgggagctcagaaatgtcacatgagggacttgcctggtgattcagtgttaagactgcactcccaaagcagggggcctaggtttgatctctggtcagaaaactagatcccacatgcccaaact

SEQ ID NO: 11484 - DNA, 201 bp, Bos taurus
cttaaatctttgtgaaaaggagctaaaaaaaaaaaattttacttctatctctacaatgctataagtaaaaaaaaaaaaaaaagtaactcaatccctgtgcctatcctctggtctctattttcttctccctcacctctgagttttcaaattatcactttatcccaaccactattagtgtatcaacaatcttcttatgaaatt

SEQ ID NO: 11485 - DNA, 201 bp, Bos taurus
cacagatcggatagcttaaacaacagatattttttcaaaattctggaggctagaagtccaaaatcaaggtgtaggcaggcttggttttttccaaggcctcactctttggcttgtagacagccatcttctccatctgtcttcacacggtcttcaccatcatgtctgtctgtgtactatctcctcttcttataggggcactag

SEQ ID NO: 11486 - DNA, 201 bp, Bos taurus
tgacaaacatttagtttttaatgcatgttctatgagtctgtgagggagactcttcaggctatagattggattcaggtcttttcatgttgtattttggattcactaatttcctggtacatattctccttacgataaatgacagaaattcaggaaaccaagtcaaaaaactcaagtacctttgaaatctcaggttttgtttat

SEQ ID NO: 11487 - DNA, 201 bp, Bos taurus
atcactggtggtctgggaggctgtgtatacatgcaaggctgcatacacactcaggaagattagagagggtcctagctattcacagatatatgctggacacgaggccttgcacgtgtacagcggttttgcttcttctctgttctacgaagagaatgtgttccaggtggagtaaatggccgaaggctcatcttccctgtaggc

SEQ ID NO: 11488 - DNA, 201 bp, Bos taurus
ggccatctagaattgctttaggaaatgtgcagcctctttgaaggattccactgtgctaatggcttgcacattcaagatgagggatcagtgcaattgtggtggacaggccagggataagaacaagtggcagcttgatgtgaactagcacttaggttaaaatctgtgaatgtttataatatttctttcctctcatctttttct

SEQ ID NO: 11489 - DNA, 201 bp, Bos taurus
ggtgtcagaaaggcaccttaccttggggttggtgattactttggtccctctgcgtgtcacttagtctttctcagtctgctcaacttactgaatggacatagtaaacccagcccaaatgtgactgctgggtttctggcccgtgcatcttgttgagggtgaaccatggaagagcaagttggggtgtaggggatgggttgtgtc

SEQ ID NO: 11490 - DNA, 201 bp, Bos taurus
caggtgcattttttccatcacattaggccataggtggcctccatatgcagcacttttcaaagagcagtcctcgggatgattcttgaatattatctggcaaacacttcaagcaacaggcccatctctttgaaaataattatacatataatccaaatgcattctgtagttggaattggctacctgttggctatatttcagaag

SEQ ID NO: 11491 - DNA, 201 bp, Bos taurus
ccatctctattcattagggatactgacctgtagttttctttctttgtagtgcccttatctggctttgctatcagggcaatgctgggctcataaaatgactctgggagtgtttgtttccctcttactcaattttttggaagagtttgagaagaactggcactgctgctgctgctgctaagtcgcttcagtcgtgtccgactg

SEQ ID NO: 11492 - DNA, 201 bp, Bos taurus
agtaggtatttctagcttatactacagattgcttagtatttgttgaatgaatgaagggatgagtaaacatattctctaaggagttagtcttctggatcctgggcctctctgtagcttcaattcagaacatgaagagtgaactgacaactgtgcctgcagatacccctgggaccaccttgtcactgttcctgcattttacat

SEQ ID NO: 11493 - DNA, 201 bp, Bos taurus
gagtttcagcatcatggttcttcaatcatttcccagcttttctgttatctgctgactcgtctggggagcgtggcactcccttggcccacggccacagttgttctgcaagtggagtgatctctaggcattttcttctctgtgcttaatgaaagacttgttgcggttttgctgtggctgaactagacttagctgcacacacat

SEQ ID NO: 11494 - DNA, 201 bp, Bos taurus
acatacacatattgagacattagagcccattcgggctggtctgtgtaataaggtcacgttcaccactcttgcctgatacattttcgaggccagacagagggaaggagctccagggcatgtggggagaggctgtaagtcacaggctttgtccagggaagaggccgagtcccctgtgatttgagaccatgggcatatggggag

SEQ ID NO: 11495 - DNA, 201 bp, Bos taurus
gtccaggaagatttcacatacctcggagcaactaagcccatgagccacaactcctgagcccacatgctgccactcctgcactctgtgcacctagggcctgtgttccacaacaagaggagccacggcaatgagaagccacggcacgaccaccagagcgtagtccccactgccgtaactagagaaggcccgagcagcggtgaa

SEQ ID NO: 11496 - DNA, 201 bp, Bos taurus
gaaattcagctctcattttcttttttcccttttttcttttttttaaataacaatcaaattaccttgttaaatcaactcaaattaccaagttcttatctagagcaaccagtatggagacagatgtggtgggagatcccaagtatttcaccatgaaatcatagggagatcaagtaacatggaatcataaaatactgattccaa

SEQ ID NO: 11497 - DNA, 201 bp, Bos taurus
agtcataccaaaaggtgttagtcctctttcttccctaagctgattgctggcagtcataatgaatgctgctgctttccttcgcaaagagtttggtttagtggaaagaactgctagagatggaagacttggaaagcactgttagaaatagaagacctggtttataaagtcagcttgaccacagagactttaggcaagtcaatt

SEQ ID NO: 11498 - DNA, 201 bp, Bos taurus
gtcacaactaagacccaatgaagccaaataaaaacataagtaaagctggtagaaactgaaggaagtgtcaaagaggaacagtttgtagcaagtccagagagtcggaggtacccccatggttatactgggcagcttcctgcatgacagctctgtagtgagggttctgtgtgtattacaacacatttgaccctatgatggctc

SEQ ID NO: 11499 - DNA, 201 bp, Bos taurus
actttcgtctgcatgtgattctgagttacagaacacacgtgaccaacatacattccttgggcatcgctgcctgagtgtggaatgggaggggcccgccttcgatattatccttccatccaatgagaatgtgggtggcagacagcaagacaggtgtataccagaggagggaaagcctggacagggattcaggaggcctggtac

SEQ ID NO: 11500 - DNA, 201 bp, Bos taurus
cagaataataaaattataaaatcttagtggtcttacatctatccgtataacaaactatgttcagtgccctctgtatagcacaagtctaatagagaccctggtcccttcatatgtgcagcctctttaccttatagaaattgctgtatcagttctcgagcttttcttacatgcatctagcagtaaagattgcaccttgaaaga

SEQ ID NO: 11501 - DNA, 201 bp, Bos taurus
atggagatttcttcatttcataaaatttacaaggtgacctcactcttctgaaaaaagaactacataagctcatgatatttataaccttacttgtatgatggtggaataatgctagaaatcaactggactttaagcaatatccagagagataggtgtccgggcaccagaaggaagtcaaactctgctgaaaactcctcccac

SEQ ID NO: 11502 - DNA, 201 bp, Bos taurus
gaactcataattgcagtcggtgaggcccagggttttctgcatttccacaggtacctgttccaggggtggctcttggccagtcaacaagtctgtatgcaggctcaccttcctgtcaccaggattataggaactcatgcattcctcatacttggtctgtggtttcccatcttctaatttgctgagcctggccatcattcacag

SEQ ID NO: 11503 - DNA, 201 bp, Bos taurus
tccacaaataattgtttagtactatgtgaatacattattccaggtattgaagatataccaatgaacaaaacaatatcaaacaaagcccatgcctgtcaccatagcacttaatgtctgtctagtgagactctaaaatatagaatgttagagaaaattctctaattttcagaagagatgctgatgggatgtttctgagctgga

SEQ ID NO: 11504 - DNA, 201 bp, Bos taurus
ctttagcccttcctgtaactattcaagaggaatccagcacatgatacctctaaagcactcaacaaacggctttttatctcccaggagaccctcatcaaggcggtcaggctcattagctctgttttaactgtggaagcaaagacaagtaaatacccagaccaaagtcaccccagcctgacacagaacagggactaagacaga

SEQ ID NO: 11505 - DNA, 201 bp, Bos taurus
atagggccaccagccatcctcataatcctgcagcggtggagggagttctggaaggacaccaggtaaaagcttgagatctgtgctcctaaaaaaggccaaagaccttgaagaggtgatacccaccctgcttgctcagcagggaaatagaaggatgagcccaggtgaactttaagtcaggagaaggacatttgtggagaaaca

SEQ ID NO: 11506 - DNA, 201 bp, Bos taurus
gaacagttcagagaaggcttatggtttaggtctgcaggactcagcaatttgacattctatttctgttgtttctcaccttaaactgaacagagtcagcagggttttgtttgtttgtttgtttgtttgttttttccttccctgaactcatctccctattaggtttccttgcccattacttcccactctcatcgtttacttcat

SEQ ID NO: 11507 - DNA, 201 bp, Bos taurus
gagcagctctgttcttctctcaaaatcacagtacaaacaatccctggagggtacttctcttgttgaagtcttccccgtatgtgatagccagctttcaagatggcctccagagattctcatttctggtgtccaccccctttttgtgcaaccccctcccacagggtatcaggcttggtctccatgaacaataaacacagcaga

SEQ ID NO: 11508 - DNA, 201 bp, Bos taurus
aaaacaataatcattttgctcactcagcgcctgtaggttggctgagttatctatactacaggttgtgcgtctgcacaagggccattaggtctttcctccagtgatgcttattatgggtctcaggctaaaaggcagtatcttatagctacattttttgttgttcagttgctaagttgtgtctgactttacggcccgatggac

SEQ ID NO: 11509 - DNA, 201 bp, Bos taurus
ggcccagatttcctccctgtgaatgggaggaggccatgaggtactccacgggacactcaggttggttcctgactcagccacgtcactggcctgtgacctccagcaggttatatcaccaccccaagtctcagtcgttttcttttgttgtatatgcaaatagacctaatacctaccaaagagatccatttcaagctaaggtaa

SEQ ID NO: 11510 - DNA, 201 bp, Bos taurus
tgtttcactccctgcaacagaagtaacaccctttctaggtggctccagacagaggattctctctgaacttttgaagagctcattatgttagctgtttcttctagtaaatcacatacattcctcaagaccccacaaatctaaacaagctcttctcagcttcatcccaaactcatattttcagtgacagatgacaagtgcaat

SEQ ID NO: 11511 - DNA, 201 bp, Bos taurus
agtgaattgttcgctgtaattttcccctctaccttttcctaacatagtatttatctgaatgtaattgtaagaaaagatataatcatcttgactcaagccacgatacccctgaattcctggccttatatctcttttctgtaactttgctactgactacaaatactaatggctctaaagcaaacagatatggagatggtgttg

SEQ ID NO: 11512 - DNA, 201 bp, Bos taurus
gctgaaggctggttcctcccactcacaggccctggaggctgcgctgggctcacctaccactgcctctgtcccttgctcctcctgctgaggatgcagagccgtcctggccctctgaatgtctcctccagctctcagggttggttcctcctctagatgtgatcttactcttctgacccctctcctgtttctcttaccaaaaca

SEQ ID NO: 11513 - DNA, 201 bp, Bos taurus
cctggccaagccattactagcagtactgggctctgacaccatctcattttcttggcttcctatcctggcttcttagttaaaagcatggaaattttctgaacttcttgggccctccatttcttcatctgaagcttgggttcctaactggctcattttttaggactatggatactgtgagtaagtaagtataaggaacttaac

SEQ ID NO: 11514 - DNA, 201 bp, Bos taurus
aaatctctgtgagaaaagagaaaacaaaactgattttctctgaattcccgtccatcctccactccccatctccaaccccatctgtctcctgcagctgcattgcaggcccaatcaataaagggctttcctttcacatggaagctttctgtgaagtttgatggaaaacactagtcagtaatccaaaggccaagcttcgccact

SEQ ID NO: 11515 - DNA, 201 bp, Bos taurus
tcccgtcacctatccttgccagtccttctgggcatggtctctcagcaaggatccaggccctcaggtgaagaggtggcctcctcggccatttaacatctatggcaatgttatcaaccaccctgtcctagcctttgccaagaagctggagccccagccaatacccagcctgtggccagagagagcgggtgaagagaccagtcc

SEQ ID NO: 11516 - DNA, 201 bp, Bos taurus
gatcctgttgttgtaggaagggcctcactctacacttaggctacatgaagtcatttcttcctaatattaatagcagcaggtcactgattcattcaacaaatatttgttgatcacttgctctgggccaggtgctattctgggtgctgagactgtagcggggaaacagaaatggagagactgtcaggcctcgtggaacttgcc

SEQ ID NO: 11517 - DNA, 201 bp, Bos taurus
agtctttcttgatgtgcctctattaacatcctgttaaaatattttagagactaagttattgcatttccttggatactagtatgtctgttccttgccaggtgatcataggatgatctaagtaaaggagaatcaaaggataagagtttaaaggaaattcttagaatcagtgcctcccagtagttaatgtgtatacatttgata

SEQ ID NO: 11518 - DNA, 201 bp, Bos taurus
agcaacaagttaattgttaaatgggtaaaaggtatatgagttatctaagaactgagtcaagtgattatgtttcacacatactctcttgatactacaggctatgtctctggtcaaatggattactaaagcgtttaatagccactcagagatcattttaaaggagtgcacctgtgcaaaatacttttttttttctctttaaca

SEQ ID NO: 11519 - DNA, 201 bp, Bos taurus
ctatagcatgggggaaaaaaaagaaaccatttgtctttaaataagacctttgcataaaaaagaaatgcgtaaggttaccttgaatggtgtctatttctccgtctccaacacaggaatgagaataaaaaacaatgtctgtggtgcagcttccagctcccttgcgattagtaatgttatagtacattattgtgttttgttgaa

SEQ ID NO: 11520 - DNA, 201 bp, Bos taurus
catcacaaggacacgctctggctcatggggagcacaagtagctgcagctacgcagagccttgaggtttatttcgtaagtcaccaccaggccgtctcagaatggcatttggaagacagaaaaaatgaaagtgttcccactcggatttgttccttgttttaacaccaagcaaaggactgggggacgatcctgggccagacttg

SEQ ID NO: 11521 - DNA, 201 bp, Bos taurus
tttccctcagccacaaggctcaatatctcgattctcaagctctacttggaagcactttcttgtcaaagctttatttccacctcaaatgctcccactcttcgtagaaggcctctggttcttactactactactaagtcacttcagtcgtgtccgactctgtgcgaccccatagacagcagcccaccaggatcccccgtccct

SEQ ID NO: 11522 - DNA, 201 bp, Bos taurus
ggctgggcctcgctggtcactcctggttctgtttcctgaggaatgaaaatccgacaaagcccagaaagcatcaccagccagtgtgatgccagcctcctgcggagaggccaccaggtgaaatgtgttttgctgcgtattcaaatcccccgagggagcttcgaaaactgcggtgcctggcttcatctcatggcagaatggctg

SEQ ID NO: 11523 - DNA, 201 bp, Bos taurus
aagttacaaagttcttttggtttaggactgatagtaataaatacatacatatacacatatttgttcaaataatctataaaaacatactcagaattcaatccctatgatttcattgctaaactctccagcttaaaacaagatatcaataaaattacaaaatcactgaaaaattttaatgataatcttagttaataaagctct

SEQ ID NO: 11524 - DNA, 201 bp, Bos taurus
aacacatggaatcatatcactttattaggcatccctacctggtcatcaccagtacctgcacatgcaaactattatatgtgaaatactacttttgtttagcatatgaagattcctccaccatggattcttaagatcctgcctagacttaggcaagggcttcccagtggtcaagaatctgcctgtcaatgcaggagatgcatg

SEQ ID NO: 11525 - DNA, 201 bp, Bos taurus
gtgtgtagtagacatcaataaaatgtttgaaataatagatctatcaccaaggtctgtacttgttcgtgttttcatagtgcttttcatctggctccgttttgatgcctggcaaacttctgtttcttctttgaactctggctctaatgtcacctttatgaggacttacccaacttctccaagtgtttggttatgccttctctt

SEQ ID NO: 11526 - DNA, 201 bp, Bos taurus
gcataaatgtgttagtctttagtctacttggaaccttgaaaaagttcattgttctttgtgatctcatcacttagttacaaaatgaagaaatgtccctcccgtatactgcctttgggggtgttcagtaattcagttctgtgaacaacacttacttggtcccttggtctgtcgtgtactacgttaggagctgagattttggag

SEQ ID NO: 11527 - DNA, 201 bp, Bos taurus
agaccaggctttctgtgctgtttggccatggtgggccacaaggcccatgggtacccagacaaaatcattgtgccctgggtggacagaagacatcgggagcgaagattgtaatcgatgggccctttgcaagcagccagggctttggaggggcttccctggtgactcagatggtaaagaatccgcctgcagtgcaggagaccc

SEQ ID NO: 11528 - DNA, 201 bp, Bos taurus
tagttcttttgaattctgttctttcaagttggaaagcctcctggagtttcctgacctgcttcttgaagaatgggagggacttaatgaaaaaattaatgagatgaagtctcagttggattcatcgttatacattattggcactgttccgcagtacatagatatggattctggcctgtaagttttcatagctatctgctgggg

SEQ ID NO: 11529 - DNA, 201 bp, Bos taurus
gtgacagatgttacaaccaacagctttcacatctggcctccaagatacttcagtgggtcaaagaggcacttggactcttgcctcagagcactggcagcaagtttctgggaaggaaaaggccccctgatttctctttctttgcatttgatataaagcaggaaccgatgccttagaaagaattcataggatcactgtttctca

SEQ ID NO: 11530 - DNA, 201 bp, Bos taurus
tttggagtgggatgtcctcccctgagggctctctgcacagagaaaggagtagcagcccctgcacccaccctctcaaggggcctgtgtcccagatcctcccggttccaccacctggacagtggagtttgaaaagggaatagcccagctcttcctgctgttggtgagaagaaactgagagacttcaggcttcagttgctttgc

SEQ ID NO: 11531 - DNA, 201 bp, Bos taurus
agggaagcagtggtgggatgtctgggacaggagccccccggggccgcctgaatctgctcaggccgccacaacgagctgccacacactgggccttaaacaatagaaacgtgtcttctcacgttctggaagctggaagtccatgatgaaggcgttggcagggtgggttccacggaggcctctccttggttttgtagatggccg

SEQ ID NO: 11532 - DNA, 201 bp, Bos taurus
cctgcacgcagtaggggctcagtgataggatgaagcaggtgctgactggcaagttcctcggaggcctctccctcggccagtgtgctgctctgcccccgtcgccgtcatccttcggggcgaattcacagttttaccttgtttccatccagggagttttaactatggccatctcattactgcctgctgcagaacaagccgcat

SEQ ID NO: 11533 - DNA, 201 bp, Bos taurus
tttgaaatatgcatcaggcaggaggccgttgtggagattgccttgaggtcagggctttcagttccttggttgctgagtctgaggtttctgccaaaggccacgaaatatcccttcattaactggttcttggcggcaaatataattaagagcttgccatagacccgaatgttgtaaaacgaaaggtgtctcctgtggtgtgaa

SEQ ID NO: 11534 - DNA, 201 bp, Bos taurus
tcctttggagatgaccttgatccactgagcaggagcagccccctgttctgctcttaggcatccttacccgacagggattttttttctgtcattttaactacgtggcctctagtcagtagcttttatgtgctgggagtgtgttggagccaggaacgaggttgaggaggaggaagcactgtgaggtgtcagaggctgaccact

SEQ ID NO: 11535 - DNA, 201 bp, Bos taurus
cagcagtattagctttatatatctctattgtactttctactctgcacagaagattagtgtgcttcaagttcagggggtgagactaggccattaagtactacggtctgttttcttttagattatagataacagccacaaggtcttaaaaacctttctccccaccattgggccaatatctaccattaaatgttataatctaac

SEQ ID NO: 11536 - DNA, 201 bp, Bos taurus
gttacctgccaaacctgggattcaaatccaggcaaaggctctgctcctcccactgcgtcctggggcctctcctgttgggaggccggttttccattgtgggaattgtcttttggtcatttaggggcttatcaggactgtggcaaggaaggggataagggataggggaccagggatgagaggacgcccaaggccccacagctc

SEQ ID NO: 11537 - DNA, 201 bp, Bos taurus
tttctaaccttgtctgggatcatctggaaaggatcagcaggaggatttgggaacctggggtgctaaatgactaattcagggtctaatttgtggggccccacggagcggctgagcatatcccaaggtgcacagctggtttttcaaagtgttgctattataggattattggaaatggcaagtgggcctcaagcatggggcctc

SEQ ID NO: 11538 - DNA, 201 bp, Bos taurus
gggcaccatactgttcaagttagttgttacttgttgccagagaggcaagaaataaaatgacaggtgtatcactggggtcatactaggccatctgggattgcatttctttcttggatagttggaggcaatctgttgtggagccatccggttggtaggtgtggccctctgcctacaagaagaagggggctgtcaaggagggtt

SEQ ID NO: 11539 - DNA, 201 bp, Bos taurus
cgctacagggttggtgttttgggtccaccagaaaaggtgcattcttgtctcagtgcctagaccctcagggtgctcagcacacattaggatggattcacaacctcatcaggaaagccaaagacagaaggatacatataatatgattgtatttattggactggccaaaaagtttatttgagtatgtctataacatcttatgga

SEQ ID NO: 11540 - DNA, 201 bp, Bos taurus
atcaatgacccagtctcgatggtgttctggctctggcccatcctcttgaacgctgattgttcaccttgccttaacactcacgtatggccagcagtcgctcatttccagttctgacctcttgcttccatccctgagcacggttcagactcatgagatggactgaacttgttcattctggccttgtccagaaatgtacaccct

SEQ ID NO: 11541 - DNA, 201 bp, Bos taurus
gcgtgtgtggaaaggctgggagacgacttttcctgtgagcatactggcctctgggaggggtgcagacagtgtccgtggagacgatggtggtggccctgtccatgtctggggtttaggcatgaggtcccgtctctgccctacttctggtccctctagggcagatgtgtcgttctccatggcccaggcaggggctatgatctc

SEQ ID NO: 11542 - DNA, 201 bp, Bos taurus
tcgttgcactttccagtctccctgactgcatcttaagctgcctgaggtccaggagtgcccctataacagtttcctcacccagcctcgtgctttgggcctgggcagtgctcagtgagaccagagttgcctggagtgtatgtggcttccggggagcgtgtggagctgtgttcccagggcccgtcccagccggcagggcggtgg

SEQ ID NO: 11543 - DNA, 201 bp, Bos taurus
tcactcagtgcaatttaacagacaccctgaccttcacaggcaccttgctgggcagttacctagctccctctcccaccttctcgtcccatccccagtggaaagtgaagggcaccattctgcatgtagcaaggtttctcaagagttccacatgttcttcttatagtcagcaacaagactgatggagaagccagtcccttgaaa

SEQ ID NO: 11544 - DNA, 201 bp, Bos taurus
ctctgacacccacgtgcagagtcaggaccactcagagaagactggggaggccagttttgccaactgttttccgggcacccatctggggaacttctataccctcctgcctgggaacagagggtgggcctggggaggctcggagagatggtcctctctggccagccagctggagacagggttaaaaatgaaagacaccattca

SEQ ID NO: 11545 - DNA, 201 bp, Bos taurus
aaaatattcctagctctctttgttgggtagccaggataaacatttttaaagcagctctactctttatgcagtgatactagctgtctatatagagcatgtacatttgccaaactaacattccttaaccaggaaaattaaatgatttgggcaggaatctagagatttccaatccaacttcttaaagctctcaaatgctctcat

SEQ ID NO: 11546 - DNA, 201 bp, Bos taurus
gtggatggggtcaaagtggagaaagaaagagaataggaaggttgtctgaaaatcatctagggagctttgcaggaagtacgggaacatcgtaatagagaaggcaagaaaccatatatatatatgctgaagtgctctccaaatgatcctgacatccctccatcactcattcctgagtatcaacagactttagaaaaaagagca

SEQ ID NO: 11547 - DNA, 201 bp, Bos taurus
ggaaagtctgcccactccggtattctggcctggagaattcaatggactttacagtccatggagtcgcaaaaagtaggacatgactgagcaactttcactcactatggggcccatgtgctcaaaaggatgcagccataatcatagctggcattggagtggcactttacaactgatacatatcttgtccctgcataatgttat

SEQ ID NO: 11548 - DNA, 201 bp, Bos taurus
tggcccaagatctatgctaagaaaattacttctttaaaatttgacttccagaaaagtttaatgtatgtgtactatatttgtaattcatgcttcttggaagttgaatttgtggttattccactgagtttatatgaacataattccctggttgtatttactatgctcatgagatttagtgatttattattaaacttcttagag

SEQ ID NO: 11549 - DNA, 201 bp, Bos taurus
attaggtaaaaagtcaccagcatggtatcagaactttcttcaagtcaatcctgggatattctgggtgggaggaaagggtccatgctggccatgggccaatcaacaatcaacaggaggtcttgttgatgctcctggttcatccccaggacaacttgctggagtgtatggaactgcccaggagtgaggatgcatggaattggg

SEQ ID NO: 11550 - DNA, 201 bp, Bos taurus
tgggttgggtttttttttttttgaaagggttttcccagcatgctcctaactagtaggcctctaaaaattgtacagaaatggcaggcccctgaatctaagtagggtttatttttccactctctggagtgcccgtgggctagccatcagttgctcatctggcctgattaacataatatcatcaatatcaatatgatagatcag

SEQ ID NO: 11551 - DNA, 201 bp, Bos taurus
caatatataaatactagagaataagtggcataaaaaattcaaagtgtggctggggacacatcagaatgcatatggcgggcagatcagacagtgtggcctcaagcacatgataaaaagacattgtctgtaatggatattgaagtccctagcctgacctccagagctttacaatctggcctccacctgcctgtcagccttacc

SEQ ID NO: 11552 - DNA, 201 bp, Bos taurus
aggaaaaagaacaaacctggaggcataaccctcccagacttcagacaagactacaaagctacaataaccaaaacactgtggtcttggcagaaaaacagacgtatgggttaatggacaagaaagacggcccaaaacacccatgatcaattaaccttccacaaaggaagcaataatatacaatggagaaaagacagtctctta

SEQ ID NO: 11553 - DNA, 201 bp, Bos taurus
attatattgtccatgtgggggtgggatgcttctgctcatttgatgctggctctcactgtcccccaattctgaggatgcctcacttggcctttcctcttaacgagatggctgaggggttgggcggggtggggtagaccaagatccaacttgtggaccagccagagtacttggctctcctgtggcctcggggccatcagttga

SEQ ID NO: 11554 - DNA, 201 bp, Bos taurus
ccaagctctgtccaaactcacctggttcactgcaatggcttcctggctgatgcctctggatctgctcttgaccctcagcagatccatttccacactggccacaacgtaagttgtgtgatttaactgaaaataaaagtgaggacattgaagacagatggctgtctccagtaaaagccaaagtccttgctaaaaccaacaagg

SEQ ID NO: 11555 - DNA, 201 bp, Bos taurus
gagggggcagggaggccgcatgcatcctgccgctaggcctgcggcctttcaggtcacaacacccagttccatcccgatcatgttgttccaaatcccatattttcttaagggaaatgagcggtaaataaacattttaagcactgactgggtccccggcactttgttcattgcttcacaagagatatgcacccagtcaacccc

SEQ ID NO: 11556 - DNA, 201 bp, Bos taurus
tgcttacatccccaacccttccctgcccctattgtgacctgagccttacacagtgaactcactttttacaaattagcttcccagtggccagctggcttctgcgaaggcaaagggcaggaagccagagagtaaggaagagtgtgcgtgctcattctccatcgctcagtcatgtccgactctttgtagccccatggcctgtaa

SEQ ID NO: 11557 - DNA, 201 bp, Bos taurus
cagacatcttcataagggaataggggcaaagccttcacttaatattagcaacattttccaagtcagccacaccttggttggatatcagcaagagagccttgagcagacatccttggcatgatggtggccataatacctcagtggctggagacatcacctaaactgctcagaaaggagaaaatcagtggagacagctgagag

SEQ ID NO: 11558 - DNA, 201 bp, Bos taurus
gttgttgttcggtctgcttggaaagtcaaataatgtaaggttctgagcttgttcgactatcactgatttcataaaaattctttctcggcaccactaataacggtggattaatgttgttactgagaaggcagaatgacttgacctaacacatgttaactctagagatgacctttaacatgttctcgggaagcctcaacttct

SEQ ID NO: 11559 - DNA, 201 bp, Bos taurus
gcaatgaaagacctatccgaatggatttaaaagcactttgcaaactagaaagcacttcaggaaatccattttttctaaatgaaataagcactgcccattgccttttatggaaaactgaggttaattcacatcagcaagagaaagctcagggagttgcttatggttgtgtttctgatttattaacacaacacttgatattag

SEQ ID NO: 11560 - DNA, 201 bp, Bos taurus
ctttcactattttatttttctccacagcacttactaaattctaggctggtgcttctcaactgggagtgatcttgtcccccaggcatgtttggcaatatgtggagacatttttgttacaactggaaggggatggtggcattattgacatctaatgggtagaggccagggttgctgctagacatcatacaatatataggagaa

SEQ ID NO: 11561 - DNA, 201 bp, Bos taurus
gacacattgaggctgtgagaaatttttaggttagtgaggaatgtctctagatttttctgtgattatttgtagctctttccataattgcagtgatctcacagttttaccttttaaccaaagtctaatccaatcttcaagcttcctgctaaagaaccacccaggaatgtttggggatttctgtgtaaccaggccctaggaaag

SEQ ID NO: 11562 - DNA, 201 bp, Bos taurus
atcagtggagattattgtccagagggccaacatggctggagaattaggtctggacctgtgaccacccaggggtaagacgaactagctacatataccactacagcaggcctcaacgctcctagccaaactgttcaagcttgtgttttgaggctgtttggaaatgtatgactcaggatgccagaatcaaaccaacactgaagc

SEQ ID NO: 11563 - DNA, 201 bp, Bos taurus
atccctaaggcctctatggtacctgacacatagtggaatccttgcatatgtttgatgaatgttcattcaatgaatgtatgaatatacttcagtttactaccgtctgttatgactctctgctctggccttctttctgtctttatgtgtttctgtgactttgttttgttttttaactctatttaaatttggtatttttttctg

SEQ ID NO: 11564 - DNA, 201 bp, Bos taurus
aagccttcctcacggggatgctcagcagatcactgtgagcatacacttcttaagtcaaagaaatgtggttgtgaaggccgttgctttcctgatagaggaatgtgtcagtataattatttgtacaaatgcctgttcagttcagttcagtcactcagtcatgtccaactctttgcgaccccatgaaccgcagcacaccaggcc

SEQ ID NO: 11565 - DNA, 201 bp, Bos taurus
cgggtattccacaaagcttctctctctccctctttcccagggcaaggatggctgtgggggtccccttcaaggtgctggggagtcagtcatctagccacactgccttgcaaagacttgcagtgaaaggtaaaaataaggactaacatttacacagtggtgtgaagttacacaggacttgaataatctatgcctcctatatag

SEQ ID NO: 11566 - DNA, 201 bp, Bos taurus
ccctgcccctggtataacttccaaactggtctctcctctctcattctcacatttctttgctcaaaatgcaaaacaatgggagagggggcctcacttccaagcttggtcacatgtgtttctgttggttattctgttaaaaggaaaataatctttcacgagcggtcattatatcaaggcctcagagcacttgcgttgggtgtc

SEQ ID NO: 11567 - DNA, 201 bp, Bos taurus
gccactggcctcttccaagaacaaggagtttttaccttgttgcctctgacctttgtcttcttgaataactggcttcacgatggtaacaagacccttccaaagtaggcttggtggccgtgacccagtagtcaggccacgcttgagtggagaggtgtccaccgtggaggatattattcagggtgattagaaacatccccccca

SEQ ID NO: 11568 - DNA, 201 bp, Bos taurus
agtggcagagttgggatcagaacccagcccctctgactccagagcccctcctgactgcactgtccactctgactctgagagaaagagcactggcctgtgagtaaggaaatcggggttctatgctgcagctctcagcagttagcagcagaagcttgggcaaatccctgaccctgacatcttcatctctcaaatgaggagact

SEQ ID NO: 11569 - DNA, 201 bp, Bos taurus
acgaagctggtgttcagaccatggagatttggtcaaagtgcccattacagagaaaccaagctgaagaaatgccagggaggggcagaaaaataaatgcagtaaattaaaaatagagagaaaaccagttctcagagatgattcttcattctttccatcctttttgaggacatgcaagaaggtggctttgagctgtgagctgcc

SEQ ID NO: 11570 - DNA, 201 bp, Bos taurus
tattaactgagtgactgtgaatcctaaatgtgatatgactctgttttcaggataagggaaatcttgaaggcgtcacgaaaattgcaaggtgatcccgacttgcccacgtcatttactttggccatagtggagtccgactctaccatagtctactacaaactcactgatggatttatgctgccggatcctcaggtcagtttg

SEQ ID NO: 11571 - DNA, 201 bp, Bos taurus
ctctggactgccagcatctttaatgaacagatggagccatcctcccttccttggctatatctgtttaatcagctttggaaggagctatcataccaccagctaataaaagtcttaataaatatctaaactgcaataccaccagacaggtgttcatgctattagaaaaatctgacaaaagaatgcctggatttttatttaaga

SEQ ID NO: 11572 - DNA, 201 bp, Bos taurus
aatctatggcagcatttcccaaatttatttgatcaagacccctgtatcagttttccatagctgctgtaccaaatcactacaaactcaacagcataaacaacacaaatgccttatcttacagtctgcagattagaggtctcatgatggtctctacaggctcaaatcaaggtgtcagcagggctatgttcctttcttgaggct

SEQ ID NO: 11573 - DNA, 201 bp, Bos taurus
aagccctctcatctcccattcatctctctttctaaggctctggattggctcaggcacgatgataaaaattggggtggcttttctccactccaacagttgcacggtcaaaggaacaaatatatgcacatagtcacgcattaatcctgggagatgacaggcaccgttcgagatagcagtgttcggtttccggtaggacgttga

SEQ ID NO: 11574 - DNA, 201 bp, Bos taurus
tgtactggaggcataattagtcagtgtcttttcttttcaattaacaagtgcttttcctacttctgagtaaataattcctaattaaatgcaccaattttattgatttactttcattttttttctcttctgcataccaaattgaaatgtgaaattcttacacattgtaattgtggatcagaacccactgattaacttgttaat

SEQ ID NO: 11575 - DNA, 201 bp, Bos taurus
ctaacttgcagcagcatcctaagtgattatgcttgcatcctcattggagtaagccttgaccaggtgatctgctgtgcatatggccagctcttctcatccccgcagatagaatcatgacttcactcccttaggtcctggactaggacatttacaggtggcctgcctggatatcatcaggtgacagtaaggatgtcaatctta

SEQ ID NO: 11576 - DNA, 201 bp, Bos taurus
ttgggggaatctctctctctctctctctctcacacacacacacacacacgcacacacaaaaccagcacaatgggagctaatccataggggcccaaggtgcaggtgagggcgaggaggggcacaagtcccaggggaggagctgtgaggaggtcctgaggtggttagaggccaagccagagctcagcaacttgttcaccacgg

SEQ ID NO: 11577 - DNA, 201 bp, Bos taurus
cctagatccacttggccaccctaaaactattagcttagagaaaattatgctttgcccaaactgaattaaccagggataaatgattttgaaagaaatgttacgggaatggccgaatcttgagaaatgaattcaaaactgtaaaaacacccagaacttcatcaccattatatcctaaaaacatttaagaactcagtatgtact

SEQ ID NO: 11578 - DNA, 201 bp, Bos taurus
tgacagagagcagtctgccatctggaggaagagagcttttttcctaattcgcccaagggtgctgtggtggactggcagtggccttgactgagcccctcttcctgtgcagatactgagatgacatctttgtattccttatctcattggatgagctactttgacctggggcttgtgcttggccagctttctttgtggagacca

SEQ ID NO: 11579 - DNA, 201 bp, Bos taurus
taagatttggttcgggggcatgaagtttagtgtaggaaataagataattccaccatctgttcaccactgtatccccagcaccccaaacagccacaaggccgatgcttaatttggtaaaagtggtacaaagaaaggataattatccctaaggcaataaagggtgtgataaatgctatcagagaaagcaaagggccctcggag

SEQ ID NO: 11580 - DNA, 201 bp, Bos taurus
ttgtcaaggcccaaatattaaagtagggaactgtccttcagaaccaagtcttgcctttaattttcccaggcaactcttttgaaagccttaaggggcacacctcatagtcataggccataatcctcagtatcctggcttgacaagtttcatttgacatgttgttgcaagaccatgttaattccttcataaaaaccttaaaca

SEQ ID NO: 11581 - DNA, 201 bp, Bos taurus
tgtctttataaaagaacaacagagagagtttacatttagaagaggaggcagtatgaccacagaggcaaagattggaatcatgtggccacaggtcaagaaacgccagcagttactccaagctggaagaggcaaggagcagaatctttcataaaatctctgaaagaagcgcggcctgccaacaccttcattttggccctgtga

SEQ ID NO: 11582 - DNA, 201 bp, Bos taurus
gagcacattacctgccatcaagtgcagatacgcatcaggttgagtgagtgattgaatgatacatcatgctttaaaaaaaaaacatgaaaattggcacttaggctcattctgaaaaacctaaaaaagacaagaagaaatttgcttatattcttagcagtattcttgctgctatagattcagaactgattgttggggttgagc

SEQ ID NO: 11583 - DNA, 201 bp, Bos taurus
ctggatctagcaacctgttactctgaacttccccagttccaagagtgggtagggtcaacatactgcaggtgattgagagaactagaaggtaaggctggccaggtcattcttaatctaaaagtatttacttgaagataaaataatgggcatcagcacaaatatgtttaccattaagttaatttttagacttagtaatgacta

SEQ ID NO: 11584 - DNA, 201 bp, Bos taurus
ccatttctcctaagtggtttgagaacttaatgtaagcaagtttagttccttgagacaaaaatgttacatctttaaattattacctgtagattaactcactgtgctaatttaaggggggaaaattctattagcttcttttgcccatagctcactgttaacccaagttgtttatttttcactgaaattgtattgtgtccagag

SEQ ID NO: 11585 - DNA, 201 bp, Bos taurus
aaataggtaaactggttgttttgatgcatttaaaaataaataatttgcttaagtcttttactttgtaatggattgattgtgtatcttagaaatgccttaggatttacaaagcatacttggattggaaatagtatttctaagattgagaggggaaaggaaaacaatgactgtttattttagaggatgagtatacatggtacc

SEQ ID NO: 11586 - DNA, 201 bp, Bos taurus
ttaagatttacatattcaaagttttgaaatttatttagttgaatatattggtcttctaaatttttaatatcttctttcacttttggatttagaattcaaccgtccttcagatttctaattggtagtttttgacttttaattttgaagtgatttctgattaaaagttgtaaatatagtatagagttcctatgaatttttcag

SEQ ID NO: 11587 - DNA, 201 bp, Bos taurus
gtatgtagtctatggacctgggtgatgaggatgtgttagttcaggtacatcaggggcaacatacattatcattctattgtgcggtacttgtggggaaagtgcatatgcgtagggggaagggacatatgggaactctctctctcccctctaaaaacctaaaaatactctaaaaagtaacatctgtttttaaaaatgtgtagt

SEQ ID NO: 11588 - DNA, 201 bp, Bos taurus
tcctcctgcttcttaagagaaagataaaaaacgtcttgacacttgcagcctgtttcctcctttggagacccctaggtttcctgcctgttaccctctcagtaacacacaaaataatacatctatttgtaaaaataatgccatattttacaatgagaagtctgcttcctggaagagggctctcacgtgatgatgctggcaccc

SEQ ID NO: 11589 - DNA, 201 bp, Bos taurus
acaagctttgtggcttcattaaaaatgtaaaagtagaatgttctattccgctaagcacgccatgaaagagttatgctgttctttcttctcttgacatttgtaccaaaggagaataagattgtaaacatctgttttatataagccaattccaggcttataacttgattagtatgagaatatttgatgtgattaattttccag

SEQ ID NO: 11590 - DNA, 201 bp, Bos taurus
gctttgggatcttgcttcatgcagttagtacaactccttatctgttacttgcttagggtttcagtttatcctcaggagatttattcccccaattagagacctggatacatggtaaacttccttgccagttttctagattagtgtgaggaatttttcctgaccctcgtttcactgataggacttgacttttaaaagggtact

SEQ ID NO: 11591 - DNA, 201 bp, Bos taurus
atgttcccttatgccccttctctgcctctcctcctaccatagagataaccatttttctaataactgtcaccatggcttagttttgcacatgagtgttgccgaaagactacgtattcacttgtgacggacttctttcactcaatgcattggttttgcatgtgtaaattcctttttcatgaccaagtaatattcagttatatg

SEQ ID NO: 11592 - DNA, 201 bp, Bos taurus
tagatgttgtgaagagtacaaaataatcttttggaaaagatcttcgttaaaaagagaaaagggaataatcttgttggtttgacaggaaaaacagcattgaaaacaataacaaataaaaagagctttatatctgagaaattttacacttataatggtagctgtatcactcagaaatgctgactagatgatgctgaagcacaa

SEQ ID NO: 11593 - DNA, 201 bp, Bos taurus
tattgtttctcttgtctctgttctgattttttggccacgaggtgtgtatggaatcttagctcccaaacagggatcaagcctgcagcttgggttggaaggcgcagtcttaattactggactgctggccaagtgattttacctatagttctgtgttttgctgtttttgtttaatggtatatgataaacatttacttgtttttc

SEQ ID NO: 11594 - DNA, 201 bp, Bos taurus
gattatatacctcttttattaagatgtattctctaattgagttggccaaaaatttcatttggcagaagaaagctgaatcagctttttggctaactcaatgcaacttttatctgatactcacagggcccataaatctgctccattagagggattcattatacgctcttaaaaattacatttttagttcatagaaacagaaca

SEQ ID NO: 11595 - DNA, 201 bp, Bos taurus
agaagcaacagttagaacctcacatggaacaaccgactggtcaaaattggtaaaggagtatgacgaggctgctcactgtcaccctgttaacttaacttctgtgcagagtacatcatgccaaaggccaggctggtgaatcacaagctggaatcaagattgctgggagaaatatcaacaacctcagatatgcagatgatacca

SEQ ID NO: 11596 - DNA, 201 bp, Bos taurus
cactgtacaaagaacaaaagaggaaagtgaaggacagccagaaatccatgtctcccccagagaagcccaaaatgtgtttcaacgttcagaatgtattacctcagtgtaatctcctcatgaagcaaatactgaactataggaagaaaggaagagatgggctgcaaagggaatgggcagctcttctagaaagggccatggtta

SEQ ID NO: 11597 - DNA, 201 bp, Bos taurus
ttgtctatagttattattctttctactgttactcctctttcacagtacactttaggagatcccctcatctcatggccctaaatgacaccccccttcaccccgactgtgttaagtgctgccataaccataggagatctcctcgcacttatgtctcatagctgcatggaacttgcttactcctttgcatcaatgattgtcaaa

SEQ ID NO: 11598 - DNA, 201 bp, Bos taurus
aattatatagattctggccactatttctgtccttctatatggcctgtcttttccttacattgtaaagctttggtttggggcctcagcatttctcacatttccccaactatcctttaagaatggcaggtagggaaatgaggcatagttaggattatgttgcccattttttagattgtttattagtttttttctctgctctgg

SEQ ID NO: 11599 - DNA, 201 bp, Bos taurus
caccttgttattacttgatgcgcccaactgtaactgtggcaaaggcttgcttccttatcaagagctgccacagagtctctgacgtgctagaggtaggagacatatgttaccagaaaataactcgagtgccttttgtgtacaaaccaatttagttacctgaaggaattagcattatgataatggtttttgtgactgaagctt

SEQ ID NO: 11600 - DNA, 201 bp, Bos taurus
ccagtcagataaatgacaagttcattcaaatttattgtttataaaccagcattattaaaaatgactacattttagactgaatgtactaaattgattagtcctttttcagataaaacttttaccaagatggactccatttatctccttctggttatttccaagttttagaatgactgtatgtttggaatgaaaagttacaag

SEQ ID NO: 11601 - DNA, 201 bp, Bos taurus
gactggggaggccacagtccatgaggtcacaaagagtcagacacaactgaagcgaccaaaacctgagcacatacaacgtattaaatgggaagaacctggatattacaacaagagaagtaaaatttgaactgttcactatatttgtgttttctgaaaaatgacaaaatatatcgcatagaaaagtctctatttataaacatt

SEQ ID NO: 11602 - DNA, 201 bp, Bos taurus
aaggtcagaaaggaatagatgaatattacgaatagggagaggatggtaaaatcattaggaatcaataatattctacgagagaggagacaaaagggaacagattaggaaaagacaatcagaaggaaaaagttttcaaaagtagtacctgcataatagcaccttcataattattttccctgtcatatcagatcagatcagtcg

SEQ ID NO: 11603 - DNA, 201 bp, Bos taurus
gagaattagaactagaaccaagactaggacactttccattctaccatgaattaatcttcttaagctcaacctaaggacccattttcttggccaatattcctcatgacaaatttctgcaaaaactatcactaaacagattttctaaaataaaagaaataataatttcccaaagggccttcaatttaattcaatttaataaac

SEQ ID NO: 11604 - DNA, 201 bp, Bos taurus
ctagttcatgcaaactcagaggattcgacacgtataggcagtacttccatgaaatgcctgcctgatatggtccctccagggccacttaccttccctgctagcggctgttatgtttcttgtgggactcaccccgattgaaggtgctgtgtgtgtcctgggcctcagtaacataatcccgattccttggtctttcagttggtt

SEQ ID NO: 11605 - DNA, 201 bp, Bos taurus
caccatgcatatccttccccatttctaaaactgtccaaagaatgacattccatactgttctgcaaagtggcacagccagattgctcagtcccgtgttaatcgtgatgtgctgcataaaatcagctcttccagaagaaaacaatgatagaaaaagtcttcattcatttctcctctgtcccaaacaccccagtctcaggaggt

SEQ ID NO: 11606 - DNA, 201 bp, Bos taurus
agaaattggttaggccttgtaagagctttctcacaataaaattaagtctcttttatgattcggtggatattaagtcactaaacttgccagatcagcttcttctctgactaatagaatttggccacctcatgcgaagagttgactcattggaaaagactctgatgctgggagggattgggggcaggaggagaaggggacgac

SEQ ID NO: 11607 - DNA, 201 bp, Bos taurus
tcattttctaccaatgtaatgctctatagcttatacaaaaaataatatagatcttattagtccatgtatttaggtgtctataatacaccatggccttaccattttgttatatttctttgttttaaaaaaaaaaaaaagcttgagtgtgaatgagcatgcacaacaaaataaaatcttgaaataaaaacatcaaaatttgaa

SEQ ID NO: 11608 - DNA, 201 bp, Bos taurus
gaaaacctgttaggtcagtcaacagcaaagggcacaaatctcccccagatcaaatcagatccaggcagcagcttagaggaaagccataggccctgatgagttgggctgtggaaaatgtccctggtgaagccgaagacccatgactgctaggagggcagagggagaggaagaggatttgcatgagcaagaaaatccaagggg

SEQ ID NO: 11609 - DNA, 201 bp, Bos taurus
taaggtttaggaaaacaaagaacaaaatagacatttatttatcattctaacattgtgacttaatacgacttaatagccaccttaccacatggatagaaaataaaattagaaaaagactgctgtgtacctaagttatcatcttcataaaaagacaagcatacaatcaatccttggtacctgcagaaggttggttctaggacc

SEQ ID NO: 11610 - DNA, 201 bp, Bos taurus
agacagctatggtgagaatttgccctgcaggcaaccctctccccctttctggagctgcttgtccccttgatggatagttcaggcctgtggtgtggatagcaccttctgcatggctcctgctgctgctttgaagacatttcactgtctgtggttccctaacccccagtcaggtactggggagagagggaggccaaagcagat

SEQ ID NO: 11611 - DNA, 201 bp, Bos taurus
cttgctagtggccctccctttgctggcagccttttcagcagaatgttttgctcatccacacggttccagagttagccatcgcagctcctgggcgtcttgactgtgtccctcctgggggccccccgggtggctgcaaagtggagcacccccttcccagcatgccgtctttgtaatcagggcatgagaaccaggaagatgtca

SEQ ID NO: 11612 - DNA, 201 bp, Bos taurus
gtcactgggggaaggggtggtcggggcagaacagggaaccgccctccatgggcttcccaggcgtctccagctcgcccgccccgcctggccccccaggcctggtcctgagatcctggcagcagctctctcctcttctctgccccggctgggtgaccctccactcctcccagcaggctggctcttcctggaatcagcctgttt

SEQ ID NO: 11613 - DNA, 201 bp, Bos taurus
ttgaggagaaccaggaagaatgagggccctgaacctggagacagaaggcttggggagggagcgtgctgctgatggagtggggcgcgcctgtcagcgcccaagctgtggactctggggaggccgcgtgaccccacgtcacgtcctggatcagctctgtccagagcgtgcccacgccctcggcgccccctctgcggtcccgcc

SEQ ID NO: 11614 - DNA, 201 bp, Bos taurus
ctgaagagaagaatacatcatggatactctcccatttagacactttaagaagcattcactgagcacccactgtgtaagaagcattcactgagcacccactatggccagtcagtgggatagaaagaggggcaaaatgtgggtctggacctttgcataccatacattcacaatccttattgggtgttaccgggtcaaatactg

SEQ ID NO: 11615 - DNA, 201 bp, Bos taurus
tcagttgtgtccaactctttgcgaccatgaaccgcagcacgccaggcctcaccaactcccggagtttacccaaactcatatccttattattatggtctcataaattatttcatccatgtgtcttatctctgattccagattataaactgcttgtgagtagagattgtttttctctcttctgtatttcctagctcaatctta

SEQ ID NO: 11616 - DNA, 201 bp, Bos taurus
agcaaaataatgacataatcaccatcagtgtcacagaccagactgtacacaaggtgacaggggaggggggggctgtaatacacacatgaggaggacccgccggggcccactgcggctgcgccctgaggcccgggatgcgggcacgaccacgtgcccacctctctctagcggagtctcacttcctaaggtgaggcttgtccc

SEQ ID NO: 11617 - DNA, 201 bp, Bos taurus
caagccgagtaacatgatatccagggcccagatatgagagagaacgggggtgggagggagactttaaattgtctagtatgtcctggattcttgctccccccacccaccccagtaagccaccccttccatcagacactgcccactcaccctcactcactcacacctttgcacacccctccccttcccttcccaagtgccggc

SEQ ID NO: 11618 - DNA, 201 bp, Bos taurus
accacggagatgtaagataattcctcttactgacggggagcctctatcatttcagaatatgcttatttttcagcaaggaaaccaggccaattcactcaaccgcttacaatgtcatcgtgcatttgtgaaatggaagctttctctgggctcaatgtgacaaaatgctgatggctgactttcagtggccgcgtcaccaggaaa

SEQ ID NO: 11619 - DNA, 201 bp, Bos taurus
atggtcctctattctctgcattactctaaagtcttctttctctctcctctcttcctctaagttctcatcccatcatcgccgtattctgctgaaggccttctcatcgttcttcccattcctgttgctttcatccacccttgaactgaactaaaccatcatggcaacttctgggctccaactttccagttctgggcctttccg

SEQ ID NO: 11620 - DNA, 201 bp, Bos taurus
aattacaccaaagtttgggagtggtaaaaaggggacccacagcagaaatccctccagctcaaaggcatcatttgcctgccccacaggcccctacggtgcacaggttaataagttcacccaagacacgtggacctgggctcccccgagggacccatccaggaacatggccagtcagacatgtcccctctgaattgcttcctc

SEQ ID NO: 11621 - DNA, 201 bp, Bos taurus
gtcactggaggtctgatatatgtggacaaatattccagatgcatggcctcccatctccttcacttgtttagtgcacttgttagggtctgatcagcccatcgacaagtcaacaaatagtaatggcctcatggtcttaatactacttgcagggactcctccaaataaatcttctgccccagccatgttcccatttcacatccc

SEQ ID NO: 11622 - DNA, 201 bp, Bos taurus
cccagtttcacctcttaacagtattaaataatattatcacccatgaaaccccctaaatcaaaaagctccttaagtcctgtgagttctcccgtccccaccttcatgaccagtgacctagaagtctagtcaattctaccccctaagtatttctcttttccaccctccactctccttcacctaccatgatttcagtgtttacta

SEQ ID NO: 11623 - DNA, 201 bp, Bos taurus
actggctcctcaactgtgctttggggcagtggtcccaaacctctttggcaccagggactggcttcatggaagacaattcttccattggccgggctggaagagggacggtttggggacgattcacgcacattccattcactgtgcactttgtttctcgtattattacattaactccatctcagatcatcaggccttagatcc

SEQ ID NO: 11624 - DNA, 201 bp, Bos taurus
aataatgtccatgtgtggtgactggtatatttctaaacagaatccacagactagaaacactgccctaatgttacatttaaacatgtataacatttaaacacataacatgttaaatgtataaccatgtgcctgaaacagaaattattatacattttggttaaaagttagaattgtgactatggtcaccacggtttgtatgaa

SEQ ID NO: 11625 - DNA, 201 bp, Bos taurus
cttcttttaagcttatagattctctaaaaagttccacatttgtctttatgactttcatgacagtaagagtatcctctttattgatggggagaggaagatcgaaggagtatgtgtgttgtgtatgagtgtttatacatatatatggtactgtgtttatgtatctatagatacatacgtgtgtgtgtatgtatttttttaagt

SEQ ID NO: 11626 - DNA, 201 bp, Bos taurus
ttaggggcggggagggggtgtgtatggaaaaaggaagaggggagcagaaggacaggagccacaggtccttgtggcctggaagcctgcaagcatgctactgcatgtgcataaaggggtgaggtgggtcgagggggcagagaaggttggagaggtggagagagccctgtgaggccaaataggattgctgggcttcatcctagt

SEQ ID NO: 11627 - DNA, 201 bp, Bos taurus
cactgaaaaaggacccgggagctagctggaggtgtgtgaaggtcagagtctgtctaggatgctgagcctacgctcctcgaggccagagatccccacactccagctgcttccagagctggttctgttggatcctagagatcccaggaaaaatgcagacttggccattacctctgggcaggcaagagagaaatgtttttcaag

SEQ ID NO: 11628 - DNA, 201 bp, Bos taurus
agggagaccagagctgggcctgcagtggggaggattcggttcagtggaaaagagcagggaggtgctcagagaaggggaattgcagccataattgcctgtcaagtatgcaggagaggaggcctggatcaaccagaaactatactttaaagacaggaatataagtttcgagacagggtcaggggtttgtgtatcaggaggcag

SEQ ID NO: 11629 - DNA, 201 bp, Bos taurus
ggcacgaaccggctatttttggtgctcagagattgtgtgtgaggaactctgacagagcacagtgggaaccacaggggccgtggtgtgaaccagctattcttagtgctcagagattgagtgtgaggaaccctgagagggcgcagtgggaaccacagggcctgtggtgagcctgactgccagcaggagctccggtcctctcca

SEQ ID NO: 11630 - DNA, 201 bp, Bos taurus
gagctgatgtaataataatagaaataaagtgcacaataaatgtaaggcacttgaatcatccccaaaccataaacccatcacgcccccccgacactatttcgtggaaaaattgtcttccacgaaactggtccctatgtcaaaaaggctgggaacttctgccttaaagttttccctgtattctgttgcttgaggagatgtttg

SEQ ID NO: 11631 - DNA, 201 bp, Bos taurus
agcctgaaggaatacaaaggaggcaaagaaattcaactcagatttagtcattactcctgggggcattgccttaaggccagatatcattgtaaacaagccactgaagaccactaagagaataatatgaatacaatagttagttatgttgtagagttcacaaatatccatctacagacagaaaggcaggccttaaaagcctct

SEQ ID NO: 11632 - DNA, 201 bp, Bos taurus
cccatttattatttattgttttaccatttgcatgagtcagaagtccaggcgtgacttcactgggtgccctgctcgtgttgtcacagagttgcggtcaaggcgtcagccagggccagtcttgtttgggatttgggtgcagggtccccttctaaactcatgtaattgttggcaggattcatgtcctcacagctgtgagacttg

SEQ ID NO: 11633 - DNA, 201 bp, Bos taurus
agaagactcctagagcaaactctgatctaatgaggggtgtagggtgcatccagagagaagcgaaattcagacaaaattcaggagtcccttctcagcccccgaccccgaccccacccatttgcctaccacaccttctttgctgtcttgatctgtgggtctcaccttcttgcccccatagcagacccatgaccctgagcaagt

SEQ ID NO: 11634 - DNA, 201 bp, Bos taurus
actagtgttcttttgctgtgtaacggtagtaccacaaacttagctgggtcctcagcttagaatctccaggctaccatccaggtgtcagctgggatgtgttttcatctgaaaatgtgactggggaagactctgcttccaggctcaatcaagttgctgacagaagcatttctttgaggttctgaaactgagggccctggtttc

SEQ ID NO: 11635 - DNA, 201 bp, Bos taurus
acgcaaacacacacacatccatacagtatgcggacaaagtatggaaatgacatggcctacattttctggtataatcctcaaaaagattgcccatatcacattatgaaatattttgcactataaattttaaaatcacaataaagacattattctttagaaatctgtttatggttacttaacagtcatgatttacaaagtaat

SEQ ID NO: 11636 - DNA, 201 bp, Bos taurus
atctgtaataggttgtgccaaattgttgaactggattgaactgtgtgcaaaagggtagtgagatgtaaccccacctttgggaactgacaatctaataaccgccggggagagtcagagacagttcacgttgcacctggtacatgatgttatgggtcttgcgtggttttcattaaccagacatatggctgaactacaccagtg

SEQ ID NO: 11637 - DNA, 201 bp, Bos taurus
gaaaaaataatcagactgtgctctcctctctgttagagccaagaatgcacctgtttaatagaatcttttaaaataaattttaaaatggcctctctacttctgtcctctctaggacgagaaaccacaaagcagagaggagtaacattacctacagccatgctctcagccccagaaaaaggccctgccctgggactcaggaat

SEQ ID NO: 11638 - DNA, 201 bp, Bos taurus
caaacactgtaaatcaaattatgtttcaattaaagtcttttaaaagtcacatccgagttagaatactctatcccagagtaagaatatagcttgtgggggccgcaagctagcccaatgccgaggcccaagaagggattctgcaccctccaccccagcagcagccctgcaaaaatccagggcagagggcaattcctgatgtat

SEQ ID NO: 11639 - DNA, 201 bp, Bos taurus
ccatttctcagcctcccctcccagcgcgctgtccctgagccagtcttgccaaaacccaacgagagagcccgacccagagaaaaggcgtttaaccttggccggggagctcagtggaaagtttttattacttgtcatggcaaaaaaaaaaaaaggagaagaaaaagaaaatcatgcttttgaaaataacctcttctttgaggc

SEQ ID NO: 11640 - DNA, 201 bp, Bos taurus
tctctgacacatcaaggacatccagcagcgggtgggggtgagactagacaagaaatgatgcactggcaggttaagggcaggagctctttgtgttgacgagggggaatcaagcccaacgtgtgctgggggcccttcctcccatcactagtccatgggcttcttcccccaccatttggagacccctcagccccctctctctct

SEQ ID NO: 11641 - DNA, 201 bp, Bos taurus
cccctcttcctcggtttccgcagggccagttcctctacaacatgttggggctccctccactttcttctcccaaagcgaagcagacagagacacacttggtagttgtttccaccagccctgatcggcctgaactggatctgcctccagtcaaaacactgagagatgaagacagaaaattggctccagtttccagccgtgagt

SEQ ID NO: 11642 - DNA, 201 bp, Bos taurus
catggagaccaccgagaacaatgaaagcagcagagagtaacaatatagatagagcaactggagtgaagacaaattaaatacagatactccacactcaagtggcatctttccttcgacgattcctcagggcaagttgctccattcagcgtgcattcaggaatctctccctactctcgctgcagactccatcattaatttatc

SEQ ID NO: 11643 - DNA, 201 bp, Bos taurus
tgccaccttgtaaccaaaacattattgcaaaatagaatagaacgtgtattatcagcaaaattaccaataaaaattatttggaaaatgtaagaaatcatctcctttgtctatacttttttctttcttattgtagcaatcaaattttcttgaaaaattaaaatctttcactacgtaaaatatattttttaaaaaatcaagaat

SEQ ID NO: 11644 - DNA, 201 bp, Bos taurus
ccctttctgcaacattacaatttaaaaaaactaagtccattcagaaatcaaactggaatgttctaagacaactattcaaaagttaaatggcaaatggctagagaacgtcttcccttaagacaaacagaagataagactaattttctaccttaatttttttctacttcttttctttcataaatcttacactgtccagcttct

SEQ ID NO: 11645 - DNA, 201 bp, Bos taurus
gtgggcgtggggtgggcggggaggagaggaggtgagtctgaagcagcaggaagcagacaggtggggtcaccaaggccccagctgaggccttgaaaggttgctttctcctgtgcgctctgccaccgatttcctgtatggctaaggacagtcatcctgggtctcagtttatttgctgcaagatgagaggctttgctaagatga

SEQ ID NO: 11646 - DNA, 201 bp, Bos taurus
ggaagaccaggacccccacgaatgccagagtatgagcctgggaccccccacctcccctgcaaccactggctggggtgctggcctctctgggccgtgatgatctcctctgggacacggggagaatctcatctttattattaatatttaaatctaaaccaattgccccgtaactaaagctctccttgctctttggggaaggag

SEQ ID NO: 11647 - DNA, 201 bp, Bos taurus
agccagtttaaaaggaaatagagacgcttccctgctcctgtcttttctgagctgtgagagccaatgccacacaggggccaaggggcacccgctgggtttcctctgacggagagtcaagagctaagtgtgtcttctttcccatgaaggttctgccaggtcgacggtaggtgaaattacaggcttacctccggccagtgtttt

SEQ ID NO: 11648 - DNA, 201 bp, Bos taurus
ttactagaatttctaccttgtaacttctcaggaaggcttacaggggatcaagagggagagggagccgtgccaaagaggccagttgactaactgagggaacgtcgatccacccccaccgtgctccatgactgccccgcggcattttggaagaagtaggccagagatcactggggaacaatggctgcggggttcactgccaca

SEQ ID NO: 11649 - DNA, 201 bp, Bos taurus
tccctttccagctctggaggagcatgacggcactaaaggctgggcatgctcgtgattcctccttcatcctccagtacactcactggcctccccctccagatggcagcaagagtcttggaggcctggcattgcactctggggacttattctgactttctcctggggcccacatggccattccctatctggtggtctagaact

SEQ ID NO: 11650 - DNA, 201 bp, Bos taurus
acacatgtataagtcaaatcttgatgggaacctctggaacagacagccccgatagtaggcgccacggctacccagacaaacccggtttcaaaaggccacggtctcatcagaccacgtgcacagccaatatgcccccactgggataatgaaggcggctgcactcacatggccccaggcaggtacccagttgccctgtgctat

SEQ ID NO: 11651 - DNA, 201 bp, Bos taurus
gactccgaagaaggccatgtgggagagcccagagctcttcagtctgtgtccctttgctcccgtttcttcctcctcatccctctactccctccaacagaaacatttcacctgcattttctagtggccgtctctaaggcttgttgcccacgtggtatgctaataacaatgaaagtgaaagttttacttgctttgcagtgtctg

SEQ ID NO: 11652 - DNA, 201 bp, Bos taurus
attaggtggctcccagccagtgactgagattggcagggacactaaagcagactgccatgggagatcctggactcttttgaaagtttggcttgatgactctctggtgggcctgctgaacattcctgagtctgtctggtgttctagaacagtttcttcctctctgcttcctctggaagatgagacttgccatgtgggccaatg

SEQ ID NO: 11653 - DNA, 201 bp, Bos taurus
ctttctgagctcgtcaacaaggccccgtcaatgggagcaacaggacaccggaccagcacggagattcagcccatcagtcaatgtttctgcaggagacaacggggccctccctggagagtctcggccttggggacagcagttacttctgcagggaagctcggtttattcaaaccagaaggcagagaggaatgcggattgcca

SEQ ID NO: 11654 - DNA, 201 bp, Bos taurus
tagcaatgaagccagccgttggtggcatggggatagaaggtgttggtggtgtgggtgttatgggctgattctaaaggtttaggtctgttgggtcttctgtagtgcaagctggctgggcgcccatctccttgtcagcccctggcttcatccccactgctgcctctacctccacatccgcctgtgctcggccctgaggtgtct

SEQ ID NO: 11655 - DNA, 201 bp, Bos taurus
ttagcatctattgtttcatttaacatgtgcaaattctcttcagtgggtgtatctgctccattttagaggaatgggaactgaggttcgaggccatttgcctgtaagcagagaaacagcattcaaacctcagtttagttcagttcagtctctcagttgtgtctgactgtttgcaaccccatggactgcagcacgccaggcctc

SEQ ID NO: 11656 - DNA, 201 bp, Bos taurus
cacttcctgagaacccccctctctccagctgggcttcgaatgccctccaggcgctgactaacagctgggttgtcatccaggccactgagccctgccggcagtgtgactgcattttttccaagttcaactccagatgcttgctcacaagtcactaaattaacagcagattcattttgggctcattaacattacaccaagatc

SEQ ID NO: 11657 - DNA, 201 bp, Bos taurus
atccctcgacagaggccagaatagcatcaaccagaatgatttctactctcttctctctatgtgaccattagacatgtgttcctctggaggcagcccagagtggccttgattaatgcccacaggttactgcagactgcttctcttcctactggcgcttggttcttgagacactgatcatgggcagacagcataatgcggatg

SEQ ID NO: 11658 - DNA, 201 bp, Bos taurus
attccagcctcattggaccatctttgcctcatacttgctgaaggggaagagaaaaagattctcgtaaggtcagaagcaaaggaatggaaattgaaattcaaattagtggatctcttctagaagcttggtctcagaagatgcaaagatccagataacataatcagactgtataattcaggttatcatcctctgcagtcctcc

SEQ ID NO: 11659 - DNA, 201 bp, Bos taurus
tcgaataaaaggacacaaacagcatggttctggccaaatggaatgctgggggcttgtgtcaggaagggtggtgagctgacggaccagtctagaagccagattgctgagttcctgggagtgtggcctcaatgtctaggcctaaggatttcccaagggatactgttaaaatgcagattctgtattactaggtgaggatgcggc

SEQ ID NO: 11660 - DNA, 201 bp, Bos taurus
gaggctggtatgaggagacaaaatgtgtacatgattcctcacctcaagggcagctagaaaaaggcataggaatttattagatgaaggcccaggtgggaaacaccaagctgactctaccttccctggaaatcacatatcctgaagatgcagtctggttaggaagaaagaatattgggcttgaggcctgaatatctgagtttg

SEQ ID NO: 11661 - DNA, 201 bp, Bos taurus
ttttaagatcttgccattctctaggagtgtgtacggaggacacccctaatgttaattagagcttgcttcattaacaacttaaccaaaaggccacactttgcgaaattatttgggagcctacaaggaatgagagttgatgaaaagaaattaccatgagtatctttcccatcagttaatgaagaatatgatgtataaatcatt

SEQ ID NO: 11662 - DNA, 201 bp, Bos taurus
caaaagacaaatcacaaaaaaaggaaagaaaaatctgaacagctggtaaatataggaagtcatacttgacctccttattgatgaaacaatgcaaaatgaaacaaaaaagctactttatgtctattatattataaatatttgaaaataacaataattattaaagcacctactatgtgttaggccccattctgatcaaaactc

SEQ ID NO: 11663 - DNA, 201 bp, Bos taurus
acctctgcactggccacgccggcttcattggtctcatgacaaccactgtggcgatggcgaaccatgtacagctgattccagttctggaaacctcactctcgatgggggccattctctgctccgccagctgatgcaactgcctccttacaggccaactttgtagccattacaagagtattagttatctatgcttatattcct

SEQ ID NO: 11664 - DNA, 201 bp, Bos taurus
tggaagaggggggccccagccacacgcttgcctctgggtccccgcaagagagagacaaatcctccaagaccagcctaaggctggactgaccttaaacctcgtggaggcacctgggcctgtgggccttttaagtccagtgacattaaacgagggtttgtcctgagctgatggggagagcctggtgggtgggtatgtccctgc

SEQ ID NO: 11665 - DNA, 201 bp, Bos taurus
ccacctctcctttcaaggccccttcccctagaccttgcagggaggaaaggacggggcctctacatacctcagacggccctacgtccctgcccctcgcccttgcgctggtcttagcgctttctgagtctcctccctctctgcgtcagtggcatcgctggctttttaccgttctgtaacagtaaatggacaaaacctgctcct

SEQ ID NO: 11666 - DNA, 201 bp, Bos taurus
agagcgaggctgacagacttctcagtgctcaaagcttccggaaggaaggagaaagaaagctggtggcagagcctcggcccttggcctggagccctgaagtgccggaccttgaaccctgcctgcctcgcggacgggcatgggggtctgtctaaggttgcaggggcccagcttccagggccagggagagagtgagagacctcc

SEQ ID NO: 11667 - DNA, 201 bp, Bos taurus
cttcttgtgtcaggaattgaaaatgattcaatctaatgtgtgtagctcttgcccttgctgccagaaaccttagagctagcttctggcacctgtgccagtcggtccaacgtaactgcttacttgtctacgcttcttgcatccttcagctgtgctctgcagggctttactatgaattatcttattttggactgtgtttcaatc

SEQ ID NO: 11668 - DNA, 201 bp, Bos taurus
gaaatttcagaagctatgtagaacaatttaaagaaggacatgaataaataagtgtagatggaaaaaaagctcagccactgaacctggatgacttagtcctgaagtcatggttggagaagtgggcttggaatctggaatggaaaattagattcaattctccagccttatccatacaaaattatggatttaaatctggtattt

SEQ ID NO: 11669 - DNA, 201 bp, Bos taurus
caccgcctcttcgtgaacacactgtcactgccctacttaggaaggatgggaaggaatcaagggcaggcgcagtcgtcgttggcccttttccagaacgctgtactaaataaaaagaatcaagcgcctccatctgaaaacagtctggatccctgtggggcagacacagctcaggactccactttggacctggggccctccaga

SEQ ID NO: 11670 - DNA, 201 bp, Bos taurus
tcccagcttaaagaatataaagaacataactgaggaacactcagatggaagagatgcacagggtgaggtgtgtagaaggcgaggaacttccaggcccctcgtagtagccactcttccagcacatccacatgttcaccaaccaggaatctctcagaatcccatcctttttttcttatggaggttttatggcaggggcaattg

SEQ ID NO: 11671 - DNA, 201 bp, Bos taurus
actccttccccatctccttggcttttggatcatcaactggcccccttactcctggggatgaaaactcccagggttagctgctaaacccctttgagtctggtagacccctggtcactggccctccgtgatgacccactgagaggaactctctcccatccccaggaaggtgtaaactgtatgcgctcatggtctccaatcatg

SEQ ID NO: 11672 - DNA, 201 bp, Bos taurus
ctgcaaggtggtgcccggagccaagaacacagacaagaaaagcaagacaaaaaaggggttggaagaggaagaaaggaattaaaaaatatgaaaaataacagtgatggccagtagttgaatacttgcgccaggcactcccagagtcttgtaatttaggttactgatgtagtcagcaccagaagtctatcagaagtgcaccat

SEQ ID NO: 11673 - DNA, 201 bp, Bos taurus
tgaacattaatcatctctttatttatatgtatatatatggcattctcacaggatattcaaaactgggaacttctgtaagtttgcatttagtaggacctaaataaaagcaataaattcaggaaccagaatgactcactatcataaaccttaatcagtaatatttaaatatccatgcaaaataatttcttgaacaatatactc

SEQ ID NO: 11674 - DNA, 201 bp, Bos taurus
taagtaatttctctcaatgatgatagtgctactcgattttggcataagagaataattccttttgttactatgttttaattacagccaacacttatggagtggttatttatatatcaagcaatgttatgagcatccgatgtgtcttaactcaatctttaaaaagccctgtgctgcaggtctggtattcccatctctttcaga

SEQ ID NO: 11675 - DNA, 201 bp, Bos taurus
ggccttctctgatgttgagctgtcttgatgaccacaggtgtgccatgagcagtacctcatttaatcctaatatcagtaggaaggttactgacacttgacagatgcaaaaactaaggcccaaacggttaaatgatttactcagactcatcactggttttccttcaaaacactgtcttgggtttcagtgtcctaatttataaa

SEQ ID NO: 11676 - DNA, 201 bp, Bos taurus
cagcaattttttggaatctgaattggaaccaattgattcttgaatgtacgggagaacctgcctgtctgatacagtaaatgctggttaaatttaattcttatgtgtgggtactgtgtgtgttcagtcatgtccgactctctgtgaccccacggactgcagtctgccaggctcctacatccatgggattttccaggcaagaat

SEQ ID NO: 11677 - DNA, 201 bp, Bos taurus
gatatttatttcctatagagtacaactgtgaaataagtacgtatggaagccacgtgagagagacaagagctggggcctgtgaaatcagagaaatctgacagcaaaggttgctcacagtgaactgagtcacagtataaaggaaactggaccctccctttgtggccacaagtctaagggcaacgctgtcaccgttaacagtga

SEQ ID NO: 11678 - DNA, 201 bp, Bos taurus
gaatgacatctacaacttactcataaatgggtcagcataacaatagagacatggagaatgtatgtgtgtgtgtgtgtgtgtgtgtacacattgagagagcaaggtggggacagacagaagcagcttaacaactgtgaatcttgggcacgtgtagacaagagttcacagtactattcctgaaacttacctgcaaacctaatt

SEQ ID NO: 11679 - DNA, 201 bp, Bos taurus
ccactcagttcggagatgccctgaccgcgggctggaacctgcccgccagactccccagacgccggacagtgaactggccgcagcacgttcactgattctgctggatgtttcttggcttggggaccgcagcgatgggcaggcgatccggctcgctctaggccggggcgagaacagtggttaaaaaagaattagctcgcctct

SEQ ID NO: 11680 - DNA, 201 bp, Bos taurus
acgcgcgtggcagtgcagagaacagcgtggtttagattcagccccgagctgaaatggcacgtctgaggacacctgattacagtcatccgtctcgggcctctgggctgctgactctccctggctgtgcatggaaagtcagaggtacttgcgccaggtgtctttccagaccagaaagagctcaggcgtggcctcagcagcgct

SEQ ID NO: 11681 - DNA, 201 bp, Bos taurus
taacatttcacctctgtgctaatatttattcatctaagaatgtgcatcagccagatcatgaaactcctgttgtgattttctcgagcagacatccttctttatttctcccacaggtcagggtatggatctttcttcttctgctgtctgcaaaattccctccccgtaggcacttcacaccagcactgtaggaagattggcaca

SEQ ID NO: 11682 - DNA, 201 bp, Bos taurus
acactgagtagggggatgggggggtggaatgaattgagagattgggattgacacagatactttgtataaaatagataactaatgagaacttcccctgataaaacagggaactcttctcaatgctctgtggtgacctaaatgggaaggaaatccaaaaaagaagggatctatgcttacatgcagctgattcactctgctgta

SEQ ID NO: 11683 - DNA, 201 bp, Bos taurus
ggctactcgctccagtgttctggcctgaaaaatcccatggacagaggagcctggcgggctgcagcccatggggtcacacggacacgactgagtgagcgcacagacaaggaaggccacttggcgagctgatggagattctgggagcactccccgagtcctttctggaggaaaatggcatcacggatctgcagttttgggtgt

SEQ ID NO: 11684 - DNA, 201 bp, Bos taurus
taaatgtgcgctttcattgaaaatcacttcgggttagacaaagcccattcttccgcacttgaaaagcttaccggtttctgcaattcatttgtgtgagagatagagattttccacggaccccagaggaacccggtggagacaatccctgtgcgggtttcagccgcacagcgcggcccgggagatgcaggagtccctccggcc

SEQ ID NO: 11685 - DNA, 201 bp, Bos taurus
acttcagcttttttaaaggactcatggttaggtcatgctcacccagaacagtctcgggatcttccagcgggaaagtccctgctgacttgaggctggagttcgctctgcagtttctttgccgtggtgcctacattagtggttgatgagataaccaagacctggaaaccttggcaccatctggaaattctcctcaccacccat

SEQ ID NO: 11686 - DNA, 201 bp, Bos taurus
gcagggcttccagggtgcacggggggaggggggctacaaacagcacagccaggtctgacagccatgctgagatcggtcatcggtgtctggccagcattatctggactgttttaagtacagtcagtcttcagttccgggtcagtgtgttcccatttctttggggccagttttcagaatcgtggctacagtgtggtcatcacg

SEQ ID NO: 11687 - DNA, 201 bp, Bos taurus
gtcccctagacacagtctataccccccgacgctgcatttacctggcttgatgtaaaacagggtgaagggagcagctaacgtccccgtggaggccccacgcgttgggatgctctagaatctaaattcggagtcatagaagctaaacatcctcccaaattttaacacagaaaccttagaataggttttgactcatcacagatc

SEQ ID NO: 11688 - DNA, 201 bp, Bos taurus
tcctccggtgaacagagcatggtgagcactgtgtgaacagggcctccattagctctctcagaaagcactctgcacgtcgcacggctacatttggcactggctcaccgtgtgcagtgatggccatgaggaggaagacagtacctgctacctctaagtggttcaggttgcgacaagttactcctttgtgtacggttccaaagt

SEQ ID NO: 11689 - DNA, 201 bp, Bos taurus
agaacttgacaggggaacggggtttgatttcttgagaacccaatcatctaatgtatcgcttgaaacagaaaaagccttgtcttctgcatgaaaacgaaatgtcactaacatgtatctgcccatgtttcatgctattattaccaacgccccgttttctttttaaatggtgactcagagctgtgtgtgtagtagggcctgctc

SEQ ID NO: 11690 - DNA, 201 bp, Bos taurus
ctggatccttttccaacattgagggcccttgtggagtttcctgaatgtatcccccactgtagcccaatcacacggagtaaaggaaacttccattcagaccgcctggccttgggggatctgtttggaggctggaggtcatcacttagcatgttcacctgagctctggaatatatggatatatgccaccgcccaaagcaaagg

SEQ ID NO: 11691 - DNA, 201 bp, Bos taurus
tcactccctttgtggcccccgtcacgtgtgccttgttctatttggtggtgtcctcaacgtccctctgagtgagtgtgcactcagtggcttcggtggtgtccgattctgtgcggccccatggaccatggcccaccacgcgcctctctccatggggttctccaggcaagaatactggagtgggttgccatgtcccctccaggg

SEQ ID NO: 11692 - DNA, 201 bp, Bos taurus
tgggggacctaagatcccacctctgtgaggcaactaaacccacgtgctgcagctcctgcgtgtgccgtccagcccaagcaccccagctagagaaggccacccccacgaggaaagatcctgcacgccacaactaagagctggcgtagccaaataaaaatagttaaaagtatctggcctcttgagttcatgtgttacaaactt

SEQ ID NO: 11693 - DNA, 201 bp, Bos taurus
aaaaatgcacacaagaaacgggaagagattaaaaatcttaaccttgttcattaggatagcagggaaatttattagcttcactgtcaacatatacatacatgtgtcacaagtaataaaatttaaggatgagcactttggtagattgattggatggcagactgactgatggcctctaacttttcacacctccctaaatgcata

SEQ ID NO: 11694 - DNA, 201 bp, Bos taurus
ctgctctcctgcatggtaggtggattcttcaccactgagccaacaatgcaaggcctcatgtccactctattcttctaggtggtttgagaagcagaggaggttgagcagtgctaagtattgagggccgagagcaccagaagcccttatttgggttcatttttgttcatagcaggacacaggatgagccatggtggcagcggg

SEQ ID NO: 11695 - DNA, 201 bp, Bos taurus
tctactaaatacacctgggcttgagtcccaatttcatttaatggcattgtattcatttatccagccttctaagaaattactctgagtcattcttgacctcacgtcctccaggcatcaatcctatgaatccgtacttctgaataaatatctccggaatgtatcttctgttcatccccactgactacatcactgagactgttt

SEQ ID NO: 11696 - DNA, 201 bp, Bos taurus
tgttaatcttactggaggtgcacaaattctatttattaggctgttaatctttgcctaacaggaccaggatcaatccctcaggttgctcataaaatccgcacggggaagacagtagactttgaaaactgtacacaaatgttgagagagggcagcgacgcacacggaatctgaaagaccaccatctcgtctgcagtatcaaag

SEQ ID NO: 11697 - DNA, 201 bp, Bos taurus
cagagaactgactatattggtcaagcaaaactgaaccactttcagcaagttttgaagggaaattcccaactgagcgttttcaggccaaagtctgtttgtcctgaatgatacgggcttctgtggcttgtgagggctgtattggactgctcacagaagggtcccacttcctacttctcggcctggagtctgagcagtaacacc

SEQ ID NO: 11698 - DNA, 201 bp, Bos taurus
ggggtccaaccaggaaactcgggcctcagcatgattcagttctctgtgctcaaagtgacaactgtaagtcgcagcgttctgagtatggagataaagagggcggtggggccagccatggttatcatctgttctgatagtcatagttagagcctgctccagacacaaggccgacacagatgtagcaatgttgggcatgaaaaa

SEQ ID NO: 11699 - DNA, 201 bp, Bos taurus
ggagttgggtcatggcccactctgacttcagcccgtcccccgttcccagaaagatctgttaggacccaacagatcatgtccatatatttagctctttacataaggaaatatatagagatttaaaggtatatcattttacccccaaaactatgtaataaaaaccacagagagcaaaaacccactggactgtagttgtgacat

SEQ ID NO: 11700 - DNA, 201 bp, Bos taurus
ttagcatacacaccctcaattttcaggagagctgcatgttccctctggttccttggatccagcttataacaggcaaacttggcccacaccttccagacacatttgtcgtggtaggggtcccgttcccggtggggggccctccagctggtccagcttcgagccacattgcccctttgccgaggcacacagctgagcctgcgt

SEQ ID NO: 11701 - DNA, 201 bp, Bos taurus
ctagggagactctcggggctgagccccttgacctacttgcggggagaagtagatgctcactaaatatttcctgaccacataaatgtttgggcaaagtggaatcaaacacgcacgggaaaaactgaggatcaggaagcagagagaccagtctactcgagcaatgcctgctccttcttggggtcagggaggacaaatgtttgc

SEQ ID NO: 11702 - DNA, 201 bp, Bos taurus
atcccagtaagctataagtaattgtgtttatttgagttttgttgttgtttgtaacttatttttagcatacgtgctagcaaagcaagcgccgagactaaattttgaagactgagctggaaagacgagcttatcttccgttatgattttgtcatggcacccaccaccgacctcttggcgcttccgcaagttaggagtcttccc

SEQ ID NO: 11703 - DNA, 201 bp, Bos taurus
gagggcgtcgtggtggtgaggctggggggcagggaggtgacggcagaggggagaacccgtggctgaggccaaggtgtggcaggggccagactgggggcgacctcagacacgctgaccctgatctggctccatgaacaagggcaccctccttgccctctctgggcctgccacttcacttccaaatcaccaggctgtggatag

SEQ ID NO: 11704 - DNA, 201 bp, Bos taurus
taacactaggaggtaaggatcaccagcagagttctgaccatattcacaccagcaaatgtggacaagatgctttcacacaggtgtgtgtcagaacacaagagcttaaaaattggagggatgtcacagaagaagtgatagatgacattggaactgcagaatgacaagctgttcacataacctgtgtgaaccacagagttgaac

SEQ ID NO: 11705 - DNA, 201 bp, Bos taurus
actcacgtcctccatgacgccggccgccggaggccgcagccgggccgcccagcctccgcacctgcgcccgctcctccttccgggacacgccctgggacccaccctttgctttcaattggccgaagcgtagaggcgggcccctcctcctcgctccagggccctgcttccggcggccgtcccagacccgcccctcgccctcga

SEQ ID NO: 11706 - DNA, 201 bp, Bos taurus
gaggctgaataaaggctgtgtctataatgaaagaaatggaggacaaaaaggccttgtgaccaggagccccacaggaccctgcatagtatcaaaacctgatgaatgtagaactaaacctttttgccaaggtgtcccctagtgctcaacattatttttagactgtcttgtttttgactgagttttctttcaccagtgattatg

SEQ ID NO: 11707 - DNA, 201 bp, Bos taurus
gactggccggctacagtccatgggattacaaagagacatgacttggcgactaagcagttacagcacgcactagctctcttctgataggctgtggaacttggtcagatcttttggcctctctaggattaagtttcttcatcagacaaattcagttcagttcagttcagtcgctcagtcgtgtccgactttttgcgaccccgt

SEQ ID NO: 11708 - DNA, 201 bp, Bos taurus
cagtaacccagaccccagttttctaaatgggcaagcaaatgattttaaaagggaaacatacagtggttattatgaaatgttagtcgtccttttttgcctgccccctggcctctctctgtcctccctccctctttttctcatctctttgtataacgtatgtaaaattattaactgatcttagtataatcatttgggaagcaa

SEQ ID NO: 11709 - DNA, 201 bp, Bos taurus
ggggcctggaaactagtcctgccactagaattggtcatgaatttatgacattgaatgtaacaataagggaaggagggaggaacccagttgtctagaaagtatttttggcctatttaggagccctttatcagcacattggcgcgcgggagcagtggggccatgctgcgggcctgggccatggctgccgccgatgctgaggtg

SEQ ID NO: 11710 - DNA, 201 bp, Bos taurus
gaccacttctagtttatcttgattcatggacctaacattccaggttcctatgcaatattgttcttacagcatcaatctccagctatatctacacctgggcgttgtttttgctttagctccatctcttcattctttctggaatcatttctccactcttctccattagcatattaggcacctaccaacctggggagttcttct

SEQ ID NO: 11711 - DNA, 201 bp, Bos taurus
ggaggcctggcgtgctgctatttatggggtcacaaagagttagacacaactgagtgactgatctgatcagatctgattgaggaaacaaattcagaaagtggaatattctgtagaacaatcggcctggattcatcaaaagattcagtgtcataaaggtctgtgggagacaatggaagatgaaatgtacacatggcattcaaa

SEQ ID NO: 11712 - DNA, 201 bp, Bos taurus
cctggaccccaggagtggtcacaggccctacatactgcctcctgtgtcccagaaatggtaaaatcaggagtggtcatgattccccaccaactcacctttgaactctgggactgatcattggccctagtcaacacctatccaaactccagaagtgcttgttagctgtctctactcccaccgtgtgccctggagttgcagttg

SEQ ID NO: 11713 - DNA, 201 bp, Bos taurus
taggaaacattttcatgaatatttggaaatcagacttatttacattaatgggccatttgatcctagtttctagtgtgttgtcttttatgagacttttccaaatagtaggagggagtcatggaaggttttatgtaatctccaaaatcatatagtgaaatctctgacaaatgaattgagcatatctatggggaaaaatacaaa

SEQ ID NO: 11714 - DNA, 201 bp, Bos taurus
atggacagggaggcctggtctgctgcgattcatggggtcgcaaagaatcggacatgactgagcaacagaactgactgaaacaactgattctaagaagtcattgactaacaagctgagcaaggccagaagtcctaagtccttgaggagcagtgtccaccatggggccctaggaatggggacttcaagggcaagtgacagaat

SEQ ID NO: 11715 - DNA, 201 bp, Bos taurus
gtcagactgtttgccactccatggcccatagcctctctgtccataggatttcccaggtaagaatacaagagtgggttaagtagatgactttccattaaattcactgtaacttttttaaaaggccatagattagacacacagaggcctaaggtttatggaaaaaaaaaaaatctgtatctatgcagtccaatatgataatta

SEQ ID NO: 11716 - DNA, 201 bp, Bos taurus
cgttcttcgtctcgcctccaagcttcctaagaagccaggtctctgaaagcagccaggggcaggccgggtagaggggccagccgctgggttctcgggttgctggctgccctccgcaggaatgccaggtgaatacagaaggcgggacttgcgggtcgcggagaactggggccggagccgcgctcggctgtgcactggcgtggc

SEQ ID NO: 11717 - DNA, 201 bp, Bos taurus
gtggcctcaacatcctctgcttggcttccatcacttgtgtaaccaatttttggcattaaattacttctctttgcattcttgaataggttctcttttgcacgatatgctgaactgtccatgcatatgtgctttcattaattttctctgccactacaggtgctacatgcacaggttgatggcactaacatacagaagaaaatc

SEQ ID NO: 11718 - DNA, 201 bp, Bos taurus
atcagatcagattcagaagtactataaaaagtactaccccatttaaggaacaaacatagaaatatgacctagcattggacgctctgtaagaattggcagtgtctggatgaattactcaagagcagcactaagtgattacagataatagagaacaccttaataaattttgtcatcatgcccctaaatcagatacagctgaag

SEQ ID NO: 11719 - DNA, 201 bp, Bos taurus
aaacattgtaacattctcatccattacaattgttcccattacaattgttcccattttgcttctgattcttgagcaccctcacttgatctctaattattcacggatcataccatctcctttgcaatgagcttggtcctaccaccagacttggtctacagaggacagccaccactaagtttctaaacattatatctcaacatt

SEQ ID NO: 11720 - DNA, 201 bp, Bos taurus
gatcaagcccaagaccaattatgtagactgttccaccaggtccagttgtataagctgtgcttcacacaaccctaaggttgcaaatcacctctgaaattatgtagaacagacctattcacctggatgtggtgatcctgagcaggcaccttggcctcaaagaaacaatttcagttgagaggcaagaggtgttgttggggagct

SEQ ID NO: 11721 - DNA, 201 bp, Bos taurus
ggaaacacctaggcattgtcgctgtgtgattcatagtaatgagaaaatctttaggaatttaaccacgccataaggaaaatgtttaagatggagcttgttgctcattcttgattaaactttcattttctaatgtattttcagaactttctgaacacaataatacttgattacagctgtatcttctttaaagaaatccaaaca

SEQ ID NO: 11722 - DNA, 201 bp, Bos taurus
attttaaaactgaatgtcattttatcctccaaacctgttccttcctgttttaccttacctccatcaattcatctggccaactgataatgacaccacaaggattatttattactccttctccaaactgtcacaaccagaaactcaggaacttaatcctgaggccttcctctgactcagctgatcagccacaaaaacctacat

SEQ ID NO: 11723 - DNA, 201 bp, Bos taurus
cagtgaaatacagcaagacacctggtgtagtcagcaggatcagtgagacatacggtctattgctcttcagtttctgtttcagtgaccattcaatgttgtagtaaagtacatactctaagaatacaatggtttcttaaatattcagcgttaaatgaagttaatctgtgtgtagatttatgcctcagagaaggcaatggcacc

SEQ ID NO: 11724 - DNA, 201 bp, Bos taurus
attgctaagtttacaacatacacagaagtaaaatgtatgaagagtacaaaaaaatagaagaggcgaaataaaagtatatgattgtaaaattcttatactacatgtaacatcacttgaaagtagattgctacagtaaagatgcatagaagaacattggagccaacaccaaaataacaactttatactgatataataaaattt

SEQ ID NO: 11725 - DNA, 201 bp, Bos taurus
cttcctcccgttgcctccccactgttcatcttttcactgtgtgtgcttagttgctcagtagtgtctgactctctggctctttgcaaagctatggattgtagactgccaagcttctctgtccatggggattctccaggccagaatactagagtgggtagcctttcccttctccaggggatcttcccaagccaggggtcgaac

SEQ ID NO: 11726 - DNA, 201 bp, Bos taurus
gtaacaaactgtccagtgaaatgtgagaggaacctcacttaggggctgaggaagctaaaaaccagagtgtgtcttccactgtctcctcccctgtcagagtggctttgggggcctcctcagaacacgtcctctgaaccaaagaagggctgctcctttctttcattgtctctgtcctctactgtcttattttggaatgtcttt

SEQ ID NO: 11727 - DNA, 201 bp, Bos taurus
aacacaaaaaaggtattgaggaagttaataactttaaactcatcttccaaaatcatatttaaagaaaattctgccatctgtggagcattatgataccgtccttatgattttatattatttcattttatgcatgacatgtgtacagtgtgctcagtcgttttagtcatgtctgactctttacgaccctgtggatagtagcct

SEQ ID NO: 11728 - DNA, 201 bp, Bos taurus
tcggggtgtgctagcagtcactgccatgttgaggggcggggccaggtttggagaggctggagccacaatcctgagtgaggttatcatatccttggtgctacagagtttctgtcttggccaggggtagcgatgggacccacgaggctggaagaggagccttgagccagccctggcctttcccaaggtgcactggtgattctg

SEQ ID NO: 11729 - DNA, 201 bp, Bos taurus
ggttctctgttacttccataaacaaaataaataaaagagtcaggtcctggctctgttcatgaaaatagctgtgttctttaagcacagggcctgtctcccctttttttttccccctcaggtcaccatttcagaactggtgcctctggggcaccccgtgctgaccattgtggccacagacgtggaaagcagtgagaacattac

SEQ ID NO: 11730 - DNA, 201 bp, Bos taurus
atgcaagccctcacaaactctgtagccaaattttgaataaaatcaattctatatttctgcatgatatgtgatatgtctctactctgaagtgaaagtgttggtcactcagtcttgtctgactctttacagccccatggactgtagcacaccagctcctctatgcacgggattctccaggcaagaatactggagccattcctt

SEQ ID NO: 11731 - DNA, 201 bp, Bos taurus
ggaataataatagcatctatttcacaaagcccttgtggggattcagtaagtcagaacatctcaagtgcttcctacagggcctagaacagcattggcactcgatgaattgtggtcattattgttgaaaattttcagctgccaaataaatggacaacatgtaactaattgccttataagatggccatcaagtgcttactttac

SEQ ID NO: 11732 - DNA, 201 bp, Bos taurus
agccaagatggacgccattcagcgcgccccgcctctacccccactcctaacctgcctccccatcgccagggggcctgacaaacccagcttcttgctccagaaatcaaagcagaattcctaactgtgatctgagaaggctgggtggaggcgagtaagaaaaactaggtaaaaaatcaacagttttgttcccttgccttcata

SEQ ID NO: 11733 - DNA, 201 bp, Bos taurus
agaactcggacggcatgtgctcgcctggcctgaggtcacttcagagccttttttcttcactaggtccacactctccaaggggactaccttgctctctgtgcaccaggacaggctccacagtgaacaccgacccacgacacatcctgggacgtgctgggtcacagccaccatcagcatctgtattttacaggcttataaacg

SEQ ID NO: 11734 - DNA, 201 bp, Bos taurus
tggcctggtgtaatcagtctgcccacagtggctggtgagcccgggtggggaggatgccacattcaaggctgggtgtttgtctttgctcctggcaggctggggaatcagctgtgctctggccccatccccttgttgcattggatccacttgctaagaccaagcataacctccagccccagtgcttcagccgccttatccacg

SEQ ID NO: 11735 - DNA, 201 bp, Bos taurus
ttctggggctccagccaagtggatgattgttaaccaagcgatttttaaaccgtaaaaagtgggtacccgtgcagacccatgagataaataagtttaggtgaaccaatcctgcccacctcccccctgctttgtagtaactggccataggtgtcaccacactgtatccacactctgatcttttctgatcagttcccacataga

SEQ ID NO: 11736 - DNA, 201 bp, Bos taurus
aacatctataggactttccatcaagcaatagcagaatacatatttttctcaaattattctgtaagtggcccaaagatggctagtgtatattggcccttacattatttactttttcacaagaggttggcaccatcaactcaatgccaaactcaaattcttacatatccaattactttaaatatatctaaagtaagtgtgtat

SEQ ID NO: 11737 - DNA, 201 bp, Bos taurus
ttctccagcctccaggcctttgcatcaccctgatcacaatacaaagcagcctgcgggtgtgggcagccaccacaagaaacttgtgaagaaggaagattcttgggccccagcccagacccaccagaaacgggggtccagccctgccacagagttttaacaacccctccagggctctgaggcaccaaggctggagcgctgacg

SEQ ID NO: 11738 - DNA, 201 bp, Bos taurus
agctgctcactgccccgggtgcagcagaatcagctgggggactcgtcaaatgagatgcccaggtcccacccccagagttttttcactcaatgtaggccaaataacttgcacgttgaacgagttcccaagtggtacagacgttactggtccagggatggcactctgagaaccagcgatgcaggcctgagaatgggctgggtg

SEQ ID NO: 11739 - DNA, 201 bp, Bos taurus
aggtaaatcaacctcagccccatgataactggcctcaagacactaatatgagtcagaaaggatttcataccttcccctttcttctttaaggaagagtcccccataacaccctggccacctggggaagtgtagatgcctgcctgcaaacacaccgcagccgagcaggctacaggctgtcatctgctcgctgaggggcccggg

SEQ ID NO: 11740 - DNA, 201 bp, Bos taurus
cactcccccatctcccgccaccaaaggacagccccaagataaggctgaaagtgctcacaggaaaagcccttgctgtcagcacatgcaaactgaactttctctaggcctcccaagcccttaacagaatgcaggtcagattagcgcagtctctggcctaaaacctttcagtacagtccactggtttggggacttacagcaaat

SEQ ID NO: 11741 - DNA, 201 bp, Bos taurus
tcacctaagaacatcagatgatgctgagtcagacaatggtcttgtctgagtcgttcaccgctctctgtgtttggaggacggggctcaccaggtccacctccggggccgatcggtccagcggggatgtgggtccagtaggctacaccttcaggggcactggcaggcggccccagcgaggggttctatgtggaagacattcag

SEQ ID NO: 11742 - DNA, 201 bp, Bos taurus
ttacacctgctctttgcaatattctattctctccatgttatcattaaaaaaaaaaaaagactcagcaagttaagtaattcacctaagttttagacatccaggaagcagataggatttggggaacttaggaatgtctattccaagactggcttctttcccctattctaacctgcctctattcataaggcaataagcatttta

SEQ ID NO: 11743 - DNA, 201 bp, Bos taurus
aacacaagtgtgatttcagaattactaggagaaaattcttggaagaaaaagataacttacccttattaatttgaaaacgactctagaaagaaatagggagcgacactttctgcctcttacttatctgcattttctattgtttctacagtcagaatgtatcacctgaggaaaacttaagtgtggtattttatatatgaattg

SEQ ID NO: 11744 - DNA, 201 bp, Bos taurus
gaggtcgccctgaagctgaggactgaagaatgaacagaaggtacacaagcccagtagaggcgcagtgtcccaagcagaaggagcagcaagtgcaaggcctcgaagcagaaaaggggttgcatatttagttagagaaaggacttcagtgaggctgacagcaggagaacaagtggataacataggaaaggggaagaggccagg

SEQ ID NO: 11745 - DNA, 201 bp, Bos taurus
agcctatagacagaggagctaattacctcatgggaaactagggatcaagcctggacatgacagacattacttcagtccatgttctgctggccagactaatcacgtggctccagcctaactgcaagggaggctgggaaacagttctttgtgaccaggaagaggaagaaggcacgtgggcctcttgcatctacttgaaaggtt

SEQ ID NO: 11746 - DNA, 201 bp, Bos taurus
ttctcaaacctaagcctaatacattctcctttgctcaagtaaacgaagtgtttcctctgggatgaggctcccaagactctccctcagcccaggcctcagggttgtcctgtcttgagccccttccccaaacgtttgccctcagggctttcacaagtgggctgccggctgcagagctgaactgggtggcctctgtgagactgg

SEQ ID NO: 11747 - DNA, 201 bp, Bos taurus
ttcctcattttattcctcttttttccccagatggaggccttcatcctggattccggagatgcaccacgacgccaaatgcacagccgggagagagactgtattccctgggccagcttccttacttctgccttctctctgttttgttctggtccttgactcattttccccagaagccccacagttatctgtctcggttctgct

SEQ ID NO: 11748 - DNA, 201 bp, Bos taurus
gatgacatggaatctagtcttaactgtgactaaccagccatgtgaacttggttgaacaaagtaccttcacgacacacttcctgtttcttcttcagagcctggaagccgcagtggccctacacttaccttacagagtcttttaggtgatcaaatgtgtttaagcatggttgtgctttgaaaaatgtaaatttctattagagc

SEQ ID NO: 11749 - DNA, 201 bp, Bos taurus
atcttgtagattgagggtgagaacatgttttttcccaaggagaggaggatgagctgaggcccttgtcttgcaggttgaccttggcctcctgtgatagagtgttgtgtctggattgtccgccgttcagggagcacctgggtggctcacgttgctctgagctacttttaggcctttggtcccttatcgctggatgttcacgtt

SEQ ID NO: 11750 - DNA, 201 bp, Bos taurus
gaacttctggatgggagcttgtgccctgaggcaggggaaggcgtcctgaaacaagaggcattcctgtgcacaggggagcttccttgcaggcgggcccaacggggagctgtggagtcttggaaaactgggcagagtagggaattaaagggcagaaaacagagcaagttgcacttctcagcccgtgaacagcttgcaaactat

SEQ ID NO: 11751 - DNA, 201 bp, Bos taurus
cagataaaagtgaatgggaagtacagagaccagaagagaaacaggacatggcttgatctagaagctgaaagaaatctgattcgttgtagcccaggagaaggacatggccacccactccagtatccttgccgggagaatctacggacagagaatcctagcagtccatggggtcacacggagttgcacactactgaagtgact

SEQ ID NO: 11752 - DNA, 201 bp, Bos taurus
cggcgctggcagctgctgtcggctgcgctgagacgcgatggcagggtgcttagccagcactcccagtaagagggtctgtcaggagcccagtaagcagatgcagggctgagctaatgagctaagtggaaacagcacactcttttctcagaggctgcagacagagagatgactgttagtccccagaatggtactccgcaggga

SEQ ID NO: 11753 - DNA, 201 bp, Bos taurus
atgttggcaggagaccattgccctgaaagcagcggccaccctggagacagacatgctctcctcctttgccagactcaggtgaaggcagaggatgcagaaatgagccctggccactcctcgctggagaatggaggccccaggagaaggggctttcccaggacttgacggtgtccaggggcagggtgcagcagtgcggagaag

SEQ ID NO: 11754 - DNA, 201 bp, Bos taurus
ctggctgcctgctccaggaccacaaagctagccgccataaacccgctgaatagcttagctgctgactgacaacttttctcctacccaatgaatgcaattcaaagttctgtggcctaaaatcaaaacacaacccagagctcaagacccaaagtcagacaaacctggttttgactctggtgtgtcccatggactgcaaggaga

SEQ ID NO: 11755 - DNA, 201 bp, Bos taurus
cagactggatggtaatgatgtggataacaactgcttgtcattaagaaacaggcagtcttcaaatgtggcttctcctctggccagtctaagcagctggttagatgggtagagaatattgaattctgtctgctaatttacttagaattactattgaataaaccattcagattaaatagaaaatccaggccaggcatgggaggt

SEQ ID NO: 11756 - DNA, 201 bp, Bos taurus
tcagttctgtctcgtcacaacaaagatttgaagcgatgaacattaaagccctcggcgcattatagctcttggacagactgtgttttagctcttggattgcgaacagaccatgttagagctcttagatccttgttacagctcagttttatttagaaaatagcaggaaagtacatccttgaggcgtgagggaatgccaaccca

SEQ ID NO: 11757 - DNA, 201 bp, Bos taurus
gaggttattgtttagttgtctgtgtttcttatatgggctttcttggtggctcagtggtaaagaatccaccttccaatacaggagatgcaagttcattccatgggtcacgaagttctgctggagaaggagatgccatcctgctccagtgttcttgctttggaaagcccacggacagaggagcctggtgatgtacagtctatg

SEQ ID NO: 11758 - DNA, 201 bp, Bos taurus
tagaccattgctgtgagagatcctatccagtggtgacacttatgaaacaagttgcacaaaatagtacttgcagtataaacatagtatttcaataaagtacgagtagtttagtaaaggtaatttctggttaagtccatgattaatgcagaaaatatatgaatagtaattataaggcatgttgtaaagaaaagtcaaagaatt

SEQ ID NO: 11759 - DNA, 201 bp, Bos taurus
atagttaggggaatggtctgtaagcctgtttgaagcaggtgggggagcaggaatctttgttgtgactgcggtgagatttaagagtagaacattagtacaacggggttacaatggttgtagcaagagaataaagtggaaattttgaatacaataagttaagattgcacacggctgcaattcagagtgtaacaaaaataatcc

SEQ ID NO: 11760 - DNA, 201 bp, Bos taurus
ggtgtgtcatttgagggctccttggtcagtcacccggcatgccagccagttcctgcatctgcatggagcgcagccagtgtggtgcagagtttgacatgctgccttttcactcagaagcacccagagtcaccaaagccaggaaggacacggtggggacctaaccttgcatcatgcagtcagtaaacgcactgcgttaattat

SEQ ID NO: 11761 - DNA, 201 bp, Bos taurus
gcctgcagcctggcaggggaggaggaaaggggtccccaggatggagaacgggtcccccaccccaggacagagcagtgggcttccccccggctcccacctgtacccaggcctccaagggaaggatcagacgtgcaacgagctgtgagagtaagtgactgttccctcccattcggggaggaaatcagcctttccagaggggga

SEQ ID NO: 11762 - DNA, 201 bp, Bos taurus
gggtttctgtgacaggcctgtagccagctctgtggctcagagagcgtatgaaggacaccagcgcactcttttcacacccattcagcctggattctctgctgcccgtcgtttcctctgtccccttccgccatgccactttggaccaaaccctgtttgcggggaagctcttctgatgggctgcgcagtccttctccttccatt

SEQ ID NO: 11763 - DNA, 201 bp, Bos taurus
tttttagctatgtttactcatcaaagtataggtcaagaaaaggaaaacaagagagcaaatgcttcttgtctcttaaggcctgctccctggttcctgagtcatcttcagggtctgccttccaccctgtatgacatcaggagttccagcacccttcaagagggaattgatgtggacttacctggtgggccagagactaagact

SEQ ID NO: 11764 - DNA, 201 bp, Bos taurus
ggctgaagaaggtggccttcaaggatcctttagaggattagacagttggacggcattattgattcaatggatatgagcttcggcaaactccgagagacgatgagggacagggaggcctggcgtgctgcagtccattgactcgcaaagagtcagacacaactgagcaactgaaaaacagtatcttttaaaggttcaaaacgt

SEQ ID NO: 11765 - DNA, 201 bp, Bos taurus
aggtaaaaatgttttcacaatactttggaatttttataattgtcctctgtattgtttgactgtcagttaaattagaacgtgtgataattgtagggagctggtaagactttctattaaaggtatgtcattatgttaatcctggttcaaatatagtttgctcaaattttattttgattatataatattagaataaattaacct

SEQ ID NO: 11766 - DNA, 201 bp, Bos taurus
catagagtatctttctggatcccctaaaatgggtataatagtttgttcaaaactggctatattattctcctttctataaacatactcttatcatgttacacggaggtccttcctatcaggagatggattctactctcctacccattccatctgaggtggccatgtgacttgtgttggccagcaggatgtagcagaagtgac

SEQ ID NO: 11767 - DNA, 201 bp, Bos taurus
aagggcctaagaagtcttattataaagaatgtacagtagtgagctgattttaattttagttataattttccaaactgtgtatcacaccttcttcagtgatgctcacttgtcataaaatagattcattagaatttcattatccattacctaccttctgaagcctacataaattagctctaaaatagtcaaaaggcttgaagt

SEQ ID NO: 11768 - DNA, 201 bp, Bos taurus
gattctcccggcaagaatactggactgggttgccatatcctcctgcaggggatcttcccagtctagggatcaaaccagcatctcttacgcctcctatactggcagacgagttctttaccactcgctccaccctggaaagcccatgtaatggctagtgaggtatattagacagagaaattataccaggttcagataaagatg

SEQ ID NO: 11769 - DNA, 201 bp, Bos taurus
gaatataatttgctgtacaatgttgtgttcatttcttctgtacaatgaagtgaatcagctatatcctggtactcttggacctctttctcaccaccaccccctcaggtcatcacagagcatcgagttgagctcccggtgtgaaaataattgcaaatgaagcaacagacaaaggattaatctccaaaatatacaaacatctca

SEQ ID NO: 11770 - DNA, 201 bp, Bos taurus
ctgactgggcacattctagtggcccttcaaactgcttggcatagttcagtgtagacaaagggcaaccagagttggggtctggtgaatatggagacctaaaacaggggcctctcttgtgcctctaagggaaacgatagtgtccttactgcttaattttgtgtttttctttctttaccagaacaaccctctgggatgtaattg

SEQ ID NO: 11771 - DNA, 201 bp, Bos taurus
ccctgttcacggcacgtgtgccctccctggccccactgctaaggctctaggttgttccgccagggactgtcggaggttggcctgggctgcatgcatatcccgggtctaagctgatcaggttcaggcactcgggtagtcctcagaggcgcagactcggttgggcctgtgttttgtgcccttcgcaggtccgagcagctcagg

SEQ ID NO: 11772 - DNA, 201 bp, Bos taurus
ttaaacaaatatacaaatgaacttatttgcaaaagagaaacagattcacaaacataggagacaaacatatggttcccagagaggagagagggatacgttaggagtttgggaataagaaaagcccacacacgccaggcctccctgtccatcaccaactcctggagctcactcaaactcatgtccatcaagtcggtgatgcca

SEQ ID NO: 11773 - DNA, 201 bp, Bos taurus
cagtgttcttgcctggagaatcccatgggcggaggggcctggtgggctgcagtctatggggttgcagagagttggacacgactgagcaactaacagacatacaaagccgcaaatttagtatcatttgtacttactgtatttttgtttaacccatgcttccaaaagataggggatgaagcagaatacacagaccaactacac

SEQ ID NO: 11774 - DNA, 201 bp, Bos taurus
caagctctaaacagacagtcaacgaaatgtgctggcaatcaaaaagaaaaattaagatattggaaaatgactcattcttggtgagtaaaaaagaaatcctggataaactaaagaggacaaagaaaacagccgctgcccatcctaagagaggaacaagtccattacatattttacatggaaataagaaactactcatgatat

SEQ ID NO: 11775 - DNA, 201 bp, Bos taurus
tagtaatccccctaatagcatgtacattttaacaatgaactgaaaaacacatggaaggtgaaagtagagacatcaggccagcacaagccacggagtagcagtcccggacctttccaggactccagaaatcacatcaaggaagcagtgttccatctgctcgggcctaaccctataaagctgatgagtaaagcaaatagtcca

SEQ ID NO: 11776 - DNA, 201 bp, Bos taurus
tgtactctcaaggtgagaagtgcttatgaaactatcacaatgagctttggcggggagggagaggaattgttccttttaagaggtctttctctacctggccactgtgctctgcctctacccgagtcccacctgcgggtgctgacaccttggctctggggctgtgtgcagaagttctgcaaccaagacagaagtagcaggcca

SEQ ID NO: 11777 - DNA, 201 bp, Bos taurus
catccagggacttgtcatcgcaggtgtgtaaaggccagggccctcaccccaactcaggataattctggagaccaatcccagcttcacaggctttccgaggtgttgacagaggccattattaagaccccatcttggccccccaccatgcccaaaccctccctctgcccagtcctgcatccttcccttccttcccaaaagatg

SEQ ID NO: 11778 - DNA, 201 bp, Bos taurus
ttttctttgatttagagaaaggcagcccagggtaggttagatgaccctacattgtcatcagatctgaggatctttctgactttcttttcagccctccttttggtcatccagctttcaccctcatgcttgttgcctcatggtgacaaagtggctgccacacctccagggtcctcctagaaatgaagaagttgaaaggaaagg

SEQ ID NO: 11779 - DNA, 201 bp, Bos taurus
gacactgaggtttctcatttgggatcctcagagtgtatctcaatttctccttgtgatatcttgtagagatggaataaactgtcagaatccatatctaaactgctgtcaccttactatcaagaatatttaaatgaatgatagtaatacttttggacattcatttggaaatagttttagcatgtatgttgcttttttcttgac

SEQ ID NO: 11780 - DNA, 201 bp, Bos taurus
tgtatgacatgggtccactgtttatagactgacatttaaaaataggcctgcttatctgttaatggcagctgtggcaccaggcttctcacttgtgtctatgatggtctctaagtgaggcttggcccagtacacaattcaggttcacctaactttgttgttggtttctgtatatatgcaggataggttttatggatttcggta

SEQ ID NO: 11781 - DNA, 201 bp, Bos taurus
gacgttttgacagctcaggaaatttagagcactgtgctcggaacaccttccagtccagctgagaaaggagggttgttggattcctagctatttacctgttctcctcccctccattcttctcccctgaacaatataaattatcttttgccagatgaagaccttaagtagcaacctataagtctccttactaagctggacaaa

SEQ ID NO: 11782 - DNA, 201 bp, Bos taurus
ctgggccgggggtggagggtgtaggggagggaagggatgaacaggctgagcacaggatatccaggaccatgaaaacacaccgatgattatgatgaataaagcttgtaatgtgtttggccaaacccaagaaggtacagtcctgaatattcactgaaagcactgatactgaagctccaatactttggccacctgatgtgaaga

SEQ ID NO: 11783 - DNA, 201 bp, Bos taurus
gaataagaaatactctagagaaatacttaaaagtaaggaatctctattagtattaagatgtctatacgtggtgtggtagacaaattatggaaataacctaaatttctaacggatgagaaatacttaatgtagtgtaatagtctagtaacattaaaaataactatatggactatgctagtatgggaaagtgaacaaaaaaat

SEQ ID NO: 11784 - DNA, 201 bp, Bos taurus
cctatcagggattgaacctgggcccctaggagtggaggctcggagttctaaccactggacagtcggggaattctcaggtttagacattttgaaccgacttccctagtggcctggtggttaggaccgagcctccactgcagggggcgtgggttcaagccttggtcgcacgctgccctatatggccaaaacagagaaaagcac

SEQ ID NO: 11785 - DNA, 201 bp, Bos taurus
cagtacctgtccatggccaagatactggggacccctgccctagaggatgaagtccaagtgtcatatggtggcattctgggatgaagtctgcctttccagtacttttcatcttcagtgcttctcttcatacacagtgatcttggccctctatgccagttgggtgctatcatccatatgtgctgtgaaagttgccacctctac

SEQ ID NO: 11786 - DNA, 201 bp, Bos taurus
acaaattggtccatagcagactcccaggagagctggaattcactgagacaaattcaggtttcctgtacttaaaagaagcattgcaacttccaggaagagcgactcatttatcagagcttagtaatcaagtatgatagaggaatcattttggggaacagaaataaatatatccctcttttccctttttcctctgtgtgctgc

SEQ ID NO: 11787 - DNA, 201 bp, Bos taurus
tattattattactactactaacaaaaatagtaactattattgctgaatcttgtggactctctgagggatggagttggcaacttggacatgggaagtagaaaagtctggctgtggctggtggataagccttgggtaaatgccaactatgtaaaataagtggcctttgcttatgttctaaagccccatgaggaaaacctttcg

SEQ ID NO: 11788 - DNA, 201 bp, Bos taurus
cccccaaaaaaaacagtttctgatttcaatccactcctagaagaatgagaactcagagtttataaagatttacactttctgtcatcaacatttttcatccccacgacagctcaggaaattcaaacgtaaagaccaatgggctgagtctgagagaccaaagtgacttgtcccagatcacgtgactagcaactcacccactat

SEQ ID NO: 11789 - DNA, 201 bp, Bos taurus
ttgaggaaaaggaactatatttgctatttgatttatacttttccatggtgcctggtaatgagctctgcccatcacaaatctttagtaaacattattgaatcattttctaactgctgatcactgttacatgatgggtttttgtttgtttcctttactttagttctaatggtactgctgtctcccaaatcagctgaaaacttt

SEQ ID NO: 11790 - DNA, 201 bp, Bos taurus
gtcattagcaacattgacgtgcttcagttaaatgaccaagtatatgtgactctttttagagaacacctagaaaatgcttgcaggtggcatgtgtcagtaaggccagccttgatctagcctccttggtctaccagatgttctgtgggcacttgtgagcattttctaagtgagtcagatctggaccttccagttgcttcttgg

SEQ ID NO: 11791 - DNA, 201 bp, Bos taurus
agtaggcaggtctttatattggaggaagacaaggatgggaagccaggtactagtcagcgtgacatcagggatcaggcctcatacatagtagggcctggcaaacagtaggtactttgtgatcatttcatgaaggaataatttaaagaaagtacaaaggtgaaacacatagagagtatttaagaaaccacaagttgtccggtt

SEQ ID NO: 11792 - DNA, 201 bp, Bos taurus
ttttgtatacttcatattttaaaacaatgaggttttgtacacattaagaaaaaaaaacagctaaaactatatataaaccaaggaaatacacattagatgttaaaaaaggtagtttaggttttcaagtaagtcctgaagattgtcaggcttcttaaatgttgatggtgttaaggaaatctttatctagacccttggctttca

SEQ ID NO: 11793 - DNA, 201 bp, Bos taurus
ttacgtctcacgcttttcttctccacactctcggccagagggcagaagcaaaaatctgtgcttgcttctctcttctccatttcaaatatttttggtcatcgttttgacaagatggtggcctttgacttgtggacctgggaatgtggtttccttactctctttatggactagtcctgtaacagtaggtgccttgcattggcc

SEQ ID NO: 11794 - DNA, 201 bp, Bos taurus
ctcatccatctttctccctaaattctatttctctccctacttagtgtttaagcaggatagaatactattcaggcattctgtaggcaaccttctcttctcaatctatgagctcttcttatctgacctcagataggcccatggctttaaataccatccaaatgtatatctccaactctgatctcgcctttggacttaggatgc

SEQ ID NO: 11795 - DNA, 201 bp, Bos taurus
aaaccatctacctctaattcaacctgacactgctaattttggcattagagtttgaaacgaaaatcaatatctgttttgagcttgaaaacagagcgactgtaccttgggtggagcatgggccaggcacttattttcagtgatctgtaaggaaggtaatagaaattttccaatttggagcattgaaaaggcttatccagatga

SEQ ID NO: 11796 - DNA, 201 bp, Bos taurus
gctctgatgatgaaatgcctggatcctgtgttttatcatggtatctaagcagccatcaaagccacttcctccattaagggcccttttcaaactaatacaatattaagtcattttcaagatccatttaacttaagatgccctagattgcatcattatgtagtgttaaaccatcactaggccttgctaatttcccaagcaagt

SEQ ID NO: 11797 - DNA, 201 bp, Bos taurus
cttacagtttatatttcatactatcatagtgacctaaatggttgctacttcaaagttacccaaatggttactacttcctgcaatagtacttatattaatcgtaaaatgctaattactcattattaagtatattcaatttctaattacatacttaaaatttcatgacattttatagctacctgttagtgaaaatccattcat

SEQ ID NO: 11798 - DNA, 201 bp, Bos taurus
taagtatctattcttctttttctctgaatgtggcactcatgagagcaaagaccagtcatcaggggtgaattatttaatacaataatgttttaatagctgaaaggagacacaaatagtcgcagtgcctgtggctaatggatttccctggtaggagataaaaggctgattacacagcagagcaagtgagggcctggtgcgtta

SEQ ID NO: 11799 - DNA, 201 bp, Bos taurus
gtgtagagtttagctttacttgtaatcatgttttccattctcatagaaggttttcagggtcgaatgttcatgttaaaagttggggagtggggtagttgtcggggtgcagtgagcacaaacttagctttggaaggccctagagtgaccccggaagatgttaacatgttttctggaagcttagagcagggtgaaaataactga

SEQ ID NO: 11800 - DNA, 201 bp, Bos taurus
cagaaattttggccaactcctccagcagtgctgagtctggctgacaagcccctgagaatgcagctcacagagctgccccgtatgcattctagtttgctaacgcccggccgaccagagctgactgcacggctgctctggggctgtcctcttgtgacctctcagggggatgatcagcttcacctctctggatgctcctggagc

SEQ ID NO: 11801 - DNA, 201 bp, Bos taurus
tctaattcccatctaaagaggcagcatccgtcaaaagagagtggagccagcagctgtgctgtgcttgagttccctgtggctaaatagatggtgtgctgctgcactgagctaccatcttcaacaccagtgactttctttgctgctttcttccagctggcaccttgggagcttggcccaaggtaagcaggagtgattctgaag

SEQ ID NO: 11802 - DNA, 201 bp, Bos taurus
catttttctcccatgaacacctaaacctacaaacttagtatggagagcatgaacagagtcacgtttattgatacttcactatccccacagggcctagcacagtgccagcccacacttactgttcaatacacgtgacttctaccacttcctcctaacccactgcctggccccttctcccatctcctaaatgagggaatcagg

SEQ ID NO: 11803 - DNA, 201 bp, Bos taurus
caccattccacctctccaggccctggggttcttcatttgtaaaataagggagttatgccagaagatcacttaagacagactatcgcttaagggatcatccagctctaacattcagtcaaggccgatgcagtaactccaacaacacacatacacacattctaacatcctctgacgtgctcaaagtcaagcaagtgcaatcat

SEQ ID NO: 11804 - DNA, 201 bp, Bos taurus
cctttcactgtcaacgtttgccatatacgtcggcaactcctacattcccgagttgtgtcacttgcccttcttcttcccaggtggctgctggggaagccatgttccataacccactatgtggcccttcatctgactctggaagtaagtggcatgattgactcagcacctccaatcctcggtgggaaagctgctgtagctcct

SEQ ID NO: 11805 - DNA, 201 bp, Bos taurus
ctcccagtcagtgttgagttggagaactgtggggaagaagtttaagggaaagaccccaagcatgagaatttggatggaaggcctgcaaaatgcccagagacgctacctttgccggcgtctctgtcaggtcacgtgcctgtccatccacaacctttgaaaacacggtgagtccaaattgtgacaaaacttgctgatgccagc

SEQ ID NO: 11806 - DNA, 201 bp, Bos taurus
cacgtaatcagcttgcccctccagctccctccctgatgcctctcgccaccccaggagcatcccccttccagactgccaaggcgttaatggacccttccaacacttctgacgtcaggttgtgcccaagcctggctcctttctactgagcaactgtatcccctctactcttaagaaaaatgctgagtcttcaccagctcatag

SEQ ID NO: 11807 - DNA, 201 bp, Bos taurus
gggttgggaagaggccatcaaaggtaggatggtcagagaaagttcccctaagaaggtacagttctgggtaaagggagcagttactacaaggccccgaggtaagtgtgggcttggctctcggaaggggcagcaggaagagaggcggctggaggggcggcagggggagaacctacagagcctggaggagactcgctagggctg

SEQ ID NO: 11808 - DNA, 201 bp, Bos taurus
tacttaacaggttggccttcacctgatcaggcctcatatgcccaaaatggctgccataaccccaggcattgtctctgtgtccaaggaaagaaaaagaaggcggccaacaccaagtatatctttctctttatcaggaaagcaaaagcctttttattggtcataactttagcacatgaccccccttagctgcctctacagtgg

SEQ ID NO: 11809 - DNA, 201 bp, Bos taurus
ttagctcagaggtttattttgaccaaggattgcttgcacggtctttaaaggtcacagaggtaaaccatgggagggtcactgggatgagacgggcaatgctgcacaggtttccctgaggcctgagtgccatacaatgaaaccgagttgagaacacagcactgttccgtcaaactgcctgattcagcaggtgctatgaactga

SEQ ID NO: 11810 - DNA, 201 bp, Bos taurus
tagagcctgtgctccacaacaagagaaaccaccacaatgagacgctcatgcactccaaaaaaatgagcctctgctagccgcaactagagaaggcccaccaacagggacaaagatccactgcaaccaaaaataacaaaataaataaatccataaaaataatattgagtctccatccaggctcagatatagatcagcaggcag

SEQ ID NO: 11811 - DNA, 201 bp, Bos taurus
aggattccccatgctgcagagcaaccatgcccatgtgtcacaagtactgaagcctgtgagccctagagcctgagccccgcaacaaaagcggtcacggccacgagaagcttgggcaccgcgactggagagcggctgggtgtggctgtgttaaaaagctctacttatacaaacagctagcagatttgacttggcctgtgggca

SEQ ID NO: 11812 - DNA, 201 bp, Bos taurus
ggggaagctgggcactgttgaagcagggttgctccccgggttggaaagctggaagacgggcagaaggaggacttctccctaacgaatccctggccaagcagtatgtcaatcctaagagatcacatttagagaaaactaaataactggatgagaaattcagttcaagaaacattggccagaagtttagatgttgcttttatg

SEQ ID NO: 11813 - DNA, 201 bp, Bos taurus
tagcaggggatgcgtagagaatatgacataatcctcaatctgagaactttcaatattagctgtggagactaggaattgatataaaacaataccaaaaagaccacgtagcaaagttttacaggtgataaaaacctaatgaaagtcaggaaggaaacaggttagtgttggaaatggagcacttaataaatgggatagaatagg

SEQ ID NO: 11814 - DNA, 201 bp, Bos taurus
aaacatgattcccttaaatttttatttaattacctacaaaaataactttattcttttatgaagttgacaactaacattcctcacttagcatgttaaaatctgcccctcccttccctttaaactattattctattgggaacccttgaacatgaaaatgtacatcaaacatagcccatcacttattggacctcactttcctta

SEQ ID NO: 11815 - DNA, 201 bp, Bos taurus
aatctaaacaagggtaagaaaaccatggacagcataaaggacaccttgttttccctctttggctatgagagatttttgtttctgttgactgtgtctaatggtaagagtcgacttcctccacttcctgggcttcccgggtggcacagtggtgaagaacctgcctgccaatacaggagacttgggttcgattcctgcgtcagg

SEQ ID NO: 11816 - DNA, 201 bp, Bos taurus
ttactcccactctcagttgacctagttgctccattttcaagtagttttctgcagcgtgtagaagccataggcagctataggtgggaattaactctctaggataattctttcacgttatttagtgtttggttatgattcttcccccttggctcatccataaggtagagcagtgacattaataaagtgactagggcttgcttt

SEQ ID NO: 11817 - DNA, 201 bp, Bos taurus
gactaactggtacacatagcatcagcagacatctgtcaaactttggcttttctgttactcattctttcaaacaaaaacaaaacccagtctccagtctgagcattttgcagtgtttagttaatatgaaatatgtagtaaactgtaatatgaagctgttggatgaaaattctgatcaatgtagaaaacaaaggccatttattg

SEQ ID NO: 11818 - DNA, 201 bp, Bos taurus
ggctcctccgtccatgggattttccagacaagagtactggagtggggtgccattgccttctccttgttatatatgatactaattatgcaggccattcaaagctcagttcaatgatatttttcaggtgtaccaattaggagtagaactaggagcctggggaacttcccacgacattcaatattcaacattcaacacccagca

SEQ ID NO: 11819 - DNA, 201 bp, Bos taurus
gaaatgagaagaatgctgagatattgcccagtggttaagactctgtgcttccaacactgggggcatgggttcaggccctgatagggagactaagatcccaggggcagcgggtagcatggccaaaacaaaaccaaaaactgaggatctagggccaaaagacaggccagggagaatcaggaacttgcttggaatgtatgagga

SEQ ID NO: 11820 - DNA, 201 bp, Bos taurus
cagtccccacaatcctgtaaaccaattctaatagtttttttcttttaaagctttcttcctcatatttattttatgttaatcttttggccacaccacatagtaaataggatcttagttccccaaccaaggatcaaaccttgcatggcagcacagagtcttaaccactggactgagcaccaggaaagcccttaagccaattct

SEQ ID NO: 11821 - DNA, 201 bp, Bos taurus
ctgaattctgaagatttgaaagaggagtcagtcagctggagatgaagataccaactttaagtgagagctaggttagagcatgtggcttagatatgtaaccgatgtttggtttgtttatttgatactttattcgtttcaccatttatgccctgctaccctgaatttcagctttgtgaacatatagatacatagtatctagta

SEQ ID NO: 11822 - DNA, 201 bp, Bos taurus
ttgtgaacaacactatgaccggtgaggaactggggcctccagccaacagccagaaagcctacccataaccacacgtatgagtttgggaatggcttctcccaccccagtcaggccttgaaaaaactatcaccctggccgacagcctgactgagctctcaggaagcaccttgaccaggggcatcagataaaccacgtctcagc

SEQ ID NO: 11823 - DNA, 201 bp, Bos taurus
ggatcgaatgaactaccataagtagtagagtgcctagagcagttcttggccagagtaagcacccagtgcctagtagctgttataaatattgcagcctccacactcaatgacctctgcacaagtggccagtcactaggcttccttatcatttccactctcaggtggaaaggggatacataaacatggcaaaaatagcaggag

SEQ ID NO: 11824 - DNA, 201 bp, Bos taurus
actaaccttactagcacacactagagagattctccattggccttgaaaaaacaaactgccatgttgcaagtaagctacctgctgaaagatccatatggcaggggacttttggaggcctctagaaagtaagagcagcctccaaccaataagcagtaagaagctgggactctcggtcctccagccagaagaaaatgaattctg

SEQ ID NO: 11825 - DNA, 201 bp, Bos taurus
gcaaggcccaggcatcccttgacacacacccagtaccctgacttcacgcaagttctgaagacccactccagatggaaggaccatccagctgtgcctaacacctgcaccatcatccttcatttaggccacaacgcaaattatccaatactcccatttctttagccagctgcacaatgccttcagtaggatatgagacgacca

SEQ ID NO: 11826 - DNA, 201 bp, Bos taurus
ttcacaaagggctgccgccaggcaatggttaattactccatttggatggagcaagggcatttcagtttttcctaactatctgacgctgcttgccaatcctggtgaatgttttagtttgtaacctctgctctagagataggagacttaaaatcatacagcatcaacataggacataacaattattattctctaaaaaggaat

SEQ ID NO: 11827 - DNA, 201 bp, Bos taurus
tggtgttttcaggtgtctttgacatgagtggctaaaacagaatcacttctacaaagatgcctctggcaagctctgtattcatttcactgcacttcaaatcaaggggccggtaaagtgaaacagagacgctcaacagcgatggcagacgtggctgagtgactcctcccagaaagcaggcttatctccatggggatctttctg

SEQ ID NO: 11828 - DNA, 201 bp, Bos taurus
ggatcaaacctgggttggcactgaaagtgcagcgtcctaaccactggaccaccagggaatttcccgtaggcatgggtttctagcagccatgtttgtctgacgtgttgatactccatgcactcggccacagttgatagggatggtaagcattccatgctaagccaagttctgttgggaacatggagctgggatggagacaaa

SEQ ID NO: 11829 - DNA, 201 bp, Bos taurus
atgtgcgtgaggaagagggaggggacaggctctttgtaaattatcaagacacaggcactgacacagcaaaagacgtctatgcaaatgatatgctctgtttcaataagtcaattaacagaagcccatgttgcaatcatttccaagcagtgctttggcaaaaattaatgtagttgaggggcttatcagataataacattgaaa

SEQ ID NO: 11830 - DNA, 201 bp, Bos taurus
ccacatgcaagcacctcaagggagacaaaaatggaacagccatttaaaaggaacatctggtagaccagtcactttctcaggcctcctggcctgcatttcaggataagacaaagaggctgtggtcaggtggaaagtgctgtggcttttgtcaccaccctgacactgagaaggcctaggagggcctaaagtggaaagaagact

SEQ ID NO: 11831 - DNA, 201 bp, Bos taurus
ttcacatttcattatatgggagaaatagcggtaggaagtggccgattttgattgctactttgcctctccttcatccccctggtgattttggttgaaacacctgagaagagttgatgacaaaattaaaggagaaaggagcaaacaccagctcaataccattaagttggttctcctggacatatgttttcaaccttcatcctc

SEQ ID NO: 11832 - DNA, 201 bp, Bos taurus
ttatttgttttagcataggagcagtttagtgaagtgattgcttgtggactttagagcaaggtaggctgaaatcctagattttgccacaacaaaaaaagaactgaaaaagacatctacaaagttgtgattataacttgaaaatttagaatttgagtatttgtagtatatatgacagggttctcagttaaggaaaacatttct

SEQ ID NO: 11833 - DNA, 201 bp, Bos taurus
gaaataaatgtgcaacttcagtgcctattcaaggacaagtttgggcttggatcagtcatgagtgaaatgtcggctggcaaatgtctgccttgtaaaaggtgcagggtggtttatggggttatgaagggatctgaagaccttggagataatcaaagtttattattcattaccttcaatttacatcatctagcaattattgct

SEQ ID NO: 11834 - DNA, 201 bp, Bos taurus
aataattctattaaatggaaaaatatgcttctacagtcctttaatcttgtatagacatggacacacacacatacaccccttggcgttttaatatttgacggatgtttatcttgggttttcaatgaagtgttcacaaatattttccagcttcctgtggattatttaatttttaaattctatcgttcaatatctccctaacta

SEQ ID NO: 11835 - DNA, 201 bp, Bos taurus
acaggggccaaagtcatgtgcgttattactattgctgttggcatttattacctgctgtgctgatacagaaaagagggcgcatctttggccaagcaccgcccactatgctaatctatgctaatttcacaacaaccatcagcacagcacagggcaacagagcttcttgcttagccatccatccatgcatgcatgacatgaagg

SEQ ID NO: 11836 - DNA, 201 bp, Bos taurus
tgacttggcctctgttctccaggtgtgagtgacgcacggcattgctctagggcacagccactgactattctgaagtccctgctttggccccaagcctgccctgtgccatgccacggaatggtagccacatctctgcataccagtcagcagaccactctgttgcttgtcctgtgtctgtttgccctcctaggtggccttttc

SEQ ID NO: 11837 - DNA, 201 bp, Bos taurus
ttgtatcccttctttccctgagtacttagatagcagtgtggcccacttcagaactttctttcttgctttgctctggccacgaacatattttgagatggtacctactccatcaatcctgatccagtattaggagatgtgaagcaggcaggtgcccaggccagcccatgatgagtgtgtacattgaatgagaaagaaactttt

SEQ ID NO: 11838 - DNA, 201 bp, Bos taurus
agattaaaatacccttctctgtacctagtaagattatgcacaaaaataaagactgttattctgttccattttaaacaggtttatatgtccttgaaatagattgagtttcagttaggaaagtttgatgcttataatttatttatattatgtaggaatattaaattttagtctcatatacatttaacttccctatgggaaagt

SEQ ID NO: 11839 - DNA, 201 bp, Bos taurus
ccaatactagttccatgatctgttctatataaaatggtttgggatcataaaggtttgaaaatttctgaatacttgtaccactcttaggagctttaaacacacatgaacataggttctgggaagttctgtagtatatatgtatatgaatgtgtttgtgtgtgtgtgtgcacctttactgaacttgctataacttaaccatta

SEQ ID NO: 11840 - DNA, 201 bp, Bos taurus
attttgatatgtactgtagtaatttcattctgattctaatgagtgtgagtgtgatttatatacacacacttgtttttattgcaattctcttcaatttgttaaggtttgttttatgatctaggatataatcttagtgaatattccatatatactttgaaatacatacgtatattcggttgctgttgaattcattgtattata

SEQ ID NO: 11841 - DNA, 201 bp, Bos taurus
ctgttccgttggcttctccattctgctttccccagcacatacatgcagtagttgcttccccttggtattagcatctttgactttgaacttgcaacctaaacgagtatctgagaaaagacgataccaaactggagatgaattattatgagaccgtaagagccatttgaaaagcacaccaacaatgcaagaacaaggtttctg

SEQ ID NO: 11842 - DNA, 201 bp, Bos taurus
aaataatgctatgggttaaaggcccccttcccaacaggttacagagtataactatgttaacagtgtgagtcagtgcttgtgttatttctctactctgagcagattgttaggccacttgcatgttaagtgtactataatacagaaaatcaatgactacaccctccagtatataacagggtgaagccattaaacatttcatca

SEQ ID NO: 11843 - DNA, 201 bp, Bos taurus
aggcatttatgctaatgagatgactgagtctggaccccctcagtagcatcaagatgatgtcggtcaacagaatgacgaagagacgagaggattgcagggggtatgggctggaaattaagctcttgagcaaagacatctgatgaacgtccaggttggtgaggacatctgaatgcttggagggttacagaccccagttccatg

SEQ ID NO: 11844 - DNA, 201 bp, Bos taurus
ttatgaataggaggtctttatgtattttgtgattagagtatcatagtgttgccatataatctcattgcaaaacttctgataacctgtgtaggccaatataagtaaacatagtttggcttgaggattagattagtgaaagttaaagtggctcagtcatgtctgactcattttgaccccatagactgtgtagtccatggaatt

SEQ ID NO: 11845 - DNA, 201 bp, Bos taurus
tgggtcattgtgaggctcaaacgagctctttcatgcagatttcacaggacacagtgaacacgtaaagtgttacctctcagtgactagcactactgtgaatattacacctcaccatgagccagtcatcttgtccctcccaaacaggctcttccacccctcccacagagtagcctttaacattctcacagtctagctcagtgc

SEQ ID NO: 11846 - DNA, 201 bp, Bos taurus
ccctaagggaagggtgcttccccaaatttttcagagttatgtcataggaaaaataaggctccccagagcttggtaaagcatttaactaactttcttttgcatcacataaacatgttaaaaataaaatagaaacatattagaagtgatttaaatattaaatgtacctaaagttccatataaaatcacttcactttttatgaa

SEQ ID NO: 11847 - DNA, 201 bp, Bos taurus
attctgagtagatatccatcattctaggggtgaaaatgcttgagaaacatgctcaacaggacagttagactgagttcccactggccagatgaacagacaacgcattcatttatagacaaggtgggcttctgcaggttagacctgtgtggtgacacagggcctcaggatcagcagggccttgtgtttggggtttaaagctct

SEQ ID NO: 11848 - DNA, 201 bp, Bos taurus
gccttcagggcctgcttgagcataacctcatagatactacttccacttgaaggaggagtgttggtgtgcatgcccaggcttatggcttgatgggtcccacctcattcagttcatcacggccagttcaggttacatagtaactcggtggccaatggtacaacattcaactgccaagtccagtatgaaaccaaaaggtttttt

SEQ ID NO: 11849 - DNA, 201 bp, Bos taurus
gccctccactctgcattttcacctgactcctccttcagcttctctaactcctgagccagatgtgtatttaactccatgaccaaaaaatgccagctgctgctcctgcaggacacccacatcctaaggccaacatgggttccaggtcaccctctcaagttccagctcctgctgtggggttccaggttctcctggctcctccct

SEQ ID NO: 11850 - DNA, 201 bp, Bos taurus
tatttctaaaaacccagtcatcacagagtacaatctagtatcatgtaaacttaatttaccgtaggccaagctcacagtgtcccactagaaagatcttttctgaagtattcccacactgaccttgcaaacatattttattattagcactaaggagaaggtactgaaacatgtacattaattacatcatgtgtccaaggccac

SEQ ID NO: 11851 - DNA, 201 bp, Bos taurus
caccccactgcagcatgctctccaggtatgaccacaagggcacttactgcccttttatttttctttcaaatttctggccccaaccagactcagtgcagaagctcttaactttatcagaactacccaaggcagagagcacatttcagtgtgtctattccagggcatctactcaaagctcccttcaccgtggtctatttaggg

SEQ ID NO: 11852 - DNA, 201 bp, Bos taurus
atggccttgcagactgcatttttgtgacgggagagatgggattttgtgctggggctgccctcctccagagcaacctctgattaaccattggctttgatccgtcactttcaatccagggcctcaggtttctcacttataaatagagaagtttggattcgttgcatgtcaagagctatttgaacaccgcagtttattccttat

SEQ ID NO: 11853 - DNA, 201 bp, Bos taurus
cccgtttgtgtatgagtatgtggaggccccaaaagtttaaataatctgtccacagttacccagctagtcaaatggcaaagctgatgtgcaaacctcctccaatgggcctcagagctcatcctcgttctcttaaaccaccttgctcctccagggaggggtgctgcccaccactgctgagattcattgggggaagctttggat

SEQ ID NO: 11854 - DNA, 201 bp, Bos taurus
ttcattggcgggcatagcccttggttgctatgagcgctgtacacacaacacagctgtcatcggtattatagatctaacgggagccaagggtctcacatctctaaggaaaaaaaaaaaaaattcaggactttggaataacatcaatatctataaataaatgtgagctcagagaagttaattacagaatacaagaacacaaca

SEQ ID NO: 11855 - DNA, 201 bp, Bos taurus
gttcgatccctggttagggaactagatcctgtatgctgtcgctaagacccggtacagccaaataaataagtatttatttaaaaagaagaaaggctttatggttaagagagcagttactgtaccagggtctctcgaccttggcactgttggcattgtggactgaataattctttgtgtggggctgtcctgtgctttggagaa

SEQ ID NO: 11856 - DNA, 201 bp, Bos taurus
tctctggcttgtcctcttatagtaactgtctgaaagaaggaatgggcttcctgtctactctttgctcctggagtagtaggcacacgtggcaagtcatccgctctgtggatgtggcctgactgttgtccacctcctgtttcaggagtgaggcgagagcaggggtaacttgggtgggcaaataggacatcccagcgcattgtg

SEQ ID NO: 11857 - DNA, 201 bp, Bos taurus
ttaatagttgatgaaacagttgacttaaaaaccatgctctctcaaagcacacatgtatatttatgtatatacatacacacgcatatattctttggttttcttttcacatagactgaatgctttaaaattctttaaacctgcccctttcctcagatatgatgatatatttattgttgttgttcagttgctcagtcatgtccg

SEQ ID NO: 11858 - DNA, 201 bp, Bos taurus
agccctgttttcagttggtttcacagtagcctccattagaggaggcagggtccattcagaggcagggtcctgtgaagaaggaaagcaggccaactttggagaatttagtctaaagagaatgattgtgattcacagcatatggaactgaagcatatagacaagtcgtctatttctgagggaactgtacagcccaagaaatgt

SEQ ID NO: 11859 - DNA, 201 bp, Bos taurus
aggcttttccactgcacttcagggatgagcgggtctgcgggttattttccactcacccaggcacgtggtcattcattaaatctggaaataaatcatgcacagggccccaggggagctgtatttgttttgcatggttctaattcagcacatccagcgagagaagacagccgctaaacccttaccagttccaaggaaataaat

SEQ ID NO: 11860 - DNA, 201 bp, Bos taurus
actccgggtatcaggacgcttgtttgcagagccggccggccagccgcccggagcaggagcagctggttgtaattatgcatcgcagcttcagaggaagttgctggctgcggatccaatgctgggcccggctgcacactggctgctgggcttcagggaacaatggagatagaaactcgcggcagcaggggaaggggaggagga

SEQ ID NO: 11861 - DNA, 201 bp, Bos taurus
tatccccaagccctccccttttgtggatttacctgggtcataccagctgaaccaactgaagaaacgatgaccatgtgactggcctgaagcaaacagaacccagtcttcaccttttccctcatctgagctgctcctgtatgtctgaaggtctgagaaaaggtggggaaaggccatggcagagaggagaggaagggagagata

SEQ ID NO: 11862 - DNA, 201 bp, Bos taurus
tcgtggcccagtcaggacagcccagcttaaggaagaacagactctgcagtggacgttggaagggggacagaaaagataacgccaggctttgggggcaagatgaccccagtgcagaggccacgggtgtggaaacgctaggtcagaataaacgacaaagagaaggagctttggggaaggttagaaagcctcaacaaagtcaga

SEQ ID NO: 11863 - DNA, 201 bp, Bos taurus
agagacctatgctgaacccactgtggaggaggatttgtttccttcagagtaactgacacacaagacagacccccactgtcacaggcagtggatgacttcagctccgggccccgcagcgtccctaaatgggagaaaacgtgcacatgtaataaagcgagaacagcggaacaaggaagccgacacttggcgaagagttcctgt

SEQ ID NO: 11864 - DNA, 201 bp, Bos taurus
cacctatgggacagtatctgaaatggaattagacaaagttctggaatgtaagacacccaaagagtgaatgtttaaaaaaacaaagaaatttcatctaaaattgctataatttcccacttttctggaaaaaggctcttaaaatatgagtaatcttctagggctgactatattctaaacatatttggtaaaatgttctcttta

SEQ ID NO: 11865 - DNA, 201 bp, Bos taurus
tgaagctttgttccagaatttgtctggttgggcccatgtgtttcagtaccaaccactgcaatacagttataatagaagcagttcttgaaggtggttaacaaatatctaactttttggcccatccctggaatgtccaacacctttgggtactgagctgcatgtagaatttcactgtgtctaggattagggatagtctgtcag

SEQ ID NO: 11866 - DNA, 201 bp, Bos taurus
gtggtcactctggaccacctaatgaagaaactcaaacctaggttagaaaatttggactctgatgaactaaagagtccctgagaaatcttttacatcttctatttcctcaaccagaaaattatttccaacagctgcactctggaggcatagtatgtaaattaactagtgggtttgctcattattttacaccctatagcccca

SEQ ID NO: 11867 - DNA, 201 bp, Bos taurus
acagctgcgccaggccactgaggaactttactactttgagtttgtgtggacaacttgccaatctgtggctttgcagggaggagagtgacttcctgcctcacggccacaagatagggctctggatccatttgcacttccacctagaattccatggagactggattatatttgcccaagtctcagttgggggtgtcaagcgcc

SEQ ID NO: 11868 - DNA, 201 bp, Bos taurus
agcagggctgtcagtgagcaggcgggagttcaaggccgcctgccgccttcgcgcggagaatttcattaggcgccgaagcaatgttccgatatccgcgggattcaggtgcccaaggcccgcgtccagaagatcacaggggggccgcctggtggcattgaacccaggagctggtactagatggcctctctcatgagagtatat

SEQ ID NO: 11869 - DNA, 201 bp, Bos taurus
cttctgcattgggagcatggagtcttagccactggaccaccagggaagtccctgaaaccaattttgaaacacaaacttgaggagccatttctccaccagctaagaatctcatagacacaaaactcaaaaacactaaaggcaaagtctaagagactggcatgtgaggaacagtagctgctttgtagcctaaacacagaagtc

SEQ ID NO: 11870 - DNA, 201 bp, Bos taurus
cacttgatttttatatattgatttgtatccacacaaattgcaaaccctcttctaatatcaaaaggttcttttggattttctacagtatgtagagagttttatcatttataaacaatgatagcttcatttcctccttgccatttcttatgctttttaatttttccttatcaaactcttctggtcaggattgctagtatggtt

SEQ ID NO: 11871 - DNA, 201 bp, Bos taurus
tagtctaaatggctaaaatttgaacactattagaaaatccatttgtggaaaacggtgtgtctttaagaaaattaaacccaaacataatacagtttccaaaatgaatttgttctttagttcttgcaaatttgttataatggatttattgtgatatgaaaattttaagttttgtcagtttgaggagtccacataactttgtaa

SEQ ID NO: 11872 - DNA, 201 bp, Bos taurus
tttggaggtggaaaagcaaatgtttgctgggtcctgggagacagtataggacgcagaatagacgctggactctgggccctgtttcccccgcaacacccagcccatcttcttggcagatctctctggtggtaactccactgtgtgaacaggccctctaaattcttttagacagttagtgggaaggccaaggttctccctgag

SEQ ID NO: 11873 - DNA, 201 bp, Bos taurus
acatcagggcctcctgcattgggagtgcggagtcctagccactggaccatcagggaaggtcctctgacttgcattttaaaacacagaactgaatttgtgagagcagaagctagttttcaaagggcctatcttgtacagttgattgactttgcctttcagggcatgtggactgagggcatccagtaccctggactctatgcc

SEQ ID NO: 11874 - DNA, 201 bp, Bos taurus
gatttataaatttaaacttttagcattttgtgttactctgaatggatgatgtgacataactactttgtatttaagaaatacactaaaaaaaagttattttctattcctaaacatcttcccctaaagtgaattttatctatgtcccatggccatatatgacaccaactatttttgtgccagtaactgtgaaaggaaaaatca

SEQ ID NO: 11875 - DNA, 201 bp, Bos taurus
gattaaatggtggcctggaggctgactactctgctgaacccagagtagaggtgacaggtcctatcaggctttgctcatgctctttctttcatggttagctcctgctctttggccacttctgcctgctcaactcctggtagatcttcaaaactcagatgaaagagtagagaaaatgtatgctagtgtgctgtctatttcaag

SEQ ID NO: 11876 - DNA, 201 bp, Bos taurus
ctctcatctcttcccacccctctaggttgttacagagtcctagtttgagttctctgaatcacacagcaaattctttctggccatttatcttacatatggtagtgtgtatgtttggagaaggcaatggcaccccactccagtactcttgcctggaaaatcccatggatggaggaacctggaaggccgcagtccatggagtcg

SEQ ID NO: 11877 - DNA, 201 bp, Bos taurus
tataaacactgaacagcactcagggaaagatctgctgaagtaatcagccataatacaggacatgctggggtcagggtcaaaggaatccacttgaattctctgtgactgacatcatatctgaagactatgccatatgtcctaccaactgttacattcttctataccacacaacattgtctctcatacctttctgcatttgta

SEQ ID NO: 11878 - DNA, 201 bp, Bos taurus
tggttctgatcactgtatggtgaaagaatcaggtttttttcagtatacaaaaaataagtgaaaagcactaaaaattctgtggcctcaccacactttaagacattgtaataacattcattctgtttcaacccttgaaatacaaatttcccacaccacaaagttttctccaggaaagagaagattggcccatggatctgaact

SEQ ID NO: 11879 - DNA, 201 bp, Bos taurus
aaagcgttttctatcatcaccaggggccaaatggggacaatgcatttaggggaggaaaaaaaaatctgactttcccagatgttcttaatttagggtgaacgtgggcccatttcctgaggcagtatcagtttaggcttcttatcccaggaactatagaaagtgccttcttcagtccccggagtatccggtaatgggcaatac

SEQ ID NO: 11880 - DNA, 201 bp, Bos taurus
taaaagtgaaaatatagatgtcattttgcactgtcagtcagatatgcaaactgctatggttgccagcatcttttagaaatcatggagggatcactcagacagactggggataaagccaactgcaggactaagtattctggtttagctcacatgatatattcatcttgaacagcagggggtacattttctaaataggtcact

SEQ ID NO: 11881 - DNA, 201 bp, Bos taurus
tattgtgaggtttaaattgaactgcctatgtatggcatctatcacagtacctgtgacattgagtattcaataaatgttagtatccttccccttgcccgattttttaattgaatttattacttttcatgtgttgctactattttgttatatcagtctgaaaatcagggttttctcacctatacaatcattaatataaagccc

SEQ ID NO: 11882 - DNA, 201 bp, Bos taurus
gaagattaaattctagttctattatgctatgcttttttctcatactggagactgcccattattaaatactaggatgtgtgataaaattctggcctagtataaattttcaaccaaagaaaagaaaaccatttcaggaaactgtcaatataagatagtgaaatgtaatgacataatttaagtcaatattataatattttgaag

SEQ ID NO: 11883 - DNA, 201 bp, Bos taurus
gtgggtggacagcggcctgatatgaactcagcggaactgactacaagagtcctgggagctgcatcatgctggcgtattccataaatccattacccctaccatagtttatcttaggccaaactacagggagggaacacaaccccacccatcagcagaaaattgcgttaaagatttactgagcatagccctgcacaccagagc

SEQ ID NO: 11884 - DNA, 201 bp, Bos taurus
catgtagggacctgggccaccttctggaatgggctgatttccttgagctgtcataagtcttacttcaaactcttgtactctgaaagacacaaacttaacccaaaggttaaacaaacaagggccaaaaaggagaaaagcagtaatagcctttaaatggttcagaaaggaaaggaactgggattcctttactgttgaccagac

SEQ ID NO: 11885 - DNA, 201 bp, Bos taurus
ttgtctttttatcaacaggataatttatatacactttccaggaggaagttatttcctcaggcaaataaacacctaactggatggaagaaacatcccagggtggcctcaagttgctggacatgggatatgtacatgcatgctaagtcttttcagtcatgtctgactatttgctaccccatggactgtagccctccaggctcc

SEQ ID NO: 11886 - DNA, 201 bp, Bos taurus
ttgagcagttatgttttatcatacattgacagaaaggttgtttaggatcacagatttgccagtgttagtaatattattagacttattatctaggctcagagttgtatctctttatgtcttgtgagacttaaccaccaaatttcaatttcgtttagttttcaaatgctctgagaacaaagtcagctgcttatcgtcttagtt

SEQ ID NO: 11887 - DNA, 201 bp, Bos taurus
atagatgagaatcagaagaccattgaaaggttatttagatatcttggaagagaactacaattatagacaatagcaaattcaaaatgtttcacatggaaaaggggcaaaggaagaaagaattcagctctttgtaaggacagaaagaacagtgaggttggagaggataattcaagcaggaggatggtaagtgatgtgggagag

SEQ ID NO: 11888 - DNA, 201 bp, Bos taurus
gggtaatttacaacatttaattataagttggttaaaaaaaagcattttcatgtctgattataaatttccttcttatatttaaaatattaatattttctgacactaaaataatcactgaaaattttgacccctgtggtttaataacaacataattttcatctataaatacatatttgtatttctttttcataaatttgtgtt

SEQ ID NO: 11889 - DNA, 201 bp, Bos taurus
ctaaacatcaagtatttgattttcataatttttttaacctgaaaagatgcataaagttacccactggaaagcgtatgtgttaaactgactactttttttttaaattttattttatttttaaactttacaatattgtattagttttgccaaacatcaaaatgaatctgccacaggtatacctgtgctccccatcctgaaccc

SEQ ID NO: 11890 - DNA, 201 bp, Bos taurus
cactaaggaaccctcataaagtgaggactctgctttggtgaacaaatcatgaatagatcagcaaagaggtttttgttttttttttttaatagataagatatagtgaatataatgtaaagcaatgcatttcaaatatctttaaaaggaaactatcttaatatcacaaaagaatgatgataatgagattcttatgtatatttg

SEQ ID NO: 11891 - DNA, 201 bp, Bos taurus
ggcatgcacgttctaaattaaaattatttttattagtaaaaaaaaaaaggaatataactgctgctgactatttacaatggccaagacatagaagcagcctagatatccattggcagatgaatataaacaagttgtgatacctatattcaatggaacattactcggccataaaaaggaatgaagttgagttagttgtagtaa

SEQ ID NO: 11892 - DNA, 201 bp, Bos taurus
aaaataaggccatttgattcaacaggacttcaaagataagtgggtaaagatgcaaattaatttaatggataaaccactaaagggctgattaggagctttttagttgattgcaagataaatccaaaaactaagggtgaaagggaaacacagagacagcaggtcgtttgttttgttttgttttgtgaaagattcttgaaaata

SEQ ID NO: 11893 - DNA, 201 bp, Bos taurus
aatataacccaatttccttctgcttaaatttatcaattaggaaaatgtaaagcatcaattttttcaatgacttcgcccaactcaatgctgaaatagtattgtactcagttgcttcaattgtgtctgactatttgcgaccctatggaccatagcccaccaagctcctttgtccatgggattctctcggcatgagttctggag

SEQ ID NO: 11894 - DNA, 201 bp, Bos taurus
tatcagcctccataattacataaaccaatttcttacagtaaaactttctttctttttttgtcctttcttttctctctttctttatagatatatatatagagagagagagataaagatatatacatgcatatatcctaatagttttgtttcttgagagaacccagacttaatacaatgctcattctatagatcttccagtgg

SEQ ID NO: 11895 - DNA, 201 bp, Bos taurus
tacagataagcactaaagtttttatctagtaccatgaagggtatcagagcatgcagactccaaatatgcaattttgacatgttggttattttgagctaacggtacttgagaaacagcaggtacaaaagggttctctgacgtccctggcttcccatttctatctcaacataaatcaccaaattttctgtgagaaaagtgtcc

SEQ ID NO: 11896 - DNA, 201 bp, Bos taurus
ttgttacagctcggtcacagctcagttttatttgacaagcaaaggagagtacaccctcaaggcatgagggtgagtggaccccaaaggagaggccttaatccatcttgaccttctccttttatatgtttgtcttctccccaccttgagcctgccttctgcaaattgggctagccaagaacgggccgtgtttgtttcacctaa

SEQ ID NO: 11897 - DNA, 201 bp, Bos taurus
cccattggctctttcatggagataggtccagcctttgagcggttggaaggaaaggatgccagcaaaaatggctaatccttttccagctgcagtaaactgacgattggccaaagccaagagaaaaccgccgcagttaaaatgattttagcgtcacgtctgcagctgagaatggagcgtcagtttttaaaaggacctgtggat

SEQ ID NO: 11898 - DNA, 201 bp, Bos taurus
cagtggcctgtatctctggcctctgaccataatattttcttcttgtgtattttttttttccctccttatgtgagacagaaagttaggaggaggcaaaagtgggaggaatggccttctttcagggctctgaaataagactctggtagagtctttcccagcaatgcagggcttttttagatggaatgcttgtggtgtaatgta

SEQ ID NO: 11899 - DNA, 201 bp, Bos taurus
gatactggtgtgggatttccttctctgcgggatcttcccaacctagggatcgaacccaggtctcccacattgcaggcaggctctttaccatctgagccactagggaagcccatatatcaaatgaatcaaccataaatatacaattgttcccctccttcatgaacctccatcccaactcccacctcatcccatccctctagg

SEQ ID NO: 11900 - DNA, 201 bp, Bos taurus
tttaaatagtgccaacttatacaaaaatattctacttattccaatccagtttcaacttgaacaataaaatatgcttccttttattttacctatttcatttcttttatgtaatatcttgctttttattctgttgataacctcagaaataagtacaagccaagcatatcaaacattgggaaaacaatatttatgttatatgaa

SEQ ID NO: 11901 - DNA, 201 bp, Bos taurus
tagtaattgactccaaaattcattagagggaccattagtggacatggactgccagaagaaagaatatgtgagttgggatataatacagagaaagaaatggaatgaagaaatagaaacagagctcagagaaacgtgggaaattttaagtgcaccaatatacgcataaggagagtactggaaggagaggagaaaaataaatca

SEQ ID NO: 11902 - DNA, 201 bp, Bos taurus
ttgtaatttagactgtctagatttcaattacttaaacttttattatattgcaggagcagaaatgatcaagaacttgaatgcaacacattaacattttttccataaaattctatagatgcagcttcctaaatcactttagagaattctttcatagtaagactttataaaatcattattgtatctaatttttcatacttttaa

SEQ ID NO: 11903 - DNA, 201 bp, Bos taurus
cattacaagttcagctgtgcagtgtgtgaagtagatgagctactcagtaggcctagtcttaacacacagacagagcagtctgagattcatcagtaagttccaggtctaactgtctgttacagtggcccttctgttactctacatttaaagagaatatcaaataaggtccacattcatatttaaattggagaaggaaatggc

SEQ ID NO: 11904 - DNA, 201 bp, Bos taurus
gcatggccaaaaaagaaaaacactttctaacactaaattaataagatttatttagcctttgacaccctggacgtagttccaattttagatcccccagctgctccataaatgtatttcttaacttctaacctcaaacttcagcaacaaaaagtataaatacaaacattctttcctgtagtatgtataaatgtttcccacaga

SEQ ID NO: 11905 - DNA, 201 bp, Bos taurus
gttgttcatgctgcaaaaatatactgcctatttacactgtgtgggcctttgtaatgactgctatcattacagtgtgctagacgatactctattcttcacatgtttattctttagtcttaaaacaattcaaaagcataggtacagtacaaattaatcatttgaaacctctactataacagacttgagaggccagaaagagaa

SEQ ID NO: 11906 - DNA, 201 bp, Bos taurus
gagaggtgtcagtgtggtggaagcagagagcagaggaagcacagacctaatgcctcccctactcgctcacatcctgaaagcccaccatgcttggggtggagaatcactactggaaaatcatggtgtatgatttgcatttgtgtatgaacagaaatggggttgttaaaataattttgttaaatgctgaaaatgaggataatt

SEQ ID NO: 11907 - DNA, 201 bp, Bos taurus
ataagagaatgaaatattgtagaagaagtggctgcagggtggggaaaggtaagtagaatctaaaatcatcatcaaaatctatcttagtcagaaatccaaagaatacaagcaaatgttggcagaggagggtcagagtggcctagcacagaagcagaaacttggaaaattaggttttctcttttcagaggtctggaatcagtg

SEQ ID NO: 11908 - DNA, 201 bp, Bos taurus
ttcagtcctggggaaactgggacatttaatcgtcctgcagaggatactgattaaagatctctcagaggaaaagaggaaaaaaaggccactttaattatgtgtcaggaccagagaatatatcaatagcttagaacctgtgagtcagttaggaaccttcagcctcctttgtcctctccttcctattccctggcctttcctaga

SEQ ID NO: 11909 - DNA, 201 bp, Bos taurus
cactttcaaagcaagacaacaagtttctgtgcaatgaaaagaaagaagaaaatttaaattgtactctctttctgaaaccccacagaacctgattgcagcatagaaagttttctgcattactttttttaaatgagtttccactggcctgagatgactagggaacagtctccaatatgcctattcaaggttagaatttcaaaa

SEQ ID NO: 11910 - DNA, 201 bp, Bos taurus
ttatctattttatatatagtactgtgcatattttaatcttaaactcttaatttattcctactcccctcccctttggtaactgtaagcttgtttcctatgttggaggctatttttgttctgcaagtaagttcattttcatatggtatttattatatgtagtatctaaagccacaataatttaaagaaaacctacaatgtggt

SEQ ID NO: 11911 - DNA, 201 bp, Bos taurus
ctcctcaaagttctttgtaaactataaaaaagttcatataaaactattctttgaaaaaaatcagtaaatcctaacgtaagaaatataaacttatttaaatgttttctaacacccagtggttttcgagagtttaaaagataactttttattgccatgctgataaaatctgtaattgttcaatttttaaaaagctgttgtgtg

SEQ ID NO: 11912 - DNA, 201 bp, Bos taurus
aagctgccttgctctgagatgcttgctttgtttagtgtttacactggaagtggtgttctaaaaggcagagttcccaataagggagtggcctgctacaaaacacatgattacttttcagatgctgagaaatccaactttagcctcctagcatgcacagggaagatttgtttgggccgtttttgtttaagctaggtgtaccag

SEQ ID NO: 11913 - DNA, 201 bp, Bos taurus
atctggtccatctgctggacagccagtaatatccagattttctgaatacttctattgatggatacttgacctattttttttttttttaattttggcctttcaaaaatatctctacttgcacatcaaaatacaaaacccaatatttctttctataaaaggtagacaacttagaaaatatttatttatttaattggccatgcc

SEQ ID NO: 11914 - DNA, 201 bp, Bos taurus
ggagatggtgaaggacagggaagcctggcattcttttcagtccatgggattgcaaagagctggacatgactgaaaaacaacaaggaggataagagcattaaaagcagtcatgaagtggtctggagagttatcctcaaggaggactactcacctcaggcaagtgtattgctcctttgaggagaggaaggagaaatatttatc

SEQ ID NO: 11915 - DNA, 201 bp, Bos taurus
ccttttaaaatttattttcttttctttgaggtggtgaatgaaggggtcaagtagtggacttggattcaaatttcaattttttctacacatcaaaattaatgaggcctgtgtccttgtactagttttcttttgaaatcattattgctacccaatcattccatggtcactggcaataataatagatttacctttttaaaagaa

SEQ ID NO: 11916 - DNA, 201 bp, Bos taurus
tctatcaaagagctagagaaaggaactctaacttataaacattggggatgtcagtgtccttgcaatcttaccctggtcacataagaaatggacacacgctgttctttctgaggaataactagggctacctgccactctcactctaccaccaaacagggaaaaataaatgaaaagaggtggtacaagggaagactgtcaaga

SEQ ID NO: 11917 - DNA, 201 bp, Bos taurus
tgaccagaagcagccagaaagtgactgaatgattaaagagtagtatggccataacttgatcattacagggaaagcgtgaaggtggaatttggagaagaaggtatagaacagcttctgcatggcccattaaagaagtatgggttttatgtaaagagtattgaagtatctttttaggatttataaaaagagcaaaatattcag

SEQ ID NO: 11918 - DNA, 201 bp, Bos taurus
ccagagcactaagttccccatacttctagcctgacttccacactgactgagttccaatgacttcagaaagaagagagaaaggcatagcttgcatttacaggagtatcatgtccatgtgaattttagcgtgcaaagaattttatgctatggttgaaatcagatgtagatcaatgagatgtgactcagcacactgaagcactg

SEQ ID NO: 11919 - DNA, 201 bp, Bos taurus
caatagaagaagattttttcatattctaataatcatattgttcaacgaaatctccaaatgagattttactttcctcactaatcatggtgagttgtcaaggtttacaaagatagtatgaataattttatatgtctaattgcccaagaccgtaacaaacaaagaagaaagatatcccaaataatcagccaccaatgagatcca

SEQ ID NO: 11920 - DNA, 201 bp, Bos taurus
tgcctaaatctttttgtcacccaggttattaacctaagaagctattattcatttactcttaagaagtcatctttaatttaaagcatttgtctatcttctcgatcttttcccggggtaggattgtctactgaatttcactagaatcagatttcaatgtctccagacaatttctgaagcatcttagatatataacatccaaag

SEQ ID NO: 11921 - DNA, 201 bp, Bos taurus
aggaagctgagctttggggccccttgctcaagaggggagccttgaaactactgcattgagttaagaacctggagagggattaaggaagtctcaggaaactgtcttggggccactggcaggagaagcaagataacctgatcccactataaatgaagaactttgaagtagattatagtggtctctggcaggcctgggactatg

SEQ ID NO: 11922 - DNA, 201 bp, Bos taurus
tgctggatgctacagaaagatatacttttaacatacaaaacatttctgaatccaacaagtgcccaataatttaataatgtaatgactagtggacttactcgagtccactaaaccaatatttctcagagtattttaggctaggttagcatttattctgacagatgacctgcaatgccatccctacaagaaaattgccatatt

SEQ ID NO: 11923 - DNA, 201 bp, Bos taurus
tgtcagagctctcgcctcctgcaccatcgtgcccgtttcatcaagaggccagaatgcttctcctgatgatgtctgtcctcctgctgatagagctgctggcgtggatgcacttcttctcggaggcctcgctctccgagtcactcatctctacgtcagggacatacccgtcattctcgttgtcagctttcagtttgctttttg

SEQ ID NO: 11924 - DNA, 201 bp, Bos taurus
aactctcaaagcaggataggagtggggaggagcaccctgcactgctgaagggcagaggagggcggaagcagggtggtggggagggcaagaggaggcctccgggagaatttgggattgagaggttgtggtgattccttagtcagcaggagtggacgctaaaactggtgggaaggccagcagggccaggcactggacaggtgc

SEQ ID NO: 11925 - DNA, 201 bp, Bos taurus
aggcagcttatagctgcagagaaagctcacgttacaaagacttcattacttttacaaaatatgcacccaaggacatttactagtgtattgagagctattaccataaataattaaaactaaactattcttctctaaataaatgtataaagtacattgggtgattccaagcactaagctttctcaacatactgctttgtagac

SEQ ID NO: 11926 - DNA, 201 bp, Bos taurus
ttttggaattttaggtgatcaaactgttagatgccagtgagtaagttctggagttgggggaccagcccttatctgccttatgctaaacatgcatttgcctctaaaaaatactcgagagagatcacttagtgtagatgaggaatatacatttttcaatttccccttgaaagcactaattctagcagaaccagtttataggac

SEQ ID NO: 11927 - DNA, 201 bp, Bos taurus
caaactgcctgggaaacaccagcagttttagtttcacatcagctggtgaacggggaccagagcctcaggaccacgttgaggcctggagatatcagagcaccttctctttctctcatcactgtattattaagaagctcaaaaacgcctctctccatgtgatagagaaaaggccatctgcagcctcacgtccgcatcctctgt

SEQ ID NO: 11928 - DNA, 201 bp, Bos taurus
ttggatataaaaacctttggctacagagctatgctgaagttctctaatgcaaagcaaacaggtatagtactaatcattctctgtatacgtaattcactgcctccacagctgctatggcttcctcttggagaaagtatcttattctttcttattatcagttcctagtattaagcattcaataaagattagctgtatggaatg

SEQ ID NO: 11929 - DNA, 201 bp, Bos taurus
tgtaggttgtggcctcgaacccaagtatcttggcttggaagaggtattcttccagttttaccatgctgccttccctctaaaagtcctgggagttcctagagccaaatataaaaaagactattagttggatttcatttaatcacttttatatatggtttgatttgttcccaggtccattataaccatatttggaataaatta

SEQ ID NO: 11930 - DNA, 201 bp, Bos taurus
acaacaaaagcccttcccattagctgttggtttcacttataagcaattaccaggactctggcagcaagtcatttggggccctcttgacaagattcagacatgatctacagaaggtagggagaaatctcctcatctctgcatgttaattaaggaagacagatggccctgtgattattcaaccatatgtaggtcaagactaaa

SEQ ID NO: 11931 - DNA, 201 bp, Bos taurus
tgatgaccttaataatgacattaaaataatattttttgcttctcaatctatcaaagaaaagatttataataaccagtgttggtaaggacgtagaaaagcacatgctattagtaaaagggtaaactttacaaccattctagagtatgttaattgggaatatattttcacttagaacttcaacttctaggaatttatgttagg

SEQ ID NO: 11932 - DNA, 201 bp, Bos taurus
tatattgaacatcttttgatatgttatacatatatatatgtatgtgtatataaagacttaagacttcaacacattgaaaaaattttactcaaatgtatatgaaataaattttgaaatacaaaatgggcttcaattagacattactttaaaaaataatctatttgtaggcataacatgaagttgacatcacagtaccccacc

SEQ ID NO: 11933 - DNA, 201 bp, Bos taurus
gtaaaaatcactaaggcaaatggaaatgctctaaatctgcccaaaacaggtaacgcctggagttctagagcagagtaaataaaggttcaccgagaggccacgacaccaacagatgccccttcctaatggagtggatgggctgaggaacctgctgatggtcattacttccctctggagcagtggccactcaccttggctgca

(The sequence listing continues in the following parts.)

The invention claimed is:

1. A plurality of Bos taurus cells comprising HO840003150607238 germplasm, wherein a representative sample of HO840003150607238 germplasm has been deposited under ATCC Accession No. PTA-125702.

2. A frozen vial, a cell culture, a tissue, a zygote, or an embryo comprising the plurality of Bos taurus cells according to claim 1.

3. A plurality of Bos taurus gamete cells comprising HO840003150607238 germplasm, wherein a representative sample of HO840003150607238 germplasm has been deposited under ATCC Accession No. PTA-125702.

4. Fresh semen comprising the plurality of Bos taurus gamete cells according to claim 3, wherein said gamete cells are sperm cells.

5. A cryopreserved bovine inseminate comprising the plurality of Bos taurus gamete cells according to claim 3.

6. An F1 Bos taurus animal, or part thereof, wherein said F1 Bos taurus animal is an F1 progeny animal of a Bos taurus animal comprising HO840003150607238 germplasm, wherein a representative sample of HO840003150607238 germplasm has been deposited under ATCC Accession No. PTA-125702.

7. The F1 Bos taurus animal, or part thereof, according to claim 6, wherein said F1 Bos taurus animal is prepared by artificial conception.

8. The F1 Bos taurus animal, or part thereof, according to claim 7, wherein said artificial conception is in vitro fertilization and implantation, Artificial Insemination (AI), or in vivo insemination and embryo transfer (ET).

9. The F1 Bos taurus animal, or part thereof, according to claim 6, wherein said part thereof is an isolated oocyte or a plurality of sperm.

10. An inseminate composition comprising cryoprotectant and semen comprising Bos taurus HO840003150607238 gamete cells according to claim 3, wherein the gamete cells are sperm cells.

11. The F1 Bos taurus animal, or part thereof, according to claim 6, said part comprising an F1 Bos taurus inseminate comprising at least half of a haploid genome of Bos taurus HO840003150607238 germplasm.

12. A bull comprising the plurality of Bos taurus cells according to claim 1.

13. The plurality of Bos taurus gamete cells according to claim 3, wherein the gamete cells are sperm cells.

14. Semen comprising the plurality of Bos taurus sperm cells according to claim 13.

15. Semen according to claim 14, wherein the semen is an inseminate.

16. Semen according to claim 15, wherein said inseminate is contained in a straw.

17. Semen comprising the plurality of sperm according to claim 9.

18. Semen according to claim 17, wherein the semen is an inseminate.

19. Semen according to claim 18, wherein said inseminate is contained in a straw.

20. Semen according to claim 19, wherein the inseminate is cryopreserved.

21. The F1 Bos taurus animal, or part thereof, according to claim 6, comprising a gene edited genome.

22. The F1 Bos taurus animal, or part thereof, according to claim 21, wherein said gene edited genome is the gene edited genome of Bos taurus inseminate comprising at least half of a haploid genome of Bos taurus HO840003150607238 germplasm.

\* \* \* \* \*

Disclaimer

10,982,187 B2 - Devan Charles Funk, DeForest, WI (US); Katrina Dattilo, WI (US). BOS TAURUS VARIETY 'HO840000315067238' AND METHODS OF USE THEREOF. Patent dated April 20, 2021. Disclaimer filed May 26, 2022, by the assignee, ABS Global, Inc.

I hereby disclaim the following complete claims 1-22 of said patent.

*(Official Gazette, October 25, 2022)*